United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 86

SEQ ID NO: 3079582 - RNA, 18 nt, Mycobacterium bovis subsp bovis AF2122/97
ugcggaucggcggaccgc

SEQ ID NO: 3079583 - RNA, 19 nt, Mycobacterium bovis subsp bovis AF2122/97
ugcggauguccuugcgguc

SEQ ID NO: 3079584 - RNA, 15 nt, Mycobacterium bovis subsp bovis AF2122/97
ugcggauuaagucgg

SEQ ID NO: 3079585 - RNA, 19 nt, Mycobacterium bovis subsp bovis AF2122/97
ugcggauuaagucggcggc

SEQ ID NO: 3079586 - RNA, 15 nt, Mycobacterium bovis subsp bovis AF2122/97
ugcggcaacagcgcc

SEQ ID NO: 3079587 - RNA, 18 nt, Mycobacterium bovis subsp bovis AF2122/97
ugcggcaacgaggucugc

SEQ ID NO: 3079588 - RNA, 13 nt, Mycobacterium bovis subsp bovis AF2122/97
ugcggcaacggcu

SEQ ID NO: 3079589 - RNA, 17 nt, Mycobacterium bovis subsp bovis AF2122/97
ugcggcaagcgcacgcu

SEQ ID NO: 3079590 - RNA, 17 nt, Mycobacterium bovis subsp bovis AF2122/97
ugcggcacccagucggc

SEQ ID NO: 3079591 - RNA, 14 nt, Mycobacterium bovis subsp bovis AF2122/97
ugcggcaccgcuga

SEQ ID NO: 3079592 - RNA, 15 nt, Mycobacterium bovis subsp bovis AF2122/97
ugcggcacgaucgcc

SEQ ID NO: 3079593 - RNA, 16 nt, Mycobacterium bovis subsp bovis AF2122/97
ugcggcacgaucgcca

SEQ ID NO: 3079594 - RNA, 17 nt, Mycobacterium bovis subsp bovis AF2122/97
ugcggcagauacucggc

SEQ ID NO: 3079595 - RNA, 16 nt, Mycobacterium bovis subsp bovis AF2122/97
ugcggcagcacccggg

SEQ ID NO: 3079596 - RNA, 14 nt, Mycobacterium bovis subsp bovis AF2122/97
ugcggcagcgcggc

SEQ ID NO: 3079597 - RNA, 15 nt, Mycobacterium bovis subsp bovis AF2122/97
ugcggcagcgcggcc

SEQ ID NO: 3079598 - RNA, 16 nt, Mycobacterium bovis subsp bovis AF2122/97
ugcggcagcgguggcu

SEQ ID NO: 3079599 - RNA, 15 nt, Mycobacterium bovis subsp bovis AF2122/97
ugcggcaggugcggu

SEQ ID NO: 3079600 - RNA, 21 nt, Mycobacterium bovis subsp bovis AF2122/97
ugcggcaguaccccucgcaca

SEQ ID NO: 3079601 - RNA, 15 nt, Mycobacterium bovis subsp bovis AF2122/97
ugcggcagugccaug

SEQ ID NO: 3079602 - RNA, 13 nt, Mycobacterium bovis subsp bovis AF2122/97
ugcggcauggcag

SEQ ID NO: 3079603 - RNA, 14 nt, Mycobacterium bovis subsp bovis AF2122/97
ugcggcauggcagg

SEQ ID NO: 3079604 - RNA, 15 nt, Mycobacterium bovis subsp bovis AF2122/97
ugcggcauggcaggc

SEQ ID NO: 3079605 - RNA, 19 nt, Mycobacterium bovis subsp bovis AF2122/97
ugcggcauugguaccggcu

SEQ ID NO: 3079606 - RNA, 20 nt, Mycobacterium bovis subsp bovis AF2122/97
ugcggccaaugacgucggac

SEQ ID NO: 3079607 - RNA, 15 nt, Mycobacterium bovis subsp bovis AF2122/97
ugcggccacgguggc

SEQ ID NO: 3079608 - RNA, 15 nt, Mycobacterium bovis subsp bovis AF2122/97
ugcggccagcgcggc

SEQ ID NO: 3079609 - RNA, 23 nt, Mycobacterium bovis subsp bovis AF2122/97
ugcggccaugaaaaucggcaaga

SEQ ID NO: 3079610 - RNA, 17 nt, Mycobacterium bovis subsp bovis AF2122/97
ugcggcccaaccggucg

SEQ ID NO: 3079611 - RNA, 12 nt, Mycobacterium bovis subsp bovis AF2122/97
ugcggcccacac

SEQ ID NO: 3079612 - RNA, 15 nt, Mycobacterium bovis subsp bovis AF2122/97
ugcggcccacaccag

SEQ ID NO: 3079613 - RNA, 21 nt, Mycobacterium bovis subsp bovis AF2122/97
ugcggcccacaccagcgcagc

SEQ ID NO: 3079614 - RNA, 20 nt, Mycobacterium bovis subsp bovis AF2122/97
ugcggcccaugaucucggcg

SEQ ID NO: 3079615 - RNA, 22 nt, Mycobacterium bovis subsp bovis AF2122/97
ugcggcccaugaucucggcgaa

SEQ ID NO: 3079616 - RNA, 18 nt, Mycobacterium bovis subsp bovis AF2122/97
ugcggccccaugcgccag

SEQ ID NO: 3079617 - RNA, 18 nt, Mycobacterium bovis subsp bovis AF2122/97
ugcggccccgucgccgau

SEQ ID NO: 3079618 - RNA, 21 nt, Mycobacterium bovis subsp bovis AF2122/97
ugcggcccucgagcagugccg

SEQ ID NO: 3079619 - RNA, 13 nt, Mycobacterium bovis subsp bovis AF2122/97
ugcggccgacggg

SEQ ID NO: 3079620 - RNA, 18 nt, Mycobacterium bovis subsp bovis AF2122/97
ugcggccgacgggugcgc

SEQ ID NO: 3079621 - RNA, 14 nt, Mycobacterium bovis subsp bovis AF2122/97
ugcggccgccggga

SEQ ID NO: 3079622 - RNA, 21 nt, Mycobacterium bovis subsp bovis AF2122/97
ugcggccgcgugccgcccgcc

SEQ ID NO: 3079623 - RNA, 21 nt, Mycobacterium bovis subsp bovis AF2122/97
ugcggccgcugaucaacagac

SEQ ID NO: 3079624 - RNA, 21 nt, Mycobacterium bovis subsp bovis AF2122/97
ugcggccgggucgcgcuggcg

SEQ ID NO: 3079625 - RNA, 17 nt, Mycobacterium bovis subsp bovis AF2122/97
ugcggucaucggcgcca

SEQ ID NO: 3079626 - RNA, 15 nt, Mycobacterium bovis subsp bovis AF2122/97
ugcgguccgcugcca

SEQ ID NO: 3079627 - RNA, 16 nt, Mycobacterium bovis subsp bovis AF2122/97
ugcggucgagagccaa

SEQ ID NO: 3079628 - RNA, 15 nt, Mycobacterium bovis subsp bovis AF2122/97
ugcggucgcccaggc

SEQ ID NO: 3079629 - RNA, 22 nt, Mycobacterium bovis subsp bovis AF2122/97
ugcggucuccgcccgcgggccc

SEQ ID NO: 3079630 - RNA, 21 nt, Mycobacterium bovis subsp bovis AF2122/97
ugcggugaccgugaacggcuc

SEQ ID NO: 3079631 - RNA, 14 nt, Mycobacterium bovis subsp bovis AF2122/97
ugcggugaguccgc

SEQ ID NO: 3079632 - RNA, 18 nt, Mycobacterium bovis subsp bovis AF2122/97
ugcggugauauccgugaa

SEQ ID NO: 3079633 - RNA, 19 nt, Mycobacterium bovis subsp bovis AF2122/97
ugcggugaucgaacugggg

SEQ ID NO: 3079634 - RNA, 17 nt, Mycobacterium bovis subsp bovis AF2122/97
ugcggugcaucgccacc

SEQ ID NO: 3079635 - RNA, 18 nt, Mycobacterium bovis subsp bovis AF2122/97
ugcggugcaucgccacca

SEQ ID NO: 3079636 - RNA, 20 nt, Mycobacterium bovis subsp bovis AF2122/97
ugcggugcaucgccaccacc

SEQ ID NO: 3079637 - RNA, 12 nt, Mycobacterium bovis subsp bovis AF2122/97
ugcggugccacg

SEQ ID NO: 3079638 - RNA, 14 nt, Mycobacterium bovis subsp bovis AF2122/97
ugcggugccggccc

SEQ ID NO: 3079639 - RNA, 23 nt, Mycobacterium bovis subsp bovis AF2122/97
ugcggugcuaugcaacaccgcac

SEQ ID NO: 3079640 - RNA, 12 nt, Mycobacterium bovis subsp bovis AF2122/97
ugcgguggcagg

SEQ ID NO: 3079641 - RNA, 22 nt, Mycobacterium bovis subsp bovis AF2122/97
ugcgguggcaggugaucccgau

SEQ ID NO: 3079642 - RNA, 19 nt, Mycobacterium bovis subsp bovis AF2122/97
ugcgguggccagugcgacg

SEQ ID NO: 3079643 - RNA, 20 nt, Mycobacterium bovis subsp bovis AF2122/97
ugcgguggcgcgcagcgcga

SEQ ID NO: 3079644 - RNA, 20 nt, Mycobacterium bovis subsp bovis AF2122/97
ugcgguggcuuuugcgucug

SEQ ID NO: 3079645 - RNA, 23 nt, Mycobacterium bovis subsp bovis AF2122/97
ugcgguggcuuuugcgucugcuc

SEQ ID NO: 3079646 - RNA, 15 nt, Mycobacterium bovis subsp bovis AF2122/97
ugcggugggccaggu

SEQ ID NO: 3079647 - RNA, 14 nt, Mycobacterium bovis subsp bovis AF2122/97
ugcggugggugaag

SEQ ID NO: 3079648 - RNA, 19 nt, Mycobacterium bovis subsp bovis AF2122/97
ugcggugguaggacgccag

SEQ ID NO: 3079649 - RNA, 22 nt, Mycobacterium bovis subsp bovis AF2122/97
ugcggugguaggacgccagcaa

SEQ ID NO: 3079650 - RNA, 14 nt, Mycobacterium bovis subsp bovis AF2122/97
ugcgguuagcagcc

SEQ ID NO: 3079651 - RNA, 15 nt, Mycobacterium bovis subsp bovis AF2122/97
ugcgguuagcagccg

SEQ ID NO: 3079652 - RNA, 16 nt, Mycobacterium bovis subsp bovis AF2122/97
ugcgguuccgauagcc

SEQ ID NO: 3079653 - RNA, 16 nt, Mycobacterium bovis subsp bovis AF2122/97
ugcgguucgcugcggc

SEQ ID NO: 3079654 - RNA, 21 nt, Mycobacterium bovis subsp bovis AF2122/97
ugcgguugcauccauccugcc

SEQ ID NO: 3079655 - RNA, 23 nt, Mycobacterium bovis subsp bovis AF2122/97
ugcgguuguucgugaagcgggug

SEQ ID NO: 3079656 - RNA, 20 nt, Mycobacterium bovis subsp bovis AF2122/97
ugcguaaggcugugccggcc

SEQ ID NO: 3079657 - RNA, 16 nt, Mycobacterium bovis subsp bovis AF2122/97
ugcguagcaggucgac

SEQ ID NO: 3079658 - RNA, 19 nt, Mycobacterium bovis subsp bovis AF2122/97
ugcguagccgugggccacg

SEQ ID NO: 3079659 - RNA, 20 nt, Mycobacterium bovis subsp bovis AF2122/97
ugcguagccgugggccacga

SEQ ID NO: 3079660 - RNA, 13 nt, Mycobacterium bovis subsp bovis AF2122/97
ugcguaugcccac

SEQ ID NO: 3079661 - RNA, 19 nt, Mycobacterium bovis subsp bovis AF2122/97
ugcgucaaguccgagucgg

SEQ ID NO: 3079662 - RNA, 19 nt, Mycobacterium bovis subsp bovis AF2122/97
ugcgucagccgacaagguc

SEQ ID NO: 3079663 - RNA, 22 nt, Mycobacterium bovis subsp bovis AF2122/97
ugcgucaucgcgggugaucucc

SEQ ID NO: 3079664 - RNA, 11 nt, Mycobacterium bovis subsp bovis AF2122/97
ugcguccagau

SEQ ID NO: 3079665 - RNA, 21 nt, Mycobacterium bovis subsp bovis AF2122/97
ugcguccagcaaaugcggcgc

SEQ ID NO: 3079666 - RNA, 16 nt, Mycobacterium bovis subsp bovis AF2122/97
ugcguccaggccaggg

SEQ ID NO: 3079667 - RNA, 15 nt, Mycobacterium bovis subsp bovis AF2122/97
ugcguccggugcugg

SEQ ID NO: 3079668 - RNA, 22 nt, Mycobacterium bovis subsp bovis AF2122/97
ugcguccguagcgauucugggc

SEQ ID NO: 3079669 - RNA, 15 nt, Mycobacterium bovis subsp bovis AF2122/97
ugcguccugguggcg

SEQ ID NO: 3079670 - RNA, 16 nt, Mycobacterium bovis subsp bovis AF2122/97
ugcgucgauugccgcg

SEQ ID NO: 3079671 - RNA, 19 nt, Mycobacterium bovis subsp bovis AF2122/97
ugcgucgcggaaguaccgu

SEQ ID NO: 3079672 - RNA, 19 nt, Mycobacterium bovis subsp bovis AF2122/97
ugcgucgcggacggugcgg

SEQ ID NO: 3079673 - RNA, 14 nt, Mycobacterium bovis subsp bovis AF2122/97
ugcgucggcccggu

SEQ ID NO: 3079674 - RNA, 20 nt, Mycobacterium bovis subsp bovis AF2122/97
ugcgucguucggagcccuga

SEQ ID NO: 3079675 - RNA, 12 nt, Mycobacterium bovis subsp bovis AF2122/97
ugcgucucggug

SEQ ID NO: 3079676 - RNA, 13 nt, Mycobacterium bovis subsp bovis AF2122/97
ugcgucugcucgc

SEQ ID NO: 3079677 - RNA, 15 nt, Mycobacterium bovis subsp bovis AF2122/97
ugcgucugcucggcg

SEQ ID NO: 3079678 - RNA, 17 nt, Mycobacterium bovis subsp bovis AF2122/97
ugcgucugcucggcgca

SEQ ID NO: 3079679 - RNA, 20 nt, Mycobacterium bovis subsp bovis AF2122/97
ugcgucugcucggcgcggug

SEQ ID NO: 3079680 - RNA, 15 nt, Mycobacterium bovis subsp bovis AF2122/97
ugcgugaacaagauu

SEQ ID NO: 3079681 - RNA, 16 nt, Mycobacterium bovis subsp bovis AF2122/97
ugcgugaugguugcuc

SEQ ID NO: 3079682 - RNA, 21 nt, Mycobacterium bovis subsp bovis AF2122/97
ugcgugccuugaucugagcgc

SEQ ID NO: 3079683 - RNA, 15 nt, Mycobacterium bovis subsp bovis AF2122/97
ugcgugcgcgucggu

SEQ ID NO: 3079684 - RNA, 13 nt, Mycobacterium bovis subsp bovis AF2122/97
ugcgugcgggggc

SEQ ID NO: 3079685 - RNA, 17 nt, Mycobacterium bovis subsp bovis AF2122/97
ugcgugcggucgauccg

SEQ ID NO: 3079686 - RNA, 16 nt, Mycobacterium bovis subsp bovis AF2122/97
ugcguggaauggcgcc

SEQ ID NO: 3079687 - RNA, 21 nt, Mycobacterium bovis subsp bovis AF2122/97
ugcguggaauggcgccggccg

SEQ ID NO: 3079688 - RNA, 14 nt, Mycobacterium bovis subsp bovis AF2122/97
ugcgugggcgcggc

SEQ ID NO: 3079689 - RNA, 17 nt, Mycobacterium bovis subsp bovis AF2122/97
ugcguuacgccgcgaga

SEQ ID NO: 3079690 - RNA, 16 nt, Mycobacterium bovis subsp bovis AF2122/97
ugcguucaucauccac

SEQ ID NO: 3079691 - RNA, 20 nt, Mycobacterium bovis subsp bovis AF2122/97
ugcguucaucauccacaccg

SEQ ID NO: 3079692 - RNA, 23 nt, Mycobacterium bovis subsp bovis AF2122/97
ugcguuccaguccccgccggccu

SEQ ID NO: 3079693 - RNA, 13 nt, Mycobacterium bovis subsp bovis AF2122/97
ugcguuccaucgc

SEQ ID NO: 3079694 - RNA, 15 nt, Mycobacterium bovis subsp bovis AF2122/97
ugcguuggaugaagu

SEQ ID NO: 3079695 - RNA, 12 nt, Mycobacterium bovis subsp bovis AF2122/97
ugcguuggcgcc

SEQ ID NO: 3079696 - RNA, 22 nt, Mycobacterium bovis subsp bovis AF2122/97
ugcguuggcgccaccagucacg

SEQ ID NO: 3079697 - RNA, 17 nt, Mycobacterium bovis subsp bovis AF2122/97
ugcguugggaucccagc

SEQ ID NO: 3079698 - RNA, 22 nt, Mycobacterium bovis subsp bovis AF2122/97
ugcguugucggcuggacggcgc

SEQ ID NO: 3079699 - RNA, 17 nt, Mycobacterium bovis subsp bovis AF2122/97
ugcguuugcacuguucg

SEQ ID NO: 3079700 - RNA, 16 nt, Mycobacterium bovis subsp bovis AF2122/97
ugcuagcagcagcccg

SEQ ID NO: 3079701 - RNA, 14 nt, Mycobacterium bovis subsp bovis AF2122/97
ugcuagcgccgcca

SEQ ID NO: 3079702 - RNA, 19 nt, Mycobacterium bovis subsp bovis AF2122/97
ugcuagcuuggcggccagc

SEQ ID NO: 3079703 - RNA, 17 nt, Mycobacterium bovis subsp bovis AF2122/97
ugcuaggaccaccagcg

SEQ ID NO: 3079704 - RNA, 17 nt, Mycobacterium bovis subsp bovis AF2122/97
ugcuaggcaugccacac

SEQ ID NO: 3079705 - RNA, 18 nt, Mycobacterium bovis subsp bovis AF2122/97
ugcuauucgccagcgccg

SEQ ID NO: 3079706 - RNA, 22 nt, Mycobacterium bovis subsp bovis AF2122/97
ugcucaacggcgacaucggccc

SEQ ID NO: 3079707 - RNA, 18 nt, Mycobacterium bovis subsp bovis AF2122/97
ugcucacauccggucaga

SEQ ID NO: 3079708 - RNA, 16 nt, Mycobacterium bovis subsp bovis AF2122/97
ugcucacccgucguca

SEQ ID NO: 3079709 - RNA, 13 nt, Mycobacterium bovis subsp bovis AF2122/97
ugcucaccggcgc

SEQ ID NO: 3079710 - RNA, 14 nt, Mycobacterium bovis subsp bovis AF2122/97
ugcucacggcggcg

SEQ ID NO: 3079711 - RNA, 14 nt, Mycobacterium bovis subsp bovis AF2122/97
ugcucagcacgccg

SEQ ID NO: 3079712 - RNA, 18 nt, Mycobacterium bovis subsp bovis AF2122/97
ugcugagcgccaggccgc

SEQ ID NO: 3079713 - RNA, 17 nt, Mycobacterium bovis subsp bovis AF2122/97
ugcugagcguaggccag

SEQ ID NO: 3079714 - RNA, 20 nt, Mycobacterium bovis subsp bovis AF2122/97
ugcugagcguaggccagcga

SEQ ID NO: 3079715 - RNA, 21 nt, Mycobacterium bovis subsp bovis AF2122/97
ugcugagcugcucgccggcca

SEQ ID NO: 3079716 - RNA, 15 nt, Mycobacterium bovis subsp bovis AF2122/97
ugcugagucgguuca

SEQ ID NO: 3079717 - RNA, 15 nt, Mycobacterium bovis subsp bovis AF2122/97
ugcugaugcccuugc

SEQ ID NO: 3079718 - RNA, 16 nt, Mycobacterium bovis subsp bovis AF2122/97
ugcugaugggucaggc

SEQ ID NO: 3079719 - RNA, 13 nt, Mycobacterium bovis subsp bovis AF2122/97
ugcugcaaccgac

SEQ ID NO: 3079720 - RNA, 18 nt, Mycobacterium bovis subsp bovis AF2122/97
ugcugcaaccgacuucga

SEQ ID NO: 3079721 - RNA, 12 nt, Mycobacterium bovis subsp bovis AF2122/97
ugcugcaaggaa

SEQ ID NO: 3079722 - RNA, 15 nt, Mycobacterium bovis subsp bovis AF2122/97
ugcugcaccuggcgc

SEQ ID NO: 3079723 - RNA, 13 nt, Mycobacterium bovis subsp bovis AF2122/97
ugcugcacgcucu

SEQ ID NO: 3079724 - RNA, 19 nt, Mycobacterium bovis subsp bovis AF2122/97
ugcugcacgcucugcgcca

SEQ ID NO: 3079725 - RNA, 21 nt, Mycobacterium bovis subsp bovis AF2122/97
ugcugcagacccguucgccgu

SEQ ID NO: 3079726 - RNA, 17 nt, Mycobacterium bovis subsp bovis AF2122/97
ugcugcagcaauugcac

SEQ ID NO: 3079727 - RNA, 20 nt, Mycobacterium bovis subsp bovis AF2122/97
ugcugcagcgaugcggcguu

SEQ ID NO: 3079728 - RNA, 17 nt, Mycobacterium bovis subsp bovis AF2122/97
ugcugcagggccuggcc

SEQ ID NO: 3079729 - RNA, 13 nt, Mycobacterium bovis subsp bovis AF2122/97
ugcugcaugccga

SEQ ID NO: 3079730 - RNA, 16 nt, Mycobacterium bovis subsp bovis AF2122/97
ugcugcaugccgaccc

SEQ ID NO: 3079731 - RNA, 15 nt, Mycobacterium bovis subsp bovis AF2122/97
ugcugccauugccgc

SEQ ID NO: 3079732 - RNA, 16 nt, Mycobacterium bovis subsp bovis AF2122/97
ugcugccauugccgca

SEQ ID NO: 3079733 - RNA, 14 nt, Mycobacterium bovis subsp bovis AF2122/97
ugcugcccaucccg

SEQ ID NO: 3079734 - RNA, 15 nt, Mycobacterium bovis subsp bovis AF2122/97
ugcugcccaucccgg

SEQ ID NO: 3079735 - RNA, 14 nt, Mycobacterium bovis subsp bovis AF2122/97
ugcugcccgaguuc

SEQ ID NO: 3079736 - RNA, 17 nt, Mycobacterium bovis subsp bovis AF2122/97
ugcugcccggcaaccug

SEQ ID NO: 3079737 - RNA, 20 nt, Mycobacterium bovis subsp bovis AF2122/97
ugcugcccugguuggugacg

SEQ ID NO: 3079738 - RNA, 17 nt, Mycobacterium bovis subsp bovis AF2122/97
ugcugccgaccuuccgu

SEQ ID NO: 3079739 - RNA, 18 nt, Mycobacterium bovis subsp bovis AF2122/97
ugcugccgauagcgcggc

SEQ ID NO: 3079740 - RNA, 21 nt, Mycobacterium bovis subsp bovis AF2122/97
ugcugccgauagcgcggcacc

SEQ ID NO: 3079741 - RNA, 23 nt, Mycobacterium bovis subsp bovis AF2122/97
ugcugccgauguguggaacaucc

SEQ ID NO: 3079742 - RNA, 15 nt, Mycobacterium bovis subsp bovis AF2122/97
ugcugccgcacacgc

SEQ ID NO: 3079743 - RNA, 20 nt, Mycobacterium bovis subsp bovis AF2122/97
ugcugccgcacacgcgugca

SEQ ID NO: 3079744 - RNA, 14 nt, Mycobacterium bovis subsp bovis AF2122/97
ugcugccgccgccg

SEQ ID NO: 3079745 - RNA, 15 nt, Mycobacterium bovis subsp bovis AF2122/97
ugcugccgccgccgc

SEQ ID NO: 3079746 - RNA, 20 nt, Mycobacterium bovis subsp bovis AF2122/97
ugcugccgccgccgccggcg

SEQ ID NO: 3079747 - RNA, 15 nt, Mycobacterium bovis subsp bovis AF2122/97
ugcugccgcugcgaa

SEQ ID NO: 3079748 - RNA, 21 nt, Mycobacterium bovis subsp bovis AF2122/97
ugcugccggagacacccgcca

SEQ ID NO: 3079749 - RNA, 20 nt, Mycobacterium bovis subsp bovis AF2122/97
ugcugccgggggcccgaccu

SEQ ID NO: 3079750 - RNA, 22 nt, Mycobacterium bovis subsp bovis AF2122/97
ugcugccguauccaggcgugca

SEQ ID NO: 3079751 - RNA, 16 nt, Mycobacterium bovis subsp bovis AF2122/97
ugcugccguggcggca

SEQ ID NO: 3079752 - RNA, 18 nt, Mycobacterium bovis subsp bovis AF2122/97
ugcugccguugggcaccg

SEQ ID NO: 3079753 - RNA, 21 nt, Mycobacterium bovis subsp bovis AF2122/97
ugcugccuugggaccgcgcca

SEQ ID NO: 3079754 - RNA, 13 nt, Mycobacterium bovis subsp bovis AF2122/97
ugcugccuuugcg

SEQ ID NO: 3079755 - RNA, 18 nt, Mycobacterium bovis subsp bovis AF2122/97
ugcugcgcaccaaggccg

SEQ ID NO: 3079756 - RNA, 20 nt, Mycobacterium bovis subsp bovis AF2122/97
ugcugcgcaccaaggccgug

SEQ ID NO: 3079757 - RNA, 14 nt, Mycobacterium bovis subsp bovis AF2122/97
ugcugcgcgcggcg

SEQ ID NO: 3079758 - RNA, 18 nt, Mycobacterium bovis subsp bovis AF2122/97
ugcugcgcgcggcggccg

SEQ ID NO: 3079759 - RNA, 12 nt, Mycobacterium bovis subsp bovis AF2122/97
ugcugcgcggug

SEQ ID NO: 3079760 - RNA, 20 nt, Mycobacterium bovis subsp bovis AF2122/97
ugcugcgcggugccggccgu

SEQ ID NO: 3079761 - RNA, 12 nt, Mycobacterium bovis subsp bovis AF2122/97
ugcugcgcguug

SEQ ID NO: 3079762 - RNA, 19 nt, Mycobacterium bovis subsp bovis AF2122/97
ugcugcgcguugcugcagc

SEQ ID NO: 3079763 - RNA, 13 nt, Mycobacterium bovis subsp bovis AF2122/97
ugcugcgcguuug

SEQ ID NO: 3079764 - RNA, 14 nt, Mycobacterium bovis subsp bovis AF2122/97
ugcugcgcugucuu

SEQ ID NO: 3079765 - RNA, 17 nt, Mycobacterium bovis subsp bovis AF2122/97
ugcugcgggaauccggu

SEQ ID NO: 3079766 - RNA, 20 nt, Mycobacterium bovis subsp bovis AF2122/97
ugcugcuccuucucgcggac

SEQ ID NO: 3079767 - RNA, 14 nt, Mycobacterium bovis subsp bovis AF2122/97
ugcugcucgugagc

SEQ ID NO: 3079768 - RNA, 19 nt, Mycobacterium bovis subsp bovis AF2122/97
ugcugcugcagcgaugcgg

SEQ ID NO: 3079769 - RNA, 15 nt, Mycobacterium bovis subsp bovis AF2122/97
ugcugcugccguggc

SEQ ID NO: 3079770 - RNA, 14 nt, Mycobacterium bovis subsp bovis AF2122/97
ugcuggaacagguu

SEQ ID NO: 3079771 - RNA, 21 nt, Mycobacterium bovis subsp bovis AF2122/97
ugcuggaaguugugcgcacuc

SEQ ID NO: 3079772 - RNA, 14 nt, Mycobacterium bovis subsp bovis AF2122/97
ugcuggaucucggu

SEQ ID NO: 3079773 - RNA, 19 nt, Mycobacterium bovis subsp bovis AF2122/97
ugcuggcaaaguaucgcag

SEQ ID NO: 3079774 - RNA, 14 nt, Mycobacterium bovis subsp bovis AF2122/97
ugcuggcaccagca

SEQ ID NO: 3079775 - RNA, 14 nt, Mycobacterium bovis subsp bovis AF2122/97
ugcuggcagcggcc

SEQ ID NO: 3079776 - RNA, 23 nt, Mycobacterium bovis subsp bovis AF2122/97
ugcuggcagcggccuccgggcca

SEQ ID NO: 3079777 - RNA, 13 nt, Mycobacterium bovis subsp bovis AF2122/97
ugcuggccgcgau

SEQ ID NO: 3079778 - RNA, 12 nt, Mycobacterium bovis subsp bovis AF2122/97
ugcuggccgcgg

SEQ ID NO: 3079779 - RNA, 15 nt, Mycobacterium bovis subsp bovis AF2122/97
ugcuggccgcggcug

SEQ ID NO: 3079780 - RNA, 21 nt, Mycobacterium bovis subsp bovis AF2122/97
ugcuggcgaacucgaggucga

SEQ ID NO: 3079781 - RNA, 14 nt, Mycobacterium bovis subsp bovis AF2122/97
ugcuggcggccucg

SEQ ID NO: 3079782 - RNA, 13 nt, Mycobacterium bovis subsp bovis AF2122/97
ugcuggcggcgcg

SEQ ID NO: 3079783 - RNA, 18 nt, Mycobacterium bovis subsp bovis AF2122/97
ugcugggcccgccagccc

SEQ ID NO: 3079784 - RNA, 15 nt, Mycobacterium bovis subsp bovis AF2122/97
ugcuggggguaccuc

SEQ ID NO: 3079785 - RNA, 17 nt, Mycobacterium bovis subsp bovis AF2122/97
ugcuggggguaccuccc

SEQ ID NO: 3079786 - RNA, 12 nt, Mycobacterium bovis subsp bovis AF2122/97
ugcugggugccg

SEQ ID NO: 3079787 - RNA, 17 nt, Mycobacterium bovis subsp bovis AF2122/97
ugcugguauagccggcg

SEQ ID NO: 3079788 - RNA, 13 nt, Mycobacterium bovis subsp bovis AF2122/97
ugcugguccagcc

SEQ ID NO: 3079789 - RNA, 14 nt, Mycobacterium bovis subsp bovis AF2122/97
ugcugguccagccg

SEQ ID NO: 3079790 - RNA, 16 nt, Mycobacterium bovis subsp bovis AF2122/97
ugcuggucgccgucga

SEQ ID NO: 3079791 - RNA, 14 nt, Mycobacterium bovis subsp bovis AF2122/97
ugcugguggcggca

SEQ ID NO: 3079792 - RNA, 17 nt, Mycobacterium bovis subsp bovis AF2122/97
ugcuggugucggcucga

SEQ ID NO: 3079793 - RNA, 15 nt, Mycobacterium bovis subsp bovis AF2122/97
ugcugucgacgucgg

SEQ ID NO: 3079794 - RNA, 18 nt, Mycobacterium bovis subsp bovis AF2122/97
ugcugucgauuucgccgu

SEQ ID NO: 3079795 - RNA, 14 nt, Mycobacterium bovis subsp bovis AF2122/97
ugcugucggugccg

SEQ ID NO: 3079796 - RNA, 17 nt, Mycobacterium bovis subsp bovis AF2122/97
ugcugucguagcgcgag

SEQ ID NO: 3079797 - RNA, 23 nt, Mycobacterium bovis subsp bovis AF2122/97
ugcuguugccagucgaucgcggc

SEQ ID NO: 3079798 - RNA, 23 nt, Mycobacterium bovis subsp bovis AF2122/97
ugcuguugguauuagggccggcg

SEQ ID NO: 3079799 - RNA, 24 nt, Mycobacterium bovis subsp bovis AF2122/97
uggagcgccagccgcugccacagg

SEQ ID NO: 3079800 - RNA, 21 nt, Mycobacterium bovis subsp bovis AF2122/97
uggagcuaugucauagcgcac

SEQ ID NO: 3079801 - RNA, 21 nt, Mycobacterium bovis subsp bovis AF2122/97
uggagcucaucgacgagccgc

SEQ ID NO: 3079802 - RNA, 21 nt, Mycobacterium bovis subsp bovis AF2122/97
uggaggaaucguucggggugg

SEQ ID NO: 3079803 - RNA, 19 nt, Mycobacterium bovis subsp bovis AF2122/97
uggaggccaccaccuucgg

SEQ ID NO: 3079804 - RNA, 14 nt, Mycobacterium bovis subsp bovis AF2122/97
uggaggcgaucugc

SEQ ID NO: 3079805 - RNA, 19 nt, Mycobacterium bovis subsp bovis AF2122/97
uggagguaauccggcugcc

SEQ ID NO: 3079806 - RNA, 17 nt, Mycobacterium bovis subsp bovis AF2122/97
uggaggucaaaucaacg

SEQ ID NO: 3079807 - RNA, 16 nt, Mycobacterium bovis subsp bovis AF2122/97
uggaguauccggcaga

SEQ ID NO: 3079808 - RNA, 17 nt, Mycobacterium bovis subsp bovis AF2122/97
uggaguauccggcagac

SEQ ID NO: 3079809 - RNA, 21 nt, Mycobacterium bovis subsp bovis AF2122/97
uggaguauccggcagaccggu

SEQ ID NO: 3079810 - RNA, 16 nt, Mycobacterium bovis subsp bovis AF2122/97
uggagugaggcugugc

SEQ ID NO: 3079811 - RNA, 22 nt, Mycobacterium bovis subsp bovis AF2122/97
uggagugaggcugugccccagg

SEQ ID NO: 3079812 - RNA, 20 nt, Mycobacterium bovis subsp bovis AF2122/97
uggaguggugauccagccgu

SEQ ID NO: 3079813 - RNA, 13 nt, Mycobacterium bovis subsp bovis AF2122/97
uggaguuggcugc

SEQ ID NO: 3079814 - RNA, 22 nt, Mycobacterium bovis subsp bovis AF2122/97
uggauaauccaugacacugggg

SEQ ID NO: 3079815 - RNA, 16 nt, Mycobacterium bovis subsp bovis AF2122/97
uggaucacgucgaugu

SEQ ID NO: 3079816 - RNA, 15 nt, Mycobacterium bovis subsp bovis AF2122/97
uggauccggccacca

SEQ ID NO: 3079817 - RNA, 16 nt, Mycobacterium bovis subsp bovis AF2122/97
uggaucgccaccggcg

SEQ ID NO: 3079818 - RNA, 18 nt, Mycobacterium bovis subsp bovis AF2122/97
uggaucggcagcccggug

SEQ ID NO: 3079819 - RNA, 19 nt, Mycobacterium bovis subsp bovis AF2122/97
uggaucgucgggagcacac

SEQ ID NO: 3079820 - RNA, 19 nt, Mycobacterium bovis subsp bovis AF2122/97
uggaucgucucgcgcaccu

SEQ ID NO: 3079821 - RNA, 21 nt, Mycobacterium bovis subsp bovis AF2122/97
uggaucgugccgaacacggug

SEQ ID NO: 3079822 - RNA, 15 nt, Mycobacterium bovis subsp bovis AF2122/97
uggaucuuggccagc

SEQ ID NO: 3079823 - RNA, 19 nt, Mycobacterium bovis subsp bovis AF2122/97
uggaucuuggccagcagcg

SEQ ID NO: 3079824 - RNA, 21 nt, Mycobacterium bovis subsp bovis AF2122/97
uggaugaccgaaccuggucuu

SEQ ID NO: 3079825 - RNA, 20 nt, Mycobacterium bovis subsp bovis AF2122/97
uggaugcccguagacgccga

SEQ ID NO: 3079826 - RNA, 22 nt, Mycobacterium bovis subsp bovis AF2122/97
uggaugcccguagacgccgagc

SEQ ID NO: 3079827 - RNA, 15 nt, Mycobacterium bovis subsp bovis AF2122/97
uggaugcgccgcacg

SEQ ID NO: 3079828 - RNA, 19 nt, Mycobacterium bovis subsp bovis AF2122/97
uggaugcgccgcacggcga

SEQ ID NO: 3079829 - RNA, 16 nt, Mycobacterium bovis subsp bovis AF2122/97
uggauggccgccaggc

SEQ ID NO: 3079830 - RNA, 13 nt, Mycobacterium bovis subsp bovis AF2122/97
uggauggcgcccu

SEQ ID NO: 3079831 - RNA, 13 nt, Mycobacterium bovis subsp bovis AF2122/97
uggaugggcucga

SEQ ID NO: 3079832 - RNA, 15 nt, Mycobacterium bovis subsp bovis AF2122/97
uggaugggcucgacg

SEQ ID NO: 3079833 - RNA, 20 nt, Mycobacterium bovis subsp bovis AF2122/97
uggauguaggcuucgccgag

SEQ ID NO: 3079834 - RNA, 22 nt, Mycobacterium bovis subsp bovis AF2122/97
uggauguaguuggcgaccugcg

SEQ ID NO: 3079835 - RNA, 17 nt, Mycobacterium bovis subsp bovis AF2122/97
uggaugugggcgcucgc

SEQ ID NO: 3079836 - RNA, 14 nt, Mycobacterium bovis subsp bovis AF2122/97
uggauguguaggug

SEQ ID NO: 3079837 - RNA, 15 nt, Mycobacterium bovis subsp bovis AF2122/97
uggauucgaucaggc

SEQ ID NO: 3079838 - RNA, 19 nt, Mycobacterium bovis subsp bovis AF2122/97
uggauuggcgucagcagca

SEQ ID NO: 3079839 - RNA, 19 nt, Mycobacterium bovis subsp bovis AF2122/97
uggcaaagacgcuggccac

SEQ ID NO: 3079840 - RNA, 19 nt, Mycobacterium bovis subsp bovis AF2122/97
uggcaacggaggugccggc

SEQ ID NO: 3079841 - RNA, 21 nt, Mycobacterium bovis subsp bovis AF2122/97
uggcaagcacggcgucgaugu

SEQ ID NO: 3079842 - RNA, 14 nt, Mycobacterium bovis subsp bovis AF2122/97
uggcaagcggccgc

SEQ ID NO: 3079843 - RNA, 22 nt, Mycobacterium bovis subsp bovis AF2122/97
uggcaagcugccccgccaccuc

SEQ ID NO: 3079844 - RNA, 17 nt, Mycobacterium bovis subsp bovis AF2122/97
uggcaagucaacaccgc

SEQ ID NO: 3079845 - RNA, 21 nt, Mycobacterium bovis subsp bovis AF2122/97
uggcaaucgaggaaggugugc

SEQ ID NO: 3079846 - RNA, 20 nt, Mycobacterium bovis subsp bovis AF2122/97
uggcaaugaccccggcguug

SEQ ID NO: 3079847 - RNA, 22 nt, Mycobacterium bovis subsp bovis AF2122/97
uggcacacagguccugcgccgc

SEQ ID NO: 3079848 - RNA, 17 nt, Mycobacterium bovis subsp bovis AF2122/97
uggcacaguccgcgaag

SEQ ID NO: 3079849 - RNA, 13 nt, Mycobacterium bovis subsp bovis AF2122/97
uggcaccagccgg

SEQ ID NO: 3079850 - RNA, 14 nt, Mycobacterium bovis subsp bovis AF2122/97
uggcaccagccggu

SEQ ID NO: 3079851 - RNA, 15 nt, Mycobacterium bovis subsp bovis AF2122/97
uggcaccagccggug

SEQ ID NO: 3079852 - RNA, 21 nt, Mycobacterium bovis subsp bovis AF2122/97
uggcacccgcgucgagugccg

SEQ ID NO: 3079853 - RNA, 16 nt, Mycobacterium bovis subsp bovis AF2122/97
uggcacccuccgccgg

SEQ ID NO: 3079854 - RNA, 16 nt, Mycobacterium bovis subsp bovis AF2122/97
uggcaccgacagcagu

SEQ ID NO: 3079855 - RNA, 14 nt, Mycobacterium bovis subsp bovis AF2122/97
uggcaccgccagcc

SEQ ID NO: 3079856 - RNA, 20 nt, Mycobacterium bovis subsp bovis AF2122/97
uggcaccgguuucgucgguc

SEQ ID NO: 3079857 - RNA, 14 nt, Mycobacterium bovis subsp bovis AF2122/97
uggcaccucccggg

SEQ ID NO: 3079858 - RNA, 23 nt, Mycobacterium bovis subsp bovis AF2122/97
uggcacgcaacaccgccaacucc

SEQ ID NO: 3079859 - RNA, 13 nt, Mycobacterium bovis subsp bovis AF2122/97
uggcacgcaugag

SEQ ID NO: 3079860 - RNA, 22 nt, Mycobacterium bovis subsp bovis AF2122/97
uggcacggccccugccacgacg

SEQ ID NO: 3079861 - RNA, 16 nt, Mycobacterium bovis subsp bovis AF2122/97
uggcacugacgcgccc

SEQ ID NO: 3079862 - RNA, 15 nt, Mycobacterium bovis subsp bovis AF2122/97
uggcagagccgccgu

SEQ ID NO: 3079863 - RNA, 17 nt, Mycobacterium bovis subsp bovis AF2122/97
uggcagagccgccguug

SEQ ID NO: 3079864 - RNA, 22 nt, Mycobacterium bovis subsp bovis AF2122/97
uggcagagccgccguugccgcc

SEQ ID NO: 3079865 - RNA, 21 nt, Mycobacterium bovis subsp bovis AF2122/97
uggcagccaaaaacgcugccg

SEQ ID NO: 3079866 - RNA, 22 nt, Mycobacterium bovis subsp bovis AF2122/97
uggcagcccguucgaaguucuc

SEQ ID NO: 3079867 - RNA, 13 nt, Mycobacterium bovis subsp bovis AF2122/97
uggcagccugcug

SEQ ID NO: 3079868 - RNA, 14 nt, Mycobacterium bovis subsp bovis AF2122/97
uggcagccugcugc

SEQ ID NO: 3079869 - RNA, 12 nt, Mycobacterium bovis subsp bovis AF2122/97
uggcagcgcacc

SEQ ID NO: 3079870 - RNA, 13 nt, Mycobacterium bovis subsp bovis AF2122/97
uggcagcgcaccc

SEQ ID NO: 3079871 - RNA, 19 nt, Mycobacterium bovis subsp bovis AF2122/97
uggcagcgccgauggccgc

SEQ ID NO: 3079872 - RNA, 13 nt, Mycobacterium bovis subsp bovis AF2122/97
uggcagcgcggcc

SEQ ID NO: 3079873 - RNA, 17 nt, Mycobacterium bovis subsp bovis AF2122/97
uggcagcgcggccgggc

SEQ ID NO: 3079874 - RNA, 13 nt, Mycobacterium bovis subsp bovis AF2122/97
uggcagcgcuggc

SEQ ID NO: 3079875 - RNA, 22 nt, Mycobacterium bovis subsp bovis AF2122/97
uggcagcggccuccgggccaug

SEQ ID NO: 3079876 - RNA, 11 nt, Mycobacterium bovis subsp bovis AF2122/97
uggcagcggcg

SEQ ID NO: 3079877 - RNA, 13 nt, Mycobacterium bovis subsp bovis AF2122/97
uggcagcggcggu

SEQ ID NO: 3079878 - RNA, 13 nt, Mycobacterium bovis subsp bovis AF2122/97
uggcagcggugua

SEQ ID NO: 3079879 - RNA, 15 nt, Mycobacterium bovis subsp bovis AF2122/97
uggcaggcagguugg

SEQ ID NO: 3079880 - RNA, 12 nt, Mycobacterium bovis subsp bovis AF2122/97
uggcaggccagc

SEQ ID NO: 3079881 - RNA, 15 nt, Mycobacterium bovis subsp bovis AF2122/97
uggcaggccagcaug

SEQ ID NO: 3079882 - RNA, 22 nt, Mycobacterium bovis subsp bovis AF2122/97
uggcagggccagcggcagccug

SEQ ID NO: 3079883 - RNA, 17 nt, Mycobacterium bovis subsp bovis AF2122/97
uggcaguccagccgggu

SEQ ID NO: 3079884 - RNA, 16 nt, Mycobacterium bovis subsp bovis AF2122/97
uggcagucgcacggug

SEQ ID NO: 3079885 - RNA, 15 nt, Mycobacterium bovis subsp bovis AF2122/97
uggcaguggcgcggc

SEQ ID NO: 3079886 - RNA, 18 nt, Mycobacterium bovis subsp bovis AF2122/97
uggccaugguggcgccga

SEQ ID NO: 3079887 - RNA, 16 nt, Mycobacterium bovis subsp bovis AF2122/97
uggccauguccaccag

SEQ ID NO: 3079888 - RNA, 18 nt, Mycobacterium bovis subsp bovis AF2122/97
uggcccaauugcgccgag

SEQ ID NO: 3079889 - RNA, 23 nt, Mycobacterium bovis subsp bovis AF2122/97
uggcccaccgccguugggccgcg

SEQ ID NO: 3079890 - RNA, 15 nt, Mycobacterium bovis subsp bovis AF2122/97
uggcccagcgugucu

SEQ ID NO: 3079891 - RNA, 23 nt, Mycobacterium bovis subsp bovis AF2122/97
uggccccaccgaacgugugggcc

SEQ ID NO: 3079892 - RNA, 13 nt, Mycobacterium bovis subsp bovis AF2122/97
uggccccagggga

SEQ ID NO: 3079893 - RNA, 17 nt, Mycobacterium bovis subsp bovis AF2122/97
uggcccccacaccacgc

SEQ ID NO: 3079894 - RNA, 22 nt, Mycobacterium bovis subsp bovis AF2122/97
uggcccccgacggugaaccacc

SEQ ID NO: 3079895 - RNA, 13 nt, Mycobacterium bovis subsp bovis AF2122/97
uggcccccgccgg

SEQ ID NO: 3079896 - RNA, 15 nt, Mycobacterium bovis subsp bovis AF2122/97
uggcccccgccggcc

SEQ ID NO: 3079897 - RNA, 17 nt, Mycobacterium bovis subsp bovis AF2122/97
uggcccccgccggccac

SEQ ID NO: 3079898 - RNA, 12 nt, Mycobacterium bovis subsp bovis AF2122/97
uggcccccgggu

SEQ ID NO: 3079899 - RNA, 12 nt, Mycobacterium bovis subsp bovis AF2122/97
uggccccgggcg

SEQ ID NO: 3079900 - RNA, 22 nt, Mycobacterium bovis subsp bovis AF2122/97
uggccccgggcggugaggcagc

SEQ ID NO: 3079901 - RNA, 16 nt, Mycobacterium bovis subsp bovis AF2122/97
uggccccgguggugcu

SEQ ID NO: 3079902 - RNA, 17 nt, Mycobacterium bovis subsp bovis AF2122/97
uggccccgguggugcug

SEQ ID NO: 3079903 - RNA, 16 nt, Mycobacterium bovis subsp bovis AF2122/97
uggcccgaccgggaac

SEQ ID NO: 3079904 - RNA, 14 nt, Mycobacterium bovis subsp bovis AF2122/97
uggcccgaguuggc

SEQ ID NO: 3079905 - RNA, 23 nt, Mycobacterium bovis subsp bovis AF2122/97
uggcccgaguuggcgaagcccga

SEQ ID NO: 3079906 - RNA, 19 nt, Mycobacterium bovis subsp bovis AF2122/97
uggcccgauaaaugccgcg

SEQ ID NO: 3079907 - RNA, 16 nt, Mycobacterium bovis subsp bovis AF2122/97
uggcccgaucgaccgc

SEQ ID NO: 3079908 - RNA, 16 nt, Mycobacterium bovis subsp bovis AF2122/97
uggcccgcacgaaccg

SEQ ID NO: 3079909 - RNA, 19 nt, Mycobacterium bovis subsp bovis AF2122/97
uggcccgcacgaaccgguc

SEQ ID NO: 3079910 - RNA, 19 nt, Mycobacterium bovis subsp bovis AF2122/97
uggcccgccacgaugucgu

SEQ ID NO: 3079911 - RNA, 17 nt, Mycobacterium bovis subsp bovis AF2122/97
uggcccgccggcaguga

SEQ ID NO: 3079912 - RNA, 13 nt, Mycobacterium bovis subsp bovis AF2122/97
uggcccgccugac

SEQ ID NO: 3079913 - RNA, 21 nt, Mycobacterium bovis subsp bovis AF2122/97
uggcccggacaugcgggcagc

SEQ ID NO: 3079914 - RNA, 22 nt, Mycobacterium bovis subsp bovis AF2122/97
uggcccggacaugcgggcagca

SEQ ID NO: 3079915 - RNA, 22 nt, Mycobacterium bovis subsp bovis AF2122/97
uggcccggcgaaagcuugggcg

SEQ ID NO: 3079916 - RNA, 17 nt, Mycobacterium bovis subsp bovis AF2122/97
uggcccgggccaccgga

SEQ ID NO: 3079917 - RNA, 12 nt, Mycobacterium bovis subsp bovis AF2122/97
uggcccgggccc

SEQ ID NO: 3079918 - RNA, 21 nt, Mycobacterium bovis subsp bovis AF2122/97
uggcccgggcccgcgggauca

SEQ ID NO: 3079919 - RNA, 23 nt, Mycobacterium bovis subsp bovis AF2122/97
uggcccgggucuccggcgcaccu

SEQ ID NO: 3079920 - RNA, 22 nt, Mycobacterium bovis subsp bovis AF2122/97
uggcccgucauacucgacaccg

SEQ ID NO: 3079921 - RNA, 13 nt, Mycobacterium bovis subsp bovis AF2122/97
uggcccgugcggu

SEQ ID NO: 3079922 - RNA, 15 nt, Mycobacterium bovis subsp bovis AF2122/97
uggcccgugcgguug

SEQ ID NO: 3079923 - RNA, 17 nt, Mycobacterium bovis subsp bovis AF2122/97
uggcccguuggcagcac

SEQ ID NO: 3079924 - RNA, 23 nt, Mycobacterium bovis subsp bovis AF2122/97
uggcccugauguugaucguugug

SEQ ID NO: 3079925 - RNA, 21 nt, Mycobacterium bovis subsp bovis AF2122/97
uggccgaacagcaggccucca

SEQ ID NO: 3079926 - RNA, 17 nt, Mycobacterium bovis subsp bovis AF2122/97
uggccgaacaggaugau

SEQ ID NO: 3079927 - RNA, 18 nt, Mycobacterium bovis subsp bovis AF2122/97
uggccgaacaggaugaug

SEQ ID NO: 3079928 - RNA, 18 nt, Mycobacterium bovis subsp bovis AF2122/97
uggccgaacgacgggucc

SEQ ID NO: 3079929 - RNA, 17 nt, Mycobacterium bovis subsp bovis AF2122/97
uggccgaacuaccgacg

SEQ ID NO: 3079930 - RNA, 17 nt, Mycobacterium bovis subsp bovis AF2122/97
uggccgacagccaccgc

SEQ ID NO: 3079931 - RNA, 18 nt, Mycobacterium bovis subsp bovis AF2122/97
uggccgacagccaccgcg

SEQ ID NO: 3079932 - RNA, 20 nt, Mycobacterium bovis subsp bovis AF2122/97
uggccgacgauagcggcccg

SEQ ID NO: 3079933 - RNA, 16 nt, Mycobacterium bovis subsp bovis AF2122/97
uggccgacgcugcuga

SEQ ID NO: 3079934 - RNA, 22 nt, Mycobacterium bovis subsp bovis AF2122/97
uggccgacgucugguuggcugg

SEQ ID NO: 3079935 - RNA, 20 nt, Mycobacterium bovis subsp bovis AF2122/97
uggccgacuuguacgcaucg

SEQ ID NO: 3079936 - RNA, 17 nt, Mycobacterium bovis subsp bovis AF2122/97
uggccgagcagggccgg

SEQ ID NO: 3079937 - RNA, 12 nt, Mycobacterium bovis subsp bovis AF2122/97
uggccgagccgc

SEQ ID NO: 3079938 - RNA, 13 nt, Mycobacterium bovis subsp bovis AF2122/97
uggccgagccgcg

SEQ ID NO: 3079939 - RNA, 15 nt, Mycobacterium bovis subsp bovis AF2122/97
uggccgagccgcggu

SEQ ID NO: 3079940 - RNA, 22 nt, Mycobacterium bovis subsp bovis AF2122/97
uggccgaguagauggucgacgg

SEQ ID NO: 3079941 - RNA, 18 nt, Mycobacterium bovis subsp bovis AF2122/97
uggccgaugugggcggag

SEQ ID NO: 3079942 - RNA, 22 nt, Mycobacterium bovis subsp bovis AF2122/97
uggccgaugugggcggagccga

SEQ ID NO: 3079943 - RNA, 17 nt, Mycobacterium bovis subsp bovis AF2122/97
uggccgauuccgcgcgu

SEQ ID NO: 3079944 - RNA, 20 nt, Mycobacterium bovis subsp bovis AF2122/97
uggccgauuccgcgcguccg

SEQ ID NO: 3079945 - RNA, 16 nt, Mycobacterium bovis subsp bovis AF2122/97
uggccgcaucgccuca

SEQ ID NO: 3079946 - RNA, 18 nt, Mycobacterium bovis subsp bovis AF2122/97
uggccgcauuggcgaccg

SEQ ID NO: 3079947 - RNA, 20 nt, Mycobacterium bovis subsp bovis AF2122/97
uggccgccacaccgccgcca

SEQ ID NO: 3079948 - RNA, 12 nt, Mycobacterium bovis subsp bovis AF2122/97
uggccgccaccg

SEQ ID NO: 3079949 - RNA, 15 nt, Mycobacterium bovis subsp bovis AF2122/97
uggccgccaccgcac

SEQ ID NO: 3079950 - RNA, 17 nt, Mycobacterium bovis subsp bovis AF2122/97
uggccgccaccgcgacg

SEQ ID NO: 3079951 - RNA, 16 nt, Mycobacterium bovis subsp bovis AF2122/97
uggccgccaccuccca

SEQ ID NO: 3079952 - RNA, 16 nt, Mycobacterium bovis subsp bovis AF2122/97
uggccgcccagaccgc

SEQ ID NO: 3079953 - RNA, 15 nt, Mycobacterium bovis subsp bovis AF2122/97
uggccgccccggccg

SEQ ID NO: 3079954 - RNA, 17 nt, Mycobacterium bovis subsp bovis AF2122/97
uggccgcccgcugcggc

SEQ ID NO: 3079955 - RNA, 18 nt, Mycobacterium bovis subsp bovis AF2122/97
uggccgcccgcugcggcg

SEQ ID NO: 3079956 - RNA, 17 nt, Mycobacterium bovis subsp bovis AF2122/97
uggccgcccuggccgcc

SEQ ID NO: 3079957 - RNA, 20 nt, Mycobacterium bovis subsp bovis AF2122/97
uggccgccgaauccgacguc

SEQ ID NO: 3079958 - RNA, 13 nt, Mycobacterium bovis subsp bovis AF2122/97
uggccgccgacaa

SEQ ID NO: 3079959 - RNA, 21 nt, Mycobacterium bovis subsp bovis AF2122/97
uggccgccgacaaccccgcca

SEQ ID NO: 3079960 - RNA, 17 nt, Mycobacterium bovis subsp bovis AF2122/97
uggccgccgccaccugu

SEQ ID NO: 3079961 - RNA, 16 nt, Mycobacterium bovis subsp bovis AF2122/97
uggccgccgccccggc

SEQ ID NO: 3079962 - RNA, 21 nt, Mycobacterium bovis subsp bovis AF2122/97
uggccgccgccccggcgcugg

SEQ ID NO: 3079963 - RNA, 12 nt, Mycobacterium bovis subsp bovis AF2122/97
uggccgccgccg

SEQ ID NO: 3079964 - RNA, 13 nt, Mycobacterium bovis subsp bovis AF2122/97
uggccgccgcgag

SEQ ID NO: 3079965 - RNA, 21 nt, Mycobacterium bovis subsp bovis AF2122/97
uggccgccgcgaggaugcuga

SEQ ID NO: 3079966 - RNA, 10 nt, Mycobacterium bovis subsp bovis AF2122/97
uggccgccgg

SEQ ID NO: 3079967 - RNA, 13 nt, Mycobacterium bovis subsp bovis AF2122/97
uggccgccggccc

SEQ ID NO: 3079968 - RNA, 15 nt, Mycobacterium bovis subsp bovis AF2122/97
uggccgccggccgcg

SEQ ID NO: 3079969 - RNA, 17 nt, Mycobacterium bovis subsp bovis AF2122/97
uggccgccggccgcgca

SEQ ID NO: 3079970 - RNA, 15 nt, Mycobacterium bovis subsp bovis AF2122/97
uggccgccggcgccg

SEQ ID NO: 3079971 - RNA, 16 nt, Mycobacterium bovis subsp bovis AF2122/97
uggccgccggcgccgc

SEQ ID NO: 3079972 - RNA, 18 nt, Mycobacterium bovis subsp bovis AF2122/97
uggccgccggcgccgcca

SEQ ID NO: 3079973 - RNA, 19 nt, Mycobacterium bovis subsp bovis AF2122/97
uggccuuguuguccuucag

SEQ ID NO: 3079974 - RNA, 18 nt, Mycobacterium bovis subsp bovis AF2122/97
uggccuuugagcgcggcc

SEQ ID NO: 3079975 - RNA, 15 nt, Mycobacterium bovis subsp bovis AF2122/97
uggcgaacacgucgg

SEQ ID NO: 3079976 - RNA, 17 nt, Mycobacterium bovis subsp bovis AF2122/97
uggcgaacacgucggcc

SEQ ID NO: 3079977 - RNA, 22 nt, Mycobacterium bovis subsp bovis AF2122/97
uggcgaaccucaccugacacgc

SEQ ID NO: 3079978 - RNA, 20 nt, Mycobacterium bovis subsp bovis AF2122/97
uggcgaacugguagcccgga

SEQ ID NO: 3079979 - RNA, 18 nt, Mycobacterium bovis subsp bovis AF2122/97
uggcgaagucgucgaggu

SEQ ID NO: 3079980 - RNA, 19 nt, Mycobacterium bovis subsp bovis AF2122/97
uggcgacaucucggucaga

SEQ ID NO: 3079981 - RNA, 13 nt, Mycobacterium bovis subsp bovis AF2122/97
uggcgaccaccgc

SEQ ID NO: 3079982 - RNA, 16 nt, Mycobacterium bovis subsp bovis AF2122/97
uggcgaccaccgcguc

SEQ ID NO: 3079983 - RNA, 13 nt, Mycobacterium bovis subsp bovis AF2122/97
uggcgaccugcgc

SEQ ID NO: 3079984 - RNA, 14 nt, Mycobacterium bovis subsp bovis AF2122/97
uggcgacggugcgc

SEQ ID NO: 3079985 - RNA, 20 nt, Mycobacterium bovis subsp bovis AF2122/97
uggcgacggugcgcuggaug

SEQ ID NO: 3079986 - RNA, 12 nt, Mycobacterium bovis subsp bovis AF2122/97
uggcgacgucga

SEQ ID NO: 3079987 - RNA, 20 nt, Mycobacterium bovis subsp bovis AF2122/97
uggcgacucgugucugccuc

SEQ ID NO: 3079988 - RNA, 18 nt, Mycobacterium bovis subsp bovis AF2122/97
uggcgacugucuggucgg

SEQ ID NO: 3079989 - RNA, 19 nt, Mycobacterium bovis subsp bovis AF2122/97
uggcgagccacggcacugg

SEQ ID NO: 3079990 - RNA, 16 nt, Mycobacterium bovis subsp bovis AF2122/97
uggcgagccagcuucc

SEQ ID NO: 3079991 - RNA, 21 nt, Mycobacterium bovis subsp bovis AF2122/97
uggcgagccagcuucccgcug

SEQ ID NO: 3079992 - RNA, 12 nt, Mycobacterium bovis subsp bovis AF2122/97
uggcgaggcagc

SEQ ID NO: 3079993 - RNA, 14 nt, Mycobacterium bovis subsp bovis AF2122/97
uggcgaggcagcac

SEQ ID NO: 3079994 - RNA, 22 nt, Mycobacterium bovis subsp bovis AF2122/97
uggcgagggcuaccggcgccgc

SEQ ID NO: 3079995 - RNA, 17 nt, Mycobacterium bovis subsp bovis AF2122/97
uggcgaggucggugagg

SEQ ID NO: 3079996 - RNA, 14 nt, Mycobacterium bovis subsp bovis AF2122/97
uggcgaucaaccgc

SEQ ID NO: 3079997 - RNA, 15 nt, Mycobacterium bovis subsp bovis AF2122/97
uggcgaucagcagcc

SEQ ID NO: 3079998 - RNA, 16 nt, Mycobacterium bovis subsp bovis AF2122/97
uggcgauccaggccag

SEQ ID NO: 3079999 - RNA, 17 nt, Mycobacterium bovis subsp bovis AF2122/97
uggcgaucccgccgggg

SEQ ID NO: 3080000 - RNA, 17 nt, Mycobacterium bovis subsp bovis AF2122/97
uggcgaucuccagcggu

SEQ ID NO: 3080001 - RNA, 17 nt, Mycobacterium bovis subsp bovis AF2122/97
uggcgaugaccuugggg

SEQ ID NO: 3080002 - RNA, 15 nt, Mycobacterium bovis subsp bovis AF2122/97
uggcgaugacgaucg

SEQ ID NO: 3080003 - RNA, 17 nt, Mycobacterium bovis subsp bovis AF2122/97
uggcgaugacgaucgcg

SEQ ID NO: 3080004 - RNA, 21 nt, Mycobacterium bovis subsp bovis AF2122/97
uggcgaugaggaacguuucgc

SEQ ID NO: 3080005 - RNA, 17 nt, Mycobacterium bovis subsp bovis AF2122/97
uggcgauggcaggggcg

SEQ ID NO: 3080006 - RNA, 19 nt, Mycobacterium bovis subsp bovis AF2122/97
uggcgcaacccccgaagac

SEQ ID NO: 3080007 - RNA, 14 nt, Mycobacterium bovis subsp bovis AF2122/97
uggcgcaccaccgc

SEQ ID NO: 3080008 - RNA, 23 nt, Mycobacterium bovis subsp bovis AF2122/97
uggcgcaccaccgccccgcgccc

SEQ ID NO: 3080009 - RNA, 20 nt, Mycobacterium bovis subsp bovis AF2122/97
uggcgcaccaccuccccgau

SEQ ID NO: 3080010 - RNA, 15 nt, Mycobacterium bovis subsp bovis AF2122/97
uggcgcaccggcguc

SEQ ID NO: 3080011 - RNA, 16 nt, Mycobacterium bovis subsp bovis AF2122/97
uggcgcaccggcgucg

SEQ ID NO: 3080012 - RNA, 21 nt, Mycobacterium bovis subsp bovis AF2122/97
uggcgcaccggcgucggcgcg

SEQ ID NO: 3080013 - RNA, 21 nt, Mycobacterium bovis subsp bovis AF2122/97
uggcgcagccugccgaugacg

SEQ ID NO: 3080014 - RNA, 19 nt, Mycobacterium bovis subsp bovis AF2122/97
uggcgccaacgcaacggug

SEQ ID NO: 3080015 - RNA, 11 nt, Mycobacterium bovis subsp bovis AF2122/97
uggcgccaccg

SEQ ID NO: 3080016 - RNA, 14 nt, Mycobacterium bovis subsp bovis AF2122/97
uggcgccaccggcg

SEQ ID NO: 3080017 - RNA, 15 nt, Mycobacterium bovis subsp bovis AF2122/97
uggcgccacggcagc

SEQ ID NO: 3080018 - RNA, 20 nt, Mycobacterium bovis subsp bovis AF2122/97
uggcgccacggcagcgccca

SEQ ID NO: 3080019 - RNA, 14 nt, Mycobacterium bovis subsp bovis AF2122/97
uggcgccagggccu

SEQ ID NO: 3080020 - RNA, 15 nt, Mycobacterium bovis subsp bovis AF2122/97
uggcgccauccccgc

SEQ ID NO: 3080021 - RNA, 19 nt, Mycobacterium bovis subsp bovis AF2122/97
uggcgcccauggccaccag

SEQ ID NO: 3080022 - RNA, 14 nt, Mycobacterium bovis subsp bovis AF2122/97
uggcgcccccgcca

SEQ ID NO: 3080023 - RNA, 21 nt, Mycobacterium bovis subsp bovis AF2122/97
uggcgcccgucuccagcacca

SEQ ID NO: 3080024 - RNA, 23 nt, Mycobacterium bovis subsp bovis AF2122/97
uggcgcccgugccgcccgcgccg

SEQ ID NO: 3080025 - RNA, 17 nt, Mycobacterium bovis subsp bovis AF2122/97
uggcgcccuugccggcg

SEQ ID NO: 3080026 - RNA, 19 nt, Mycobacterium bovis subsp bovis AF2122/97
uggcgcccuugccggcgag

SEQ ID NO: 3080027 - RNA, 23 nt, Mycobacterium bovis subsp bovis AF2122/97
uggcgccgaaaaggucggggaac

SEQ ID NO: 3080028 - RNA, 21 nt, Mycobacterium bovis subsp bovis AF2122/97
uggcgccgaacgccagcagcu

SEQ ID NO: 3080029 - RNA, 19 nt, Mycobacterium bovis subsp bovis AF2122/97
uggcgccgaaguagccgac

SEQ ID NO: 3080030 - RNA, 15 nt, Mycobacterium bovis subsp bovis AF2122/97
uggcgccgaccugga

SEQ ID NO: 3080031 - RNA, 18 nt, Mycobacterium bovis subsp bovis AF2122/97
uggcgccgaugccggcca

SEQ ID NO: 3080032 - RNA, 20 nt, Mycobacterium bovis subsp bovis AF2122/97
uggcgccgccggcaccgccg

SEQ ID NO: 3080033 - RNA, 14 nt, Mycobacterium bovis subsp bovis AF2122/97
uggcgccgccggug

SEQ ID NO: 3080034 - RNA, 13 nt, Mycobacterium bovis subsp bovis AF2122/97
uggcgccgcgccg

SEQ ID NO: 3080035 - RNA, 15 nt, Mycobacterium bovis subsp bovis AF2122/97
uggcgccgcgccgau

SEQ ID NO: 3080036 - RNA, 12 nt, Mycobacterium bovis subsp bovis AF2122/97
uggcgccggcca

SEQ ID NO: 3080037 - RNA, 14 nt, Mycobacterium bovis subsp bovis AF2122/97
uggcgccggccagc

SEQ ID NO: 3080038 - RNA, 12 nt, Mycobacterium bovis subsp bovis AF2122/97
uggcgccggccg

SEQ ID NO: 3080039 - RNA, 18 nt, Mycobacterium bovis subsp bovis AF2122/97
uggcgccggggaccacgg

SEQ ID NO: 3080040 - RNA, 18 nt, Mycobacterium bovis subsp bovis AF2122/97
uggcgccggggccgccga

SEQ ID NO: 3080041 - RNA, 13 nt, Mycobacterium bovis subsp bovis AF2122/97
uggcgccggggcg

SEQ ID NO: 3080042 - RNA, 11 nt, Mycobacterium bovis subsp bovis AF2122/97
uggcgccggug

SEQ ID NO: 3080043 - RNA, 14 nt, Mycobacterium bovis subsp bovis AF2122/97
uggcgccggugccg

SEQ ID NO: 3080044 - RNA, 18 nt, Mycobacterium bovis subsp bovis AF2122/97
uggcgccggugccgccgg

SEQ ID NO: 3080045 - RNA, 15 nt, Mycobacterium bovis subsp bovis AF2122/97
uggcgccgucggccg

SEQ ID NO: 3080046 - RNA, 18 nt, Mycobacterium bovis subsp bovis AF2122/97
uggcgcgaccgaugaucg

SEQ ID NO: 3080047 - RNA, 13 nt, Mycobacterium bovis subsp bovis AF2122/97
uggcgcgcaaccg

SEQ ID NO: 3080048 - RNA, 15 nt, Mycobacterium bovis subsp bovis AF2122/97
uggcgcgcagcgcga

SEQ ID NO: 3080049 - RNA, 21 nt, Mycobacterium bovis subsp bovis AF2122/97
uggcgcgccgcaucggcgaac

SEQ ID NO: 3080050 - RNA, 17 nt, Mycobacterium bovis subsp bovis AF2122/97
uggcgcgcgcaacgcug

SEQ ID NO: 3080051 - RNA, 19 nt, Mycobacterium bovis subsp bovis AF2122/97
uggcgcgcggcgccgcaau

SEQ ID NO: 3080052 - RNA, 14 nt, Mycobacterium bovis subsp bovis AF2122/97
uggcgcggacccgc

SEQ ID NO: 3080053 - RNA, 16 nt, Mycobacterium bovis subsp bovis AF2122/97
uggcgcggcacccggu

SEQ ID NO: 3080054 - RNA, 11 nt, Mycobacterium bovis subsp bovis AF2122/97
uggcgcggccg

SEQ ID NO: 3080055 - RNA, 22 nt, Mycobacterium bovis subsp bovis AF2122/97
uggcgcggccgaaagagccagc

SEQ ID NO: 3080056 - RNA, 17 nt, Mycobacterium bovis subsp bovis AF2122/97
uggcgcggcgagcacgc

SEQ ID NO: 3080057 - RNA, 12 nt, Mycobacterium bovis subsp bovis AF2122/97
uggcgcgggccg

SEQ ID NO: 3080058 - RNA, 18 nt, Mycobacterium bovis subsp bovis AF2122/97
uggcgcgggccggcgacu

SEQ ID NO: 3080059 - RNA, 14 nt, Mycobacterium bovis subsp bovis AF2122/97
uggcgcgggcgaga

SEQ ID NO: 3080060 - RNA, 19 nt, Mycobacterium bovis subsp bovis AF2122/97
uggcggugccggcggcgca

SEQ ID NO: 3080061 - RNA, 16 nt, Mycobacterium bovis subsp bovis AF2122/97
uggcggugcgcaccac

SEQ ID NO: 3080062 - RNA, 14 nt, Mycobacterium bovis subsp bovis AF2122/97
uggcggugcgcagc

SEQ ID NO: 3080063 - RNA, 20 nt, Mycobacterium bovis subsp bovis AF2122/97
uggcggugggcuuggcgccg

SEQ ID NO: 3080064 - RNA, 15 nt, Mycobacterium bovis subsp bovis AF2122/97
uggcgguggugccgc

SEQ ID NO: 3080065 - RNA, 18 nt, Mycobacterium bovis subsp bovis AF2122/97
uggcgguggugccgcggc

SEQ ID NO: 3080066 - RNA, 19 nt, Mycobacterium bovis subsp bovis AF2122/97
uggcgguguaacccggaac

SEQ ID NO: 3080067 - RNA, 21 nt, Mycobacterium bovis subsp bovis AF2122/97
uggcgguguugcucccggccg

SEQ ID NO: 3080068 - RNA, 15 nt, Mycobacterium bovis subsp bovis AF2122/97
uggcgguuccggccg

SEQ ID NO: 3080069 - RNA, 17 nt, Mycobacterium bovis subsp bovis AF2122/97
uggcgguuccggccggc

SEQ ID NO: 3080070 - RNA, 21 nt, Mycobacterium bovis subsp bovis AF2122/97
uggcgguuccggccggcuccg

SEQ ID NO: 3080071 - RNA, 22 nt, Mycobacterium bovis subsp bovis AF2122/97
uggcgguugcaaaccgcugcgc

SEQ ID NO: 3080072 - RNA, 18 nt, Mycobacterium bovis subsp bovis AF2122/97
uggcguaggacucuucgg

SEQ ID NO: 3080073 - RNA, 23 nt, Mycobacterium bovis subsp bovis AF2122/97
uggcguagggcuguccgaccucg

SEQ ID NO: 3080074 - RNA, 16 nt, Mycobacterium bovis subsp bovis AF2122/97
uggcguagugcagcug

SEQ ID NO: 3080075 - RNA, 21 nt, Mycobacterium bovis subsp bovis AF2122/97
uggcguauagcaugccgcggc

SEQ ID NO: 3080076 - RNA, 12 nt, Mycobacterium bovis subsp bovis AF2122/97
uggcgucaccgc

SEQ ID NO: 3080077 - RNA, 23 nt, Mycobacterium bovis subsp bovis AF2122/97
uggcgucaccgccggugcugacg

SEQ ID NO: 3080078 - RNA, 14 nt, Mycobacterium bovis subsp bovis AF2122/97
uggcgucagcagca

SEQ ID NO: 3080079 - RNA, 15 nt, Mycobacterium bovis subsp bovis AF2122/97
uggcgucagcagcaa

SEQ ID NO: 3080080 - RNA, 22 nt, Mycobacterium bovis subsp bovis AF2122/97
uggcgucgacgucgacggcgau

SEQ ID NO: 3080081 - RNA, 14 nt, Mycobacterium bovis subsp bovis AF2122/97
uggcgucgaucucg

SEQ ID NO: 3080082 - RNA, 16 nt, Mycobacterium bovis subsp bovis AF2122/97
uggcgucgaugccggc

SEQ ID NO: 3080083 - RNA, 17 nt, Mycobacterium bovis subsp bovis AF2122/97
uggcgucgaugcgggcc

SEQ ID NO: 3080084 - RNA, 18 nt, Mycobacterium bovis subsp bovis AF2122/97
uggcgucgaugcgggcca

SEQ ID NO: 3080085 - RNA, 14 nt, Mycobacterium bovis subsp bovis AF2122/97
uggcgucgcgguug

SEQ ID NO: 3080086 - RNA, 16 nt, Mycobacterium bovis subsp bovis AF2122/97
uggcgucgcucgucgu

SEQ ID NO: 3080087 - RNA, 14 nt, Mycobacterium bovis subsp bovis AF2122/97
uggcgucggccagg

SEQ ID NO: 3080088 - RNA, 17 nt, Mycobacterium bovis subsp bovis AF2122/97
uggcgucgugcgcggcc

SEQ ID NO: 3080089 - RNA, 11 nt, Mycobacterium bovis subsp bovis AF2122/97
uggcgugcagc

SEQ ID NO: 3080090 - RNA, 12 nt, Mycobacterium bovis subsp bovis AF2122/97
uggcgugcagca

SEQ ID NO: 3080091 - RNA, 16 nt, Mycobacterium bovis subsp bovis AF2122/97
uggcguggcccucggc

SEQ ID NO: 3080092 - RNA, 19 nt, Mycobacterium bovis subsp bovis AF2122/97
uggcguggcccucggcgau

SEQ ID NO: 3080093 - RNA, 20 nt, Mycobacterium bovis subsp bovis AF2122/97
uggcguggucucggucagcc

SEQ ID NO: 3080094 - RNA, 13 nt, Mycobacterium bovis subsp bovis AF2122/97
uggcguguggcuu

SEQ ID NO: 3080095 - RNA, 15 nt, Mycobacterium bovis subsp bovis AF2122/97
uggcguucagcggcc

SEQ ID NO: 3080096 - RNA, 20 nt, Mycobacterium bovis subsp bovis AF2122/97
uggcguucagcggccagcag

SEQ ID NO: 3080097 - RNA, 23 nt, Mycobacterium bovis subsp bovis AF2122/97
uggcguucugcgcccguccgcgc

SEQ ID NO: 3080098 - RNA, 14 nt, Mycobacterium bovis subsp bovis AF2122/97
uggcguugaugucg

SEQ ID NO: 3080099 - RNA, 22 nt, Mycobacterium bovis subsp bovis AF2122/97
uggcguugggcgggauggccgc

SEQ ID NO: 3080100 - RNA, 17 nt, Mycobacterium bovis subsp bovis AF2122/97
uggcguugguggucugc

SEQ ID NO: 3080101 - RNA, 14 nt, Mycobacterium bovis subsp bovis AF2122/97
uggcguuguugacg

SEQ ID NO: 3080102 - RNA, 21 nt, Mycobacterium bovis subsp bovis AF2122/97
uggcguuugaugcgggcggca

SEQ ID NO: 3080103 - RNA, 22 nt, Mycobacterium bovis subsp bovis AF2122/97
uggcuaccuuggacucggcggg

SEQ ID NO: 3080104 - RNA, 22 nt, Mycobacterium bovis subsp bovis AF2122/97
uggcuagcagguacucgcccca

SEQ ID NO: 3080105 - RNA, 23 nt, Mycobacterium bovis subsp bovis AF2122/97
uggcuaguugggugggugcagca

SEQ ID NO: 3080106 - RNA, 21 nt, Mycobacterium bovis subsp bovis AF2122/97
uggcuauccaccugcuggggc

SEQ ID NO: 3080107 - RNA, 12 nt, Mycobacterium bovis subsp bovis AF2122/97
uggcucaccagc

SEQ ID NO: 3080108 - RNA, 18 nt, Mycobacterium bovis subsp bovis AF2122/97
uggcucaccgacaugacg

SEQ ID NO: 3080109 - RNA, 18 nt, Mycobacterium bovis subsp bovis AF2122/97
uggcucccuuuuccaaag

SEQ ID NO: 3080110 - RNA, 18 nt, Mycobacterium bovis subsp bovis AF2122/97
uggcuccgaaguccacgc

SEQ ID NO: 3080111 - RNA, 19 nt, Mycobacterium bovis subsp bovis AF2122/97
uggcuccgaaguccacgca

SEQ ID NO: 3080112 - RNA, 22 nt, Mycobacterium bovis subsp bovis AF2122/97
uggcucgacgaugcggucaacg

SEQ ID NO: 3080113 - RNA, 13 nt, Mycobacterium bovis subsp bovis AF2122/97
uggcucgagccgc

SEQ ID NO: 3080114 - RNA, 17 nt, Mycobacterium bovis subsp bovis AF2122/97
uggcucgagccgcccgu

SEQ ID NO: 3080115 - RNA, 13 nt, Mycobacterium bovis subsp bovis AF2122/97
uggcucgccgaac

SEQ ID NO: 3080116 - RNA, 17 nt, Mycobacterium bovis subsp bovis AF2122/97
uggcucgcggaugcucg

SEQ ID NO: 3080117 - RNA, 16 nt, Mycobacterium bovis subsp bovis AF2122/97
uggcucgcucugcgcg

SEQ ID NO: 3080118 - RNA, 16 nt, Mycobacterium bovis subsp bovis AF2122/97
uggcucggggugcaga

SEQ ID NO: 3080119 - RNA, 22 nt, Mycobacterium bovis subsp bovis AF2122/97
uggcucuguagcgucgcaccca

SEQ ID NO: 3080120 - RNA, 12 nt, Mycobacterium bovis subsp bovis AF2122/97
uggcugagcagc

SEQ ID NO: 3080121 - RNA, 19 nt, Mycobacterium bovis subsp bovis AF2122/97
uggcugagcccgccgcgac

SEQ ID NO: 3080122 - RNA, 22 nt, Mycobacterium bovis subsp bovis AF2122/97
uggcugagcccgccgcgaccac

SEQ ID NO: 3080123 - RNA, 16 nt, Mycobacterium bovis subsp bovis AF2122/97
uggcugaucaccguug

SEQ ID NO: 3080124 - RNA, 17 nt, Mycobacterium bovis subsp bovis AF2122/97
uggcugaugacgcggac

SEQ ID NO: 3080125 - RNA, 23 nt, Mycobacterium bovis subsp bovis AF2122/97
uggcugccggcaacagcucgccu

SEQ ID NO: 3080126 - RNA, 19 nt, Mycobacterium bovis subsp bovis AF2122/97
uggcugcgguaguugcagu

SEQ ID NO: 3080127 - RNA, 19 nt, Mycobacterium bovis subsp bovis AF2122/97
uggcugcuguugguauuag

SEQ ID NO: 3080128 - RNA, 17 nt, Mycobacterium bovis subsp bovis AF2122/97
uggcuggaccacucgcc

SEQ ID NO: 3080129 - RNA, 14 nt, Mycobacterium bovis subsp bovis AF2122/97
uggcuggccgccac

SEQ ID NO: 3080130 - RNA, 17 nt, Mycobacterium bovis subsp bovis AF2122/97
uggcuggcggcgaccgu

SEQ ID NO: 3080131 - RNA, 14 nt, Mycobacterium bovis subsp bovis AF2122/97
uggcugggucguca

SEQ ID NO: 3080132 - RNA, 22 nt, Mycobacterium bovis subsp bovis AF2122/97
uggcugguuucggggaccacgc

SEQ ID NO: 3080133 - RNA, 15 nt, Mycobacterium bovis subsp bovis AF2122/97
uggcugugcccacgc

SEQ ID NO: 3080134 - RNA, 22 nt, Mycobacterium bovis subsp bovis AF2122/97
uggcuucacccaaccccgccgg

SEQ ID NO: 3080135 - RNA, 18 nt, Mycobacterium bovis subsp bovis AF2122/97
uggcuucgaagcgaucgc

SEQ ID NO: 3080136 - RNA, 19 nt, Mycobacterium bovis subsp bovis AF2122/97
uggcuucuagcccguuguc

SEQ ID NO: 3080137 - RNA, 16 nt, Mycobacterium bovis subsp bovis AF2122/97
uggcuugccccgccgu

SEQ ID NO: 3080138 - RNA, 14 nt, Mycobacterium bovis subsp bovis AF2122/97
uggcuugcucugcg

SEQ ID NO: 3080139 - RNA, 18 nt, Mycobacterium bovis subsp bovis AF2122/97
uggcuugggccagcgcau

SEQ ID NO: 3080140 - RNA, 15 nt, Mycobacterium bovis subsp bovis AF2122/97
uggcuuggugcccaa

SEQ ID NO: 3080141 - RNA, 15 nt, Mycobacterium bovis subsp bovis AF2122/97
uggcuuucgguaugc

SEQ ID NO: 3080142 - RNA, 16 nt, Mycobacterium bovis subsp bovis AF2122/97
uggcuuuugcgccgaa

SEQ ID NO: 3080143 - RNA, 18 nt, Mycobacterium bovis subsp bovis AF2122/97
ugggaaacccggccagcu

SEQ ID NO: 3080144 - RNA, 15 nt, Mycobacterium bovis subsp bovis AF2122/97
ugggaaccaccagca

SEQ ID NO: 3080145 - RNA, 17 nt, Mycobacterium bovis subsp bovis AF2122/97
ugggaagugcggugaga

SEQ ID NO: 3080146 - RNA, 23 nt, Mycobacterium bovis subsp bovis AF2122/97
ugggcgacaguagggucguacgu

SEQ ID NO: 3080147 - RNA, 19 nt, Mycobacterium bovis subsp bovis AF2122/97
ugggcgacgcggcgccgcc

SEQ ID NO: 3080148 - RNA, 22 nt, Mycobacterium bovis subsp bovis AF2122/97
ugggcgacgcggcgccgccauc

SEQ ID NO: 3080149 - RNA, 16 nt, Mycobacterium bovis subsp bovis AF2122/97
ugggcgacgucaucgc

SEQ ID NO: 3080150 - RNA, 19 nt, Mycobacterium bovis subsp bovis AF2122/97
ugggcgacgucaucgccga

SEQ ID NO: 3080151 - RNA, 21 nt, Mycobacterium bovis subsp bovis AF2122/97
ugggcgacgucaucgccgacc

SEQ ID NO: 3080152 - RNA, 20 nt, Mycobacterium bovis subsp bovis AF2122/97
ugggcgagaaguccgggccc

SEQ ID NO: 3080153 - RNA, 23 nt, Mycobacterium bovis subsp bovis AF2122/97
ugggcgagaaguccgggccccuu

SEQ ID NO: 3080154 - RNA, 13 nt, Mycobacterium bovis subsp bovis AF2122/97
ugggcgagaccgc

SEQ ID NO: 3080155 - RNA, 14 nt, Mycobacterium bovis subsp bovis AF2122/97
ugggcgagaccgcg

SEQ ID NO: 3080156 - RNA, 23 nt, Mycobacterium bovis subsp bovis AF2122/97
ugggcgagcagacgcagaaucgc

SEQ ID NO: 3080157 - RNA, 14 nt, Mycobacterium bovis subsp bovis AF2122/97
ugggcgagcugcug

SEQ ID NO: 3080158 - RNA, 23 nt, Mycobacterium bovis subsp bovis AF2122/97
ugggcgauucugugucugcucgc

SEQ ID NO: 3080159 - RNA, 18 nt, Mycobacterium bovis subsp bovis AF2122/97
ugggcgauuuugcgucug

SEQ ID NO: 3080160 - RNA, 20 nt, Mycobacterium bovis subsp bovis AF2122/97
ugggcgauuuugcgucugcu

SEQ ID NO: 3080161 - RNA, 21 nt, Mycobacterium bovis subsp bovis AF2122/97
ugggcgcagagucaacgucgu

SEQ ID NO: 3080162 - RNA, 14 nt, Mycobacterium bovis subsp bovis AF2122/97
ugggcgccacagcc

SEQ ID NO: 3080163 - RNA, 16 nt, Mycobacterium bovis subsp bovis AF2122/97
ugggcgccgacaccgg

SEQ ID NO: 3080164 - RNA, 18 nt, Mycobacterium bovis subsp bovis AF2122/97
ugggcgccgacaccggcu

SEQ ID NO: 3080165 - RNA, 22 nt, Mycobacterium bovis subsp bovis AF2122/97
ugggcgccgcaaccgccgcguc

SEQ ID NO: 3080166 - RNA, 16 nt, Mycobacterium bovis subsp bovis AF2122/97
ugggcgccgucucugc

SEQ ID NO: 3080167 - RNA, 21 nt, Mycobacterium bovis subsp bovis AF2122/97
ugggcgcgaaacgccgcaaug

SEQ ID NO: 3080168 - RNA, 19 nt, Mycobacterium bovis subsp bovis AF2122/97
ugggcgcgcucaucgaccg

SEQ ID NO: 3080169 - RNA, 20 nt, Mycobacterium bovis subsp bovis AF2122/97
ugggcgcgcucaucgaccgc

SEQ ID NO: 3080170 - RNA, 22 nt, Mycobacterium bovis subsp bovis AF2122/97
ugggcgcgcucaucgaccgggg

SEQ ID NO: 3080171 - RNA, 17 nt, Mycobacterium bovis subsp bovis AF2122/97
ugggcgcgcuggcgggc

SEQ ID NO: 3080172 - RNA, 19 nt, Mycobacterium bovis subsp bovis AF2122/97
ugggcgcggcaggccuggc

SEQ ID NO: 3080173 - RNA, 19 nt, Mycobacterium bovis subsp bovis AF2122/97
ugggcgcgggugcgccggc

SEQ ID NO: 3080174 - RNA, 16 nt, Mycobacterium bovis subsp bovis AF2122/97
ugggcgcucgcaucau

SEQ ID NO: 3080175 - RNA, 17 nt, Mycobacterium bovis subsp bovis AF2122/97
ugggcggaacgaugccg

SEQ ID NO: 3080176 - RNA, 22 nt, Mycobacterium bovis subsp bovis AF2122/97
ugggcggaacgaugccggcaag

SEQ ID NO: 3080177 - RNA, 12 nt, Mycobacterium bovis subsp bovis AF2122/97
ugggcggccagc

SEQ ID NO: 3080178 - RNA, 15 nt, Mycobacterium bovis subsp bovis AF2122/97
ugggcggccagcacg

SEQ ID NO: 3080179 - RNA, 19 nt, Mycobacterium bovis subsp bovis AF2122/97
ugggcggccgggcucccca

SEQ ID NO: 3080180 - RNA, 23 nt, Mycobacterium bovis subsp bovis AF2122/97
ugggcggccuggucggccagguc

SEQ ID NO: 3080181 - RNA, 18 nt, Mycobacterium bovis subsp bovis AF2122/97
ugggcggcucgucgauug

SEQ ID NO: 3080182 - RNA, 18 nt, Mycobacterium bovis subsp bovis AF2122/97
ugggcggcuucgaugucg

SEQ ID NO: 3080183 - RNA, 16 nt, Mycobacterium bovis subsp bovis AF2122/97
ugggcgggauggccgc

SEQ ID NO: 3080184 - RNA, 18 nt, Mycobacterium bovis subsp bovis AF2122/97
ugggcgggauggccgccg

SEQ ID NO: 3080185 - RNA, 20 nt, Mycobacterium bovis subsp bovis AF2122/97
ugggcgggauggccgccgac

SEQ ID NO: 3080186 - RNA, 22 nt, Mycobacterium bovis subsp bovis AF2122/97
ugggcgggcaaucaccgccggc

SEQ ID NO: 3080187 - RNA, 17 nt, Mycobacterium bovis subsp bovis AF2122/97
ugggcgguaccucgucg

SEQ ID NO: 3080188 - RNA, 18 nt, Mycobacterium bovis subsp bovis AF2122/97
ugggcgguccgcgucugg

SEQ ID NO: 3080189 - RNA, 23 nt, Mycobacterium bovis subsp bovis AF2122/97
ugggcguaaaccguggccgcgau

SEQ ID NO: 3080190 - RNA, 15 nt, Mycobacterium bovis subsp bovis AF2122/97
ugggcgucaagcaag

SEQ ID NO: 3080191 - RNA, 19 nt, Mycobacterium bovis subsp bovis AF2122/97
ugggcgucgaagaccgccu

SEQ ID NO: 3080192 - RNA, 19 nt, Mycobacterium bovis subsp bovis AF2122/97
ugggcgucgaccacgcaag

SEQ ID NO: 3080193 - RNA, 18 nt, Mycobacterium bovis subsp bovis AF2122/97
ugggcgugacugguggcg

SEQ ID NO: 3080194 - RNA, 21 nt, Mycobacterium bovis subsp bovis AF2122/97
ugggcuaccgagauugggcug

SEQ ID NO: 3080195 - RNA, 24 nt, Mycobacterium bovis subsp bovis AF2122/97
ugggcuaccgagauugggcuggga

SEQ ID NO: 3080196 - RNA, 13 nt, Mycobacterium bovis subsp bovis AF2122/97
ugggcucguugug

SEQ ID NO: 3080197 - RNA, 16 nt, Mycobacterium bovis subsp bovis AF2122/97
ugggcugccggccaga

SEQ ID NO: 3080198 - RNA, 23 nt, Mycobacterium bovis subsp bovis AF2122/97
ugggcugcgcgucgagcagcacc

SEQ ID NO: 3080199 - RNA, 18 nt, Mycobacterium bovis subsp bovis AF2122/97
ugggcugcggaugcgcgg

SEQ ID NO: 3080200 - RNA, 16 nt, Mycobacterium bovis subsp bovis AF2122/97
ugggcuggccagcacg

SEQ ID NO: 3080201 - RNA, 20 nt, Mycobacterium bovis subsp bovis AF2122/97
ugggcuggccagcacgcccg

SEQ ID NO: 3080202 - RNA, 19 nt, Mycobacterium bovis subsp bovis AF2122/97
ugggcugggauagcgcggu

SEQ ID NO: 3080203 - RNA, 23 nt, Mycobacterium bovis subsp bovis AF2122/97
ugggcuucgagugcgacggcgac

SEQ ID NO: 3080204 - RNA, 13 nt, Mycobacterium bovis subsp bovis AF2122/97
ugggcuugcccca

SEQ ID NO: 3080205 - RNA, 13 nt, Mycobacterium bovis subsp bovis AF2122/97
ugggcuuggcugu

SEQ ID NO: 3080206 - RNA, 12 nt, Mycobacterium bovis subsp bovis AF2122/97
ugggcuuggugc

SEQ ID NO: 3080207 - RNA, 19 nt, Mycobacterium bovis subsp bovis AF2122/97
ugggcuuuugcgucugcuc

SEQ ID NO: 3080208 - RNA, 22 nt, Mycobacterium bovis subsp bovis AF2122/97
ugggcuuuugcgucugcucgcg

SEQ ID NO: 3080209 - RNA, 18 nt, Mycobacterium bovis subsp bovis AF2122/97
uggggaacagcagcgcac

SEQ ID NO: 3080210 - RNA, 22 nt, Mycobacterium bovis subsp bovis AF2122/97
uggggaccuauuggucgcucgc

SEQ ID NO: 3080211 - RNA, 21 nt, Mycobacterium bovis subsp bovis AF2122/97
uggggaggaaggucgaaucgc

SEQ ID NO: 3080212 - RNA, 23 nt, Mycobacterium bovis subsp bovis AF2122/97
uggggauaaucguuuucggccug

SEQ ID NO: 3080213 - RNA, 22 nt, Mycobacterium bovis subsp bovis AF2122/97
uggggaucgaccauggucgauu

SEQ ID NO: 3080214 - RNA, 19 nt, Mycobacterium bovis subsp bovis AF2122/97
uggggaucgcaccgugggc

SEQ ID NO: 3080215 - RNA, 16 nt, Mycobacterium bovis subsp bovis AF2122/97
uggggaugcgauggcc

SEQ ID NO: 3080216 - RNA, 15 nt, Mycobacterium bovis subsp bovis AF2122/97
uggggauuccgcacc

SEQ ID NO: 3080217 - RNA, 20 nt, Mycobacterium bovis subsp bovis AF2122/97
uggggcacgacgccggccug

SEQ ID NO: 3080218 - RNA, 21 nt, Mycobacterium bovis subsp bovis AF2122/97
uggggcagccgggcgucgcug

SEQ ID NO: 3080219 - RNA, 12 nt, Mycobacterium bovis subsp bovis AF2122/97
uggggccaccag

SEQ ID NO: 3080220 - RNA, 11 nt, Mycobacterium bovis subsp bovis AF2122/97
uggggccggcg

SEQ ID NO: 3080221 - RNA, 19 nt, Mycobacterium bovis subsp bovis AF2122/97
uggggccggcgucgaugac

SEQ ID NO: 3080222 - RNA, 21 nt, Mycobacterium bovis subsp bovis AF2122/97
uggggccgggcuccucugguu

SEQ ID NO: 3080223 - RNA, 16 nt, Mycobacterium bovis subsp bovis AF2122/97
uggggccggggucggc

SEQ ID NO: 3080224 - RNA, 19 nt, Mycobacterium bovis subsp bovis AF2122/97
uggggccggggucggcccg

SEQ ID NO: 3080225 - RNA, 14 nt, Mycobacterium bovis subsp bovis AF2122/97
uggggcgccaccac

SEQ ID NO: 3080226 - RNA, 12 nt, Mycobacterium bovis subsp bovis AF2122/97
uggggcgccggg

SEQ ID NO: 3080227 - RNA, 21 nt, Mycobacterium bovis subsp bovis AF2122/97
uggggcgcgugggcgugcagg

SEQ ID NO: 3080228 - RNA, 16 nt, Mycobacterium bovis subsp bovis AF2122/97
uggggcuauggcgcag

SEQ ID NO: 3080229 - RNA, 17 nt, Mycobacterium bovis subsp bovis AF2122/97
uggggcuauggcgcagc

SEQ ID NO: 3080230 - RNA, 13 nt, Mycobacterium bovis subsp bovis AF2122/97
uggggcucgagug

SEQ ID NO: 3080231 - RNA, 14 nt, Mycobacterium bovis subsp bovis AF2122/97
ugggggagccggug

SEQ ID NO: 3080232 - RNA, 16 nt, Mycobacterium bovis subsp bovis AF2122/97
ugggggagcggccgcc

SEQ ID NO: 3080233 - RNA, 18 nt, Mycobacterium bovis subsp bovis AF2122/97
ugggggauaccgcugggu

SEQ ID NO: 3080234 - RNA, 16 nt, Mycobacterium bovis subsp bovis AF2122/97
ugggggcaucaggguc

SEQ ID NO: 3080235 - RNA, 20 nt, Mycobacterium bovis subsp bovis AF2122/97
ugggggccggcacugccgag

SEQ ID NO: 3080236 - RNA, 18 nt, Mycobacterium bovis subsp bovis AF2122/97
ugggggcuucugcgucug

SEQ ID NO: 3080237 - RNA, 20 nt, Mycobacterium bovis subsp bovis AF2122/97
ugggggugcacgccuugagc

SEQ ID NO: 3080238 - RNA, 15 nt, Mycobacterium bovis subsp bovis AF2122/97
ugggggugcuuccuc

SEQ ID NO: 3080239 - RNA, 13 nt, Mycobacterium bovis subsp bovis AF2122/97
uggggguggcagc

SEQ ID NO: 3080240 - RNA, 18 nt, Mycobacterium bovis subsp bovis AF2122/97
uggggguggcagcgcggc

SEQ ID NO: 3080241 - RNA, 18 nt, Mycobacterium bovis subsp bovis AF2122/97
uggggguuguucaacucg

SEQ ID NO: 3080242 - RNA, 20 nt, Mycobacterium bovis subsp bovis AF2122/97
uggggguuguucaacucggg

SEQ ID NO: 3080243 - RNA, 23 nt, Mycobacterium bovis subsp bovis AF2122/97
ugggguagaucucuucggagccg

SEQ ID NO: 3080244 - RNA, 16 nt, Mycobacterium bovis subsp bovis AF2122/97
ugggguccgcgucggc

SEQ ID NO: 3080245 - RNA, 14 nt, Mycobacterium bovis subsp bovis AF2122/97
uggggucguucgcc

SEQ ID NO: 3080246 - RNA, 15 nt, Mycobacterium bovis subsp bovis AF2122/97
uggggucugauggcg

SEQ ID NO: 3080247 - RNA, 14 nt, Mycobacterium bovis subsp bovis AF2122/97
uggggugacgcacc

SEQ ID NO: 3080248 - RNA, 21 nt, Mycobacterium bovis subsp bovis AF2122/97
uggggugcuuucgcgucugcu

SEQ ID NO: 3080249 - RNA, 12 nt, Mycobacterium bovis subsp bovis AF2122/97
ugggguggcagc

SEQ ID NO: 3080250 - RNA, 19 nt, Mycobacterium bovis subsp bovis AF2122/97
ugggguggcaucgaacgcc

SEQ ID NO: 3080251 - RNA, 16 nt, Mycobacterium bovis subsp bovis AF2122/97
ugggguggcggugccg

SEQ ID NO: 3080252 - RNA, 21 nt, Mycobacterium bovis subsp bovis AF2122/97
ugggguguagccagcggcugc

SEQ ID NO: 3080253 - RNA, 20 nt, Mycobacterium bovis subsp bovis AF2122/97
uggguacgacaccgcagcgg

SEQ ID NO: 3080254 - RNA, 15 nt, Mycobacterium bovis subsp bovis AF2122/97
uggguagccgcccag

SEQ ID NO: 3080255 - RNA, 23 nt, Mycobacterium bovis subsp bovis AF2122/97
uggguagcugacgugucggcugc

SEQ ID NO: 3080256 - RNA, 11 nt, Mycobacterium bovis subsp bovis AF2122/97
uggguaggcuc

SEQ ID NO: 3080257 - RNA, 16 nt, Mycobacterium bovis subsp bovis AF2122/97
uggguaugcacccagg

SEQ ID NO: 3080258 - RNA, 16 nt, Mycobacterium bovis subsp bovis AF2122/97
ugggucaccucggaga

SEQ ID NO: 3080259 - RNA, 14 nt, Mycobacterium bovis subsp bovis AF2122/97
ugggucaggccgac

SEQ ID NO: 3080260 - RNA, 14 nt, Mycobacterium bovis subsp bovis AF2122/97
ugggucagguuguc

SEQ ID NO: 3080261 - RNA, 20 nt, Mycobacterium bovis subsp bovis AF2122/97
ugggucaugccguagguugc

SEQ ID NO: 3080262 - RNA, 22 nt, Mycobacterium bovis subsp bovis AF2122/97
uggguccacgcgcucggugccg

SEQ ID NO: 3080263 - RNA, 20 nt, Mycobacterium bovis subsp bovis AF2122/97
uggguccucgagcggcagau

SEQ ID NO: 3080264 - RNA, 22 nt, Mycobacterium bovis subsp bovis AF2122/97
ugggucgaccguagccgugaca

SEQ ID NO: 3080265 - RNA, 18 nt, Mycobacterium bovis subsp bovis AF2122/97
ugggucgauccggugccg

SEQ ID NO: 3080266 - RNA, 20 nt, Mycobacterium bovis subsp bovis AF2122/97
ugggucgcaauauccggccg

SEQ ID NO: 3080267 - RNA, 15 nt, Mycobacterium bovis subsp bovis AF2122/97
ugggucggaccuucc

SEQ ID NO: 3080268 - RNA, 20 nt, Mycobacterium bovis subsp bovis AF2122/97
ugggucggcuuccggugccg

SEQ ID NO: 3080269 - RNA, 14 nt, Mycobacterium bovis subsp bovis AF2122/97
ugggucggggcggc

SEQ ID NO: 3080270 - RNA, 19 nt, Mycobacterium bovis subsp bovis AF2122/97
ugggucgugcaggcgacgg

SEQ ID NO: 3080271 - RNA, 21 nt, Mycobacterium bovis subsp bovis AF2122/97
ugggucgugcaggcgacggcu

SEQ ID NO: 3080272 - RNA, 21 nt, Mycobacterium bovis subsp bovis AF2122/97
ugggucuccggaucgccgaau

SEQ ID NO: 3080273 - RNA, 19 nt, Mycobacterium bovis subsp bovis AF2122/97
ugggucugcucagcgcggc

SEQ ID NO: 3080274 - RNA, 15 nt, Mycobacterium bovis subsp bovis AF2122/97
ugggugaacgccugc

SEQ ID NO: 3080275 - RNA, 20 nt, Mycobacterium bovis subsp bovis AF2122/97
ugggugaagagaagucucgc

SEQ ID NO: 3080276 - RNA, 19 nt, Mycobacterium bovis subsp bovis AF2122/97
ugggugacguaggcgcuga

SEQ ID NO: 3080277 - RNA, 13 nt, Mycobacterium bovis subsp bovis AF2122/97
ugggugaggccaa

SEQ ID NO: 3080278 - RNA, 22 nt, Mycobacterium bovis subsp bovis AF2122/97
ugggugagguuggagcgccagc

SEQ ID NO: 3080279 - RNA, 18 nt, Mycobacterium bovis subsp bovis AF2122/97
ugggugcagcacguccgc

SEQ ID NO: 3080280 - RNA, 23 nt, Mycobacterium bovis subsp bovis AF2122/97
ugggugcagcacguccgcggagc

SEQ ID NO: 3080281 - RNA, 15 nt, Mycobacterium bovis subsp bovis AF2122/97
ugggugcagugaccu

SEQ ID NO: 3080282 - RNA, 17 nt, Mycobacterium bovis subsp bovis AF2122/97
ugggugccggcagcggc

SEQ ID NO: 3080283 - RNA, 20 nt, Mycobacterium bovis subsp bovis AF2122/97
ugggugccggcagcggcgcg

SEQ ID NO: 3080284 - RNA, 17 nt, Mycobacterium bovis subsp bovis AF2122/97
ugggugccggcgucgcu

SEQ ID NO: 3080285 - RNA, 22 nt, Mycobacterium bovis subsp bovis AF2122/97
ugggugcgccgucagcccaggu

SEQ ID NO: 3080286 - RNA, 17 nt, Mycobacterium bovis subsp bovis AF2122/97
ugggugcgucgacccag

SEQ ID NO: 3080287 - RNA, 18 nt, Mycobacterium bovis subsp bovis AF2122/97
ugggugcgucgacccagc

SEQ ID NO: 3080288 - RNA, 18 nt, Mycobacterium bovis subsp bovis AF2122/97
ugggugucaaugugguuc

SEQ ID NO: 3080289 - RNA, 20 nt, Mycobacterium bovis subsp bovis AF2122/97
uggguguugcuggccgcgau

SEQ ID NO: 3080290 - RNA, 16 nt, Mycobacterium bovis subsp bovis AF2122/97
uggguguugucgucga

SEQ ID NO: 3080291 - RNA, 22 nt, Mycobacterium bovis subsp bovis AF2122/97
uggguguugucgucgagcgcgc

SEQ ID NO: 3080292 - RNA, 15 nt, Mycobacterium bovis subsp bovis AF2122/97
uggguugaccgccac

SEQ ID NO: 3080293 - RNA, 19 nt, Mycobacterium bovis subsp bovis AF2122/97
uggguugauuggccccggc

SEQ ID NO: 3080294 - RNA, 17 nt, Mycobacterium bovis subsp bovis AF2122/97
ugguaacaccggcgagu

SEQ ID NO: 3080295 - RNA, 13 nt, Mycobacterium bovis subsp bovis AF2122/97
ugguaaccagggc

SEQ ID NO: 3080296 - RNA, 16 nt, Mycobacterium bovis subsp bovis AF2122/97
ugguaaccagggcagc

SEQ ID NO: 3080297 - RNA, 17 nt, Mycobacterium bovis subsp bovis AF2122/97
ugguaaccagggcagcc

SEQ ID NO: 3080298 - RNA, 19 nt, Mycobacterium bovis subsp bovis AF2122/97
ugguaaccagggcagccgg

SEQ ID NO: 3080299 - RNA, 15 nt, Mycobacterium bovis subsp bovis AF2122/97
ugguacagggugugc

SEQ ID NO: 3080300 - RNA, 15 nt, Mycobacterium bovis subsp bovis AF2122/97
ugguacccaccaggg

SEQ ID NO: 3080301 - RNA, 18 nt, Mycobacterium bovis subsp bovis AF2122/97
ugguacccgcgccgcgca

SEQ ID NO: 3080302 - RNA, 12 nt, Mycobacterium bovis subsp bovis AF2122/97
ugguaccggcgg

SEQ ID NO: 3080303 - RNA, 18 nt, Mycobacterium bovis subsp bovis AF2122/97
ugguaccggcggcgccgg

SEQ ID NO: 3080304 - RNA, 19 nt, Mycobacterium bovis subsp bovis AF2122/97
ugguaccggcggcgccgga

SEQ ID NO: 3080305 - RNA, 23 nt, Mycobacterium bovis subsp bovis AF2122/97
ugguacgugaauuaaggugacca

SEQ ID NO: 3080306 - RNA, 17 nt, Mycobacterium bovis subsp bovis AF2122/97
ugguacuuucacgcucg

SEQ ID NO: 3080307 - RNA, 13 nt, Mycobacterium bovis subsp bovis AF2122/97
ugguagccagggc

SEQ ID NO: 3080308 - RNA, 21 nt, Mycobacterium bovis subsp bovis AF2122/97
ugguagcccggaccgcccgug

SEQ ID NO: 3080309 - RNA, 13 nt, Mycobacterium bovis subsp bovis AF2122/97
ugguagccggccg

SEQ ID NO: 3080310 - RNA, 16 nt, Mycobacterium bovis subsp bovis AF2122/97
ugguaggccggugcgu

SEQ ID NO: 3080311 - RNA, 17 nt, Mycobacterium bovis subsp bovis AF2122/97
ugguaggccggugcguc

SEQ ID NO: 3080312 - RNA, 12 nt, Mycobacterium bovis subsp bovis AF2122/97
ugguaggcggcc

SEQ ID NO: 3080313 - RNA, 13 nt, Mycobacterium bovis subsp bovis AF2122/97
ugguaggucaccg

SEQ ID NO: 3080314 - RNA, 16 nt, Mycobacterium bovis subsp bovis AF2122/97
ugguaggucaccgguc

SEQ ID NO: 3080315 - RNA, 22 nt, Mycobacterium bovis subsp bovis AF2122/97
ugguagguuacgccgggguaga

SEQ ID NO: 3080316 - RNA, 14 nt, Mycobacterium bovis subsp bovis AF2122/97
ugguaguaggccug

SEQ ID NO: 3080317 - RNA, 15 nt, Mycobacterium bovis subsp bovis AF2122/97
ugguaucugucggga

SEQ ID NO: 3080318 - RNA, 23 nt, Mycobacterium bovis subsp bovis AF2122/97
ugguaugcccgccguagaccagc

SEQ ID NO: 3080319 - RNA, 13 nt, Mycobacterium bovis subsp bovis AF2122/97
uggucggcgacgu

SEQ ID NO: 3080320 - RNA, 14 nt, Mycobacterium bovis subsp bovis AF2122/97
uggucggcgcgccg

SEQ ID NO: 3080321 - RNA, 20 nt, Mycobacterium bovis subsp bovis AF2122/97
uggucggcggccucggucug

SEQ ID NO: 3080322 - RNA, 16 nt, Mycobacterium bovis subsp bovis AF2122/97
uggucggcuacggcca

SEQ ID NO: 3080323 - RNA, 14 nt, Mycobacterium bovis subsp bovis AF2122/97
uggucggcucguca

SEQ ID NO: 3080324 - RNA, 20 nt, Mycobacterium bovis subsp bovis AF2122/97
uggucggucgcgcgacggcc

SEQ ID NO: 3080325 - RNA, 16 nt, Mycobacterium bovis subsp bovis AF2122/97
uggucggugacugugc

SEQ ID NO: 3080326 - RNA, 21 nt, Mycobacterium bovis subsp bovis AF2122/97
uggucggugcugaccccgccg

SEQ ID NO: 3080327 - RNA, 18 nt, Mycobacterium bovis subsp bovis AF2122/97
uggucggugggguauucg

SEQ ID NO: 3080328 - RNA, 14 nt, Mycobacterium bovis subsp bovis AF2122/97
uggucguaggugac

SEQ ID NO: 3080329 - RNA, 24 nt, Mycobacterium bovis subsp bovis AF2122/97
uggucgucggaguaccgcgcguug

SEQ ID NO: 3080330 - RNA, 22 nt, Mycobacterium bovis subsp bovis AF2122/97
uggucgugggccaccaccucgg

SEQ ID NO: 3080331 - RNA, 14 nt, Mycobacterium bovis subsp bovis AF2122/97
uggucuacccgcgg

SEQ ID NO: 3080332 - RNA, 17 nt, Mycobacterium bovis subsp bovis AF2122/97
uggucuccggcaccgag

SEQ ID NO: 3080333 - RNA, 17 nt, Mycobacterium bovis subsp bovis AF2122/97
uggucucgacggcgccg

SEQ ID NO: 3080334 - RNA, 15 nt, Mycobacterium bovis subsp bovis AF2122/97
uggucucgguaggcg

SEQ ID NO: 3080335 - RNA, 16 nt, Mycobacterium bovis subsp bovis AF2122/97
uggucucuagcaaagc

SEQ ID NO: 3080336 - RNA, 20 nt, Mycobacterium bovis subsp bovis AF2122/97
uggucucuagcaaagccagc

SEQ ID NO: 3080337 - RNA, 14 nt, Mycobacterium bovis subsp bovis AF2122/97
uggucugcaggcgg

SEQ ID NO: 3080338 - RNA, 14 nt, Mycobacterium bovis subsp bovis AF2122/97
uggucugcgcggug

SEQ ID NO: 3080339 - RNA, 16 nt, Mycobacterium bovis subsp bovis AF2122/97
uggucuggacugcagc

SEQ ID NO: 3080340 - RNA, 20 nt, Mycobacterium bovis subsp bovis AF2122/97
uggugaacgagaugccgcga

SEQ ID NO: 3080341 - RNA, 18 nt, Mycobacterium bovis subsp bovis AF2122/97
uggugaagccguagacgu

SEQ ID NO: 3080342 - RNA, 21 nt, Mycobacterium bovis subsp bovis AF2122/97
uggugaaggcaaacaccagcc

SEQ ID NO: 3080343 - RNA, 17 nt, Mycobacterium bovis subsp bovis AF2122/97
uggugaagucggugccg

SEQ ID NO: 3080344 - RNA, 16 nt, Mycobacterium bovis subsp bovis AF2122/97
uggugaagugaaccag

SEQ ID NO: 3080345 - RNA, 19 nt, Mycobacterium bovis subsp bovis AF2122/97
uggugacaccgaggucggc

SEQ ID NO: 3080346 - RNA, 14 nt, Mycobacterium bovis subsp bovis AF2122/97
uggugacagagcgg

SEQ ID NO: 3080347 - RNA, 23 nt, Mycobacterium bovis subsp bovis AF2122/97
uggugacauagaccucgccggug

SEQ ID NO: 3080348 - RNA, 23 nt, Mycobacterium bovis subsp bovis AF2122/97
uggugaccccguaggcgccgaac

SEQ ID NO: 3080349 - RNA, 15 nt, Mycobacterium bovis subsp bovis AF2122/97
uggugaccgacgcgg

SEQ ID NO: 3080350 - RNA, 23 nt, Mycobacterium bovis subsp bovis AF2122/97
uggugaccgggucgaucaccgac

SEQ ID NO: 3080351 - RNA, 14 nt, Mycobacterium bovis subsp bovis AF2122/97
uggugaccugacgc

SEQ ID NO: 3080352 - RNA, 13 nt, Mycobacterium bovis subsp bovis AF2122/97
uggugacggcggu

SEQ ID NO: 3080353 - RNA, 17 nt, Mycobacterium bovis subsp bovis AF2122/97
uggugagccucggcgag

SEQ ID NO: 3080354 - RNA, 21 nt, Mycobacterium bovis subsp bovis AF2122/97
uggugagguggucagccggug

SEQ ID NO: 3080355 - RNA, 20 nt, Mycobacterium bovis subsp bovis AF2122/97
uggugaguagauugcugacg

SEQ ID NO: 3080356 - RNA, 15 nt, Mycobacterium bovis subsp bovis AF2122/97
uggugagugcgucuc

SEQ ID NO: 3080357 - RNA, 17 nt, Mycobacterium bovis subsp bovis AF2122/97
uggugagugcgucucgg

SEQ ID NO: 3080358 - RNA, 23 nt, Mycobacterium bovis subsp bovis AF2122/97
uggugauccagccgucggcgcug

SEQ ID NO: 3080359 - RNA, 17 nt, Mycobacterium bovis subsp bovis AF2122/97
uggugauccggucuccg

SEQ ID NO: 3080360 - RNA, 22 nt, Mycobacterium bovis subsp bovis AF2122/97
uggugaucugcugggcaagauc

SEQ ID NO: 3080361 - RNA, 16 nt, Mycobacterium bovis subsp bovis AF2122/97
uggugauugcggaaca

SEQ ID NO: 3080362 - RNA, 15 nt, Mycobacterium bovis subsp bovis AF2122/97
uggugauugcggccg

SEQ ID NO: 3080363 - RNA, 23 nt, Mycobacterium bovis subsp bovis AF2122/97
uggugcacggcuuuucgacgcug

SEQ ID NO: 3080364 - RNA, 17 nt, Mycobacterium bovis subsp bovis AF2122/97
uggugcagccgcggucg

SEQ ID NO: 3080365 - RNA, 19 nt, Mycobacterium bovis subsp bovis AF2122/97
uggugcaggugagugcggc

SEQ ID NO: 3080366 - RNA, 13 nt, Mycobacterium bovis subsp bovis AF2122/97
uggugccaaccug

SEQ ID NO: 3080367 - RNA, 22 nt, Mycobacterium bovis subsp bovis AF2122/97
uggugccaaccugggccaucac

SEQ ID NO: 3080368 - RNA, 17 nt, Mycobacterium bovis subsp bovis AF2122/97
uggugccaacugcgccg

SEQ ID NO: 3080369 - RNA, 13 nt, Mycobacterium bovis subsp bovis AF2122/97
uggugccagccgg

SEQ ID NO: 3080370 - RNA, 19 nt, Mycobacterium bovis subsp bovis AF2122/97
uggugcccaaggcagaccc

SEQ ID NO: 3080371 - RNA, 22 nt, Mycobacterium bovis subsp bovis AF2122/97
uggugcccaaggcagaccccca

SEQ ID NO: 3080372 - RNA, 23 nt, Mycobacterium bovis subsp bovis AF2122/97
uggugcccaaggcagacccccag

SEQ ID NO: 3080373 - RNA, 20 nt, Mycobacterium bovis subsp bovis AF2122/97
uggugcccgacccgccgaug

SEQ ID NO: 3080374 - RNA, 17 nt, Mycobacterium bovis subsp bovis AF2122/97
uggugcccgugugcagc

SEQ ID NO: 3080375 - RNA, 16 nt, Mycobacterium bovis subsp bovis AF2122/97
uggugcccuugaagaa

SEQ ID NO: 3080376 - RNA, 14 nt, Mycobacterium bovis subsp bovis AF2122/97
uggugccgacccgc

SEQ ID NO: 3080377 - RNA, 16 nt, Mycobacterium bovis subsp bovis AF2122/97
uggugccgacccgccg

SEQ ID NO: 3080378 - RNA, 14 nt, Mycobacterium bovis subsp bovis AF2122/97
uggugccgagcagc

SEQ ID NO: 3080379 - RNA, 16 nt, Mycobacterium bovis subsp bovis AF2122/97
uggugccgccaccacc

SEQ ID NO: 3080380 - RNA, 14 nt, Mycobacterium bovis subsp bovis AF2122/97
uggugccgccugug

SEQ ID NO: 3080381 - RNA, 15 nt, Mycobacterium bovis subsp bovis AF2122/97
uggugccgccugugc

SEQ ID NO: 3080382 - RNA, 16 nt, Mycobacterium bovis subsp bovis AF2122/97
uggugccgccugugcc

SEQ ID NO: 3080383 - RNA, 17 nt, Mycobacterium bovis subsp bovis AF2122/97
uggugccgcggccaccg

SEQ ID NO: 3080384 - RNA, 20 nt, Mycobacterium bovis subsp bovis AF2122/97
uggugccgcggccaccgccg

SEQ ID NO: 3080385 - RNA, 23 nt, Mycobacterium bovis subsp bovis AF2122/97
uggugccggucaccucgccggcg

SEQ ID NO: 3080386 - RNA, 17 nt, Mycobacterium bovis subsp bovis AF2122/97
uggugccgucagguucu

SEQ ID NO: 3080387 - RNA, 21 nt, Mycobacterium bovis subsp bovis AF2122/97
uggugccguccggcgcuggcg

SEQ ID NO: 3080388 - RNA, 18 nt, Mycobacterium bovis subsp bovis AF2122/97
uggugccuacaccggcaa

SEQ ID NO: 3080389 - RNA, 18 nt, Mycobacterium bovis subsp bovis AF2122/97
uggugccugcggguggau

SEQ ID NO: 3080390 - RNA, 15 nt, Mycobacterium bovis subsp bovis AF2122/97
uggugcgccacgcca

SEQ ID NO: 3080391 - RNA, 18 nt, Mycobacterium bovis subsp bovis AF2122/97
uggugcgccgggcguccg

SEQ ID NO: 3080392 - RNA, 22 nt, Mycobacterium bovis subsp bovis AF2122/97
uggugcgcucgcgguagcgccg

SEQ ID NO: 3080393 - RNA, 23 nt, Mycobacterium bovis subsp bovis AF2122/97
uggugcgggugggcacaccggug

SEQ ID NO: 3080394 - RNA, 19 nt, Mycobacterium bovis subsp bovis AF2122/97
uggugcggucuggcgacuc

SEQ ID NO: 3080395 - RNA, 20 nt, Mycobacterium bovis subsp bovis AF2122/97
uggugcguagcccacccggg

SEQ ID NO: 3080396 - RNA, 17 nt, Mycobacterium bovis subsp bovis AF2122/97
uggugcuagcgccgcca

SEQ ID NO: 3080397 - RNA, 15 nt, Mycobacterium bovis subsp bovis AF2122/97
uggugcucagcggcu

SEQ ID NO: 3080398 - RNA, 17 nt, Mycobacterium bovis subsp bovis AF2122/97
uggugcucgucgguguc

SEQ ID NO: 3080399 - RNA, 17 nt, Mycobacterium bovis subsp bovis AF2122/97
uggugcugaccgcgccg

SEQ ID NO: 3080400 - RNA, 23 nt, Mycobacterium bovis subsp bovis AF2122/97
ugguggaccucacugugguaggc

SEQ ID NO: 3080401 - RNA, 14 nt, Mycobacterium bovis subsp bovis AF2122/97
ugguggaccuccgg

SEQ ID NO: 3080402 - RNA, 16 nt, Mycobacterium bovis subsp bovis AF2122/97
ugguggacgaccgcgc

SEQ ID NO: 3080403 - RNA, 15 nt, Mycobacterium bovis subsp bovis AF2122/97
ugguggacgaugcgg

SEQ ID NO: 3080404 - RNA, 20 nt, Mycobacterium bovis subsp bovis AF2122/97
ugguggacgcagagucaacg

SEQ ID NO: 3080405 - RNA, 18 nt, Mycobacterium bovis subsp bovis AF2122/97
uguacccgaccagcacca

SEQ ID NO: 3080406 - RNA, 16 nt, Mycobacterium bovis subsp bovis AF2122/97
uguacccgccucgggc

SEQ ID NO: 3080407 - RNA, 17 nt, Mycobacterium bovis subsp bovis AF2122/97
uguacgcaucgccguca

SEQ ID NO: 3080408 - RNA, 14 nt, Mycobacterium bovis subsp bovis AF2122/97
uguacgcccgcucg

SEQ ID NO: 3080409 - RNA, 17 nt, Mycobacterium bovis subsp bovis AF2122/97
uguacggaucaggcccg

SEQ ID NO: 3080410 - RNA, 21 nt, Mycobacterium bovis subsp bovis AF2122/97
uguacggggccgucucgccgu

SEQ ID NO: 3080411 - RNA, 22 nt, Mycobacterium bovis subsp bovis AF2122/97
uguacugcggugccacggugac

SEQ ID NO: 3080412 - RNA, 13 nt, Mycobacterium bovis subsp bovis AF2122/97
uguacugcugcuu

SEQ ID NO: 3080413 - RNA, 16 nt, Mycobacterium bovis subsp bovis AF2122/97
uguagacggcggcauc

SEQ ID NO: 3080414 - RNA, 13 nt, Mycobacterium bovis subsp bovis AF2122/97
uguagaucagcaa

SEQ ID NO: 3080415 - RNA, 16 nt, Mycobacterium bovis subsp bovis AF2122/97
uguagaucugggcugg

SEQ ID NO: 3080416 - RNA, 20 nt, Mycobacterium bovis subsp bovis AF2122/97
uguagaugaacuucccaccc

SEQ ID NO: 3080417 - RNA, 19 nt, Mycobacterium bovis subsp bovis AF2122/97
uguagcagcgccagcagcu

SEQ ID NO: 3080418 - RNA, 12 nt, Mycobacterium bovis subsp bovis AF2122/97
uguagcccuccg

SEQ ID NO: 3080419 - RNA, 14 nt, Mycobacterium bovis subsp bovis AF2122/97
uguagccgagcacg

SEQ ID NO: 3080420 - RNA, 20 nt, Mycobacterium bovis subsp bovis AF2122/97
uguagccgagcacgggcaga

SEQ ID NO: 3080421 - RNA, 22 nt, Mycobacterium bovis subsp bovis AF2122/97
uguagcgaaugaucuugccacu

SEQ ID NO: 3080422 - RNA, 14 nt, Mycobacterium bovis subsp bovis AF2122/97
uguagcgcaucgcc

SEQ ID NO: 3080423 - RNA, 16 nt, Mycobacterium bovis subsp bovis AF2122/97
uguagcucggacccuc

SEQ ID NO: 3080424 - RNA, 17 nt, Mycobacterium bovis subsp bovis AF2122/97
uguaggccucggcagca

SEQ ID NO: 3080425 - RNA, 21 nt, Mycobacterium bovis subsp bovis AF2122/97
uguaggccugcccccggcgcg

SEQ ID NO: 3080426 - RNA, 15 nt, Mycobacterium bovis subsp bovis AF2122/97
uguaggcuuccagcu

SEQ ID NO: 3080427 - RNA, 15 nt, Mycobacterium bovis subsp bovis AF2122/97
uguagggccggugac

SEQ ID NO: 3080428 - RNA, 15 nt, Mycobacterium bovis subsp bovis AF2122/97
uguagggcuuccagg

SEQ ID NO: 3080429 - RNA, 14 nt, Mycobacterium bovis subsp bovis AF2122/97
uguaggucagcgcg

SEQ ID NO: 3080430 - RNA, 15 nt, Mycobacterium bovis subsp bovis AF2122/97
uguaguagagccugg

SEQ ID NO: 3080431 - RNA, 23 nt, Mycobacterium bovis subsp bovis AF2122/97
uguaguccucgguggccuucugg

SEQ ID NO: 3080432 - RNA, 14 nt, Mycobacterium bovis subsp bovis AF2122/97
uguaucugcugccg

SEQ ID NO: 3080433 - RNA, 18 nt, Mycobacterium bovis subsp bovis AF2122/97
uguaugacaggucacggu

SEQ ID NO: 3080434 - RNA, 13 nt, Mycobacterium bovis subsp bovis AF2122/97
ugucaaaggugca

SEQ ID NO: 3080435 - RNA, 22 nt, Mycobacterium bovis subsp bovis AF2122/97
ugucaaugacaccggggcagau

SEQ ID NO: 3080436 - RNA, 13 nt, Mycobacterium bovis subsp bovis AF2122/97
ugucacaggcgac

SEQ ID NO: 3080437 - RNA, 14 nt, Mycobacterium bovis subsp bovis AF2122/97
ugucacaguggugg

SEQ ID NO: 3080438 - RNA, 17 nt, Mycobacterium bovis subsp bovis AF2122/97
ugucacccaauggagcc

SEQ ID NO: 3080439 - RNA, 17 nt, Mycobacterium bovis subsp bovis AF2122/97
ugucaccccgcccagcg

SEQ ID NO: 3080440 - RNA, 13 nt, Mycobacterium bovis subsp bovis AF2122/97
ugucacccgcccg

SEQ ID NO: 3080441 - RNA, 21 nt, Mycobacterium bovis subsp bovis AF2122/97
ugucaccgcagccaacgucac

SEQ ID NO: 3080442 - RNA, 13 nt, Mycobacterium bovis subsp bovis AF2122/97
ugucaccgccggg

SEQ ID NO: 3080443 - RNA, 20 nt, Mycobacterium bovis subsp bovis AF2122/97
ugucaccggcgucgcugccu

SEQ ID NO: 3080444 - RNA, 17 nt, Mycobacterium bovis subsp bovis AF2122/97
ugucaccggcuucggcc

SEQ ID NO: 3080445 - RNA, 15 nt, Mycobacterium bovis subsp bovis AF2122/97
ugucacgcaccgcgg

SEQ ID NO: 3080446 - RNA, 14 nt, Mycobacterium bovis subsp bovis AF2122/97
ugucagccaccggu

SEQ ID NO: 3080447 - RNA, 18 nt, Mycobacterium bovis subsp bovis AF2122/97
ugucagccgguuccgcaa

SEQ ID NO: 3080448 - RNA, 20 nt, Mycobacterium bovis subsp bovis AF2122/97
ugucagcgcugagccgcuca

SEQ ID NO: 3080449 - RNA, 21 nt, Mycobacterium bovis subsp bovis AF2122/97
ugucagcgcugagccgcucau

SEQ ID NO: 3080450 - RNA, 11 nt, Mycobacterium bovis subsp bovis AF2122/97
ugucagcggcc

SEQ ID NO: 3080451 - RNA, 14 nt, Mycobacterium bovis subsp bovis AF2122/97
ugucagcggccgcg

SEQ ID NO: 3080452 - RNA, 17 nt, Mycobacterium bovis subsp bovis AF2122/97
ugucagcuuuaucggcc

SEQ ID NO: 3080453 - RNA, 19 nt, Mycobacterium bovis subsp bovis AF2122/97
ugucaggauauuucuaaau

SEQ ID NO: 3080454 - RNA, 16 nt, Mycobacterium bovis subsp bovis AF2122/97
ugucagugaucaccaa

SEQ ID NO: 3080455 - RNA, 16 nt, Mycobacterium bovis subsp bovis AF2122/97
ugucauccccggccag

SEQ ID NO: 3080456 - RNA, 13 nt, Mycobacterium bovis subsp bovis AF2122/97
uguccaccaccgg

SEQ ID NO: 3080457 - RNA, 16 nt, Mycobacterium bovis subsp bovis AF2122/97
uguccaccaccggcac

SEQ ID NO: 3080458 - RNA, 18 nt, Mycobacterium bovis subsp bovis AF2122/97
uguccaccagcguguagc

SEQ ID NO: 3080459 - RNA, 16 nt, Mycobacterium bovis subsp bovis AF2122/97
uguccaccgaugccac

SEQ ID NO: 3080460 - RNA, 16 nt, Mycobacterium bovis subsp bovis AF2122/97
uguccaccgccaccac

SEQ ID NO: 3080461 - RNA, 14 nt, Mycobacterium bovis subsp bovis AF2122/97
uguccaccgugcgg

SEQ ID NO: 3080462 - RNA, 18 nt, Mycobacterium bovis subsp bovis AF2122/97
uguccacgaugacgucga

SEQ ID NO: 3080463 - RNA, 17 nt, Mycobacterium bovis subsp bovis AF2122/97
uguccacguccagcccg

SEQ ID NO: 3080464 - RNA, 21 nt, Mycobacterium bovis subsp bovis AF2122/97
uguccacguccagcccgucca

SEQ ID NO: 3080465 - RNA, 16 nt, Mycobacterium bovis subsp bovis AF2122/97
uguccacugccaccgc

SEQ ID NO: 3080466 - RNA, 23 nt, Mycobacterium bovis subsp bovis AF2122/97
uguccagaacggcgaucaccgag

SEQ ID NO: 3080467 - RNA, 13 nt, Mycobacterium bovis subsp bovis AF2122/97
uguccagaacggu

SEQ ID NO: 3080468 - RNA, 15 nt, Mycobacterium bovis subsp bovis AF2122/97
uguccagcaugcccg

SEQ ID NO: 3080469 - RNA, 17 nt, Mycobacterium bovis subsp bovis AF2122/97
uguccagcaugcccgcc

SEQ ID NO: 3080470 - RNA, 22 nt, Mycobacterium bovis subsp bovis AF2122/97
uguccagcgcgacguccaccag

SEQ ID NO: 3080471 - RNA, 16 nt, Mycobacterium bovis subsp bovis AF2122/97
uguccagcguccuggc

SEQ ID NO: 3080472 - RNA, 22 nt, Mycobacterium bovis subsp bovis AF2122/97
uguccaggaucgcguggcgcac

SEQ ID NO: 3080473 - RNA, 15 nt, Mycobacterium bovis subsp bovis AF2122/97
uguccaggcgcgcac

SEQ ID NO: 3080474 - RNA, 19 nt, Mycobacterium bovis subsp bovis AF2122/97
uguccaggcgcgcaccacc

SEQ ID NO: 3080475 - RNA, 20 nt, Mycobacterium bovis subsp bovis AF2122/97
uguccaggcgcgcaccaccg

SEQ ID NO: 3080476 - RNA, 15 nt, Mycobacterium bovis subsp bovis AF2122/97
uguccagguggcgcg

SEQ ID NO: 3080477 - RNA, 16 nt, Mycobacterium bovis subsp bovis AF2122/97
uguccagguggcgcgg

SEQ ID NO: 3080478 - RNA, 14 nt, Mycobacterium bovis subsp bovis AF2122/97
uguccauagccggc

SEQ ID NO: 3080479 - RNA, 14 nt, Mycobacterium bovis subsp bovis AF2122/97
uguccaucgcgcgg

SEQ ID NO: 3080480 - RNA, 13 nt, Mycobacterium bovis subsp bovis AF2122/97
uguccccgacgga

SEQ ID NO: 3080481 - RNA, 19 nt, Mycobacterium bovis subsp bovis AF2122/97
uguccccgccgagggcuug

SEQ ID NO: 3080482 - RNA, 23 nt, Mycobacterium bovis subsp bovis AF2122/97
uguccccggcggcagcauauccg

SEQ ID NO: 3080483 - RNA, 17 nt, Mycobacterium bovis subsp bovis AF2122/97
ugucccgaugguggccg

SEQ ID NO: 3080484 - RNA, 17 nt, Mycobacterium bovis subsp bovis AF2122/97
ugucccgcacccggccc

SEQ ID NO: 3080485 - RNA, 18 nt, Mycobacterium bovis subsp bovis AF2122/97
ugucccgcgggccagcac

SEQ ID NO: 3080486 - RNA, 21 nt, Mycobacterium bovis subsp bovis AF2122/97
ugucccgcgggccagcaccuc

SEQ ID NO: 3080487 - RNA, 19 nt, Mycobacterium bovis subsp bovis AF2122/97
ugucccgguguccagccac

SEQ ID NO: 3080488 - RNA, 16 nt, Mycobacterium bovis subsp bovis AF2122/97
uguccgaccucgccgc

SEQ ID NO: 3080489 - RNA, 18 nt, Mycobacterium bovis subsp bovis AF2122/97
uguccgaccucgccgcgc

SEQ ID NO: 3080490 - RNA, 22 nt, Mycobacterium bovis subsp bovis AF2122/97
uguccgacgccaccgccaccac

SEQ ID NO: 3080491 - RNA, 16 nt, Mycobacterium bovis subsp bovis AF2122/97
uguccgauaacccggu

SEQ ID NO: 3080492 - RNA, 24 nt, Mycobacterium bovis subsp bovis AF2122/97
ugucgggcucgcauucggcgagcc

SEQ ID NO: 3080493 - RNA, 20 nt, Mycobacterium bovis subsp bovis AF2122/97
ugucgggcuggguggccaac

SEQ ID NO: 3080494 - RNA, 16 nt, Mycobacterium bovis subsp bovis AF2122/97
ugucggggauucgucg

SEQ ID NO: 3080495 - RNA, 16 nt, Mycobacterium bovis subsp bovis AF2122/97
ugucggggccgucguc

SEQ ID NO: 3080496 - RNA, 20 nt, Mycobacterium bovis subsp bovis AF2122/97
ugucgggguuucaggcggca

SEQ ID NO: 3080497 - RNA, 18 nt, Mycobacterium bovis subsp bovis AF2122/97
ugucggucggaucggcgc

SEQ ID NO: 3080498 - RNA, 14 nt, Mycobacterium bovis subsp bovis AF2122/97
ugucggugcgcggc

SEQ ID NO: 3080499 - RNA, 19 nt, Mycobacterium bovis subsp bovis AF2122/97
ugucggugcguccggugcu

SEQ ID NO: 3080500 - RNA, 17 nt, Mycobacterium bovis subsp bovis AF2122/97
ugucggugguaccggcg

SEQ ID NO: 3080501 - RNA, 20 nt, Mycobacterium bovis subsp bovis AF2122/97
ugucggugguaccggcggcg

SEQ ID NO: 3080502 - RNA, 21 nt, Mycobacterium bovis subsp bovis AF2122/97
ugucgguguacagucgcgcgc

SEQ ID NO: 3080503 - RNA, 22 nt, Mycobacterium bovis subsp bovis AF2122/97
ugucgguguacagucgcgcgcu

SEQ ID NO: 3080504 - RNA, 16 nt, Mycobacterium bovis subsp bovis AF2122/97
ugucggugucggugac

SEQ ID NO: 3080505 - RNA, 20 nt, Mycobacterium bovis subsp bovis AF2122/97
ugucguaacugcccgcggcg

SEQ ID NO: 3080506 - RNA, 16 nt, Mycobacterium bovis subsp bovis AF2122/97
ugucguaccagccaug

SEQ ID NO: 3080507 - RNA, 19 nt, Mycobacterium bovis subsp bovis AF2122/97
ugucguaccgcggaucgga

SEQ ID NO: 3080508 - RNA, 15 nt, Mycobacterium bovis subsp bovis AF2122/97
ugucguagcgcgaga

SEQ ID NO: 3080509 - RNA, 14 nt, Mycobacterium bovis subsp bovis AF2122/97
ugucguaggccgca

SEQ ID NO: 3080510 - RNA, 13 nt, Mycobacterium bovis subsp bovis AF2122/97
ugucgucaccgug

SEQ ID NO: 3080511 - RNA, 13 nt, Mycobacterium bovis subsp bovis AF2122/97
ugucgucgagcgc

SEQ ID NO: 3080512 - RNA, 19 nt, Mycobacterium bovis subsp bovis AF2122/97
ugucgucgcccugacacaa

SEQ ID NO: 3080513 - RNA, 17 nt, Mycobacterium bovis subsp bovis AF2122/97
ugucgucgccggcggcg

SEQ ID NO: 3080514 - RNA, 23 nt, Mycobacterium bovis subsp bovis AF2122/97
ugucgucgguguuccgccgcgcu

SEQ ID NO: 3080515 - RNA, 15 nt, Mycobacterium bovis subsp bovis AF2122/97
ugucgucgucgugua

SEQ ID NO: 3080516 - RNA, 17 nt, Mycobacterium bovis subsp bovis AF2122/97
ugucgucgucguguagg

SEQ ID NO: 3080517 - RNA, 17 nt, Mycobacterium bovis subsp bovis AF2122/97
ugucgucuuggcgaucg

SEQ ID NO: 3080518 - RNA, 18 nt, Mycobacterium bovis subsp bovis AF2122/97
ugucgucuuuggucagcc

SEQ ID NO: 3080519 - RNA, 13 nt, Mycobacterium bovis subsp bovis AF2122/97
ugucgugggcacc

SEQ ID NO: 3080520 - RNA, 22 nt, Mycobacterium bovis subsp bovis AF2122/97
ugucgugggcaccuuggccggc

SEQ ID NO: 3080521 - RNA, 17 nt, Mycobacterium bovis subsp bovis AF2122/97
ugucguugccgucggcg

SEQ ID NO: 3080522 - RNA, 19 nt, Mycobacterium bovis subsp bovis AF2122/97
ugucucccuugccgccauu

SEQ ID NO: 3080523 - RNA, 18 nt, Mycobacterium bovis subsp bovis AF2122/97
ugucuccggcaacagcac

SEQ ID NO: 3080524 - RNA, 22 nt, Mycobacterium bovis subsp bovis AF2122/97
ugucuccuccggaaagcucucg

SEQ ID NO: 3080525 - RNA, 18 nt, Mycobacterium bovis subsp bovis AF2122/97
ugucuccuuguccugccu

SEQ ID NO: 3080526 - RNA, 21 nt, Mycobacterium bovis subsp bovis AF2122/97
ugucucggcaccacagugaaa

SEQ ID NO: 3080527 - RNA, 21 nt, Mycobacterium bovis subsp bovis AF2122/97
ugucucgggcgcgggugacca

SEQ ID NO: 3080528 - RNA, 23 nt, Mycobacterium bovis subsp bovis AF2122/97
ugucugccaugugucccggacca

SEQ ID NO: 3080529 - RNA, 12 nt, Mycobacterium bovis subsp bovis AF2122/97
ugucugcccgag

SEQ ID NO: 3080530 - RNA, 19 nt, Mycobacterium bovis subsp bovis AF2122/97
ugucugcccgauacccggu

SEQ ID NO: 3080531 - RNA, 15 nt, Mycobacterium bovis subsp bovis AF2122/97
ugucugcucgcgccg

SEQ ID NO: 3080532 - RNA, 23 nt, Mycobacterium bovis subsp bovis AF2122/97
ugucugcucggcgagcgucgggc

SEQ ID NO: 3080533 - RNA, 19 nt, Mycobacterium bovis subsp bovis AF2122/97
ugucuguacaacgacacgc

SEQ ID NO: 3080534 - RNA, 14 nt, Mycobacterium bovis subsp bovis AF2122/97
ugucuuagccagca

SEQ ID NO: 3080535 - RNA, 19 nt, Mycobacterium bovis subsp bovis AF2122/97
ugucuuagccagcagcaca

SEQ ID NO: 3080536 - RNA, 16 nt, Mycobacterium bovis subsp bovis AF2122/97
ugucuugccaccacgc

SEQ ID NO: 3080537 - RNA, 18 nt, Mycobacterium bovis subsp bovis AF2122/97
ugugaacagcgcgucgga

SEQ ID NO: 3080538 - RNA, 22 nt, Mycobacterium bovis subsp bovis AF2122/97
ugugaacgaagggaaggacgcg

SEQ ID NO: 3080539 - RNA, 17 nt, Mycobacterium bovis subsp bovis AF2122/97
ugugaacggugucaacg

SEQ ID NO: 3080540 - RNA, 17 nt, Mycobacterium bovis subsp bovis AF2122/97
ugugaacuggucgacgu

SEQ ID NO: 3080541 - RNA, 15 nt, Mycobacterium bovis subsp bovis AF2122/97
ugugaacugucccac

SEQ ID NO: 3080542 - RNA, 19 nt, Mycobacterium bovis subsp bovis AF2122/97
ugugacagcccgcuggccg

SEQ ID NO: 3080543 - RNA, 12 nt, Mycobacterium bovis subsp bovis AF2122/97
ugugacaucggg

SEQ ID NO: 3080544 - RNA, 23 nt, Mycobacterium bovis subsp bovis AF2122/97
ugugacaucgggccgccgagcuc

SEQ ID NO: 3080545 - RNA, 19 nt, Mycobacterium bovis subsp bovis AF2122/97
ugugaccggcgaucgggcg

SEQ ID NO: 3080546 - RNA, 13 nt, Mycobacterium bovis subsp bovis AF2122/97
ugugaccgucagc

SEQ ID NO: 3080547 - RNA, 15 nt, Mycobacterium bovis subsp bovis AF2122/97
ugugacgccgggcug

SEQ ID NO: 3080548 - RNA, 19 nt, Mycobacterium bovis subsp bovis AF2122/97
ugugacgggcacaaccaga

SEQ ID NO: 3080549 - RNA, 18 nt, Mycobacterium bovis subsp bovis AF2122/97
ugugacuuauccggccag

SEQ ID NO: 3080550 - RNA, 21 nt, Mycobacterium bovis subsp bovis AF2122/97
ugugacuuauccggccaguga

SEQ ID NO: 3080551 - RNA, 18 nt, Mycobacterium bovis subsp bovis AF2122/97
ugugaggccuucgccgac

SEQ ID NO: 3080552 - RNA, 23 nt, Mycobacterium bovis subsp bovis AF2122/97
ugugagguagucggcgcgucguu

SEQ ID NO: 3080553 - RNA, 15 nt, Mycobacterium bovis subsp bovis AF2122/97
ugugauccgguggug

SEQ ID NO: 3080554 - RNA, 24 nt, Mycobacterium bovis subsp bovis AF2122/97
ugugauccgguggugggccguggg

SEQ ID NO: 3080555 - RNA, 19 nt, Mycobacterium bovis subsp bovis AF2122/97
ugugcaacggugaaucgaa

SEQ ID NO: 3080556 - RNA, 20 nt, Mycobacterium bovis subsp bovis AF2122/97
ugugcacgcgggcguuggcc

SEQ ID NO: 3080557 - RNA, 19 nt, Mycobacterium bovis subsp bovis AF2122/97
ugugcacggcuucggcgag

SEQ ID NO: 3080558 - RNA, 14 nt, Mycobacterium bovis subsp bovis AF2122/97
ugugcacggugugc

SEQ ID NO: 3080559 - RNA, 20 nt, Mycobacterium bovis subsp bovis AF2122/97
ugugcacggugugcacggcg

SEQ ID NO: 3080560 - RNA, 20 nt, Mycobacterium bovis subsp bovis AF2122/97
ugugcaggaucacgccgccg

SEQ ID NO: 3080561 - RNA, 21 nt, Mycobacterium bovis subsp bovis AF2122/97
ugugcaggaucacgccgccgg

SEQ ID NO: 3080562 - RNA, 17 nt, Mycobacterium bovis subsp bovis AF2122/97
ugugcagggacccggcg

SEQ ID NO: 3080563 - RNA, 19 nt, Mycobacterium bovis subsp bovis AF2122/97
ugugcagguggccgucgcc

SEQ ID NO: 3080564 - RNA, 13 nt, Mycobacterium bovis subsp bovis AF2122/97
ugugccaccgcug

SEQ ID NO: 3080565 - RNA, 13 nt, Mycobacterium bovis subsp bovis AF2122/97
ugugccacggggc

SEQ ID NO: 3080566 - RNA, 21 nt, Mycobacterium bovis subsp bovis AF2122/97
ugugccacuucuucacuggcg

SEQ ID NO: 3080567 - RNA, 24 nt, Mycobacterium bovis subsp bovis AF2122/97
ugugcccggcgcgaagucguuguu

SEQ ID NO: 3080568 - RNA, 21 nt, Mycobacterium bovis subsp bovis AF2122/97
ugugcccggcuccuccccggc

SEQ ID NO: 3080569 - RNA, 21 nt, Mycobacterium bovis subsp bovis AF2122/97
ugugcccucaacgucccagcc

SEQ ID NO: 3080570 - RNA, 19 nt, Mycobacterium bovis subsp bovis AF2122/97
ugugccgauuggccugcca

SEQ ID NO: 3080571 - RNA, 15 nt, Mycobacterium bovis subsp bovis AF2122/97
ugugccgccgcggca

SEQ ID NO: 3080572 - RNA, 13 nt, Mycobacterium bovis subsp bovis AF2122/97
ugugccgccggcg

SEQ ID NO: 3080573 - RNA, 17 nt, Mycobacterium bovis subsp bovis AF2122/97
ugugccgcugcauccgc

SEQ ID NO: 3080574 - RNA, 18 nt, Mycobacterium bovis subsp bovis AF2122/97
ugugccgcugcauccgca

SEQ ID NO: 3080575 - RNA, 16 nt, Mycobacterium bovis subsp bovis AF2122/97
ugugccgcugugaauu

SEQ ID NO: 3080576 - RNA, 19 nt, Mycobacterium bovis subsp bovis AF2122/97
ugugccgggcgaugcuggg

SEQ ID NO: 3080577 - RNA, 20 nt, Mycobacterium bovis subsp bovis AF2122/97
ugugccgggcgaugcugggc

SEQ ID NO: 3080578 - RNA, 20 nt, Mycobacterium bovis subsp bovis AF2122/97
uguuccagaaggccgcaccg

SEQ ID NO: 3080579 - RNA, 17 nt, Mycobacterium bovis subsp bovis AF2122/97
uguuccagcgugccugg

SEQ ID NO: 3080580 - RNA, 15 nt, Mycobacterium bovis subsp bovis AF2122/97
uguuccccgucgcca

SEQ ID NO: 3080581 - RNA, 15 nt, Mycobacterium bovis subsp bovis AF2122/97
uguuccgccacccgc

SEQ ID NO: 3080582 - RNA, 15 nt, Mycobacterium bovis subsp bovis AF2122/97
uguuccgccgcgcua

SEQ ID NO: 3080583 - RNA, 18 nt, Mycobacterium bovis subsp bovis AF2122/97
uguucgaaagcaccgaug

SEQ ID NO: 3080584 - RNA, 15 nt, Mycobacterium bovis subsp bovis AF2122/97
uguucgacugcagaa

SEQ ID NO: 3080585 - RNA, 18 nt, Mycobacterium bovis subsp bovis AF2122/97
uguucgaguucggccgcg

SEQ ID NO: 3080586 - RNA, 17 nt, Mycobacterium bovis subsp bovis AF2122/97
uguucgaugggugcacc

SEQ ID NO: 3080587 - RNA, 22 nt, Mycobacterium bovis subsp bovis AF2122/97
uguucgccgucgcuacccgcca

SEQ ID NO: 3080588 - RNA, 14 nt, Mycobacterium bovis subsp bovis AF2122/97
uguucggagccaau

SEQ ID NO: 3080589 - RNA, 18 nt, Mycobacterium bovis subsp bovis AF2122/97
uguucggagcugggcuga

SEQ ID NO: 3080590 - RNA, 21 nt, Mycobacterium bovis subsp bovis AF2122/97
uguucggcccuauggguuccu

SEQ ID NO: 3080591 - RNA, 23 nt, Mycobacterium bovis subsp bovis AF2122/97
uguucgggcagcuggcgacggug

SEQ ID NO: 3080592 - RNA, 15 nt, Mycobacterium bovis subsp bovis AF2122/97
uguucgggucgauca

SEQ ID NO: 3080593 - RNA, 15 nt, Mycobacterium bovis subsp bovis AF2122/97
uguucggucuugccg

SEQ ID NO: 3080594 - RNA, 23 nt, Mycobacterium bovis subsp bovis AF2122/97
uguucgugccggcguugccgaaa

SEQ ID NO: 3080595 - RNA, 18 nt, Mycobacterium bovis subsp bovis AF2122/97
uguucuggauacccagcg

SEQ ID NO: 3080596 - RNA, 21 nt, Mycobacterium bovis subsp bovis AF2122/97
uguucuugagccggacguucu

SEQ ID NO: 3080597 - RNA, 15 nt, Mycobacterium bovis subsp bovis AF2122/97
uguucuuggugacca

SEQ ID NO: 3080598 - RNA, 22 nt, Mycobacterium bovis subsp bovis AF2122/97
uguugaaauugaugaucugcag

SEQ ID NO: 3080599 - RNA, 20 nt, Mycobacterium bovis subsp bovis AF2122/97
uguugaccaggcuccggccg

SEQ ID NO: 3080600 - RNA, 14 nt, Mycobacterium bovis subsp bovis AF2122/97
uguugacccaucau

SEQ ID NO: 3080601 - RNA, 16 nt, Mycobacterium bovis subsp bovis AF2122/97
uguugaccgggucguc

SEQ ID NO: 3080602 - RNA, 15 nt, Mycobacterium bovis subsp bovis AF2122/97
uguugacgccacgac

SEQ ID NO: 3080603 - RNA, 18 nt, Mycobacterium bovis subsp bovis AF2122/97
uguugagcuggaccuccg

SEQ ID NO: 3080604 - RNA, 14 nt, Mycobacterium bovis subsp bovis AF2122/97
uguugaggccggug

SEQ ID NO: 3080605 - RNA, 20 nt, Mycobacterium bovis subsp bovis AF2122/97
uguugagggugcccgaguuc

SEQ ID NO: 3080606 - RNA, 15 nt, Mycobacterium bovis subsp bovis AF2122/97
uguugaugggcagcc

SEQ ID NO: 3080607 - RNA, 20 nt, Mycobacterium bovis subsp bovis AF2122/97
uguugaugggcagccgcccg

SEQ ID NO: 3080608 - RNA, 18 nt, Mycobacterium bovis subsp bovis AF2122/97
uguugauugaccugcugg

SEQ ID NO: 3080609 - RNA, 21 nt, Mycobacterium bovis subsp bovis AF2122/97
uguugccccggucggcgacgu

SEQ ID NO: 3080610 - RNA, 21 nt, Mycobacterium bovis subsp bovis AF2122/97
uguugcccgaccacaccggga

SEQ ID NO: 3080611 - RNA, 14 nt, Mycobacterium bovis subsp bovis AF2122/97
uguugccgaagccc

SEQ ID NO: 3080612 - RNA, 21 nt, Mycobacterium bovis subsp bovis AF2122/97
uguugccgcccggguugaccg

SEQ ID NO: 3080613 - RNA, 13 nt, Mycobacterium bovis subsp bovis AF2122/97
uguugccgccgcg

SEQ ID NO: 3080614 - RNA, 14 nt, Mycobacterium bovis subsp bovis AF2122/97
uguugccgccggug

SEQ ID NO: 3080615 - RNA, 20 nt, Mycobacterium bovis subsp bovis AF2122/97
uguugccuaaguucgccacg

SEQ ID NO: 3080616 - RNA, 14 nt, Mycobacterium bovis subsp bovis AF2122/97
uguugcgcugcggc

SEQ ID NO: 3080617 - RNA, 18 nt, Mycobacterium bovis subsp bovis AF2122/97
uguugcggcugaccuccc

SEQ ID NO: 3080618 - RNA, 15 nt, Mycobacterium bovis subsp bovis AF2122/97
uguugcucgccgucg

SEQ ID NO: 3080619 - RNA, 15 nt, Mycobacterium bovis subsp bovis AF2122/97
uguugcugucgaagu

SEQ ID NO: 3080620 - RNA, 20 nt, Mycobacterium bovis subsp bovis AF2122/97
uguuggaagucccgccguug

SEQ ID NO: 3080621 - RNA, 19 nt, Mycobacterium bovis subsp bovis AF2122/97
uguuggauccggccaccac

SEQ ID NO: 3080622 - RNA, 18 nt, Mycobacterium bovis subsp bovis AF2122/97
uguuggccauguccacca

SEQ ID NO: 3080623 - RNA, 21 nt, Mycobacterium bovis subsp bovis AF2122/97
uguuggccguaccggugaucg

SEQ ID NO: 3080624 - RNA, 17 nt, Mycobacterium bovis subsp bovis AF2122/97
uguuggcgaaggccgca

SEQ ID NO: 3080625 - RNA, 17 nt, Mycobacterium bovis subsp bovis AF2122/97
uguuggcgcccgggccc

SEQ ID NO: 3080626 - RNA, 21 nt, Mycobacterium bovis subsp bovis AF2122/97
uguuggcgcccgggcccacgu

SEQ ID NO: 3080627 - RNA, 16 nt, Mycobacterium bovis subsp bovis AF2122/97
uguuggcguggaucuu

SEQ ID NO: 3080628 - RNA, 19 nt, Mycobacterium bovis subsp bovis AF2122/97
uguuggcguggaucuuggc

SEQ ID NO: 3080629 - RNA, 14 nt, Mycobacterium bovis subsp bovis AF2122/97
uguugggagccacc

SEQ ID NO: 3080630 - RNA, 20 nt, Mycobacterium bovis subsp bovis AF2122/97
uguugggcgcgaaacgccgc

SEQ ID NO: 3080631 - RNA, 12 nt, Mycobacterium bovis subsp bovis AF2122/97
uguuggugaccg

SEQ ID NO: 3080632 - RNA, 16 nt, Mycobacterium bovis subsp bovis AF2122/97
uguuggugccagccgg

SEQ ID NO: 3080633 - RNA, 21 nt, Mycobacterium bovis subsp bovis AF2122/97
uguugguggccgggucgauca

SEQ ID NO: 3080634 - RNA, 20 nt, Mycobacterium bovis subsp bovis AF2122/97
uguugucccuauaccgcugg

SEQ ID NO: 3080635 - RNA, 12 nt, Mycobacterium bovis subsp bovis AF2122/97
uguugucgauca

SEQ ID NO: 3080636 - RNA, 15 nt, Mycobacterium bovis subsp bovis AF2122/97
uguugucugaccccc

SEQ ID NO: 3080637 - RNA, 15 nt, Mycobacterium bovis subsp bovis AF2122/97
uguuguugccccggu

SEQ ID NO: 3080638 - RNA, 20 nt, Mycobacterium bovis subsp bovis AF2122/97
uguuuccgaaacccgccgcg

SEQ ID NO: 3080639 - RNA, 16 nt, Mycobacterium bovis subsp bovis AF2122/97
uguuuccggugugcuc

SEQ ID NO: 3080640 - RNA, 17 nt, Mycobacterium bovis subsp bovis AF2122/97
uguuugggcaucucggc

SEQ ID NO: 3080641 - RNA, 22 nt, Mycobacterium bovis subsp bovis AF2122/97
uguuuugucaggauauuucuaa

SEQ ID NO: 3080642 - RNA, 14 nt, Mycobacterium bovis subsp bovis AF2122/97
uguuuuugcacuga

SEQ ID NO: 3080643 - RNA, 18 nt, Mycobacterium bovis subsp bovis AF2122/97
uguuuuuguauguucggc

SEQ ID NO: 3080644 - RNA, 22 nt, Mycobacterium bovis subsp bovis AF2122/97
uuaaccgagccgaccggcggca

SEQ ID NO: 3080645 - RNA, 17 nt, Mycobacterium bovis subsp bovis AF2122/97
uuaacuacggugcccug

SEQ ID NO: 3080646 - RNA, 15 nt, Mycobacterium bovis subsp bovis AF2122/97
uuaagucuggaguga

SEQ ID NO: 3080647 - RNA, 17 nt, Mycobacterium bovis subsp bovis AF2122/97
uuacauagaccaccggc

SEQ ID NO: 3080648 - RNA, 14 nt, Mycobacterium bovis subsp bovis AF2122/97
uuacaugucacacc

SEQ ID NO: 3080649 - RNA, 17 nt, Mycobacterium bovis subsp bovis AF2122/97
uuacaugucacacccac

SEQ ID NO: 3080650 - RNA, 15 nt, Mycobacterium bovis subsp bovis AF2122/97
uuaccauauccggac

SEQ ID NO: 3080651 - RNA, 18 nt, Mycobacterium bovis subsp bovis AF2122/97
uuaccccaccggaaucga

SEQ ID NO: 3080652 - RNA, 17 nt, Mycobacterium bovis subsp bovis AF2122/97
uuacccgggcggcggcg

SEQ ID NO: 3080653 - RNA, 15 nt, Mycobacterium bovis subsp bovis AF2122/97
uuaccgauuggcccg

SEQ ID NO: 3080654 - RNA, 11 nt, Mycobacterium bovis subsp bovis AF2122/97
uuaccgccguc

SEQ ID NO: 3080655 - RNA, 14 nt, Mycobacterium bovis subsp bovis AF2122/97
uuaccgccgucgcc

SEQ ID NO: 3080656 - RNA, 11 nt, Mycobacterium bovis subsp bovis AF2122/97
uuaccgccguu

SEQ ID NO: 3080657 - RNA, 19 nt, Mycobacterium bovis subsp bovis AF2122/97
uuaccggcacgccggcggc

SEQ ID NO: 3080658 - RNA, 15 nt, Mycobacterium bovis subsp bovis AF2122/97
uuacgcaccgaggcc

SEQ ID NO: 3080659 - RNA, 14 nt, Mycobacterium bovis subsp bovis AF2122/97
uuacgccgagcaca

SEQ ID NO: 3080660 - RNA, 15 nt, Mycobacterium bovis subsp bovis AF2122/97
uuacguacagggugg

SEQ ID NO: 3080661 - RNA, 13 nt, Mycobacterium bovis subsp bovis AF2122/97
uuacgucugcucg

SEQ ID NO: 3080662 - RNA, 16 nt, Mycobacterium bovis subsp bovis AF2122/97
uuacuggagauaccga

SEQ ID NO: 3080663 - RNA, 19 nt, Mycobacterium bovis subsp bovis AF2122/97
uuagcaccaguucccuaca

SEQ ID NO: 3080664 - RNA, 11 nt, Mycobacterium bovis subsp bovis AF2122/97
uuagccagguc

SEQ ID NO: 3080665 - RNA, 23 nt, Mycobacterium bovis subsp bovis AF2122/97
uucccgccauugccgccgucgcc

SEQ ID NO: 3080666 - RNA, 14 nt, Mycobacterium bovis subsp bovis AF2122/97
uucccgcggcaacg

SEQ ID NO: 3080667 - RNA, 15 nt, Mycobacterium bovis subsp bovis AF2122/97
uucccgcuugagcag

SEQ ID NO: 3080668 - RNA, 15 nt, Mycobacterium bovis subsp bovis AF2122/97
uucccggaagcgccg

SEQ ID NO: 3080669 - RNA, 15 nt, Mycobacterium bovis subsp bovis AF2122/97
uucccggacccacca

SEQ ID NO: 3080670 - RNA, 20 nt, Mycobacterium bovis subsp bovis AF2122/97
uucccggauagacggcgacg

SEQ ID NO: 3080671 - RNA, 14 nt, Mycobacterium bovis subsp bovis AF2122/97
uucccggcggcgcg

SEQ ID NO: 3080672 - RNA, 15 nt, Mycobacterium bovis subsp bovis AF2122/97
uucccgucggcggcg

SEQ ID NO: 3080673 - RNA, 22 nt, Mycobacterium bovis subsp bovis AF2122/97
uucccguugcugagcguaggcc

SEQ ID NO: 3080674 - RNA, 13 nt, Mycobacterium bovis subsp bovis AF2122/97
uucccuggccgcc

SEQ ID NO: 3080675 - RNA, 17 nt, Mycobacterium bovis subsp bovis AF2122/97
uucccuuguucccgaaa

SEQ ID NO: 3080676 - RNA, 16 nt, Mycobacterium bovis subsp bovis AF2122/97
uuccgaaacccgccgc

SEQ ID NO: 3080677 - RNA, 15 nt, Mycobacterium bovis subsp bovis AF2122/97
uuccgaggagggccg

SEQ ID NO: 3080678 - RNA, 16 nt, Mycobacterium bovis subsp bovis AF2122/97
uuccgauagccgacca

SEQ ID NO: 3080679 - RNA, 12 nt, Mycobacterium bovis subsp bovis AF2122/97
uuccgccgccgc

SEQ ID NO: 3080680 - RNA, 13 nt, Mycobacterium bovis subsp bovis AF2122/97
uuccgccgccgcc

SEQ ID NO: 3080681 - RNA, 17 nt, Mycobacterium bovis subsp bovis AF2122/97
uuccgccgccgccgcca

SEQ ID NO: 3080682 - RNA, 17 nt, Mycobacterium bovis subsp bovis AF2122/97
uuccgcgaaggucucga

SEQ ID NO: 3080683 - RNA, 18 nt, Mycobacterium bovis subsp bovis AF2122/97
uuccgcgcguccgucggc

SEQ ID NO: 3080684 - RNA, 15 nt, Mycobacterium bovis subsp bovis AF2122/97
uuccgcggguuugau

SEQ ID NO: 3080685 - RNA, 16 nt, Mycobacterium bovis subsp bovis AF2122/97
uuccgcgucgccggcc

SEQ ID NO: 3080686 - RNA, 19 nt, Mycobacterium bovis subsp bovis AF2122/97
uuccgcucguucgugcagc

SEQ ID NO: 3080687 - RNA, 16 nt, Mycobacterium bovis subsp bovis AF2122/97
uuccggccgacacgcc

SEQ ID NO: 3080688 - RNA, 23 nt, Mycobacterium bovis subsp bovis AF2122/97
uuccggccgacacgccgaugccg

SEQ ID NO: 3080689 - RNA, 11 nt, Mycobacterium bovis subsp bovis AF2122/97
uuccggccgau

SEQ ID NO: 3080690 - RNA, 13 nt, Mycobacterium bovis subsp bovis AF2122/97
uuccggcgcggcc

SEQ ID NO: 3080691 - RNA, 19 nt, Mycobacterium bovis subsp bovis AF2122/97
uuccggcucaccgaucccg

SEQ ID NO: 3080692 - RNA, 19 nt, Mycobacterium bovis subsp bovis AF2122/97
uuccgggacuaccacccgc

SEQ ID NO: 3080693 - RNA, 22 nt, Mycobacterium bovis subsp bovis AF2122/97
uuccgggcgaccaacacgucga

SEQ ID NO: 3080694 - RNA, 13 nt, Mycobacterium bovis subsp bovis AF2122/97
uuccgggcgcgug

SEQ ID NO: 3080695 - RNA, 16 nt, Mycobacterium bovis subsp bovis AF2122/97
uuccgguccagcggcc

SEQ ID NO: 3080696 - RNA, 19 nt, Mycobacterium bovis subsp bovis AF2122/97
uuccgguccagcggccgcc

SEQ ID NO: 3080697 - RNA, 19 nt, Mycobacterium bovis subsp bovis AF2122/97
uuccggugccgggaugccg

SEQ ID NO: 3080698 - RNA, 19 nt, Mycobacterium bovis subsp bovis AF2122/97
uuccgucugacccaccgcc

SEQ ID NO: 3080699 - RNA, 15 nt, Mycobacterium bovis subsp bovis AF2122/97
uuccguuaggcucca

SEQ ID NO: 3080700 - RNA, 15 nt, Mycobacterium bovis subsp bovis AF2122/97
uuccuccgacgcgau

SEQ ID NO: 3080701 - RNA, 13 nt, Mycobacterium bovis subsp bovis AF2122/97
uuccucgaccgcu

SEQ ID NO: 3080702 - RNA, 22 nt, Mycobacterium bovis subsp bovis AF2122/97
uuccucggauugcagcgcgaug

SEQ ID NO: 3080703 - RNA, 20 nt, Mycobacterium bovis subsp bovis AF2122/97
uuccucguaggcguacacca

SEQ ID NO: 3080704 - RNA, 15 nt, Mycobacterium bovis subsp bovis AF2122/97
uuccucgucaccgcg

SEQ ID NO: 3080705 - RNA, 16 nt, Mycobacterium bovis subsp bovis AF2122/97
uuccugaggguuucca

SEQ ID NO: 3080706 - RNA, 18 nt, Mycobacterium bovis subsp bovis AF2122/97
uuccugcgccgguaacug

SEQ ID NO: 3080707 - RNA, 21 nt, Mycobacterium bovis subsp bovis AF2122/97
uuccuggcgggcgccuugguc

SEQ ID NO: 3080708 - RNA, 15 nt, Mycobacterium bovis subsp bovis AF2122/97
uuccuugccaggguc

SEQ ID NO: 3080709 - RNA, 17 nt, Mycobacterium bovis subsp bovis AF2122/97
uucgaacuggcuggugg

SEQ ID NO: 3080710 - RNA, 16 nt, Mycobacterium bovis subsp bovis AF2122/97
uucgaagcgaucgccg

SEQ ID NO: 3080711 - RNA, 13 nt, Mycobacterium bovis subsp bovis AF2122/97
uucgacagcgcgc

SEQ ID NO: 3080712 - RNA, 13 nt, Mycobacterium bovis subsp bovis AF2122/97
uucgacaggccac

SEQ ID NO: 3080713 - RNA, 16 nt, Mycobacterium bovis subsp bovis AF2122/97
uucgacaggccaccgc

SEQ ID NO: 3080714 - RNA, 24 nt, Mycobacterium bovis subsp bovis AF2122/97
uucgacaggccaccgcagacgccg

SEQ ID NO: 3080715 - RNA, 17 nt, Mycobacterium bovis subsp bovis AF2122/97
uucgaccaccacccgga

SEQ ID NO: 3080716 - RNA, 14 nt, Mycobacterium bovis subsp bovis AF2122/97
uucgaccagcccgc

SEQ ID NO: 3080717 - RNA, 14 nt, Mycobacterium bovis subsp bovis AF2122/97
uucgaccuugcacc

SEQ ID NO: 3080718 - RNA, 20 nt, Mycobacterium bovis subsp bovis AF2122/97
uucgaccuugcaccggccga

SEQ ID NO: 3080719 - RNA, 21 nt, Mycobacterium bovis subsp bovis AF2122/97
uucgaccuugcaccggccgaa

SEQ ID NO: 3080720 - RNA, 21 nt, Mycobacterium bovis subsp bovis AF2122/97
uucgacgacacguugaccgug

SEQ ID NO: 3080721 - RNA, 16 nt, Mycobacterium bovis subsp bovis AF2122/97
uucgacgacagcaccg

SEQ ID NO: 3080722 - RNA, 13 nt, Mycobacterium bovis subsp bovis AF2122/97
uucgacgcggcga

SEQ ID NO: 3080723 - RNA, 18 nt, Mycobacterium bovis subsp bovis AF2122/97
uucgacggugccgucugc

SEQ ID NO: 3080724 - RNA, 16 nt, Mycobacterium bovis subsp bovis AF2122/97
uucgacgucguugccg

SEQ ID NO: 3080725 - RNA, 19 nt, Mycobacterium bovis subsp bovis AF2122/97
uucgacguuggcgugcacc

SEQ ID NO: 3080726 - RNA, 20 nt, Mycobacterium bovis subsp bovis AF2122/97
uucgagagccccgaccagca

SEQ ID NO: 3080727 - RNA, 15 nt, Mycobacterium bovis subsp bovis AF2122/97
uucgagcgcgccuuc

SEQ ID NO: 3080728 - RNA, 19 nt, Mycobacterium bovis subsp bovis AF2122/97
uucgaggaacacgaugccc

SEQ ID NO: 3080729 - RNA, 14 nt, Mycobacterium bovis subsp bovis AF2122/97
uucgagguggcugc

SEQ ID NO: 3080730 - RNA, 14 nt, Mycobacterium bovis subsp bovis AF2122/97
uucgagugcagcgg

SEQ ID NO: 3080731 - RNA, 23 nt, Mycobacterium bovis subsp bovis AF2122/97
uucgagugcggucgagagccaaa

SEQ ID NO: 3080732 - RNA, 22 nt, Mycobacterium bovis subsp bovis AF2122/97
uucgauauagccgccggugccg

SEQ ID NO: 3080733 - RNA, 13 nt, Mycobacterium bovis subsp bovis AF2122/97
uucgaucaggccu

SEQ ID NO: 3080734 - RNA, 15 nt, Mycobacterium bovis subsp bovis AF2122/97
uucgaucagucgugg

SEQ ID NO: 3080735 - RNA, 20 nt, Mycobacterium bovis subsp bovis AF2122/97
uucgaucccguccgcgccca

SEQ ID NO: 3080736 - RNA, 12 nt, Mycobacterium bovis subsp bovis AF2122/97
uucgaugguguc

SEQ ID NO: 3080737 - RNA, 20 nt, Mycobacterium bovis subsp bovis AF2122/97
uucgaugucguaccgggcga

SEQ ID NO: 3080738 - RNA, 17 nt, Mycobacterium bovis subsp bovis AF2122/97
uucgauugcgcugcacc

SEQ ID NO: 3080739 - RNA, 18 nt, Mycobacterium bovis subsp bovis AF2122/97
uucgauugcgcugcaccg

SEQ ID NO: 3080740 - RNA, 22 nt, Mycobacterium bovis subsp bovis AF2122/97
uucgcacaccuccucgaccgug

SEQ ID NO: 3080741 - RNA, 18 nt, Mycobacterium bovis subsp bovis AF2122/97
uucgcacccguucgugag

SEQ ID NO: 3080742 - RNA, 22 nt, Mycobacterium bovis subsp bovis AF2122/97
uucgcagugacguuccgcucgc

SEQ ID NO: 3080743 - RNA, 19 nt, Mycobacterium bovis subsp bovis AF2122/97
uucgcaguugaggguguga

SEQ ID NO: 3080744 - RNA, 20 nt, Mycobacterium bovis subsp bovis AF2122/97
uucgcauuggggacgcccga

SEQ ID NO: 3080745 - RNA, 14 nt, Mycobacterium bovis subsp bovis AF2122/97
uucgccaacuucaa

SEQ ID NO: 3080746 - RNA, 13 nt, Mycobacterium bovis subsp bovis AF2122/97
uucgccagcgccg

SEQ ID NO: 3080747 - RNA, 15 nt, Mycobacterium bovis subsp bovis AF2122/97
uucgccagguggccg

SEQ ID NO: 3080748 - RNA, 13 nt, Mycobacterium bovis subsp bovis AF2122/97
uucgcccgcccgu

SEQ ID NO: 3080749 - RNA, 22 nt, Mycobacterium bovis subsp bovis AF2122/97
uucgcccgcccgucuuccagcc

SEQ ID NO: 3080750 - RNA, 17 nt, Mycobacterium bovis subsp bovis AF2122/97
uucgcccggggaaccgu

SEQ ID NO: 3080751 - RNA, 14 nt, Mycobacterium bovis subsp bovis AF2122/97
uucgcccuugccgc

SEQ ID NO: 3080752 - RNA, 14 nt, Mycobacterium bovis subsp bovis AF2122/97
uucguagucucgac

SEQ ID NO: 3080753 - RNA, 21 nt, Mycobacterium bovis subsp bovis AF2122/97
uucguauggacgaggagcuca

SEQ ID NO: 3080754 - RNA, 21 nt, Mycobacterium bovis subsp bovis AF2122/97
uucgucaccacgaucgcagug

SEQ ID NO: 3080755 - RNA, 12 nt, Mycobacterium bovis subsp bovis AF2122/97
uucgucaccguu

SEQ ID NO: 3080756 - RNA, 19 nt, Mycobacterium bovis subsp bovis AF2122/97
uucguccaccgcgaugccc

SEQ ID NO: 3080757 - RNA, 15 nt, Mycobacterium bovis subsp bovis AF2122/97
uucgucgaaccuguc

SEQ ID NO: 3080758 - RNA, 16 nt, Mycobacterium bovis subsp bovis AF2122/97
uucgucgacacccgca

SEQ ID NO: 3080759 - RNA, 16 nt, Mycobacterium bovis subsp bovis AF2122/97
uucgucggagaacgcc

SEQ ID NO: 3080760 - RNA, 20 nt, Mycobacterium bovis subsp bovis AF2122/97
uucgucggagaacgcccgca

SEQ ID NO: 3080761 - RNA, 18 nt, Mycobacterium bovis subsp bovis AF2122/97
uucgucguagagauacgg

SEQ ID NO: 3080762 - RNA, 18 nt, Mycobacterium bovis subsp bovis AF2122/97
uucgucguaguccaggcc

SEQ ID NO: 3080763 - RNA, 15 nt, Mycobacterium bovis subsp bovis AF2122/97
uucgucgucgcagug

SEQ ID NO: 3080764 - RNA, 17 nt, Mycobacterium bovis subsp bovis AF2122/97
uucgucguggagcucac

SEQ ID NO: 3080765 - RNA, 20 nt, Mycobacterium bovis subsp bovis AF2122/97
uucgucguggagcucacgug

SEQ ID NO: 3080766 - RNA, 15 nt, Mycobacterium bovis subsp bovis AF2122/97
uucgugagcggccag

SEQ ID NO: 3080767 - RNA, 18 nt, Mycobacterium bovis subsp bovis AF2122/97
uucgugccggcguugccg

SEQ ID NO: 3080768 - RNA, 15 nt, Mycobacterium bovis subsp bovis AF2122/97
uucguggccuugaca

SEQ ID NO: 3080769 - RNA, 18 nt, Mycobacterium bovis subsp bovis AF2122/97
uucguggcuggcaugccg

SEQ ID NO: 3080770 - RNA, 14 nt, Mycobacterium bovis subsp bovis AF2122/97
uucguugagaacau

SEQ ID NO: 3080771 - RNA, 22 nt, Mycobacterium bovis subsp bovis AF2122/97
uucuaacggucagcuugucagc

SEQ ID NO: 3080772 - RNA, 12 nt, Mycobacterium bovis subsp bovis AF2122/97
uucuagcccguu

SEQ ID NO: 3080773 - RNA, 14 nt, Mycobacterium bovis subsp bovis AF2122/97
uucuccagcucgaa

SEQ ID NO: 3080774 - RNA, 20 nt, Mycobacterium bovis subsp bovis AF2122/97
uucuccccgcuagcccacca

SEQ ID NO: 3080775 - RNA, 21 nt, Mycobacterium bovis subsp bovis AF2122/97
uucuccucgucgcgggcgaug

SEQ ID NO: 3080776 - RNA, 16 nt, Mycobacterium bovis subsp bovis AF2122/97
uucuccucgugcagca

SEQ ID NO: 3080777 - RNA, 12 nt, Mycobacterium bovis subsp bovis AF2122/97
uucucgcuguug

SEQ ID NO: 3080778 - RNA, 23 nt, Mycobacterium bovis subsp bovis AF2122/97
uucucgcuguugaagccgcccga

SEQ ID NO: 3080779 - RNA, 15 nt, Mycobacterium bovis subsp bovis AF2122/97
uucucggccggcggc

SEQ ID NO: 3080780 - RNA, 23 nt, Mycobacterium bovis subsp bovis AF2122/97
uucugacgaccggcuaccggcgu

SEQ ID NO: 3080781 - RNA, 16 nt, Mycobacterium bovis subsp bovis AF2122/97
uucugacggcuugcgu

SEQ ID NO: 3080782 - RNA, 14 nt, Mycobacterium bovis subsp bovis AF2122/97
uucugcagcgucuc

SEQ ID NO: 3080783 - RNA, 21 nt, Mycobacterium bovis subsp bovis AF2122/97
uucugccaucaacaggccucg

SEQ ID NO: 3080784 - RNA, 16 nt, Mycobacterium bovis subsp bovis AF2122/97
uucugcgcccacccgc

SEQ ID NO: 3080785 - RNA, 21 nt, Mycobacterium bovis subsp bovis AF2122/97
uucugcggucaauguggcgcu

SEQ ID NO: 3080786 - RNA, 13 nt, Mycobacterium bovis subsp bovis AF2122/97
uucuggaaccccg

SEQ ID NO: 3080787 - RNA, 14 nt, Mycobacterium bovis subsp bovis AF2122/97
uucugguccagcac

SEQ ID NO: 3080788 - RNA, 15 nt, Mycobacterium bovis subsp bovis AF2122/97
uucuggucgcguacc

SEQ ID NO: 3080789 - RNA, 22 nt, Mycobacterium bovis subsp bovis AF2122/97
uucuguaccggcugguugaccg

SEQ ID NO: 3080790 - RNA, 21 nt, Mycobacterium bovis subsp bovis AF2122/97
uucugugucugcucgcgccgc

SEQ ID NO: 3080791 - RNA, 24 nt, Mycobacterium bovis subsp bovis AF2122/97
uucuguuccagaaggccgcaccgc

SEQ ID NO: 3080792 - RNA, 13 nt, Mycobacterium bovis subsp bovis AF2122/97
uucuucagcagcg

SEQ ID NO: 3080793 - RNA, 18 nt, Mycobacterium bovis subsp bovis AF2122/97
uucuuccgcgcgccggcg

SEQ ID NO: 3080794 - RNA, 24 nt, Mycobacterium bovis subsp bovis AF2122/97
uucuucgcgaagaacgacgccacc

SEQ ID NO: 3080795 - RNA, 15 nt, Mycobacterium bovis subsp bovis AF2122/97
uucuucggccagcuc

SEQ ID NO: 3080796 - RNA, 17 nt, Mycobacterium bovis subsp bovis AF2122/97
uucuucggccagcuccc

SEQ ID NO: 3080797 - RNA, 20 nt, Mycobacterium bovis subsp bovis AF2122/97
uucuucuccaccaccgucga

SEQ ID NO: 3080798 - RNA, 15 nt, Mycobacterium bovis subsp bovis AF2122/97
uucuugaccgcggug

SEQ ID NO: 3080799 - RNA, 15 nt, Mycobacterium bovis subsp bovis AF2122/97
uucuugacgccgaug

SEQ ID NO: 3080800 - RNA, 21 nt, Mycobacterium bovis subsp bovis AF2122/97
uucuuggcaggugccuucuuc

SEQ ID NO: 3080801 - RNA, 21 nt, Mycobacterium bovis subsp bovis AF2122/97
uucuuggcgggcgccuugguc

SEQ ID NO: 3080802 - RNA, 16 nt, Mycobacterium bovis subsp bovis AF2122/97
uucuuggcgucuugga

SEQ ID NO: 3080803 - RNA, 15 nt, Mycobacterium bovis subsp bovis AF2122/97
uucuuuaaaccccug

SEQ ID NO: 3080804 - RNA, 14 nt, Mycobacterium bovis subsp bovis AF2122/97
uucuuuugcgucug

SEQ ID NO: 3080805 - RNA, 16 nt, Mycobacterium bovis subsp bovis AF2122/97
uugaaauugaugaucu

SEQ ID NO: 3080806 - RNA, 22 nt, Mycobacterium bovis subsp bovis AF2122/97
uugaacaugggaugcucaccgg

SEQ ID NO: 3080807 - RNA, 20 nt, Mycobacterium bovis subsp bovis AF2122/97
uugaaccgguacaaccccca

SEQ ID NO: 3080808 - RNA, 19 nt, Mycobacterium bovis subsp bovis AF2122/97
uugaacgcccgcuucagca

SEQ ID NO: 3080809 - RNA, 14 nt, Mycobacterium bovis subsp bovis AF2122/97
uugaacgccgccag

SEQ ID NO: 3080810 - RNA, 15 nt, Mycobacterium bovis subsp bovis AF2122/97
uugaacucuggugac

SEQ ID NO: 3080811 - RNA, 13 nt, Mycobacterium bovis subsp bovis AF2122/97
uugaagaagcccg

SEQ ID NO: 3080812 - RNA, 18 nt, Mycobacterium bovis subsp bovis AF2122/97
uugaagaauuucggcgcc

SEQ ID NO: 3080813 - RNA, 14 nt, Mycobacterium bovis subsp bovis AF2122/97
uugaagaggcgcac

SEQ ID NO: 3080814 - RNA, 14 nt, Mycobacterium bovis subsp bovis AF2122/97
uugaagccgcccga

SEQ ID NO: 3080815 - RNA, 17 nt, Mycobacterium bovis subsp bovis AF2122/97
uugaaggcuugugccag

SEQ ID NO: 3080816 - RNA, 17 nt, Mycobacterium bovis subsp bovis AF2122/97
uugacaacccuguuguu

SEQ ID NO: 3080817 - RNA, 20 nt, Mycobacterium bovis subsp bovis AF2122/97
uugaccaaugugccggucac

SEQ ID NO: 3080818 - RNA, 18 nt, Mycobacterium bovis subsp bovis AF2122/97
uugaccacagcggagacg

SEQ ID NO: 3080819 - RNA, 12 nt, Mycobacterium bovis subsp bovis AF2122/97
uugaccaggcuc

SEQ ID NO: 3080820 - RNA, 22 nt, Mycobacterium bovis subsp bovis AF2122/97
uugaccccuggccgccggcgcc

SEQ ID NO: 3080821 - RNA, 23 nt, Mycobacterium bovis subsp bovis AF2122/97
uugaccccuggccgccggcgccg

SEQ ID NO: 3080822 - RNA, 17 nt, Mycobacterium bovis subsp bovis AF2122/97
uugacccgacgaugccg

SEQ ID NO: 3080823 - RNA, 14 nt, Mycobacterium bovis subsp bovis AF2122/97
uugacccggggacg

SEQ ID NO: 3080824 - RNA, 15 nt, Mycobacterium bovis subsp bovis AF2122/97
uugaccgauacgcgg

SEQ ID NO: 3080825 - RNA, 18 nt, Mycobacterium bovis subsp bovis AF2122/97
uugaccgggucgaugacg

SEQ ID NO: 3080826 - RNA, 21 nt, Mycobacterium bovis subsp bovis AF2122/97
uugaccuucgacaaguccgcg

SEQ ID NO: 3080827 - RNA, 18 nt, Mycobacterium bovis subsp bovis AF2122/97
uugaccuucucgucggcc

SEQ ID NO: 3080828 - RNA, 17 nt, Mycobacterium bovis subsp bovis AF2122/97
uugacgaacccaccgug

SEQ ID NO: 3080829 - RNA, 17 nt, Mycobacterium bovis subsp bovis AF2122/97
uugacgacaaacggcga

SEQ ID NO: 3080830 - RNA, 19 nt, Mycobacterium bovis subsp bovis AF2122/97
uugacgacaaacggcgacc

SEQ ID NO: 3080831 - RNA, 22 nt, Mycobacterium bovis subsp bovis AF2122/97
uugacgagacgacgaccggcua

SEQ ID NO: 3080832 - RNA, 17 nt, Mycobacterium bovis subsp bovis AF2122/97
uugacggucagccgcgg

SEQ ID NO: 3080833 - RNA, 19 nt, Mycobacterium bovis subsp bovis AF2122/97
uugacgguugccccggcga

SEQ ID NO: 3080834 - RNA, 21 nt, Mycobacterium bovis subsp bovis AF2122/97
uugacguagaccgucgauccg

SEQ ID NO: 3080835 - RNA, 20 nt, Mycobacterium bovis subsp bovis AF2122/97
uugacgucgagcagcgccac

SEQ ID NO: 3080836 - RNA, 21 nt, Mycobacterium bovis subsp bovis AF2122/97
uugacgugugagggccgggug

SEQ ID NO: 3080837 - RNA, 18 nt, Mycobacterium bovis subsp bovis AF2122/97
uugacucugcguccaccg

SEQ ID NO: 3080838 - RNA, 20 nt, Mycobacterium bovis subsp bovis AF2122/97
uugccgccggccccgccagc

SEQ ID NO: 3080839 - RNA, 23 nt, Mycobacterium bovis subsp bovis AF2122/97
uugccgccggccccgccagcgcc

SEQ ID NO: 3080840 - RNA, 23 nt, Mycobacterium bovis subsp bovis AF2122/97
uugccgccggccccgccgucgcc

SEQ ID NO: 3080841 - RNA, 20 nt, Mycobacterium bovis subsp bovis AF2122/97
uugccgccggcgccgccggc

SEQ ID NO: 3080842 - RNA, 21 nt, Mycobacterium bovis subsp bovis AF2122/97
uugccgccggcgccgccggcg

SEQ ID NO: 3080843 - RNA, 12 nt, Mycobacterium bovis subsp bovis AF2122/97
uugccgccggug

SEQ ID NO: 3080844 - RNA, 15 nt, Mycobacterium bovis subsp bovis AF2122/97
uugccgccggugccg

SEQ ID NO: 3080845 - RNA, 10 nt, Mycobacterium bovis subsp bovis AF2122/97
uugccgccgu

SEQ ID NO: 3080846 - RNA, 11 nt, Mycobacterium bovis subsp bovis AF2122/97
uugccgccguc

SEQ ID NO: 3080847 - RNA, 13 nt, Mycobacterium bovis subsp bovis AF2122/97
uugccgccguccc

SEQ ID NO: 3080848 - RNA, 14 nt, Mycobacterium bovis subsp bovis AF2122/97
uugccgccgucgcc

SEQ ID NO: 3080849 - RNA, 20 nt, Mycobacterium bovis subsp bovis AF2122/97
uugccgccgucgccgccgcu

SEQ ID NO: 3080850 - RNA, 23 nt, Mycobacterium bovis subsp bovis AF2122/97
uugccgccgucgccgccguugcc

SEQ ID NO: 3080851 - RNA, 11 nt, Mycobacterium bovis subsp bovis AF2122/97
uugccgccguu

SEQ ID NO: 3080852 - RNA, 18 nt, Mycobacterium bovis subsp bovis AF2122/97
uugccgccguuaccgccg

SEQ ID NO: 3080853 - RNA, 19 nt, Mycobacterium bovis subsp bovis AF2122/97
uugccgccguuaccgccgc

SEQ ID NO: 3080854 - RNA, 20 nt, Mycobacterium bovis subsp bovis AF2122/97
uugccgccguuaccgccgcu

SEQ ID NO: 3080855 - RNA, 15 nt, Mycobacterium bovis subsp bovis AF2122/97
uugccgccguugccg

SEQ ID NO: 3080856 - RNA, 21 nt, Mycobacterium bovis subsp bovis AF2122/97
uugccgccugguaccgcggug

SEQ ID NO: 3080857 - RNA, 21 nt, Mycobacterium bovis subsp bovis AF2122/97
uugccgccugucccgccggcc

SEQ ID NO: 3080858 - RNA, 15 nt, Mycobacterium bovis subsp bovis AF2122/97
uugccgccuuggccc

SEQ ID NO: 3080859 - RNA, 14 nt, Mycobacterium bovis subsp bovis AF2122/97
uugccgccuuugcc

SEQ ID NO: 3080860 - RNA, 20 nt, Mycobacterium bovis subsp bovis AF2122/97
uugccggacaaccuggggcc

SEQ ID NO: 3080861 - RNA, 17 nt, Mycobacterium bovis subsp bovis AF2122/97
uugccggagacgucgcc

SEQ ID NO: 3080862 - RNA, 13 nt, Mycobacterium bovis subsp bovis AF2122/97
uugccggcguugc

SEQ ID NO: 3080863 - RNA, 17 nt, Mycobacterium bovis subsp bovis AF2122/97
uugccggcuucggcgag

SEQ ID NO: 3080864 - RNA, 19 nt, Mycobacterium bovis subsp bovis AF2122/97
uugccgggcgcacgcccgc

SEQ ID NO: 3080865 - RNA, 23 nt, Mycobacterium bovis subsp bovis AF2122/97
uugccgggcgcuggacggcgggc

SEQ ID NO: 3080866 - RNA, 16 nt, Mycobacterium bovis subsp bovis AF2122/97
uugccggugccgccgc

SEQ ID NO: 3080867 - RNA, 20 nt, Mycobacterium bovis subsp bovis AF2122/97
uugccggugccgccgcggcc

SEQ ID NO: 3080868 - RNA, 15 nt, Mycobacterium bovis subsp bovis AF2122/97
uugccgucugcgguc

SEQ ID NO: 3080869 - RNA, 20 nt, Mycobacterium bovis subsp bovis AF2122/97
uugccguuaccgccaaacgc

SEQ ID NO: 3080870 - RNA, 16 nt, Mycobacterium bovis subsp bovis AF2122/97
uugccucccuuuucca

SEQ ID NO: 3080871 - RNA, 14 nt, Mycobacterium bovis subsp bovis AF2122/97
uugccugccgcgca

SEQ ID NO: 3080872 - RNA, 21 nt, Mycobacterium bovis subsp bovis AF2122/97
uugccuucuuggcgggagccu

SEQ ID NO: 3080873 - RNA, 17 nt, Mycobacterium bovis subsp bovis AF2122/97
uugccuuguuccagcgc

SEQ ID NO: 3080874 - RNA, 19 nt, Mycobacterium bovis subsp bovis AF2122/97
uugcgaaacgaauccgcca

SEQ ID NO: 3080875 - RNA, 12 nt, Mycobacterium bovis subsp bovis AF2122/97
uugcgaagccca

SEQ ID NO: 3080876 - RNA, 13 nt, Mycobacterium bovis subsp bovis AF2122/97
uugcgaagcccac

SEQ ID NO: 3080877 - RNA, 17 nt, Mycobacterium bovis subsp bovis AF2122/97
uugcgaucugcggcgcc

SEQ ID NO: 3080878 - RNA, 22 nt, Mycobacterium bovis subsp bovis AF2122/97
uugcgaugcccacggugccggc

SEQ ID NO: 3080879 - RNA, 21 nt, Mycobacterium bovis subsp bovis AF2122/97
uugcgcaaauaggacugcgcc

SEQ ID NO: 3080880 - RNA, 13 nt, Mycobacterium bovis subsp bovis AF2122/97
uugcgcagcagcg

SEQ ID NO: 3080881 - RNA, 14 nt, Mycobacterium bovis subsp bovis AF2122/97
uugcgcagccgcag

SEQ ID NO: 3080882 - RNA, 23 nt, Mycobacterium bovis subsp bovis AF2122/97
uugcgcaggauguucaaucccuc

SEQ ID NO: 3080883 - RNA, 19 nt, Mycobacterium bovis subsp bovis AF2122/97
uugcgccaggagcgcggcc

SEQ ID NO: 3080884 - RNA, 16 nt, Mycobacterium bovis subsp bovis AF2122/97
uugcgcccagcgaccc

SEQ ID NO: 3080885 - RNA, 19 nt, Mycobacterium bovis subsp bovis AF2122/97
uugcgccggaugacaccga

SEQ ID NO: 3080886 - RNA, 15 nt, Mycobacterium bovis subsp bovis AF2122/97
uugcgcgcugagcuc

SEQ ID NO: 3080887 - RNA, 16 nt, Mycobacterium bovis subsp bovis AF2122/97
uugcgcggcaguggcc

SEQ ID NO: 3080888 - RNA, 19 nt, Mycobacterium bovis subsp bovis AF2122/97
uugcgcggcaguggccaga

SEQ ID NO: 3080889 - RNA, 18 nt, Mycobacterium bovis subsp bovis AF2122/97
uugcgcggcaucccgcca

SEQ ID NO: 3080890 - RNA, 21 nt, Mycobacterium bovis subsp bovis AF2122/97
uugcgcuacuacugcaguccc

SEQ ID NO: 3080891 - RNA, 19 nt, Mycobacterium bovis subsp bovis AF2122/97
uugcgcucguugguucagc

SEQ ID NO: 3080892 - RNA, 12 nt, Mycobacterium bovis subsp bovis AF2122/97
uugcgcuuguug

SEQ ID NO: 3080893 - RNA, 19 nt, Mycobacterium bovis subsp bovis AF2122/97
uugcggaaacccggccgcc

SEQ ID NO: 3080894 - RNA, 11 nt, Mycobacterium bovis subsp bovis AF2122/97
uugcggcccgg

SEQ ID NO: 3080895 - RNA, 21 nt, Mycobacterium bovis subsp bovis AF2122/97
uugcggcccgggaggcguugc

SEQ ID NO: 3080896 - RNA, 14 nt, Mycobacterium bovis subsp bovis AF2122/97
uugcggccgccggg

SEQ ID NO: 3080897 - RNA, 19 nt, Mycobacterium bovis subsp bovis AF2122/97
uugcgggacuagguccgau

SEQ ID NO: 3080898 - RNA, 13 nt, Mycobacterium bovis subsp bovis AF2122/97
uugcgggcgugga

SEQ ID NO: 3080899 - RNA, 23 nt, Mycobacterium bovis subsp bovis AF2122/97
uugcgggggaguaguggugggcg

SEQ ID NO: 3080900 - RNA, 17 nt, Mycobacterium bovis subsp bovis AF2122/97
uugcggucaucggcgcc

SEQ ID NO: 3080901 - RNA, 14 nt, Mycobacterium bovis subsp bovis AF2122/97
uugcgguucgaacg

SEQ ID NO: 3080902 - RNA, 15 nt, Mycobacterium bovis subsp bovis AF2122/97
uugcguccauccgca

SEQ ID NO: 3080903 - RNA, 16 nt, Mycobacterium bovis subsp bovis AF2122/97
uugcguccauccgcag

SEQ ID NO: 3080904 - RNA, 24 nt, Mycobacterium bovis subsp bovis AF2122/97
uugcgucguggggaccggcaggcc

SEQ ID NO: 3080905 - RNA, 18 nt, Mycobacterium bovis subsp bovis AF2122/97
uugcgucugcucggcggc

SEQ ID NO: 3080906 - RNA, 23 nt, Mycobacterium bovis subsp bovis AF2122/97
uugcguuccaguccccgccggcc

SEQ ID NO: 3080907 - RNA, 23 nt, Mycobacterium bovis subsp bovis AF2122/97
uugcguucggucagugggacggg

SEQ ID NO: 3080908 - RNA, 16 nt, Mycobacterium bovis subsp bovis AF2122/97
uugcucagccggcccu

SEQ ID NO: 3080909 - RNA, 23 nt, Mycobacterium bovis subsp bovis AF2122/97
uugcuccuggacuuccgguucau

SEQ ID NO: 3080910 - RNA, 20 nt, Mycobacterium bovis subsp bovis AF2122/97
uugcucgacgaucugcagca

SEQ ID NO: 3080911 - RNA, 23 nt, Mycobacterium bovis subsp bovis AF2122/97
uugcucgaucugucgcgccggug

SEQ ID NO: 3080912 - RNA, 23 nt, Mycobacterium bovis subsp bovis AF2122/97
uugcucggugaugcccagcgccg

SEQ ID NO: 3080913 - RNA, 22 nt, Mycobacterium bovis subsp bovis AF2122/97
uugcugaucagagcguucuuca

SEQ ID NO: 3080914 - RNA, 20 nt, Mycobacterium bovis subsp bovis AF2122/97
uugcugcggcuuucagcgcu

SEQ ID NO: 3080915 - RNA, 14 nt, Mycobacterium bovis subsp bovis AF2122/97
uugcuugcagggcc

SEQ ID NO: 3080916 - RNA, 23 nt, Mycobacterium bovis subsp bovis AF2122/97
uuggaacuuguugacgaacccac

SEQ ID NO: 3080917 - RNA, 21 nt, Mycobacterium bovis subsp bovis AF2122/97
uuggaagucccgccguugccg

SEQ ID NO: 3080918 - RNA, 20 nt, Mycobacterium bovis subsp bovis AF2122/97
uuggacacucccgggugcga

SEQ ID NO: 3080919 - RNA, 18 nt, Mycobacterium bovis subsp bovis AF2122/97
uuggaccgagacuugcug

SEQ ID NO: 3080920 - RNA, 15 nt, Mycobacterium bovis subsp bovis AF2122/97
uuggcagcccucugg

SEQ ID NO: 3080921 - RNA, 16 nt, Mycobacterium bovis subsp bovis AF2122/97
uuggcaugccgcccgc

SEQ ID NO: 3080922 - RNA, 23 nt, Mycobacterium bovis subsp bovis AF2122/97
uuggccaaccccauggccagcgc

SEQ ID NO: 3080923 - RNA, 17 nt, Mycobacterium bovis subsp bovis AF2122/97
uuggccaccaucgccgc

SEQ ID NO: 3080924 - RNA, 14 nt, Mycobacterium bovis subsp bovis AF2122/97
uuguaggagaacgu

SEQ ID NO: 3080925 - RNA, 18 nt, Mycobacterium bovis subsp bovis AF2122/97
uuguaugcugcgcgccgu

SEQ ID NO: 3080926 - RNA, 12 nt, Mycobacterium bovis subsp bovis AF2122/97
uugucaaccaau

SEQ ID NO: 3080927 - RNA, 13 nt, Mycobacterium bovis subsp bovis AF2122/97
uuguccagcgucu

SEQ ID NO: 3080928 - RNA, 16 nt, Mycobacterium bovis subsp bovis AF2122/97
uuguccagggugguca

SEQ ID NO: 3080929 - RNA, 22 nt, Mycobacterium bovis subsp bovis AF2122/97
uugucccuauaccgcuggggcu

SEQ ID NO: 3080930 - RNA, 17 nt, Mycobacterium bovis subsp bovis AF2122/97
uuguccggugguggcga

SEQ ID NO: 3080931 - RNA, 22 nt, Mycobacterium bovis subsp bovis AF2122/97
uuguccgguuacuuuucgagug

SEQ ID NO: 3080932 - RNA, 18 nt, Mycobacterium bovis subsp bovis AF2122/97
uuguccuaauucggggcc

SEQ ID NO: 3080933 - RNA, 22 nt, Mycobacterium bovis subsp bovis AF2122/97
uugucgagcaggcccaacgcga

SEQ ID NO: 3080934 - RNA, 23 nt, Mycobacterium bovis subsp bovis AF2122/97
uugucgaucugcccccgccggcc

SEQ ID NO: 3080935 - RNA, 23 nt, Mycobacterium bovis subsp bovis AF2122/97
uugucgccggcauacaccgugac

SEQ ID NO: 3080936 - RNA, 13 nt, Mycobacterium bovis subsp bovis AF2122/97
uugucgcgcagca

SEQ ID NO: 3080937 - RNA, 19 nt, Mycobacterium bovis subsp bovis AF2122/97
uugucggagcuagacccgu

SEQ ID NO: 3080938 - RNA, 17 nt, Mycobacterium bovis subsp bovis AF2122/97
uugucggccccggccgc

SEQ ID NO: 3080939 - RNA, 15 nt, Mycobacterium bovis subsp bovis AF2122/97
uugucggcuggacgg

SEQ ID NO: 3080940 - RNA, 22 nt, Mycobacterium bovis subsp bovis AF2122/97
uugugaacggugucaacggcac

SEQ ID NO: 3080941 - RNA, 20 nt, Mycobacterium bovis subsp bovis AF2122/97
uugugacaccacaucgggcc

SEQ ID NO: 3080942 - RNA, 15 nt, Mycobacterium bovis subsp bovis AF2122/97
uugugaccgccgaug

SEQ ID NO: 3080943 - RNA, 22 nt, Mycobacterium bovis subsp bovis AF2122/97
uugugagcaauggcgcgaccga

SEQ ID NO: 3080944 - RNA, 15 nt, Mycobacterium bovis subsp bovis AF2122/97
uugugccuuagcugc

SEQ ID NO: 3080945 - RNA, 14 nt, Mycobacterium bovis subsp bovis AF2122/97
uuguggccagcgcu

SEQ ID NO: 3080946 - RNA, 11 nt, Mycobacterium bovis subsp bovis AF2122/97
uuguucaacuc

SEQ ID NO: 3080947 - RNA, 13 nt, Mycobacterium bovis subsp bovis AF2122/97
uuguucaccgacg

SEQ ID NO: 3080948 - RNA, 17 nt, Mycobacterium bovis subsp bovis AF2122/97
uuguuccagcgcaucga

SEQ ID NO: 3080949 - RNA, 17 nt, Mycobacterium bovis subsp bovis AF2122/97
uuguuccguccccgacg

SEQ ID NO: 3080950 - RNA, 13 nt, Mycobacterium bovis subsp bovis AF2122/97
uuguugaagcccg

SEQ ID NO: 3080951 - RNA, 21 nt, Mycobacterium bovis subsp bovis AF2122/97
uuguugaggaugacgacggug

SEQ ID NO: 3080952 - RNA, 14 nt, Mycobacterium bovis subsp bovis AF2122/97
uuguugcaggagcc

SEQ ID NO: 3080953 - RNA, 13 nt, Mycobacterium bovis subsp bovis AF2122/97
uuguugcgcgacg

SEQ ID NO: 3080954 - RNA, 13 nt, Mycobacterium bovis subsp bovis AF2122/97
uuguuggagaugu

SEQ ID NO: 3080955 - RNA, 18 nt, Mycobacterium bovis subsp bovis AF2122/97
uuguuggauccggccacc

SEQ ID NO: 3080956 - RNA, 16 nt, Mycobacterium bovis subsp bovis AF2122/97
uuguugggccgccagc

SEQ ID NO: 3080957 - RNA, 13 nt, Mycobacterium bovis subsp bovis AF2122/97
uuuagcgccgguu

SEQ ID NO: 3080958 - RNA, 16 nt, Mycobacterium bovis subsp bovis AF2122/97
uuucaccaccguggcc

SEQ ID NO: 3080959 - RNA, 12 nt, Mycobacterium bovis subsp bovis AF2122/97
uuuccagccgac

SEQ ID NO: 3080960 - RNA, 16 nt, Mycobacterium bovis subsp bovis AF2122/97
uuuccccgcccuugcc

SEQ ID NO: 3080961 - RNA, 19 nt, Mycobacterium bovis subsp bovis AF2122/97
uuuccgccgccgccgccau

SEQ ID NO: 3080962 - RNA, 19 nt, Mycobacterium bovis subsp bovis AF2122/97
uuuccgccggccaggugac

SEQ ID NO: 3080963 - RNA, 17 nt, Mycobacterium bovis subsp bovis AF2122/97
uuuccggcauugccgcc

SEQ ID NO: 3080964 - RNA, 19 nt, Mycobacterium bovis subsp bovis AF2122/97
uuuccggcauugccgccgu

SEQ ID NO: 3080965 - RNA, 14 nt, Mycobacterium bovis subsp bovis AF2122/97
uuuccuugcgcgcc

SEQ ID NO: 3080966 - RNA, 16 nt, Mycobacterium bovis subsp bovis AF2122/97
uuuccuugcgcgccau

SEQ ID NO: 3080967 - RNA, 21 nt, Mycobacterium bovis subsp bovis AF2122/97
uuuccuugcgcgccauuggcg

SEQ ID NO: 3080968 - RNA, 19 nt, Mycobacterium bovis subsp bovis AF2122/97
uuucgaagaacguucacgc

SEQ ID NO: 3080969 - RNA, 18 nt, Mycobacterium bovis subsp bovis AF2122/97
uuucgauauagccgccgg

SEQ ID NO: 3080970 - RNA, 24 nt, Mycobacterium bovis subsp bovis AF2122/97
uuucgaugaugggcgguuccacgc

SEQ ID NO: 3080971 - RNA, 20 nt, Mycobacterium bovis subsp bovis AF2122/97
uuucgccagcugacacccgc

SEQ ID NO: 3080972 - RNA, 17 nt, Mycobacterium bovis subsp bovis AF2122/97
uuucgccgugaugaugu

SEQ ID NO: 3080973 - RNA, 21 nt, Mycobacterium bovis subsp bovis AF2122/97
uuucggaugcaacccggugau

SEQ ID NO: 3080974 - RNA, 18 nt, Mycobacterium bovis subsp bovis AF2122/97
uuucgugccaugguugau

SEQ ID NO: 3080975 - RNA, 15 nt, Mycobacterium bovis subsp bovis AF2122/97
uuucuccgccgccca

SEQ ID NO: 3080976 - RNA, 20 nt, Mycobacterium bovis subsp bovis AF2122/97
uuucugggccgcuccaccac

SEQ ID NO: 3080977 - RNA, 16 nt, Mycobacterium bovis subsp bovis AF2122/97
uuugaccaccugguuu

SEQ ID NO: 3080978 - RNA, 15 nt, Mycobacterium bovis subsp bovis AF2122/97
uuugacgggauagcc

SEQ ID NO: 3080979 - RNA, 13 nt, Mycobacterium bovis subsp bovis AF2122/97
uuugagaacaacg

SEQ ID NO: 3080980 - RNA, 14 nt, Mycobacterium bovis subsp bovis AF2122/97
uuugagaccccaac

SEQ ID NO: 3080981 - RNA, 20 nt, Mycobacterium bovis subsp bovis AF2122/97
uuugagcagaaggccagcga

SEQ ID NO: 3080982 - RNA, 14 nt, Mycobacterium bovis subsp bovis AF2122/97
uuugagcgcacuca

SEQ ID NO: 3080983 - RNA, 13 nt, Mycobacterium bovis subsp bovis AF2122/97
uuugagcggccac

SEQ ID NO: 3080984 - RNA, 19 nt, Mycobacterium bovis subsp bovis AF2122/97
uuugaggaccuugccggug

SEQ ID NO: 3080985 - RNA, 15 nt, Mycobacterium bovis subsp bovis AF2122/97
uuugauaggcgcgca

SEQ ID NO: 3080986 - RNA, 14 nt, Mycobacterium bovis subsp bovis AF2122/97
uuugaucaccgugg

SEQ ID NO: 3080987 - RNA, 17 nt, Mycobacterium bovis subsp bovis AF2122/97
uuugauccuggcucagg

SEQ ID NO: 3080988 - RNA, 16 nt, Mycobacterium bovis subsp bovis AF2122/97
uuugcacucgucggug

SEQ ID NO: 3080989 - RNA, 18 nt, Mycobacterium bovis subsp bovis AF2122/97
uuugcagccuucgacgca

SEQ ID NO: 3080990 - RNA, 20 nt, Mycobacterium bovis subsp bovis AF2122/97
uuugcaggcccgaguuguug

SEQ ID NO: 3080991 - RNA, 16 nt, Mycobacterium bovis subsp bovis AF2122/97
uuugccaucgggaccg

SEQ ID NO: 3080992 - RNA, 13 nt, Mycobacterium bovis subsp bovis AF2122/97
uuugcccccggug

SEQ ID NO: 3080993 - RNA, 11 nt, Mycobacterium bovis subsp bovis AF2122/97
uuugccggcuu

SEQ ID NO: 3080994 - RNA, 21 nt, Mycobacterium bovis subsp bovis AF2122/97
uuugcgaugcccacggugccg

SEQ ID NO: 3080995 - RNA, 19 nt, Mycobacterium bovis subsp bovis AF2122/97
uuugcgucugcucgccagg

SEQ ID NO: 3080996 - RNA, 23 nt, Mycobacterium bovis subsp bovis AF2122/97
uuugcuucucccgccacugcugg

SEQ ID NO: 3080997 - RNA, 19 nt, Mycobacterium bovis subsp bovis AF2122/97
uuuggcaacauccuccggg

SEQ ID NO: 3080998 - RNA, 12 nt, Mycobacterium bovis subsp bovis AF2122/97
uuuggccgccgu

SEQ ID NO: 3080999 - RNA, 17 nt, Mycobacterium bovis subsp bovis AF2122/97
uuuggcgacgucgacaa

SEQ ID NO: 3081000 - RNA, 21 nt, Mycobacterium bovis subsp bovis AF2122/97
uuuggcggcgcgcagcuugga

SEQ ID NO: 3081001 - RNA, 14 nt, Mycobacterium bovis subsp bovis AF2122/97
uuugggucggcgau

SEQ ID NO: 3081002 - RNA, 17 nt, Mycobacterium bovis subsp bovis AF2122/97
uuuggguucgucgacac

SEQ ID NO: 3081003 - RNA, 13 nt, Mycobacterium bovis subsp bovis AF2122/97
uuuggguuuuguu

SEQ ID NO: 3081004 - RNA, 23 nt, Mycobacterium bovis subsp bovis AF2122/97
uuuggugguuucacauuuuuguu

SEQ ID NO: 3081005 - RNA, 22 nt, Mycobacterium bovis subsp bovis AF2122/97
uuugguugcccgcauugccaac

SEQ ID NO: 3081006 - RNA, 14 nt, Mycobacterium bovis subsp bovis AF2122/97
uuugucgccuucuu

SEQ ID NO: 3081007 - RNA, 15 nt, Mycobacterium bovis subsp bovis AF2122/97
uuugucgccuucuug

SEQ ID NO: 3081008 - RNA, 16 nt, Mycobacterium bovis subsp bovis AF2122/97
uuugucgccuucuugg

SEQ ID NO: 3081009 - RNA, 13 nt, Mycobacterium bovis subsp bovis AF2122/97
uuugugucugcuc

SEQ ID NO: 3081010 - RNA, 20 nt, Mycobacterium bovis subsp bovis AF2122/97
uuuucccgucgccgcccgug

SEQ ID NO: 3081011 - RNA, 15 nt, Mycobacterium bovis subsp bovis AF2122/97
aaaaaccacccccac

SEQ ID NO: 3081012 - RNA, 20 nt, Mycobacterium bovis subsp bovis AF2122/97
aaaaaccucgacgcccgccc

SEQ ID NO: 3081013 - RNA, 14 nt, Mycobacterium bovis subsp bovis AF2122/97
aaaaagcccagcga

SEQ ID NO: 3081014 - RNA, 22 nt, Mycobacterium bovis subsp bovis AF2122/97
aaaaaggcggcguuguccccca

SEQ ID NO: 3081015 - RNA, 21 nt, Mycobacterium bovis subsp bovis AF2122/97
aaaacccggaaucgucgcggc

SEQ ID NO: 3081016 - RNA, 19 nt, Mycobacterium bovis subsp bovis AF2122/97
aaaaccgcaccgucccagu

SEQ ID NO: 3081017 - RNA, 14 nt, Mycobacterium bovis subsp bovis AF2122/97
aaaaccgccgcaac

SEQ ID NO: 3081018 - RNA, 12 nt, Mycobacterium bovis subsp bovis AF2122/97
aaaaccgcgaac

SEQ ID NO: 3081019 - RNA, 14 nt, Mycobacterium bovis subsp bovis AF2122/97
aaaacgcccggcac

SEQ ID NO: 3081020 - RNA, 17 nt, Mycobacterium bovis subsp bovis AF2122/97
aaaacgcccggcacacg

SEQ ID NO: 3081021 - RNA, 14 nt, Mycobacterium bovis subsp bovis AF2122/97
aaaagcaucaaagc

SEQ ID NO: 3081022 - RNA, 19 nt, Mycobacterium bovis subsp bovis AF2122/97
aaaaggaagaccucggcgu

SEQ ID NO: 3081023 - RNA, 20 nt, Mycobacterium bovis subsp bovis AF2122/97
aaaaggcgacucggugcggu

SEQ ID NO: 3081024 - RNA, 15 nt, Mycobacterium bovis subsp bovis AF2122/97
aaaaucgccaucggu

SEQ ID NO: 3081025 - RNA, 19 nt, Mycobacterium bovis subsp bovis AF2122/97
aaaaucggcaagacgcggu

SEQ ID NO: 3081026 - RNA, 20 nt, Mycobacterium bovis subsp bovis AF2122/97
aaaaugccuuggcagcccag

SEQ ID NO: 3081027 - RNA, 15 nt, Mycobacterium bovis subsp bovis AF2122/97
aaaauugcuccacca

SEQ ID NO: 3081028 - RNA, 19 nt, Mycobacterium bovis subsp bovis AF2122/97
aaaauugcuccaccacuga

SEQ ID NO: 3081029 - RNA, 18 nt, Mycobacterium bovis subsp bovis AF2122/97
aaacaaacccaacaccag

SEQ ID NO: 3081030 - RNA, 12 nt, Mycobacterium bovis subsp bovis AF2122/97
aaacaccagaca

SEQ ID NO: 3081031 - RNA, 16 nt, Mycobacterium bovis subsp bovis AF2122/97
aaacaccagcccggcg

SEQ ID NO: 3081032 - RNA, 20 nt, Mycobacterium bovis subsp bovis AF2122/97
aaacaccagcgaggccagcg

SEQ ID NO: 3081033 - RNA, 16 nt, Mycobacterium bovis subsp bovis AF2122/97
aaacacguucucacca

SEQ ID NO: 3081034 - RNA, 12 nt, Mycobacterium bovis subsp bovis AF2122/97
aaacagcaccca

SEQ ID NO: 3081035 - RNA, 23 nt, Mycobacterium bovis subsp bovis AF2122/97
aaacagcauggcgaagaacaaca

SEQ ID NO: 3081036 - RNA, 22 nt, Mycobacterium bovis subsp bovis AF2122/97
aaacagcgccaucgaugcggug

SEQ ID NO: 3081037 - RNA, 20 nt, Mycobacterium bovis subsp bovis AF2122/97
aaacagcuugcugcgcacca

SEQ ID NO: 3081038 - RNA, 16 nt, Mycobacterium bovis subsp bovis AF2122/97
aaacagguaagcagcc

SEQ ID NO: 3081039 - RNA, 18 nt, Mycobacterium bovis subsp bovis AF2122/97
aaacaucgcacccaccac

SEQ ID NO: 3081040 - RNA, 18 nt, Mycobacterium bovis subsp bovis AF2122/97
aaacaucucggcgcagcc

SEQ ID NO: 3081041 - RNA, 12 nt, Mycobacterium bovis subsp bovis AF2122/97
aaacauugcuag

SEQ ID NO: 3081042 - RNA, 13 nt, Mycobacterium bovis subsp bovis AF2122/97
aaaccaagcgcgc

SEQ ID NO: 3081043 - RNA, 13 nt, Mycobacterium bovis subsp bovis AF2122/97
aaaccacagcgcc

SEQ ID NO: 3081044 - RNA, 13 nt, Mycobacterium bovis subsp bovis AF2122/97
aaaccacccccac

SEQ ID NO: 3081045 - RNA, 17 nt, Mycobacterium bovis subsp bovis AF2122/97
aaaccacccgcaacaca

SEQ ID NO: 3081046 - RNA, 17 nt, Mycobacterium bovis subsp bovis AF2122/97
aaaccagauugccgagc

SEQ ID NO: 3081047 - RNA, 19 nt, Mycobacterium bovis subsp bovis AF2122/97
aaaccagguggccaggccg

SEQ ID NO: 3081048 - RNA, 20 nt, Mycobacterium bovis subsp bovis AF2122/97
aaacccagcgacgcggccag

SEQ ID NO: 3081049 - RNA, 14 nt, Mycobacterium bovis subsp bovis AF2122/97
aaaccccggccacc

SEQ ID NO: 3081050 - RNA, 15 nt, Mycobacterium bovis subsp bovis AF2122/97
aaaccccggccacca

SEQ ID NO: 3081051 - RNA, 18 nt, Mycobacterium bovis subsp bovis AF2122/97
aaacccgaugacuacucc

SEQ ID NO: 3081052 - RNA, 12 nt, Mycobacterium bovis subsp bovis AF2122/97
aaacccugcugc

SEQ ID NO: 3081053 - RNA, 16 nt, Mycobacterium bovis subsp bovis AF2122/97
aaaccgauaucgcugc

SEQ ID NO: 3081054 - RNA, 14 nt, Mycobacterium bovis subsp bovis AF2122/97
aaaccgcagcgcga

SEQ ID NO: 3081055 - RNA, 13 nt, Mycobacterium bovis subsp bovis AF2122/97
aaaccgcugcgcg

SEQ ID NO: 3081056 - RNA, 23 nt, Mycobacterium bovis subsp bovis AF2122/97
aaaccggcgguuuuggggugcuu

SEQ ID NO: 3081057 - RNA, 21 nt, Mycobacterium bovis subsp bovis AF2122/97
aaaccuugcggcagaccaagc

SEQ ID NO: 3081058 - RNA, 19 nt, Mycobacterium bovis subsp bovis AF2122/97
aaacgacagcccuaucagc

SEQ ID NO: 3081059 - RNA, 17 nt, Mycobacterium bovis subsp bovis AF2122/97
aaacgagccggugcgcg

SEQ ID NO: 3081060 - RNA, 17 nt, Mycobacterium bovis subsp bovis AF2122/97
aaacgauggccgggucg

SEQ ID NO: 3081061 - RNA, 16 nt, Mycobacterium bovis subsp bovis AF2122/97
aaacgccccggcgcgg

SEQ ID NO: 3081062 - RNA, 17 nt, Mycobacterium bovis subsp bovis AF2122/97
aaacgcccgcgcugccg

SEQ ID NO: 3081063 - RNA, 23 nt, Mycobacterium bovis subsp bovis AF2122/97
aaacgccggauuauucgcgguag

SEQ ID NO: 3081064 - RNA, 20 nt, Mycobacterium bovis subsp bovis AF2122/97
aaacgccgucgccugcaagc

SEQ ID NO: 3081065 - RNA, 14 nt, Mycobacterium bovis subsp bovis AF2122/97
aaacgcugcuggca

SEQ ID NO: 3081066 - RNA, 21 nt, Mycobacterium bovis subsp bovis AF2122/97
aaacgggcucuucgcagcggu

SEQ ID NO: 3081067 - RNA, 19 nt, Mycobacterium bovis subsp bovis AF2122/97
aaacuaacggcagccaccg

SEQ ID NO: 3081068 - RNA, 15 nt, Mycobacterium bovis subsp bovis AF2122/97
aaacuaauucuccug

SEQ ID NO: 3081069 - RNA, 18 nt, Mycobacterium bovis subsp bovis AF2122/97
aaacucaccagcaccccg

SEQ ID NO: 3081070 - RNA, 16 nt, Mycobacterium bovis subsp bovis AF2122/97
aaagacccggcaccca

SEQ ID NO: 3081071 - RNA, 15 nt, Mycobacterium bovis subsp bovis AF2122/97
aaagagccagcggca

SEQ ID NO: 3081072 - RNA, 23 nt, Mycobacterium bovis subsp bovis AF2122/97
aaagaucagcaugguccacagcc

SEQ ID NO: 3081073 - RNA, 13 nt, Mycobacterium bovis subsp bovis AF2122/97
aaagcagcagcgg

SEQ ID NO: 3081074 - RNA, 22 nt, Mycobacterium bovis subsp bovis AF2122/97
aaagcaucaaagcggugccauu

SEQ ID NO: 3081075 - RNA, 13 nt, Mycobacterium bovis subsp bovis AF2122/97
aaagccagcgcag

SEQ ID NO: 3081076 - RNA, 14 nt, Mycobacterium bovis subsp bovis AF2122/97
aaagcccgacacga

SEQ ID NO: 3081077 - RNA, 14 nt, Mycobacterium bovis subsp bovis AF2122/97
aaagcccgacauga

SEQ ID NO: 3081078 - RNA, 16 nt, Mycobacterium bovis subsp bovis AF2122/97
aaagcccgacaugaau

SEQ ID NO: 3081079 - RNA, 14 nt, Mycobacterium bovis subsp bovis AF2122/97
aaagccgugccagc

SEQ ID NO: 3081080 - RNA, 22 nt, Mycobacterium bovis subsp bovis AF2122/97
aaagccuaguccuggcucggca

SEQ ID NO: 3081081 - RNA, 16 nt, Mycobacterium bovis subsp bovis AF2122/97
aaagccucagccgcuc

SEQ ID NO: 3081082 - RNA, 16 nt, Mycobacterium bovis subsp bovis AF2122/97
aaagccucgguuagcu

SEQ ID NO: 3081083 - RNA, 23 nt, Mycobacterium bovis subsp bovis AF2122/97
aaagccucucuucccaaccgccc

SEQ ID NO: 3081084 - RNA, 14 nt, Mycobacterium bovis subsp bovis AF2122/97
aaagcgacagcgcg

SEQ ID NO: 3081085 - RNA, 15 nt, Mycobacterium bovis subsp bovis AF2122/97
aaagcgacgagcagc

SEQ ID NO: 3081086 - RNA, 15 nt, Mycobacterium bovis subsp bovis AF2122/97
aaaggacgucgaccu

SEQ ID NO: 3081087 - RNA, 15 nt, Mycobacterium bovis subsp bovis AF2122/97
aaaggccuugggcgg

SEQ ID NO: 3081088 - RNA, 18 nt, Mycobacterium bovis subsp bovis AF2122/97
aaaggcgacucggugcgg

SEQ ID NO: 3081089 - RNA, 21 nt, Mycobacterium bovis subsp bovis AF2122/97
aaaggucggggaacgcggcga

SEQ ID NO: 3081090 - RNA, 16 nt, Mycobacterium bovis subsp bovis AF2122/97
aaaguacgcccuggaa

SEQ ID NO: 3081091 - RNA, 22 nt, Mycobacterium bovis subsp bovis AF2122/97
aaagucaccguccacgacagca

SEQ ID NO: 3081092 - RNA, 13 nt, Mycobacterium bovis subsp bovis AF2122/97
aaaguuccacgac

SEQ ID NO: 3081093 - RNA, 20 nt, Mycobacterium bovis subsp bovis AF2122/97
aaauacaggcccggcaccgc

SEQ ID NO: 3081094 - RNA, 18 nt, Mycobacterium bovis subsp bovis AF2122/97
aaauacagggugucacgc

SEQ ID NO: 3081095 - RNA, 22 nt, Mycobacterium bovis subsp bovis AF2122/97
aaauacagggugucacgcccau

SEQ ID NO: 3081096 - RNA, 21 nt, Mycobacterium bovis subsp bovis AF2122/97
aaauacccagcgcagcagcgg

SEQ ID NO: 3081097 - RNA, 22 nt, Mycobacterium bovis subsp bovis AF2122/97
aaauacuccgcgagcccggccu

SEQ ID NO: 3081098 - RNA, 16 nt, Mycobacterium bovis subsp bovis AF2122/97
aaauagauucccggcu

SEQ ID NO: 3081099 - RNA, 13 nt, Mycobacterium bovis subsp bovis AF2122/97
aaauagcgagcgu

SEQ ID NO: 3081100 - RNA, 13 nt, Mycobacterium bovis subsp bovis AF2122/97
aaauagcugcgga

SEQ ID NO: 3081101 - RNA, 16 nt, Mycobacterium bovis subsp bovis AF2122/97
aaauaggccgggcagu

SEQ ID NO: 3081102 - RNA, 14 nt, Mycobacterium bovis subsp bovis AF2122/97
aaaucaagcacagc

SEQ ID NO: 3081103 - RNA, 19 nt, Mycobacterium bovis subsp bovis AF2122/97
aaaucagaugcgaaggcau

SEQ ID NO: 3081104 - RNA, 14 nt, Mycobacterium bovis subsp bovis AF2122/97
aaauccgcccaccg

SEQ ID NO: 3081105 - RNA, 14 nt, Mycobacterium bovis subsp bovis AF2122/97
aaauccgccgggcg

SEQ ID NO: 3081106 - RNA, 13 nt, Mycobacterium bovis subsp bovis AF2122/97
aaauccgcguggu

SEQ ID NO: 3081107 - RNA, 22 nt, Mycobacterium bovis subsp bovis AF2122/97
aaauccggggggauccagcagg

SEQ ID NO: 3081108 - RNA, 16 nt, Mycobacterium bovis subsp bovis AF2122/97
aaaucgacagcagcgc

SEQ ID NO: 3081109 - RNA, 23 nt, Mycobacterium bovis subsp bovis AF2122/97
aaaucggccagcuucccgguagc

SEQ ID NO: 3081110 - RNA, 20 nt, Mycobacterium bovis subsp bovis AF2122/97
aaaucggcggcguccagcag

SEQ ID NO: 3081111 - RNA, 21 nt, Mycobacterium bovis subsp bovis AF2122/97
aaaucggcggcguccagcagc

SEQ ID NO: 3081112 - RNA, 19 nt, Mycobacterium bovis subsp bovis AF2122/97
aaaucgucagcgccgccgg

SEQ ID NO: 3081113 - RNA, 22 nt, Mycobacterium bovis subsp bovis AF2122/97
aaaucgucgauggucuccggac

SEQ ID NO: 3081114 - RNA, 22 nt, Mycobacterium bovis subsp bovis AF2122/97
aaaugacggcugaaccugcugg

SEQ ID NO: 3081115 - RNA, 15 nt, Mycobacterium bovis subsp bovis AF2122/97
aaaugauagcggcgc

SEQ ID NO: 3081116 - RNA, 18 nt, Mycobacterium bovis subsp bovis AF2122/97
aaaugccgggcccgacgu

SEQ ID NO: 3081117 - RNA, 12 nt, Mycobacterium bovis subsp bovis AF2122/97
aaaugccggugc

SEQ ID NO: 3081118 - RNA, 23 nt, Mycobacterium bovis subsp bovis AF2122/97
aaaugccugcccaccuucgaguu

SEQ ID NO: 3081119 - RNA, 15 nt, Mycobacterium bovis subsp bovis AF2122/97
aaauggccaccggcg

SEQ ID NO: 3081120 - RNA, 20 nt, Mycobacterium bovis subsp bovis AF2122/97
aaaugggugugcugccaccg

SEQ ID NO: 3081121 - RNA, 20 nt, Mycobacterium bovis subsp bovis AF2122/97
aaauggugccguccggcgcu

SEQ ID NO: 3081122 - RNA, 21 nt, Mycobacterium bovis subsp bovis AF2122/97
aaaugguucgcacaccuccuc

SEQ ID NO: 3081123 - RNA, 13 nt, Mycobacterium bovis subsp bovis AF2122/97
aaaugucuccucc

SEQ ID NO: 3081124 - RNA, 13 nt, Mycobacterium bovis subsp bovis AF2122/97
aaauugggugccg

SEQ ID NO: 3081125 - RNA, 16 nt, Mycobacterium bovis subsp bovis AF2122/97
aacaaacccaacacca

SEQ ID NO: 3081126 - RNA, 21 nt, Mycobacterium bovis subsp bovis AF2122/97
aacaaacccaacaccagcagc

SEQ ID NO: 3081127 - RNA, 13 nt, Mycobacterium bovis subsp bovis AF2122/97
aacaaaggcuugc

SEQ ID NO: 3081128 - RNA, 14 nt, Mycobacterium bovis subsp bovis AF2122/97
aacaacaccaccag

SEQ ID NO: 3081129 - RNA, 18 nt, Mycobacterium bovis subsp bovis AF2122/97
aacaacagccgcagccag

SEQ ID NO: 3081130 - RNA, 23 nt, Mycobacterium bovis subsp bovis AF2122/97
aacaaccccgguugacucgcucc

SEQ ID NO: 3081131 - RNA, 16 nt, Mycobacterium bovis subsp bovis AF2122/97
aacaacgucugcagcc

SEQ ID NO: 3081132 - RNA, 16 nt, Mycobacterium bovis subsp bovis AF2122/97
aacaagguauggccgg

SEQ ID NO: 3081133 - RNA, 21 nt, Mycobacterium bovis subsp bovis AF2122/97
aacaagguauggccggagcgc

SEQ ID NO: 3081134 - RNA, 20 nt, Mycobacterium bovis subsp bovis AF2122/97
aacaaugccagcuguugcgg

SEQ ID NO: 3081135 - RNA, 16 nt, Mycobacterium bovis subsp bovis AF2122/97
aacaauucacgcacca

SEQ ID NO: 3081136 - RNA, 21 nt, Mycobacterium bovis subsp bovis AF2122/97
aacaauucacgcaccacaaac

SEQ ID NO: 3081137 - RNA, 18 nt, Mycobacterium bovis subsp bovis AF2122/97
aacaauuucgaccuugca

SEQ ID NO: 3081138 - RNA, 16 nt, Mycobacterium bovis subsp bovis AF2122/97
aacaauuucugcagcc

SEQ ID NO: 3081139 - RNA, 19 nt, Mycobacterium bovis subsp bovis AF2122/97
aacacaugccgcaggcucu

SEQ ID NO: 3081140 - RNA, 22 nt, Mycobacterium bovis subsp bovis AF2122/97
aacaccaaccagugcagcucga

SEQ ID NO: 3081141 - RNA, 10 nt, Mycobacterium bovis subsp bovis AF2122/97
aacaccacac

SEQ ID NO: 3081142 - RNA, 13 nt, Mycobacterium bovis subsp bovis AF2122/97
aacaccagaugca

SEQ ID NO: 3081143 - RNA, 19 nt, Mycobacterium bovis subsp bovis AF2122/97
aacaccagaugcaccucgc

SEQ ID NO: 3081144 - RNA, 21 nt, Mycobacterium bovis subsp bovis AF2122/97
aacaccagcaggcggcucaac

SEQ ID NO: 3081145 - RNA, 13 nt, Mycobacterium bovis subsp bovis AF2122/97
aacaccagcgcgu

SEQ ID NO: 3081146 - RNA, 20 nt, Mycobacterium bovis subsp bovis AF2122/97
aacaccagggccuccacccg

SEQ ID NO: 3081147 - RNA, 16 nt, Mycobacterium bovis subsp bovis AF2122/97
aacaccaucagcgaca

SEQ ID NO: 3081148 - RNA, 20 nt, Mycobacterium bovis subsp bovis AF2122/97
aacacccacgugcugccuuu

SEQ ID NO: 3081149 - RNA, 14 nt, Mycobacterium bovis subsp bovis AF2122/97
aacaccccacacag

SEQ ID NO: 3081150 - RNA, 15 nt, Mycobacterium bovis subsp bovis AF2122/97
aacaccccccgucca

SEQ ID NO: 3081151 - RNA, 14 nt, Mycobacterium bovis subsp bovis AF2122/97
aacaccccgggcgc

SEQ ID NO: 3081152 - RNA, 13 nt, Mycobacterium bovis subsp bovis AF2122/97
aacacccgagcaa

SEQ ID NO: 3081153 - RNA, 13 nt, Mycobacterium bovis subsp bovis AF2122/97
aacacccggccgc

SEQ ID NO: 3081154 - RNA, 22 nt, Mycobacterium bovis subsp bovis AF2122/97
aacacccuugcccacggcgacc

SEQ ID NO: 3081155 - RNA, 11 nt, Mycobacterium bovis subsp bovis AF2122/97
aacaccgcacg

SEQ ID NO: 3081156 - RNA, 20 nt, Mycobacterium bovis subsp bovis AF2122/97
aacaccgccagcaugacacc

SEQ ID NO: 3081157 - RNA, 13 nt, Mycobacterium bovis subsp bovis AF2122/97
aacaccgcccgca

SEQ ID NO: 3081158 - RNA, 20 nt, Mycobacterium bovis subsp bovis AF2122/97
aacaccgcccggcccggcuc

SEQ ID NO: 3081159 - RNA, 13 nt, Mycobacterium bovis subsp bovis AF2122/97
aacaccgcgccga

SEQ ID NO: 3081160 - RNA, 21 nt, Mycobacterium bovis subsp bovis AF2122/97
aacaccgcggugaguucgccg

SEQ ID NO: 3081161 - RNA, 22 nt, Mycobacterium bovis subsp bovis AF2122/97
aacaccgcggugaguucgccgg

SEQ ID NO: 3081162 - RNA, 16 nt, Mycobacterium bovis subsp bovis AF2122/97
aacaccggccagcggc

SEQ ID NO: 3081163 - RNA, 17 nt, Mycobacterium bovis subsp bovis AF2122/97
aacaccggccaggccgg

SEQ ID NO: 3081164 - RNA, 19 nt, Mycobacterium bovis subsp bovis AF2122/97
aacaccggcugguucaaca

SEQ ID NO: 3081165 - RNA, 20 nt, Mycobacterium bovis subsp bovis AF2122/97
aacaccgguaacgccaacac

SEQ ID NO: 3081166 - RNA, 19 nt, Mycobacterium bovis subsp bovis AF2122/97
aacaccgguggcuucaacc

SEQ ID NO: 3081167 - RNA, 22 nt, Mycobacterium bovis subsp bovis AF2122/97
aacaccggugucggccagcaac

SEQ ID NO: 3081168 - RNA, 18 nt, Mycobacterium bovis subsp bovis AF2122/97
aacaccgugcaccagcuc

SEQ ID NO: 3081169 - RNA, 20 nt, Mycobacterium bovis subsp bovis AF2122/97
aacaccgugcaccagcucac

SEQ ID NO: 3081170 - RNA, 15 nt, Mycobacterium bovis subsp bovis AF2122/97
aacaccucggcacgg

SEQ ID NO: 3081171 - RNA, 14 nt, Mycobacterium bovis subsp bovis AF2122/97
aacacgaccucuug

SEQ ID NO: 3081172 - RNA, 21 nt, Mycobacterium bovis subsp bovis AF2122/97
aacacgacugucccgcgcaac

SEQ ID NO: 3081173 - RNA, 16 nt, Mycobacterium bovis subsp bovis AF2122/97
aacacgaugcgcggug

SEQ ID NO: 3081174 - RNA, 20 nt, Mycobacterium bovis subsp bovis AF2122/97
aacacgaugcgcggugcgcg

SEQ ID NO: 3081175 - RNA, 22 nt, Mycobacterium bovis subsp bovis AF2122/97
aacacgccggcccggugaugaa

SEQ ID NO: 3081176 - RNA, 15 nt, Mycobacterium bovis subsp bovis AF2122/97
aacacgccucgccga

SEQ ID NO: 3081177 - RNA, 17 nt, Mycobacterium bovis subsp bovis AF2122/97
aacacgccucgccgaag

SEQ ID NO: 3081178 - RNA, 22 nt, Mycobacterium bovis subsp bovis AF2122/97
aacacgcugaauuccacugcgc

SEQ ID NO: 3081179 - RNA, 15 nt, Mycobacterium bovis subsp bovis AF2122/97
aacacgucgcgguag

SEQ ID NO: 3081180 - RNA, 15 nt, Mycobacterium bovis subsp bovis AF2122/97
aacagaauucgaccg

SEQ ID NO: 3081181 - RNA, 17 nt, Mycobacterium bovis subsp bovis AF2122/97
aacagacauuugucaac

SEQ ID NO: 3081182 - RNA, 23 nt, Mycobacterium bovis subsp bovis AF2122/97
aacagagucaccgcgcuggucag

SEQ ID NO: 3081183 - RNA, 18 nt, Mycobacterium bovis subsp bovis AF2122/97
aacagauuguccggccgg

SEQ ID NO: 3081184 - RNA, 12 nt, Mycobacterium bovis subsp bovis AF2122/97
aacagcaccagu

SEQ ID NO: 3081185 - RNA, 13 nt, Mycobacterium bovis subsp bovis AF2122/97
aacagcaccagug

SEQ ID NO: 3081186 - RNA, 15 nt, Mycobacterium bovis subsp bovis AF2122/97
aacagcaggccucca

SEQ ID NO: 3081187 - RNA, 18 nt, Mycobacterium bovis subsp bovis AF2122/97
aacagcagguuggcgagc

SEQ ID NO: 3081188 - RNA, 16 nt, Mycobacterium bovis subsp bovis AF2122/97
aacagcccaccggugc

SEQ ID NO: 3081189 - RNA, 13 nt, Mycobacterium bovis subsp bovis AF2122/97
aacagccggccgg

SEQ ID NO: 3081190 - RNA, 19 nt, Mycobacterium bovis subsp bovis AF2122/97
aacagcgaaccgccggcac

SEQ ID NO: 3081191 - RNA, 13 nt, Mycobacterium bovis subsp bovis AF2122/97
aacagcgagcggu

SEQ ID NO: 3081192 - RNA, 21 nt, Mycobacterium bovis subsp bovis AF2122/97
aacagcgccaagacgucggcg

SEQ ID NO: 3081193 - RNA, 13 nt, Mycobacterium bovis subsp bovis AF2122/97
aacagcggcacga

SEQ ID NO: 3081194 - RNA, 18 nt, Mycobacterium bovis subsp bovis AF2122/97
aacagcggggugugcggu

SEQ ID NO: 3081195 - RNA, 19 nt, Mycobacterium bovis subsp bovis AF2122/97
aacagcgucuggccgucgc

SEQ ID NO: 3081196 - RNA, 19 nt, Mycobacterium bovis subsp bovis AF2122/97
aacagcugcccgccagcgc

SEQ ID NO: 3081197 - RNA, 19 nt, Mycobacterium bovis subsp bovis AF2122/97
aacagcuucgcgcagccgg

SEQ ID NO: 3081198 - RNA, 15 nt, Mycobacterium bovis subsp bovis AF2122/97
aacaggccggugugc

SEQ ID NO: 3081199 - RNA, 19 nt, Mycobacterium bovis subsp bovis AF2122/97
aacaggccggugugcgggc

SEQ ID NO: 3081200 - RNA, 12 nt, Mycobacterium bovis subsp bovis AF2122/97
aacaggccuagg

SEQ ID NO: 3081201 - RNA, 18 nt, Mycobacterium bovis subsp bovis AF2122/97
aacaggcgucccgcccgg

SEQ ID NO: 3081202 - RNA, 21 nt, Mycobacterium bovis subsp bovis AF2122/97
aacagguaagcagccagcaac

SEQ ID NO: 3081203 - RNA, 22 nt, Mycobacterium bovis subsp bovis AF2122/97
aacagguaggguucuucgacgc

SEQ ID NO: 3081204 - RNA, 11 nt, Mycobacterium bovis subsp bovis AF2122/97
aacagguugaa

SEQ ID NO: 3081205 - RNA, 16 nt, Mycobacterium bovis subsp bovis AF2122/97
aacagucgcagccagg

SEQ ID NO: 3081206 - RNA, 22 nt, Mycobacterium bovis subsp bovis AF2122/97
aacagugacgccacgaccgccg

SEQ ID NO: 3081207 - RNA, 15 nt, Mycobacterium bovis subsp bovis AF2122/97
aacagugccucgcgu

SEQ ID NO: 3081208 - RNA, 14 nt, Mycobacterium bovis subsp bovis AF2122/97
aacagugccugggu

SEQ ID NO: 3081209 - RNA, 21 nt, Mycobacterium bovis subsp bovis AF2122/97
aacaguggggguccggcggcc

SEQ ID NO: 3081210 - RNA, 22 nt, Mycobacterium bovis subsp bovis AF2122/97
aacaguugcacaccggcacugc

SEQ ID NO: 3081211 - RNA, 23 nt, Mycobacterium bovis subsp bovis AF2122/97
aacaguugcccgacgccggucac

SEQ ID NO: 3081212 - RNA, 15 nt, Mycobacterium bovis subsp bovis AF2122/97
aacauacgaaacaug

SEQ ID NO: 3081213 - RNA, 13 nt, Mycobacterium bovis subsp bovis AF2122/97
aacaucaccgucg

SEQ ID NO: 3081214 - RNA, 14 nt, Mycobacterium bovis subsp bovis AF2122/97
aacaucaccgucgc

SEQ ID NO: 3081215 - RNA, 16 nt, Mycobacterium bovis subsp bovis AF2122/97
aacaucaccucgaugc

SEQ ID NO: 3081216 - RNA, 23 nt, Mycobacterium bovis subsp bovis AF2122/97
aacaucccagcgaaugcugacau

SEQ ID NO: 3081217 - RNA, 18 nt, Mycobacterium bovis subsp bovis AF2122/97
aacauccgguggugcucg

SEQ ID NO: 3081218 - RNA, 17 nt, Mycobacterium bovis subsp bovis AF2122/97
aacaucgacagcaucac

SEQ ID NO: 3081219 - RNA, 14 nt, Mycobacterium bovis subsp bovis AF2122/97
aacaucgccagcgc

SEQ ID NO: 3081220 - RNA, 17 nt, Mycobacterium bovis subsp bovis AF2122/97
aacaucgccagcgccgg

SEQ ID NO: 3081221 - RNA, 20 nt, Mycobacterium bovis subsp bovis AF2122/97
aacaucgccauaccggccgc

SEQ ID NO: 3081222 - RNA, 23 nt, Mycobacterium bovis subsp bovis AF2122/97
aacaucggaacgugaccgacgcc

SEQ ID NO: 3081223 - RNA, 19 nt, Mycobacterium bovis subsp bovis AF2122/97
aacaucggguucuucaacu

SEQ ID NO: 3081224 - RNA, 18 nt, Mycobacterium bovis subsp bovis AF2122/97
aacaucgucaucgacgag

SEQ ID NO: 3081225 - RNA, 20 nt, Mycobacterium bovis subsp bovis AF2122/97
aacaucuccucggcgaugcc

SEQ ID NO: 3081226 - RNA, 20 nt, Mycobacterium bovis subsp bovis AF2122/97
aacaugaguggcaaucccgc

SEQ ID NO: 3081227 - RNA, 18 nt, Mycobacterium bovis subsp bovis AF2122/97
aacaugauccgccggcaa

SEQ ID NO: 3081228 - RNA, 22 nt, Mycobacterium bovis subsp bovis AF2122/97
aacaugccauggcccgugcggu

SEQ ID NO: 3081229 - RNA, 19 nt, Mycobacterium bovis subsp bovis AF2122/97
aacaugcucacgaucaccc

SEQ ID NO: 3081230 - RNA, 23 nt, Mycobacterium bovis subsp bovis AF2122/97
aacaugcucacgaucacccgcac

SEQ ID NO: 3081231 - RNA, 22 nt, Mycobacterium bovis subsp bovis AF2122/97
aacauguccagugccguuucga

SEQ ID NO: 3081232 - RNA, 22 nt, Mycobacterium bovis subsp bovis AF2122/97
aacauugcuagguucgcgacgu

SEQ ID NO: 3081233 - RNA, 21 nt, Mycobacterium bovis subsp bovis AF2122/97
aaccaaagcgacgagcagcaa

SEQ ID NO: 3081234 - RNA, 19 nt, Mycobacterium bovis subsp bovis AF2122/97
aaccaaccucggaucgcca

SEQ ID NO: 3081235 - RNA, 13 nt, Mycobacterium bovis subsp bovis AF2122/97
aaccaccagcacg

SEQ ID NO: 3081236 - RNA, 16 nt, Mycobacterium bovis subsp bovis AF2122/97
aaccaccagcacggcg

SEQ ID NO: 3081237 - RNA, 16 nt, Mycobacterium bovis subsp bovis AF2122/97
aaccacccaccggcca

SEQ ID NO: 3081238 - RNA, 16 nt, Mycobacterium bovis subsp bovis AF2122/97
aaccacccgcaacaca

SEQ ID NO: 3081239 - RNA, 16 nt, Mycobacterium bovis subsp bovis AF2122/97
aaccaccggccgcgca

SEQ ID NO: 3081240 - RNA, 22 nt, Mycobacterium bovis subsp bovis AF2122/97
aaccaccgguccagcgccggaa

SEQ ID NO: 3081241 - RNA, 18 nt, Mycobacterium bovis subsp bovis AF2122/97
aaccacgccccgaucggu

SEQ ID NO: 3081242 - RNA, 17 nt, Mycobacterium bovis subsp bovis AF2122/97
aaccacggccgccgcgu

SEQ ID NO: 3081243 - RNA, 18 nt, Mycobacterium bovis subsp bovis AF2122/97
aaccacggcggcaucacc

SEQ ID NO: 3081244 - RNA, 19 nt, Mycobacterium bovis subsp bovis AF2122/97
aaccacucgcucaggaaca

SEQ ID NO: 3081245 - RNA, 23 nt, Mycobacterium bovis subsp bovis AF2122/97
aaccacucgcucaggaacaauga

SEQ ID NO: 3081246 - RNA, 16 nt, Mycobacterium bovis subsp bovis AF2122/97
aaccacuuuccgagga

SEQ ID NO: 3081247 - RNA, 12 nt, Mycobacterium bovis subsp bovis AF2122/97
aaccagcagcag

SEQ ID NO: 3081248 - RNA, 13 nt, Mycobacterium bovis subsp bovis AF2122/97
aaccagcagcagg

SEQ ID NO: 3081249 - RNA, 24 nt, Mycobacterium bovis subsp bovis AF2122/97
auggcggccaccgucagcgcgacc

SEQ ID NO: 3081250 - RNA, 19 nt, Mycobacterium bovis subsp bovis AF2122/97
auggcggccgggucgguga

SEQ ID NO: 3081251 - RNA, 12 nt, Mycobacterium bovis subsp bovis AF2122/97
auggcggcgccg

SEQ ID NO: 3081252 - RNA, 22 nt, Mycobacterium bovis subsp bovis AF2122/97
auggcggcgcguucgucgucgc

SEQ ID NO: 3081253 - RNA, 19 nt, Mycobacterium bovis subsp bovis AF2122/97
auggcggcucguugcgggc

SEQ ID NO: 3081254 - RNA, 22 nt, Mycobacterium bovis subsp bovis AF2122/97
auggcggcuucgacgucggcga

SEQ ID NO: 3081255 - RNA, 12 nt, Mycobacterium bovis subsp bovis AF2122/97
auggcgggugcg

SEQ ID NO: 3081256 - RNA, 20 nt, Mycobacterium bovis subsp bovis AF2122/97
auggcggucggccugcggca

SEQ ID NO: 3081257 - RNA, 14 nt, Mycobacterium bovis subsp bovis AF2122/97
auggcggugagcac

SEQ ID NO: 3081258 - RNA, 19 nt, Mycobacterium bovis subsp bovis AF2122/97
auggcggugcgcagcuugg

SEQ ID NO: 3081259 - RNA, 21 nt, Mycobacterium bovis subsp bovis AF2122/97
auggcgguggcggucuugccg

SEQ ID NO: 3081260 - RNA, 20 nt, Mycobacterium bovis subsp bovis AF2122/97
auggcguagggcuguccgac

SEQ ID NO: 3081261 - RNA, 24 nt, Mycobacterium bovis subsp bovis AF2122/97
auggcgucaugaacgaucggacca

SEQ ID NO: 3081262 - RNA, 20 nt, Mycobacterium bovis subsp bovis AF2122/97
auggcgucgaaccagucgaa

SEQ ID NO: 3081263 - RNA, 14 nt, Mycobacterium bovis subsp bovis AF2122/97
auggcgucgccggc

SEQ ID NO: 3081264 - RNA, 17 nt, Mycobacterium bovis subsp bovis AF2122/97
auggcgucgccggcacc

SEQ ID NO: 3081265 - RNA, 16 nt, Mycobacterium bovis subsp bovis AF2122/97
auggcgucgccggccc

SEQ ID NO: 3081266 - RNA, 17 nt, Mycobacterium bovis subsp bovis AF2122/97
auggcgucgccggcccc

SEQ ID NO: 3081267 - RNA, 20 nt, Mycobacterium bovis subsp bovis AF2122/97
auggcgucgccggccccgcc

SEQ ID NO: 3081268 - RNA, 21 nt, Mycobacterium bovis subsp bovis AF2122/97
auggcgucgccggccccgccg

SEQ ID NO: 3081269 - RNA, 23 nt, Mycobacterium bovis subsp bovis AF2122/97
auggcgucgccggccccgccggc

SEQ ID NO: 3081270 - RNA, 13 nt, Mycobacterium bovis subsp bovis AF2122/97
auggcgucggcca

SEQ ID NO: 3081271 - RNA, 16 nt, Mycobacterium bovis subsp bovis AF2122/97
auggcgucggccagga

SEQ ID NO: 3081272 - RNA, 18 nt, Mycobacterium bovis subsp bovis AF2122/97
auggcgugcagacccggu

SEQ ID NO: 3081273 - RNA, 14 nt, Mycobacterium bovis subsp bovis AF2122/97
auggcguucugcgc

SEQ ID NO: 3081274 - RNA, 17 nt, Mycobacterium bovis subsp bovis AF2122/97
auggcguuugccggccg

SEQ ID NO: 3081275 - RNA, 14 nt, Mycobacterium bovis subsp bovis AF2122/97
auggcuccggccgc

SEQ ID NO: 3081276 - RNA, 16 nt, Mycobacterium bovis subsp bovis AF2122/97
auggcugagcccgccg

SEQ ID NO: 3081277 - RNA, 13 nt, Mycobacterium bovis subsp bovis AF2122/97
auggcuugcucug

SEQ ID NO: 3081278 - RNA, 15 nt, Mycobacterium bovis subsp bovis AF2122/97
auggcuugcucugcg

SEQ ID NO: 3081279 - RNA, 13 nt, Mycobacterium bovis subsp bovis AF2122/97
auggcuuggacca

SEQ ID NO: 3081280 - RNA, 14 nt, Mycobacterium bovis subsp bovis AF2122/97
augggacacaaucc

SEQ ID NO: 3081281 - RNA, 14 nt, Mycobacterium bovis subsp bovis AF2122/97
augggagucccacc

SEQ ID NO: 3081282 - RNA, 16 nt, Mycobacterium bovis subsp bovis AF2122/97
augggauggcaccacc

SEQ ID NO: 3081283 - RNA, 19 nt, Mycobacterium bovis subsp bovis AF2122/97
augggcagaucgauaccgu

SEQ ID NO: 3081284 - RNA, 15 nt, Mycobacterium bovis subsp bovis AF2122/97
augggcagccgcccg

SEQ ID NO: 3081285 - RNA, 18 nt, Mycobacterium bovis subsp bovis AF2122/97
augggcccugcacagcag

SEQ ID NO: 3081286 - RNA, 17 nt, Mycobacterium bovis subsp bovis AF2122/97
augggccggcgccgcac

SEQ ID NO: 3081287 - RNA, 18 nt, Mycobacterium bovis subsp bovis AF2122/97
augggcgagaaguccggg

SEQ ID NO: 3081288 - RNA, 22 nt, Mycobacterium bovis subsp bovis AF2122/97
augggcgauaaggaccgcgccc

SEQ ID NO: 3081289 - RNA, 19 nt, Mycobacterium bovis subsp bovis AF2122/97
augggcgauuuugcgucug

SEQ ID NO: 3081290 - RNA, 21 nt, Mycobacterium bovis subsp bovis AF2122/97
augggcggguggugcggccgu

SEQ ID NO: 3081291 - RNA, 17 nt, Mycobacterium bovis subsp bovis AF2122/97
augggcgguuccacgcu

SEQ ID NO: 3081292 - RNA, 22 nt, Mycobacterium bovis subsp bovis AF2122/97
augggcgucggucaccuggcga

SEQ ID NO: 3081293 - RNA, 19 nt, Mycobacterium bovis subsp bovis AF2122/97
augggcugcgcgucgagca

SEQ ID NO: 3081294 - RNA, 13 nt, Mycobacterium bovis subsp bovis AF2122/97
auggggaacgggu

SEQ ID NO: 3081295 - RNA, 14 nt, Mycobacterium bovis subsp bovis AF2122/97
auggggcagcucau

SEQ ID NO: 3081296 - RNA, 15 nt, Mycobacterium bovis subsp bovis AF2122/97
auggggccaacaccu

SEQ ID NO: 3081297 - RNA, 18 nt, Mycobacterium bovis subsp bovis AF2122/97
auggggccaacaccucaa

SEQ ID NO: 3081298 - RNA, 19 nt, Mycobacterium bovis subsp bovis AF2122/97
auggggcccgcaugggcuu

SEQ ID NO: 3081299 - RNA, 14 nt, Mycobacterium bovis subsp bovis AF2122/97
augggggagccggu

SEQ ID NO: 3081300 - RNA, 15 nt, Mycobacterium bovis subsp bovis AF2122/97
augggggagccggug

SEQ ID NO: 3081301 - RNA, 17 nt, Mycobacterium bovis subsp bovis AF2122/97
augggggagccggugac

SEQ ID NO: 3081302 - RNA, 15 nt, Mycobacterium bovis subsp bovis AF2122/97
auggggugacgcacc

SEQ ID NO: 3081303 - RNA, 18 nt, Mycobacterium bovis subsp bovis AF2122/97
augggguguuugucgcgg

SEQ ID NO: 3081304 - RNA, 21 nt, Mycobacterium bovis subsp bovis AF2122/97
augggguuaggaguggccggg

SEQ ID NO: 3081305 - RNA, 13 nt, Mycobacterium bovis subsp bovis AF2122/97
auggguagccgcc

SEQ ID NO: 3081306 - RNA, 16 nt, Mycobacterium bovis subsp bovis AF2122/97
auggguagccgcccag

SEQ ID NO: 3081307 - RNA, 17 nt, Mycobacterium bovis subsp bovis AF2122/97
augggucuuugcccgcc

SEQ ID NO: 3081308 - RNA, 13 nt, Mycobacterium bovis subsp bovis AF2122/97
augggugacccgc

SEQ ID NO: 3081309 - RNA, 16 nt, Mycobacterium bovis subsp bovis AF2122/97
augggugacgguggcc

SEQ ID NO: 3081310 - RNA, 23 nt, Mycobacterium bovis subsp bovis AF2122/97
augggugugcugccaccggccgg

SEQ ID NO: 3081311 - RNA, 15 nt, Mycobacterium bovis subsp bovis AF2122/97
auggguugccagcga

SEQ ID NO: 3081312 - RNA, 13 nt, Mycobacterium bovis subsp bovis AF2122/97
augguacccgcgc

SEQ ID NO: 3081313 - RNA, 18 nt, Mycobacterium bovis subsp bovis AF2122/97
augguacccgcgccgcgc

SEQ ID NO: 3081314 - RNA, 13 nt, Mycobacterium bovis subsp bovis AF2122/97
augguaccgccac

SEQ ID NO: 3081315 - RNA, 22 nt, Mycobacterium bovis subsp bovis AF2122/97
augguaccgccacuggcgcuga

SEQ ID NO: 3081316 - RNA, 22 nt, Mycobacterium bovis subsp bovis AF2122/97
augguaugcccgccguagacca

SEQ ID NO: 3081317 - RNA, 14 nt, Mycobacterium bovis subsp bovis AF2122/97
auggucaaccgcgc

SEQ ID NO: 3081318 - RNA, 16 nt, Mycobacterium bovis subsp bovis AF2122/97
auggucaaccgcgccc

SEQ ID NO: 3081319 - RNA, 12 nt, Mycobacterium bovis subsp bovis AF2122/97
auggucaccgga

SEQ ID NO: 3081320 - RNA, 16 nt, Mycobacterium bovis subsp bovis AF2122/97
auggucacggcgucga

SEQ ID NO: 3081321 - RNA, 11 nt, Mycobacterium bovis subsp bovis AF2122/97
auggucagcag

SEQ ID NO: 3081322 - RNA, 15 nt, Mycobacterium bovis subsp bovis AF2122/97
auggucagcuggccg

SEQ ID NO: 3081323 - RNA, 22 nt, Mycobacterium bovis subsp bovis AF2122/97
auggucccgcucuggucgucga

SEQ ID NO: 3081324 - RNA, 14 nt, Mycobacterium bovis subsp bovis AF2122/97
augguccgaccagc

SEQ ID NO: 3081325 - RNA, 18 nt, Mycobacterium bovis subsp bovis AF2122/97
augguccgaccagcggcc

SEQ ID NO: 3081326 - RNA, 16 nt, Mycobacterium bovis subsp bovis AF2122/97
augguccgggccuauc

SEQ ID NO: 3081327 - RNA, 16 nt, Mycobacterium bovis subsp bovis AF2122/97
auggucguaggguggg

SEQ ID NO: 3081328 - RNA, 22 nt, Mycobacterium bovis subsp bovis AF2122/97
auggucguucccgccggcacga

SEQ ID NO: 3081329 - RNA, 12 nt, Mycobacterium bovis subsp bovis AF2122/97
auggucuccacc

SEQ ID NO: 3081330 - RNA, 20 nt, Mycobacterium bovis subsp bovis AF2122/97
auggucucccggcugaugcc

SEQ ID NO: 3081331 - RNA, 21 nt, Mycobacterium bovis subsp bovis AF2122/97
auggucucccggcugaugccu

SEQ ID NO: 3081332 - RNA, 21 nt, Mycobacterium bovis subsp bovis AF2122/97
auggugaacgcgaauaccaga

SEQ ID NO: 3081333 - RNA, 20 nt, Mycobacterium bovis subsp bovis AF2122/97
auggugaaggcaaacaccag

SEQ ID NO: 3081334 - RNA, 11 nt, Mycobacterium bovis subsp bovis AF2122/97
auggugaaguu

SEQ ID NO: 3081335 - RNA, 22 nt, Mycobacterium bovis subsp bovis AF2122/97
auggugaaguugccggucaggc

SEQ ID NO: 3081336 - RNA, 23 nt, Mycobacterium bovis subsp bovis AF2122/97
cacagcggcgggucccgccacca

SEQ ID NO: 3081337 - RNA, 20 nt, Mycobacterium bovis subsp bovis AF2122/97
cacagcguccgucgucggcg

SEQ ID NO: 3081338 - RNA, 18 nt, Mycobacterium bovis subsp bovis AF2122/97
cacagcucgccgugacca

SEQ ID NO: 3081339 - RNA, 16 nt, Mycobacterium bovis subsp bovis AF2122/97
cacagcugacgagccg

SEQ ID NO: 3081340 - RNA, 22 nt, Mycobacterium bovis subsp bovis AF2122/97
cacagcugauucugguucagcc

SEQ ID NO: 3081341 - RNA, 15 nt, Mycobacterium bovis subsp bovis AF2122/97
cacagcugcgcacgu

SEQ ID NO: 3081342 - RNA, 15 nt, Mycobacterium bovis subsp bovis AF2122/97
cacagcuugagcaca

SEQ ID NO: 3081343 - RNA, 22 nt, Mycobacterium bovis subsp bovis AF2122/97
cacagcuugagcacacguccgg

SEQ ID NO: 3081344 - RNA, 13 nt, Mycobacterium bovis subsp bovis AF2122/97
cacagcuugcccg

SEQ ID NO: 3081345 - RNA, 16 nt, Mycobacterium bovis subsp bovis AF2122/97
cacagcuugcccgagc

SEQ ID NO: 3081346 - RNA, 17 nt, Mycobacterium bovis subsp bovis AF2122/97
cacagcuuggacguggu

SEQ ID NO: 3081347 - RNA, 20 nt, Mycobacterium bovis subsp bovis AF2122/97
cacaggacaauggacaccaa

SEQ ID NO: 3081348 - RNA, 21 nt, Mycobacterium bovis subsp bovis AF2122/97
cacaggacuuguccaucacau

SEQ ID NO: 3081349 - RNA, 21 nt, Mycobacterium bovis subsp bovis AF2122/97
cacaggcauuuucacugugcc

SEQ ID NO: 3081350 - RNA, 16 nt, Mycobacterium bovis subsp bovis AF2122/97
cacaggcgcgaucgcu

SEQ ID NO: 3081351 - RNA, 14 nt, Mycobacterium bovis subsp bovis AF2122/97
cacaggcggccagc

SEQ ID NO: 3081352 - RNA, 13 nt, Mycobacterium bovis subsp bovis AF2122/97
cacaggcggcgcu

SEQ ID NO: 3081353 - RNA, 16 nt, Mycobacterium bovis subsp bovis AF2122/97
cacaggcggcgcugca

SEQ ID NO: 3081354 - RNA, 16 nt, Mycobacterium bovis subsp bovis AF2122/97
cacaggcugaagacga

SEQ ID NO: 3081355 - RNA, 22 nt, Mycobacterium bovis subsp bovis AF2122/97
cacaggggcagcgcggccaccc

SEQ ID NO: 3081356 - RNA, 13 nt, Mycobacterium bovis subsp bovis AF2122/97
cacaggggccagc

SEQ ID NO: 3081357 - RNA, 15 nt, Mycobacterium bovis subsp bovis AF2122/97
cacagguccugcgcc

SEQ ID NO: 3081358 - RNA, 21 nt, Mycobacterium bovis subsp bovis AF2122/97
cacaggugccaaacgccgccc

SEQ ID NO: 3081359 - RNA, 17 nt, Mycobacterium bovis subsp bovis AF2122/97
cacagguuugcgccgcg

SEQ ID NO: 3081360 - RNA, 19 nt, Mycobacterium bovis subsp bovis AF2122/97
cacagguuugcgccgcgca

SEQ ID NO: 3081361 - RNA, 20 nt, Mycobacterium bovis subsp bovis AF2122/97
cacagugaugguucaaugcc

SEQ ID NO: 3081362 - RNA, 20 nt, Mycobacterium bovis subsp bovis AF2122/97
cacagugccaauuccagccc

SEQ ID NO: 3081363 - RNA, 22 nt, Mycobacterium bovis subsp bovis AF2122/97
cacagugccaauuccagccccc

SEQ ID NO: 3081364 - RNA, 17 nt, Mycobacterium bovis subsp bovis AF2122/97
cacagugcggccccgac

SEQ ID NO: 3081365 - RNA, 14 nt, Mycobacterium bovis subsp bovis AF2122/97
cacaguggcucgcg

SEQ ID NO: 3081366 - RNA, 22 nt, Mycobacterium bovis subsp bovis AF2122/97
cacaguuaucagccgcgcgcca

SEQ ID NO: 3081367 - RNA, 13 nt, Mycobacterium bovis subsp bovis AF2122/97
cacauaagccccc

SEQ ID NO: 3081368 - RNA, 17 nt, Mycobacterium bovis subsp bovis AF2122/97
cacauacagcaggccgc

SEQ ID NO: 3081369 - RNA, 21 nt, Mycobacterium bovis subsp bovis AF2122/97
cacauacagcaggccgcgcuc

SEQ ID NO: 3081370 - RNA, 14 nt, Mycobacterium bovis subsp bovis AF2122/97
cacauaccaccacg

SEQ ID NO: 3081371 - RNA, 14 nt, Mycobacterium bovis subsp bovis AF2122/97
cacauaccggcgca

SEQ ID NO: 3081372 - RNA, 18 nt, Mycobacterium bovis subsp bovis AF2122/97
cacauacgauuucgacga

SEQ ID NO: 3081373 - RNA, 15 nt, Mycobacterium bovis subsp bovis AF2122/97
cacauagccggucag

SEQ ID NO: 3081374 - RNA, 18 nt, Mycobacterium bovis subsp bovis AF2122/97
cacaucaaaacggcggug

SEQ ID NO: 3081375 - RNA, 19 nt, Mycobacterium bovis subsp bovis AF2122/97
cacaucaaaacggcggugg

SEQ ID NO: 3081376 - RNA, 20 nt, Mycobacterium bovis subsp bovis AF2122/97
cacaucaaaacggcgguggg

SEQ ID NO: 3081377 - RNA, 18 nt, Mycobacterium bovis subsp bovis AF2122/97
cacaucaaagucggcguc

SEQ ID NO: 3081378 - RNA, 22 nt, Mycobacterium bovis subsp bovis AF2122/97
cacaucaccaaaaacccgguga

SEQ ID NO: 3081379 - RNA, 14 nt, Mycobacterium bovis subsp bovis AF2122/97
cacaucaugccagc

SEQ ID NO: 3081380 - RNA, 17 nt, Mycobacterium bovis subsp bovis AF2122/97
cacaucaugccagccgu

SEQ ID NO: 3081381 - RNA, 12 nt, Mycobacterium bovis subsp bovis AF2122/97
cacauccacgca

SEQ ID NO: 3081382 - RNA, 22 nt, Mycobacterium bovis subsp bovis AF2122/97
cacauccacuucacgugcgacg

SEQ ID NO: 3081383 - RNA, 18 nt, Mycobacterium bovis subsp bovis AF2122/97
cacauccagggugccggu

SEQ ID NO: 3081384 - RNA, 14 nt, Mycobacterium bovis subsp bovis AF2122/97
cacauccaucucca

SEQ ID NO: 3081385 - RNA, 17 nt, Mycobacterium bovis subsp bovis AF2122/97
cacaucgcauccacuuc

SEQ ID NO: 3081386 - RNA, 21 nt, Mycobacterium bovis subsp bovis AF2122/97
cacaucgcccggaaccggcgu

SEQ ID NO: 3081387 - RNA, 19 nt, Mycobacterium bovis subsp bovis AF2122/97
cacaucgccggagucgacc

SEQ ID NO: 3081388 - RNA, 20 nt, Mycobacterium bovis subsp bovis AF2122/97
cacaucgcgggcgugccgac

SEQ ID NO: 3081389 - RNA, 13 nt, Mycobacterium bovis subsp bovis AF2122/97
cacaucggccucu

SEQ ID NO: 3081390 - RNA, 15 nt, Mycobacterium bovis subsp bovis AF2122/97
cacaucggugccacg

SEQ ID NO: 3081391 - RNA, 20 nt, Mycobacterium bovis subsp bovis AF2122/97
cacaucggugccacguucgc

SEQ ID NO: 3081392 - RNA, 20 nt, Mycobacterium bovis subsp bovis AF2122/97
cacaucggugguuagguggc

SEQ ID NO: 3081393 - RNA, 21 nt, Mycobacterium bovis subsp bovis AF2122/97
cacaucguucaugaucggcag

SEQ ID NO: 3081394 - RNA, 15 nt, Mycobacterium bovis subsp bovis AF2122/97
cacaugacgaucgcg

SEQ ID NO: 3081395 - RNA, 16 nt, Mycobacterium bovis subsp bovis AF2122/97
cacaugacgaucgcgg

SEQ ID NO: 3081396 - RNA, 12 nt, Mycobacterium bovis subsp bovis AF2122/97
cacaugaucgag

SEQ ID NO: 3081397 - RNA, 15 nt, Mycobacterium bovis subsp bovis AF2122/97
cacaugaucgagcag

SEQ ID NO: 3081398 - RNA, 15 nt, Mycobacterium bovis subsp bovis AF2122/97
cacaugccacagcgg

SEQ ID NO: 3081399 - RNA, 14 nt, Mycobacterium bovis subsp bovis AF2122/97
cacaugcgccgaaa

SEQ ID NO: 3081400 - RNA, 20 nt, Mycobacterium bovis subsp bovis AF2122/97
cacaugcucgacgcccgcca

SEQ ID NO: 3081401 - RNA, 13 nt, Mycobacterium bovis subsp bovis AF2122/97
cacaugcucggcc

SEQ ID NO: 3081402 - RNA, 16 nt, Mycobacterium bovis subsp bovis AF2122/97
cacaugcucggccugc

SEQ ID NO: 3081403 - RNA, 15 nt, Mycobacterium bovis subsp bovis AF2122/97
cacaugugcgcgucg

SEQ ID NO: 3081404 - RNA, 13 nt, Mycobacterium bovis subsp bovis AF2122/97
cacauucagcgcc

SEQ ID NO: 3081405 - RNA, 21 nt, Mycobacterium bovis subsp bovis AF2122/97
cacauugaccaggugcccgcc

SEQ ID NO: 3081406 - RNA, 20 nt, Mycobacterium bovis subsp bovis AF2122/97
cacauugaucgacggccagc

SEQ ID NO: 3081407 - RNA, 14 nt, Mycobacterium bovis subsp bovis AF2122/97
cacauugccaccgu

SEQ ID NO: 3081408 - RNA, 17 nt, Mycobacterium bovis subsp bovis AF2122/97
cacauugccggccacca

SEQ ID NO: 3081409 - RNA, 17 nt, Mycobacterium bovis subsp bovis AF2122/97
cacauuggccaggucgg

SEQ ID NO: 3081410 - RNA, 22 nt, Mycobacterium bovis subsp bovis AF2122/97
cacauuggccaggucggccacc

SEQ ID NO: 3081411 - RNA, 15 nt, Mycobacterium bovis subsp bovis AF2122/97
cacauugguguccac

SEQ ID NO: 3081412 - RNA, 15 nt, Mycobacterium bovis subsp bovis AF2122/97
cacauuucaccaccg

SEQ ID NO: 3081413 - RNA, 20 nt, Mycobacterium bovis subsp bovis AF2122/97
cacauuucuuugggcggccc

SEQ ID NO: 3081414 - RNA, 18 nt, Mycobacterium bovis subsp bovis AF2122/97
caccaaaaggaucaacgu

SEQ ID NO: 3081415 - RNA, 14 nt, Mycobacterium bovis subsp bovis AF2122/97
caccaaaugccccg

SEQ ID NO: 3081416 - RNA, 15 nt, Mycobacterium bovis subsp bovis AF2122/97
caccaacaccgcggc

SEQ ID NO: 3081417 - RNA, 18 nt, Mycobacterium bovis subsp bovis AF2122/97
caccaacaccgcggcgcu

SEQ ID NO: 3081418 - RNA, 13 nt, Mycobacterium bovis subsp bovis AF2122/97
caccaacaccggu

SEQ ID NO: 3081419 - RNA, 14 nt, Mycobacterium bovis subsp bovis AF2122/97
caccaaccaccgac

SEQ ID NO: 3081420 - RNA, 14 nt, Mycobacterium bovis subsp bovis AF2122/97
caccaacccacccc

SEQ ID NO: 3081421 - RNA, 15 nt, Mycobacterium bovis subsp bovis AF2122/97
caccaacccaccccc

SEQ ID NO: 3081422 - RNA, 15 nt, Mycobacterium bovis subsp bovis AF2122/97
caccaacgaacuggg

SEQ ID NO: 3081423 - RNA, 14 nt, Mycobacterium bovis subsp bovis AF2122/97
caccaccggcaccg

SEQ ID NO: 3081424 - RNA, 12 nt, Mycobacterium bovis subsp bovis AF2122/97
caccaccggccc

SEQ ID NO: 3081425 - RNA, 23 nt, Mycobacterium bovis subsp bovis AF2122/97
caccaccggccccaccgacagcc

SEQ ID NO: 3081426 - RNA, 14 nt, Mycobacterium bovis subsp bovis AF2122/97
caccaccggcgccg

SEQ ID NO: 3081427 - RNA, 20 nt, Mycobacterium bovis subsp bovis AF2122/97
caccaccgucucgccgcgca

SEQ ID NO: 3081428 - RNA, 13 nt, Mycobacterium bovis subsp bovis AF2122/97
caccaccgugaag

SEQ ID NO: 3081429 - RNA, 16 nt, Mycobacterium bovis subsp bovis AF2122/97
caccaccguggccgug

SEQ ID NO: 3081430 - RNA, 14 nt, Mycobacterium bovis subsp bovis AF2122/97
caccaccguggcgc

SEQ ID NO: 3081431 - RNA, 13 nt, Mycobacterium bovis subsp bovis AF2122/97
caccaccuccgcg

SEQ ID NO: 3081432 - RNA, 20 nt, Mycobacterium bovis subsp bovis AF2122/97
caccaccucggugaccaggc

SEQ ID NO: 3081433 - RNA, 22 nt, Mycobacterium bovis subsp bovis AF2122/97
caccaccucggugaccaggccg

SEQ ID NO: 3081434 - RNA, 23 nt, Mycobacterium bovis subsp bovis AF2122/97
caccaccucggugaccaggccgg

SEQ ID NO: 3081435 - RNA, 14 nt, Mycobacterium bovis subsp bovis AF2122/97
caccaccuggccgg

SEQ ID NO: 3081436 - RNA, 21 nt, Mycobacterium bovis subsp bovis AF2122/97
caccaccuggugcaaccgugc

SEQ ID NO: 3081437 - RNA, 18 nt, Mycobacterium bovis subsp bovis AF2122/97
caccaccuuggaugcccu

SEQ ID NO: 3081438 - RNA, 17 nt, Mycobacterium bovis subsp bovis AF2122/97
caccacgaacucggccg

SEQ ID NO: 3081439 - RNA, 18 nt, Mycobacterium bovis subsp bovis AF2122/97
caccacgaacucggccgg

SEQ ID NO: 3081440 - RNA, 21 nt, Mycobacterium bovis subsp bovis AF2122/97
caccacgaacucggccgggcg

SEQ ID NO: 3081441 - RNA, 23 nt, Mycobacterium bovis subsp bovis AF2122/97
caccacgaacucggccgggcggu

SEQ ID NO: 3081442 - RNA, 19 nt, Mycobacterium bovis subsp bovis AF2122/97
caccacgaccgacaccccg

SEQ ID NO: 3081443 - RNA, 16 nt, Mycobacterium bovis subsp bovis AF2122/97
caccacgagcagccga

SEQ ID NO: 3081444 - RNA, 13 nt, Mycobacterium bovis subsp bovis AF2122/97
caccacgaucgcg

SEQ ID NO: 3081445 - RNA, 20 nt, Mycobacterium bovis subsp bovis AF2122/97
caccacgaucgcgagcccau

SEQ ID NO: 3081446 - RNA, 17 nt, Mycobacterium bovis subsp bovis AF2122/97
caccacgauggcggcca

SEQ ID NO: 3081447 - RNA, 20 nt, Mycobacterium bovis subsp bovis AF2122/97
caccacgauggcggccaccg

SEQ ID NO: 3081448 - RNA, 23 nt, Mycobacterium bovis subsp bovis AF2122/97
caccacgccagcccguccggccc

SEQ ID NO: 3081449 - RNA, 18 nt, Mycobacterium bovis subsp bovis AF2122/97
caccacgcccgacgagga

SEQ ID NO: 3081450 - RNA, 14 nt, Mycobacterium bovis subsp bovis AF2122/97
caccacgccgaccg

SEQ ID NO: 3081451 - RNA, 13 nt, Mycobacterium bovis subsp bovis AF2122/97
caccacgccgguc

SEQ ID NO: 3081452 - RNA, 14 nt, Mycobacterium bovis subsp bovis AF2122/97
caccacgccguagc

SEQ ID NO: 3081453 - RNA, 14 nt, Mycobacterium bovis subsp bovis AF2122/97
caccacgcgccgca

SEQ ID NO: 3081454 - RNA, 13 nt, Mycobacterium bovis subsp bovis AF2122/97
caccacgcggcgg

SEQ ID NO: 3081455 - RNA, 16 nt, Mycobacterium bovis subsp bovis AF2122/97
caccacgcggcggucg

SEQ ID NO: 3081456 - RNA, 20 nt, Mycobacterium bovis subsp bovis AF2122/97
caccacgcggcggucguugc

SEQ ID NO: 3081457 - RNA, 22 nt, Mycobacterium bovis subsp bovis AF2122/97
caccacgcggcggucguugccg

SEQ ID NO: 3081458 - RNA, 18 nt, Mycobacterium bovis subsp bovis AF2122/97
caccacgcuggccucguc

SEQ ID NO: 3081459 - RNA, 18 nt, Mycobacterium bovis subsp bovis AF2122/97
caccacggaccagcgccg

SEQ ID NO: 3081460 - RNA, 20 nt, Mycobacterium bovis subsp bovis AF2122/97
caccacggaccagcgccgga

SEQ ID NO: 3081461 - RNA, 13 nt, Mycobacterium bovis subsp bovis AF2122/97
caccacggccagc

SEQ ID NO: 3081462 - RNA, 15 nt, Mycobacterium bovis subsp bovis AF2122/97
caccacggccagcgg

SEQ ID NO: 3081463 - RNA, 14 nt, Mycobacterium bovis subsp bovis AF2122/97
caccacggcgcgcg

SEQ ID NO: 3081464 - RNA, 22 nt, Mycobacterium bovis subsp bovis AF2122/97
caccacggcgcgcgcgccggcu

SEQ ID NO: 3081465 - RNA, 16 nt, Mycobacterium bovis subsp bovis AF2122/97
caccacggcggccacc

SEQ ID NO: 3081466 - RNA, 17 nt, Mycobacterium bovis subsp bovis AF2122/97
caccacggcggccaccu

SEQ ID NO: 3081467 - RNA, 14 nt, Mycobacterium bovis subsp bovis AF2122/97
caccacggcggcgg

SEQ ID NO: 3081468 - RNA, 19 nt, Mycobacterium bovis subsp bovis AF2122/97
caccacggcguugccgccg

SEQ ID NO: 3081469 - RNA, 19 nt, Mycobacterium bovis subsp bovis AF2122/97
caccacggucaagccggcg

SEQ ID NO: 3081470 - RNA, 22 nt, Mycobacterium bovis subsp bovis AF2122/97
caccacggucaagccggcgccc

SEQ ID NO: 3081471 - RNA, 20 nt, Mycobacterium bovis subsp bovis AF2122/97
caccacggugccgacgauga

SEQ ID NO: 3081472 - RNA, 18 nt, Mycobacterium bovis subsp bovis AF2122/97
caccacgguggccgcugc

SEQ ID NO: 3081473 - RNA, 14 nt, Mycobacterium bovis subsp bovis AF2122/97
caccacgucgacga

SEQ ID NO: 3081474 - RNA, 16 nt, Mycobacterium bovis subsp bovis AF2122/97
caccacgucgacgaug

SEQ ID NO: 3081475 - RNA, 18 nt, Mycobacterium bovis subsp bovis AF2122/97
caccacgucgacgauguc

SEQ ID NO: 3081476 - RNA, 15 nt, Mycobacterium bovis subsp bovis AF2122/97
caccacgucgucggg

SEQ ID NO: 3081477 - RNA, 16 nt, Mycobacterium bovis subsp bovis AF2122/97
caccacgugcgccacu

SEQ ID NO: 3081478 - RNA, 22 nt, Mycobacterium bovis subsp bovis AF2122/97
caccacguugugcagcgcguca

SEQ ID NO: 3081479 - RNA, 20 nt, Mycobacterium bovis subsp bovis AF2122/97
caccacuagcggcucaccgc

SEQ ID NO: 3081480 - RNA, 21 nt, Mycobacterium bovis subsp bovis AF2122/97
caccacuagcggcucaccgcg

SEQ ID NO: 3081481 - RNA, 22 nt, Mycobacterium bovis subsp bovis AF2122/97
caccacuaggucgccggccacg

SEQ ID NO: 3081482 - RNA, 17 nt, Mycobacterium bovis subsp bovis AF2122/97
caccacuggacccgccc

SEQ ID NO: 3081483 - RNA, 14 nt, Mycobacterium bovis subsp bovis AF2122/97
caccacuucggcgc

SEQ ID NO: 3081484 - RNA, 15 nt, Mycobacterium bovis subsp bovis AF2122/97
caccacuucggcgcc

SEQ ID NO: 3081485 - RNA, 19 nt, Mycobacterium bovis subsp bovis AF2122/97
caccacuuggguggcgccg

SEQ ID NO: 3081486 - RNA, 23 nt, Mycobacterium bovis subsp bovis AF2122/97
caccacuuggguggcgccguugu

SEQ ID NO: 3081487 - RNA, 12 nt, Mycobacterium bovis subsp bovis AF2122/97
caccagaaacac

SEQ ID NO: 3081488 - RNA, 17 nt, Mycobacterium bovis subsp bovis AF2122/97
caccagaaacaccgacg

SEQ ID NO: 3081489 - RNA, 22 nt, Mycobacterium bovis subsp bovis AF2122/97
caccagaaaugguucgcacacc

SEQ ID NO: 3081490 - RNA, 16 nt, Mycobacterium bovis subsp bovis AF2122/97
caccagaaccagcgac

SEQ ID NO: 3081491 - RNA, 13 nt, Mycobacterium bovis subsp bovis AF2122/97
caccagaaccggu

SEQ ID NO: 3081492 - RNA, 17 nt, Mycobacterium bovis subsp bovis AF2122/97
caccagaauccugcuuu

SEQ ID NO: 3081493 - RNA, 15 nt, Mycobacterium bovis subsp bovis AF2122/97
caccagacaacgccg

SEQ ID NO: 3081494 - RNA, 18 nt, Mycobacterium bovis subsp bovis AF2122/97
caccagacaacgccgucg

SEQ ID NO: 3081495 - RNA, 20 nt, Mycobacterium bovis subsp bovis AF2122/97
caccagauagaucgugaucg

SEQ ID NO: 3081496 - RNA, 20 nt, Mycobacterium bovis subsp bovis AF2122/97
caccagaucgcacaccaaca

SEQ ID NO: 3081497 - RNA, 22 nt, Mycobacterium bovis subsp bovis AF2122/97
caccagaucgcacaccaacacc

SEQ ID NO: 3081498 - RNA, 18 nt, Mycobacterium bovis subsp bovis AF2122/97
caccagaucuucgagcgc

SEQ ID NO: 3081499 - RNA, 19 nt, Mycobacterium bovis subsp bovis AF2122/97
caccagauggcucucggug

SEQ ID NO: 3081500 - RNA, 17 nt, Mycobacterium bovis subsp bovis AF2122/97
caccagcaacagcccga

SEQ ID NO: 3081501 - RNA, 21 nt, Mycobacterium bovis subsp bovis AF2122/97
caccagcaacagcccgaggcc

SEQ ID NO: 3081502 - RNA, 21 nt, Mycobacterium bovis subsp bovis AF2122/97
caccagcaagugugagcagac

SEQ ID NO: 3081503 - RNA, 13 nt, Mycobacterium bovis subsp bovis AF2122/97
caccagcaccccg

SEQ ID NO: 3081504 - RNA, 16 nt, Mycobacterium bovis subsp bovis AF2122/97
caccagcacggcaacc

SEQ ID NO: 3081505 - RNA, 19 nt, Mycobacterium bovis subsp bovis AF2122/97
caccagcacggcaaccagc

SEQ ID NO: 3081506 - RNA, 14 nt, Mycobacterium bovis subsp bovis AF2122/97
caccagcagcacca

SEQ ID NO: 3081507 - RNA, 13 nt, Mycobacterium bovis subsp bovis AF2122/97
caccagcagcacu

SEQ ID NO: 3081508 - RNA, 20 nt, Mycobacterium bovis subsp bovis AF2122/97
caccagcagcacuccggcga

SEQ ID NO: 3081509 - RNA, 14 nt, Mycobacterium bovis subsp bovis AF2122/97
caccagguccaccc

SEQ ID NO: 3081510 - RNA, 18 nt, Mycobacterium bovis subsp bovis AF2122/97
caccaggucuucgaccac

SEQ ID NO: 3081511 - RNA, 23 nt, Mycobacterium bovis subsp bovis AF2122/97
caccagguugccgagguugcgga

SEQ ID NO: 3081512 - RNA, 18 nt, Mycobacterium bovis subsp bovis AF2122/97
caccaguaccaccggcac

SEQ ID NO: 3081513 - RNA, 19 nt, Mycobacterium bovis subsp bovis AF2122/97
caccagucacgcccaccac

SEQ ID NO: 3081514 - RNA, 15 nt, Mycobacterium bovis subsp bovis AF2122/97
caccaguccagcggg

SEQ ID NO: 3081515 - RNA, 17 nt, Mycobacterium bovis subsp bovis AF2122/97
caccaguccagcgggca

SEQ ID NO: 3081516 - RNA, 14 nt, Mycobacterium bovis subsp bovis AF2122/97
caccagucgcccca

SEQ ID NO: 3081517 - RNA, 14 nt, Mycobacterium bovis subsp bovis AF2122/97
caccagugccccgc

SEQ ID NO: 3081518 - RNA, 18 nt, Mycobacterium bovis subsp bovis AF2122/97
caccagugccccgccgag

SEQ ID NO: 3081519 - RNA, 20 nt, Mycobacterium bovis subsp bovis AF2122/97
caccagugccccgccgagcg

SEQ ID NO: 3081520 - RNA, 19 nt, Mycobacterium bovis subsp bovis AF2122/97
caccaguggcgcgugcagc

SEQ ID NO: 3081521 - RNA, 21 nt, Mycobacterium bovis subsp bovis AF2122/97
caccaguuugugccgccgcgg

SEQ ID NO: 3081522 - RNA, 23 nt, Mycobacterium bovis subsp bovis AF2122/97
caccaguuugugccgccgcggca

SEQ ID NO: 3081523 - RNA, 16 nt, Mycobacterium bovis subsp bovis AF2122/97
caccauaggccgacgg

SEQ ID NO: 3081524 - RNA, 23 nt, Mycobacterium bovis subsp bovis AF2122/97
caccaucaacauugugcucgccg

SEQ ID NO: 3081525 - RNA, 14 nt, Mycobacterium bovis subsp bovis AF2122/97
caccaucaaggacu

SEQ ID NO: 3081526 - RNA, 14 nt, Mycobacterium bovis subsp bovis AF2122/97
caccaucaccgccu

SEQ ID NO: 3081527 - RNA, 20 nt, Mycobacterium bovis subsp bovis AF2122/97
caccaucacgguggccgcac

SEQ ID NO: 3081528 - RNA, 11 nt, Mycobacterium bovis subsp bovis AF2122/97
caccaucauca

SEQ ID NO: 3081529 - RNA, 12 nt, Mycobacterium bovis subsp bovis AF2122/97
caccaucaucac

SEQ ID NO: 3081530 - RNA, 14 nt, Mycobacterium bovis subsp bovis AF2122/97
caccauccagccca

SEQ ID NO: 3081531 - RNA, 14 nt, Mycobacterium bovis subsp bovis AF2122/97
caccauccgguccc

SEQ ID NO: 3081532 - RNA, 13 nt, Mycobacterium bovis subsp bovis AF2122/97
caccaucgccgcc

SEQ ID NO: 3081533 - RNA, 14 nt, Mycobacterium bovis subsp bovis AF2122/97
caccaucgccgccg

SEQ ID NO: 3081534 - RNA, 15 nt, Mycobacterium bovis subsp bovis AF2122/97
caccaucgccgccgu

SEQ ID NO: 3081535 - RNA, 18 nt, Mycobacterium bovis subsp bovis AF2122/97
caccaucgccgccguugc

SEQ ID NO: 3081536 - RNA, 17 nt, Mycobacterium bovis subsp bovis AF2122/97
caccaucgccucggcgc

SEQ ID NO: 3081537 - RNA, 21 nt, Mycobacterium bovis subsp bovis AF2122/97
caccaucgccucggcgcugcg

SEQ ID NO: 3081538 - RNA, 16 nt, Mycobacterium bovis subsp bovis AF2122/97
caccaucgcggccgcu

SEQ ID NO: 3081539 - RNA, 18 nt, Mycobacterium bovis subsp bovis AF2122/97
caccaucggcgaggccuc

SEQ ID NO: 3081540 - RNA, 19 nt, Mycobacterium bovis subsp bovis AF2122/97
caccaucggggaaggggcu

SEQ ID NO: 3081541 - RNA, 21 nt, Mycobacterium bovis subsp bovis AF2122/97
caccaucgguaucgagggcag

SEQ ID NO: 3081542 - RNA, 23 nt, Mycobacterium bovis subsp bovis AF2122/97
caccaucguugccggugccgccg

SEQ ID NO: 3081543 - RNA, 17 nt, Mycobacterium bovis subsp bovis AF2122/97
caccaucuccgccgucg

SEQ ID NO: 3081544 - RNA, 21 nt, Mycobacterium bovis subsp bovis AF2122/97
caccaucuccgccgucgccac

SEQ ID NO: 3081545 - RNA, 23 nt, Mycobacterium bovis subsp bovis AF2122/97
caccaucuguuccgugccagcug

SEQ ID NO: 3081546 - RNA, 16 nt, Mycobacterium bovis subsp bovis AF2122/97
caccaugaucacaccg

SEQ ID NO: 3081547 - RNA, 20 nt, Mycobacterium bovis subsp bovis AF2122/97
caccaugaucacaccgagcg

SEQ ID NO: 3081548 - RNA, 13 nt, Mycobacterium bovis subsp bovis AF2122/97
caccaugaucagc

SEQ ID NO: 3081549 - RNA, 17 nt, Mycobacterium bovis subsp bovis AF2122/97
caccaugaucaggcccc

SEQ ID NO: 3081550 - RNA, 20 nt, Mycobacterium bovis subsp bovis AF2122/97
caccaugauugccaggaccg

SEQ ID NO: 3081551 - RNA, 15 nt, Mycobacterium bovis subsp bovis AF2122/97
caccauggcgccgcg

SEQ ID NO: 3081552 - RNA, 16 nt, Mycobacterium bovis subsp bovis AF2122/97
caccauggcgccgcgc

SEQ ID NO: 3081553 - RNA, 17 nt, Mycobacterium bovis subsp bovis AF2122/97
caccauguacaggcugu

SEQ ID NO: 3081554 - RNA, 15 nt, Mycobacterium bovis subsp bovis AF2122/97
caccauguauuucuc

SEQ ID NO: 3081555 - RNA, 21 nt, Mycobacterium bovis subsp bovis AF2122/97
caccauguauuucucccagcc

SEQ ID NO: 3081556 - RNA, 23 nt, Mycobacterium bovis subsp bovis AF2122/97
caccauguauuucucccagccca

SEQ ID NO: 3081557 - RNA, 18 nt, Mycobacterium bovis subsp bovis AF2122/97
caccaugucggccacccg

SEQ ID NO: 3081558 - RNA, 20 nt, Mycobacterium bovis subsp bovis AF2122/97
caccaugucggccacccgga

SEQ ID NO: 3081559 - RNA, 16 nt, Mycobacterium bovis subsp bovis AF2122/97
caccauucgcaccggc

SEQ ID NO: 3081560 - RNA, 21 nt, Mycobacterium bovis subsp bovis AF2122/97
caccauuggccuaggacaccg

SEQ ID NO: 3081561 - RNA, 23 nt, Mycobacterium bovis subsp bovis AF2122/97
caccauuggccuaggacaccggc

SEQ ID NO: 3081562 - RNA, 17 nt, Mycobacterium bovis subsp bovis AF2122/97
cacccaaaccggcccgc

SEQ ID NO: 3081563 - RNA, 20 nt, Mycobacterium bovis subsp bovis AF2122/97
cacccaaaccggcccgcagc

SEQ ID NO: 3081564 - RNA, 23 nt, Mycobacterium bovis subsp bovis AF2122/97
cacccaaaccggcccgcagcagc

SEQ ID NO: 3081565 - RNA, 12 nt, Mycobacterium bovis subsp bovis AF2122/97
cacccaacccgg

SEQ ID NO: 3081566 - RNA, 21 nt, Mycobacterium bovis subsp bovis AF2122/97
cacccaacgcaauaagggaga

SEQ ID NO: 3081567 - RNA, 15 nt, Mycobacterium bovis subsp bovis AF2122/97
cacccaacuccauca

SEQ ID NO: 3081568 - RNA, 19 nt, Mycobacterium bovis subsp bovis AF2122/97
cacccaauacacccaacuc

SEQ ID NO: 3081569 - RNA, 14 nt, Mycobacterium bovis subsp bovis AF2122/97
cacccaaugccacc

SEQ ID NO: 3081570 - RNA, 16 nt, Mycobacterium bovis subsp bovis AF2122/97
cacccaaugccaccgc

SEQ ID NO: 3081571 - RNA, 16 nt, Mycobacterium bovis subsp bovis AF2122/97
cacccaauggagccgc

SEQ ID NO: 3081572 - RNA, 19 nt, Mycobacterium bovis subsp bovis AF2122/97
cacccaauucacgacgccg

SEQ ID NO: 3081573 - RNA, 23 nt, Mycobacterium bovis subsp bovis AF2122/97
cacccaauucacgacgccgagca

SEQ ID NO: 3081574 - RNA, 15 nt, Mycobacterium bovis subsp bovis AF2122/97
cacccacacccagcg

SEQ ID NO: 3081575 - RNA, 19 nt, Mycobacterium bovis subsp bovis AF2122/97
cacccacaugacgaucgcg

SEQ ID NO: 3081576 - RNA, 23 nt, Mycobacterium bovis subsp bovis AF2122/97
cacccacaugacgaucgcggcgg

SEQ ID NO: 3081577 - RNA, 14 nt, Mycobacterium bovis subsp bovis AF2122/97
cacccacauggcgg

SEQ ID NO: 3081578 - RNA, 15 nt, Mycobacterium bovis subsp bovis AF2122/97
cacccacauggcggc

SEQ ID NO: 3081579 - RNA, 17 nt, Mycobacterium bovis subsp bovis AF2122/97
cacccacauggcggccc

SEQ ID NO: 3081580 - RNA, 18 nt, Mycobacterium bovis subsp bovis AF2122/97
cacccacauggcggcccg

SEQ ID NO: 3081581 - RNA, 16 nt, Mycobacterium bovis subsp bovis AF2122/97
cacccacauggugauc

SEQ ID NO: 3081582 - RNA, 17 nt, Mycobacterium bovis subsp bovis AF2122/97
cacccaccacaccaagg

SEQ ID NO: 3081583 - RNA, 14 nt, Mycobacterium bovis subsp bovis AF2122/97
cacccaccagugca

SEQ ID NO: 3081584 - RNA, 16 nt, Mycobacterium bovis subsp bovis AF2122/97
cacccacccgcaccgc

SEQ ID NO: 3081585 - RNA, 14 nt, Mycobacterium bovis subsp bovis AF2122/97
cacccaccggacca

SEQ ID NO: 3081586 - RNA, 19 nt, Mycobacterium bovis subsp bovis AF2122/97
cacccaccggaccaccgcc

SEQ ID NO: 3081587 - RNA, 20 nt, Mycobacterium bovis subsp bovis AF2122/97
cacccaccggaccaccgccg

SEQ ID NO: 3081588 - RNA, 14 nt, Mycobacterium bovis subsp bovis AF2122/97
cacccaccggccac

SEQ ID NO: 3081589 - RNA, 15 nt, Mycobacterium bovis subsp bovis AF2122/97
cacccaccggccacc

SEQ ID NO: 3081590 - RNA, 16 nt, Mycobacterium bovis subsp bovis AF2122/97
cacccaccggccacca

SEQ ID NO: 3081591 - RNA, 19 nt, Mycobacterium bovis subsp bovis AF2122/97
cacccaccggccaccaggg

SEQ ID NO: 3081592 - RNA, 14 nt, Mycobacterium bovis subsp bovis AF2122/97
cacccacgccggug

SEQ ID NO: 3081593 - RNA, 14 nt, Mycobacterium bovis subsp bovis AF2122/97
cacccacgucgagc

SEQ ID NO: 3081594 - RNA, 15 nt, Mycobacterium bovis subsp bovis AF2122/97
cacccacuccgccga

SEQ ID NO: 3081595 - RNA, 16 nt, Mycobacterium bovis subsp bovis AF2122/97
cacccacucgacgucg

SEQ ID NO: 3081596 - RNA, 17 nt, Mycobacterium bovis subsp bovis AF2122/97
caccccuucgccagcgc

SEQ ID NO: 3081597 - RNA, 14 nt, Mycobacterium bovis subsp bovis AF2122/97
caccccuuugacgc

SEQ ID NO: 3081598 - RNA, 15 nt, Mycobacterium bovis subsp bovis AF2122/97
cacccgaaccgggga

SEQ ID NO: 3081599 - RNA, 15 nt, Mycobacterium bovis subsp bovis AF2122/97
cacccgaagccggcg

SEQ ID NO: 3081600 - RNA, 16 nt, Mycobacterium bovis subsp bovis AF2122/97
cacccgacacggcucg

SEQ ID NO: 3081601 - RNA, 16 nt, Mycobacterium bovis subsp bovis AF2122/97
cacccgacaugcgccg

SEQ ID NO: 3081602 - RNA, 21 nt, Mycobacterium bovis subsp bovis AF2122/97
cacccgagcgaugcgaccgac

SEQ ID NO: 3081603 - RNA, 14 nt, Mycobacterium bovis subsp bovis AF2122/97
cacccgagggccug

SEQ ID NO: 3081604 - RNA, 21 nt, Mycobacterium bovis subsp bovis AF2122/97
cacccgauaguucuggcccgc

SEQ ID NO: 3081605 - RNA, 13 nt, Mycobacterium bovis subsp bovis AF2122/97
cacccgaucgggc

SEQ ID NO: 3081606 - RNA, 12 nt, Mycobacterium bovis subsp bovis AF2122/97
cacccgauuggc

SEQ ID NO: 3081607 - RNA, 18 nt, Mycobacterium bovis subsp bovis AF2122/97
cacccgauuggccaaccc

SEQ ID NO: 3081608 - RNA, 19 nt, Mycobacterium bovis subsp bovis AF2122/97
cacccgauuggccaacccc

SEQ ID NO: 3081609 - RNA, 18 nt, Mycobacterium bovis subsp bovis AF2122/97
cacccgcaaugaccgcgg

SEQ ID NO: 3081610 - RNA, 12 nt, Mycobacterium bovis subsp bovis AF2122/97
cacccgcaccac

SEQ ID NO: 3081611 - RNA, 16 nt, Mycobacterium bovis subsp bovis AF2122/97
cacccgcaccaccggc

SEQ ID NO: 3081612 - RNA, 17 nt, Mycobacterium bovis subsp bovis AF2122/97
cacccgcaccaccggcc

SEQ ID NO: 3081613 - RNA, 19 nt, Mycobacterium bovis subsp bovis AF2122/97
cacccgcaccaccggcccc

SEQ ID NO: 3081614 - RNA, 20 nt, Mycobacterium bovis subsp bovis AF2122/97
cacccgcaccaccggcccca

SEQ ID NO: 3081615 - RNA, 22 nt, Mycobacterium bovis subsp bovis AF2122/97
cacccgcaccaccggccccacc

SEQ ID NO: 3081616 - RNA, 14 nt, Mycobacterium bovis subsp bovis AF2122/97
cacccgcaccgccg

SEQ ID NO: 3081617 - RNA, 13 nt, Mycobacterium bovis subsp bovis AF2122/97
cacccgcaccgcg

SEQ ID NO: 3081618 - RNA, 14 nt, Mycobacterium bovis subsp bovis AF2122/97
cacccgcaccgcgg

SEQ ID NO: 3081619 - RNA, 15 nt, Mycobacterium bovis subsp bovis AF2122/97
cacccgcaccgcggu

SEQ ID NO: 3081620 - RNA, 18 nt, Mycobacterium bovis subsp bovis AF2122/97
cacccgcaccgcgguacg

SEQ ID NO: 3081621 - RNA, 12 nt, Mycobacterium bovis subsp bovis AF2122/97
cacccgcaccgg

SEQ ID NO: 3081622 - RNA, 18 nt, Mycobacterium bovis subsp bovis AF2122/97
cacccgcaccggaucggc

SEQ ID NO: 3081623 - RNA, 15 nt, Mycobacterium bovis subsp bovis AF2122/97
cacccgcacgaagcc

SEQ ID NO: 3081624 - RNA, 14 nt, Mycobacterium bovis subsp bovis AF2122/97
cacccgcacggccu

SEQ ID NO: 3081625 - RNA, 16 nt, Mycobacterium bovis subsp bovis AF2122/97
cacccgcagaccgguu

SEQ ID NO: 3081626 - RNA, 14 nt, Mycobacterium bovis subsp bovis AF2122/97
cacccgcaggucga

SEQ ID NO: 3081627 - RNA, 21 nt, Mycobacterium bovis subsp bovis AF2122/97
cacccgcaggucgaucugcgc

SEQ ID NO: 3081628 - RNA, 18 nt, Mycobacterium bovis subsp bovis AF2122/97
cacccgcaggucgcacca

SEQ ID NO: 3081629 - RNA, 20 nt, Mycobacterium bovis subsp bovis AF2122/97
cacccgcaggucgcaccaca

SEQ ID NO: 3081630 - RNA, 20 nt, Mycobacterium bovis subsp bovis AF2122/97
cacccgcaggucgcuggccg

SEQ ID NO: 3081631 - RNA, 19 nt, Mycobacterium bovis subsp bovis AF2122/97
cacccgcaucggcacgcca

SEQ ID NO: 3081632 - RNA, 18 nt, Mycobacterium bovis subsp bovis AF2122/97
cacccgcauggcagcggc

SEQ ID NO: 3081633 - RNA, 13 nt, Mycobacterium bovis subsp bovis AF2122/97
cacccgccaacgc

SEQ ID NO: 3081634 - RNA, 11 nt, Mycobacterium bovis subsp bovis AF2122/97
cacccgccagg

SEQ ID NO: 3081635 - RNA, 17 nt, Mycobacterium bovis subsp bovis AF2122/97
cacccgccaggccgcgc

SEQ ID NO: 3081636 - RNA, 15 nt, Mycobacterium bovis subsp bovis AF2122/97
cacccgccagggcgg

SEQ ID NO: 3081637 - RNA, 16 nt, Mycobacterium bovis subsp bovis AF2122/97
cacccgccagggcggc

SEQ ID NO: 3081638 - RNA, 13 nt, Mycobacterium bovis subsp bovis AF2122/97
cacccgccgcagc

SEQ ID NO: 3081639 - RNA, 18 nt, Mycobacterium bovis subsp bovis AF2122/97
cacccgccgccgcccggg

SEQ ID NO: 3081640 - RNA, 21 nt, Mycobacterium bovis subsp bovis AF2122/97
cacccgccggauucgcccggg

SEQ ID NO: 3081641 - RNA, 13 nt, Mycobacterium bovis subsp bovis AF2122/97
cacccgccggccg

SEQ ID NO: 3081642 - RNA, 22 nt, Mycobacterium bovis subsp bovis AF2122/97
cacccgccggucaaacugccau

SEQ ID NO: 3081643 - RNA, 23 nt, Mycobacterium bovis subsp bovis AF2122/97
cacccgccggucaaacugccauc

SEQ ID NO: 3081644 - RNA, 11 nt, Mycobacterium bovis subsp bovis AF2122/97
cacccgccgug

SEQ ID NO: 3081645 - RNA, 16 nt, Mycobacterium bovis subsp bovis AF2122/97
cacccgccgugccccc

SEQ ID NO: 3081646 - RNA, 17 nt, Mycobacterium bovis subsp bovis AF2122/97
cacccgcgaacgcgaca

SEQ ID NO: 3081647 - RNA, 22 nt, Mycobacterium bovis subsp bovis AF2122/97
cacccgcgaacgcgacagccac

SEQ ID NO: 3081648 - RNA, 23 nt, Mycobacterium bovis subsp bovis AF2122/97
cacccgcgaacgcgacagccacc

SEQ ID NO: 3081649 - RNA, 16 nt, Mycobacterium bovis subsp bovis AF2122/97
cacccgcgaagccgcc

SEQ ID NO: 3081650 - RNA, 12 nt, Mycobacterium bovis subsp bovis AF2122/97
cacccgcgacga

SEQ ID NO: 3081651 - RNA, 17 nt, Mycobacterium bovis subsp bovis AF2122/97
cacccgcgagaucgggc

SEQ ID NO: 3081652 - RNA, 20 nt, Mycobacterium bovis subsp bovis AF2122/97
cacccgcgagaucgggccgg

SEQ ID NO: 3081653 - RNA, 23 nt, Mycobacterium bovis subsp bovis AF2122/97
cacccgcgagaucgggccggccg

SEQ ID NO: 3081654 - RNA, 13 nt, Mycobacterium bovis subsp bovis AF2122/97
cacccgcgccgcc

SEQ ID NO: 3081655 - RNA, 15 nt, Mycobacterium bovis subsp bovis AF2122/97
cacccgcgcgacgcc

SEQ ID NO: 3081656 - RNA, 19 nt, Mycobacterium bovis subsp bovis AF2122/97
cacccgcgcggagaccccg

SEQ ID NO: 3081657 - RNA, 13 nt, Mycobacterium bovis subsp bovis AF2122/97
cacccgcgcucca

SEQ ID NO: 3081658 - RNA, 12 nt, Mycobacterium bovis subsp bovis AF2122/97
cacccgcggcga

SEQ ID NO: 3081659 - RNA, 13 nt, Mycobacterium bovis subsp bovis AF2122/97
cacccgcggcgaa

SEQ ID NO: 3081660 - RNA, 15 nt, Mycobacterium bovis subsp bovis AF2122/97
cacccgcggcgaacc

SEQ ID NO: 3081661 - RNA, 13 nt, Mycobacterium bovis subsp bovis AF2122/97
cacccgcggcgcc

SEQ ID NO: 3081662 - RNA, 17 nt, Mycobacterium bovis subsp bovis AF2122/97
cacccgcggcgccguug

SEQ ID NO: 3081663 - RNA, 22 nt, Mycobacterium bovis subsp bovis AF2122/97
cacccgcgggucguccggcggc

SEQ ID NO: 3081664 - RNA, 19 nt, Mycobacterium bovis subsp bovis AF2122/97
cacccgcggugacgccagc

SEQ ID NO: 3081665 - RNA, 16 nt, Mycobacterium bovis subsp bovis AF2122/97
cacccgcuccagcucg

SEQ ID NO: 3081666 - RNA, 23 nt, Mycobacterium bovis subsp bovis AF2122/97
cacccgcuccauaucgucgggcg

SEQ ID NO: 3081667 - RNA, 17 nt, Mycobacterium bovis subsp bovis AF2122/97
cacccgcucgcccgccg

SEQ ID NO: 3081668 - RNA, 23 nt, Mycobacterium bovis subsp bovis AF2122/97
cacccgcucgcccgccgccacca

SEQ ID NO: 3081669 - RNA, 14 nt, Mycobacterium bovis subsp bovis AF2122/97
cacccgcucggccg

SEQ ID NO: 3081670 - RNA, 17 nt, Mycobacterium bovis subsp bovis AF2122/97
cacccgcucggccguca

SEQ ID NO: 3081671 - RNA, 14 nt, Mycobacterium bovis subsp bovis AF2122/97
cacccgcucggcgc

SEQ ID NO: 3081672 - RNA, 14 nt, Mycobacterium bovis subsp bovis AF2122/97
cacccgcugcacgc

SEQ ID NO: 3081673 - RNA, 20 nt, Mycobacterium bovis subsp bovis AF2122/97
cacccgcugcgagaucgcgg

SEQ ID NO: 3081674 - RNA, 14 nt, Mycobacterium bovis subsp bovis AF2122/97
cacccgcuggcggu

SEQ ID NO: 3081675 - RNA, 16 nt, Mycobacterium bovis subsp bovis AF2122/97
cacccgcuggucgagc

SEQ ID NO: 3081676 - RNA, 17 nt, Mycobacterium bovis subsp bovis AF2122/97
cacccgcuggucgagca

SEQ ID NO: 3081677 - RNA, 18 nt, Mycobacterium bovis subsp bovis AF2122/97
cacccggaaagaucucgg

SEQ ID NO: 3081678 - RNA, 22 nt, Mycobacterium bovis subsp bovis AF2122/97
cacccggacugcgaagaguccu

SEQ ID NO: 3081679 - RNA, 18 nt, Mycobacterium bovis subsp bovis AF2122/97
cacccggccaccggacga

SEQ ID NO: 3081680 - RNA, 23 nt, Mycobacterium bovis subsp bovis AF2122/97
cacccggccgaccucggcaacga

SEQ ID NO: 3081681 - RNA, 12 nt, Mycobacterium bovis subsp bovis AF2122/97
cacccggccgcc

SEQ ID NO: 3081682 - RNA, 13 nt, Mycobacterium bovis subsp bovis AF2122/97
cacccggccguug

SEQ ID NO: 3081683 - RNA, 18 nt, Mycobacterium bovis subsp bovis AF2122/97
caccgaaugcacgacggu

SEQ ID NO: 3081684 - RNA, 20 nt, Mycobacterium bovis subsp bovis AF2122/97
caccgaaugcacgacggugu

SEQ ID NO: 3081685 - RNA, 16 nt, Mycobacterium bovis subsp bovis AF2122/97
caccgaauuacgcacc

SEQ ID NO: 3081686 - RNA, 21 nt, Mycobacterium bovis subsp bovis AF2122/97
caccgacaagaauggccgccu

SEQ ID NO: 3081687 - RNA, 22 nt, Mycobacterium bovis subsp bovis AF2122/97
caccgacaagaauggccgccuu

SEQ ID NO: 3081688 - RNA, 20 nt, Mycobacterium bovis subsp bovis AF2122/97
caccgacaauucaacacacg

SEQ ID NO: 3081689 - RNA, 21 nt, Mycobacterium bovis subsp bovis AF2122/97
caccgacaauucaacacacgg

SEQ ID NO: 3081690 - RNA, 15 nt, Mycobacterium bovis subsp bovis AF2122/97
caccgacaccggccg

SEQ ID NO: 3081691 - RNA, 15 nt, Mycobacterium bovis subsp bovis AF2122/97
caccgacaccguguu

SEQ ID NO: 3081692 - RNA, 16 nt, Mycobacterium bovis subsp bovis AF2122/97
caccgacagcacccgg

SEQ ID NO: 3081693 - RNA, 23 nt, Mycobacterium bovis subsp bovis AF2122/97
caccgacagcacccggccaccgg

SEQ ID NO: 3081694 - RNA, 21 nt, Mycobacterium bovis subsp bovis AF2122/97
caccgacagcaguuucaccuu

SEQ ID NO: 3081695 - RNA, 22 nt, Mycobacterium bovis subsp bovis AF2122/97
caccgacagccccaucaccacc

SEQ ID NO: 3081696 - RNA, 23 nt, Mycobacterium bovis subsp bovis AF2122/97
caccgacagccccaucaccaccg

SEQ ID NO: 3081697 - RNA, 15 nt, Mycobacterium bovis subsp bovis AF2122/97
caccgacaugacgcg

SEQ ID NO: 3081698 - RNA, 17 nt, Mycobacterium bovis subsp bovis AF2122/97
caccgacaugacgcggc

SEQ ID NO: 3081699 - RNA, 19 nt, Mycobacterium bovis subsp bovis AF2122/97
caccgacauguguggcagc

SEQ ID NO: 3081700 - RNA, 14 nt, Mycobacterium bovis subsp bovis AF2122/97
caccgaccagggcc

SEQ ID NO: 3081701 - RNA, 17 nt, Mycobacterium bovis subsp bovis AF2122/97
caccgaccagggccgcc

SEQ ID NO: 3081702 - RNA, 18 nt, Mycobacterium bovis subsp bovis AF2122/97
caccgaccagggccgccg

SEQ ID NO: 3081703 - RNA, 19 nt, Mycobacterium bovis subsp bovis AF2122/97
caccgaccagggccgccgc

SEQ ID NO: 3081704 - RNA, 20 nt, Mycobacterium bovis subsp bovis AF2122/97
caccgaccagggccgccgcu

SEQ ID NO: 3081705 - RNA, 22 nt, Mycobacterium bovis subsp bovis AF2122/97
caccgacccgcugccacccauc

SEQ ID NO: 3081706 - RNA, 17 nt, Mycobacterium bovis subsp bovis AF2122/97
caccgaccgcaugaucg

SEQ ID NO: 3081707 - RNA, 13 nt, Mycobacterium bovis subsp bovis AF2122/97
caccgaccggguc

SEQ ID NO: 3081708 - RNA, 22 nt, Mycobacterium bovis subsp bovis AF2122/97
caccgaccgggucgcaaccgcc

SEQ ID NO: 3081709 - RNA, 16 nt, Mycobacterium bovis subsp bovis AF2122/97
caccgaccuaccgucg

SEQ ID NO: 3081710 - RNA, 18 nt, Mycobacterium bovis subsp bovis AF2122/97
caccgaccuaccgucgac

SEQ ID NO: 3081711 - RNA, 21 nt, Mycobacterium bovis subsp bovis AF2122/97
caccgaccuggacgcggccaa

SEQ ID NO: 3081712 - RNA, 14 nt, Mycobacterium bovis subsp bovis AF2122/97
caccgacgacacca

SEQ ID NO: 3081713 - RNA, 20 nt, Mycobacterium bovis subsp bovis AF2122/97
caccgacgacaccagagcga

SEQ ID NO: 3081714 - RNA, 16 nt, Mycobacterium bovis subsp bovis AF2122/97
caccgacgacaucggu

SEQ ID NO: 3081715 - RNA, 18 nt, Mycobacterium bovis subsp bovis AF2122/97
caccgacgacgcgcgcga

SEQ ID NO: 3081716 - RNA, 22 nt, Mycobacterium bovis subsp bovis AF2122/97
caccgacgacggcgacggcgcc

SEQ ID NO: 3081717 - RNA, 13 nt, Mycobacterium bovis subsp bovis AF2122/97
caccgacgcgaac

SEQ ID NO: 3081718 - RNA, 17 nt, Mycobacterium bovis subsp bovis AF2122/97
caccgacgcgaacgcgg

SEQ ID NO: 3081719 - RNA, 20 nt, Mycobacterium bovis subsp bovis AF2122/97
caccgacgcgaacgcggcca

SEQ ID NO: 3081720 - RNA, 22 nt, Mycobacterium bovis subsp bovis AF2122/97
caccgacgcgaacgcggccacc

SEQ ID NO: 3081721 - RNA, 13 nt, Mycobacterium bovis subsp bovis AF2122/97
caccgacgcgguc

SEQ ID NO: 3081722 - RNA, 14 nt, Mycobacterium bovis subsp bovis AF2122/97
caccgacgcggucg

SEQ ID NO: 3081723 - RNA, 21 nt, Mycobacterium bovis subsp bovis AF2122/97
caccgacgcggucggcggccg

SEQ ID NO: 3081724 - RNA, 23 nt, Mycobacterium bovis subsp bovis AF2122/97
caccgacgcggucggcggccgcc

SEQ ID NO: 3081725 - RNA, 13 nt, Mycobacterium bovis subsp bovis AF2122/97
caccgacgcgucg

SEQ ID NO: 3081726 - RNA, 14 nt, Mycobacterium bovis subsp bovis AF2122/97
caccgacgcgucgg

SEQ ID NO: 3081727 - RNA, 16 nt, Mycobacterium bovis subsp bovis AF2122/97
caccgacgcgucggcg

SEQ ID NO: 3081728 - RNA, 18 nt, Mycobacterium bovis subsp bovis AF2122/97
caccgacgcgucggcgac

SEQ ID NO: 3081729 - RNA, 19 nt, Mycobacterium bovis subsp bovis AF2122/97
caccgacgcgucggcgacg

SEQ ID NO: 3081730 - RNA, 19 nt, Mycobacterium bovis subsp bovis AF2122/97
caccgacggaaugucagcc

SEQ ID NO: 3081731 - RNA, 21 nt, Mycobacterium bovis subsp bovis AF2122/97
caccgacggaaugucagccgg

SEQ ID NO: 3081732 - RNA, 18 nt, Mycobacterium bovis subsp bovis AF2122/97
caccgacggaugaucagc

SEQ ID NO: 3081733 - RNA, 14 nt, Mycobacterium bovis subsp bovis AF2122/97
caccgacggcgcau

SEQ ID NO: 3081734 - RNA, 14 nt, Mycobacterium bovis subsp bovis AF2122/97
caccgacgucaggc

SEQ ID NO: 3081735 - RNA, 12 nt, Mycobacterium bovis subsp bovis AF2122/97
caccgacgucgc

SEQ ID NO: 3081736 - RNA, 15 nt, Mycobacterium bovis subsp bovis AF2122/97
caccgacugcuguca

SEQ ID NO: 3081737 - RNA, 19 nt, Mycobacterium bovis subsp bovis AF2122/97
caccgacugcugucaccgc

SEQ ID NO: 3081738 - RNA, 17 nt, Mycobacterium bovis subsp bovis AF2122/97
caccgagaaagugcagu

SEQ ID NO: 3081739 - RNA, 19 nt, Mycobacterium bovis subsp bovis AF2122/97
caccgagaagcugugccuu

SEQ ID NO: 3081740 - RNA, 21 nt, Mycobacterium bovis subsp bovis AF2122/97
caccgagcaaacacgccucgc

SEQ ID NO: 3081741 - RNA, 15 nt, Mycobacterium bovis subsp bovis AF2122/97
caccgagccacgacc

SEQ ID NO: 3081742 - RNA, 16 nt, Mycobacterium bovis subsp bovis AF2122/97
caccgagccacgaccc

SEQ ID NO: 3081743 - RNA, 18 nt, Mycobacterium bovis subsp bovis AF2122/97
caccgagccacgacccag

SEQ ID NO: 3081744 - RNA, 20 nt, Mycobacterium bovis subsp bovis AF2122/97
caccgagccacgacccagca

SEQ ID NO: 3081745 - RNA, 12 nt, Mycobacterium bovis subsp bovis AF2122/97
caccgagccgau

SEQ ID NO: 3081746 - RNA, 21 nt, Mycobacterium bovis subsp bovis AF2122/97
caccgagccguccaagccagc

SEQ ID NO: 3081747 - RNA, 15 nt, Mycobacterium bovis subsp bovis AF2122/97
caccgagcgagacca

SEQ ID NO: 3081748 - RNA, 20 nt, Mycobacterium bovis subsp bovis AF2122/97
caccgagcgcaaucgaccac

SEQ ID NO: 3081749 - RNA, 21 nt, Mycobacterium bovis subsp bovis AF2122/97
caccgagcgcaaucgaccacg

SEQ ID NO: 3081750 - RNA, 13 nt, Mycobacterium bovis subsp bovis AF2122/97
caccgagcugagc

SEQ ID NO: 3081751 - RNA, 18 nt, Mycobacterium bovis subsp bovis AF2122/97
caccgagcugagcggcca

SEQ ID NO: 3081752 - RNA, 20 nt, Mycobacterium bovis subsp bovis AF2122/97
caccgagcugagcggccagc

SEQ ID NO: 3081753 - RNA, 21 nt, Mycobacterium bovis subsp bovis AF2122/97
caccgagcugagcggccagca

SEQ ID NO: 3081754 - RNA, 17 nt, Mycobacterium bovis subsp bovis AF2122/97
caccgaggaccucguca

SEQ ID NO: 3081755 - RNA, 19 nt, Mycobacterium bovis subsp bovis AF2122/97
caccgaggaccucgucacc

SEQ ID NO: 3081756 - RNA, 13 nt, Mycobacterium bovis subsp bovis AF2122/97
caccgaggccgcc

SEQ ID NO: 3081757 - RNA, 14 nt, Mycobacterium bovis subsp bovis AF2122/97
caccgaggccgccg

SEQ ID NO: 3081758 - RNA, 15 nt, Mycobacterium bovis subsp bovis AF2122/97
caccgaggccgccga

SEQ ID NO: 3081759 - RNA, 16 nt, Mycobacterium bovis subsp bovis AF2122/97
caccgaggccgccgag

SEQ ID NO: 3081760 - RNA, 17 nt, Mycobacterium bovis subsp bovis AF2122/97
caccgaggccgccgaga

SEQ ID NO: 3081761 - RNA, 18 nt, Mycobacterium bovis subsp bovis AF2122/97
caccgaggucgagcgacc

SEQ ID NO: 3081762 - RNA, 20 nt, Mycobacterium bovis subsp bovis AF2122/97
caccgaggucgagcgacccc

SEQ ID NO: 3081763 - RNA, 14 nt, Mycobacterium bovis subsp bovis AF2122/97
caccgaggucggcc

SEQ ID NO: 3081764 - RNA, 19 nt, Mycobacterium bovis subsp bovis AF2122/97
caccgaggugccgcgcagc

SEQ ID NO: 3081765 - RNA, 20 nt, Mycobacterium bovis subsp bovis AF2122/97
caccgaggugccgcgcagcu

SEQ ID NO: 3081766 - RNA, 23 nt, Mycobacterium bovis subsp bovis AF2122/97
caccgaggugccgcgcagcugcc

SEQ ID NO: 3081767 - RNA, 18 nt, Mycobacterium bovis subsp bovis AF2122/97
caccgagucgacggccag

SEQ ID NO: 3081768 - RNA, 13 nt, Mycobacterium bovis subsp bovis AF2122/97
caccgagucgauc

SEQ ID NO: 3081769 - RNA, 22 nt, Mycobacterium bovis subsp bovis AF2122/97
caccgcccuugccgccggcccc

SEQ ID NO: 3081770 - RNA, 16 nt, Mycobacterium bovis subsp bovis AF2122/97
caccgccgaacagugu

SEQ ID NO: 3081771 - RNA, 22 nt, Mycobacterium bovis subsp bovis AF2122/97
caccgccgaacagugucgauag

SEQ ID NO: 3081772 - RNA, 12 nt, Mycobacterium bovis subsp bovis AF2122/97
caccgccgaccc

SEQ ID NO: 3081773 - RNA, 17 nt, Mycobacterium bovis subsp bovis AF2122/97
caccgccgaccuaguca

SEQ ID NO: 3081774 - RNA, 13 nt, Mycobacterium bovis subsp bovis AF2122/97
caccgccgacgcc

SEQ ID NO: 3081775 - RNA, 14 nt, Mycobacterium bovis subsp bovis AF2122/97
caccgccgacgccc

SEQ ID NO: 3081776 - RNA, 17 nt, Mycobacterium bovis subsp bovis AF2122/97
caccgccgacgcccgac

SEQ ID NO: 3081777 - RNA, 18 nt, Mycobacterium bovis subsp bovis AF2122/97
caccgccgacgcccgacg

SEQ ID NO: 3081778 - RNA, 16 nt, Mycobacterium bovis subsp bovis AF2122/97
caccgccgagcagacg

SEQ ID NO: 3081779 - RNA, 20 nt, Mycobacterium bovis subsp bovis AF2122/97
caccgccgagcagacgcgga

SEQ ID NO: 3081780 - RNA, 22 nt, Mycobacterium bovis subsp bovis AF2122/97
caccgccgcacgcuagccgaca

SEQ ID NO: 3081781 - RNA, 15 nt, Mycobacterium bovis subsp bovis AF2122/97
caccgccgcaucguu

SEQ ID NO: 3081782 - RNA, 23 nt, Mycobacterium bovis subsp bovis AF2122/97
caccgccgccaagcucggccacc

SEQ ID NO: 3081783 - RNA, 20 nt, Mycobacterium bovis subsp bovis AF2122/97
caccgccgccaccaccgcug

SEQ ID NO: 3081784 - RNA, 18 nt, Mycobacterium bovis subsp bovis AF2122/97
caccgccgcccccgccgg

SEQ ID NO: 3081785 - RNA, 22 nt, Mycobacterium bovis subsp bovis AF2122/97
caccgccgcccccgccggccgc

SEQ ID NO: 3081786 - RNA, 23 nt, Mycobacterium bovis subsp bovis AF2122/97
caccgccgcccccgccggccgcg

SEQ ID NO: 3081787 - RNA, 22 nt, Mycobacterium bovis subsp bovis AF2122/97
caccgccgccgaagcgaugccg

SEQ ID NO: 3081788 - RNA, 13 nt, Mycobacterium bovis subsp bovis AF2122/97
caccgccgccgcc

SEQ ID NO: 3081789 - RNA, 14 nt, Mycobacterium bovis subsp bovis AF2122/97
caccgccgccgcca

SEQ ID NO: 3081790 - RNA, 15 nt, Mycobacterium bovis subsp bovis AF2122/97
caccgccgccgccac

SEQ ID NO: 3081791 - RNA, 22 nt, Mycobacterium bovis subsp bovis AF2122/97
caccgccgccgccaccggcgcc

SEQ ID NO: 3081792 - RNA, 14 nt, Mycobacterium bovis subsp bovis AF2122/97
caccgccgccgccg

SEQ ID NO: 3081793 - RNA, 15 nt, Mycobacterium bovis subsp bovis AF2122/97
caccgccgccgccga

SEQ ID NO: 3081794 - RNA, 17 nt, Mycobacterium bovis subsp bovis AF2122/97
caccgccgccgccgacg

SEQ ID NO: 3081795 - RNA, 12 nt, Mycobacterium bovis subsp bovis AF2122/97
caccgccgccgg

SEQ ID NO: 3081796 - RNA, 15 nt, Mycobacterium bovis subsp bovis AF2122/97
caccgccgccggcac

SEQ ID NO: 3081797 - RNA, 18 nt, Mycobacterium bovis subsp bovis AF2122/97
caccgccgccggcaccgc

SEQ ID NO: 3081798 - RNA, 20 nt, Mycobacterium bovis subsp bovis AF2122/97
caccgccgccggcaccgccg

SEQ ID NO: 3081799 - RNA, 23 nt, Mycobacterium bovis subsp bovis AF2122/97
caccgccgccggcaccgccggcg

SEQ ID NO: 3081800 - RNA, 13 nt, Mycobacterium bovis subsp bovis AF2122/97
caccgccgccugc

SEQ ID NO: 3081801 - RNA, 17 nt, Mycobacterium bovis subsp bovis AF2122/97
caccgccgccugcccgg

SEQ ID NO: 3081802 - RNA, 21 nt, Mycobacterium bovis subsp bovis AF2122/97
caccgccgccugcccggcccg

SEQ ID NO: 3081803 - RNA, 14 nt, Mycobacterium bovis subsp bovis AF2122/97
caccgccgcgaccg

SEQ ID NO: 3081804 - RNA, 17 nt, Mycobacterium bovis subsp bovis AF2122/97
caccgccgcgaccgccu

SEQ ID NO: 3081805 - RNA, 18 nt, Mycobacterium bovis subsp bovis AF2122/97
caccgccgcgccggcggc

SEQ ID NO: 3081806 - RNA, 20 nt, Mycobacterium bovis subsp bovis AF2122/97
caccgccgcgccggcggcca

SEQ ID NO: 3081807 - RNA, 22 nt, Mycobacterium bovis subsp bovis AF2122/97
caccgccgcgccggcggccacc

SEQ ID NO: 3081808 - RNA, 13 nt, Mycobacterium bovis subsp bovis AF2122/97
caccgccgcgcgg

SEQ ID NO: 3081809 - RNA, 17 nt, Mycobacterium bovis subsp bovis AF2122/97
caccgccgcgcggauac

SEQ ID NO: 3081810 - RNA, 12 nt, Mycobacterium bovis subsp bovis AF2122/97
caccgccgcggc

SEQ ID NO: 3081811 - RNA, 14 nt, Mycobacterium bovis subsp bovis AF2122/97
caccgccgcggccg

SEQ ID NO: 3081812 - RNA, 15 nt, Mycobacterium bovis subsp bovis AF2122/97
caccgccgcggccgc

SEQ ID NO: 3081813 - RNA, 15 nt, Mycobacterium bovis subsp bovis AF2122/97
caccgccgcgucgag

SEQ ID NO: 3081814 - RNA, 18 nt, Mycobacterium bovis subsp bovis AF2122/97
caccgccgcuaccgcccg

SEQ ID NO: 3081815 - RNA, 19 nt, Mycobacterium bovis subsp bovis AF2122/97
caccgccgcuaccgcccgc

SEQ ID NO: 3081816 - RNA, 22 nt, Mycobacterium bovis subsp bovis AF2122/97
caccgccggcaauaccgccagc

SEQ ID NO: 3081817 - RNA, 16 nt, Mycobacterium bovis subsp bovis AF2122/97
caccgccggcaccgcc

SEQ ID NO: 3081818 - RNA, 17 nt, Mycobacterium bovis subsp bovis AF2122/97
caccgccggcaccgcca

SEQ ID NO: 3081819 - RNA, 22 nt, Mycobacterium bovis subsp bovis AF2122/97
caccgccggcaccgccggcgcc

SEQ ID NO: 3081820 - RNA, 23 nt, Mycobacterium bovis subsp bovis AF2122/97
caccgccggcagcaucggcaccc

SEQ ID NO: 3081821 - RNA, 13 nt, Mycobacterium bovis subsp bovis AF2122/97
caccgccggcccg

SEQ ID NO: 3081822 - RNA, 14 nt, Mycobacterium bovis subsp bovis AF2122/97
caccgccggccuug

SEQ ID NO: 3081823 - RNA, 12 nt, Mycobacterium bovis subsp bovis AF2122/97
caccgccggcga

SEQ ID NO: 3081824 - RNA, 19 nt, Mycobacterium bovis subsp bovis AF2122/97
caccgccggcgacgggucg

SEQ ID NO: 3081825 - RNA, 13 nt, Mycobacterium bovis subsp bovis AF2122/97
caccgccggcgcc

SEQ ID NO: 3081826 - RNA, 21 nt, Mycobacterium bovis subsp bovis AF2122/97
caccgccggcgcccaggccga

SEQ ID NO: 3081827 - RNA, 12 nt, Mycobacterium bovis subsp bovis AF2122/97
caccgccggcgg

SEQ ID NO: 3081828 - RNA, 15 nt, Mycobacterium bovis subsp bovis AF2122/97
caccgccggcggcgg

SEQ ID NO: 3081829 - RNA, 14 nt, Mycobacterium bovis subsp bovis AF2122/97
caccgccgggcugu

SEQ ID NO: 3081830 - RNA, 16 nt, Mycobacterium bovis subsp bovis AF2122/97
caccgccggugccgcc

SEQ ID NO: 3081831 - RNA, 17 nt, Mycobacterium bovis subsp bovis AF2122/97
caccgccggugccgcca

SEQ ID NO: 3081832 - RNA, 17 nt, Mycobacterium bovis subsp bovis AF2122/97
caccgccggugcggcca

SEQ ID NO: 3081833 - RNA, 21 nt, Mycobacterium bovis subsp bovis AF2122/97
caccgccgucaccgucauugc

SEQ ID NO: 3081834 - RNA, 21 nt, Mycobacterium bovis subsp bovis AF2122/97
caccgccgucggguugcgacg

SEQ ID NO: 3081835 - RNA, 15 nt, Mycobacterium bovis subsp bovis AF2122/97
caccgccguugccgc

SEQ ID NO: 3081836 - RNA, 22 nt, Mycobacterium bovis subsp bovis AF2122/97
caccgccguugccgccggcgcc

SEQ ID NO: 3081837 - RNA, 24 nt, Mycobacterium bovis subsp bovis AF2122/97
caccgccguugccgccggcgccgc

SEQ ID NO: 3081838 - RNA, 20 nt, Mycobacterium bovis subsp bovis AF2122/97
caccgccguugggccgcgcc

SEQ ID NO: 3081839 - RNA, 14 nt, Mycobacterium bovis subsp bovis AF2122/97
caccgccugcgccg

SEQ ID NO: 3081840 - RNA, 15 nt, Mycobacterium bovis subsp bovis AF2122/97
caccgccugcgccgc

SEQ ID NO: 3081841 - RNA, 18 nt, Mycobacterium bovis subsp bovis AF2122/97
caccgccugcgccgcccg

SEQ ID NO: 3081842 - RNA, 21 nt, Mycobacterium bovis subsp bovis AF2122/97
caccgccugcgccgcccgcgc

SEQ ID NO: 3081843 - RNA, 17 nt, Mycobacterium bovis subsp bovis AF2122/97
caccgccugcucggcga

SEQ ID NO: 3081844 - RNA, 19 nt, Mycobacterium bovis subsp bovis AF2122/97
caccgccugcucggcgacc

SEQ ID NO: 3081845 - RNA, 22 nt, Mycobacterium bovis subsp bovis AF2122/97
caccgccuggaucagcgcguug

SEQ ID NO: 3081846 - RNA, 14 nt, Mycobacterium bovis subsp bovis AF2122/97
caccgccugggcgg

SEQ ID NO: 3081847 - RNA, 18 nt, Mycobacterium bovis subsp bovis AF2122/97
caccgccugggcggccag

SEQ ID NO: 3081848 - RNA, 19 nt, Mycobacterium bovis subsp bovis AF2122/97
caccgccugggcggccagc

SEQ ID NO: 3081849 - RNA, 20 nt, Mycobacterium bovis subsp bovis AF2122/97
caccgccugggcggccagca

SEQ ID NO: 3081850 - RNA, 17 nt, Mycobacterium bovis subsp bovis AF2122/97
caccgccugugccgccg

SEQ ID NO: 3081851 - RNA, 20 nt, Mycobacterium bovis subsp bovis AF2122/97
caccgccugugccgccggcg

SEQ ID NO: 3081852 - RNA, 21 nt, Mycobacterium bovis subsp bovis AF2122/97
caccgccugugccgccggcgc

SEQ ID NO: 3081853 - RNA, 23 nt, Mycobacterium bovis subsp bovis AF2122/97
caccgccugugccgccggcgcca

SEQ ID NO: 3081854 - RNA, 15 nt, Mycobacterium bovis subsp bovis AF2122/97
caccgccuuggucac

SEQ ID NO: 3081855 - RNA, 13 nt, Mycobacterium bovis subsp bovis AF2122/97
caccgcugaccgc

SEQ ID NO: 3081856 - RNA, 14 nt, Mycobacterium bovis subsp bovis AF2122/97
caccgcugaccgca

SEQ ID NO: 3081857 - RNA, 23 nt, Mycobacterium bovis subsp bovis AF2122/97
caccgcugaggaacccuccggac

SEQ ID NO: 3081858 - RNA, 14 nt, Mycobacterium bovis subsp bovis AF2122/97
caccgcugccggca

SEQ ID NO: 3081859 - RNA, 15 nt, Mycobacterium bovis subsp bovis AF2122/97
caccgcugccggcac

SEQ ID NO: 3081860 - RNA, 16 nt, Mycobacterium bovis subsp bovis AF2122/97
caccgcugccggcacg

SEQ ID NO: 3081861 - RNA, 16 nt, Mycobacterium bovis subsp bovis AF2122/97
caccgcugccggcagc

SEQ ID NO: 3081862 - RNA, 17 nt, Mycobacterium bovis subsp bovis AF2122/97
caccgcugccggcagcg

SEQ ID NO: 3081863 - RNA, 15 nt, Mycobacterium bovis subsp bovis AF2122/97
caccgcugccggcgc

SEQ ID NO: 3081864 - RNA, 16 nt, Mycobacterium bovis subsp bovis AF2122/97
caccgcugccggcgcc

SEQ ID NO: 3081865 - RNA, 17 nt, Mycobacterium bovis subsp bovis AF2122/97
caccgcugccggcgccg

SEQ ID NO: 3081866 - RNA, 19 nt, Mycobacterium bovis subsp bovis AF2122/97
caccgcugccggcgccgcc

SEQ ID NO: 3081867 - RNA, 14 nt, Mycobacterium bovis subsp bovis AF2122/97
caccgcugcggcac

SEQ ID NO: 3081868 - RNA, 22 nt, Mycobacterium bovis subsp bovis AF2122/97
caccgcugcggcaccacccggc

SEQ ID NO: 3081869 - RNA, 14 nt, Mycobacterium bovis subsp bovis AF2122/97
caccgcuggaucga

SEQ ID NO: 3081870 - RNA, 14 nt, Mycobacterium bovis subsp bovis AF2122/97
caccgcugucgaug

SEQ ID NO: 3081871 - RNA, 19 nt, Mycobacterium bovis subsp bovis AF2122/97
caccgcuguguucagcgca

SEQ ID NO: 3081872 - RNA, 19 nt, Mycobacterium bovis subsp bovis AF2122/97
caccgcuguucuuggugac

SEQ ID NO: 3081873 - RNA, 22 nt, Mycobacterium bovis subsp bovis AF2122/97
caccgcuguucuuggugaccaa

SEQ ID NO: 3081874 - RNA, 20 nt, Mycobacterium bovis subsp bovis AF2122/97
caccgcuguugcaucgccgc

SEQ ID NO: 3081875 - RNA, 13 nt, Mycobacterium bovis subsp bovis AF2122/97
caccgcuugcugg

SEQ ID NO: 3081876 - RNA, 17 nt, Mycobacterium bovis subsp bovis AF2122/97
caccggaacccccagcu

SEQ ID NO: 3081877 - RNA, 19 nt, Mycobacterium bovis subsp bovis AF2122/97
caccggaacccccagcugc

SEQ ID NO: 3081878 - RNA, 20 nt, Mycobacterium bovis subsp bovis AF2122/97
caccggaacgccgucgagca

SEQ ID NO: 3081879 - RNA, 14 nt, Mycobacterium bovis subsp bovis AF2122/97
caccggaauccccc

SEQ ID NO: 3081880 - RNA, 21 nt, Mycobacterium bovis subsp bovis AF2122/97
caccggaauccuggccgccgc

SEQ ID NO: 3081881 - RNA, 20 nt, Mycobacterium bovis subsp bovis AF2122/97
caccggaauuugcgucgugg

SEQ ID NO: 3081882 - RNA, 16 nt, Mycobacterium bovis subsp bovis AF2122/97
caccggaccaccgccg

SEQ ID NO: 3081883 - RNA, 13 nt, Mycobacterium bovis subsp bovis AF2122/97
caccggaccgacc

SEQ ID NO: 3081884 - RNA, 15 nt, Mycobacterium bovis subsp bovis AF2122/97
caccggaccgaccac

SEQ ID NO: 3081885 - RNA, 13 nt, Mycobacterium bovis subsp bovis AF2122/97
caccggagcgccg

SEQ ID NO: 3081886 - RNA, 16 nt, Mycobacterium bovis subsp bovis AF2122/97
caccggagucggcguc

SEQ ID NO: 3081887 - RNA, 18 nt, Mycobacterium bovis subsp bovis AF2122/97
caccggagucggcgucga

SEQ ID NO: 3081888 - RNA, 21 nt, Mycobacterium bovis subsp bovis AF2122/97
caccggaguucucgcugauca

SEQ ID NO: 3081889 - RNA, 17 nt, Mycobacterium bovis subsp bovis AF2122/97
caccggauacagccacg

SEQ ID NO: 3081890 - RNA, 19 nt, Mycobacterium bovis subsp bovis AF2122/97
caccggauacagccacgca

SEQ ID NO: 3081891 - RNA, 15 nt, Mycobacterium bovis subsp bovis AF2122/97
caccggauagguggu

SEQ ID NO: 3081892 - RNA, 15 nt, Mycobacterium bovis subsp bovis AF2122/97
caccggaucaccgcg

SEQ ID NO: 3081893 - RNA, 14 nt, Mycobacterium bovis subsp bovis AF2122/97
caccggauccacgg

SEQ ID NO: 3081894 - RNA, 15 nt, Mycobacterium bovis subsp bovis AF2122/97
caccggauccacgga

SEQ ID NO: 3081895 - RNA, 17 nt, Mycobacterium bovis subsp bovis AF2122/97
caccggaucgccgucgc

SEQ ID NO: 3081896 - RNA, 19 nt, Mycobacterium bovis subsp bovis AF2122/97
caccggaucgccgucggcg

SEQ ID NO: 3081897 - RNA, 17 nt, Mycobacterium bovis subsp bovis AF2122/97
caccggaucgcucccgu

SEQ ID NO: 3081898 - RNA, 12 nt, Mycobacterium bovis subsp bovis AF2122/97
caccggaucggc

SEQ ID NO: 3081899 - RNA, 17 nt, Mycobacterium bovis subsp bovis AF2122/97
caccggaucggcuaccu

SEQ ID NO: 3081900 - RNA, 21 nt, Mycobacterium bovis subsp bovis AF2122/97
caccggaucggcuaccuaacc

SEQ ID NO: 3081901 - RNA, 20 nt, Mycobacterium bovis subsp bovis AF2122/97
caccggaucgucgaacagca

SEQ ID NO: 3081902 - RNA, 22 nt, Mycobacterium bovis subsp bovis AF2122/97
caccggauucuucggugaagaa

SEQ ID NO: 3081903 - RNA, 19 nt, Mycobacterium bovis subsp bovis AF2122/97
caccggcaacaucagcagg

SEQ ID NO: 3081904 - RNA, 18 nt, Mycobacterium bovis subsp bovis AF2122/97
caccggcaagccacgccg

SEQ ID NO: 3081905 - RNA, 17 nt, Mycobacterium bovis subsp bovis AF2122/97
caccggcaaucggcggc

SEQ ID NO: 3081906 - RNA, 18 nt, Mycobacterium bovis subsp bovis AF2122/97
caccggcaccacgaucaa

SEQ ID NO: 3081907 - RNA, 16 nt, Mycobacterium bovis subsp bovis AF2122/97
caccggcacccccguc

SEQ ID NO: 3081908 - RNA, 15 nt, Mycobacterium bovis subsp bovis AF2122/97
caccggcacccgcac

SEQ ID NO: 3081909 - RNA, 16 nt, Mycobacterium bovis subsp bovis AF2122/97
caccggcacccgcugg

SEQ ID NO: 3081910 - RNA, 13 nt, Mycobacterium bovis subsp bovis AF2122/97
caccggcaccgcc

SEQ ID NO: 3081911 - RNA, 14 nt, Mycobacterium bovis subsp bovis AF2122/97
caccggcaccgcug

SEQ ID NO: 3081912 - RNA, 19 nt, Mycobacterium bovis subsp bovis AF2122/97
caccggcaccgcugccgcu

SEQ ID NO: 3081913 - RNA, 14 nt, Mycobacterium bovis subsp bovis AF2122/97
caccggcaccggcc

SEQ ID NO: 3081914 - RNA, 15 nt, Mycobacterium bovis subsp bovis AF2122/97
caccggcaccggccg

SEQ ID NO: 3081915 - RNA, 15 nt, Mycobacterium bovis subsp bovis AF2122/97
caccggcacgucgcc

SEQ ID NO: 3081916 - RNA, 18 nt, Mycobacterium bovis subsp bovis AF2122/97
caccggcacugcccagca

SEQ ID NO: 3081917 - RNA, 17 nt, Mycobacterium bovis subsp bovis AF2122/97
caccggcagcgcgaucg

SEQ ID NO: 3081918 - RNA, 14 nt, Mycobacterium bovis subsp bovis AF2122/97
caccggcaggcggg

SEQ ID NO: 3081919 - RNA, 17 nt, Mycobacterium bovis subsp bovis AF2122/97
caccggcaggcggggga

SEQ ID NO: 3081920 - RNA, 12 nt, Mycobacterium bovis subsp bovis AF2122/97
caccggccacca

SEQ ID NO: 3081921 - RNA, 19 nt, Mycobacterium bovis subsp bovis AF2122/97
caccggccaccagggccac

SEQ ID NO: 3081922 - RNA, 17 nt, Mycobacterium bovis subsp bovis AF2122/97
caccggccacucgggac

SEQ ID NO: 3081923 - RNA, 14 nt, Mycobacterium bovis subsp bovis AF2122/97
caccggccagcggc

SEQ ID NO: 3081924 - RNA, 14 nt, Mycobacterium bovis subsp bovis AF2122/97
caccggccaggccg

SEQ ID NO: 3081925 - RNA, 13 nt, Mycobacterium bovis subsp bovis AF2122/97
caccggccagugg

SEQ ID NO: 3081926 - RNA, 14 nt, Mycobacterium bovis subsp bovis AF2122/97
caccggccccaccg

SEQ ID NO: 3081927 - RNA, 16 nt, Mycobacterium bovis subsp bovis AF2122/97
caccggccccaccgac

SEQ ID NO: 3081928 - RNA, 16 nt, Mycobacterium bovis subsp bovis AF2122/97
caccggccccaccggc

SEQ ID NO: 3081929 - RNA, 18 nt, Mycobacterium bovis subsp bovis AF2122/97
caccggccccaccggcac

SEQ ID NO: 3081930 - RNA, 12 nt, Mycobacterium bovis subsp bovis AF2122/97
caccggccgccg

SEQ ID NO: 3081931 - RNA, 15 nt, Mycobacterium bovis subsp bovis AF2122/97
caccggccgccgaca

SEQ ID NO: 3081932 - RNA, 13 nt, Mycobacterium bovis subsp bovis AF2122/97
caccggccgcgca

SEQ ID NO: 3081933 - RNA, 14 nt, Mycobacterium bovis subsp bovis AF2122/97
caccggccgcgcag

SEQ ID NO: 3081934 - RNA, 14 nt, Mycobacterium bovis subsp bovis AF2122/97
caccggccgcggcg

SEQ ID NO: 3081935 - RNA, 23 nt, Mycobacterium bovis subsp bovis AF2122/97
caccggccgguggguagccagcg

SEQ ID NO: 3081936 - RNA, 16 nt, Mycobacterium bovis subsp bovis AF2122/97
caccggccgugccgcc

SEQ ID NO: 3081937 - RNA, 17 nt, Mycobacterium bovis subsp bovis AF2122/97
caccggccgugccgccg

SEQ ID NO: 3081938 - RNA, 17 nt, Mycobacterium bovis subsp bovis AF2122/97
caccggccugcgcgacc

SEQ ID NO: 3081939 - RNA, 22 nt, Mycobacterium bovis subsp bovis AF2122/97
caccggccugcgcgaccgacca

SEQ ID NO: 3081940 - RNA, 14 nt, Mycobacterium bovis subsp bovis AF2122/97
caccggcgaccgac

SEQ ID NO: 3081941 - RNA, 15 nt, Mycobacterium bovis subsp bovis AF2122/97
caccggcgaccgacg

SEQ ID NO: 3081942 - RNA, 14 nt, Mycobacterium bovis subsp bovis AF2122/97
caccggucgccgcg

SEQ ID NO: 3081943 - RNA, 18 nt, Mycobacterium bovis subsp bovis AF2122/97
caccggugaaacgaucgu

SEQ ID NO: 3081944 - RNA, 21 nt, Mycobacterium bovis subsp bovis AF2122/97
caccggugaaacgaucgugcg

SEQ ID NO: 3081945 - RNA, 15 nt, Mycobacterium bovis subsp bovis AF2122/97
caccggugacgcaca

SEQ ID NO: 3081946 - RNA, 21 nt, Mycobacterium bovis subsp bovis AF2122/97
caccggugauggugaccagca

SEQ ID NO: 3081947 - RNA, 23 nt, Mycobacterium bovis subsp bovis AF2122/97
caccggugauggugaccagcagg

SEQ ID NO: 3081948 - RNA, 14 nt, Mycobacterium bovis subsp bovis AF2122/97
caccggugcccacc

SEQ ID NO: 3081949 - RNA, 13 nt, Mycobacterium bovis subsp bovis AF2122/97
caccggugccgcc

SEQ ID NO: 3081950 - RNA, 14 nt, Mycobacterium bovis subsp bovis AF2122/97
caccggugccgccc

SEQ ID NO: 3081951 - RNA, 18 nt, Mycobacterium bovis subsp bovis AF2122/97
caccggugccgcccgcgc

SEQ ID NO: 3081952 - RNA, 15 nt, Mycobacterium bovis subsp bovis AF2122/97
caccggugccgccgu

SEQ ID NO: 3081953 - RNA, 14 nt, Mycobacterium bovis subsp bovis AF2122/97
caccggugccggcg

SEQ ID NO: 3081954 - RNA, 15 nt, Mycobacterium bovis subsp bovis AF2122/97
caccggugcucgucg

SEQ ID NO: 3081955 - RNA, 14 nt, Mycobacterium bovis subsp bovis AF2122/97
caccgguggcgccc

SEQ ID NO: 3081956 - RNA, 13 nt, Mycobacterium bovis subsp bovis AF2122/97
caccgguguuggu

SEQ ID NO: 3081957 - RNA, 23 nt, Mycobacterium bovis subsp bovis AF2122/97
caccgguucggggggcaggucga

SEQ ID NO: 3081958 - RNA, 23 nt, Mycobacterium bovis subsp bovis AF2122/97
caccgguucggugagcgggagga

SEQ ID NO: 3081959 - RNA, 21 nt, Mycobacterium bovis subsp bovis AF2122/97
caccgguuugacguccagggc

SEQ ID NO: 3081960 - RNA, 22 nt, Mycobacterium bovis subsp bovis AF2122/97
caccguaaacagcgcgccggcg

SEQ ID NO: 3081961 - RNA, 17 nt, Mycobacterium bovis subsp bovis AF2122/97
caccguacgacagucgc

SEQ ID NO: 3081962 - RNA, 15 nt, Mycobacterium bovis subsp bovis AF2122/97
caccguacggccacg

SEQ ID NO: 3081963 - RNA, 19 nt, Mycobacterium bovis subsp bovis AF2122/97
caccguagagcaugccgcc

SEQ ID NO: 3081964 - RNA, 20 nt, Mycobacterium bovis subsp bovis AF2122/97
caccguagagcaugccgccc

SEQ ID NO: 3081965 - RNA, 22 nt, Mycobacterium bovis subsp bovis AF2122/97
caccguagagcaugccgcccgc

SEQ ID NO: 3081966 - RNA, 22 nt, Mycobacterium bovis subsp bovis AF2122/97
caccguagccgcugcacguggc

SEQ ID NO: 3081967 - RNA, 22 nt, Mycobacterium bovis subsp bovis AF2122/97
caccguaggcgaucucacgcau

SEQ ID NO: 3081968 - RNA, 21 nt, Mycobacterium bovis subsp bovis AF2122/97
caccguaguaguucagccagg

SEQ ID NO: 3081969 - RNA, 14 nt, Mycobacterium bovis subsp bovis AF2122/97
caccgucacccccg

SEQ ID NO: 3081970 - RNA, 18 nt, Mycobacterium bovis subsp bovis AF2122/97
caccgucaccgccgucac

SEQ ID NO: 3081971 - RNA, 16 nt, Mycobacterium bovis subsp bovis AF2122/97
caccgucacgccaccg

SEQ ID NO: 3081972 - RNA, 11 nt, Mycobacterium bovis subsp bovis AF2122/97
caccgucacgg

SEQ ID NO: 3081973 - RNA, 16 nt, Mycobacterium bovis subsp bovis AF2122/97
caccgucacggucgcg

SEQ ID NO: 3081974 - RNA, 16 nt, Mycobacterium bovis subsp bovis AF2122/97
caccgucagcgcgacc

SEQ ID NO: 3081975 - RNA, 20 nt, Mycobacterium bovis subsp bovis AF2122/97
caccgucaguucggugugcg

SEQ ID NO: 3081976 - RNA, 20 nt, Mycobacterium bovis subsp bovis AF2122/97
caccguccaauagcugacac

SEQ ID NO: 3081977 - RNA, 19 nt, Mycobacterium bovis subsp bovis AF2122/97
caccguccaauuggcgucg

SEQ ID NO: 3081978 - RNA, 14 nt, Mycobacterium bovis subsp bovis AF2122/97
caccguccagcagc

SEQ ID NO: 3081979 - RNA, 20 nt, Mycobacterium bovis subsp bovis AF2122/97
caccgucccugugucgccgu

SEQ ID NO: 3081980 - RNA, 18 nt, Mycobacterium bovis subsp bovis AF2122/97
caccguccgucggcgcuc

SEQ ID NO: 3081981 - RNA, 20 nt, Mycobacterium bovis subsp bovis AF2122/97
caccgucgagccggacaggc

SEQ ID NO: 3081982 - RNA, 20 nt, Mycobacterium bovis subsp bovis AF2122/97
caccgucgagguacacgccg

SEQ ID NO: 3081983 - RNA, 22 nt, Mycobacterium bovis subsp bovis AF2122/97
caccgucgagguacacgccgag

SEQ ID NO: 3081984 - RNA, 20 nt, Mycobacterium bovis subsp bovis AF2122/97
caccgucgcauacgcccacu

SEQ ID NO: 3081985 - RNA, 18 nt, Mycobacterium bovis subsp bovis AF2122/97
caccgucgcccggguggc

SEQ ID NO: 3081986 - RNA, 23 nt, Mycobacterium bovis subsp bovis AF2122/97
caccgucgcccggguggcgucga

SEQ ID NO: 3081987 - RNA, 13 nt, Mycobacterium bovis subsp bovis AF2122/97
caccgucgccgcc

SEQ ID NO: 3081988 - RNA, 14 nt, Mycobacterium bovis subsp bovis AF2122/97
caccgucgccgccg

SEQ ID NO: 3081989 - RNA, 15 nt, Mycobacterium bovis subsp bovis AF2122/97
caccgucgccgccgg

SEQ ID NO: 3081990 - RNA, 16 nt, Mycobacterium bovis subsp bovis AF2122/97
caccgucgcggcggca

SEQ ID NO: 3081991 - RNA, 21 nt, Mycobacterium bovis subsp bovis AF2122/97
caccgucgcuaugcgccgcau

SEQ ID NO: 3081992 - RNA, 20 nt, Mycobacterium bovis subsp bovis AF2122/97
caccgucgcugcccgcgcgg

SEQ ID NO: 3081993 - RNA, 21 nt, Mycobacterium bovis subsp bovis AF2122/97
caccgucgcugcccgcgcggc

SEQ ID NO: 3081994 - RNA, 21 nt, Mycobacterium bovis subsp bovis AF2122/97
caccgucggaacugaccacgu

SEQ ID NO: 3081995 - RNA, 14 nt, Mycobacterium bovis subsp bovis AF2122/97
caccgucggcacca

SEQ ID NO: 3081996 - RNA, 17 nt, Mycobacterium bovis subsp bovis AF2122/97
caccgucggcaccagca

SEQ ID NO: 3081997 - RNA, 17 nt, Mycobacterium bovis subsp bovis AF2122/97
caccgucggcagcagcg

SEQ ID NO: 3081998 - RNA, 18 nt, Mycobacterium bovis subsp bovis AF2122/97
caccgucggcagcagcgg

SEQ ID NO: 3081999 - RNA, 23 nt, Mycobacterium bovis subsp bovis AF2122/97
caccgucgggauggacggcagcc

SEQ ID NO: 3082000 - RNA, 13 nt, Mycobacterium bovis subsp bovis AF2122/97
caccgucgggccc

SEQ ID NO: 3082001 - RNA, 17 nt, Mycobacterium bovis subsp bovis AF2122/97
caccgucgggcccagcc

SEQ ID NO: 3082002 - RNA, 18 nt, Mycobacterium bovis subsp bovis AF2122/97
caccgucgggcccagccg

SEQ ID NO: 3082003 - RNA, 21 nt, Mycobacterium bovis subsp bovis AF2122/97
caccgucguacucggcggcca

SEQ ID NO: 3082004 - RNA, 23 nt, Mycobacterium bovis subsp bovis AF2122/97
caccgucguacucggcggccacc

SEQ ID NO: 3082005 - RNA, 16 nt, Mycobacterium bovis subsp bovis AF2122/97
caccgucucgcaccgc

SEQ ID NO: 3082006 - RNA, 15 nt, Mycobacterium bovis subsp bovis AF2122/97
caccgucucgccgcg

SEQ ID NO: 3082007 - RNA, 16 nt, Mycobacterium bovis subsp bovis AF2122/97
caccgucucgccgcgc

SEQ ID NO: 3082008 - RNA, 16 nt, Mycobacterium bovis subsp bovis AF2122/97
caccgucugcuggccg

SEQ ID NO: 3082009 - RNA, 23 nt, Mycobacterium bovis subsp bovis AF2122/97
caccgugaagcccuggccagcga

SEQ ID NO: 3082010 - RNA, 15 nt, Mycobacterium bovis subsp bovis AF2122/97
caccgugacagcggc

SEQ ID NO: 3082011 - RNA, 16 nt, Mycobacterium bovis subsp bovis AF2122/97
caccgugacagcggca

SEQ ID NO: 3082012 - RNA, 23 nt, Mycobacterium bovis subsp bovis AF2122/97
caccgugacagcggcauugccag

SEQ ID NO: 3082013 - RNA, 13 nt, Mycobacterium bovis subsp bovis AF2122/97
caccgugaccgcc

SEQ ID NO: 3082014 - RNA, 14 nt, Mycobacterium bovis subsp bovis AF2122/97
caccgugaccgccg

SEQ ID NO: 3082015 - RNA, 19 nt, Mycobacterium bovis subsp bovis AF2122/97
caccgugcaccagcucacc

SEQ ID NO: 3082016 - RNA, 14 nt, Mycobacterium bovis subsp bovis AF2122/97
caccgugcccuggg

SEQ ID NO: 3082017 - RNA, 13 nt, Mycobacterium bovis subsp bovis AF2122/97
caccgugccgacg

SEQ ID NO: 3082018 - RNA, 14 nt, Mycobacterium bovis subsp bovis AF2122/97
caccgugccgacgc

SEQ ID NO: 3082019 - RNA, 17 nt, Mycobacterium bovis subsp bovis AF2122/97
caccgugccgacgcccc

SEQ ID NO: 3082020 - RNA, 12 nt, Mycobacterium bovis subsp bovis AF2122/97
caccgugcgccg

SEQ ID NO: 3082021 - RNA, 16 nt, Mycobacterium bovis subsp bovis AF2122/97
caccgugcggaucgcg

SEQ ID NO: 3082022 - RNA, 18 nt, Mycobacterium bovis subsp bovis AF2122/97
caccgugcggaucgcgcu

SEQ ID NO: 3082023 - RNA, 23 nt, Mycobacterium bovis subsp bovis AF2122/97
caccguggaagauguugccgccg

SEQ ID NO: 3082024 - RNA, 12 nt, Mycobacterium bovis subsp bovis AF2122/97
caccguggaucg

SEQ ID NO: 3082025 - RNA, 15 nt, Mycobacterium bovis subsp bovis AF2122/97
caccguggaucggca

SEQ ID NO: 3082026 - RNA, 17 nt, Mycobacterium bovis subsp bovis AF2122/97
caccguggaucggcagc

SEQ ID NO: 3082027 - RNA, 18 nt, Mycobacterium bovis subsp bovis AF2122/97
caccguggcggaucgcga

SEQ ID NO: 3082028 - RNA, 22 nt, Mycobacterium bovis subsp bovis AF2122/97
caccugacgugcggcgcggcga

SEQ ID NO: 3082029 - RNA, 23 nt, Mycobacterium bovis subsp bovis AF2122/97
caccugacgugcggcgcggcgac

SEQ ID NO: 3082030 - RNA, 18 nt, Mycobacterium bovis subsp bovis AF2122/97
caccugcaaccuucgugu

SEQ ID NO: 3082031 - RNA, 13 nt, Mycobacterium bovis subsp bovis AF2122/97
caccugcaccgca

SEQ ID NO: 3082032 - RNA, 17 nt, Mycobacterium bovis subsp bovis AF2122/97
caccugcacgugacccu

SEQ ID NO: 3082033 - RNA, 19 nt, Mycobacterium bovis subsp bovis AF2122/97
caccugcacgugacccugg

SEQ ID NO: 3082034 - RNA, 20 nt, Mycobacterium bovis subsp bovis AF2122/97
caccugcacgugacccuggg

SEQ ID NO: 3082035 - RNA, 23 nt, Mycobacterium bovis subsp bovis AF2122/97
caccugcagcacgacgugcgucg

SEQ ID NO: 3082036 - RNA, 16 nt, Mycobacterium bovis subsp bovis AF2122/97
caccugccagugggcc

SEQ ID NO: 3082037 - RNA, 20 nt, Mycobacterium bovis subsp bovis AF2122/97
caccugccagugggccgacg

SEQ ID NO: 3082038 - RNA, 22 nt, Mycobacterium bovis subsp bovis AF2122/97
caccugccgacucaucggccgc

SEQ ID NO: 3082039 - RNA, 16 nt, Mycobacterium bovis subsp bovis AF2122/97
caccugccgaucgggc

SEQ ID NO: 3082040 - RNA, 16 nt, Mycobacterium bovis subsp bovis AF2122/97
caccugccguuccggc

SEQ ID NO: 3082041 - RNA, 24 nt, Mycobacterium bovis subsp bovis AF2122/97
caccugcgaugaugugcgaccaca

SEQ ID NO: 3082042 - RNA, 13 nt, Mycobacterium bovis subsp bovis AF2122/97
caccugcgccacc

SEQ ID NO: 3082043 - RNA, 14 nt, Mycobacterium bovis subsp bovis AF2122/97
caccugcgcgcggc

SEQ ID NO: 3082044 - RNA, 15 nt, Mycobacterium bovis subsp bovis AF2122/97
caccugcgcgcggcc

SEQ ID NO: 3082045 - RNA, 12 nt, Mycobacterium bovis subsp bovis AF2122/97
caccugcgcggc

SEQ ID NO: 3082046 - RNA, 16 nt, Mycobacterium bovis subsp bovis AF2122/97
caccugcgucggcccg

SEQ ID NO: 3082047 - RNA, 17 nt, Mycobacterium bovis subsp bovis AF2122/97
caccugcgucggcccgc

SEQ ID NO: 3082048 - RNA, 21 nt, Mycobacterium bovis subsp bovis AF2122/97
caccugcucgucggucaccga

SEQ ID NO: 3082049 - RNA, 22 nt, Mycobacterium bovis subsp bovis AF2122/97
caccuggaguccagcucgggca

SEQ ID NO: 3082050 - RNA, 13 nt, Mycobacterium bovis subsp bovis AF2122/97
caccuggccgccc

SEQ ID NO: 3082051 - RNA, 19 nt, Mycobacterium bovis subsp bovis AF2122/97
caccuggcgugucgccgcc

SEQ ID NO: 3082052 - RNA, 14 nt, Mycobacterium bovis subsp bovis AF2122/97
caccugggcggcau

SEQ ID NO: 3082053 - RNA, 17 nt, Mycobacterium bovis subsp bovis AF2122/97
caccugggcggcgcgaa

SEQ ID NO: 3082054 - RNA, 23 nt, Mycobacterium bovis subsp bovis AF2122/97
caccugggcgggcuuggcgucga

SEQ ID NO: 3082055 - RNA, 15 nt, Mycobacterium bovis subsp bovis AF2122/97
caccugggcugccgg

SEQ ID NO: 3082056 - RNA, 16 nt, Mycobacterium bovis subsp bovis AF2122/97
caccugggcugccggc

SEQ ID NO: 3082057 - RNA, 18 nt, Mycobacterium bovis subsp bovis AF2122/97
caccugggcugccggcca

SEQ ID NO: 3082058 - RNA, 15 nt, Mycobacterium bovis subsp bovis AF2122/97
caccugggucgacga

SEQ ID NO: 3082059 - RNA, 13 nt, Mycobacterium bovis subsp bovis AF2122/97
caccuggucggcc

SEQ ID NO: 3082060 - RNA, 23 nt, Mycobacterium bovis subsp bovis AF2122/97
caccuggucggccgcaaggcgcc

SEQ ID NO: 3082061 - RNA, 21 nt, Mycobacterium bovis subsp bovis AF2122/97
caccuguaguucgaugacuga

SEQ ID NO: 3082062 - RNA, 19 nt, Mycobacterium bovis subsp bovis AF2122/97
caccuguccgguggaaucc

SEQ ID NO: 3082063 - RNA, 22 nt, Mycobacterium bovis subsp bovis AF2122/97
caccuguccgguggaauccacc

SEQ ID NO: 3082064 - RNA, 19 nt, Mycobacterium bovis subsp bovis AF2122/97
caccuguuggcaugccgcc

SEQ ID NO: 3082065 - RNA, 21 nt, Mycobacterium bovis subsp bovis AF2122/97
caccuguuggcaugccgcccg

SEQ ID NO: 3082066 - RNA, 22 nt, Mycobacterium bovis subsp bovis AF2122/97
caccuuagcgcuugccgcugag

SEQ ID NO: 3082067 - RNA, 12 nt, Mycobacterium bovis subsp bovis AF2122/97
caccuuccacga

SEQ ID NO: 3082068 - RNA, 15 nt, Mycobacterium bovis subsp bovis AF2122/97
caccuucgacguugc

SEQ ID NO: 3082069 - RNA, 22 nt, Mycobacterium bovis subsp bovis AF2122/97
caccuucgacguugcggacggc

SEQ ID NO: 3082070 - RNA, 18 nt, Mycobacterium bovis subsp bovis AF2122/97
caccuucugacgcggccg

SEQ ID NO: 3082071 - RNA, 19 nt, Mycobacterium bovis subsp bovis AF2122/97
caccuugacgcccaucuca

SEQ ID NO: 3082072 - RNA, 21 nt, Mycobacterium bovis subsp bovis AF2122/97
caccuugcccaagaucucgcg

SEQ ID NO: 3082073 - RNA, 21 nt, Mycobacterium bovis subsp bovis AF2122/97
caccuugccgaacacucgcag

SEQ ID NO: 3082074 - RNA, 15 nt, Mycobacterium bovis subsp bovis AF2122/97
caccuugccuagccg

SEQ ID NO: 3082075 - RNA, 21 nt, Mycobacterium bovis subsp bovis AF2122/97
caccuuggccaggaagucccg

SEQ ID NO: 3082076 - RNA, 14 nt, Mycobacterium bovis subsp bovis AF2122/97
caccuuggccggcc

SEQ ID NO: 3082077 - RNA, 15 nt, Mycobacterium bovis subsp bovis AF2122/97
caccuuggccggccc

SEQ ID NO: 3082078 - RNA, 18 nt, Mycobacterium bovis subsp bovis AF2122/97
caccuuggccggccccgc

SEQ ID NO: 3082079 - RNA, 19 nt, Mycobacterium bovis subsp bovis AF2122/97
caccuuggccggccccgcc

SEQ ID NO: 3082080 - RNA, 16 nt, Mycobacterium bovis subsp bovis AF2122/97
caccuugggcagcuug

SEQ ID NO: 3082081 - RNA, 17 nt, Mycobacterium bovis subsp bovis AF2122/97
caccuuguggacccgcc

SEQ ID NO: 3082082 - RNA, 13 nt, Mycobacterium bovis subsp bovis AF2122/97
cacgaaaaccggu

SEQ ID NO: 3082083 - RNA, 14 nt, Mycobacterium bovis subsp bovis AF2122/97
cacgaaaccgcagc

SEQ ID NO: 3082084 - RNA, 21 nt, Mycobacterium bovis subsp bovis AF2122/97
cacgaaauugggcgauucugc

SEQ ID NO: 3082085 - RNA, 19 nt, Mycobacterium bovis subsp bovis AF2122/97
cacgaacaucagaucgccg

SEQ ID NO: 3082086 - RNA, 22 nt, Mycobacterium bovis subsp bovis AF2122/97
cacgaacaucagaucgccgacu

SEQ ID NO: 3082087 - RNA, 17 nt, Mycobacterium bovis subsp bovis AF2122/97
cacgaacccucagccgc

SEQ ID NO: 3082088 - RNA, 18 nt, Mycobacterium bovis subsp bovis AF2122/97
cacgaacccucagccgcg

SEQ ID NO: 3082089 - RNA, 22 nt, Mycobacterium bovis subsp bovis AF2122/97
cacgaacccucagccgcgccgg

SEQ ID NO: 3082090 - RNA, 13 nt, Mycobacterium bovis subsp bovis AF2122/97
cacgaacgccugc

SEQ ID NO: 3082091 - RNA, 19 nt, Mycobacterium bovis subsp bovis AF2122/97
cacgaacgccugcucgucg

SEQ ID NO: 3082092 - RNA, 23 nt, Mycobacterium bovis subsp bovis AF2122/97
cacgaacgccugcucgucggcca

SEQ ID NO: 3082093 - RNA, 15 nt, Mycobacterium bovis subsp bovis AF2122/97
cacgaacucggccgg

SEQ ID NO: 3082094 - RNA, 19 nt, Mycobacterium bovis subsp bovis AF2122/97
cacgaacugaucgaccgcc

SEQ ID NO: 3082095 - RNA, 23 nt, Mycobacterium bovis subsp bovis AF2122/97
cacgaacugaucgaccgccuccu

SEQ ID NO: 3082096 - RNA, 20 nt, Mycobacterium bovis subsp bovis AF2122/97
cacgaagaccaggccgguga

SEQ ID NO: 3082097 - RNA, 19 nt, Mycobacterium bovis subsp bovis AF2122/97
cacgaagaccgcgucggcg

SEQ ID NO: 3082098 - RNA, 21 nt, Mycobacterium bovis subsp bovis AF2122/97
cacgaagcuggcgugcagcag

SEQ ID NO: 3082099 - RNA, 22 nt, Mycobacterium bovis subsp bovis AF2122/97
cacgaagcuggcgugcagcagg

SEQ ID NO: 3082100 - RNA, 14 nt, Mycobacterium bovis subsp bovis AF2122/97
cacgaaggucgcgg

SEQ ID NO: 3082101 - RNA, 13 nt, Mycobacterium bovis subsp bovis AF2122/97
cacgaauccggcc

SEQ ID NO: 3082102 - RNA, 21 nt, Mycobacterium bovis subsp bovis AF2122/97
cacgaauccggccacuccggu

SEQ ID NO: 3082103 - RNA, 19 nt, Mycobacterium bovis subsp bovis AF2122/97
cacgaccaccggaucgccg

SEQ ID NO: 3082104 - RNA, 22 nt, Mycobacterium bovis subsp bovis AF2122/97
cacgaccaccggaucgccgucg

SEQ ID NO: 3082105 - RNA, 13 nt, Mycobacterium bovis subsp bovis AF2122/97
cacgaccagcuga

SEQ ID NO: 3082106 - RNA, 19 nt, Mycobacterium bovis subsp bovis AF2122/97
cacgacccaagucgccgag

SEQ ID NO: 3082107 - RNA, 14 nt, Mycobacterium bovis subsp bovis AF2122/97
cacgaccccggcgg

SEQ ID NO: 3082108 - RNA, 16 nt, Mycobacterium bovis subsp bovis AF2122/97
cacgacccgggaagga

SEQ ID NO: 3082109 - RNA, 17 nt, Mycobacterium bovis subsp bovis AF2122/97
cacgacccgggaaggaa

SEQ ID NO: 3082110 - RNA, 16 nt, Mycobacterium bovis subsp bovis AF2122/97
cacgaccgacaccccg

SEQ ID NO: 3082111 - RNA, 15 nt, Mycobacterium bovis subsp bovis AF2122/97
cacgaccgccgauac

SEQ ID NO: 3082112 - RNA, 19 nt, Mycobacterium bovis subsp bovis AF2122/97
cacgaccgcgcaacaccuc

SEQ ID NO: 3082113 - RNA, 14 nt, Mycobacterium bovis subsp bovis AF2122/97
cacgaccgucucgg

SEQ ID NO: 3082114 - RNA, 15 nt, Mycobacterium bovis subsp bovis AF2122/97
aacgacgucgccgac

SEQ ID NO: 3082115 - RNA, 23 nt, Mycobacterium bovis subsp bovis AF2122/97
aacgacgucgccgacccgggggc

SEQ ID NO: 3082116 - RNA, 22 nt, Mycobacterium bovis subsp bovis AF2122/97
aacgacgucgucgccgccgaaa

SEQ ID NO: 3082117 - RNA, 14 nt, Mycobacterium bovis subsp bovis AF2122/97
aacgacguugaucc

SEQ ID NO: 3082118 - RNA, 21 nt, Mycobacterium bovis subsp bovis AF2122/97
aacgacguugauccccagcuc

SEQ ID NO: 3082119 - RNA, 16 nt, Mycobacterium bovis subsp bovis AF2122/97
aacgacucgagagcga

SEQ ID NO: 3082120 - RNA, 16 nt, Mycobacterium bovis subsp bovis AF2122/97
aacgacucgcgguggc

SEQ ID NO: 3082121 - RNA, 22 nt, Mycobacterium bovis subsp bovis AF2122/97
aacgacuguggcgccgccggca

SEQ ID NO: 3082122 - RNA, 23 nt, Mycobacterium bovis subsp bovis AF2122/97
aacgacuguggcgccgccggcac

SEQ ID NO: 3082123 - RNA, 17 nt, Mycobacterium bovis subsp bovis AF2122/97
aacgacuuucaucgcga

SEQ ID NO: 3082124 - RNA, 18 nt, Mycobacterium bovis subsp bovis AF2122/97
aacgagaugugagcacac

SEQ ID NO: 3082125 - RNA, 14 nt, Mycobacterium bovis subsp bovis AF2122/97
aacgagcggccgcg

SEQ ID NO: 3082126 - RNA, 18 nt, Mycobacterium bovis subsp bovis AF2122/97
aacgagcuuccacgccgg

SEQ ID NO: 3082127 - RNA, 16 nt, Mycobacterium bovis subsp bovis AF2122/97
aacgaggccgacgaca

SEQ ID NO: 3082128 - RNA, 21 nt, Mycobacterium bovis subsp bovis AF2122/97
aacgaggcgcccagcgacaac

SEQ ID NO: 3082129 - RNA, 16 nt, Mycobacterium bovis subsp bovis AF2122/97
aacgaggucgccgcaa

SEQ ID NO: 3082130 - RNA, 16 nt, Mycobacterium bovis subsp bovis AF2122/97
aacgaggucugcggcc

SEQ ID NO: 3082131 - RNA, 21 nt, Mycobacterium bovis subsp bovis AF2122/97
aacgaguuugauuucgcacgg

SEQ ID NO: 3082132 - RNA, 22 nt, Mycobacterium bovis subsp bovis AF2122/97
aacgauagaacguagcgcccac

SEQ ID NO: 3082133 - RNA, 17 nt, Mycobacterium bovis subsp bovis AF2122/97
aacgaucgacaccaggg

SEQ ID NO: 3082134 - RNA, 19 nt, Mycobacterium bovis subsp bovis AF2122/97
aacgaucgacaccagggcg

SEQ ID NO: 3082135 - RNA, 19 nt, Mycobacterium bovis subsp bovis AF2122/97
aacgaugaugaugaccaca

SEQ ID NO: 3082136 - RNA, 15 nt, Mycobacterium bovis subsp bovis AF2122/97
aacgaugccggcaag

SEQ ID NO: 3082137 - RNA, 20 nt, Mycobacterium bovis subsp bovis AF2122/97
aacgaugguguaacggcggc

SEQ ID NO: 3082138 - RNA, 15 nt, Mycobacterium bovis subsp bovis AF2122/97
aacgauguccgcgcg

SEQ ID NO: 3082139 - RNA, 18 nt, Mycobacterium bovis subsp bovis AF2122/97
aacgauguccgcgcgaac

SEQ ID NO: 3082140 - RNA, 14 nt, Mycobacterium bovis subsp bovis AF2122/97
aacgauugcugcgg

SEQ ID NO: 3082141 - RNA, 13 nt, Mycobacterium bovis subsp bovis AF2122/97
aacgcaaagacag

SEQ ID NO: 3082142 - RNA, 14 nt, Mycobacterium bovis subsp bovis AF2122/97
aacgcaagcagcgc

SEQ ID NO: 3082143 - RNA, 22 nt, Mycobacterium bovis subsp bovis AF2122/97
aacgcacccaucgugcugaagc

SEQ ID NO: 3082144 - RNA, 17 nt, Mycobacterium bovis subsp bovis AF2122/97
aacgcaccgaaacgccg

SEQ ID NO: 3082145 - RNA, 12 nt, Mycobacterium bovis subsp bovis AF2122/97
aacgccaaaaug

SEQ ID NO: 3082146 - RNA, 15 nt, Mycobacterium bovis subsp bovis AF2122/97
aacgccaacgccacg

SEQ ID NO: 3082147 - RNA, 22 nt, Mycobacterium bovis subsp bovis AF2122/97
aacgccaagcucggcccagcgc

SEQ ID NO: 3082148 - RNA, 19 nt, Mycobacterium bovis subsp bovis AF2122/97
aacgccaccgucgcugccc

SEQ ID NO: 3082149 - RNA, 22 nt, Mycobacterium bovis subsp bovis AF2122/97
aacgccacggcaucggccaccu

SEQ ID NO: 3082150 - RNA, 14 nt, Mycobacterium bovis subsp bovis AF2122/97
aacgccagcaccag

SEQ ID NO: 3082151 - RNA, 18 nt, Mycobacterium bovis subsp bovis AF2122/97
aacgccagugaacgcgcg

SEQ ID NO: 3082152 - RNA, 19 nt, Mycobacterium bovis subsp bovis AF2122/97
aacgcccccauccggucga

SEQ ID NO: 3082153 - RNA, 14 nt, Mycobacterium bovis subsp bovis AF2122/97
aacgccccggcgcg

SEQ ID NO: 3082154 - RNA, 17 nt, Mycobacterium bovis subsp bovis AF2122/97
aacgccccggcgcggcc

SEQ ID NO: 3082155 - RNA, 11 nt, Mycobacterium bovis subsp bovis AF2122/97
aacgcccggca

SEQ ID NO: 3082156 - RNA, 13 nt, Mycobacterium bovis subsp bovis AF2122/97
aacgcccgggcgg

SEQ ID NO: 3082157 - RNA, 15 nt, Mycobacterium bovis subsp bovis AF2122/97
aacgccgccagcaga

SEQ ID NO: 3082158 - RNA, 21 nt, Mycobacterium bovis subsp bovis AF2122/97
aacgccgcccgccggugaucg

SEQ ID NO: 3082159 - RNA, 13 nt, Mycobacterium bovis subsp bovis AF2122/97
aacgccgcccgcu

SEQ ID NO: 3082160 - RNA, 22 nt, Mycobacterium bovis subsp bovis AF2122/97
aacgccgcccgcugggcucgcu

SEQ ID NO: 3082161 - RNA, 12 nt, Mycobacterium bovis subsp bovis AF2122/97
aacgccgcucau

SEQ ID NO: 3082162 - RNA, 13 nt, Mycobacterium bovis subsp bovis AF2122/97
aacgccggcaucg

SEQ ID NO: 3082163 - RNA, 14 nt, Mycobacterium bovis subsp bovis AF2122/97
aacgccggcaucgc

SEQ ID NO: 3082164 - RNA, 20 nt, Mycobacterium bovis subsp bovis AF2122/97
aacgccgggucguacaacac

SEQ ID NO: 3082165 - RNA, 18 nt, Mycobacterium bovis subsp bovis AF2122/97
aacgccggguucgccgga

SEQ ID NO: 3082166 - RNA, 23 nt, Mycobacterium bovis subsp bovis AF2122/97
aacgccgucgucguagaacugca

SEQ ID NO: 3082167 - RNA, 13 nt, Mycobacterium bovis subsp bovis AF2122/97
aacgccucaccga

SEQ ID NO: 3082168 - RNA, 15 nt, Mycobacterium bovis subsp bovis AF2122/97
aacgccucaggggcg

SEQ ID NO: 3082169 - RNA, 15 nt, Mycobacterium bovis subsp bovis AF2122/97
aacgccucugcgauc

SEQ ID NO: 3082170 - RNA, 13 nt, Mycobacterium bovis subsp bovis AF2122/97
aacgccugcucgu

SEQ ID NO: 3082171 - RNA, 22 nt, Mycobacterium bovis subsp bovis AF2122/97
aacgccugcucgucggccaccg

SEQ ID NO: 3082172 - RNA, 23 nt, Mycobacterium bovis subsp bovis AF2122/97
aacgccuugacugaacucaacac

SEQ ID NO: 3082173 - RNA, 16 nt, Mycobacterium bovis subsp bovis AF2122/97
aacgcgaacccgcgag

SEQ ID NO: 3082174 - RNA, 23 nt, Mycobacterium bovis subsp bovis AF2122/97
aacgcgaauaccagaccggccga

SEQ ID NO: 3082175 - RNA, 17 nt, Mycobacterium bovis subsp bovis AF2122/97
aacgcgaaugucgcgcu

SEQ ID NO: 3082176 - RNA, 23 nt, Mycobacterium bovis subsp bovis AF2122/97
aacgcgaccaucucgacgucggu

SEQ ID NO: 3082177 - RNA, 18 nt, Mycobacterium bovis subsp bovis AF2122/97
aacgcgcgcacgccaccg

SEQ ID NO: 3082178 - RNA, 16 nt, Mycobacterium bovis subsp bovis AF2122/97
aacgcgcgcguggucg

SEQ ID NO: 3082179 - RNA, 20 nt, Mycobacterium bovis subsp bovis AF2122/97
aacgcggaucgggcaccccg

SEQ ID NO: 3082180 - RNA, 14 nt, Mycobacterium bovis subsp bovis AF2122/97
aacgcggccucguc

SEQ ID NO: 3082181 - RNA, 18 nt, Mycobacterium bovis subsp bovis AF2122/97
aacgcggccucgucgagu

SEQ ID NO: 3082182 - RNA, 14 nt, Mycobacterium bovis subsp bovis AF2122/97
aacgcggcgcgcug

SEQ ID NO: 3082183 - RNA, 15 nt, Mycobacterium bovis subsp bovis AF2122/97
aacgcggcgucgaug

SEQ ID NO: 3082184 - RNA, 20 nt, Mycobacterium bovis subsp bovis AF2122/97
aacgcgguaaagccccgcuc

SEQ ID NO: 3082185 - RNA, 21 nt, Mycobacterium bovis subsp bovis AF2122/97
aacgcgguaaagccccgcucc

SEQ ID NO: 3082186 - RNA, 16 nt, Mycobacterium bovis subsp bovis AF2122/97
aacgcggugggcacag

SEQ ID NO: 3082187 - RNA, 17 nt, Mycobacterium bovis subsp bovis AF2122/97
aacgcggugggcacagc

SEQ ID NO: 3082188 - RNA, 16 nt, Mycobacterium bovis subsp bovis AF2122/97
aacgcguacugggugu

SEQ ID NO: 3082189 - RNA, 19 nt, Mycobacterium bovis subsp bovis AF2122/97
aacgcguagagccgaucac

SEQ ID NO: 3082190 - RNA, 22 nt, Mycobacterium bovis subsp bovis AF2122/97
aacgcgucccgccgcaccgccg

SEQ ID NO: 3082191 - RNA, 14 nt, Mycobacterium bovis subsp bovis AF2122/97
aacgcgucgccgac

SEQ ID NO: 3082192 - RNA, 19 nt, Mycobacterium bovis subsp bovis AF2122/97
aacgcgucgccgacgccgg

SEQ ID NO: 3082193 - RNA, 15 nt, Mycobacterium bovis subsp bovis AF2122/97
aacgcgucguagcgc

SEQ ID NO: 3082194 - RNA, 21 nt, Mycobacterium bovis subsp bovis AF2122/97
aacgcgugcugagucgguuca

SEQ ID NO: 3082195 - RNA, 18 nt, Mycobacterium bovis subsp bovis AF2122/97
aacgcuccaggccuaguc

SEQ ID NO: 3082196 - RNA, 19 nt, Mycobacterium bovis subsp bovis AF2122/97
aacgcugacgugaagcaga

SEQ ID NO: 3082197 - RNA, 14 nt, Mycobacterium bovis subsp bovis AF2122/97
aacgcugcgcccgg

SEQ ID NO: 3082198 - RNA, 20 nt, Mycobacterium bovis subsp bovis AF2122/97
aacgcugcgcccggaccacu

SEQ ID NO: 3082199 - RNA, 20 nt, Mycobacterium bovis subsp bovis AF2122/97
aacgcuggccacucacauug

SEQ ID NO: 3082200 - RNA, 18 nt, Mycobacterium bovis subsp bovis AF2122/97
aacgcugggcggcuaccc

SEQ ID NO: 3082201 - RNA, 18 nt, Mycobacterium bovis subsp bovis AF2122/97
aacgcugucccagcccgg

SEQ ID NO: 3082202 - RNA, 16 nt, Mycobacterium bovis subsp bovis AF2122/97
aacgcuucaccucguc

SEQ ID NO: 3082203 - RNA, 20 nt, Mycobacterium bovis subsp bovis AF2122/97
aacgcuucaccucgucgaca

SEQ ID NO: 3082204 - RNA, 13 nt, Mycobacterium bovis subsp bovis AF2122/97
aacgcuuccagcg

SEQ ID NO: 3082205 - RNA, 17 nt, Mycobacterium bovis subsp bovis AF2122/97
aacgcuuuccggcggug

SEQ ID NO: 3082206 - RNA, 15 nt, Mycobacterium bovis subsp bovis AF2122/97
aacggaaacucaagu

SEQ ID NO: 3082207 - RNA, 20 nt, Mycobacterium bovis subsp bovis AF2122/97
aacggaaucgguuucgaccu

SEQ ID NO: 3082208 - RNA, 16 nt, Mycobacterium bovis subsp bovis AF2122/97
aacggagccgagccga

SEQ ID NO: 3082209 - RNA, 20 nt, Mycobacterium bovis subsp bovis AF2122/97
aacggaggugccggcgccac

SEQ ID NO: 3082210 - RNA, 20 nt, Mycobacterium bovis subsp bovis AF2122/97
aacggauaacccguggcggu

SEQ ID NO: 3082211 - RNA, 18 nt, Mycobacterium bovis subsp bovis AF2122/97
aacggaugccggucggcg

SEQ ID NO: 3082212 - RNA, 22 nt, Mycobacterium bovis subsp bovis AF2122/97
aacggauucccgcccagcagca

SEQ ID NO: 3082213 - RNA, 23 nt, Mycobacterium bovis subsp bovis AF2122/97
aacggcaccagcgggucggcggu

SEQ ID NO: 3082214 - RNA, 13 nt, Mycobacterium bovis subsp bovis AF2122/97
aacggcagcacgg

SEQ ID NO: 3082215 - RNA, 22 nt, Mycobacterium bovis subsp bovis AF2122/97
aacggcagcccaaagcgccagc

SEQ ID NO: 3082216 - RNA, 18 nt, Mycobacterium bovis subsp bovis AF2122/97
aacggcauccuguggcgg

SEQ ID NO: 3082217 - RNA, 19 nt, Mycobacterium bovis subsp bovis AF2122/97
aacggccaagacuucuccg

SEQ ID NO: 3082218 - RNA, 22 nt, Mycobacterium bovis subsp bovis AF2122/97
aacggccgacuuggugaccccg

SEQ ID NO: 3082219 - RNA, 13 nt, Mycobacterium bovis subsp bovis AF2122/97
aacggcgaucacc

SEQ ID NO: 3082220 - RNA, 14 nt, Mycobacterium bovis subsp bovis AF2122/97
aacggcgcgccgac

SEQ ID NO: 3082221 - RNA, 18 nt, Mycobacterium bovis subsp bovis AF2122/97
aacggcgcgccgaccacc

SEQ ID NO: 3082222 - RNA, 18 nt, Mycobacterium bovis subsp bovis AF2122/97
aacggcggaucggcggcc

SEQ ID NO: 3082223 - RNA, 21 nt, Mycobacterium bovis subsp bovis AF2122/97
aacggcggaucggcggccggc

SEQ ID NO: 3082224 - RNA, 18 nt, Mycobacterium bovis subsp bovis AF2122/97
aacggcggcaacggcggc

SEQ ID NO: 3082225 - RNA, 19 nt, Mycobacterium bovis subsp bovis AF2122/97
aacggcggcaacggcggca

SEQ ID NO: 3082226 - RNA, 13 nt, Mycobacterium bovis subsp bovis AF2122/97
aacggcggcaggc

SEQ ID NO: 3082227 - RNA, 16 nt, Mycobacterium bovis subsp bovis AF2122/97
aacggcggcaggccgg

SEQ ID NO: 3082228 - RNA, 18 nt, Mycobacterium bovis subsp bovis AF2122/97
aacggcggcaggccggcc

SEQ ID NO: 3082229 - RNA, 19 nt, Mycobacterium bovis subsp bovis AF2122/97
aacggcggcaggccggcca

SEQ ID NO: 3082230 - RNA, 21 nt, Mycobacterium bovis subsp bovis AF2122/97
aacggcggcaucggcggcaag

SEQ ID NO: 3082231 - RNA, 10 nt, Mycobacterium bovis subsp bovis AF2122/97
aacggcggcg

SEQ ID NO: 3082232 - RNA, 16 nt, Mycobacterium bovis subsp bovis AF2122/97
aacggcggcgacggcg

SEQ ID NO: 3082233 - RNA, 17 nt, Mycobacterium bovis subsp bovis AF2122/97
aacggcggcgucgcggu

SEQ ID NO: 3082234 - RNA, 22 nt, Mycobacterium bovis subsp bovis AF2122/97
aacggcgggcgauuucggcgcc

SEQ ID NO: 3082235 - RNA, 16 nt, Mycobacterium bovis subsp bovis AF2122/97
aacggcggggccggcg

SEQ ID NO: 3082236 - RNA, 17 nt, Mycobacterium bovis subsp bovis AF2122/97
aacggcgguaagggcgg

SEQ ID NO: 3082237 - RNA, 17 nt, Mycobacterium bovis subsp bovis AF2122/97
aacggcggugugguggg

SEQ ID NO: 3082238 - RNA, 20 nt, Mycobacterium bovis subsp bovis AF2122/97
aacggcguuggcgccguuac

SEQ ID NO: 3082239 - RNA, 23 nt, Mycobacterium bovis subsp bovis AF2122/97
aacggcuuggcugccuccaucaa

SEQ ID NO: 3082240 - RNA, 15 nt, Mycobacterium bovis subsp bovis AF2122/97
aacgggacgucaccg

SEQ ID NO: 3082241 - RNA, 13 nt, Mycobacterium bovis subsp bovis AF2122/97
aacgggaugcggu

SEQ ID NO: 3082242 - RNA, 17 nt, Mycobacterium bovis subsp bovis AF2122/97
aacgggcaaaccauugc

SEQ ID NO: 3082243 - RNA, 21 nt, Mycobacterium bovis subsp bovis AF2122/97
aacgggccggugcgcaccaga

SEQ ID NO: 3082244 - RNA, 22 nt, Mycobacterium bovis subsp bovis AF2122/97
aacgggccuucagcucaccacc

SEQ ID NO: 3082245 - RNA, 23 nt, Mycobacterium bovis subsp bovis AF2122/97
aacgggcgaacuuguugaccucc

SEQ ID NO: 3082246 - RNA, 13 nt, Mycobacterium bovis subsp bovis AF2122/97
aacgggcugcccc

SEQ ID NO: 3082247 - RNA, 17 nt, Mycobacterium bovis subsp bovis AF2122/97
aacgggggcgccuucac

SEQ ID NO: 3082248 - RNA, 23 nt, Mycobacterium bovis subsp bovis AF2122/97
aacggggucaaucccacgcccgg

SEQ ID NO: 3082249 - RNA, 19 nt, Mycobacterium bovis subsp bovis AF2122/97
aacggguacacccgcucgc

SEQ ID NO: 3082250 - RNA, 19 nt, Mycobacterium bovis subsp bovis AF2122/97
aacgggucgaugucggcaa

SEQ ID NO: 3082251 - RNA, 20 nt, Mycobacterium bovis subsp bovis AF2122/97
aacgggucguugccggacaa

SEQ ID NO: 3082252 - RNA, 23 nt, Mycobacterium bovis subsp bovis AF2122/97
aacgggucguugccggacaaccu

SEQ ID NO: 3082253 - RNA, 19 nt, Mycobacterium bovis subsp bovis AF2122/97
aacggguugucguugcugg

SEQ ID NO: 3082254 - RNA, 18 nt, Mycobacterium bovis subsp bovis AF2122/97
aacgguacgccgccgcga

SEQ ID NO: 3082255 - RNA, 13 nt, Mycobacterium bovis subsp bovis AF2122/97
aacgguagcacgg

SEQ ID NO: 3082256 - RNA, 20 nt, Mycobacterium bovis subsp bovis AF2122/97
aacgguagcacugucgaggu

SEQ ID NO: 3082257 - RNA, 23 nt, Mycobacterium bovis subsp bovis AF2122/97
aacgguagcacugucgagguggu

SEQ ID NO: 3082258 - RNA, 18 nt, Mycobacterium bovis subsp bovis AF2122/97
aacggugaucagccaccg

SEQ ID NO: 3082259 - RNA, 21 nt, Mycobacterium bovis subsp bovis AF2122/97
aacggugccucgcagccaacg

SEQ ID NO: 3082260 - RNA, 19 nt, Mycobacterium bovis subsp bovis AF2122/97
aacgguucggccggggcga

SEQ ID NO: 3082261 - RNA, 21 nt, Mycobacterium bovis subsp bovis AF2122/97
aacgguuucuuucggcagcga

SEQ ID NO: 3082262 - RNA, 19 nt, Mycobacterium bovis subsp bovis AF2122/97
aacguauccccgaccacug

SEQ ID NO: 3082263 - RNA, 13 nt, Mycobacterium bovis subsp bovis AF2122/97
aacguaugacgcc

SEQ ID NO: 3082264 - RNA, 18 nt, Mycobacterium bovis subsp bovis AF2122/97
aacgucacgucgacggcg

SEQ ID NO: 3082265 - RNA, 20 nt, Mycobacterium bovis subsp bovis AF2122/97
aacgucacgucgacggcggc

SEQ ID NO: 3082266 - RNA, 22 nt, Mycobacterium bovis subsp bovis AF2122/97
aacgucacguggucggccaccc

SEQ ID NO: 3082267 - RNA, 12 nt, Mycobacterium bovis subsp bovis AF2122/97
aacgucagugcc

SEQ ID NO: 3082268 - RNA, 14 nt, Mycobacterium bovis subsp bovis AF2122/97
aacgucgagauccu

SEQ ID NO: 3082269 - RNA, 17 nt, Mycobacterium bovis subsp bovis AF2122/97
aacgucggcaccgguuu

SEQ ID NO: 3082270 - RNA, 21 nt, Mycobacterium bovis subsp bovis AF2122/97
aacgucugccacgucggcgaa

SEQ ID NO: 3082271 - RNA, 15 nt, Mycobacterium bovis subsp bovis AF2122/97
aacgugacgccggcc

SEQ ID NO: 3082272 - RNA, 16 nt, Mycobacterium bovis subsp bovis AF2122/97
aacgugacgccggcca

SEQ ID NO: 3082273 - RNA, 17 nt, Mycobacterium bovis subsp bovis AF2122/97
aacgugacgccggccag

SEQ ID NO: 3082274 - RNA, 19 nt, Mycobacterium bovis subsp bovis AF2122/97
aacgugaugcggucgcgga

SEQ ID NO: 3082275 - RNA, 19 nt, Mycobacterium bovis subsp bovis AF2122/97
aacgugaugcguucggccg

SEQ ID NO: 3082276 - RNA, 16 nt, Mycobacterium bovis subsp bovis AF2122/97
aacgugauguggucgg

SEQ ID NO: 3082277 - RNA, 15 nt, Mycobacterium bovis subsp bovis AF2122/97
aacgugcaaccacgg

SEQ ID NO: 3082278 - RNA, 14 nt, Mycobacterium bovis subsp bovis AF2122/97
aacgugccucucuc

SEQ ID NO: 3082279 - RNA, 19 nt, Mycobacterium bovis subsp bovis AF2122/97
aacgugcgcaacgcgucgu

SEQ ID NO: 3082280 - RNA, 20 nt, Mycobacterium bovis subsp bovis AF2122/97
aacgugcgcaacgcgucguc

SEQ ID NO: 3082281 - RNA, 23 nt, Mycobacterium bovis subsp bovis AF2122/97
aacgugcgcaacgcgucgucggu

SEQ ID NO: 3082282 - RNA, 12 nt, Mycobacterium bovis subsp bovis AF2122/97
aacgugucgggu

SEQ ID NO: 3082283 - RNA, 13 nt, Mycobacterium bovis subsp bovis AF2122/97
aacuaacggcagc

SEQ ID NO: 3082284 - RNA, 18 nt, Mycobacterium bovis subsp bovis AF2122/97
aacuaacggcagccaccg

SEQ ID NO: 3082285 - RNA, 15 nt, Mycobacterium bovis subsp bovis AF2122/97
aacuacccgccagca

SEQ ID NO: 3082286 - RNA, 18 nt, Mycobacterium bovis subsp bovis AF2122/97
aacuacccgcccacggca

SEQ ID NO: 3082287 - RNA, 16 nt, Mycobacterium bovis subsp bovis AF2122/97
aaccagccaccaccag

SEQ ID NO: 3082288 - RNA, 20 nt, Mycobacterium bovis subsp bovis AF2122/97
aaccagccaccaccaggucg

SEQ ID NO: 3082289 - RNA, 18 nt, Mycobacterium bovis subsp bovis AF2122/97
aaccagcgaccuagcagc

SEQ ID NO: 3082290 - RNA, 22 nt, Mycobacterium bovis subsp bovis AF2122/97
aaccagcgauggguguugcugg

SEQ ID NO: 3082291 - RNA, 20 nt, Mycobacterium bovis subsp bovis AF2122/97
aaccagcugagccgucggcg

SEQ ID NO: 3082292 - RNA, 17 nt, Mycobacterium bovis subsp bovis AF2122/97
aaccagcuugcgccgca

SEQ ID NO: 3082293 - RNA, 21 nt, Mycobacterium bovis subsp bovis AF2122/97
aaccagcuugcgccgcagcga

SEQ ID NO: 3082294 - RNA, 16 nt, Mycobacterium bovis subsp bovis AF2122/97
aaccagguggccaggc

SEQ ID NO: 3082295 - RNA, 19 nt, Mycobacterium bovis subsp bovis AF2122/97
aaccaguccucgggcaggc

SEQ ID NO: 3082296 - RNA, 16 nt, Mycobacterium bovis subsp bovis AF2122/97
aaccagugcagcucga

SEQ ID NO: 3082297 - RNA, 15 nt, Mycobacterium bovis subsp bovis AF2122/97
aaccagugguuuugg

SEQ ID NO: 3082298 - RNA, 22 nt, Mycobacterium bovis subsp bovis AF2122/97
aaccaguugacgaagaacaccu

SEQ ID NO: 3082299 - RNA, 21 nt, Mycobacterium bovis subsp bovis AF2122/97
aaccaucguuguugaccacca

SEQ ID NO: 3082300 - RNA, 22 nt, Mycobacterium bovis subsp bovis AF2122/97
aaccaucguuguugaccaccac

SEQ ID NO: 3082301 - RNA, 14 nt, Mycobacterium bovis subsp bovis AF2122/97
aaccaugccgccga

SEQ ID NO: 3082302 - RNA, 16 nt, Mycobacterium bovis subsp bovis AF2122/97
aaccauugcccgacga

SEQ ID NO: 3082303 - RNA, 21 nt, Mycobacterium bovis subsp bovis AF2122/97
aacccaacaaaaggccauccg

SEQ ID NO: 3082304 - RNA, 18 nt, Mycobacterium bovis subsp bovis AF2122/97
aacccaacaccagcagca

SEQ ID NO: 3082305 - RNA, 20 nt, Mycobacterium bovis subsp bovis AF2122/97
aacccaaccgcgccaccucc

SEQ ID NO: 3082306 - RNA, 19 nt, Mycobacterium bovis subsp bovis AF2122/97
aacccaccgcauuaagggu

SEQ ID NO: 3082307 - RNA, 15 nt, Mycobacterium bovis subsp bovis AF2122/97
aacccacucgcagca

SEQ ID NO: 3082308 - RNA, 23 nt, Mycobacterium bovis subsp bovis AF2122/97
aacccagcgacgcggccagcggc

SEQ ID NO: 3082309 - RNA, 17 nt, Mycobacterium bovis subsp bovis AF2122/97
aacccaggccgucgcgc

SEQ ID NO: 3082310 - RNA, 15 nt, Mycobacterium bovis subsp bovis AF2122/97
aacccaugaccuuca

SEQ ID NO: 3082311 - RNA, 14 nt, Mycobacterium bovis subsp bovis AF2122/97
aacccccgccggcg

SEQ ID NO: 3082312 - RNA, 14 nt, Mycobacterium bovis subsp bovis AF2122/97
aaccccgagcugcc

SEQ ID NO: 3082313 - RNA, 17 nt, Mycobacterium bovis subsp bovis AF2122/97
aaccccgagcugccaac

SEQ ID NO: 3082314 - RNA, 17 nt, Mycobacterium bovis subsp bovis AF2122/97
aaccccgccaggaucug

SEQ ID NO: 3082315 - RNA, 13 nt, Mycobacterium bovis subsp bovis AF2122/97
aaccccgccggcc

SEQ ID NO: 3082316 - RNA, 12 nt, Mycobacterium bovis subsp bovis AF2122/97
aaccccgcgcgg

SEQ ID NO: 3082317 - RNA, 14 nt, Mycobacterium bovis subsp bovis AF2122/97
aaccccuugccuuc

SEQ ID NO: 3082318 - RNA, 15 nt, Mycobacterium bovis subsp bovis AF2122/97
aacccgacgucgcgg

SEQ ID NO: 3082319 - RNA, 21 nt, Mycobacterium bovis subsp bovis AF2122/97
aacccgagcguguugaaauug

SEQ ID NO: 3082320 - RNA, 14 nt, Mycobacterium bovis subsp bovis AF2122/97
aacccgcaccggau

SEQ ID NO: 3082321 - RNA, 20 nt, Mycobacterium bovis subsp bovis AF2122/97
aacccgcaccggggugugcg

SEQ ID NO: 3082322 - RNA, 18 nt, Mycobacterium bovis subsp bovis AF2122/97
aacccgcgauucgcggca

SEQ ID NO: 3082323 - RNA, 18 nt, Mycobacterium bovis subsp bovis AF2122/97
aacccgcucggcggucgg

SEQ ID NO: 3082324 - RNA, 13 nt, Mycobacterium bovis subsp bovis AF2122/97
aacccggaaguug

SEQ ID NO: 3082325 - RNA, 19 nt, Mycobacterium bovis subsp bovis AF2122/97
aacccggaaucgucgcggc

SEQ ID NO: 3082326 - RNA, 23 nt, Mycobacterium bovis subsp bovis AF2122/97
aacccggacgaacgccgucgacg

SEQ ID NO: 3082327 - RNA, 22 nt, Mycobacterium bovis subsp bovis AF2122/97
aacccggcccugaacgguucgg

SEQ ID NO: 3082328 - RNA, 19 nt, Mycobacterium bovis subsp bovis AF2122/97
aacccggccgccgagacga

SEQ ID NO: 3082329 - RNA, 12 nt, Mycobacterium bovis subsp bovis AF2122/97
aacccggccucg

SEQ ID NO: 3082330 - RNA, 22 nt, Mycobacterium bovis subsp bovis AF2122/97
aacccggccuucuccaucgucg

SEQ ID NO: 3082331 - RNA, 12 nt, Mycobacterium bovis subsp bovis AF2122/97
aacccggcgacc

SEQ ID NO: 3082332 - RNA, 21 nt, Mycobacterium bovis subsp bovis AF2122/97
aacccggcgggcccgccggcc

SEQ ID NO: 3082333 - RNA, 17 nt, Mycobacterium bovis subsp bovis AF2122/97
aacccggcuccagcacc

SEQ ID NO: 3082334 - RNA, 20 nt, Mycobacterium bovis subsp bovis AF2122/97
aacccgggcagcaucaacac

SEQ ID NO: 3082335 - RNA, 13 nt, Mycobacterium bovis subsp bovis AF2122/97
aacccggugacca

SEQ ID NO: 3082336 - RNA, 21 nt, Mycobacterium bovis subsp bovis AF2122/97
aacccggugaccagcaaccac

SEQ ID NO: 3082337 - RNA, 23 nt, Mycobacterium bovis subsp bovis AF2122/97
aacccgguguuccggucgcccga

SEQ ID NO: 3082338 - RNA, 19 nt, Mycobacterium bovis subsp bovis AF2122/97
aacccguaaaagccgauga

SEQ ID NO: 3082339 - RNA, 15 nt, Mycobacterium bovis subsp bovis AF2122/97
aacccguaagacaga

SEQ ID NO: 3082340 - RNA, 21 nt, Mycobacterium bovis subsp bovis AF2122/97
aacccguaggguggccgacga

SEQ ID NO: 3082341 - RNA, 21 nt, Mycobacterium bovis subsp bovis AF2122/97
aacccguauggcggcuccaac

SEQ ID NO: 3082342 - RNA, 22 nt, Mycobacterium bovis subsp bovis AF2122/97
aacccguauugccaaagcccga

SEQ ID NO: 3082343 - RNA, 15 nt, Mycobacterium bovis subsp bovis AF2122/97
aacccgucgagccgu

SEQ ID NO: 3082344 - RNA, 21 nt, Mycobacterium bovis subsp bovis AF2122/97
aacccgucgagccgugccucg

SEQ ID NO: 3082345 - RNA, 19 nt, Mycobacterium bovis subsp bovis AF2122/97
aacccgucuuaucggcguc

SEQ ID NO: 3082346 - RNA, 18 nt, Mycobacterium bovis subsp bovis AF2122/97
aacccucagccgcgccgg

SEQ ID NO: 3082347 - RNA, 12 nt, Mycobacterium bovis subsp bovis AF2122/97
aacccucgccac

SEQ ID NO: 3082348 - RNA, 15 nt, Mycobacterium bovis subsp bovis AF2122/97
aacccucgccgguca

SEQ ID NO: 3082349 - RNA, 22 nt, Mycobacterium bovis subsp bovis AF2122/97
aacccugccacgcgugacucgg

SEQ ID NO: 3082350 - RNA, 16 nt, Mycobacterium bovis subsp bovis AF2122/97
aacccugccgcgauga

SEQ ID NO: 3082351 - RNA, 19 nt, Mycobacterium bovis subsp bovis AF2122/97
aacccugccgcgaugagcg

SEQ ID NO: 3082352 - RNA, 22 nt, Mycobacterium bovis subsp bovis AF2122/97
aacccugcggugcaggauucgg

SEQ ID NO: 3082353 - RNA, 17 nt, Mycobacterium bovis subsp bovis AF2122/97
aaccgaagccgucgaug

SEQ ID NO: 3082354 - RNA, 14 nt, Mycobacterium bovis subsp bovis AF2122/97
aaccgaauuguugu

SEQ ID NO: 3082355 - RNA, 12 nt, Mycobacterium bovis subsp bovis AF2122/97
aaccgacccggc

SEQ ID NO: 3082356 - RNA, 14 nt, Mycobacterium bovis subsp bovis AF2122/97
aaccgacccggccg

SEQ ID NO: 3082357 - RNA, 15 nt, Mycobacterium bovis subsp bovis AF2122/97
aaccgacccggccgc

SEQ ID NO: 3082358 - RNA, 20 nt, Mycobacterium bovis subsp bovis AF2122/97
aaccgagccgaccggcggca

SEQ ID NO: 3082359 - RNA, 21 nt, Mycobacterium bovis subsp bovis AF2122/97
aaccgaggaugugguuggugc

SEQ ID NO: 3082360 - RNA, 22 nt, Mycobacterium bovis subsp bovis AF2122/97
aaccgagggauggccguugagg

SEQ ID NO: 3082361 - RNA, 20 nt, Mycobacterium bovis subsp bovis AF2122/97
aaccgaucggucgaucgaau

SEQ ID NO: 3082362 - RNA, 18 nt, Mycobacterium bovis subsp bovis AF2122/97
aaccgaucggucguccgg

SEQ ID NO: 3082363 - RNA, 23 nt, Mycobacterium bovis subsp bovis AF2122/97
aaccgaucggucguccggaucgg

SEQ ID NO: 3082364 - RNA, 13 nt, Mycobacterium bovis subsp bovis AF2122/97
aaccgaugacgcg

SEQ ID NO: 3082365 - RNA, 19 nt, Mycobacterium bovis subsp bovis AF2122/97
aaccgcaaacccgccgaca

SEQ ID NO: 3082366 - RNA, 23 nt, Mycobacterium bovis subsp bovis AF2122/97
aaccgcacccugacagcgagcga

SEQ ID NO: 3082367 - RNA, 16 nt, Mycobacterium bovis subsp bovis AF2122/97
aaccgcaggccgaaga

SEQ ID NO: 3082368 - RNA, 17 nt, Mycobacterium bovis subsp bovis AF2122/97
aaccgccccgugggccu

SEQ ID NO: 3082369 - RNA, 22 nt, Mycobacterium bovis subsp bovis AF2122/97
aaccgccccgugggccucgauc

SEQ ID NO: 3082370 - RNA, 22 nt, Mycobacterium bovis subsp bovis AF2122/97
aaccgccgcgucauucaccgcg

SEQ ID NO: 3082371 - RNA, 14 nt, Mycobacterium bovis subsp bovis AF2122/97
aaccgccggcugcg

SEQ ID NO: 3082372 - RNA, 12 nt, Mycobacterium bovis subsp bovis AF2122/97
aaccgccggugc

SEQ ID NO: 3082373 - RNA, 18 nt, Mycobacterium bovis subsp bovis AF2122/97
aaccgccggugccgauga

SEQ ID NO: 3082374 - RNA, 21 nt, Mycobacterium bovis subsp bovis AF2122/97
aaccgccggugccgaugaccg

SEQ ID NO: 3082375 - RNA, 21 nt, Mycobacterium bovis subsp bovis AF2122/97
aaccgcgcgagccucgcgcgu

SEQ ID NO: 3082376 - RNA, 13 nt, Mycobacterium bovis subsp bovis AF2122/97
aaccgcgcggcga

SEQ ID NO: 3082377 - RNA, 19 nt, Mycobacterium bovis subsp bovis AF2122/97
aaccgcgcggcgaucgagg

SEQ ID NO: 3082378 - RNA, 13 nt, Mycobacterium bovis subsp bovis AF2122/97
aaccgcggaucga

SEQ ID NO: 3082379 - RNA, 14 nt, Mycobacterium bovis subsp bovis AF2122/97
aaccgcguccgcgc

SEQ ID NO: 3082380 - RNA, 16 nt, Mycobacterium bovis subsp bovis AF2122/97
aaccgcguccgcgcgu

SEQ ID NO: 3082381 - RNA, 16 nt, Mycobacterium bovis subsp bovis AF2122/97
aaccgcgugcgucagc

SEQ ID NO: 3082382 - RNA, 19 nt, Mycobacterium bovis subsp bovis AF2122/97
aaccgcguuaugccaggcg

SEQ ID NO: 3082383 - RNA, 16 nt, Mycobacterium bovis subsp bovis AF2122/97
aaccgcucagcgcagc

SEQ ID NO: 3082384 - RNA, 22 nt, Mycobacterium bovis subsp bovis AF2122/97
aaccgcucagcgcagcaucguc

SEQ ID NO: 3082385 - RNA, 23 nt, Mycobacterium bovis subsp bovis AF2122/97
aaccgcucagcgcagcaucgucg

SEQ ID NO: 3082386 - RNA, 17 nt, Mycobacterium bovis subsp bovis AF2122/97
aaccgcugauagcgguc

SEQ ID NO: 3082387 - RNA, 22 nt, Mycobacterium bovis subsp bovis AF2122/97
aaccgcugccggugugcggcgu

SEQ ID NO: 3082388 - RNA, 21 nt, Mycobacterium bovis subsp bovis AF2122/97
aaccgcugcuccucgcgguag

SEQ ID NO: 3082389 - RNA, 13 nt, Mycobacterium bovis subsp bovis AF2122/97
aaccgcugcugcu

SEQ ID NO: 3082390 - RNA, 15 nt, Mycobacterium bovis subsp bovis AF2122/97
aaccgcuuugaauug

SEQ ID NO: 3082391 - RNA, 15 nt, Mycobacterium bovis subsp bovis AF2122/97
aaccggaucaucgcc

SEQ ID NO: 3082392 - RNA, 22 nt, Mycobacterium bovis subsp bovis AF2122/97
aaccggaugcggucccugauca

SEQ ID NO: 3082393 - RNA, 22 nt, Mycobacterium bovis subsp bovis AF2122/97
aaccggcauaacgaucccguga

SEQ ID NO: 3082394 - RNA, 15 nt, Mycobacterium bovis subsp bovis AF2122/97
aaccggcccgcagca

SEQ ID NO: 3082395 - RNA, 13 nt, Mycobacterium bovis subsp bovis AF2122/97
aaccggccgacgc

SEQ ID NO: 3082396 - RNA, 14 nt, Mycobacterium bovis subsp bovis AF2122/97
aaccggccgcgacg

SEQ ID NO: 3082397 - RNA, 15 nt, Mycobacterium bovis subsp bovis AF2122/97
aaccggccgcgacga

SEQ ID NO: 3082398 - RNA, 22 nt, Mycobacterium bovis subsp bovis AF2122/97
aaccggcgaucgguuggugagg

SEQ ID NO: 3082399 - RNA, 19 nt, Mycobacterium bovis subsp bovis AF2122/97
aaccggcgcaguagccgac

SEQ ID NO: 3082400 - RNA, 20 nt, Mycobacterium bovis subsp bovis AF2122/97
aaccggcggcgacggcggca

SEQ ID NO: 3082401 - RNA, 22 nt, Mycobacterium bovis subsp bovis AF2122/97
aaccggcggcgacggcggcacg

SEQ ID NO: 3082402 - RNA, 21 nt, Mycobacterium bovis subsp bovis AF2122/97
aaccggcgggcacaccgcacc

SEQ ID NO: 3082403 - RNA, 23 nt, Mycobacterium bovis subsp bovis AF2122/97
aaccggcgguuuuggggugcuuu

SEQ ID NO: 3082404 - RNA, 17 nt, Mycobacterium bovis subsp bovis AF2122/97
aaccggcgugucgaggg

SEQ ID NO: 3082405 - RNA, 19 nt, Mycobacterium bovis subsp bovis AF2122/97
aaccggcucaaggacgcac

SEQ ID NO: 3082406 - RNA, 16 nt, Mycobacterium bovis subsp bovis AF2122/97
aaccgggcaaaucaag

SEQ ID NO: 3082407 - RNA, 19 nt, Mycobacterium bovis subsp bovis AF2122/97
aaccgggcaaaucaagcac

SEQ ID NO: 3082408 - RNA, 20 nt, Mycobacterium bovis subsp bovis AF2122/97
aaccgggcaaaucaagcaca

SEQ ID NO: 3082409 - RNA, 20 nt, Mycobacterium bovis subsp bovis AF2122/97
aaccgggcagcaaaaaccag

SEQ ID NO: 3082410 - RNA, 13 nt, Mycobacterium bovis subsp bovis AF2122/97
aaccgggccggcu

SEQ ID NO: 3082411 - RNA, 21 nt, Mycobacterium bovis subsp bovis AF2122/97
aaccgggccggcuagggcagc

SEQ ID NO: 3082412 - RNA, 16 nt, Mycobacterium bovis subsp bovis AF2122/97
aaccgguagccaggcg

SEQ ID NO: 3082413 - RNA, 13 nt, Mycobacterium bovis subsp bovis AF2122/97
aaccggucgcagu

SEQ ID NO: 3082414 - RNA, 14 nt, Mycobacterium bovis subsp bovis AF2122/97
aaccggucgcagug

SEQ ID NO: 3082415 - RNA, 13 nt, Mycobacterium bovis subsp bovis AF2122/97
aaccggucguggu

SEQ ID NO: 3082416 - RNA, 22 nt, Mycobacterium bovis subsp bovis AF2122/97
aaccgguggaugaacaccucau

SEQ ID NO: 3082417 - RNA, 13 nt, Mycobacterium bovis subsp bovis AF2122/97
aaccgguggccgg

SEQ ID NO: 3082418 - RNA, 15 nt, Mycobacterium bovis subsp bovis AF2122/97
aaccgguguagcagc

SEQ ID NO: 3082419 - RNA, 21 nt, Mycobacterium bovis subsp bovis AF2122/97
aaccgguuggcgauccgcggc

SEQ ID NO: 3082420 - RNA, 15 nt, Mycobacterium bovis subsp bovis AF2122/97
aaccguagcgcccac

SEQ ID NO: 3082421 - RNA, 14 nt, Mycobacterium bovis subsp bovis AF2122/97
aaccgucagcgcgc

SEQ ID NO: 3082422 - RNA, 19 nt, Mycobacterium bovis subsp bovis AF2122/97
aaccgucagcgcgccgucg

SEQ ID NO: 3082423 - RNA, 14 nt, Mycobacterium bovis subsp bovis AF2122/97
aaccgucagcggca

SEQ ID NO: 3082424 - RNA, 16 nt, Mycobacterium bovis subsp bovis AF2122/97
aaccgucagcggcaac

SEQ ID NO: 3082425 - RNA, 20 nt, Mycobacterium bovis subsp bovis AF2122/97
aaccguccccggcguccgac

SEQ ID NO: 3082426 - RNA, 19 nt, Mycobacterium bovis subsp bovis AF2122/97
aaccgucucggcgaccgac

SEQ ID NO: 3082427 - RNA, 13 nt, Mycobacterium bovis subsp bovis AF2122/97
aaccgugagcacc

SEQ ID NO: 3082428 - RNA, 14 nt, Mycobacterium bovis subsp bovis AF2122/97
aaccguggccgcga

SEQ ID NO: 3082429 - RNA, 17 nt, Mycobacterium bovis subsp bovis AF2122/97
aaccguggucccucggg

SEQ ID NO: 3082430 - RNA, 22 nt, Mycobacterium bovis subsp bovis AF2122/97
aaccgugguguacccgccucgg

SEQ ID NO: 3082431 - RNA, 14 nt, Mycobacterium bovis subsp bovis AF2122/97
aaccguucccggca

SEQ ID NO: 3082432 - RNA, 17 nt, Mycobacterium bovis subsp bovis AF2122/97
aaccguucggcgacagc

SEQ ID NO: 3082433 - RNA, 21 nt, Mycobacterium bovis subsp bovis AF2122/97
aaccguucggcgacagcgcgg

SEQ ID NO: 3082434 - RNA, 23 nt, Mycobacterium bovis subsp bovis AF2122/97
aaccguuggagucaggcgggagc

SEQ ID NO: 3082435 - RNA, 15 nt, Mycobacterium bovis subsp bovis AF2122/97
aaccguuguacccca

SEQ ID NO: 3082436 - RNA, 17 nt, Mycobacterium bovis subsp bovis AF2122/97
aaccguuucgccggcgc

SEQ ID NO: 3082437 - RNA, 19 nt, Mycobacterium bovis subsp bovis AF2122/97
aaccguuugacgcgcucgc

SEQ ID NO: 3082438 - RNA, 19 nt, Mycobacterium bovis subsp bovis AF2122/97
aaccucgacgcccgcccug

SEQ ID NO: 3082439 - RNA, 18 nt, Mycobacterium bovis subsp bovis AF2122/97
aaccucugcugagcugcu

SEQ ID NO: 3082440 - RNA, 14 nt, Mycobacterium bovis subsp bovis AF2122/97
aaccugaguccggc

SEQ ID NO: 3082441 - RNA, 20 nt, Mycobacterium bovis subsp bovis AF2122/97
aaccugcgaccaggcgcggc

SEQ ID NO: 3082442 - RNA, 15 nt, Mycobacterium bovis subsp bovis AF2122/97
aaccuggcggucccg

SEQ ID NO: 3082443 - RNA, 22 nt, Mycobacterium bovis subsp bovis AF2122/97
aaccuguaccgccacggcggcu

SEQ ID NO: 3082444 - RNA, 22 nt, Mycobacterium bovis subsp bovis AF2122/97
aaccuguuccagcgugccuggu

SEQ ID NO: 3082445 - RNA, 20 nt, Mycobacterium bovis subsp bovis AF2122/97
aacgaaaauuugacgacggc

SEQ ID NO: 3082446 - RNA, 18 nt, Mycobacterium bovis subsp bovis AF2122/97
aacgaaccgcucagcgca

SEQ ID NO: 3082447 - RNA, 16 nt, Mycobacterium bovis subsp bovis AF2122/97
aacgaagccggcgccg

SEQ ID NO: 3082448 - RNA, 21 nt, Mycobacterium bovis subsp bovis AF2122/97
aacgacaacacccacgugcug

SEQ ID NO: 3082449 - RNA, 14 nt, Mycobacterium bovis subsp bovis AF2122/97
aacgacacgccgca

SEQ ID NO: 3082450 - RNA, 16 nt, Mycobacterium bovis subsp bovis AF2122/97
aacgacaggcgcccac

SEQ ID NO: 3082451 - RNA, 16 nt, Mycobacterium bovis subsp bovis AF2122/97
aacgacaugggcaggc

SEQ ID NO: 3082452 - RNA, 13 nt, Mycobacterium bovis subsp bovis AF2122/97
aacgacgacgaca

SEQ ID NO: 3082453 - RNA, 18 nt, Mycobacterium bovis subsp bovis AF2122/97
aacgacgccaugagcgcg

SEQ ID NO: 3082454 - RNA, 24 nt, Mycobacterium bovis subsp bovis AF2122/97
aacgacgccaugagcgcgcccaac

SEQ ID NO: 3082455 - RNA, 16 nt, Mycobacterium bovis subsp bovis AF2122/97
aacgacgccgcggucg

SEQ ID NO: 3082456 - RNA, 13 nt, Mycobacterium bovis subsp bovis AF2122/97
aacgacggcaaca

SEQ ID NO: 3082457 - RNA, 14 nt, Mycobacterium bovis subsp bovis AF2122/97
aacgacggccgaca

SEQ ID NO: 3082458 - RNA, 19 nt, Mycobacterium bovis subsp bovis AF2122/97
aacgacggccgucgcccca

SEQ ID NO: 3082459 - RNA, 17 nt, Mycobacterium bovis subsp bovis AF2122/97
aacgacgguuccgccac

SEQ ID NO: 3082460 - RNA, 12 nt, Mycobacterium bovis subsp bovis AF2122/97
gccgucgauccc

SEQ ID NO: 3082461 - RNA, 20 nt, Mycobacterium bovis subsp bovis AF2122/97
gccgucgaucccggucggug

SEQ ID NO: 3082462 - RNA, 22 nt, Mycobacterium bovis subsp bovis AF2122/97
gccgucgaucccggucggugug

SEQ ID NO: 3082463 - RNA, 15 nt, Mycobacterium bovis subsp bovis AF2122/97
gccgucgaucuucuc

SEQ ID NO: 3082464 - RNA, 18 nt, Mycobacterium bovis subsp bovis AF2122/97
gccgucgaugaccagcac

SEQ ID NO: 3082465 - RNA, 23 nt, Mycobacterium bovis subsp bovis AF2122/97
gccgucgaugaccagcacaccgc

SEQ ID NO: 3082466 - RNA, 14 nt, Mycobacterium bovis subsp bovis AF2122/97
gccgucgaugguca

SEQ ID NO: 3082467 - RNA, 18 nt, Mycobacterium bovis subsp bovis AF2122/97
gccgucgauguggcgcuc

SEQ ID NO: 3082468 - RNA, 22 nt, Mycobacterium bovis subsp bovis AF2122/97
gccgucgauguggcgcuccggc

SEQ ID NO: 3082469 - RNA, 20 nt, Mycobacterium bovis subsp bovis AF2122/97
gccgucgauguugcccagca

SEQ ID NO: 3082470 - RNA, 15 nt, Mycobacterium bovis subsp bovis AF2122/97
gccgucgcagccagc

SEQ ID NO: 3082471 - RNA, 14 nt, Mycobacterium bovis subsp bovis AF2122/97
gccgucgccaccau

SEQ ID NO: 3082472 - RNA, 15 nt, Mycobacterium bovis subsp bovis AF2122/97
gccgucgccaccauc

SEQ ID NO: 3082473 - RNA, 13 nt, Mycobacterium bovis subsp bovis AF2122/97
gccgucgccaccg

SEQ ID NO: 3082474 - RNA, 23 nt, Mycobacterium bovis subsp bovis AF2122/97
gccgucgccaccgguaccgauca

SEQ ID NO: 3082475 - RNA, 23 nt, Mycobacterium bovis subsp bovis AF2122/97
gccgucgccacgcccagcgcccg

SEQ ID NO: 3082476 - RNA, 12 nt, Mycobacterium bovis subsp bovis AF2122/97
gccgucgcccca

SEQ ID NO: 3082477 - RNA, 22 nt, Mycobacterium bovis subsp bovis AF2122/97
gccgucgcccuuagggucgccg

SEQ ID NO: 3082478 - RNA, 11 nt, Mycobacterium bovis subsp bovis AF2122/97
gccgucgccga

SEQ ID NO: 3082479 - RNA, 13 nt, Mycobacterium bovis subsp bovis AF2122/97
gccgucgccgauc

SEQ ID NO: 3082480 - RNA, 14 nt, Mycobacterium bovis subsp bovis AF2122/97
gccgucgccgcccu

SEQ ID NO: 3082481 - RNA, 16 nt, Mycobacterium bovis subsp bovis AF2122/97
gccgugaucagcucgc

SEQ ID NO: 3082482 - RNA, 17 nt, Mycobacterium bovis subsp bovis AF2122/97
gccgugaucagcucgcg

SEQ ID NO: 3082483 - RNA, 21 nt, Mycobacterium bovis subsp bovis AF2122/97
gccgugaucagcucgcgcacg

SEQ ID NO: 3082484 - RNA, 23 nt, Mycobacterium bovis subsp bovis AF2122/97
gccgugaucagcucgcgcacguc

SEQ ID NO: 3082485 - RNA, 18 nt, Mycobacterium bovis subsp bovis AF2122/97
gccgugaucgcuggcgac

SEQ ID NO: 3082486 - RNA, 16 nt, Mycobacterium bovis subsp bovis AF2122/97
gccgugaugccacggc

SEQ ID NO: 3082487 - RNA, 22 nt, Mycobacterium bovis subsp bovis AF2122/97
gccgugaugccacggcgucgcu

SEQ ID NO: 3082488 - RNA, 14 nt, Mycobacterium bovis subsp bovis AF2122/97
gccgugcaccagcg

SEQ ID NO: 3082489 - RNA, 16 nt, Mycobacterium bovis subsp bovis AF2122/97
gccgugcaccagcgac

SEQ ID NO: 3082490 - RNA, 18 nt, Mycobacterium bovis subsp bovis AF2122/97
gccgugcaccagcgacca

SEQ ID NO: 3082491 - RNA, 20 nt, Mycobacterium bovis subsp bovis AF2122/97
gccgugcaccagcgaccagg

SEQ ID NO: 3082492 - RNA, 20 nt, Mycobacterium bovis subsp bovis AF2122/97
gccgugcagcucggucagcg

SEQ ID NO: 3082493 - RNA, 19 nt, Mycobacterium bovis subsp bovis AF2122/97
gccgugcaugggacaucca

SEQ ID NO: 3082494 - RNA, 13 nt, Mycobacterium bovis subsp bovis AF2122/97
gccgugccagccc

SEQ ID NO: 3082495 - RNA, 17 nt, Mycobacterium bovis subsp bovis AF2122/97
gccgugccagcccaggc

SEQ ID NO: 3082496 - RNA, 17 nt, Mycobacterium bovis subsp bovis AF2122/97
gccgugcccaggccacc

SEQ ID NO: 3082497 - RNA, 22 nt, Mycobacterium bovis subsp bovis AF2122/97
gccgugcccaggccaccggcug

SEQ ID NO: 3082498 - RNA, 14 nt, Mycobacterium bovis subsp bovis AF2122/97
gccgugcccccggc

SEQ ID NO: 3082499 - RNA, 14 nt, Mycobacterium bovis subsp bovis AF2122/97
gccgugcccggugc

SEQ ID NO: 3082500 - RNA, 19 nt, Mycobacterium bovis subsp bovis AF2122/97
gccgugcccggugcggugc

SEQ ID NO: 3082501 - RNA, 14 nt, Mycobacterium bovis subsp bovis AF2122/97
gccgugccgccgac

SEQ ID NO: 3082502 - RNA, 15 nt, Mycobacterium bovis subsp bovis AF2122/97
gccgugccgccgaca

SEQ ID NO: 3082503 - RNA, 21 nt, Mycobacterium bovis subsp bovis AF2122/97
gccgugccgccgacaccaccg

SEQ ID NO: 3082504 - RNA, 14 nt, Mycobacterium bovis subsp bovis AF2122/97
gccgugccgcggcg

SEQ ID NO: 3082505 - RNA, 15 nt, Mycobacterium bovis subsp bovis AF2122/97
gccgugccgcggcga

SEQ ID NO: 3082506 - RNA, 19 nt, Mycobacterium bovis subsp bovis AF2122/97
gccgugccgguuuggccga

SEQ ID NO: 3082507 - RNA, 12 nt, Mycobacterium bovis subsp bovis AF2122/97
gccgugccguac

SEQ ID NO: 3082508 - RNA, 16 nt, Mycobacterium bovis subsp bovis AF2122/97
gccgugccguggugaa

SEQ ID NO: 3082509 - RNA, 18 nt, Mycobacterium bovis subsp bovis AF2122/97
gccgugccucgaggacgg

SEQ ID NO: 3082510 - RNA, 20 nt, Mycobacterium bovis subsp bovis AF2122/97
gccgugccucgaggacggcg

SEQ ID NO: 3082511 - RNA, 14 nt, Mycobacterium bovis subsp bovis AF2122/97
gccgugcgaucacc

SEQ ID NO: 3082512 - RNA, 18 nt, Mycobacterium bovis subsp bovis AF2122/97
gccgugcgccgugcgauc

SEQ ID NO: 3082513 - RNA, 14 nt, Mycobacterium bovis subsp bovis AF2122/97
gccgugcggcggcu

SEQ ID NO: 3082514 - RNA, 18 nt, Mycobacterium bovis subsp bovis AF2122/97
gccgugcggcggcugccg

SEQ ID NO: 3082515 - RNA, 19 nt, Mycobacterium bovis subsp bovis AF2122/97
gccgugcggucgcgcccuc

SEQ ID NO: 3082516 - RNA, 13 nt, Mycobacterium bovis subsp bovis AF2122/97
gccgugcgugcgg

SEQ ID NO: 3082517 - RNA, 18 nt, Mycobacterium bovis subsp bovis AF2122/97
gccgugcgugcgggggcu

SEQ ID NO: 3082518 - RNA, 17 nt, Mycobacterium bovis subsp bovis AF2122/97
gccgugcucaccggcgc

SEQ ID NO: 3082519 - RNA, 18 nt, Mycobacterium bovis subsp bovis AF2122/97
gccgugcucaccggcgcc

SEQ ID NO: 3082520 - RNA, 22 nt, Mycobacterium bovis subsp bovis AF2122/97
gccgugcucaccggcgcccagc

SEQ ID NO: 3082521 - RNA, 23 nt, Mycobacterium bovis subsp bovis AF2122/97
gccgugcucaccggcgcccagcg

SEQ ID NO: 3082522 - RNA, 20 nt, Mycobacterium bovis subsp bovis AF2122/97
gccgugcucacggcaggcgg

SEQ ID NO: 3082523 - RNA, 23 nt, Mycobacterium bovis subsp bovis AF2122/97
gccgugcucacggcaggcgguga

SEQ ID NO: 3082524 - RNA, 21 nt, Mycobacterium bovis subsp bovis AF2122/97
gccgugcugaacuccgccgcg

SEQ ID NO: 3082525 - RNA, 22 nt, Mycobacterium bovis subsp bovis AF2122/97
gccgugcugaacuccgccgcga

SEQ ID NO: 3082526 - RNA, 17 nt, Mycobacterium bovis subsp bovis AF2122/97
gccgugcugggccgacg

SEQ ID NO: 3082527 - RNA, 18 nt, Mycobacterium bovis subsp bovis AF2122/97
gccgugcugggccgacgg

SEQ ID NO: 3082528 - RNA, 18 nt, Mycobacterium bovis subsp bovis AF2122/97
gccguggauacgcacggc

SEQ ID NO: 3082529 - RNA, 23 nt, Mycobacterium bovis subsp bovis AF2122/97
gccguggaucaucccgaccagca

SEQ ID NO: 3082530 - RNA, 20 nt, Mycobacterium bovis subsp bovis AF2122/97
gccguggaugucgcggucga

SEQ ID NO: 3082531 - RNA, 13 nt, Mycobacterium bovis subsp bovis AF2122/97
gccguggcacccg

SEQ ID NO: 3082532 - RNA, 18 nt, Mycobacterium bovis subsp bovis AF2122/97
gccguggcagucgcacgg

SEQ ID NO: 3082533 - RNA, 20 nt, Mycobacterium bovis subsp bovis AF2122/97
gccguggcaucgccuccagg

SEQ ID NO: 3082534 - RNA, 18 nt, Mycobacterium bovis subsp bovis AF2122/97
gccguggcauguugcgga

SEQ ID NO: 3082535 - RNA, 20 nt, Mycobacterium bovis subsp bovis AF2122/97
gccguggcauguugcggacc

SEQ ID NO: 3082536 - RNA, 13 nt, Mycobacterium bovis subsp bovis AF2122/97
gccguggccgcac

SEQ ID NO: 3082537 - RNA, 16 nt, Mycobacterium bovis subsp bovis AF2122/97
gccguggccgcacugc

SEQ ID NO: 3082538 - RNA, 13 nt, Mycobacterium bovis subsp bovis AF2122/97
gccguggccgcca

SEQ ID NO: 3082539 - RNA, 19 nt, Mycobacterium bovis subsp bovis AF2122/97
gccguggcgaaugacggcc

SEQ ID NO: 3082540 - RNA, 14 nt, Mycobacterium bovis subsp bovis AF2122/97
gccguggcggcagc

SEQ ID NO: 3082541 - RNA, 21 nt, Mycobacterium bovis subsp bovis AF2122/97
gccguggcggcgggccucggc

SEQ ID NO: 3082542 - RNA, 23 nt, Mycobacterium bovis subsp bovis AF2122/97
gccguggcggcgggccucggcga

SEQ ID NO: 3082543 - RNA, 15 nt, Mycobacterium bovis subsp bovis AF2122/97
gccguggcgucggcg

SEQ ID NO: 3082544 - RNA, 16 nt, Mycobacterium bovis subsp bovis AF2122/97
gccguggcgucggcgu

SEQ ID NO: 3082545 - RNA, 18 nt, Mycobacterium bovis subsp bovis AF2122/97
gccguggcgucggcguca

SEQ ID NO: 3082546 - RNA, 18 nt, Mycobacterium bovis subsp bovis AF2122/97
gccguggcgucgguggca

SEQ ID NO: 3082547 - RNA, 19 nt, Mycobacterium bovis subsp bovis AF2122/97
gccguggcgucgguggcaa

SEQ ID NO: 3082548 - RNA, 23 nt, Mycobacterium bovis subsp bovis AF2122/97
gccguggcuggacccgcauggcg

SEQ ID NO: 3082549 - RNA, 22 nt, Mycobacterium bovis subsp bovis AF2122/97
gccguggguguugaugggcagc

SEQ ID NO: 3082550 - RNA, 22 nt, Mycobacterium bovis subsp bovis AF2122/97
gccguggguguuuuugcgggug

SEQ ID NO: 3082551 - RNA, 12 nt, Mycobacterium bovis subsp bovis AF2122/97
gccguggucgag

SEQ ID NO: 3082552 - RNA, 18 nt, Mycobacterium bovis subsp bovis AF2122/97
gccguggucgagggcggc

SEQ ID NO: 3082553 - RNA, 19 nt, Mycobacterium bovis subsp bovis AF2122/97
gccguggucgagggcggcg

SEQ ID NO: 3082554 - RNA, 17 nt, Mycobacterium bovis subsp bovis AF2122/97
gccgugguggacgaugc

SEQ ID NO: 3082555 - RNA, 23 nt, Mycobacterium bovis subsp bovis AF2122/97
gccgugguggucucgagggugaa

SEQ ID NO: 3082556 - RNA, 21 nt, Mycobacterium bovis subsp bovis AF2122/97
gccguguccagcaugcccgcc

SEQ ID NO: 3082557 - RNA, 14 nt, Mycobacterium bovis subsp bovis AF2122/97
gccguguccgccgg

SEQ ID NO: 3082558 - RNA, 14 nt, Mycobacterium bovis subsp bovis AF2122/97
gccgugucgggcgc

SEQ ID NO: 3082559 - RNA, 19 nt, Mycobacterium bovis subsp bovis AF2122/97
gccgugugcaucggcgacc

SEQ ID NO: 3082560 - RNA, 21 nt, Mycobacterium bovis subsp bovis AF2122/97
gccgugugcaucggcgaccgc

SEQ ID NO: 3082561 - RNA, 19 nt, Mycobacterium bovis subsp bovis AF2122/97
gccgugugcuucgagcacc

SEQ ID NO: 3082562 - RNA, 20 nt, Mycobacterium bovis subsp bovis AF2122/97
gccgugugcuucgagcaccg

SEQ ID NO: 3082563 - RNA, 21 nt, Mycobacterium bovis subsp bovis AF2122/97
gccgugugugcgauccagggc

SEQ ID NO: 3082564 - RNA, 17 nt, Mycobacterium bovis subsp bovis AF2122/97
gccguguuccagguaca

SEQ ID NO: 3082565 - RNA, 22 nt, Mycobacterium bovis subsp bovis AF2122/97
gccguguucgaccgcagggacc

SEQ ID NO: 3082566 - RNA, 17 nt, Mycobacterium bovis subsp bovis AF2122/97
gccguguucgauagcgg

SEQ ID NO: 3082567 - RNA, 21 nt, Mycobacterium bovis subsp bovis AF2122/97
gccuaaguucgccacgcccga

SEQ ID NO: 3082568 - RNA, 16 nt, Mycobacterium bovis subsp bovis AF2122/97
gccuaccagcaccggg

SEQ ID NO: 3082569 - RNA, 14 nt, Mycobacterium bovis subsp bovis AF2122/97
gccuaccaggcgcg

SEQ ID NO: 3082570 - RNA, 17 nt, Mycobacterium bovis subsp bovis AF2122/97
gccuaccaggcgcggcc

SEQ ID NO: 3082571 - RNA, 18 nt, Mycobacterium bovis subsp bovis AF2122/97
gccuaccaggcgcggccc

SEQ ID NO: 3082572 - RNA, 12 nt, Mycobacterium bovis subsp bovis AF2122/97
gccuaccggccu

SEQ ID NO: 3082573 - RNA, 18 nt, Mycobacterium bovis subsp bovis AF2122/97
gccuaccggccuuuccag

SEQ ID NO: 3082574 - RNA, 22 nt, Mycobacterium bovis subsp bovis AF2122/97
gccuaccggccuuuccagcacc

SEQ ID NO: 3082575 - RNA, 23 nt, Mycobacterium bovis subsp bovis AF2122/97
gccuaccggccuuuccagcaccc

SEQ ID NO: 3082576 - RNA, 12 nt, Mycobacterium bovis subsp bovis AF2122/97
gccuaccgggcc

SEQ ID NO: 3082577 - RNA, 22 nt, Mycobacterium bovis subsp bovis AF2122/97
gccuagcacgaagcuggcgugc

SEQ ID NO: 3082578 - RNA, 13 nt, Mycobacterium bovis subsp bovis AF2122/97
gccuagccgcagc

SEQ ID NO: 3082579 - RNA, 14 nt, Mycobacterium bovis subsp bovis AF2122/97
gccuagccgcggca

SEQ ID NO: 3082580 - RNA, 13 nt, Mycobacterium bovis subsp bovis AF2122/97
gccuagcgagcgc

SEQ ID NO: 3082581 - RNA, 18 nt, Mycobacterium bovis subsp bovis AF2122/97
gccuagcgcgggcucggu

SEQ ID NO: 3082582 - RNA, 14 nt, Mycobacterium bovis subsp bovis AF2122/97
gccuaggacaccgg

SEQ ID NO: 3082583 - RNA, 23 nt, Mycobacterium bovis subsp bovis AF2122/97
gccuagggaaaggcgccggucgc

SEQ ID NO: 3082584 - RNA, 15 nt, Mycobacterium bovis subsp bovis AF2122/97
gccuagggcggcggc

SEQ ID NO: 3082585 - RNA, 16 nt, Mycobacterium bovis subsp bovis AF2122/97
gccuagggcggcggcg

SEQ ID NO: 3082586 - RNA, 17 nt, Mycobacterium bovis subsp bovis AF2122/97
gccuagggcggcggcgc

SEQ ID NO: 3082587 - RNA, 17 nt, Mycobacterium bovis subsp bovis AF2122/97
gccuaggucgacgccga

SEQ ID NO: 3082588 - RNA, 22 nt, Mycobacterium bovis subsp bovis AF2122/97
gccuaguccggcacugcggcca

SEQ ID NO: 3082589 - RNA, 18 nt, Mycobacterium bovis subsp bovis AF2122/97
gccuaguccuggcucggc

SEQ ID NO: 3082590 - RNA, 20 nt, Mycobacterium bovis subsp bovis AF2122/97
gccuaguccuggcucggcau

SEQ ID NO: 3082591 - RNA, 14 nt, Mycobacterium bovis subsp bovis AF2122/97
gccuagugguucga

SEQ ID NO: 3082592 - RNA, 17 nt, Mycobacterium bovis subsp bovis AF2122/97
gccuagugguucgaacc

SEQ ID NO: 3082593 - RNA, 18 nt, Mycobacterium bovis subsp bovis AF2122/97
gccuaugcugcccggcaa

SEQ ID NO: 3082594 - RNA, 13 nt, Mycobacterium bovis subsp bovis AF2122/97
gccucaacacccg

SEQ ID NO: 3082595 - RNA, 15 nt, Mycobacterium bovis subsp bovis AF2122/97
gccucaagcucgccg

SEQ ID NO: 3082596 - RNA, 14 nt, Mycobacterium bovis subsp bovis AF2122/97
gccucaaugaccac

SEQ ID NO: 3082597 - RNA, 18 nt, Mycobacterium bovis subsp bovis AF2122/97
gccucaaugaccaccggg

SEQ ID NO: 3082598 - RNA, 22 nt, Mycobacterium bovis subsp bovis AF2122/97
gccucaccaggucuucgaccac

SEQ ID NO: 3082599 - RNA, 15 nt, Mycobacterium bovis subsp bovis AF2122/97
gccucaccgacgucg

SEQ ID NO: 3082600 - RNA, 23 nt, Mycobacterium bovis subsp bovis AF2122/97
gccucaccgccgcuaccgcccgc

SEQ ID NO: 3082601 - RNA, 13 nt, Mycobacterium bovis subsp bovis AF2122/97
gccucaccggcgc

SEQ ID NO: 3082602 - RNA, 17 nt, Mycobacterium bovis subsp bovis AF2122/97
gccucaccggcgcgagc

SEQ ID NO: 3082603 - RNA, 20 nt, Mycobacterium bovis subsp bovis AF2122/97
gccucagaccggaaacagca

SEQ ID NO: 3082604 - RNA, 13 nt, Mycobacterium bovis subsp bovis AF2122/97
gccucagcccggc

SEQ ID NO: 3082605 - RNA, 16 nt, Mycobacterium bovis subsp bovis AF2122/97
gccucagcccggccag

SEQ ID NO: 3082606 - RNA, 18 nt, Mycobacterium bovis subsp bovis AF2122/97
gccucagcccggccagcc

SEQ ID NO: 3082607 - RNA, 15 nt, Mycobacterium bovis subsp bovis AF2122/97
gccucaggggcgccu

SEQ ID NO: 3082608 - RNA, 22 nt, Mycobacterium bovis subsp bovis AF2122/97
gccucaguacagcgcguuggcg

SEQ ID NO: 3082609 - RNA, 16 nt, Mycobacterium bovis subsp bovis AF2122/97
gccucauccaccgaug

SEQ ID NO: 3082610 - RNA, 20 nt, Mycobacterium bovis subsp bovis AF2122/97
gccucauccaccgauggcgc

SEQ ID NO: 3082611 - RNA, 22 nt, Mycobacterium bovis subsp bovis AF2122/97
gccucauccaccgauggcgcgc

SEQ ID NO: 3082612 - RNA, 21 nt, Mycobacterium bovis subsp bovis AF2122/97
gccuccaaaaucgcggccaca

SEQ ID NO: 3082613 - RNA, 22 nt, Mycobacterium bovis subsp bovis AF2122/97
gccuccaaaaucgcggccacac

SEQ ID NO: 3082614 - RNA, 14 nt, Mycobacterium bovis subsp bovis AF2122/97
gccuccaagcccgc

SEQ ID NO: 3082615 - RNA, 15 nt, Mycobacterium bovis subsp bovis AF2122/97
gccuccaagcccgcc

SEQ ID NO: 3082616 - RNA, 17 nt, Mycobacterium bovis subsp bovis AF2122/97
gccuccaagcccgccgg

SEQ ID NO: 3082617 - RNA, 14 nt, Mycobacterium bovis subsp bovis AF2122/97
gccuccacccgcca

SEQ ID NO: 3082618 - RNA, 15 nt, Mycobacterium bovis subsp bovis AF2122/97
gccuccacccgccac

SEQ ID NO: 3082619 - RNA, 14 nt, Mycobacterium bovis subsp bovis AF2122/97
gccuccaccgccgc

SEQ ID NO: 3082620 - RNA, 15 nt, Mycobacterium bovis subsp bovis AF2122/97
gccuccaccgccgcg

SEQ ID NO: 3082621 - RNA, 12 nt, Mycobacterium bovis subsp bovis AF2122/97
gccuccaccgcg

SEQ ID NO: 3082622 - RNA, 16 nt, Mycobacterium bovis subsp bovis AF2122/97
gccuccaccgcgucca

SEQ ID NO: 3082623 - RNA, 20 nt, Mycobacterium bovis subsp bovis AF2122/97
gccuccacucuucgggcggc

SEQ ID NO: 3082624 - RNA, 22 nt, Mycobacterium bovis subsp bovis AF2122/97
gccuccacucuucgggcggcgu

SEQ ID NO: 3082625 - RNA, 20 nt, Mycobacterium bovis subsp bovis AF2122/97
gccuccagauucgccgccca

SEQ ID NO: 3082626 - RNA, 23 nt, Mycobacterium bovis subsp bovis AF2122/97
gccuccagcagguccgcggccgc

SEQ ID NO: 3082627 - RNA, 13 nt, Mycobacterium bovis subsp bovis AF2122/97
gccuccagccggc

SEQ ID NO: 3082628 - RNA, 16 nt, Mycobacterium bovis subsp bovis AF2122/97
gccuccagcgcaccgg

SEQ ID NO: 3082629 - RNA, 15 nt, Mycobacterium bovis subsp bovis AF2122/97
gccuccaggcgccac

SEQ ID NO: 3082630 - RNA, 16 nt, Mycobacterium bovis subsp bovis AF2122/97
gccuccaggcgccacc

SEQ ID NO: 3082631 - RNA, 12 nt, Mycobacterium bovis subsp bovis AF2122/97
gccuccccgacc

SEQ ID NO: 3082632 - RNA, 12 nt, Mycobacterium bovis subsp bovis AF2122/97
gccucccgggcc

SEQ ID NO: 3082633 - RNA, 13 nt, Mycobacterium bovis subsp bovis AF2122/97
gccucccgggccg

SEQ ID NO: 3082634 - RNA, 15 nt, Mycobacterium bovis subsp bovis AF2122/97
gccucccgggccgcc

SEQ ID NO: 3082635 - RNA, 17 nt, Mycobacterium bovis subsp bovis AF2122/97
gccucccgggccgccgc

SEQ ID NO: 3082636 - RNA, 15 nt, Mycobacterium bovis subsp bovis AF2122/97
gccucccuuuuccaa

SEQ ID NO: 3082637 - RNA, 12 nt, Mycobacterium bovis subsp bovis AF2122/97
gccuccgccgag

SEQ ID NO: 3082638 - RNA, 15 nt, Mycobacterium bovis subsp bovis AF2122/97
gccuccgccgaggcc

SEQ ID NO: 3082639 - RNA, 17 nt, Mycobacterium bovis subsp bovis AF2122/97
gccuccgccgaggccgc

SEQ ID NO: 3082640 - RNA, 19 nt, Mycobacterium bovis subsp bovis AF2122/97
gccuccgccgaggccgccg

SEQ ID NO: 3082641 - RNA, 13 nt, Mycobacterium bovis subsp bovis AF2122/97
gccuccgccugcc

SEQ ID NO: 3082642 - RNA, 16 nt, Mycobacterium bovis subsp bovis AF2122/97
gccuccgcugccgccc

SEQ ID NO: 3082643 - RNA, 10 nt, Mycobacterium bovis subsp bovis AF2122/97
gccuccggca

SEQ ID NO: 3082644 - RNA, 17 nt, Mycobacterium bovis subsp bovis AF2122/97
gccuccggcaccuccag

SEQ ID NO: 3082645 - RNA, 23 nt, Mycobacterium bovis subsp bovis AF2122/97
gccuccggugcauauuggaucgu

SEQ ID NO: 3082646 - RNA, 15 nt, Mycobacterium bovis subsp bovis AF2122/97
gccuccguugccccc

SEQ ID NO: 3082647 - RNA, 21 nt, Mycobacterium bovis subsp bovis AF2122/97
gccuccuccccgaccgccacc

SEQ ID NO: 3082648 - RNA, 20 nt, Mycobacterium bovis subsp bovis AF2122/97
gccuccucgacgucggcgag

SEQ ID NO: 3082649 - RNA, 16 nt, Mycobacterium bovis subsp bovis AF2122/97
gccuccucuugggucc

SEQ ID NO: 3082650 - RNA, 21 nt, Mycobacterium bovis subsp bovis AF2122/97
gccuccucuuggguccacaac

SEQ ID NO: 3082651 - RNA, 15 nt, Mycobacterium bovis subsp bovis AF2122/97
gccuccugccgccgc

SEQ ID NO: 3082652 - RNA, 20 nt, Mycobacterium bovis subsp bovis AF2122/97
gccuccugccgccgcuccau

SEQ ID NO: 3082653 - RNA, 12 nt, Mycobacterium bovis subsp bovis AF2122/97
gccuccugcugg

SEQ ID NO: 3082654 - RNA, 17 nt, Mycobacterium bovis subsp bovis AF2122/97
gccugaaacggcugcag

SEQ ID NO: 3082655 - RNA, 13 nt, Mycobacterium bovis subsp bovis AF2122/97
gccugaaugcgac

SEQ ID NO: 3082656 - RNA, 15 nt, Mycobacterium bovis subsp bovis AF2122/97
gccugacacgaugcc

SEQ ID NO: 3082657 - RNA, 15 nt, Mycobacterium bovis subsp bovis AF2122/97
gccugaccgccaccg

SEQ ID NO: 3082658 - RNA, 18 nt, Mycobacterium bovis subsp bovis AF2122/97
gccugaccgccaccguca

SEQ ID NO: 3082659 - RNA, 15 nt, Mycobacterium bovis subsp bovis AF2122/97
gccugaccggcucgc

SEQ ID NO: 3082660 - RNA, 17 nt, Mycobacterium bovis subsp bovis AF2122/97
gccugaccggcucgccg

SEQ ID NO: 3082661 - RNA, 18 nt, Mycobacterium bovis subsp bovis AF2122/97
gccugaccggcucgccgg

SEQ ID NO: 3082662 - RNA, 20 nt, Mycobacterium bovis subsp bovis AF2122/97
gccugaccggcucgccggcg

SEQ ID NO: 3082663 - RNA, 21 nt, Mycobacterium bovis subsp bovis AF2122/97
gccugaccggcucgccggcgc

SEQ ID NO: 3082664 - RNA, 16 nt, Mycobacterium bovis subsp bovis AF2122/97
gccugaccggucaccc

SEQ ID NO: 3082665 - RNA, 22 nt, Mycobacterium bovis subsp bovis AF2122/97
gccugacgcgucagcggcgagc

SEQ ID NO: 3082666 - RNA, 17 nt, Mycobacterium bovis subsp bovis AF2122/97
gccugacucaucaccga

SEQ ID NO: 3082667 - RNA, 16 nt, Mycobacterium bovis subsp bovis AF2122/97
gccugagcacguucac

SEQ ID NO: 3082668 - RNA, 21 nt, Mycobacterium bovis subsp bovis AF2122/97
gccugagcacguucaccgcgc

SEQ ID NO: 3082669 - RNA, 13 nt, Mycobacterium bovis subsp bovis AF2122/97
gccugagccacca

SEQ ID NO: 3082670 - RNA, 14 nt, Mycobacterium bovis subsp bovis AF2122/97
gccugagccaccaa

SEQ ID NO: 3082671 - RNA, 21 nt, Mycobacterium bovis subsp bovis AF2122/97
gccugagccaccaacaccgcg

SEQ ID NO: 3082672 - RNA, 15 nt, Mycobacterium bovis subsp bovis AF2122/97
gccugagcgccgcgg

SEQ ID NO: 3082673 - RNA, 16 nt, Mycobacterium bovis subsp bovis AF2122/97
gccugagcgccgcggc

SEQ ID NO: 3082674 - RNA, 17 nt, Mycobacterium bovis subsp bovis AF2122/97
gccugagcgccgcggcg

SEQ ID NO: 3082675 - RNA, 18 nt, Mycobacterium bovis subsp bovis AF2122/97
gccugagcgccgcggcgg

SEQ ID NO: 3082676 - RNA, 19 nt, Mycobacterium bovis subsp bovis AF2122/97
gccugagcgccgcggcgga

SEQ ID NO: 3082677 - RNA, 14 nt, Mycobacterium bovis subsp bovis AF2122/97
gccugagcggccau

SEQ ID NO: 3082678 - RNA, 16 nt, Mycobacterium bovis subsp bovis AF2122/97
gccugagcggccaucg

SEQ ID NO: 3082679 - RNA, 14 nt, Mycobacterium bovis subsp bovis AF2122/97
gccugagcggccuc

SEQ ID NO: 3082680 - RNA, 13 nt, Mycobacterium bovis subsp bovis AF2122/97
gccugagcgggga

SEQ ID NO: 3082681 - RNA, 23 nt, Mycobacterium bovis subsp bovis AF2122/97
gccugagcggggauguccgcggc

SEQ ID NO: 3082682 - RNA, 20 nt, Mycobacterium bovis subsp bovis AF2122/97
gccugaguuuaugcccggca

SEQ ID NO: 3082683 - RNA, 18 nt, Mycobacterium bovis subsp bovis AF2122/97
gccugauaaagcccggcg

SEQ ID NO: 3082684 - RNA, 20 nt, Mycobacterium bovis subsp bovis AF2122/97
gccugauaaagcccggcggc

SEQ ID NO: 3082685 - RNA, 20 nt, Mycobacterium bovis subsp bovis AF2122/97
gccugaugagggacgaacac

SEQ ID NO: 3082686 - RNA, 22 nt, Mycobacterium bovis subsp bovis AF2122/97
gccugauuccacugggccugcc

SEQ ID NO: 3082687 - RNA, 21 nt, Mycobacterium bovis subsp bovis AF2122/97
gccugcaagacaaagccgucg

SEQ ID NO: 3082688 - RNA, 18 nt, Mycobacterium bovis subsp bovis AF2122/97
gccugcaccacggcggcc

SEQ ID NO: 3082689 - RNA, 15 nt, Mycobacterium bovis subsp bovis AF2122/97
gccugcaccgccgcc

SEQ ID NO: 3082690 - RNA, 16 nt, Mycobacterium bovis subsp bovis AF2122/97
gccugcaccgccgccg

SEQ ID NO: 3082691 - RNA, 15 nt, Mycobacterium bovis subsp bovis AF2122/97
gccugcacgcccggc

SEQ ID NO: 3082692 - RNA, 16 nt, Mycobacterium bovis subsp bovis AF2122/97
gccugcacgcccggcg

SEQ ID NO: 3082693 - RNA, 18 nt, Mycobacterium bovis subsp bovis AF2122/97
gccugcacgccggcgcug

SEQ ID NO: 3082694 - RNA, 14 nt, Mycobacterium bovis subsp bovis AF2122/97
gccugcacggcgcu

SEQ ID NO: 3082695 - RNA, 17 nt, Mycobacterium bovis subsp bovis AF2122/97
gccugcacggcgcugac

SEQ ID NO: 3082696 - RNA, 18 nt, Mycobacterium bovis subsp bovis AF2122/97
gccugcacggcgcugacg

SEQ ID NO: 3082697 - RNA, 22 nt, Mycobacterium bovis subsp bovis AF2122/97
gccugcagcgaaacaccggcca

SEQ ID NO: 3082698 - RNA, 18 nt, Mycobacterium bovis subsp bovis AF2122/97
gccugcagcgaugacgac

SEQ ID NO: 3082699 - RNA, 14 nt, Mycobacterium bovis subsp bovis AF2122/97
gccugcagcgcgac

SEQ ID NO: 3082700 - RNA, 15 nt, Mycobacterium bovis subsp bovis AF2122/97
gccugcagcgcgacc

SEQ ID NO: 3082701 - RNA, 12 nt, Mycobacterium bovis subsp bovis AF2122/97
gccugcaggccg

SEQ ID NO: 3082702 - RNA, 14 nt, Mycobacterium bovis subsp bovis AF2122/97
gccugcaggccgcc

SEQ ID NO: 3082703 - RNA, 16 nt, Mycobacterium bovis subsp bovis AF2122/97
gccugcaggccgccgg

SEQ ID NO: 3082704 - RNA, 19 nt, Mycobacterium bovis subsp bovis AF2122/97
gccugcaggccgccggcca

SEQ ID NO: 3082705 - RNA, 19 nt, Mycobacterium bovis subsp bovis AF2122/97
gccugcagguuuccggccu

SEQ ID NO: 3082706 - RNA, 15 nt, Mycobacterium bovis subsp bovis AF2122/97
gccugcaguucggcg

SEQ ID NO: 3082707 - RNA, 17 nt, Mycobacterium bovis subsp bovis AF2122/97
gccugcaguucggcgua

SEQ ID NO: 3082708 - RNA, 11 nt, Mycobacterium bovis subsp bovis AF2122/97
gccugccaccc

SEQ ID NO: 3082709 - RNA, 13 nt, Mycobacterium bovis subsp bovis AF2122/97
gccugccacccgg

SEQ ID NO: 3082710 - RNA, 14 nt, Mycobacterium bovis subsp bovis AF2122/97
gccugccacccggc

SEQ ID NO: 3082711 - RNA, 15 nt, Mycobacterium bovis subsp bovis AF2122/97
gccugccacccggcc

SEQ ID NO: 3082712 - RNA, 16 nt, Mycobacterium bovis subsp bovis AF2122/97
gccugccacccggcca

SEQ ID NO: 3082713 - RNA, 16 nt, Mycobacterium bovis subsp bovis AF2122/97
gccugccaccggcgcu

SEQ ID NO: 3082714 - RNA, 13 nt, Mycobacterium bovis subsp bovis AF2122/97
gccugcccaccuu

SEQ ID NO: 3082715 - RNA, 14 nt, Mycobacterium bovis subsp bovis AF2122/97
gccugcccaccuuc

SEQ ID NO: 3082716 - RNA, 16 nt, Mycobacterium bovis subsp bovis AF2122/97
gccugcccaccuucga

SEQ ID NO: 3082717 - RNA, 12 nt, Mycobacterium bovis subsp bovis AF2122/97
gccugcccagca

SEQ ID NO: 3082718 - RNA, 14 nt, Mycobacterium bovis subsp bovis AF2122/97
gccugcccagcacc

SEQ ID NO: 3082719 - RNA, 18 nt, Mycobacterium bovis subsp bovis AF2122/97
gccugcccagcaccaccg

SEQ ID NO: 3082720 - RNA, 23 nt, Mycobacterium bovis subsp bovis AF2122/97
gccugccccacccgcggcgccgu

SEQ ID NO: 3082721 - RNA, 12 nt, Mycobacterium bovis subsp bovis AF2122/97
gccugccccaga

SEQ ID NO: 3082722 - RNA, 13 nt, Mycobacterium bovis subsp bovis AF2122/97
gccugccccagau

SEQ ID NO: 3082723 - RNA, 14 nt, Mycobacterium bovis subsp bovis AF2122/97
gccugcccccgcgc

SEQ ID NO: 3082724 - RNA, 17 nt, Mycobacterium bovis subsp bovis AF2122/97
gccugcccccgcgcgca

SEQ ID NO: 3082725 - RNA, 21 nt, Mycobacterium bovis subsp bovis AF2122/97
gccugcccccgcgcgcacggc

SEQ ID NO: 3082726 - RNA, 15 nt, Mycobacterium bovis subsp bovis AF2122/97
gccugcccccggcgc

SEQ ID NO: 3082727 - RNA, 16 nt, Mycobacterium bovis subsp bovis AF2122/97
gccugcccccggcgcg

SEQ ID NO: 3082728 - RNA, 18 nt, Mycobacterium bovis subsp bovis AF2122/97
gccugcccccggcgcggc

SEQ ID NO: 3082729 - RNA, 23 nt, Mycobacterium bovis subsp bovis AF2122/97
gccugcccgaaccaccaccggca

SEQ ID NO: 3082730 - RNA, 15 nt, Mycobacterium bovis subsp bovis AF2122/97
gccugcccggcccgc

SEQ ID NO: 3082731 - RNA, 13 nt, Mycobacterium bovis subsp bovis AF2122/97
gccugcccggcgc

SEQ ID NO: 3082732 - RNA, 14 nt, Mycobacterium bovis subsp bovis AF2122/97
gccugcccgggaug

SEQ ID NO: 3082733 - RNA, 21 nt, Mycobacterium bovis subsp bovis AF2122/97
gccugccgaaacgccgaccgc

SEQ ID NO: 3082734 - RNA, 22 nt, Mycobacterium bovis subsp bovis AF2122/97
gccugccgaaacgccgaccgcg

SEQ ID NO: 3082735 - RNA, 18 nt, Mycobacterium bovis subsp bovis AF2122/97
gccugccgacggcaucaa

SEQ ID NO: 3082736 - RNA, 21 nt, Mycobacterium bovis subsp bovis AF2122/97
gccugccgacggcaucaacgc

SEQ ID NO: 3082737 - RNA, 15 nt, Mycobacterium bovis subsp bovis AF2122/97
gccugccgaugacga

SEQ ID NO: 3082738 - RNA, 18 nt, Mycobacterium bovis subsp bovis AF2122/97
gccugccgcacguucggc

SEQ ID NO: 3082739 - RNA, 20 nt, Mycobacterium bovis subsp bovis AF2122/97
gccugccgcacguucggcga

SEQ ID NO: 3082740 - RNA, 23 nt, Mycobacterium bovis subsp bovis AF2122/97
gccugccgcacguucggcgauga

SEQ ID NO: 3082741 - RNA, 16 nt, Mycobacterium bovis subsp bovis AF2122/97
gccugggacggcggca

SEQ ID NO: 3082742 - RNA, 20 nt, Mycobacterium bovis subsp bovis AF2122/97
gccugggacggcggcagucg

SEQ ID NO: 3082743 - RNA, 18 nt, Mycobacterium bovis subsp bovis AF2122/97
gccugggcacggccgucg

SEQ ID NO: 3082744 - RNA, 13 nt, Mycobacterium bovis subsp bovis AF2122/97
gccugggccagcc

SEQ ID NO: 3082745 - RNA, 15 nt, Mycobacterium bovis subsp bovis AF2122/97
gccugggccagccgc

SEQ ID NO: 3082746 - RNA, 17 nt, Mycobacterium bovis subsp bovis AF2122/97
gccugggccagccgcuc

SEQ ID NO: 3082747 - RNA, 17 nt, Mycobacterium bovis subsp bovis AF2122/97
gccugggccgcacaagu

SEQ ID NO: 3082748 - RNA, 15 nt, Mycobacterium bovis subsp bovis AF2122/97
gccugggcggccagc

SEQ ID NO: 3082749 - RNA, 22 nt, Mycobacterium bovis subsp bovis AF2122/97
gccuggggcagccgggcgucgc

SEQ ID NO: 3082750 - RNA, 18 nt, Mycobacterium bovis subsp bovis AF2122/97
gccuggggguucuggccg

SEQ ID NO: 3082751 - RNA, 17 nt, Mycobacterium bovis subsp bovis AF2122/97
gccugguaccgcggugu

SEQ ID NO: 3082752 - RNA, 21 nt, Mycobacterium bovis subsp bovis AF2122/97
gccugguacucccgcgaucgc

SEQ ID NO: 3082753 - RNA, 14 nt, Mycobacterium bovis subsp bovis AF2122/97
gccugguccucacg

SEQ ID NO: 3082754 - RNA, 18 nt, Mycobacterium bovis subsp bovis AF2122/97
gccugguccucacggguc

SEQ ID NO: 3082755 - RNA, 13 nt, Mycobacterium bovis subsp bovis AF2122/97
gccuggucgcgca

SEQ ID NO: 3082756 - RNA, 13 nt, Mycobacterium bovis subsp bovis AF2122/97
gccuggucggcca

SEQ ID NO: 3082757 - RNA, 19 nt, Mycobacterium bovis subsp bovis AF2122/97
gccuggucggccaggucga

SEQ ID NO: 3082758 - RNA, 20 nt, Mycobacterium bovis subsp bovis AF2122/97
gccuggucuuguugcgcagc

SEQ ID NO: 3082759 - RNA, 20 nt, Mycobacterium bovis subsp bovis AF2122/97
gccugguguacacacccgcc

SEQ ID NO: 3082760 - RNA, 13 nt, Mycobacterium bovis subsp bovis AF2122/97
gccugguguccga

SEQ ID NO: 3082761 - RNA, 19 nt, Mycobacterium bovis subsp bovis AF2122/97
gccugguguccgagcggcc

SEQ ID NO: 3082762 - RNA, 22 nt, Mycobacterium bovis subsp bovis AF2122/97
gccugucaggcggcggacccgc

SEQ ID NO: 3082763 - RNA, 13 nt, Mycobacterium bovis subsp bovis AF2122/97
gccugucccgccg

SEQ ID NO: 3082764 - RNA, 15 nt, Mycobacterium bovis subsp bovis AF2122/97
gccugucccgccggc

SEQ ID NO: 3082765 - RNA, 16 nt, Mycobacterium bovis subsp bovis AF2122/97
gccugucccgccggcc

SEQ ID NO: 3082766 - RNA, 20 nt, Mycobacterium bovis subsp bovis AF2122/97
gccugucgaagauccagcgc

SEQ ID NO: 3082767 - RNA, 21 nt, Mycobacterium bovis subsp bovis AF2122/97
gccugugccaccgcuggaucg

SEQ ID NO: 3082768 - RNA, 22 nt, Mycobacterium bovis subsp bovis AF2122/97
gccugugccaccgcuggaucga

SEQ ID NO: 3082769 - RNA, 14 nt, Mycobacterium bovis subsp bovis AF2122/97
gccugugccgccgg

SEQ ID NO: 3082770 - RNA, 16 nt, Mycobacterium bovis subsp bovis AF2122/97
gccugugccgccggcg

SEQ ID NO: 3082771 - RNA, 14 nt, Mycobacterium bovis subsp bovis AF2122/97
gccugugcgcggug

SEQ ID NO: 3082772 - RNA, 20 nt, Mycobacterium bovis subsp bovis AF2122/97
gccugugcgcggugacgagc

SEQ ID NO: 3082773 - RNA, 21 nt, Mycobacterium bovis subsp bovis AF2122/97
gccuguucaacuccggcaccg

SEQ ID NO: 3082774 - RNA, 15 nt, Mycobacterium bovis subsp bovis AF2122/97
gccuguucgccgucg

SEQ ID NO: 3082775 - RNA, 21 nt, Mycobacterium bovis subsp bovis AF2122/97
gccuguucggcggcugccagc

SEQ ID NO: 3082776 - RNA, 15 nt, Mycobacterium bovis subsp bovis AF2122/97
gccuguugcgaccau

SEQ ID NO: 3082777 - RNA, 21 nt, Mycobacterium bovis subsp bovis AF2122/97
gccuuaaccgagccgaccggc

SEQ ID NO: 3082778 - RNA, 21 nt, Mycobacterium bovis subsp bovis AF2122/97
gccuuacacgccuggcuacgc

SEQ ID NO: 3082779 - RNA, 16 nt, Mycobacterium bovis subsp bovis AF2122/97
gccuuaccccgcagcu

SEQ ID NO: 3082780 - RNA, 21 nt, Mycobacterium bovis subsp bovis AF2122/97
gccuuacgcgggugaccaaca

SEQ ID NO: 3082781 - RNA, 20 nt, Mycobacterium bovis subsp bovis AF2122/97
gccuuaggugaccaggguga

SEQ ID NO: 3082782 - RNA, 14 nt, Mycobacterium bovis subsp bovis AF2122/97
gccuuauuggacgu

SEQ ID NO: 3082783 - RNA, 20 nt, Mycobacterium bovis subsp bovis AF2122/97
gccuucaaggaagccgcggc

SEQ ID NO: 3082784 - RNA, 14 nt, Mycobacterium bovis subsp bovis AF2122/97
gccuucacgcuggc

SEQ ID NO: 3082785 - RNA, 18 nt, Mycobacterium bovis subsp bovis AF2122/97
gccuucagcggucgcagc

SEQ ID NO: 3082786 - RNA, 16 nt, Mycobacterium bovis subsp bovis AF2122/97
gccuuccaggcgggcg

SEQ ID NO: 3082787 - RNA, 21 nt, Mycobacterium bovis subsp bovis AF2122/97
gccuuccaggcgggcggcacc

SEQ ID NO: 3082788 - RNA, 16 nt, Mycobacterium bovis subsp bovis AF2122/97
gccuuccuggcgggcg

SEQ ID NO: 3082789 - RNA, 17 nt, Mycobacterium bovis subsp bovis AF2122/97
gccuuccuggcgggcgc

SEQ ID NO: 3082790 - RNA, 20 nt, Mycobacterium bovis subsp bovis AF2122/97
gccuuccuggcgggcgccuu

SEQ ID NO: 3082791 - RNA, 15 nt, Mycobacterium bovis subsp bovis AF2122/97
gccuucgaucaucga

SEQ ID NO: 3082792 - RNA, 15 nt, Mycobacterium bovis subsp bovis AF2122/97
gccuucgccagcggc

SEQ ID NO: 3082793 - RNA, 16 nt, Mycobacterium bovis subsp bovis AF2122/97
gccuucgccagcggcg

SEQ ID NO: 3082794 - RNA, 15 nt, Mycobacterium bovis subsp bovis AF2122/97
gccuucggccggcgu

SEQ ID NO: 3082795 - RNA, 22 nt, Mycobacterium bovis subsp bovis AF2122/97
gccuucggcuaggucagcgggc

SEQ ID NO: 3082796 - RNA, 17 nt, Mycobacterium bovis subsp bovis AF2122/97
gccuucggugucgccga

SEQ ID NO: 3082797 - RNA, 16 nt, Mycobacterium bovis subsp bovis AF2122/97
gccuucguaaccacga

SEQ ID NO: 3082798 - RNA, 17 nt, Mycobacterium bovis subsp bovis AF2122/97
gccuucguagaaggacc

SEQ ID NO: 3082799 - RNA, 17 nt, Mycobacterium bovis subsp bovis AF2122/97
gccuucguagcggccgc

SEQ ID NO: 3082800 - RNA, 18 nt, Mycobacterium bovis subsp bovis AF2122/97
gccuucguagcggccgca

SEQ ID NO: 3082801 - RNA, 20 nt, Mycobacterium bovis subsp bovis AF2122/97
gccuucguagcggccgcagg

SEQ ID NO: 3082802 - RNA, 20 nt, Mycobacterium bovis subsp bovis AF2122/97
gccuucuccaucgucggcaa

SEQ ID NO: 3082803 - RNA, 21 nt, Mycobacterium bovis subsp bovis AF2122/97
gccuucuccaucgucggcaac

SEQ ID NO: 3082804 - RNA, 18 nt, Mycobacterium bovis subsp bovis AF2122/97
gccuucucccgcacggcc

SEQ ID NO: 3082805 - RNA, 19 nt, Mycobacterium bovis subsp bovis AF2122/97
gccuucuucgcuaccuucu

SEQ ID NO: 3082806 - RNA, 21 nt, Mycobacterium bovis subsp bovis AF2122/97
gccuucuucgcuaccuucuug

SEQ ID NO: 3082807 - RNA, 22 nt, Mycobacterium bovis subsp bovis AF2122/97
gccuucuuggcaggugccuucu

SEQ ID NO: 3082808 - RNA, 16 nt, Mycobacterium bovis subsp bovis AF2122/97
gccuucuuggcgggag

SEQ ID NO: 3082809 - RNA, 14 nt, Mycobacterium bovis subsp bovis AF2122/97
gccuugaccagcag

SEQ ID NO: 3082810 - RNA, 15 nt, Mycobacterium bovis subsp bovis AF2122/97
gccuugaccagcagc

SEQ ID NO: 3082811 - RNA, 13 nt, Mycobacterium bovis subsp bovis AF2122/97
gccuugagccgcc

SEQ ID NO: 3082812 - RNA, 14 nt, Mycobacterium bovis subsp bovis AF2122/97
gccuugaucaccgu

SEQ ID NO: 3082813 - RNA, 16 nt, Mycobacterium bovis subsp bovis AF2122/97
gccuugaucggcgagg

SEQ ID NO: 3082814 - RNA, 19 nt, Mycobacterium bovis subsp bovis AF2122/97
gccuugaucugagcgcggg

SEQ ID NO: 3082815 - RNA, 21 nt, Mycobacterium bovis subsp bovis AF2122/97
gccuugauggucuccaccagg

SEQ ID NO: 3082816 - RNA, 18 nt, Mycobacterium bovis subsp bovis AF2122/97
gccuugcagcgcccccgc

SEQ ID NO: 3082817 - RNA, 19 nt, Mycobacterium bovis subsp bovis AF2122/97
gccuugcagcgcguucggc

SEQ ID NO: 3082818 - RNA, 22 nt, Mycobacterium bovis subsp bovis AF2122/97
gccuugcagcgcguucggcacc

SEQ ID NO: 3082819 - RNA, 12 nt, Mycobacterium bovis subsp bovis AF2122/97
gccuugccaccg

SEQ ID NO: 3082820 - RNA, 15 nt, Mycobacterium bovis subsp bovis AF2122/97
gccuugccaccggua

SEQ ID NO: 3082821 - RNA, 21 nt, Mycobacterium bovis subsp bovis AF2122/97
gccuugccaccgguaccgccg

SEQ ID NO: 3082822 - RNA, 13 nt, Mycobacterium bovis subsp bovis AF2122/97
gccuugccgccgg

SEQ ID NO: 3082823 - RNA, 14 nt, Mycobacterium bovis subsp bovis AF2122/97
gccuugccgccggc

SEQ ID NO: 3082824 - RNA, 17 nt, Mycobacterium bovis subsp bovis AF2122/97
gccuugccgccggcccc

SEQ ID NO: 3082825 - RNA, 23 nt, Mycobacterium bovis subsp bovis AF2122/97
gccuugccgccggccccgccagc

SEQ ID NO: 3082826 - RNA, 15 nt, Mycobacterium bovis subsp bovis AF2122/97
gccuugccgccggcg

SEQ ID NO: 3082827 - RNA, 18 nt, Mycobacterium bovis subsp bovis AF2122/97
gcgaacaucaccgucgcc

SEQ ID NO: 3082828 - RNA, 22 nt, Mycobacterium bovis subsp bovis AF2122/97
gcgaacaucaccgucgcccggg

SEQ ID NO: 3082829 - RNA, 21 nt, Mycobacterium bovis subsp bovis AF2122/97
gcgaacaucgccagcgccggc

SEQ ID NO: 3082830 - RNA, 14 nt, Mycobacterium bovis subsp bovis AF2122/97
gcgaaccaccggcg

SEQ ID NO: 3082831 - RNA, 17 nt, Mycobacterium bovis subsp bovis AF2122/97
gcgaaccaccggcgccg

SEQ ID NO: 3082832 - RNA, 20 nt, Mycobacterium bovis subsp bovis AF2122/97
gcgaaccaccggcgccgccg

SEQ ID NO: 3082833 - RNA, 23 nt, Mycobacterium bovis subsp bovis AF2122/97
gcgaaccaccggcgccgccggca

SEQ ID NO: 3082834 - RNA, 15 nt, Mycobacterium bovis subsp bovis AF2122/97
gcgaaccacggcagc

SEQ ID NO: 3082835 - RNA, 17 nt, Mycobacterium bovis subsp bovis AF2122/97
gcgaaccacggcagcca

SEQ ID NO: 3082836 - RNA, 19 nt, Mycobacterium bovis subsp bovis AF2122/97
gcgaaccagaguucggcca

SEQ ID NO: 3082837 - RNA, 15 nt, Mycobacterium bovis subsp bovis AF2122/97
gcgaacccccgccgc

SEQ ID NO: 3082838 - RNA, 18 nt, Mycobacterium bovis subsp bovis AF2122/97
gcgaacccgagccgccgu

SEQ ID NO: 3082839 - RNA, 12 nt, Mycobacterium bovis subsp bovis AF2122/97
gcgaacccgcag

SEQ ID NO: 3082840 - RNA, 13 nt, Mycobacterium bovis subsp bovis AF2122/97
gcgaacccgccga

SEQ ID NO: 3082841 - RNA, 16 nt, Mycobacterium bovis subsp bovis AF2122/97
gcgaacccuccgcagc

SEQ ID NO: 3082842 - RNA, 16 nt, Mycobacterium bovis subsp bovis AF2122/97
gcgaacccugcgcacu

SEQ ID NO: 3082843 - RNA, 18 nt, Mycobacterium bovis subsp bovis AF2122/97
gcgaaccgaagccgucga

SEQ ID NO: 3082844 - RNA, 13 nt, Mycobacterium bovis subsp bovis AF2122/97
gcgaaccgccggc

SEQ ID NO: 3082845 - RNA, 15 nt, Mycobacterium bovis subsp bovis AF2122/97
gcgaaccgccggcac

SEQ ID NO: 3082846 - RNA, 18 nt, Mycobacterium bovis subsp bovis AF2122/97
gcgaaccgccggcaccgc

SEQ ID NO: 3082847 - RNA, 15 nt, Mycobacterium bovis subsp bovis AF2122/97
gcgaaccgcuccaca

SEQ ID NO: 3082848 - RNA, 13 nt, Mycobacterium bovis subsp bovis AF2122/97
gcgaaccggccgu

SEQ ID NO: 3082849 - RNA, 19 nt, Mycobacterium bovis subsp bovis AF2122/97
gcgaaccggccgucgacgc

SEQ ID NO: 3082850 - RNA, 19 nt, Mycobacterium bovis subsp bovis AF2122/97
gcgaaccggcugggcgcca

SEQ ID NO: 3082851 - RNA, 19 nt, Mycobacterium bovis subsp bovis AF2122/97
gcgaaccgucagcgcgccg

SEQ ID NO: 3082852 - RNA, 18 nt, Mycobacterium bovis subsp bovis AF2122/97
gcgaaccgucucggcgac

SEQ ID NO: 3082853 - RNA, 20 nt, Mycobacterium bovis subsp bovis AF2122/97
gcgaaccgucucggcgaccg

SEQ ID NO: 3082854 - RNA, 22 nt, Mycobacterium bovis subsp bovis AF2122/97
gcgaaccgucucggcgaccgac

SEQ ID NO: 3082855 - RNA, 22 nt, Mycobacterium bovis subsp bovis AF2122/97
gcgaacgauuucggcccacucc

SEQ ID NO: 3082856 - RNA, 12 nt, Mycobacterium bovis subsp bovis AF2122/97
gcgaacgccagu

SEQ ID NO: 3082857 - RNA, 12 nt, Mycobacterium bovis subsp bovis AF2122/97
gcgaacgccgug

SEQ ID NO: 3082858 - RNA, 20 nt, Mycobacterium bovis subsp bovis AF2122/97
gcgaacgccugcugguaccg

SEQ ID NO: 3082859 - RNA, 20 nt, Mycobacterium bovis subsp bovis AF2122/97
gcgaacgcgaaugucgcgcu

SEQ ID NO: 3082860 - RNA, 22 nt, Mycobacterium bovis subsp bovis AF2122/97
gcgaacgcgacagccaccucga

SEQ ID NO: 3082861 - RNA, 16 nt, Mycobacterium bovis subsp bovis AF2122/97
gcgaacgcguccagcg

SEQ ID NO: 3082862 - RNA, 21 nt, Mycobacterium bovis subsp bovis AF2122/97
gcgaacgcguccagcgcggcc

SEQ ID NO: 3082863 - RNA, 22 nt, Mycobacterium bovis subsp bovis AF2122/97
gcgaacgcuucaccucgucgac

SEQ ID NO: 3082864 - RNA, 21 nt, Mycobacterium bovis subsp bovis AF2122/97
gcgaacggauucccgcccagc

SEQ ID NO: 3082865 - RNA, 23 nt, Mycobacterium bovis subsp bovis AF2122/97
gcgaacggauucccgcccagcag

SEQ ID NO: 3082866 - RNA, 14 nt, Mycobacterium bovis subsp bovis AF2122/97
gcgaacggcaccgc

SEQ ID NO: 3082867 - RNA, 13 nt, Mycobacterium bovis subsp bovis AF2122/97
gcgaacggccagg

SEQ ID NO: 3082868 - RNA, 16 nt, Mycobacterium bovis subsp bovis AF2122/97
gcgaacggcgcaguug

SEQ ID NO: 3082869 - RNA, 14 nt, Mycobacterium bovis subsp bovis AF2122/97
gcgaacgucaaccg

SEQ ID NO: 3082870 - RNA, 18 nt, Mycobacterium bovis subsp bovis AF2122/97
gcgaacgucaaccgggcg

SEQ ID NO: 3082871 - RNA, 15 nt, Mycobacterium bovis subsp bovis AF2122/97
gcgaacuccagcagc

SEQ ID NO: 3082872 - RNA, 18 nt, Mycobacterium bovis subsp bovis AF2122/97
gcgaacucgaggucgagc

SEQ ID NO: 3082873 - RNA, 14 nt, Mycobacterium bovis subsp bovis AF2122/97
gcgaacucgcgcag

SEQ ID NO: 3082874 - RNA, 18 nt, Mycobacterium bovis subsp bovis AF2122/97
gcgaacucgcgccgagcc

SEQ ID NO: 3082875 - RNA, 21 nt, Mycobacterium bovis subsp bovis AF2122/97
gcgaacucgcgccgagccagc

SEQ ID NO: 3082876 - RNA, 22 nt, Mycobacterium bovis subsp bovis AF2122/97
gcgaacugaucguuggcaucgg

SEQ ID NO: 3082877 - RNA, 19 nt, Mycobacterium bovis subsp bovis AF2122/97
gcgaagaacgacgccaccg

SEQ ID NO: 3082878 - RNA, 23 nt, Mycobacterium bovis subsp bovis AF2122/97
gcgaagaacgacgccaccgcgac

SEQ ID NO: 3082879 - RNA, 13 nt, Mycobacterium bovis subsp bovis AF2122/97
gcgaagaccagcg

SEQ ID NO: 3082880 - RNA, 13 nt, Mycobacterium bovis subsp bovis AF2122/97
gcgaagcaacgga

SEQ ID NO: 3082881 - RNA, 13 nt, Mycobacterium bovis subsp bovis AF2122/97
gcgaagcaaguga

SEQ ID NO: 3082882 - RNA, 14 nt, Mycobacterium bovis subsp bovis AF2122/97
gcgaagcacaccgu

SEQ ID NO: 3082883 - RNA, 18 nt, Mycobacterium bovis subsp bovis AF2122/97
gcgaagcacaccguccgu

SEQ ID NO: 3082884 - RNA, 14 nt, Mycobacterium bovis subsp bovis AF2122/97
gcgaagccaccagg

SEQ ID NO: 3082885 - RNA, 16 nt, Mycobacterium bovis subsp bovis AF2122/97
gcgaagccaccagguc

SEQ ID NO: 3082886 - RNA, 22 nt, Mycobacterium bovis subsp bovis AF2122/97
gcgaagcccgacaugaggcugc

SEQ ID NO: 3082887 - RNA, 17 nt, Mycobacterium bovis subsp bovis AF2122/97
gcgaagccgagcaucag

SEQ ID NO: 3082888 - RNA, 14 nt, Mycobacterium bovis subsp bovis AF2122/97
gcgaagccggccgg

SEQ ID NO: 3082889 - RNA, 18 nt, Mycobacterium bovis subsp bovis AF2122/97
gcgaagccgggucucggu

SEQ ID NO: 3082890 - RNA, 17 nt, Mycobacterium bovis subsp bovis AF2122/97
gcgaagccgggugcugg

SEQ ID NO: 3082891 - RNA, 18 nt, Mycobacterium bovis subsp bovis AF2122/97
gcgaagccgguucgccca

SEQ ID NO: 3082892 - RNA, 14 nt, Mycobacterium bovis subsp bovis AF2122/97
gcgaagcgcucggc

SEQ ID NO: 3082893 - RNA, 20 nt, Mycobacterium bovis subsp bovis AF2122/97
gcgaagcgcucggcagccgg

SEQ ID NO: 3082894 - RNA, 18 nt, Mycobacterium bovis subsp bovis AF2122/97
gcgaagcggaccgagccg

SEQ ID NO: 3082895 - RNA, 16 nt, Mycobacterium bovis subsp bovis AF2122/97
gcgaagcgugcgccga

SEQ ID NO: 3082896 - RNA, 17 nt, Mycobacterium bovis subsp bovis AF2122/97
gcgaagcuagcgcccgc

SEQ ID NO: 3082897 - RNA, 23 nt, Mycobacterium bovis subsp bovis AF2122/97
gcgaagcuagcgcccgcgagaga

SEQ ID NO: 3082898 - RNA, 17 nt, Mycobacterium bovis subsp bovis AF2122/97
gcgaagcugaccagaca

SEQ ID NO: 3082899 - RNA, 18 nt, Mycobacterium bovis subsp bovis AF2122/97
gcgaagcugugcccggcg

SEQ ID NO: 3082900 - RNA, 21 nt, Mycobacterium bovis subsp bovis AF2122/97
gcgaagcugugcccggcgccc

SEQ ID NO: 3082901 - RNA, 15 nt, Mycobacterium bovis subsp bovis AF2122/97
gcgaaggaccagagc

SEQ ID NO: 3082902 - RNA, 13 nt, Mycobacterium bovis subsp bovis AF2122/97
gcgaaggccagca

SEQ ID NO: 3082903 - RNA, 15 nt, Mycobacterium bovis subsp bovis AF2122/97
gcgaaggccagcaga

SEQ ID NO: 3082904 - RNA, 13 nt, Mycobacterium bovis subsp bovis AF2122/97
gcgaaggccgcgc

SEQ ID NO: 3082905 - RNA, 12 nt, Mycobacterium bovis subsp bovis AF2122/97
gcgaaggcgccg

SEQ ID NO: 3082906 - RNA, 12 nt, Mycobacterium bovis subsp bovis AF2122/97
gcgaaggcggcu

SEQ ID NO: 3082907 - RNA, 15 nt, Mycobacterium bovis subsp bovis AF2122/97
gcgaagggcaccggc

SEQ ID NO: 3082908 - RNA, 16 nt, Mycobacterium bovis subsp bovis AF2122/97
gcgaagggcaccggcg

SEQ ID NO: 3082909 - RNA, 17 nt, Mycobacterium bovis subsp bovis AF2122/97
gcgaagggcaccggcga

SEQ ID NO: 3082910 - RNA, 19 nt, Mycobacterium bovis subsp bovis AF2122/97
gcgaagggcaccggcgauc

SEQ ID NO: 3082911 - RNA, 21 nt, Mycobacterium bovis subsp bovis AF2122/97
gcgaagggcaccggcgaucgu

SEQ ID NO: 3082912 - RNA, 14 nt, Mycobacterium bovis subsp bovis AF2122/97
gcgaaggggugccc

SEQ ID NO: 3082913 - RNA, 23 nt, Mycobacterium bovis subsp bovis AF2122/97
gcgaaggguaagaguucgcgcgc

SEQ ID NO: 3082914 - RNA, 14 nt, Mycobacterium bovis subsp bovis AF2122/97
gcgacagcggcgac

SEQ ID NO: 3082915 - RNA, 21 nt, Mycobacterium bovis subsp bovis AF2122/97
gcgacagcggcgacaugaucu

SEQ ID NO: 3082916 - RNA, 22 nt, Mycobacterium bovis subsp bovis AF2122/97
gcgacagcgugccgaacaggga

SEQ ID NO: 3082917 - RNA, 16 nt, Mycobacterium bovis subsp bovis AF2122/97
gcgacaggacgucggc

SEQ ID NO: 3082918 - RNA, 23 nt, Mycobacterium bovis subsp bovis AF2122/97
gcgacaggagacgguacgccagu

SEQ ID NO: 3082919 - RNA, 14 nt, Mycobacterium bovis subsp bovis AF2122/97
gcgacaggccgagc

SEQ ID NO: 3082920 - RNA, 14 nt, Mycobacterium bovis subsp bovis AF2122/97
gcgacauacccgau

SEQ ID NO: 3082921 - RNA, 21 nt, Mycobacterium bovis subsp bovis AF2122/97
gcgacaucaccaccgaccugg

SEQ ID NO: 3082922 - RNA, 22 nt, Mycobacterium bovis subsp bovis AF2122/97
gcgacaucaccaccgaccugga

SEQ ID NO: 3082923 - RNA, 17 nt, Mycobacterium bovis subsp bovis AF2122/97
gcgacauccacaccgcg

SEQ ID NO: 3082924 - RNA, 22 nt, Mycobacterium bovis subsp bovis AF2122/97
gcgacauccacaccgcggcggc

SEQ ID NO: 3082925 - RNA, 17 nt, Mycobacterium bovis subsp bovis AF2122/97
gcgacauccgcggcaug

SEQ ID NO: 3082926 - RNA, 16 nt, Mycobacterium bovis subsp bovis AF2122/97
gcgacaucgagaucgc

SEQ ID NO: 3082927 - RNA, 14 nt, Mycobacterium bovis subsp bovis AF2122/97
gcgacaucggcccg

SEQ ID NO: 3082928 - RNA, 22 nt, Mycobacterium bovis subsp bovis AF2122/97
gcgacaucggcccgaucaccau

SEQ ID NO: 3082929 - RNA, 15 nt, Mycobacterium bovis subsp bovis AF2122/97
gcgacaucgggaaug

SEQ ID NO: 3082930 - RNA, 14 nt, Mycobacterium bovis subsp bovis AF2122/97
gcgacaucgguggc

SEQ ID NO: 3082931 - RNA, 18 nt, Mycobacterium bovis subsp bovis AF2122/97
gcgacaugaucugccacc

SEQ ID NO: 3082932 - RNA, 23 nt, Mycobacterium bovis subsp bovis AF2122/97
gcgacaugucgaacgccccccac

SEQ ID NO: 3082933 - RNA, 16 nt, Mycobacterium bovis subsp bovis AF2122/97
gcgaccaacacgucga

SEQ ID NO: 3082934 - RNA, 21 nt, Mycobacterium bovis subsp bovis AF2122/97
gcgaccaacacgucgagcagc

SEQ ID NO: 3082935 - RNA, 22 nt, Mycobacterium bovis subsp bovis AF2122/97
gcgaccaacacgucgagcagcc

SEQ ID NO: 3082936 - RNA, 16 nt, Mycobacterium bovis subsp bovis AF2122/97
gcgaccaagagacguu

SEQ ID NO: 3082937 - RNA, 22 nt, Mycobacterium bovis subsp bovis AF2122/97
gcgaccacaucaugccagccgu

SEQ ID NO: 3082938 - RNA, 15 nt, Mycobacterium bovis subsp bovis AF2122/97
gcgaccaccaccgcc

SEQ ID NO: 3082939 - RNA, 12 nt, Mycobacterium bovis subsp bovis AF2122/97
gcgaccaccagc

SEQ ID NO: 3082940 - RNA, 13 nt, Mycobacterium bovis subsp bovis AF2122/97
gcgaccaccagcg

SEQ ID NO: 3082941 - RNA, 15 nt, Mycobacterium bovis subsp bovis AF2122/97
gcgaccaccagcgcc

SEQ ID NO: 3082942 - RNA, 15 nt, Mycobacterium bovis subsp bovis AF2122/97
gcgaccacccccggc

SEQ ID NO: 3082943 - RNA, 19 nt, Mycobacterium bovis subsp bovis AF2122/97
gcgaccacccccggcaggc

SEQ ID NO: 3082944 - RNA, 14 nt, Mycobacterium bovis subsp bovis AF2122/97
gcgaccacccgccg

SEQ ID NO: 3082945 - RNA, 14 nt, Mycobacterium bovis subsp bovis AF2122/97
gcgaccaccgccga

SEQ ID NO: 3082946 - RNA, 19 nt, Mycobacterium bovis subsp bovis AF2122/97
gcgaccaccgcggcugcuc

SEQ ID NO: 3082947 - RNA, 19 nt, Mycobacterium bovis subsp bovis AF2122/97
gcgaccaccgcgucgggcc

SEQ ID NO: 3082948 - RNA, 20 nt, Mycobacterium bovis subsp bovis AF2122/97
gcgaccaccguuugagcggc

SEQ ID NO: 3082949 - RNA, 13 nt, Mycobacterium bovis subsp bovis AF2122/97
gcgaccacgcacc

SEQ ID NO: 3082950 - RNA, 19 nt, Mycobacterium bovis subsp bovis AF2122/97
gcgaccacgcaccgccccg

SEQ ID NO: 3082951 - RNA, 16 nt, Mycobacterium bovis subsp bovis AF2122/97
gcgaccacgccgccgg

SEQ ID NO: 3082952 - RNA, 18 nt, Mycobacterium bovis subsp bovis AF2122/97
gcgaccacgccgccggcg

SEQ ID NO: 3082953 - RNA, 19 nt, Mycobacterium bovis subsp bovis AF2122/97
gcgaccacgccgccggcgc

SEQ ID NO: 3082954 - RNA, 20 nt, Mycobacterium bovis subsp bovis AF2122/97
gcgaccacgccgccggcgcu

SEQ ID NO: 3082955 - RNA, 22 nt, Mycobacterium bovis subsp bovis AF2122/97
gcgaccacggcaccgaucaacg

SEQ ID NO: 3082956 - RNA, 16 nt, Mycobacterium bovis subsp bovis AF2122/97
gcgaccacgucggcga

SEQ ID NO: 3082957 - RNA, 21 nt, Mycobacterium bovis subsp bovis AF2122/97
gcgaccagauagaacaacguc

SEQ ID NO: 3082958 - RNA, 15 nt, Mycobacterium bovis subsp bovis AF2122/97
gcgaccagccgagcg

SEQ ID NO: 3082959 - RNA, 13 nt, Mycobacterium bovis subsp bovis AF2122/97
gcgaccagcgccg

SEQ ID NO: 3082960 - RNA, 14 nt, Mycobacterium bovis subsp bovis AF2122/97
gcgaccagcucagc

SEQ ID NO: 3082961 - RNA, 21 nt, Mycobacterium bovis subsp bovis AF2122/97
gcgaccagcucagcugcggau

SEQ ID NO: 3082962 - RNA, 22 nt, Mycobacterium bovis subsp bovis AF2122/97
gcgaccagcucagcugcggauu

SEQ ID NO: 3082963 - RNA, 15 nt, Mycobacterium bovis subsp bovis AF2122/97
gcgaccaggcgcggc

SEQ ID NO: 3082964 - RNA, 17 nt, Mycobacterium bovis subsp bovis AF2122/97
gcgaccaggcgcggcga

SEQ ID NO: 3082965 - RNA, 18 nt, Mycobacterium bovis subsp bovis AF2122/97
gcgaccaggcgcggcgac

SEQ ID NO: 3082966 - RNA, 15 nt, Mycobacterium bovis subsp bovis AF2122/97
gcgaccaggucgcca

SEQ ID NO: 3082967 - RNA, 16 nt, Mycobacterium bovis subsp bovis AF2122/97
gcgaccaggucgccag

SEQ ID NO: 3082968 - RNA, 22 nt, Mycobacterium bovis subsp bovis AF2122/97
gcgaccaggucgccagcucggc

SEQ ID NO: 3082969 - RNA, 14 nt, Mycobacterium bovis subsp bovis AF2122/97
gcgaccaguggugg

SEQ ID NO: 3082970 - RNA, 18 nt, Mycobacterium bovis subsp bovis AF2122/97
gcgaccauccgaguuguc

SEQ ID NO: 3082971 - RNA, 17 nt, Mycobacterium bovis subsp bovis AF2122/97
gcgaccaucgcgacggc

SEQ ID NO: 3082972 - RNA, 18 nt, Mycobacterium bovis subsp bovis AF2122/97
gcgaccaucgcgacggca

SEQ ID NO: 3082973 - RNA, 15 nt, Mycobacterium bovis subsp bovis AF2122/97
gcgaccaucucgacg

SEQ ID NO: 3082974 - RNA, 22 nt, Mycobacterium bovis subsp bovis AF2122/97
gcgaccaucucgacgucgguga

SEQ ID NO: 3082975 - RNA, 21 nt, Mycobacterium bovis subsp bovis AF2122/97
gcgaccaucugaucgggcccg

SEQ ID NO: 3082976 - RNA, 13 nt, Mycobacterium bovis subsp bovis AF2122/97
gcgaccaugcucc

SEQ ID NO: 3082977 - RNA, 19 nt, Mycobacterium bovis subsp bovis AF2122/97
gcgaccauggugguaucca

SEQ ID NO: 3082978 - RNA, 15 nt, Mycobacterium bovis subsp bovis AF2122/97
gcgaccccaggcgcu

SEQ ID NO: 3082979 - RNA, 23 nt, Mycobacterium bovis subsp bovis AF2122/97
gcgacccccagcgcccgccggca

SEQ ID NO: 3082980 - RNA, 15 nt, Mycobacterium bovis subsp bovis AF2122/97
gcgaccccgccgagc

SEQ ID NO: 3082981 - RNA, 23 nt, Mycobacterium bovis subsp bovis AF2122/97
gcgaccccgccgagcgguugccu

SEQ ID NO: 3082982 - RNA, 13 nt, Mycobacterium bovis subsp bovis AF2122/97
gcgaccccggccc

SEQ ID NO: 3082983 - RNA, 16 nt, Mycobacterium bovis subsp bovis AF2122/97
gcgaccccggccccga

SEQ ID NO: 3082984 - RNA, 15 nt, Mycobacterium bovis subsp bovis AF2122/97
gcgaccccggcugcg

SEQ ID NO: 3082985 - RNA, 20 nt, Mycobacterium bovis subsp bovis AF2122/97
gcgaccccugguagcaccca

SEQ ID NO: 3082986 - RNA, 17 nt, Mycobacterium bovis subsp bovis AF2122/97
gcgacccgaucgcgcca

SEQ ID NO: 3082987 - RNA, 21 nt, Mycobacterium bovis subsp bovis AF2122/97
gcgacccgcagaccgccaccg

SEQ ID NO: 3082988 - RNA, 15 nt, Mycobacterium bovis subsp bovis AF2122/97
gcgacccggccagcg

SEQ ID NO: 3082989 - RNA, 17 nt, Mycobacterium bovis subsp bovis AF2122/97
gcgacccggccagcggc

SEQ ID NO: 3082990 - RNA, 15 nt, Mycobacterium bovis subsp bovis AF2122/97
gcgacccggcccagc

SEQ ID NO: 3082991 - RNA, 20 nt, Mycobacterium bovis subsp bovis AF2122/97
gcgacccggcccagcgcccc

SEQ ID NO: 3082992 - RNA, 16 nt, Mycobacterium bovis subsp bovis AF2122/97
gcgacccgggccgcgg

SEQ ID NO: 3082993 - RNA, 17 nt, Mycobacterium bovis subsp bovis AF2122/97
gcgacccgggccgcggc

SEQ ID NO: 3082994 - RNA, 19 nt, Mycobacterium bovis subsp bovis AF2122/97
gcgacccgggccgcggcgg

SEQ ID NO: 3082995 - RNA, 13 nt, Mycobacterium bovis subsp bovis AF2122/97
gcgacccgggcgu

SEQ ID NO: 3082996 - RNA, 16 nt, Mycobacterium bovis subsp bovis AF2122/97
gcgacccgggcguccc

SEQ ID NO: 3082997 - RNA, 21 nt, Mycobacterium bovis subsp bovis AF2122/97
gcgacccggguagacaccgcg

SEQ ID NO: 3082998 - RNA, 22 nt, Mycobacterium bovis subsp bovis AF2122/97
gcgacccggucacucuggcgag

SEQ ID NO: 3082999 - RNA, 16 nt, Mycobacterium bovis subsp bovis AF2122/97
gcgacccgguccacgc

SEQ ID NO: 3083000 - RNA, 23 nt, Mycobacterium bovis subsp bovis AF2122/97
gcgacgaucucgccgccagcgcu

SEQ ID NO: 3083001 - RNA, 19 nt, Mycobacterium bovis subsp bovis AF2122/97
gcgacgaucucggcggccg

SEQ ID NO: 3083002 - RNA, 21 nt, Mycobacterium bovis subsp bovis AF2122/97
gcgacgaugaucucgcccacc

SEQ ID NO: 3083003 - RNA, 14 nt, Mycobacterium bovis subsp bovis AF2122/97
gcgacgaugcaggu

SEQ ID NO: 3083004 - RNA, 22 nt, Mycobacterium bovis subsp bovis AF2122/97
gcgacgaugccgggucgcggga

SEQ ID NO: 3083005 - RNA, 19 nt, Mycobacterium bovis subsp bovis AF2122/97
gcgacgaugucgagcgcga

SEQ ID NO: 3083006 - RNA, 22 nt, Mycobacterium bovis subsp bovis AF2122/97
gcgacgaugucgagcgcgaucg

SEQ ID NO: 3083007 - RNA, 23 nt, Mycobacterium bovis subsp bovis AF2122/97
gcgacgaugugguccaucgcgcu

SEQ ID NO: 3083008 - RNA, 12 nt, Mycobacterium bovis subsp bovis AF2122/97
gcgacgcagacc

SEQ ID NO: 3083009 - RNA, 14 nt, Mycobacterium bovis subsp bovis AF2122/97
gcgacgcagaccgu

SEQ ID NO: 3083010 - RNA, 20 nt, Mycobacterium bovis subsp bovis AF2122/97
gcgacgcagaccguccagca

SEQ ID NO: 3083011 - RNA, 15 nt, Mycobacterium bovis subsp bovis AF2122/97
gcgacgcauaaccgg

SEQ ID NO: 3083012 - RNA, 20 nt, Mycobacterium bovis subsp bovis AF2122/97
gcgacgcauaaccggcgcgc

SEQ ID NO: 3083013 - RNA, 16 nt, Mycobacterium bovis subsp bovis AF2122/97
gcgacgccgaaaaugc

SEQ ID NO: 3083014 - RNA, 17 nt, Mycobacterium bovis subsp bovis AF2122/97
gcgacgccgaaaaugcc

SEQ ID NO: 3083015 - RNA, 12 nt, Mycobacterium bovis subsp bovis AF2122/97
gcgacgccgcgg

SEQ ID NO: 3083016 - RNA, 24 nt, Mycobacterium bovis subsp bovis AF2122/97
gcgacgccgcgguuuucgccggau

SEQ ID NO: 3083017 - RNA, 23 nt, Mycobacterium bovis subsp bovis AF2122/97
gcgacgccgcucccgcacaagcc

SEQ ID NO: 3083018 - RNA, 13 nt, Mycobacterium bovis subsp bovis AF2122/97
gcgacgccggauu

SEQ ID NO: 3083019 - RNA, 17 nt, Mycobacterium bovis subsp bovis AF2122/97
gcgacgccggccuuggc

SEQ ID NO: 3083020 - RNA, 19 nt, Mycobacterium bovis subsp bovis AF2122/97
gcgacgccggccuuggcga

SEQ ID NO: 3083021 - RNA, 22 nt, Mycobacterium bovis subsp bovis AF2122/97
gcgacgccggccuuggcgaucu

SEQ ID NO: 3083022 - RNA, 12 nt, Mycobacterium bovis subsp bovis AF2122/97
gcgacgccgucu

SEQ ID NO: 3083023 - RNA, 22 nt, Mycobacterium bovis subsp bovis AF2122/97
gcgacgcgacacacgccgccgg

SEQ ID NO: 3083024 - RNA, 23 nt, Mycobacterium bovis subsp bovis AF2122/97
gcgacgcgacacacgccgccggu

SEQ ID NO: 3083025 - RNA, 16 nt, Mycobacterium bovis subsp bovis AF2122/97
gcgacgcgaccgcgau

SEQ ID NO: 3083026 - RNA, 12 nt, Mycobacterium bovis subsp bovis AF2122/97
gcgacgcgacgg

SEQ ID NO: 3083027 - RNA, 20 nt, Mycobacterium bovis subsp bovis AF2122/97
gcgacgcgcgagaacacccg

SEQ ID NO: 3083028 - RNA, 13 nt, Mycobacterium bovis subsp bovis AF2122/97
gcgacgcggccag

SEQ ID NO: 3083029 - RNA, 14 nt, Mycobacterium bovis subsp bovis AF2122/97
gcgacgcggccagc

SEQ ID NO: 3083030 - RNA, 15 nt, Mycobacterium bovis subsp bovis AF2122/97
gcgacgcggccagcg

SEQ ID NO: 3083031 - RNA, 14 nt, Mycobacterium bovis subsp bovis AF2122/97
gcgacgcggcgccg

SEQ ID NO: 3083032 - RNA, 20 nt, Mycobacterium bovis subsp bovis AF2122/97
gcgacgcuaggacggcugcc

SEQ ID NO: 3083033 - RNA, 15 nt, Mycobacterium bovis subsp bovis AF2122/97
gcgacgcucgcugca

SEQ ID NO: 3083034 - RNA, 18 nt, Mycobacterium bovis subsp bovis AF2122/97
gcgacgcucgcugcagca

SEQ ID NO: 3083035 - RNA, 21 nt, Mycobacterium bovis subsp bovis AF2122/97
gcgacgcucgcugcagcaggg

SEQ ID NO: 3083036 - RNA, 23 nt, Mycobacterium bovis subsp bovis AF2122/97
gcgacggaaccaguugacgaaga

SEQ ID NO: 3083037 - RNA, 23 nt, Mycobacterium bovis subsp bovis AF2122/97
gcgacggacucccucgaucacgg

SEQ ID NO: 3083038 - RNA, 23 nt, Mycobacterium bovis subsp bovis AF2122/97
gcgacggcaagcacgguggccga

SEQ ID NO: 3083039 - RNA, 20 nt, Mycobacterium bovis subsp bovis AF2122/97
gcgacggcagcucggggcac

SEQ ID NO: 3083040 - RNA, 21 nt, Mycobacterium bovis subsp bovis AF2122/97
gcgacggcaggcucgggcaag

SEQ ID NO: 3083041 - RNA, 20 nt, Mycobacterium bovis subsp bovis AF2122/97
gcgacggcauguaccgaccg

SEQ ID NO: 3083042 - RNA, 21 nt, Mycobacterium bovis subsp bovis AF2122/97
gcgacggcauguaccgaccgc

SEQ ID NO: 3083043 - RNA, 19 nt, Mycobacterium bovis subsp bovis AF2122/97
gcgacggccaagaucggcg

SEQ ID NO: 3083044 - RNA, 22 nt, Mycobacterium bovis subsp bovis AF2122/97
gcgacggccaagaucggcgccc

SEQ ID NO: 3083045 - RNA, 14 nt, Mycobacterium bovis subsp bovis AF2122/97
gcgacggccagcgc

SEQ ID NO: 3083046 - RNA, 20 nt, Mycobacterium bovis subsp bovis AF2122/97
gcgacggccagcgcgucggg

SEQ ID NO: 3083047 - RNA, 16 nt, Mycobacterium bovis subsp bovis AF2122/97
gcgacggcccgauccc

SEQ ID NO: 3083048 - RNA, 22 nt, Mycobacterium bovis subsp bovis AF2122/97
gcgacggcccgaucccgaucga

SEQ ID NO: 3083049 - RNA, 12 nt, Mycobacterium bovis subsp bovis AF2122/97
gcgacggccggc

SEQ ID NO: 3083050 - RNA, 16 nt, Mycobacterium bovis subsp bovis AF2122/97
gcgacggccggcaagc

SEQ ID NO: 3083051 - RNA, 12 nt, Mycobacterium bovis subsp bovis AF2122/97
gcgacggccuug

SEQ ID NO: 3083052 - RNA, 16 nt, Mycobacterium bovis subsp bovis AF2122/97
gcgacggccuuggcga

SEQ ID NO: 3083053 - RNA, 15 nt, Mycobacterium bovis subsp bovis AF2122/97
gcgacggcgacguga

SEQ ID NO: 3083054 - RNA, 12 nt, Mycobacterium bovis subsp bovis AF2122/97
gcgacggcgccc

SEQ ID NO: 3083055 - RNA, 20 nt, Mycobacterium bovis subsp bovis AF2122/97
gcgacggcgcccauagcacc

SEQ ID NO: 3083056 - RNA, 19 nt, Mycobacterium bovis subsp bovis AF2122/97
gcgacggcgcucggcgagc

SEQ ID NO: 3083057 - RNA, 18 nt, Mycobacterium bovis subsp bovis AF2122/97
gcgacggcggagucgcgc

SEQ ID NO: 3083058 - RNA, 23 nt, Mycobacterium bovis subsp bovis AF2122/97
gcgacggcggagucgcgcagggc

SEQ ID NO: 3083059 - RNA, 14 nt, Mycobacterium bovis subsp bovis AF2122/97
gcgacggcggcacg

SEQ ID NO: 3083060 - RNA, 19 nt, Mycobacterium bovis subsp bovis AF2122/97
gcgacggcggcacgggcgg

SEQ ID NO: 3083061 - RNA, 20 nt, Mycobacterium bovis subsp bovis AF2122/97
gcgacggcggcucccggggg

SEQ ID NO: 3083062 - RNA, 15 nt, Mycobacterium bovis subsp bovis AF2122/97
gcgacggcgucaccc

SEQ ID NO: 3083063 - RNA, 16 nt, Mycobacterium bovis subsp bovis AF2122/97
gcgacggcguugccgg

SEQ ID NO: 3083064 - RNA, 20 nt, Mycobacterium bovis subsp bovis AF2122/97
gcgacggcucuaccgguccg

SEQ ID NO: 3083065 - RNA, 20 nt, Mycobacterium bovis subsp bovis AF2122/97
gcgacgggcacccgagccgc

SEQ ID NO: 3083066 - RNA, 14 nt, Mycobacterium bovis subsp bovis AF2122/97
gcgacgggccgcga

SEQ ID NO: 3083067 - RNA, 18 nt, Mycobacterium bovis subsp bovis AF2122/97
gcgacggggucgcgaugc

SEQ ID NO: 3083068 - RNA, 20 nt, Mycobacterium bovis subsp bovis AF2122/97
gcgacgggucgggcaaccug

SEQ ID NO: 3083069 - RNA, 23 nt, Mycobacterium bovis subsp bovis AF2122/97
gcgacggucaaggugcgccgcca

SEQ ID NO: 3083070 - RNA, 15 nt, Mycobacterium bovis subsp bovis AF2122/97
gcgacggucccggca

SEQ ID NO: 3083071 - RNA, 21 nt, Mycobacterium bovis subsp bovis AF2122/97
gcgacggucccggcacgucga

SEQ ID NO: 3083072 - RNA, 22 nt, Mycobacterium bovis subsp bovis AF2122/97
gcgacggugagggcgucgucga

SEQ ID NO: 3083073 - RNA, 16 nt, Mycobacterium bovis subsp bovis AF2122/97
gcgacggugccaccgc

SEQ ID NO: 3083074 - RNA, 17 nt, Mycobacterium bovis subsp bovis AF2122/97
gcgacggugccaccgcg

SEQ ID NO: 3083075 - RNA, 21 nt, Mycobacterium bovis subsp bovis AF2122/97
gcgacggugccaccgcgacgg

SEQ ID NO: 3083076 - RNA, 22 nt, Mycobacterium bovis subsp bovis AF2122/97
gcgacggugccaccgcgacggc

SEQ ID NO: 3083077 - RNA, 20 nt, Mycobacterium bovis subsp bovis AF2122/97
gcgacgguucccagcuuccg

SEQ ID NO: 3083078 - RNA, 18 nt, Mycobacterium bovis subsp bovis AF2122/97
gcgacguagacgacgucg

SEQ ID NO: 3083079 - RNA, 18 nt, Mycobacterium bovis subsp bovis AF2122/97
gcgacguaguagcgaugc

SEQ ID NO: 3083080 - RNA, 16 nt, Mycobacterium bovis subsp bovis AF2122/97
gcgacguaguugccgg

SEQ ID NO: 3083081 - RNA, 18 nt, Mycobacterium bovis subsp bovis AF2122/97
gcgacguauuucgccccc

SEQ ID NO: 3083082 - RNA, 18 nt, Mycobacterium bovis subsp bovis AF2122/97
gcgacgucaaacgcaaag

SEQ ID NO: 3083083 - RNA, 19 nt, Mycobacterium bovis subsp bovis AF2122/97
gcgacgucaggguauccac

SEQ ID NO: 3083084 - RNA, 21 nt, Mycobacterium bovis subsp bovis AF2122/97
gcgacgucaggguauccacgc

SEQ ID NO: 3083085 - RNA, 17 nt, Mycobacterium bovis subsp bovis AF2122/97
gcgacgucaucgccgac

SEQ ID NO: 3083086 - RNA, 21 nt, Mycobacterium bovis subsp bovis AF2122/97
gcgagcagacacagaaucgcc

SEQ ID NO: 3083087 - RNA, 15 nt, Mycobacterium bovis subsp bovis AF2122/97
gcgagcagacgcaaa

SEQ ID NO: 3083088 - RNA, 19 nt, Mycobacterium bovis subsp bovis AF2122/97
gcgagcagacgcaaaagcc

SEQ ID NO: 3083089 - RNA, 20 nt, Mycobacterium bovis subsp bovis AF2122/97
gcgagcagacgcaaaaucgc

SEQ ID NO: 3083090 - RNA, 21 nt, Mycobacterium bovis subsp bovis AF2122/97
gcgagcagacgcaaaaucgca

SEQ ID NO: 3083091 - RNA, 15 nt, Mycobacterium bovis subsp bovis AF2122/97
gcgagcagacgcaga

SEQ ID NO: 3083092 - RNA, 20 nt, Mycobacterium bovis subsp bovis AF2122/97
gcgagcagacgcagaagccc

SEQ ID NO: 3083093 - RNA, 21 nt, Mycobacterium bovis subsp bovis AF2122/97
gcgagcagacgcagagucgca

SEQ ID NO: 3083094 - RNA, 17 nt, Mycobacterium bovis subsp bovis AF2122/97
gcgagcagacgccgcgu

SEQ ID NO: 3083095 - RNA, 15 nt, Mycobacterium bovis subsp bovis AF2122/97
gcgagcagacgcgga

SEQ ID NO: 3083096 - RNA, 21 nt, Mycobacterium bovis subsp bovis AF2122/97
gcgagcagacgcggaaucgca

SEQ ID NO: 3083097 - RNA, 19 nt, Mycobacterium bovis subsp bovis AF2122/97
gcgagcagacguaaaagcc

SEQ ID NO: 3083098 - RNA, 22 nt, Mycobacterium bovis subsp bovis AF2122/97
gcgagcagagaacuccgccacc

SEQ ID NO: 3083099 - RNA, 14 nt, Mycobacterium bovis subsp bovis AF2122/97
gcgagcagcacagc

SEQ ID NO: 3083100 - RNA, 12 nt, Mycobacterium bovis subsp bovis AF2122/97
gcgagcagcagg

SEQ ID NO: 3083101 - RNA, 15 nt, Mycobacterium bovis subsp bovis AF2122/97
gcgagcagcccggcg

SEQ ID NO: 3083102 - RNA, 16 nt, Mycobacterium bovis subsp bovis AF2122/97
gcgagcagcgcacgau

SEQ ID NO: 3083103 - RNA, 16 nt, Mycobacterium bovis subsp bovis AF2122/97
gcgagcaggccguuga

SEQ ID NO: 3083104 - RNA, 19 nt, Mycobacterium bovis subsp bovis AF2122/97
gcgagcagggcgucgaccg

SEQ ID NO: 3083105 - RNA, 23 nt, Mycobacterium bovis subsp bovis AF2122/97
gcgagcagggcgucgaccgcggc

SEQ ID NO: 3083106 - RNA, 18 nt, Mycobacterium bovis subsp bovis AF2122/97
gcgagcauaccgccgcug

SEQ ID NO: 3083107 - RNA, 19 nt, Mycobacterium bovis subsp bovis AF2122/97
gcgagcauaccgccgcugc

SEQ ID NO: 3083108 - RNA, 16 nt, Mycobacterium bovis subsp bovis AF2122/97
gcgagcaucgacgaac

SEQ ID NO: 3083109 - RNA, 13 nt, Mycobacterium bovis subsp bovis AF2122/97
gcgagccacggca

SEQ ID NO: 3083110 - RNA, 19 nt, Mycobacterium bovis subsp bovis AF2122/97
gcgagcccagcugcgccga

SEQ ID NO: 3083111 - RNA, 22 nt, Mycobacterium bovis subsp bovis AF2122/97
gcgagcccagcugcgccgaacg

SEQ ID NO: 3083112 - RNA, 17 nt, Mycobacterium bovis subsp bovis AF2122/97
gcgagcccgaaccaccg

SEQ ID NO: 3083113 - RNA, 12 nt, Mycobacterium bovis subsp bovis AF2122/97
gcgagcccgcau

SEQ ID NO: 3083114 - RNA, 14 nt, Mycobacterium bovis subsp bovis AF2122/97
gcgagcccgcaucg

SEQ ID NO: 3083115 - RNA, 14 nt, Mycobacterium bovis subsp bovis AF2122/97
gcgagccgccaccg

SEQ ID NO: 3083116 - RNA, 12 nt, Mycobacterium bovis subsp bovis AF2122/97
gcgagccgcgcc

SEQ ID NO: 3083117 - RNA, 14 nt, Mycobacterium bovis subsp bovis AF2122/97
gcgagccggcgccg

SEQ ID NO: 3083118 - RNA, 19 nt, Mycobacterium bovis subsp bovis AF2122/97
gcgagccggcgccgggucg

SEQ ID NO: 3083119 - RNA, 14 nt, Mycobacterium bovis subsp bovis AF2122/97
gcgagccggcgcgc

SEQ ID NO: 3083120 - RNA, 14 nt, Mycobacterium bovis subsp bovis AF2122/97
gcgagccggugauc

SEQ ID NO: 3083121 - RNA, 15 nt, Mycobacterium bovis subsp bovis AF2122/97
gcgagccucgcgcgu

SEQ ID NO: 3083122 - RNA, 16 nt, Mycobacterium bovis subsp bovis AF2122/97
gcgagccucgcgcgug

SEQ ID NO: 3083123 - RNA, 12 nt, Mycobacterium bovis subsp bovis AF2122/97
gcgagcgcagcg

SEQ ID NO: 3083124 - RNA, 13 nt, Mycobacterium bovis subsp bovis AF2122/97
gcgagcgcaucga

SEQ ID NO: 3083125 - RNA, 17 nt, Mycobacterium bovis subsp bovis AF2122/97
gcgagcgccaggucagc

SEQ ID NO: 3083126 - RNA, 12 nt, Mycobacterium bovis subsp bovis AF2122/97
gcgagcgccggc

SEQ ID NO: 3083127 - RNA, 14 nt, Mycobacterium bovis subsp bovis AF2122/97
gcgagcgccggccg

SEQ ID NO: 3083128 - RNA, 15 nt, Mycobacterium bovis subsp bovis AF2122/97
gcgagcgccggccgc

SEQ ID NO: 3083129 - RNA, 18 nt, Mycobacterium bovis subsp bovis AF2122/97
gcgagcgccggccgcggc

SEQ ID NO: 3083130 - RNA, 19 nt, Mycobacterium bovis subsp bovis AF2122/97
gcgagcgccggccgcggcg

SEQ ID NO: 3083131 - RNA, 20 nt, Mycobacterium bovis subsp bovis AF2122/97
gcgagcgccggccgcggcgg

SEQ ID NO: 3083132 - RNA, 21 nt, Mycobacterium bovis subsp bovis AF2122/97
gcgagcgccggccgcggcggc

SEQ ID NO: 3083133 - RNA, 14 nt, Mycobacterium bovis subsp bovis AF2122/97
gcgagcgccggcuu

SEQ ID NO: 3083134 - RNA, 19 nt, Mycobacterium bovis subsp bovis AF2122/97
gcgagcgccuuuggcggug

SEQ ID NO: 3083135 - RNA, 14 nt, Mycobacterium bovis subsp bovis AF2122/97
gcgagcgcgccggc

SEQ ID NO: 3083136 - RNA, 14 nt, Mycobacterium bovis subsp bovis AF2122/97
gcgagcgcggccug

SEQ ID NO: 3083137 - RNA, 19 nt, Mycobacterium bovis subsp bovis AF2122/97
gcgagcggauccgugucgc

SEQ ID NO: 3083138 - RNA, 16 nt, Mycobacterium bovis subsp bovis AF2122/97
gcgagcggccuccagc

SEQ ID NO: 3083139 - RNA, 18 nt, Mycobacterium bovis subsp bovis AF2122/97
gcgagcggccuccagcac

SEQ ID NO: 3083140 - RNA, 18 nt, Mycobacterium bovis subsp bovis AF2122/97
gcgagcguuucaccaguc

SEQ ID NO: 3083141 - RNA, 20 nt, Mycobacterium bovis subsp bovis AF2122/97
gcgagcguuucaccagucca

SEQ ID NO: 3083142 - RNA, 16 nt, Mycobacterium bovis subsp bovis AF2122/97
gcgagcguuuggacgg

SEQ ID NO: 3083143 - RNA, 19 nt, Mycobacterium bovis subsp bovis AF2122/97
gcgagcguuuggacgggcg

SEQ ID NO: 3083144 - RNA, 18 nt, Mycobacterium bovis subsp bovis AF2122/97
gcgagcuaacacccgagc

SEQ ID NO: 3083145 - RNA, 19 nt, Mycobacterium bovis subsp bovis AF2122/97
gcgagcuaacacccgagca

SEQ ID NO: 3083146 - RNA, 21 nt, Mycobacterium bovis subsp bovis AF2122/97
gcgagcucagcgaugcggccc

SEQ ID NO: 3083147 - RNA, 15 nt, Mycobacterium bovis subsp bovis AF2122/97
gcgagcucggccccg

SEQ ID NO: 3083148 - RNA, 20 nt, Mycobacterium bovis subsp bovis AF2122/97
gcgagcucggccccgccgcc

SEQ ID NO: 3083149 - RNA, 18 nt, Mycobacterium bovis subsp bovis AF2122/97
gcgagcugcgggucgcgu

SEQ ID NO: 3083150 - RNA, 17 nt, Mycobacterium bovis subsp bovis AF2122/97
gcgagcuguaggucagc

SEQ ID NO: 3083151 - RNA, 16 nt, Mycobacterium bovis subsp bovis AF2122/97
gcgagcuugauuccgc

SEQ ID NO: 3083152 - RNA, 16 nt, Mycobacterium bovis subsp bovis AF2122/97
gcgagcuuggccggca

SEQ ID NO: 3083153 - RNA, 14 nt, Mycobacterium bovis subsp bovis AF2122/97
gcgagcuuggcuug

SEQ ID NO: 3083154 - RNA, 22 nt, Mycobacterium bovis subsp bovis AF2122/97
gcgaggaacuggaccggugcca

SEQ ID NO: 3083155 - RNA, 15 nt, Mycobacterium bovis subsp bovis AF2122/97
gcgaggacgcgcccg

SEQ ID NO: 3083156 - RNA, 13 nt, Mycobacterium bovis subsp bovis AF2122/97
gcgaggcagcacc

SEQ ID NO: 3083157 - RNA, 12 nt, Mycobacterium bovis subsp bovis AF2122/97
gcgaggccagcg

SEQ ID NO: 3083158 - RNA, 22 nt, Mycobacterium bovis subsp bovis AF2122/97
gcgaggccagcgguaaugccag

SEQ ID NO: 3083159 - RNA, 21 nt, Mycobacterium bovis subsp bovis AF2122/97
gcgaggcguaaucaagcagcg

SEQ ID NO: 3083160 - RNA, 18 nt, Mycobacterium bovis subsp bovis AF2122/97
gcgaggcgucaccccggu

SEQ ID NO: 3083161 - RNA, 19 nt, Mycobacterium bovis subsp bovis AF2122/97
gcgaggcucccccaccagg

SEQ ID NO: 3083162 - RNA, 17 nt, Mycobacterium bovis subsp bovis AF2122/97
gcgagggcauccgagcg

SEQ ID NO: 3083163 - RNA, 19 nt, Mycobacterium bovis subsp bovis AF2122/97
gcgagggcuaccggcgccg

SEQ ID NO: 3083164 - RNA, 14 nt, Mycobacterium bovis subsp bovis AF2122/97
gcgaggggccggcu

SEQ ID NO: 3083165 - RNA, 19 nt, Mycobacterium bovis subsp bovis AF2122/97
gcgagguaagcgagucgac

SEQ ID NO: 3083166 - RNA, 13 nt, Mycobacterium bovis subsp bovis AF2122/97
gcgagguccagca

SEQ ID NO: 3083167 - RNA, 18 nt, Mycobacterium bovis subsp bovis AF2122/97
gcgaggucccggccgagc

SEQ ID NO: 3083168 - RNA, 13 nt, Mycobacterium bovis subsp bovis AF2122/97
gcgaggucggcgg

SEQ ID NO: 3083169 - RNA, 15 nt, Mycobacterium bovis subsp bovis AF2122/97
gcgaggucggcggcg

SEQ ID NO: 3083170 - RNA, 21 nt, Mycobacterium bovis subsp bovis AF2122/97
gcgaggugauuggucacaccc

SEQ ID NO: 3083171 - RNA, 20 nt, Mycobacterium bovis subsp bovis AF2122/97
gcgaggugcccaaggccagg

SEQ ID NO: 3083172 - RNA, 13 nt, Mycobacterium bovis subsp bovis AF2122/97
gcgaggugccggg

SEQ ID NO: 3083173 - RNA, 15 nt, Mycobacterium bovis subsp bovis AF2122/97
gcgauccagggccga

SEQ ID NO: 3083174 - RNA, 18 nt, Mycobacterium bovis subsp bovis AF2122/97
gcgauccagggccgacgc

SEQ ID NO: 3083175 - RNA, 17 nt, Mycobacterium bovis subsp bovis AF2122/97
gcgaucccaacgcccgg

SEQ ID NO: 3083176 - RNA, 15 nt, Mycobacterium bovis subsp bovis AF2122/97
gcgauccccagcacc

SEQ ID NO: 3083177 - RNA, 18 nt, Mycobacterium bovis subsp bovis AF2122/97
gcgauccccagcaccacg

SEQ ID NO: 3083178 - RNA, 20 nt, Mycobacterium bovis subsp bovis AF2122/97
gcgaucccgaucgcgcuggg

SEQ ID NO: 3083179 - RNA, 17 nt, Mycobacterium bovis subsp bovis AF2122/97
gcgaucccgccggggcc

SEQ ID NO: 3083180 - RNA, 22 nt, Mycobacterium bovis subsp bovis AF2122/97
gcgaucccgccggggcccuggg

SEQ ID NO: 3083181 - RNA, 13 nt, Mycobacterium bovis subsp bovis AF2122/97
gcgauccgagacc

SEQ ID NO: 3083182 - RNA, 23 nt, Mycobacterium bovis subsp bovis AF2122/97
gcgauccgagaccgcgugcucga

SEQ ID NO: 3083183 - RNA, 13 nt, Mycobacterium bovis subsp bovis AF2122/97
gcgauccgcgcgc

SEQ ID NO: 3083184 - RNA, 22 nt, Mycobacterium bovis subsp bovis AF2122/97
gcgauccgcgcgcauauccgca

SEQ ID NO: 3083185 - RNA, 14 nt, Mycobacterium bovis subsp bovis AF2122/97
gcgauccgcggcgu

SEQ ID NO: 3083186 - RNA, 16 nt, Mycobacterium bovis subsp bovis AF2122/97
gcgauccgcggcguuc

SEQ ID NO: 3083187 - RNA, 17 nt, Mycobacterium bovis subsp bovis AF2122/97
gcgauccgcugcgccga

SEQ ID NO: 3083188 - RNA, 14 nt, Mycobacterium bovis subsp bovis AF2122/97
gcgauccggcgcac

SEQ ID NO: 3083189 - RNA, 23 nt, Mycobacterium bovis subsp bovis AF2122/97
gcgauccggcugcgggaagacgu

SEQ ID NO: 3083190 - RNA, 14 nt, Mycobacterium bovis subsp bovis AF2122/97
gcgauccggucggc

SEQ ID NO: 3083191 - RNA, 19 nt, Mycobacterium bovis subsp bovis AF2122/97
gcgauccugaccagccagg

SEQ ID NO: 3083192 - RNA, 16 nt, Mycobacterium bovis subsp bovis AF2122/97
gcgaucgacaccguga

SEQ ID NO: 3083193 - RNA, 20 nt, Mycobacterium bovis subsp bovis AF2122/97
gcgaucgacaccgugaccgc

SEQ ID NO: 3083194 - RNA, 16 nt, Mycobacterium bovis subsp bovis AF2122/97
gcgaucgacgauccac

SEQ ID NO: 3083195 - RNA, 14 nt, Mycobacterium bovis subsp bovis AF2122/97
gcgaucgacgcucg

SEQ ID NO: 3083196 - RNA, 17 nt, Mycobacterium bovis subsp bovis AF2122/97
gcgaucgauuccgcucg

SEQ ID NO: 3083197 - RNA, 18 nt, Mycobacterium bovis subsp bovis AF2122/97
gcgaucgauuccgcucgu

SEQ ID NO: 3083198 - RNA, 13 nt, Mycobacterium bovis subsp bovis AF2122/97
gcgaucgcaacac

SEQ ID NO: 3083199 - RNA, 19 nt, Mycobacterium bovis subsp bovis AF2122/97
gcgaucgcaagcgcggcga

SEQ ID NO: 3083200 - RNA, 21 nt, Mycobacterium bovis subsp bovis AF2122/97
gcgaucgcagugagcagccgg

SEQ ID NO: 3083201 - RNA, 22 nt, Mycobacterium bovis subsp bovis AF2122/97
gcgaucgcagugagcagccgga

SEQ ID NO: 3083202 - RNA, 15 nt, Mycobacterium bovis subsp bovis AF2122/97
gcgaucgcccggccc

SEQ ID NO: 3083203 - RNA, 17 nt, Mycobacterium bovis subsp bovis AF2122/97
gcgaucgcccggccccg

SEQ ID NO: 3083204 - RNA, 20 nt, Mycobacterium bovis subsp bovis AF2122/97
gcgaucgcccggccccgcaa

SEQ ID NO: 3083205 - RNA, 21 nt, Mycobacterium bovis subsp bovis AF2122/97
gcgaucgcccggccccgcaag

SEQ ID NO: 3083206 - RNA, 12 nt, Mycobacterium bovis subsp bovis AF2122/97
gcgaucgccgac

SEQ ID NO: 3083207 - RNA, 14 nt, Mycobacterium bovis subsp bovis AF2122/97
gcgaucgccgacgc

SEQ ID NO: 3083208 - RNA, 13 nt, Mycobacterium bovis subsp bovis AF2122/97
gcgaucgccgcgc

SEQ ID NO: 3083209 - RNA, 18 nt, Mycobacterium bovis subsp bovis AF2122/97
gcgaucgccgcgcugguc

SEQ ID NO: 3083210 - RNA, 14 nt, Mycobacterium bovis subsp bovis AF2122/97
gcgaucgccggccg

SEQ ID NO: 3083211 - RNA, 13 nt, Mycobacterium bovis subsp bovis AF2122/97
gcgaucgccuggg

SEQ ID NO: 3083212 - RNA, 22 nt, Mycobacterium bovis subsp bovis AF2122/97
gcgaucgccugggcuuggcgac

SEQ ID NO: 3083213 - RNA, 21 nt, Mycobacterium bovis subsp bovis AF2122/97
gcgaucgcgacccgaucgcgc

SEQ ID NO: 3083214 - RNA, 18 nt, Mycobacterium bovis subsp bovis AF2122/97
gcgaucgcgagcgagcca

SEQ ID NO: 3083215 - RNA, 17 nt, Mycobacterium bovis subsp bovis AF2122/97
gcgaucgcgcccgcuga

SEQ ID NO: 3083216 - RNA, 19 nt, Mycobacterium bovis subsp bovis AF2122/97
gcgaucgcggcgagcacca

SEQ ID NO: 3083217 - RNA, 17 nt, Mycobacterium bovis subsp bovis AF2122/97
gcgaucgcgugcggugc

SEQ ID NO: 3083218 - RNA, 21 nt, Mycobacterium bovis subsp bovis AF2122/97
gcgaucgcucauucgugcccg

SEQ ID NO: 3083219 - RNA, 18 nt, Mycobacterium bovis subsp bovis AF2122/97
gcgaucgcuccgcggcgc

SEQ ID NO: 3083220 - RNA, 21 nt, Mycobacterium bovis subsp bovis AF2122/97
gcgaucgcuccgcggcgcagc

SEQ ID NO: 3083221 - RNA, 16 nt, Mycobacterium bovis subsp bovis AF2122/97
gcgaucggcacuagcg

SEQ ID NO: 3083222 - RNA, 22 nt, Mycobacterium bovis subsp bovis AF2122/97
gcgaucggcacuuagcccgaug

SEQ ID NO: 3083223 - RNA, 15 nt, Mycobacterium bovis subsp bovis AF2122/97
gcgaucggccgccga

SEQ ID NO: 3083224 - RNA, 16 nt, Mycobacterium bovis subsp bovis AF2122/97
gcgaucggccgccgaa

SEQ ID NO: 3083225 - RNA, 21 nt, Mycobacterium bovis subsp bovis AF2122/97
gcgaucggccgccgaauuggc

SEQ ID NO: 3083226 - RNA, 18 nt, Mycobacterium bovis subsp bovis AF2122/97
gcgaucggcggcggcgcc

SEQ ID NO: 3083227 - RNA, 13 nt, Mycobacterium bovis subsp bovis AF2122/97
gcgaucggcguca

SEQ ID NO: 3083228 - RNA, 15 nt, Mycobacterium bovis subsp bovis AF2122/97
gcgaucgggcccagc

SEQ ID NO: 3083229 - RNA, 18 nt, Mycobacterium bovis subsp bovis AF2122/97
gcgaucgggcccagcagc

SEQ ID NO: 3083230 - RNA, 15 nt, Mycobacterium bovis subsp bovis AF2122/97
gcgaucgggccggcg

SEQ ID NO: 3083231 - RNA, 22 nt, Mycobacterium bovis subsp bovis AF2122/97
gcgaucgggccggcgcggucuc

SEQ ID NO: 3083232 - RNA, 17 nt, Mycobacterium bovis subsp bovis AF2122/97
gcgaucggugcgaucag

SEQ ID NO: 3083233 - RNA, 23 nt, Mycobacterium bovis subsp bovis AF2122/97
gcgaucggugcgaucaggcugcc

SEQ ID NO: 3083234 - RNA, 17 nt, Mycobacterium bovis subsp bovis AF2122/97
gcgaucggugcgggcgc

SEQ ID NO: 3083235 - RNA, 20 nt, Mycobacterium bovis subsp bovis AF2122/97
gcgaucggugcgggcgccgc

SEQ ID NO: 3083236 - RNA, 16 nt, Mycobacterium bovis subsp bovis AF2122/97
gcgaucgucagccagc

SEQ ID NO: 3083237 - RNA, 20 nt, Mycobacterium bovis subsp bovis AF2122/97
gcgaucgugcggaaaccgcu

SEQ ID NO: 3083238 - RNA, 18 nt, Mycobacterium bovis subsp bovis AF2122/97
gcgaucguguccaccgga

SEQ ID NO: 3083239 - RNA, 16 nt, Mycobacterium bovis subsp bovis AF2122/97
gcgaucucaccuggag

SEQ ID NO: 3083240 - RNA, 18 nt, Mycobacterium bovis subsp bovis AF2122/97
gcgaucucaccuggagcu

SEQ ID NO: 3083241 - RNA, 21 nt, Mycobacterium bovis subsp bovis AF2122/97
gcgaucucaccuggagcuaug

SEQ ID NO: 3083242 - RNA, 15 nt, Mycobacterium bovis subsp bovis AF2122/97
gcgaucuccggcgga

SEQ ID NO: 3083243 - RNA, 20 nt, Mycobacterium bovis subsp bovis AF2122/97
gcgaucuccgugagccggac

SEQ ID NO: 3083244 - RNA, 22 nt, Mycobacterium bovis subsp bovis AF2122/97
gcgaucuccgugagccggaccg

SEQ ID NO: 3083245 - RNA, 19 nt, Mycobacterium bovis subsp bovis AF2122/97
gcgaucuccuccaccagug

SEQ ID NO: 3083246 - RNA, 24 nt, Mycobacterium bovis subsp bovis AF2122/97
gcgaucucgaccguauugaccagc

SEQ ID NO: 3083247 - RNA, 15 nt, Mycobacterium bovis subsp bovis AF2122/97
gcgaucucgacggcc

SEQ ID NO: 3083248 - RNA, 13 nt, Mycobacterium bovis subsp bovis AF2122/97
gcgaucucgaugu

SEQ ID NO: 3083249 - RNA, 14 nt, Mycobacterium bovis subsp bovis AF2122/97
gcgaucucuaccag

SEQ ID NO: 3083250 - RNA, 18 nt, Mycobacterium bovis subsp bovis AF2122/97
gcgaucugaaacagucga

SEQ ID NO: 3083251 - RNA, 13 nt, Mycobacterium bovis subsp bovis AF2122/97
gcgaucugcagcg

SEQ ID NO: 3083252 - RNA, 21 nt, Mycobacterium bovis subsp bovis AF2122/97
gcgaucugcgacaagaccggc

SEQ ID NO: 3083253 - RNA, 14 nt, Mycobacterium bovis subsp bovis AF2122/97
gcgaucugcggcgc

SEQ ID NO: 3083254 - RNA, 15 nt, Mycobacterium bovis subsp bovis AF2122/97
gcgaucugcggcgcc

SEQ ID NO: 3083255 - RNA, 16 nt, Mycobacterium bovis subsp bovis AF2122/97
gcgaucugcggcgccc

SEQ ID NO: 3083256 - RNA, 13 nt, Mycobacterium bovis subsp bovis AF2122/97
gcgaucugcuacc

SEQ ID NO: 3083257 - RNA, 15 nt, Mycobacterium bovis subsp bovis AF2122/97
gcgaucugcuaccag

SEQ ID NO: 3083258 - RNA, 12 nt, Mycobacterium bovis subsp bovis AF2122/97
gcgaucugcucg

SEQ ID NO: 3083259 - RNA, 15 nt, Mycobacterium bovis subsp bovis AF2122/97
gcgaucugcucgccc

SEQ ID NO: 3083260 - RNA, 17 nt, Mycobacterium bovis subsp bovis AF2122/97
gcgauugcccgcgcucg

SEQ ID NO: 3083261 - RNA, 18 nt, Mycobacterium bovis subsp bovis AF2122/97
gcgauugcccgcgcucgc

SEQ ID NO: 3083262 - RNA, 23 nt, Mycobacterium bovis subsp bovis AF2122/97
gcgauugcgcacacccugcagcu

SEQ ID NO: 3083263 - RNA, 17 nt, Mycobacterium bovis subsp bovis AF2122/97
gcgauuuccaucgcgac

SEQ ID NO: 3083264 - RNA, 21 nt, Mycobacterium bovis subsp bovis AF2122/97
gcgauuuccaucgcgaccucg

SEQ ID NO: 3083265 - RNA, 19 nt, Mycobacterium bovis subsp bovis AF2122/97
gcgauuucgaucacaucgu

SEQ ID NO: 3083266 - RNA, 14 nt, Mycobacterium bovis subsp bovis AF2122/97
gcgauuucggcgcc

SEQ ID NO: 3083267 - RNA, 22 nt, Mycobacterium bovis subsp bovis AF2122/97
gcgauuucggcgccggcgucgg

SEQ ID NO: 3083268 - RNA, 18 nt, Mycobacterium bovis subsp bovis AF2122/97
gcgauuuggcgucgccga

SEQ ID NO: 3083269 - RNA, 14 nt, Mycobacterium bovis subsp bovis AF2122/97
gcgauuuucggcac

SEQ ID NO: 3083270 - RNA, 18 nt, Mycobacterium bovis subsp bovis AF2122/97
gcgauuuugcgucugcuc

SEQ ID NO: 3083271 - RNA, 19 nt, Mycobacterium bovis subsp bovis AF2122/97
gcgauuuugcgucugcucg

SEQ ID NO: 3083272 - RNA, 20 nt, Mycobacterium bovis subsp bovis AF2122/97
gcgauuuugcgucugcucgg

SEQ ID NO: 3083273 - RNA, 20 nt, Mycobacterium bovis subsp bovis AF2122/97
gcgauuuugugucugcucgc

SEQ ID NO: 3083274 - RNA, 17 nt, Mycobacterium bovis subsp bovis AF2122/97
gcgcaaaaucaccggug

SEQ ID NO: 3083275 - RNA, 13 nt, Mycobacterium bovis subsp bovis AF2122/97
gcgcaaagacacc

SEQ ID NO: 3083276 - RNA, 20 nt, Mycobacterium bovis subsp bovis AF2122/97
gcgcaaagacaccgaaagcc

SEQ ID NO: 3083277 - RNA, 17 nt, Mycobacterium bovis subsp bovis AF2122/97
gcgcaacacauccagua

SEQ ID NO: 3083278 - RNA, 12 nt, Mycobacterium bovis subsp bovis AF2122/97
gcgcaacaccuc

SEQ ID NO: 3083279 - RNA, 13 nt, Mycobacterium bovis subsp bovis AF2122/97
gcgcaacaccucg

SEQ ID NO: 3083280 - RNA, 12 nt, Mycobacterium bovis subsp bovis AF2122/97
gcgcaaccagcc

SEQ ID NO: 3083281 - RNA, 13 nt, Mycobacterium bovis subsp bovis AF2122/97
gcgcaaccagccc

SEQ ID NO: 3083282 - RNA, 23 nt, Mycobacterium bovis subsp bovis AF2122/97
gcgcaaccagccuuuccggccgc

SEQ ID NO: 3083283 - RNA, 18 nt, Mycobacterium bovis subsp bovis AF2122/97
gcgcaacccagccgcgcc

SEQ ID NO: 3083284 - RNA, 14 nt, Mycobacterium bovis subsp bovis AF2122/97
gcgcaacccggacg

SEQ ID NO: 3083285 - RNA, 23 nt, Mycobacterium bovis subsp bovis AF2122/97
gcgcaaccgagcggucgaucuga

SEQ ID NO: 3083286 - RNA, 22 nt, Mycobacterium bovis subsp bovis AF2122/97
gcgcaaccgcggccccgacugc

SEQ ID NO: 3083287 - RNA, 14 nt, Mycobacterium bovis subsp bovis AF2122/97
gcgcaaccgcucau

SEQ ID NO: 3083288 - RNA, 13 nt, Mycobacterium bovis subsp bovis AF2122/97
gcgcaaccgcuga

SEQ ID NO: 3083289 - RNA, 12 nt, Mycobacterium bovis subsp bovis AF2122/97
gcgcaaccggug

SEQ ID NO: 3083290 - RNA, 23 nt, Mycobacterium bovis subsp bovis AF2122/97
gcgcaaccuaaauugccgggccc

SEQ ID NO: 3083291 - RNA, 12 nt, Mycobacterium bovis subsp bovis AF2122/97
gcgcaacgccgc

SEQ ID NO: 3083292 - RNA, 14 nt, Mycobacterium bovis subsp bovis AF2122/97
gcgcaacgccgcca

SEQ ID NO: 3083293 - RNA, 19 nt, Mycobacterium bovis subsp bovis AF2122/97
gcgcaacgccgccagccug

SEQ ID NO: 3083294 - RNA, 20 nt, Mycobacterium bovis subsp bovis AF2122/97
gcgcaacgccgccagccugg

SEQ ID NO: 3083295 - RNA, 22 nt, Mycobacterium bovis subsp bovis AF2122/97
gcgcaacgcuggaggcgaucug

SEQ ID NO: 3083296 - RNA, 19 nt, Mycobacterium bovis subsp bovis AF2122/97
gcgcaacggaucaagagcg

SEQ ID NO: 3083297 - RNA, 14 nt, Mycobacterium bovis subsp bovis AF2122/97
gcgcaacggccagc

SEQ ID NO: 3083298 - RNA, 15 nt, Mycobacterium bovis subsp bovis AF2122/97
gcgcaacggccagcg

SEQ ID NO: 3083299 - RNA, 16 nt, Mycobacterium bovis subsp bovis AF2122/97
gcgcaacggccagcgc

SEQ ID NO: 3083300 - RNA, 16 nt, Mycobacterium bovis subsp bovis AF2122/97
gcgcaacguagccagc

SEQ ID NO: 3083301 - RNA, 19 nt, Mycobacterium bovis subsp bovis AF2122/97
gcgcaacguagccagcagc

SEQ ID NO: 3083302 - RNA, 17 nt, Mycobacterium bovis subsp bovis AF2122/97
gcgcaacuaucgcaccu

SEQ ID NO: 3083303 - RNA, 13 nt, Mycobacterium bovis subsp bovis AF2122/97
gcgcaacucccag

SEQ ID NO: 3083304 - RNA, 14 nt, Mycobacterium bovis subsp bovis AF2122/97
gcgcaacucgccac

SEQ ID NO: 3083305 - RNA, 19 nt, Mycobacterium bovis subsp bovis AF2122/97
gcgcaagaaugccgccgac

SEQ ID NO: 3083306 - RNA, 22 nt, Mycobacterium bovis subsp bovis AF2122/97
gcgcaagaaugccgccgacggg

SEQ ID NO: 3083307 - RNA, 14 nt, Mycobacterium bovis subsp bovis AF2122/97
gcgcaagcgccgcg

SEQ ID NO: 3083308 - RNA, 15 nt, Mycobacterium bovis subsp bovis AF2122/97
gcgcaagcgccgcgc

SEQ ID NO: 3083309 - RNA, 17 nt, Mycobacterium bovis subsp bovis AF2122/97
gcgcaagcgccgcgcuu

SEQ ID NO: 3083310 - RNA, 22 nt, Mycobacterium bovis subsp bovis AF2122/97
gcgcaaggcaaaucggugcgau

SEQ ID NO: 3083311 - RNA, 18 nt, Mycobacterium bovis subsp bovis AF2122/97
gcgcaaggcgccgcaggg

SEQ ID NO: 3083312 - RNA, 20 nt, Mycobacterium bovis subsp bovis AF2122/97
gcgcaagugauuucggugac

SEQ ID NO: 3083313 - RNA, 16 nt, Mycobacterium bovis subsp bovis AF2122/97
gcgcaagugcuggccg

SEQ ID NO: 3083314 - RNA, 16 nt, Mycobacterium bovis subsp bovis AF2122/97
gcgcaauagcgacagc

SEQ ID NO: 3083315 - RNA, 18 nt, Mycobacterium bovis subsp bovis AF2122/97
gcgcaauagcgacagcag

SEQ ID NO: 3083316 - RNA, 19 nt, Mycobacterium bovis subsp bovis AF2122/97
gcgcaauagcgacagcagc

SEQ ID NO: 3083317 - RNA, 20 nt, Mycobacterium bovis subsp bovis AF2122/97
gcgcaaucaacgucaccccc

SEQ ID NO: 3083318 - RNA, 23 nt, Mycobacterium bovis subsp bovis AF2122/97
gcgcaauccugcgggacuggcug

SEQ ID NO: 3083319 - RNA, 15 nt, Mycobacterium bovis subsp bovis AF2122/97
gcgcaaucgaccacg

SEQ ID NO: 3083320 - RNA, 16 nt, Mycobacterium bovis subsp bovis AF2122/97
gcgcaaucgaccacga

SEQ ID NO: 3083321 - RNA, 21 nt, Mycobacterium bovis subsp bovis AF2122/97
gcgcaaucgaccacgacgugg

SEQ ID NO: 3083322 - RNA, 18 nt, Mycobacterium bovis subsp bovis AF2122/97
gcgcaaucgugguucggc

SEQ ID NO: 3083323 - RNA, 21 nt, Mycobacterium bovis subsp bovis AF2122/97
gcgcaaugcaucgcggcggcg

SEQ ID NO: 3083324 - RNA, 15 nt, Mycobacterium bovis subsp bovis AF2122/97
gcgcaaugcgcgacg

SEQ ID NO: 3083325 - RNA, 14 nt, Mycobacterium bovis subsp bovis AF2122/97
gcgcaaugcggccc

SEQ ID NO: 3083326 - RNA, 20 nt, Mycobacterium bovis subsp bovis AF2122/97
gcgcacaaacauacgccacc

SEQ ID NO: 3083327 - RNA, 16 nt, Mycobacterium bovis subsp bovis AF2122/97
gcgcacaacccgucga

SEQ ID NO: 3083328 - RNA, 22 nt, Mycobacterium bovis subsp bovis AF2122/97
gcgcacaacccgucgagccgug

SEQ ID NO: 3083329 - RNA, 16 nt, Mycobacterium bovis subsp bovis AF2122/97
gcgcacagcgagcaca

SEQ ID NO: 3083330 - RNA, 13 nt, Mycobacterium bovis subsp bovis AF2122/97
gcgcacaggcgcg

SEQ ID NO: 3083331 - RNA, 17 nt, Mycobacterium bovis subsp bovis AF2122/97
gcgcacagugucucaca

SEQ ID NO: 3083332 - RNA, 14 nt, Mycobacterium bovis subsp bovis AF2122/97
gcgcaccaaggccg

SEQ ID NO: 3083333 - RNA, 12 nt, Mycobacterium bovis subsp bovis AF2122/97
gcgcaccacacc

SEQ ID NO: 3083334 - RNA, 15 nt, Mycobacterium bovis subsp bovis AF2122/97
gcgcaccacaccacg

SEQ ID NO: 3083335 - RNA, 21 nt, Mycobacterium bovis subsp bovis AF2122/97
gcgcaccaccgccccgcgccc

SEQ ID NO: 3083336 - RNA, 18 nt, Mycobacterium bovis subsp bovis AF2122/97
gcgcaccaccgcggcggc

SEQ ID NO: 3083337 - RNA, 21 nt, Mycobacterium bovis subsp bovis AF2122/97
gcgcaccacggcggucaacgg

SEQ ID NO: 3083338 - RNA, 13 nt, Mycobacterium bovis subsp bovis AF2122/97
gcgcaccagcaca

SEQ ID NO: 3083339 - RNA, 13 nt, Mycobacterium bovis subsp bovis AF2122/97
gcgcaccagcggc

SEQ ID NO: 3083340 - RNA, 18 nt, Mycobacterium bovis subsp bovis AF2122/97
gcgcaccagcggcugacc

SEQ ID NO: 3083341 - RNA, 19 nt, Mycobacterium bovis subsp bovis AF2122/97
gcgcaccagcggcugaccg

SEQ ID NO: 3083342 - RNA, 15 nt, Mycobacterium bovis subsp bovis AF2122/97
gcgcaccaguccagc

SEQ ID NO: 3083343 - RNA, 19 nt, Mycobacterium bovis subsp bovis AF2122/97
gcgcaccaguccagcgggc

SEQ ID NO: 3083344 - RNA, 16 nt, Mycobacterium bovis subsp bovis AF2122/97
gcgcaccaucgcggcc

SEQ ID NO: 3083345 - RNA, 19 nt, Mycobacterium bovis subsp bovis AF2122/97
gcgcaccaucgcggccgcu

SEQ ID NO: 3083346 - RNA, 14 nt, Mycobacterium bovis subsp bovis AF2122/97
gcgcacccagccca

SEQ ID NO: 3083347 - RNA, 19 nt, Mycobacterium bovis subsp bovis AF2122/97
gcgcagcauggugcggcgg

SEQ ID NO: 3083348 - RNA, 21 nt, Mycobacterium bovis subsp bovis AF2122/97
gcgcagcauggugcggcggcg

SEQ ID NO: 3083349 - RNA, 14 nt, Mycobacterium bovis subsp bovis AF2122/97
gcgcagccaggcug

SEQ ID NO: 3083350 - RNA, 16 nt, Mycobacterium bovis subsp bovis AF2122/97
gcgcagccaggcugcg

SEQ ID NO: 3083351 - RNA, 13 nt, Mycobacterium bovis subsp bovis AF2122/97
gcgcagccaggga

SEQ ID NO: 3083352 - RNA, 21 nt, Mycobacterium bovis subsp bovis AF2122/97
gcgcagccaggugucgucgau

SEQ ID NO: 3083353 - RNA, 14 nt, Mycobacterium bovis subsp bovis AF2122/97
gcgcagccgcagcc

SEQ ID NO: 3083354 - RNA, 12 nt, Mycobacterium bovis subsp bovis AF2122/97
gcgcagccgccg

SEQ ID NO: 3083355 - RNA, 16 nt, Mycobacterium bovis subsp bovis AF2122/97
gcgcagccgccgcgcc

SEQ ID NO: 3083356 - RNA, 22 nt, Mycobacterium bovis subsp bovis AF2122/97
gcgcagccgccgcgccccgcgg

SEQ ID NO: 3083357 - RNA, 14 nt, Mycobacterium bovis subsp bovis AF2122/97
gcgcagccgcucga

SEQ ID NO: 3083358 - RNA, 14 nt, Mycobacterium bovis subsp bovis AF2122/97
gcgcagccggcccg

SEQ ID NO: 3083359 - RNA, 20 nt, Mycobacterium bovis subsp bovis AF2122/97
gcgcagccggcccgucgcgu

SEQ ID NO: 3083360 - RNA, 19 nt, Mycobacterium bovis subsp bovis AF2122/97
gcgcagccgggcaccgaac

SEQ ID NO: 3083361 - RNA, 17 nt, Mycobacterium bovis subsp bovis AF2122/97
gcgcagccgggccaacc

SEQ ID NO: 3083362 - RNA, 17 nt, Mycobacterium bovis subsp bovis AF2122/97
gcgcagccugccgauga

SEQ ID NO: 3083363 - RNA, 15 nt, Mycobacterium bovis subsp bovis AF2122/97
gcgcagccuggucgc

SEQ ID NO: 3083364 - RNA, 19 nt, Mycobacterium bovis subsp bovis AF2122/97
gcgcagccuggucgcgcag

SEQ ID NO: 3083365 - RNA, 20 nt, Mycobacterium bovis subsp bovis AF2122/97
gcgcagccuucucgcugacc

SEQ ID NO: 3083366 - RNA, 13 nt, Mycobacterium bovis subsp bovis AF2122/97
gcgcagcgaccgg

SEQ ID NO: 3083367 - RNA, 15 nt, Mycobacterium bovis subsp bovis AF2122/97
gcgcagcgcaaacau

SEQ ID NO: 3083368 - RNA, 14 nt, Mycobacterium bovis subsp bovis AF2122/97
gcgcagcgcaacau

SEQ ID NO: 3083369 - RNA, 14 nt, Mycobacterium bovis subsp bovis AF2122/97
gcgcagcgccagcg

SEQ ID NO: 3083370 - RNA, 14 nt, Mycobacterium bovis subsp bovis AF2122/97
gcgcagcgccaucg

SEQ ID NO: 3083371 - RNA, 17 nt, Mycobacterium bovis subsp bovis AF2122/97
gcgcagcgccgccaccc

SEQ ID NO: 3083372 - RNA, 19 nt, Mycobacterium bovis subsp bovis AF2122/97
gcgcagcgccgccaccccg

SEQ ID NO: 3083373 - RNA, 21 nt, Mycobacterium bovis subsp bovis AF2122/97
gcgcagcgccugcggcagcac

SEQ ID NO: 3083374 - RNA, 14 nt, Mycobacterium bovis subsp bovis AF2122/97
gcgcagcgcgaucg

SEQ ID NO: 3083375 - RNA, 15 nt, Mycobacterium bovis subsp bovis AF2122/97
gcgcagcgcgaucgc

SEQ ID NO: 3083376 - RNA, 19 nt, Mycobacterium bovis subsp bovis AF2122/97
gcgcagcgcgaugucgccg

SEQ ID NO: 3083377 - RNA, 19 nt, Mycobacterium bovis subsp bovis AF2122/97
gcgcagcgcggcggcaucu

SEQ ID NO: 3083378 - RNA, 17 nt, Mycobacterium bovis subsp bovis AF2122/97
gcgcagcgguccgccgc

SEQ ID NO: 3083379 - RNA, 14 nt, Mycobacterium bovis subsp bovis AF2122/97
gcgcagcgugagug

SEQ ID NO: 3083380 - RNA, 20 nt, Mycobacterium bovis subsp bovis AF2122/97
gcgcagcguguugcguucgg

SEQ ID NO: 3083381 - RNA, 23 nt, Mycobacterium bovis subsp bovis AF2122/97
gcgcagcuacuaccugcccguaa

SEQ ID NO: 3083382 - RNA, 22 nt, Mycobacterium bovis subsp bovis AF2122/97
gcgcagcuaugucaccugggcc

SEQ ID NO: 3083383 - RNA, 16 nt, Mycobacterium bovis subsp bovis AF2122/97
gcgcagcuccaccgug

SEQ ID NO: 3083384 - RNA, 22 nt, Mycobacterium bovis subsp bovis AF2122/97
gcgcagcuccaccgugacggcc

SEQ ID NO: 3083385 - RNA, 20 nt, Mycobacterium bovis subsp bovis AF2122/97
gcgcagcugacgucaccacg

SEQ ID NO: 3083386 - RNA, 12 nt, Mycobacterium bovis subsp bovis AF2122/97
gcgcagcugccg

SEQ ID NO: 3083387 - RNA, 14 nt, Mycobacterium bovis subsp bovis AF2122/97
gcgcagcugccgca

SEQ ID NO: 3083388 - RNA, 21 nt, Mycobacterium bovis subsp bovis AF2122/97
gcgcagcugccgcacccccuc

SEQ ID NO: 3083389 - RNA, 16 nt, Mycobacterium bovis subsp bovis AF2122/97
gcgcagcugggugcgc

SEQ ID NO: 3083390 - RNA, 17 nt, Mycobacterium bovis subsp bovis AF2122/97
gcgcagcugggugcgcc

SEQ ID NO: 3083391 - RNA, 16 nt, Mycobacterium bovis subsp bovis AF2122/97
gcgcagcuuggacacc

SEQ ID NO: 3083392 - RNA, 17 nt, Mycobacterium bovis subsp bovis AF2122/97
gcgcagcuuggccagcc

SEQ ID NO: 3083393 - RNA, 18 nt, Mycobacterium bovis subsp bovis AF2122/97
gcgcagcuuggccagcca

SEQ ID NO: 3083394 - RNA, 19 nt, Mycobacterium bovis subsp bovis AF2122/97
gcgcagcuuggccagccac

SEQ ID NO: 3083395 - RNA, 22 nt, Mycobacterium bovis subsp bovis AF2122/97
gcgcaggaagcccacgaucgcg

SEQ ID NO: 3083396 - RNA, 22 nt, Mycobacterium bovis subsp bovis AF2122/97
gcgcaggagcgcgaugaccucg

SEQ ID NO: 3083397 - RNA, 22 nt, Mycobacterium bovis subsp bovis AF2122/97
gcgcaggauguucaaucccucc

SEQ ID NO: 3083398 - RNA, 23 nt, Mycobacterium bovis subsp bovis AF2122/97
gcgcaggauucugcugaccauga

SEQ ID NO: 3083399 - RNA, 12 nt, Mycobacterium bovis subsp bovis AF2122/97
gcgcaggccgcc

SEQ ID NO: 3083400 - RNA, 15 nt, Mycobacterium bovis subsp bovis AF2122/97
gcgcaggccgccgcc

SEQ ID NO: 3083401 - RNA, 16 nt, Mycobacterium bovis subsp bovis AF2122/97
gcgcaggccgccgcca

SEQ ID NO: 3083402 - RNA, 21 nt, Mycobacterium bovis subsp bovis AF2122/97
gcgcaggcuuccagccacagc

SEQ ID NO: 3083403 - RNA, 16 nt, Mycobacterium bovis subsp bovis AF2122/97
gcgcagggccuggaag

SEQ ID NO: 3083404 - RNA, 13 nt, Mycobacterium bovis subsp bovis AF2122/97
gcgcagggcgaca

SEQ ID NO: 3083405 - RNA, 14 nt, Mycobacterium bovis subsp bovis AF2122/97
gcgcagggcgacau

SEQ ID NO: 3083406 - RNA, 14 nt, Mycobacterium bovis subsp bovis AF2122/97
gcgcagggcgucgg

SEQ ID NO: 3083407 - RNA, 15 nt, Mycobacterium bovis subsp bovis AF2122/97
gcgcagggcgucggc

SEQ ID NO: 3083408 - RNA, 16 nt, Mycobacterium bovis subsp bovis AF2122/97
gcgcagggcgucggcg

SEQ ID NO: 3083409 - RNA, 15 nt, Mycobacterium bovis subsp bovis AF2122/97
gcgcagguacgccuc

SEQ ID NO: 3083410 - RNA, 17 nt, Mycobacterium bovis subsp bovis AF2122/97
gcgcagguagccaucgg

SEQ ID NO: 3083411 - RNA, 14 nt, Mycobacterium bovis subsp bovis AF2122/97
gcgcaggucgccuu

SEQ ID NO: 3083412 - RNA, 23 nt, Mycobacterium bovis subsp bovis AF2122/97
gcgcaggugccuuucggcagacc

SEQ ID NO: 3083413 - RNA, 13 nt, Mycobacterium bovis subsp bovis AF2122/97
gcgcaggugcugg

SEQ ID NO: 3083414 - RNA, 18 nt, Mycobacterium bovis subsp bovis AF2122/97
gcgcagguucucggugcc

SEQ ID NO: 3083415 - RNA, 21 nt, Mycobacterium bovis subsp bovis AF2122/97
gcgcagguuggcaagcacggc

SEQ ID NO: 3083416 - RNA, 22 nt, Mycobacterium bovis subsp bovis AF2122/97
gcgcagguuggcaagcacggcg

SEQ ID NO: 3083417 - RNA, 18 nt, Mycobacterium bovis subsp bovis AF2122/97
gcccaggacagcagccgc

SEQ ID NO: 3083418 - RNA, 20 nt, Mycobacterium bovis subsp bovis AF2122/97
gcccaggacagcagccgccg

SEQ ID NO: 3083419 - RNA, 21 nt, Mycobacterium bovis subsp bovis AF2122/97
gcccaggacagcagccgccgg

SEQ ID NO: 3083420 - RNA, 22 nt, Mycobacterium bovis subsp bovis AF2122/97
gcccaggacagcagccgccggc

SEQ ID NO: 3083421 - RNA, 11 nt, Mycobacterium bovis subsp bovis AF2122/97
gcccaggacgg

SEQ ID NO: 3083422 - RNA, 17 nt, Mycobacterium bovis subsp bovis AF2122/97
gcccaggaucacgggug

SEQ ID NO: 3083423 - RNA, 15 nt, Mycobacterium bovis subsp bovis AF2122/97
gcccaggcauggccu

SEQ ID NO: 3083424 - RNA, 18 nt, Mycobacterium bovis subsp bovis AF2122/97
gcccaggccaagguggcc

SEQ ID NO: 3083425 - RNA, 18 nt, Mycobacterium bovis subsp bovis AF2122/97
gcccaggccaccggcugc

SEQ ID NO: 3083426 - RNA, 13 nt, Mycobacterium bovis subsp bovis AF2122/97
gcccaggccgauc

SEQ ID NO: 3083427 - RNA, 16 nt, Mycobacterium bovis subsp bovis AF2122/97
gcccaggccgaucagc

SEQ ID NO: 3083428 - RNA, 17 nt, Mycobacterium bovis subsp bovis AF2122/97
gcccaggccgaucagcg

SEQ ID NO: 3083429 - RNA, 18 nt, Mycobacterium bovis subsp bovis AF2122/97
gcccaggcgaccgcugag

SEQ ID NO: 3083430 - RNA, 19 nt, Mycobacterium bovis subsp bovis AF2122/97
gcccaggcgaucgcccggc

SEQ ID NO: 3083431 - RNA, 21 nt, Mycobacterium bovis subsp bovis AF2122/97
gcccaggcgaucgcccggccc

SEQ ID NO: 3083432 - RNA, 18 nt, Mycobacterium bovis subsp bovis AF2122/97
gcccaggcgcgacguacg

SEQ ID NO: 3083433 - RNA, 22 nt, Mycobacterium bovis subsp bovis AF2122/97
gcccaggcguccaucagagaca

SEQ ID NO: 3083434 - RNA, 22 nt, Mycobacterium bovis subsp bovis AF2122/97
gcccaggcgugucgucgcggcc

SEQ ID NO: 3083435 - RNA, 15 nt, Mycobacterium bovis subsp bovis AF2122/97
gcccagggcgucggc

SEQ ID NO: 3083436 - RNA, 16 nt, Mycobacterium bovis subsp bovis AF2122/97
gcccagggcgucggcg

SEQ ID NO: 3083437 - RNA, 11 nt, Mycobacterium bovis subsp bovis AF2122/97
gcccagggugg

SEQ ID NO: 3083438 - RNA, 14 nt, Mycobacterium bovis subsp bovis AF2122/97
gcccaggguguccg

SEQ ID NO: 3083439 - RNA, 20 nt, Mycobacterium bovis subsp bovis AF2122/97
gcccaggguguccgucgaac

SEQ ID NO: 3083440 - RNA, 18 nt, Mycobacterium bovis subsp bovis AF2122/97
gcccaggucaacgacguu

SEQ ID NO: 3083441 - RNA, 17 nt, Mycobacterium bovis subsp bovis AF2122/97
gcccaggucgaugcggg

SEQ ID NO: 3083442 - RNA, 18 nt, Mycobacterium bovis subsp bovis AF2122/97
gcccaggucgaugcgggc

SEQ ID NO: 3083443 - RNA, 15 nt, Mycobacterium bovis subsp bovis AF2122/97
gcccaggucuccauc

SEQ ID NO: 3083444 - RNA, 22 nt, Mycobacterium bovis subsp bovis AF2122/97
gcccaggucuccaucaaccgcg

SEQ ID NO: 3083445 - RNA, 21 nt, Mycobacterium bovis subsp bovis AF2122/97
gcccaggugacgcccgcuccg

SEQ ID NO: 3083446 - RNA, 15 nt, Mycobacterium bovis subsp bovis AF2122/97
gcccaggugaucgcg

SEQ ID NO: 3083447 - RNA, 20 nt, Mycobacterium bovis subsp bovis AF2122/97
gcccaggugaucgcgaggcu

SEQ ID NO: 3083448 - RNA, 22 nt, Mycobacterium bovis subsp bovis AF2122/97
gcccaggugggccgagagcagc

SEQ ID NO: 3083449 - RNA, 19 nt, Mycobacterium bovis subsp bovis AF2122/97
gcccagguguguggcggcg

SEQ ID NO: 3083450 - RNA, 22 nt, Mycobacterium bovis subsp bovis AF2122/97
gcccagguguguggcggcgucc

SEQ ID NO: 3083451 - RNA, 17 nt, Mycobacterium bovis subsp bovis AF2122/97
gcccaguacguuggugu

SEQ ID NO: 3083452 - RNA, 16 nt, Mycobacterium bovis subsp bovis AF2122/97
gcccaguagaucgcga

SEQ ID NO: 3083453 - RNA, 13 nt, Mycobacterium bovis subsp bovis AF2122/97
gcccagucgccgc

SEQ ID NO: 3083454 - RNA, 14 nt, Mycobacterium bovis subsp bovis AF2122/97
gcccagucgccgcg

SEQ ID NO: 3083455 - RNA, 18 nt, Mycobacterium bovis subsp bovis AF2122/97
gcccagugaaucggaccg

SEQ ID NO: 3083456 - RNA, 13 nt, Mycobacterium bovis subsp bovis AF2122/97
gcccagugcgcaa

SEQ ID NO: 3083457 - RNA, 21 nt, Mycobacterium bovis subsp bovis AF2122/97
gcccagugggacaggucggca

SEQ ID NO: 3083458 - RNA, 20 nt, Mycobacterium bovis subsp bovis AF2122/97
gcccagugggacuggcguga

SEQ ID NO: 3083459 - RNA, 16 nt, Mycobacterium bovis subsp bovis AF2122/97
gcccaguuccgcugcg

SEQ ID NO: 3083460 - RNA, 21 nt, Mycobacterium bovis subsp bovis AF2122/97
gcccaguuccgcugcggugcc

SEQ ID NO: 3083461 - RNA, 12 nt, Mycobacterium bovis subsp bovis AF2122/97
gcccaguugggc

SEQ ID NO: 3083462 - RNA, 22 nt, Mycobacterium bovis subsp bovis AF2122/97
gcccaguugggccucagcuacc

SEQ ID NO: 3083463 - RNA, 17 nt, Mycobacterium bovis subsp bovis AF2122/97
gcccauaacagcuggcg

SEQ ID NO: 3083464 - RNA, 18 nt, Mycobacterium bovis subsp bovis AF2122/97
gcccauacgugccgccga

SEQ ID NO: 3083465 - RNA, 19 nt, Mycobacterium bovis subsp bovis AF2122/97
gcccauacgugccgccgau

SEQ ID NO: 3083466 - RNA, 16 nt, Mycobacterium bovis subsp bovis AF2122/97
gcccauagcaccucga

SEQ ID NO: 3083467 - RNA, 22 nt, Mycobacterium bovis subsp bovis AF2122/97
gcccauagccaggugugcggaa

SEQ ID NO: 3083468 - RNA, 14 nt, Mycobacterium bovis subsp bovis AF2122/97
gcccaucacacccg

SEQ ID NO: 3083469 - RNA, 17 nt, Mycobacterium bovis subsp bovis AF2122/97
gcccaucacacccggua

SEQ ID NO: 3083470 - RNA, 12 nt, Mycobacterium bovis subsp bovis AF2122/97
gcccaucccgau

SEQ ID NO: 3083471 - RNA, 13 nt, Mycobacterium bovis subsp bovis AF2122/97
gcccaucccggcc

SEQ ID NO: 3083472 - RNA, 15 nt, Mycobacterium bovis subsp bovis AF2122/97
gcccaucccggccga

SEQ ID NO: 3083473 - RNA, 22 nt, Mycobacterium bovis subsp bovis AF2122/97
gcccaucccgguuccggcgauc

SEQ ID NO: 3083474 - RNA, 14 nt, Mycobacterium bovis subsp bovis AF2122/97
gcccauccggccgu

SEQ ID NO: 3083475 - RNA, 21 nt, Mycobacterium bovis subsp bovis AF2122/97
gcccauccggccgucgggcag

SEQ ID NO: 3083476 - RNA, 22 nt, Mycobacterium bovis subsp bovis AF2122/97
gcccauccggccgucgggcagc

SEQ ID NO: 3083477 - RNA, 15 nt, Mycobacterium bovis subsp bovis AF2122/97
gcccaucgcgacggc

SEQ ID NO: 3083478 - RNA, 23 nt, Mycobacterium bovis subsp bovis AF2122/97
gcccaucgcgacuagacgccgcc

SEQ ID NO: 3083479 - RNA, 14 nt, Mycobacterium bovis subsp bovis AF2122/97
gcccaucucaugca

SEQ ID NO: 3083480 - RNA, 21 nt, Mycobacterium bovis subsp bovis AF2122/97
gcccaucucaugcaucugcuu

SEQ ID NO: 3083481 - RNA, 15 nt, Mycobacterium bovis subsp bovis AF2122/97
gcccaucuugaccaa

SEQ ID NO: 3083482 - RNA, 16 nt, Mycobacterium bovis subsp bovis AF2122/97
gcccaugaccggccgc

SEQ ID NO: 3083483 - RNA, 19 nt, Mycobacterium bovis subsp bovis AF2122/97
gcccaugaugcucgaugau

SEQ ID NO: 3083484 - RNA, 20 nt, Mycobacterium bovis subsp bovis AF2122/97
gcccaugauggccgcggcuc

SEQ ID NO: 3083485 - RNA, 15 nt, Mycobacterium bovis subsp bovis AF2122/97
gcccaugauggucac

SEQ ID NO: 3083486 - RNA, 20 nt, Mycobacterium bovis subsp bovis AF2122/97
gcccaugccgggauugccgu

SEQ ID NO: 3083487 - RNA, 13 nt, Mycobacterium bovis subsp bovis AF2122/97
gcccaugcgccac

SEQ ID NO: 3083488 - RNA, 17 nt, Mycobacterium bovis subsp bovis AF2122/97
gcccaugcuucggagac

SEQ ID NO: 3083489 - RNA, 18 nt, Mycobacterium bovis subsp bovis AF2122/97
gcccaugcuucggagacc

SEQ ID NO: 3083490 - RNA, 21 nt, Mycobacterium bovis subsp bovis AF2122/97
gcccaugcuucggagaccgcc

SEQ ID NO: 3083491 - RNA, 14 nt, Mycobacterium bovis subsp bovis AF2122/97
gcccauggccacca

SEQ ID NO: 3083492 - RNA, 16 nt, Mycobacterium bovis subsp bovis AF2122/97
gcccauggccaccagg

SEQ ID NO: 3083493 - RNA, 22 nt, Mycobacterium bovis subsp bovis AF2122/97
gcccauucauaggcccgcacga

SEQ ID NO: 3083494 - RNA, 17 nt, Mycobacterium bovis subsp bovis AF2122/97
gcccauugacguagacc

SEQ ID NO: 3083495 - RNA, 21 nt, Mycobacterium bovis subsp bovis AF2122/97
gcccauugacguagaccgucg

SEQ ID NO: 3083496 - RNA, 22 nt, Mycobacterium bovis subsp bovis AF2122/97
gcccauugacguagaccgucga

SEQ ID NO: 3083497 - RNA, 15 nt, Mycobacterium bovis subsp bovis AF2122/97
gcccauuggccaggu

SEQ ID NO: 3083498 - RNA, 19 nt, Mycobacterium bovis subsp bovis AF2122/97
gcccauuggguaaccagcg

SEQ ID NO: 3083499 - RNA, 23 nt, Mycobacterium bovis subsp bovis AF2122/97
gcccauugucgaucaccugcagc

SEQ ID NO: 3083500 - RNA, 15 nt, Mycobacterium bovis subsp bovis AF2122/97
gcccauuucggcacg

SEQ ID NO: 3083501 - RNA, 21 nt, Mycobacterium bovis subsp bovis AF2122/97
gccccaacccuaaaccagcca

SEQ ID NO: 3083502 - RNA, 19 nt, Mycobacterium bovis subsp bovis AF2122/97
gccccaagcgugcugccgc

SEQ ID NO: 3083503 - RNA, 15 nt, Mycobacterium bovis subsp bovis AF2122/97
gccccacaacaugcu

SEQ ID NO: 3083504 - RNA, 19 nt, Mycobacterium bovis subsp bovis AF2122/97
gccccacaacaugcuggag

SEQ ID NO: 3083505 - RNA, 21 nt, Mycobacterium bovis subsp bovis AF2122/97
gccccacaaggguuggccgau

SEQ ID NO: 3083506 - RNA, 14 nt, Mycobacterium bovis subsp bovis AF2122/97
gccccacagcgugc

SEQ ID NO: 3083507 - RNA, 18 nt, Mycobacterium bovis subsp bovis AF2122/97
gccccaccauucgcgggc

SEQ ID NO: 3083508 - RNA, 17 nt, Mycobacterium bovis subsp bovis AF2122/97
gccccacccgcaugccc

SEQ ID NO: 3083509 - RNA, 18 nt, Mycobacterium bovis subsp bovis AF2122/97
gccccacccgcaugcccu

SEQ ID NO: 3083510 - RNA, 14 nt, Mycobacterium bovis subsp bovis AF2122/97
gccccacccgccgc

SEQ ID NO: 3083511 - RNA, 15 nt, Mycobacterium bovis subsp bovis AF2122/97
gccccacccgccgcc

SEQ ID NO: 3083512 - RNA, 16 nt, Mycobacterium bovis subsp bovis AF2122/97
gccccacccgccgccg

SEQ ID NO: 3083513 - RNA, 15 nt, Mycobacterium bovis subsp bovis AF2122/97
gccccacccgcggcg

SEQ ID NO: 3083514 - RNA, 16 nt, Mycobacterium bovis subsp bovis AF2122/97
gccccacccgcggcgc

SEQ ID NO: 3083515 - RNA, 18 nt, Mycobacterium bovis subsp bovis AF2122/97
gccccacccgcggcgccg

SEQ ID NO: 3083516 - RNA, 18 nt, Mycobacterium bovis subsp bovis AF2122/97
gccccaccgaacgugugg

SEQ ID NO: 3083517 - RNA, 14 nt, Mycobacterium bovis subsp bovis AF2122/97
gccccaccgcgccg

SEQ ID NO: 3083518 - RNA, 15 nt, Mycobacterium bovis subsp bovis AF2122/97
gccccaccggcccgg

SEQ ID NO: 3083519 - RNA, 17 nt, Mycobacterium bovis subsp bovis AF2122/97
gccccaccggcccggga

SEQ ID NO: 3083520 - RNA, 19 nt, Mycobacterium bovis subsp bovis AF2122/97
gccccaccggcccgggaaa

SEQ ID NO: 3083521 - RNA, 13 nt, Mycobacterium bovis subsp bovis AF2122/97
gccccaccggccg

SEQ ID NO: 3083522 - RNA, 15 nt, Mycobacterium bovis subsp bovis AF2122/97
gccccaccggccgaa

SEQ ID NO: 3083523 - RNA, 11 nt, Mycobacterium bovis subsp bovis AF2122/97
gccccaccggu

SEQ ID NO: 3083524 - RNA, 17 nt, Mycobacterium bovis subsp bovis AF2122/97
gccccaccggugccgcc

SEQ ID NO: 3083525 - RNA, 19 nt, Mycobacterium bovis subsp bovis AF2122/97
gccccaccggugccgccgu

SEQ ID NO: 3083526 - RNA, 17 nt, Mycobacterium bovis subsp bovis AF2122/97
gccccacuucgggcgga

SEQ ID NO: 3083527 - RNA, 14 nt, Mycobacterium bovis subsp bovis AF2122/97
gccccagacgcgca

SEQ ID NO: 3083528 - RNA, 23 nt, Mycobacterium bovis subsp bovis AF2122/97
gccccagauauugaaccgggcca

SEQ ID NO: 3083529 - RNA, 16 nt, Mycobacterium bovis subsp bovis AF2122/97
gccccagcgacgucgc

SEQ ID NO: 3083530 - RNA, 19 nt, Mycobacterium bovis subsp bovis AF2122/97
gccccagcgacgucgcaau

SEQ ID NO: 3083531 - RNA, 18 nt, Mycobacterium bovis subsp bovis AF2122/97
gccccagcugcggucgcg

SEQ ID NO: 3083532 - RNA, 22 nt, Mycobacterium bovis subsp bovis AF2122/97
gccccagcugcggucgcggcug

SEQ ID NO: 3083533 - RNA, 16 nt, Mycobacterium bovis subsp bovis AF2122/97
gccccaggacaccuug

SEQ ID NO: 3083534 - RNA, 22 nt, Mycobacterium bovis subsp bovis AF2122/97
gccccagggggcgugccgccgc

SEQ ID NO: 3083535 - RNA, 23 nt, Mycobacterium bovis subsp bovis AF2122/97
gccccagggggcgugccgccgca

SEQ ID NO: 3083536 - RNA, 16 nt, Mycobacterium bovis subsp bovis AF2122/97
gccccagguagucgac

SEQ ID NO: 3083537 - RNA, 19 nt, Mycobacterium bovis subsp bovis AF2122/97
gccccaggugguucaaccg

SEQ ID NO: 3083538 - RNA, 24 nt, Mycobacterium bovis subsp bovis AF2122/97
gccccaggugguucaaccggacga

SEQ ID NO: 3083539 - RNA, 15 nt, Mycobacterium bovis subsp bovis AF2122/97
gccccagguuccgcu

SEQ ID NO: 3083540 - RNA, 15 nt, Mycobacterium bovis subsp bovis AF2122/97
gccccaguccgaagc

SEQ ID NO: 3083541 - RNA, 17 nt, Mycobacterium bovis subsp bovis AF2122/97
gccccaguucgacggcg

SEQ ID NO: 3083542 - RNA, 16 nt, Mycobacterium bovis subsp bovis AF2122/97
gccccaucaccaccgg

SEQ ID NO: 3083543 - RNA, 21 nt, Mycobacterium bovis subsp bovis AF2122/97
gccccaugaucuggugcgcgg

SEQ ID NO: 3083544 - RNA, 17 nt, Mycobacterium bovis subsp bovis AF2122/97
gccccaugcaacacacc

SEQ ID NO: 3083545 - RNA, 18 nt, Mycobacterium bovis subsp bovis AF2122/97
gccccaugccgaccggca

SEQ ID NO: 3083546 - RNA, 15 nt, Mycobacterium bovis subsp bovis AF2122/97
gccccaugcgccagc

SEQ ID NO: 3083547 - RNA, 16 nt, Mycobacterium bovis subsp bovis AF2122/97
gccccaugggggaacc

SEQ ID NO: 3083548 - RNA, 21 nt, Mycobacterium bovis subsp bovis AF2122/97
gcccccaacgcgguaaagccc

SEQ ID NO: 3083549 - RNA, 23 nt, Mycobacterium bovis subsp bovis AF2122/97
gcccccaacgcgguaaagccccg

SEQ ID NO: 3083550 - RNA, 12 nt, Mycobacterium bovis subsp bovis AF2122/97
gcccccagggcc

SEQ ID NO: 3083551 - RNA, 13 nt, Mycobacterium bovis subsp bovis AF2122/97
gcccccagguaac

SEQ ID NO: 3083552 - RNA, 20 nt, Mycobacterium bovis subsp bovis AF2122/97
gcccccagugcacgcucggc

SEQ ID NO: 3083553 - RNA, 15 nt, Mycobacterium bovis subsp bovis AF2122/97
gcccccaguucggcg

SEQ ID NO: 3083554 - RNA, 18 nt, Mycobacterium bovis subsp bovis AF2122/97
gcccccauaacugcggcc

SEQ ID NO: 3083555 - RNA, 16 nt, Mycobacterium bovis subsp bovis AF2122/97
gcccccauccggucga

SEQ ID NO: 3083556 - RNA, 21 nt, Mycobacterium bovis subsp bovis AF2122/97
gcccccauugccgccgucgcc

SEQ ID NO: 3083557 - RNA, 13 nt, Mycobacterium bovis subsp bovis AF2122/97
gccccccacggcc

SEQ ID NO: 3083558 - RNA, 20 nt, Mycobacterium bovis subsp bovis AF2122/97
gccccccgagcuguggucac

SEQ ID NO: 3083559 - RNA, 14 nt, Mycobacterium bovis subsp bovis AF2122/97
gccccccgcgccug

SEQ ID NO: 3083560 - RNA, 17 nt, Mycobacterium bovis subsp bovis AF2122/97
gccccccgcgccugccu

SEQ ID NO: 3083561 - RNA, 16 nt, Mycobacterium bovis subsp bovis AF2122/97
gccccccggcgacggc

SEQ ID NO: 3083562 - RNA, 20 nt, Mycobacterium bovis subsp bovis AF2122/97
gccccccggcgacggcguag

SEQ ID NO: 3083563 - RNA, 22 nt, Mycobacterium bovis subsp bovis AF2122/97
gccccccggcgacggcguagcc

SEQ ID NO: 3083564 - RNA, 13 nt, Mycobacterium bovis subsp bovis AF2122/97
gccccccggggcc

SEQ ID NO: 3083565 - RNA, 14 nt, Mycobacterium bovis subsp bovis AF2122/97
gcccccgacacgcc

SEQ ID NO: 3083566 - RNA, 17 nt, Mycobacterium bovis subsp bovis AF2122/97
gcccccgcacgcucgcc

SEQ ID NO: 3083567 - RNA, 17 nt, Mycobacterium bovis subsp bovis AF2122/97
gcccccgccacgccgaa

SEQ ID NO: 3083568 - RNA, 21 nt, Mycobacterium bovis subsp bovis AF2122/97
gcccccgccauugccgccggc

SEQ ID NO: 3083569 - RNA, 13 nt, Mycobacterium bovis subsp bovis AF2122/97
gcccccgccggcc

SEQ ID NO: 3083570 - RNA, 14 nt, Mycobacterium bovis subsp bovis AF2122/97
gcccccgccggccg

SEQ ID NO: 3083571 - RNA, 15 nt, Mycobacterium bovis subsp bovis AF2122/97
gcccccgccggccgc

SEQ ID NO: 3083572 - RNA, 18 nt, Mycobacterium bovis subsp bovis AF2122/97
gcccccgccggccgcgcc

SEQ ID NO: 3083573 - RNA, 20 nt, Mycobacterium bovis subsp bovis AF2122/97
gcccccgccggccgcgccgg

SEQ ID NO: 3083574 - RNA, 14 nt, Mycobacterium bovis subsp bovis AF2122/97
gcccccgcgggggc

SEQ ID NO: 3083575 - RNA, 21 nt, Mycobacterium bovis subsp bovis AF2122/97
gcccccgcgggggcggccggc

SEQ ID NO: 3083576 - RNA, 16 nt, Mycobacterium bovis subsp bovis AF2122/97
gcccccggccauggcg

SEQ ID NO: 3083577 - RNA, 14 nt, Mycobacterium bovis subsp bovis AF2122/97
gcccccggcgcggc

SEQ ID NO: 3083578 - RNA, 16 nt, Mycobacterium bovis subsp bovis AF2122/97
gcccccggcgcggcgg

SEQ ID NO: 3083579 - RNA, 20 nt, Mycobacterium bovis subsp bovis AF2122/97
gcccccggcgcggcggaccg

SEQ ID NO: 3083580 - RNA, 11 nt, Mycobacterium bovis subsp bovis AF2122/97
gcccccggugc

SEQ ID NO: 3083581 - RNA, 14 nt, Mycobacterium bovis subsp bovis AF2122/97
gcccccggugccgc

SEQ ID NO: 3083582 - RNA, 21 nt, Mycobacterium bovis subsp bovis AF2122/97
gcccccggugccgcccgcgcc

SEQ ID NO: 3083583 - RNA, 21 nt, Mycobacterium bovis subsp bovis AF2122/97
gcccccgugggguguggcggc

SEQ ID NO: 3083584 - RNA, 20 nt, Mycobacterium bovis subsp bovis AF2122/97
gcccccguucuggaaccccg

SEQ ID NO: 3083585 - RNA, 22 nt, Mycobacterium bovis subsp bovis AF2122/97
gcccccguucuggaaccccgag

SEQ ID NO: 3083586 - RNA, 16 nt, Mycobacterium bovis subsp bovis AF2122/97
gcccccguugccgccu

SEQ ID NO: 3083587 - RNA, 17 nt, Mycobacterium bovis subsp bovis AF2122/97
gcccccguugccgccug

SEQ ID NO: 3083588 - RNA, 21 nt, Mycobacterium bovis subsp bovis AF2122/97
gcccccguuuacggcccggca

SEQ ID NO: 3083589 - RNA, 16 nt, Mycobacterium bovis subsp bovis AF2122/97
gcccccuggauggcgc

SEQ ID NO: 3083590 - RNA, 23 nt, Mycobacterium bovis subsp bovis AF2122/97
gcccccuggauggcgcccugcgc

SEQ ID NO: 3083591 - RNA, 15 nt, Mycobacterium bovis subsp bovis AF2122/97
gccccgaaacgaugg

SEQ ID NO: 3083592 - RNA, 16 nt, Mycobacterium bovis subsp bovis AF2122/97
gccccgaaacgauggc

SEQ ID NO: 3083593 - RNA, 16 nt, Mycobacterium bovis subsp bovis AF2122/97
gccccgaagccggugc

SEQ ID NO: 3083594 - RNA, 15 nt, Mycobacterium bovis subsp bovis AF2122/97
gccccgaagcgggcg

SEQ ID NO: 3083595 - RNA, 13 nt, Mycobacterium bovis subsp bovis AF2122/97
gccccgaccagca

SEQ ID NO: 3083596 - RNA, 15 nt, Mycobacterium bovis subsp bovis AF2122/97
gccccgaccagcaga

SEQ ID NO: 3083597 - RNA, 16 nt, Mycobacterium bovis subsp bovis AF2122/97
gccccgaccgcguaca

SEQ ID NO: 3083598 - RNA, 23 nt, Mycobacterium bovis subsp bovis AF2122/97
gccccgaccgcguacaggccggc

SEQ ID NO: 3083599 - RNA, 13 nt, Mycobacterium bovis subsp bovis AF2122/97
gccccgacgguca

SEQ ID NO: 3083600 - RNA, 16 nt, Mycobacterium bovis subsp bovis AF2122/97
gccccgacugacagaa

SEQ ID NO: 3083601 - RNA, 15 nt, Mycobacterium bovis subsp bovis AF2122/97
gccccgacugcgccc

SEQ ID NO: 3083602 - RNA, 12 nt, Mycobacterium bovis subsp bovis AF2122/97
gccccgagcugc

SEQ ID NO: 3083603 - RNA, 16 nt, Mycobacterium bovis subsp bovis AF2122/97
gccccgaggaugccga

SEQ ID NO: 3083604 - RNA, 19 nt, Mycobacterium bovis subsp bovis AF2122/97
gccccgaggaugccgaacc

SEQ ID NO: 3083605 - RNA, 23 nt, Mycobacterium bovis subsp bovis AF2122/97
gccccgauaaaaaccacccccac

SEQ ID NO: 3083606 - RNA, 17 nt, Mycobacterium bovis subsp bovis AF2122/97
gccccgaucaucgacga

SEQ ID NO: 3083607 - RNA, 13 nt, Mycobacterium bovis subsp bovis AF2122/97
gccccgaucccga

SEQ ID NO: 3083608 - RNA, 15 nt, Mycobacterium bovis subsp bovis AF2122/97
gccccgaugaccgcc

SEQ ID NO: 3083609 - RNA, 21 nt, Mycobacterium bovis subsp bovis AF2122/97
gccccgcaggggguggugucg

SEQ ID NO: 3083610 - RNA, 12 nt, Mycobacterium bovis subsp bovis AF2122/97
gccccgcaucgc

SEQ ID NO: 3083611 - RNA, 18 nt, Mycobacterium bovis subsp bovis AF2122/97
gccccgcaucgcccaagc

SEQ ID NO: 3083612 - RNA, 16 nt, Mycobacterium bovis subsp bovis AF2122/97
gccccgccaccucgcc

SEQ ID NO: 3083613 - RNA, 19 nt, Mycobacterium bovis subsp bovis AF2122/97
gccccgccaccucgccggc

SEQ ID NO: 3083614 - RNA, 13 nt, Mycobacterium bovis subsp bovis AF2122/97
gccccgccagcgc

SEQ ID NO: 3083615 - RNA, 14 nt, Mycobacterium bovis subsp bovis AF2122/97
gccccgccagcggc

SEQ ID NO: 3083616 - RNA, 15 nt, Mycobacterium bovis subsp bovis AF2122/97
gccccgccagcggca

SEQ ID NO: 3083617 - RNA, 18 nt, Mycobacterium bovis subsp bovis AF2122/97
gccccgccagcggcagcg

SEQ ID NO: 3083618 - RNA, 14 nt, Mycobacterium bovis subsp bovis AF2122/97
gccccgcccgcacc

SEQ ID NO: 3083619 - RNA, 12 nt, Mycobacterium bovis subsp bovis AF2122/97
gccccgccgagc

SEQ ID NO: 3083620 - RNA, 15 nt, Mycobacterium bovis subsp bovis AF2122/97
gccccgccgagcacc

SEQ ID NO: 3083621 - RNA, 14 nt, Mycobacterium bovis subsp bovis AF2122/97
gccccgccgagcgg

SEQ ID NO: 3083622 - RNA, 17 nt, Mycobacterium bovis subsp bovis AF2122/97
gccccgccgaugccgcc

SEQ ID NO: 3083623 - RNA, 19 nt, Mycobacterium bovis subsp bovis AF2122/97
gccccgccgaugccgccgg

SEQ ID NO: 3083624 - RNA, 22 nt, Mycobacterium bovis subsp bovis AF2122/97
gccccgccgaugccgccggccc

SEQ ID NO: 3083625 - RNA, 13 nt, Mycobacterium bovis subsp bovis AF2122/97
gccccgccgccgg

SEQ ID NO: 3083626 - RNA, 14 nt, Mycobacterium bovis subsp bovis AF2122/97
gccccgccgcuacc

SEQ ID NO: 3083627 - RNA, 13 nt, Mycobacterium bovis subsp bovis AF2122/97
gccccgccggcgc

SEQ ID NO: 3083628 - RNA, 14 nt, Mycobacterium bovis subsp bovis AF2122/97
gccccgccggcgcc

SEQ ID NO: 3083629 - RNA, 15 nt, Mycobacterium bovis subsp bovis AF2122/97
gccccgccggcgccg

SEQ ID NO: 3083630 - RNA, 18 nt, Mycobacterium bovis subsp bovis AF2122/97
gccccgccggcgccgccc

SEQ ID NO: 3083631 - RNA, 15 nt, Mycobacterium bovis subsp bovis AF2122/97
gccccgccgguggcc

SEQ ID NO: 3083632 - RNA, 16 nt, Mycobacterium bovis subsp bovis AF2122/97
gccccgccguaccgaa

SEQ ID NO: 3083633 - RNA, 14 nt, Mycobacterium bovis subsp bovis AF2122/97
gccccgccgucacc

SEQ ID NO: 3083634 - RNA, 16 nt, Mycobacterium bovis subsp bovis AF2122/97
gccccgccgucacccc

SEQ ID NO: 3083635 - RNA, 14 nt, Mycobacterium bovis subsp bovis AF2122/97
gccccgccgucgcc

SEQ ID NO: 3083636 - RNA, 19 nt, Mycobacterium bovis subsp bovis AF2122/97
gccccgccgucgccgccgg

SEQ ID NO: 3083637 - RNA, 19 nt, Mycobacterium bovis subsp bovis AF2122/97
gccccgccguugccgccga

SEQ ID NO: 3083638 - RNA, 20 nt, Mycobacterium bovis subsp bovis AF2122/97
gccccgccguugccgccgac

SEQ ID NO: 3083639 - RNA, 22 nt, Mycobacterium bovis subsp bovis AF2122/97
gccccgccguuuccgccgccgc

SEQ ID NO: 3083640 - RNA, 15 nt, Mycobacterium bovis subsp bovis AF2122/97
gccccgccuuggcca

SEQ ID NO: 3083641 - RNA, 17 nt, Mycobacterium bovis subsp bovis AF2122/97
gccccgccuuggccacc

SEQ ID NO: 3083642 - RNA, 18 nt, Mycobacterium bovis subsp bovis AF2122/97
gccccgccuuggccacca

SEQ ID NO: 3083643 - RNA, 19 nt, Mycobacterium bovis subsp bovis AF2122/97
gccccgccuuggccaccau

SEQ ID NO: 3083644 - RNA, 15 nt, Mycobacterium bovis subsp bovis AF2122/97
gccccgcgcccaccc

SEQ ID NO: 3083645 - RNA, 13 nt, Mycobacterium bovis subsp bovis AF2122/97
gccccgcgccggc

SEQ ID NO: 3083646 - RNA, 23 nt, Mycobacterium bovis subsp bovis AF2122/97
gccccgcgccggccgcacgccgg

SEQ ID NO: 3083647 - RNA, 15 nt, Mycobacterium bovis subsp bovis AF2122/97
gccccgcgcguucgg

SEQ ID NO: 3083648 - RNA, 17 nt, Mycobacterium bovis subsp bovis AF2122/97
gccccgcgcguucggcg

SEQ ID NO: 3083649 - RNA, 21 nt, Mycobacterium bovis subsp bovis AF2122/97
gccccgcgcguucggcgagca

SEQ ID NO: 3083650 - RNA, 15 nt, Mycobacterium bovis subsp bovis AF2122/97
gccccgcggagcgca

SEQ ID NO: 3083651 - RNA, 16 nt, Mycobacterium bovis subsp bovis AF2122/97
gccccgcggcagacau

SEQ ID NO: 3083652 - RNA, 13 nt, Mycobacterium bovis subsp bovis AF2122/97
gccccgcggccag

SEQ ID NO: 3083653 - RNA, 14 nt, Mycobacterium bovis subsp bovis AF2122/97
gccccgcggccagc

SEQ ID NO: 3083654 - RNA, 15 nt, Mycobacterium bovis subsp bovis AF2122/97
gccccgcggccagca

SEQ ID NO: 3083655 - RNA, 18 nt, Mycobacterium bovis subsp bovis AF2122/97
gccccgcggccagcaccg

SEQ ID NO: 3083656 - RNA, 16 nt, Mycobacterium bovis subsp bovis AF2122/97
gccccgcggccagcag

SEQ ID NO: 3083657 - RNA, 17 nt, Mycobacterium bovis subsp bovis AF2122/97
gccccgcggccagcagc

SEQ ID NO: 3083658 - RNA, 12 nt, Mycobacterium bovis subsp bovis AF2122/97
gccccgcggcgc

SEQ ID NO: 3083659 - RNA, 14 nt, Mycobacterium bovis subsp bovis AF2122/97
gccccgcggcgccg

SEQ ID NO: 3083660 - RNA, 15 nt, Mycobacterium bovis subsp bovis AF2122/97
gccccgcggcgccgc

SEQ ID NO: 3083661 - RNA, 17 nt, Mycobacterium bovis subsp bovis AF2122/97
gccccgcggcgccgcca

SEQ ID NO: 3083662 - RNA, 12 nt, Mycobacterium bovis subsp bovis AF2122/97
gccccgcucggu

SEQ ID NO: 3083663 - RNA, 15 nt, Mycobacterium bovis subsp bovis AF2122/97
gccccgcuggucgac

SEQ ID NO: 3083664 - RNA, 18 nt, Mycobacterium bovis subsp bovis AF2122/97
gccccggacuccaaagcc

SEQ ID NO: 3083665 - RNA, 15 nt, Mycobacterium bovis subsp bovis AF2122/97
gccccggccaggaca

SEQ ID NO: 3083666 - RNA, 14 nt, Mycobacterium bovis subsp bovis AF2122/97
gccccggccgcugg

SEQ ID NO: 3083667 - RNA, 18 nt, Mycobacterium bovis subsp bovis AF2122/97
gccccggccgcuggcguu

SEQ ID NO: 3083668 - RNA, 21 nt, Mycobacterium bovis subsp bovis AF2122/97
gccccggccuuuacccgggcg

SEQ ID NO: 3083669 - RNA, 11 nt, Mycobacterium bovis subsp bovis AF2122/97
gccccggcgcg

SEQ ID NO: 3083670 - RNA, 14 nt, Mycobacterium bovis subsp bovis AF2122/97
gccccggcgcggcc

SEQ ID NO: 3083671 - RNA, 14 nt, Mycobacterium bovis subsp bovis AF2122/97
gccccggcgcuggu

SEQ ID NO: 3083672 - RNA, 15 nt, Mycobacterium bovis subsp bovis AF2122/97
gccccggcgcuggug

SEQ ID NO: 3083673 - RNA, 12 nt, Mycobacterium bovis subsp bovis AF2122/97
gccccggcggcg

SEQ ID NO: 3083674 - RNA, 13 nt, Mycobacterium bovis subsp bovis AF2122/97
gccccggcggcgg

SEQ ID NO: 3083675 - RNA, 14 nt, Mycobacterium bovis subsp bovis AF2122/97
gccccggcggcggc

SEQ ID NO: 3083676 - RNA, 18 nt, Mycobacterium bovis subsp bovis AF2122/97
gccccggcggcggcggcc

SEQ ID NO: 3083677 - RNA, 20 nt, Mycobacterium bovis subsp bovis AF2122/97
gccccggcggcggcggcccg

SEQ ID NO: 3083678 - RNA, 15 nt, Mycobacterium bovis subsp bovis AF2122/97
gccccggcgguaccg

SEQ ID NO: 3083679 - RNA, 22 nt, Mycobacterium bovis subsp bovis AF2122/97
gccccggcgguaccggagcagc

SEQ ID NO: 3083680 - RNA, 14 nt, Mycobacterium bovis subsp bovis AF2122/97
gccccggcucucuu

SEQ ID NO: 3083681 - RNA, 19 nt, Mycobacterium bovis subsp bovis AF2122/97
gccccggcuuucccaccgc

SEQ ID NO: 3083682 - RNA, 19 nt, Mycobacterium bovis subsp bovis AF2122/97
gccccgggccaccaguugu

SEQ ID NO: 3083683 - RNA, 18 nt, Mycobacterium bovis subsp bovis AF2122/97
gccccgggcggugaggca

SEQ ID NO: 3083684 - RNA, 17 nt, Mycobacterium bovis subsp bovis AF2122/97
gccccgggggaagcgcc

SEQ ID NO: 3083685 - RNA, 18 nt, Mycobacterium bovis subsp bovis AF2122/97
gccccgggggaagcgcca

SEQ ID NO: 3083686 - RNA, 18 nt, Mycobacterium bovis subsp bovis AF2122/97
gccccggggugcccccgg

SEQ ID NO: 3083687 - RNA, 14 nt, Mycobacterium bovis subsp bovis AF2122/97
gccccggucggcga

SEQ ID NO: 3083688 - RNA, 16 nt, Mycobacterium bovis subsp bovis AF2122/97
gccccgguggcaggga

SEQ ID NO: 3083689 - RNA, 17 nt, Mycobacterium bovis subsp bovis AF2122/97
gccccgguggcagggaa

SEQ ID NO: 3083690 - RNA, 16 nt, Mycobacterium bovis subsp bovis AF2122/97
gccccgucgaccucca

SEQ ID NO: 3083691 - RNA, 21 nt, Mycobacterium bovis subsp bovis AF2122/97
gccccgugggccucgaucagc

SEQ ID NO: 3083692 - RNA, 18 nt, Mycobacterium bovis subsp bovis AF2122/97
gccccguucacgcucgua

SEQ ID NO: 3083693 - RNA, 18 nt, Mycobacterium bovis subsp bovis AF2122/97
gccccguucgccaggccg

SEQ ID NO: 3083694 - RNA, 19 nt, Mycobacterium bovis subsp bovis AF2122/97
gccccguugagcagcaccc

SEQ ID NO: 3083695 - RNA, 18 nt, Mycobacterium bovis subsp bovis AF2122/97
gccccguuggucagcgug

SEQ ID NO: 3083696 - RNA, 15 nt, Mycobacterium bovis subsp bovis AF2122/97
gccccguugucgggg

SEQ ID NO: 3083697 - RNA, 17 nt, Mycobacterium bovis subsp bovis AF2122/97
gccccguuucggucgac

SEQ ID NO: 3083698 - RNA, 19 nt, Mycobacterium bovis subsp bovis AF2122/97
gccccuccaggggcuggug

SEQ ID NO: 3083699 - RNA, 13 nt, Mycobacterium bovis subsp bovis AF2122/97
gccccuccgcgcc

SEQ ID NO: 3083700 - RNA, 14 nt, Mycobacterium bovis subsp bovis AF2122/97
gccccuccgcgccg

SEQ ID NO: 3083701 - RNA, 16 nt, Mycobacterium bovis subsp bovis AF2122/97
gccccuccgcgccgau

SEQ ID NO: 3083702 - RNA, 20 nt, Mycobacterium bovis subsp bovis AF2122/97
gccccuccggccacacucgc

SEQ ID NO: 3083703 - RNA, 12 nt, Mycobacterium bovis subsp bovis AF2122/97
gccccucgucgu

SEQ ID NO: 3083704 - RNA, 18 nt, Mycobacterium bovis subsp bovis AF2122/97
gccccugaaggccagcca

SEQ ID NO: 3083705 - RNA, 13 nt, Mycobacterium bovis subsp bovis AF2122/97
gccccugcacagc

SEQ ID NO: 3083706 - RNA, 15 nt, Mycobacterium bovis subsp bovis AF2122/97
gccccugcacagcag

SEQ ID NO: 3083707 - RNA, 18 nt, Mycobacterium bovis subsp bovis AF2122/97
gccccugcacagcaggcu

SEQ ID NO: 3083708 - RNA, 15 nt, Mycobacterium bovis subsp bovis AF2122/97
gccccugccgauccc

SEQ ID NO: 3083709 - RNA, 16 nt, Mycobacterium bovis subsp bovis AF2122/97
gccccugcgcggccac

SEQ ID NO: 3083710 - RNA, 20 nt, Mycobacterium bovis subsp bovis AF2122/97
gccccugcgcggccaccuca

SEQ ID NO: 3083711 - RNA, 14 nt, Mycobacterium bovis subsp bovis AF2122/97
gccccuggccgccg

SEQ ID NO: 3083712 - RNA, 15 nt, Mycobacterium bovis subsp bovis AF2122/97
gccccuggccgccgc

SEQ ID NO: 3083713 - RNA, 19 nt, Mycobacterium bovis subsp bovis AF2122/97
gccccugguccacccguga

SEQ ID NO: 3083714 - RNA, 20 nt, Mycobacterium bovis subsp bovis AF2122/97
gccccugucaacgccgcggu

SEQ ID NO: 3083715 - RNA, 23 nt, Mycobacterium bovis subsp bovis AF2122/97
gccccugucauguccugggccgc

SEQ ID NO: 3083716 - RNA, 18 nt, Mycobacterium bovis subsp bovis AF2122/97
gccccuucaaagcggccu

SEQ ID NO: 3083717 - RNA, 19 nt, Mycobacterium bovis subsp bovis AF2122/97
gccccuucaaagcggccuc

SEQ ID NO: 3083718 - RNA, 23 nt, Mycobacterium bovis subsp bovis AF2122/97
gccccuucgcagcauguggccgc

SEQ ID NO: 3083719 - RNA, 19 nt, Mycobacterium bovis subsp bovis AF2122/97
gccccuucgcgagcagacg

SEQ ID NO: 3083720 - RNA, 15 nt, Mycobacterium bovis subsp bovis AF2122/97
gccccuuucugaagc

SEQ ID NO: 3083721 - RNA, 16 nt, Mycobacterium bovis subsp bovis AF2122/97
gccccuuuugccgcag

SEQ ID NO: 3083722 - RNA, 21 nt, Mycobacterium bovis subsp bovis AF2122/97
gcccgaaaugccgggcccgac

SEQ ID NO: 3083723 - RNA, 14 nt, Mycobacterium bovis subsp bovis AF2122/97
gcccgaaccaccac

SEQ ID NO: 3083724 - RNA, 18 nt, Mycobacterium bovis subsp bovis AF2122/97
gcccgaaccaccaccggc

SEQ ID NO: 3083725 - RNA, 21 nt, Mycobacterium bovis subsp bovis AF2122/97
gcccgaaccaccaccggcaac

SEQ ID NO: 3083726 - RNA, 22 nt, Mycobacterium bovis subsp bovis AF2122/97
gcccgaaccaccaccggcaaca

SEQ ID NO: 3083727 - RNA, 15 nt, Mycobacterium bovis subsp bovis AF2122/97
gcccgaaccaccgcg

SEQ ID NO: 3083728 - RNA, 18 nt, Mycobacterium bovis subsp bovis AF2122/97
gcccgaaccaccgcguug

SEQ ID NO: 3083729 - RNA, 21 nt, Mycobacterium bovis subsp bovis AF2122/97
gcccgaacgaggcgcccagcg

SEQ ID NO: 3083730 - RNA, 22 nt, Mycobacterium bovis subsp bovis AF2122/97
gcccgaacgaggcgcccagcga

SEQ ID NO: 3083731 - RNA, 23 nt, Mycobacterium bovis subsp bovis AF2122/97
gcccgaacgaggcgcccagcgac

SEQ ID NO: 3083732 - RNA, 20 nt, Mycobacterium bovis subsp bovis AF2122/97
gcccgaacucguuggcgaac

SEQ ID NO: 3083733 - RNA, 14 nt, Mycobacterium bovis subsp bovis AF2122/97
gcccgaacuucugg

SEQ ID NO: 3083734 - RNA, 22 nt, Mycobacterium bovis subsp bovis AF2122/97
gcccgaacuucugguaggcggc

SEQ ID NO: 3083735 - RNA, 23 nt, Mycobacterium bovis subsp bovis AF2122/97
gcccgaagaaugggauggcacca

SEQ ID NO: 3083736 - RNA, 22 nt, Mycobacterium bovis subsp bovis AF2122/97
gcccgaagacggggugguggug

SEQ ID NO: 3083737 - RNA, 14 nt, Mycobacterium bovis subsp bovis AF2122/97
gcccgaagccgggc

SEQ ID NO: 3083738 - RNA, 22 nt, Mycobacterium bovis subsp bovis AF2122/97
gcccgaaggcggcuccaccggg

SEQ ID NO: 3083739 - RNA, 17 nt, Mycobacterium bovis subsp bovis AF2122/97
gcccgaaucucgccccc

SEQ ID NO: 3083740 - RNA, 21 nt, Mycobacterium bovis subsp bovis AF2122/97
gcccgaaugcggugaguccgc

SEQ ID NO: 3083741 - RNA, 12 nt, Mycobacterium bovis subsp bovis AF2122/97
gcccgacacccg

SEQ ID NO: 3083742 - RNA, 18 nt, Mycobacterium bovis subsp bovis AF2122/97
gcccgacacccgcauggc

SEQ ID NO: 3083743 - RNA, 13 nt, Mycobacterium bovis subsp bovis AF2122/97
gcccgacacccgu

SEQ ID NO: 3083744 - RNA, 22 nt, Mycobacterium bovis subsp bovis AF2122/97
gcccgacaccgaucggacgucg

SEQ ID NO: 3083745 - RNA, 17 nt, Mycobacterium bovis subsp bovis AF2122/97
gcccgacaccgccccgc

SEQ ID NO: 3083746 - RNA, 22 nt, Mycobacterium bovis subsp bovis AF2122/97
gcccgacaccgccccgccgcga

SEQ ID NO: 3083747 - RNA, 17 nt, Mycobacterium bovis subsp bovis AF2122/97
gcccgacaccguccagc

SEQ ID NO: 3083748 - RNA, 18 nt, Mycobacterium bovis subsp bovis AF2122/97
gcccgacaccguccagca

SEQ ID NO: 3083749 - RNA, 17 nt, Mycobacterium bovis subsp bovis AF2122/97
gcccgacagauggucac

SEQ ID NO: 3083750 - RNA, 22 nt, Mycobacterium bovis subsp bovis AF2122/97
gcccgacagcagguugccgaag

SEQ ID NO: 3083751 - RNA, 21 nt, Mycobacterium bovis subsp bovis AF2122/97
gcccgacaguggucccgguga

SEQ ID NO: 3083752 - RNA, 17 nt, Mycobacterium bovis subsp bovis AF2122/97
gcccgacaugaauccac

SEQ ID NO: 3083753 - RNA, 23 nt, Mycobacterium bovis subsp bovis AF2122/97
gcccgaccacaccgggaugggag

SEQ ID NO: 3083754 - RNA, 14 nt, Mycobacterium bovis subsp bovis AF2122/97
gcccgacccaucac

SEQ ID NO: 3083755 - RNA, 17 nt, Mycobacterium bovis subsp bovis AF2122/97
gcccgacccaucaccag

SEQ ID NO: 3083756 - RNA, 21 nt, Mycobacterium bovis subsp bovis AF2122/97
gcccgacccaucaccagcggc

SEQ ID NO: 3083757 - RNA, 14 nt, Mycobacterium bovis subsp bovis AF2122/97
gcccgacccgccga

SEQ ID NO: 3083758 - RNA, 15 nt, Mycobacterium bovis subsp bovis AF2122/97
gcccgacccgccgac

SEQ ID NO: 3083759 - RNA, 15 nt, Mycobacterium bovis subsp bovis AF2122/97
gcccgacccgccgau

SEQ ID NO: 3083760 - RNA, 15 nt, Mycobacterium bovis subsp bovis AF2122/97
gcccgacccggccga

SEQ ID NO: 3083761 - RNA, 14 nt, Mycobacterium bovis subsp bovis AF2122/97
gcccgaccgggaac

SEQ ID NO: 3083762 - RNA, 20 nt, Mycobacterium bovis subsp bovis AF2122/97
gcccgaccggucuggcgaug

SEQ ID NO: 3083763 - RNA, 13 nt, Mycobacterium bovis subsp bovis AF2122/97
gcccgacgaccau

SEQ ID NO: 3083764 - RNA, 16 nt, Mycobacterium bovis subsp bovis AF2122/97
gcccgauggugccgac

SEQ ID NO: 3083765 - RNA, 17 nt, Mycobacterium bovis subsp bovis AF2122/97
gcccgauggugccgacc

SEQ ID NO: 3083766 - RNA, 18 nt, Mycobacterium bovis subsp bovis AF2122/97
gcccgauggugccgaccc

SEQ ID NO: 3083767 - RNA, 20 nt, Mycobacterium bovis subsp bovis AF2122/97
gcccgauggugccgacccgc

SEQ ID NO: 3083768 - RNA, 21 nt, Mycobacterium bovis subsp bovis AF2122/97
gcccgauggugccgacccgcc

SEQ ID NO: 3083769 - RNA, 17 nt, Mycobacterium bovis subsp bovis AF2122/97
gcccgaugguggugccg

SEQ ID NO: 3083770 - RNA, 20 nt, Mycobacterium bovis subsp bovis AF2122/97
gcccgaugucgucgacgagg

SEQ ID NO: 3083771 - RNA, 19 nt, Mycobacterium bovis subsp bovis AF2122/97
gcccgauucagcgccccau

SEQ ID NO: 3083772 - RNA, 19 nt, Mycobacterium bovis subsp bovis AF2122/97
gcccgcaaacagucggaga

SEQ ID NO: 3083773 - RNA, 19 nt, Mycobacterium bovis subsp bovis AF2122/97
gcccgcaacaucgggucgc

SEQ ID NO: 3083774 - RNA, 15 nt, Mycobacterium bovis subsp bovis AF2122/97
gcccgcaacgccaac

SEQ ID NO: 3083775 - RNA, 22 nt, Mycobacterium bovis subsp bovis AF2122/97
gcccgcaacgcgucggucgcgg

SEQ ID NO: 3083776 - RNA, 13 nt, Mycobacterium bovis subsp bovis AF2122/97
gcccgcaccacac

SEQ ID NO: 3083777 - RNA, 21 nt, Mycobacterium bovis subsp bovis AF2122/97
gcccgcaccacaccgugggcg

SEQ ID NO: 3083778 - RNA, 18 nt, Mycobacterium bovis subsp bovis AF2122/97
gcccgcaccaccggcccc

SEQ ID NO: 3083779 - RNA, 14 nt, Mycobacterium bovis subsp bovis AF2122/97
gcccgcaccagcug

SEQ ID NO: 3083780 - RNA, 21 nt, Mycobacterium bovis subsp bovis AF2122/97
gcccgcacccguccggccggg

SEQ ID NO: 3083781 - RNA, 23 nt, Mycobacterium bovis subsp bovis AF2122/97
gcccgcacccguccggccgggcc

SEQ ID NO: 3083782 - RNA, 23 nt, Mycobacterium bovis subsp bovis AF2122/97
gcccgcaccgcugaccccggcag

SEQ ID NO: 3083783 - RNA, 15 nt, Mycobacterium bovis subsp bovis AF2122/97
gcccgcacgaucucg

SEQ ID NO: 3083784 - RNA, 22 nt, Mycobacterium bovis subsp bovis AF2122/97
gcccgcacguuggcggccagcg

SEQ ID NO: 3083785 - RNA, 17 nt, Mycobacterium bovis subsp bovis AF2122/97
gcccgcacugccgccgg

SEQ ID NO: 3083786 - RNA, 13 nt, Mycobacterium bovis subsp bovis AF2122/97
gcccgcagcagca

SEQ ID NO: 3083787 - RNA, 13 nt, Mycobacterium bovis subsp bovis AF2122/97
gcccgcagcccgc

SEQ ID NO: 3083788 - RNA, 21 nt, Mycobacterium bovis subsp bovis AF2122/97
gcccgcagcccgccgggcucc

SEQ ID NO: 3083789 - RNA, 16 nt, Mycobacterium bovis subsp bovis AF2122/97
gcccgcaggacgcugc

SEQ ID NO: 3083790 - RNA, 19 nt, Mycobacterium bovis subsp bovis AF2122/97
gcccgcaggacgcugccgg

SEQ ID NO: 3083791 - RNA, 16 nt, Mycobacterium bovis subsp bovis AF2122/97
gcccgcagggccgccg

SEQ ID NO: 3083792 - RNA, 18 nt, Mycobacterium bovis subsp bovis AF2122/97
gcccgcaggucggccacc

SEQ ID NO: 3083793 - RNA, 18 nt, Mycobacterium bovis subsp bovis AF2122/97
gcccgcauccgcaccgaa

SEQ ID NO: 3083794 - RNA, 22 nt, Mycobacterium bovis subsp bovis AF2122/97
gcccgcauccgcaccgaaacca

SEQ ID NO: 3083795 - RNA, 16 nt, Mycobacterium bovis subsp bovis AF2122/97
gcccgcaucgccucga

SEQ ID NO: 3083796 - RNA, 22 nt, Mycobacterium bovis subsp bovis AF2122/97
gcccgcaucgccucgagguauu

SEQ ID NO: 3083797 - RNA, 14 nt, Mycobacterium bovis subsp bovis AF2122/97
gcccgcaucgcggc

SEQ ID NO: 3083798 - RNA, 17 nt, Mycobacterium bovis subsp bovis AF2122/97
gcccgcaucgcggcauc

SEQ ID NO: 3083799 - RNA, 22 nt, Mycobacterium bovis subsp bovis AF2122/97
gcccgcauugaucucgaccggc

SEQ ID NO: 3083800 - RNA, 19 nt, Mycobacterium bovis subsp bovis AF2122/97
gcccgccacaacggcggcg

SEQ ID NO: 3083801 - RNA, 13 nt, Mycobacterium bovis subsp bovis AF2122/97
gcccgccaccccg

SEQ ID NO: 3083802 - RNA, 16 nt, Mycobacterium bovis subsp bovis AF2122/97
gcccgccacccuuggc

SEQ ID NO: 3083803 - RNA, 18 nt, Mycobacterium bovis subsp bovis AF2122/97
gcccgccaccggaggugc

SEQ ID NO: 3083804 - RNA, 17 nt, Mycobacterium bovis subsp bovis AF2122/97
gcccgccaccggcgcga

SEQ ID NO: 3083805 - RNA, 21 nt, Mycobacterium bovis subsp bovis AF2122/97
gcccgccaccggcgcgaccgc

SEQ ID NO: 3083806 - RNA, 13 nt, Mycobacterium bovis subsp bovis AF2122/97
gcccgccaccggg

SEQ ID NO: 3083807 - RNA, 16 nt, Mycobacterium bovis subsp bovis AF2122/97
gcccgccacgaugucg

SEQ ID NO: 3083808 - RNA, 15 nt, Mycobacterium bovis subsp bovis AF2122/97
gcccgccacgcucgg

SEQ ID NO: 3083809 - RNA, 17 nt, Mycobacterium bovis subsp bovis AF2122/97
gcccgccacgcucgguu

SEQ ID NO: 3083810 - RNA, 22 nt, Mycobacterium bovis subsp bovis AF2122/97
gcccgccacguacuuggacgac

SEQ ID NO: 3083811 - RNA, 20 nt, Mycobacterium bovis subsp bovis AF2122/97
gcccgccagaacggcgucga

SEQ ID NO: 3083812 - RNA, 13 nt, Mycobacterium bovis subsp bovis AF2122/97
gcccgccagccca

SEQ ID NO: 3083813 - RNA, 16 nt, Mycobacterium bovis subsp bovis AF2122/97
gcccgccagcccagca

SEQ ID NO: 3083814 - RNA, 15 nt, Mycobacterium bovis subsp bovis AF2122/97
gcccgccagcgaucc

SEQ ID NO: 3083815 - RNA, 16 nt, Mycobacterium bovis subsp bovis AF2122/97
gcccgccagcgaucca

SEQ ID NO: 3083816 - RNA, 18 nt, Mycobacterium bovis subsp bovis AF2122/97
gcccgccagcgauccacc

SEQ ID NO: 3083817 - RNA, 12 nt, Mycobacterium bovis subsp bovis AF2122/97
gcccgccagcgc

SEQ ID NO: 3083818 - RNA, 13 nt, Mycobacterium bovis subsp bovis AF2122/97
gcccgccagcgcc

SEQ ID NO: 3083819 - RNA, 15 nt, Mycobacterium bovis subsp bovis AF2122/97
gcccgccagcgccgc

SEQ ID NO: 3083820 - RNA, 13 nt, Mycobacterium bovis subsp bovis AF2122/97
gcccgccaggaac

SEQ ID NO: 3083821 - RNA, 19 nt, Mycobacterium bovis subsp bovis AF2122/97
gcccgccaucagcccggcg

SEQ ID NO: 3083822 - RNA, 19 nt, Mycobacterium bovis subsp bovis AF2122/97
gcccgccaucauggcggcc

SEQ ID NO: 3083823 - RNA, 13 nt, Mycobacterium bovis subsp bovis AF2122/97
gcccgcccaccuc

SEQ ID NO: 3083824 - RNA, 15 nt, Mycobacterium bovis subsp bovis AF2122/97
gcccgcccaccucga

SEQ ID NO: 3083825 - RNA, 21 nt, Mycobacterium bovis subsp bovis AF2122/97
gcccgcccaccucgaucgcgc

SEQ ID NO: 3083826 - RNA, 22 nt, Mycobacterium bovis subsp bovis AF2122/97
gcccgcccaccucgaucgcgcc

SEQ ID NO: 3083827 - RNA, 16 nt, Mycobacterium bovis subsp bovis AF2122/97
gcccgcccagcccggc

SEQ ID NO: 3083828 - RNA, 13 nt, Mycobacterium bovis subsp bovis AF2122/97
gcccgccccgcgc

SEQ ID NO: 3083829 - RNA, 14 nt, Mycobacterium bovis subsp bovis AF2122/97
gcccgccccgcgcc

SEQ ID NO: 3083830 - RNA, 19 nt, Mycobacterium bovis subsp bovis AF2122/97
gcccgcccgucuuccagcc

SEQ ID NO: 3083831 - RNA, 22 nt, Mycobacterium bovis subsp bovis AF2122/97
gcccgcccuggcaacgacacgc

SEQ ID NO: 3083832 - RNA, 14 nt, Mycobacterium bovis subsp bovis AF2122/97
gcccgccgaucggg

SEQ ID NO: 3083833 - RNA, 14 nt, Mycobacterium bovis subsp bovis AF2122/97
gcccgccgccacca

SEQ ID NO: 3083834 - RNA, 18 nt, Mycobacterium bovis subsp bovis AF2122/97
gcccgccgccaccagcug

SEQ ID NO: 3083835 - RNA, 14 nt, Mycobacterium bovis subsp bovis AF2122/97
gcccgccgcgaacu

SEQ ID NO: 3083836 - RNA, 14 nt, Mycobacterium bovis subsp bovis AF2122/97
gcccgccgcgacca

SEQ ID NO: 3083837 - RNA, 16 nt, Mycobacterium bovis subsp bovis AF2122/97
gcccgccgcgaccacg

SEQ ID NO: 3083838 - RNA, 21 nt, Mycobacterium bovis subsp bovis AF2122/97
gcccgccgcgaccacgcaccg

SEQ ID NO: 3083839 - RNA, 16 nt, Mycobacterium bovis subsp bovis AF2122/97
gcccgccggacccgcc

SEQ ID NO: 3083840 - RNA, 18 nt, Mycobacterium bovis subsp bovis AF2122/97
gcccgccggacccgccgg

SEQ ID NO: 3083841 - RNA, 15 nt, Mycobacterium bovis subsp bovis AF2122/97
gcccgccggcaguga

SEQ ID NO: 3083842 - RNA, 16 nt, Mycobacterium bovis subsp bovis AF2122/97
gcccgccggcagugag

SEQ ID NO: 3083843 - RNA, 20 nt, Mycobacterium bovis subsp bovis AF2122/97
gcccgccggcauagaugccg

SEQ ID NO: 3083844 - RNA, 12 nt, Mycobacterium bovis subsp bovis AF2122/97
gcccgccggccc

SEQ ID NO: 3083845 - RNA, 13 nt, Mycobacterium bovis subsp bovis AF2122/97
gcccgccggccca

SEQ ID NO: 3083846 - RNA, 13 nt, Mycobacterium bovis subsp bovis AF2122/97
gcccgccggcccc

SEQ ID NO: 3083847 - RNA, 18 nt, Mycobacterium bovis subsp bovis AF2122/97
gcccgccggccccgccgg

SEQ ID NO: 3083848 - RNA, 14 nt, Mycobacterium bovis subsp bovis AF2122/97
gcccgccggccucu

SEQ ID NO: 3083849 - RNA, 16 nt, Mycobacterium bovis subsp bovis AF2122/97
gcccgccggcgcgagc

SEQ ID NO: 3083850 - RNA, 17 nt, Mycobacterium bovis subsp bovis AF2122/97
gcccgccggcgcgagcc

SEQ ID NO: 3083851 - RNA, 15 nt, Mycobacterium bovis subsp bovis AF2122/97
gcccgcucggagauc

SEQ ID NO: 3083852 - RNA, 17 nt, Mycobacterium bovis subsp bovis AF2122/97
gcccgcucggagaucgc

SEQ ID NO: 3083853 - RNA, 14 nt, Mycobacterium bovis subsp bovis AF2122/97
gcccgcucggccgc

SEQ ID NO: 3083854 - RNA, 17 nt, Mycobacterium bovis subsp bovis AF2122/97
gcccgcucggccgcagc

SEQ ID NO: 3083855 - RNA, 18 nt, Mycobacterium bovis subsp bovis AF2122/97
gcccgcucggccgcagcc

SEQ ID NO: 3083856 - RNA, 21 nt, Mycobacterium bovis subsp bovis AF2122/97
gcccgcucggccgcagccagc

SEQ ID NO: 3083857 - RNA, 17 nt, Mycobacterium bovis subsp bovis AF2122/97
gcccgcucguaggaccu

SEQ ID NO: 3083858 - RNA, 13 nt, Mycobacterium bovis subsp bovis AF2122/97
gcccgcugaccau

SEQ ID NO: 3083859 - RNA, 15 nt, Mycobacterium bovis subsp bovis AF2122/97
gcccgcugaccauca

SEQ ID NO: 3083860 - RNA, 16 nt, Mycobacterium bovis subsp bovis AF2122/97
gcccgcugaccaucac

SEQ ID NO: 3083861 - RNA, 17 nt, Mycobacterium bovis subsp bovis AF2122/97
gcccgcugaccaucaca

SEQ ID NO: 3083862 - RNA, 20 nt, Mycobacterium bovis subsp bovis AF2122/97
gcccgcugagcacucaugau

SEQ ID NO: 3083863 - RNA, 12 nt, Mycobacterium bovis subsp bovis AF2122/97
gcccgcugauca

SEQ ID NO: 3083864 - RNA, 14 nt, Mycobacterium bovis subsp bovis AF2122/97
gcccgcugccaucg

SEQ ID NO: 3083865 - RNA, 15 nt, Mycobacterium bovis subsp bovis AF2122/97
gcccgcugccgucgg

SEQ ID NO: 3083866 - RNA, 14 nt, Mycobacterium bovis subsp bovis AF2122/97
gcccgcugcgccgg

SEQ ID NO: 3083867 - RNA, 18 nt, Mycobacterium bovis subsp bovis AF2122/97
gcccgcuggccuccugga

SEQ ID NO: 3083868 - RNA, 12 nt, Mycobacterium bovis subsp bovis AF2122/97
gcccgcugggcu

SEQ ID NO: 3083869 - RNA, 15 nt, Mycobacterium bovis subsp bovis AF2122/97
gcccgcugggcucgc

SEQ ID NO: 3083870 - RNA, 18 nt, Mycobacterium bovis subsp bovis AF2122/97
gcccgcugggcucgcugc

SEQ ID NO: 3083871 - RNA, 19 nt, Mycobacterium bovis subsp bovis AF2122/97
gcccgcugggcucgcugca

SEQ ID NO: 3083872 - RNA, 17 nt, Mycobacterium bovis subsp bovis AF2122/97
gcccgcuguaccuccag

SEQ ID NO: 3083873 - RNA, 14 nt, Mycobacterium bovis subsp bovis AF2122/97
gcccgcuucagcac

SEQ ID NO: 3083874 - RNA, 19 nt, Mycobacterium bovis subsp bovis AF2122/97
gcccgcuucagcacggugu

SEQ ID NO: 3083875 - RNA, 15 nt, Mycobacterium bovis subsp bovis AF2122/97
gcccggaacccgagc

SEQ ID NO: 3083876 - RNA, 22 nt, Mycobacterium bovis subsp bovis AF2122/97
gcccggaaccggcgugcagcac

SEQ ID NO: 3083877 - RNA, 18 nt, Mycobacterium bovis subsp bovis AF2122/97
gcccggaacgaaugucac

SEQ ID NO: 3083878 - RNA, 13 nt, Mycobacterium bovis subsp bovis AF2122/97
gcccggacaggcu

SEQ ID NO: 3083879 - RNA, 19 nt, Mycobacterium bovis subsp bovis AF2122/97
gcccggacaugcgggcagc

SEQ ID NO: 3083880 - RNA, 20 nt, Mycobacterium bovis subsp bovis AF2122/97
gcccggacaugcgggcagca

SEQ ID NO: 3083881 - RNA, 21 nt, Mycobacterium bovis subsp bovis AF2122/97
gcccggacaugcgggcagcac

SEQ ID NO: 3083882 - RNA, 20 nt, Mycobacterium bovis subsp bovis AF2122/97
gcccggaccacuguuggugc

SEQ ID NO: 3083883 - RNA, 14 nt, Mycobacterium bovis subsp bovis AF2122/97
gcccggacgauggc

SEQ ID NO: 3083884 - RNA, 15 nt, Mycobacterium bovis subsp bovis AF2122/97
gcccggacgauggcg

SEQ ID NO: 3083885 - RNA, 16 nt, Mycobacterium bovis subsp bovis AF2122/97
gcccggacgauggcgu

SEQ ID NO: 3083886 - RNA, 17 nt, Mycobacterium bovis subsp bovis AF2122/97
gcccggacgauggcguc

SEQ ID NO: 3083887 - RNA, 22 nt, Mycobacterium bovis subsp bovis AF2122/97
gcccggacgauggcgucggcca

SEQ ID NO: 3083888 - RNA, 23 nt, Mycobacterium bovis subsp bovis AF2122/97
gcccggacgcaacacccgggcga

SEQ ID NO: 3083889 - RNA, 15 nt, Mycobacterium bovis subsp bovis AF2122/97
gcccggacgucggcg

SEQ ID NO: 3083890 - RNA, 17 nt, Mycobacterium bovis subsp bovis AF2122/97
gcccggacgucggcggc

SEQ ID NO: 3083891 - RNA, 18 nt, Mycobacterium bovis subsp bovis AF2122/97
gcccggacgucggcggcc

SEQ ID NO: 3083892 - RNA, 13 nt, Mycobacterium bovis subsp bovis AF2122/97
gcccggauuggcg

SEQ ID NO: 3083893 - RNA, 14 nt, Mycobacterium bovis subsp bovis AF2122/97
gcccggcaaugauc

SEQ ID NO: 3083894 - RNA, 13 nt, Mycobacterium bovis subsp bovis AF2122/97
gcccggcaccgcg

SEQ ID NO: 3083895 - RNA, 13 nt, Mycobacterium bovis subsp bovis AF2122/97
gcccggcagcacg

SEQ ID NO: 3083896 - RNA, 21 nt, Mycobacterium bovis subsp bovis AF2122/97
gcccggcaguucgcggccauc

SEQ ID NO: 3083897 - RNA, 22 nt, Mycobacterium bovis subsp bovis AF2122/97
gcccggcaguucgcggccaucg

SEQ ID NO: 3083898 - RNA, 14 nt, Mycobacterium bovis subsp bovis AF2122/97
gcccggcaucgcga

SEQ ID NO: 3083899 - RNA, 21 nt, Mycobacterium bovis subsp bovis AF2122/97
gcccggcauuaggccgggguc

SEQ ID NO: 3083900 - RNA, 18 nt, Mycobacterium bovis subsp bovis AF2122/97
gcccggccaaaauggcgc

SEQ ID NO: 3083901 - RNA, 19 nt, Mycobacterium bovis subsp bovis AF2122/97
gcccggccaaccaccaacu

SEQ ID NO: 3083902 - RNA, 16 nt, Mycobacterium bovis subsp bovis AF2122/97
gcccggccaagccggc

SEQ ID NO: 3083903 - RNA, 18 nt, Mycobacterium bovis subsp bovis AF2122/97
gcccggccaagccggcga

SEQ ID NO: 3083904 - RNA, 20 nt, Mycobacterium bovis subsp bovis AF2122/97
gcccggccacuccaguacgg

SEQ ID NO: 3083905 - RNA, 14 nt, Mycobacterium bovis subsp bovis AF2122/97
gcccggccagccgc

SEQ ID NO: 3083906 - RNA, 15 nt, Mycobacterium bovis subsp bovis AF2122/97
gcccggccagccgca

SEQ ID NO: 3083907 - RNA, 18 nt, Mycobacterium bovis subsp bovis AF2122/97
gcccggccagccgcacgg

SEQ ID NO: 3083908 - RNA, 21 nt, Mycobacterium bovis subsp bovis AF2122/97
gcccggccaggucgacaccgc

SEQ ID NO: 3083909 - RNA, 16 nt, Mycobacterium bovis subsp bovis AF2122/97
gcccggccccgcaagc

SEQ ID NO: 3083910 - RNA, 15 nt, Mycobacterium bovis subsp bovis AF2122/97
gcccggccccgcggc

SEQ ID NO: 3083911 - RNA, 17 nt, Mycobacterium bovis subsp bovis AF2122/97
gcccggccccgcggcca

SEQ ID NO: 3083912 - RNA, 21 nt, Mycobacterium bovis subsp bovis AF2122/97
gcccggccccgcggccagcac

SEQ ID NO: 3083913 - RNA, 13 nt, Mycobacterium bovis subsp bovis AF2122/97
gcccggcccgccc

SEQ ID NO: 3083914 - RNA, 17 nt, Mycobacterium bovis subsp bovis AF2122/97
gcccggcccgcucagcc

SEQ ID NO: 3083915 - RNA, 22 nt, Mycobacterium bovis subsp bovis AF2122/97
gcccggcccgcucagccguccg

SEQ ID NO: 3083916 - RNA, 14 nt, Mycobacterium bovis subsp bovis AF2122/97
gcccggcccggcuc

SEQ ID NO: 3083917 - RNA, 17 nt, Mycobacterium bovis subsp bovis AF2122/97
gcccggcccgggucagc

SEQ ID NO: 3083918 - RNA, 13 nt, Mycobacterium bovis subsp bovis AF2122/97
gcccggccgccag

SEQ ID NO: 3083919 - RNA, 14 nt, Mycobacterium bovis subsp bovis AF2122/97
gcccggccgccagc

SEQ ID NO: 3083920 - RNA, 15 nt, Mycobacterium bovis subsp bovis AF2122/97
gcccggccgccagcg

SEQ ID NO: 3083921 - RNA, 12 nt, Mycobacterium bovis subsp bovis AF2122/97
gcccggccgccg

SEQ ID NO: 3083922 - RNA, 11 nt, Mycobacterium bovis subsp bovis AF2122/97
gcccggccgcg

SEQ ID NO: 3083923 - RNA, 13 nt, Mycobacterium bovis subsp bovis AF2122/97
gcccggccgcgcc

SEQ ID NO: 3083924 - RNA, 17 nt, Mycobacterium bovis subsp bovis AF2122/97
gcccggccgcgccccau

SEQ ID NO: 3083925 - RNA, 18 nt, Mycobacterium bovis subsp bovis AF2122/97
gcccggccucggcgagca

SEQ ID NO: 3083926 - RNA, 16 nt, Mycobacterium bovis subsp bovis AF2122/97
gcccggccugcugguc

SEQ ID NO: 3083927 - RNA, 15 nt, Mycobacterium bovis subsp bovis AF2122/97
gcccggccuugccgc

SEQ ID NO: 3083928 - RNA, 20 nt, Mycobacterium bovis subsp bovis AF2122/97
gcccggccuugccgccggcc

SEQ ID NO: 3083929 - RNA, 23 nt, Mycobacterium bovis subsp bovis AF2122/97
gcccggccuugccgccggccccg

SEQ ID NO: 3083930 - RNA, 21 nt, Mycobacterium bovis subsp bovis AF2122/97
gcccggccuugccgccggcgc

SEQ ID NO: 3083931 - RNA, 22 nt, Mycobacterium bovis subsp bovis AF2122/97
gcccggccuugccgccggcgcc

SEQ ID NO: 3083932 - RNA, 23 nt, Mycobacterium bovis subsp bovis AF2122/97
gcccggccuugccgccggcgccg

SEQ ID NO: 3083933 - RNA, 20 nt, Mycobacterium bovis subsp bovis AF2122/97
gcccggcgaaagcuugggcg

SEQ ID NO: 3083934 - RNA, 22 nt, Mycobacterium bovis subsp bovis AF2122/97
gcccggcgaauacgaccgucgc

SEQ ID NO: 3083935 - RNA, 14 nt, Mycobacterium bovis subsp bovis AF2122/97
gcccggcgacgacc

SEQ ID NO: 3083936 - RNA, 22 nt, Mycobacterium bovis subsp bovis AF2122/97
gcccggcgagcagggcgucgac

SEQ ID NO: 3083937 - RNA, 24 nt, Mycobacterium bovis subsp bovis AF2122/97
gcccggcgauaaacccgaggcucg

SEQ ID NO: 3083938 - RNA, 21 nt, Mycobacterium bovis subsp bovis AF2122/97
gcccggucgcugauccgggcg

SEQ ID NO: 3083939 - RNA, 21 nt, Mycobacterium bovis subsp bovis AF2122/97
gcccggucuauuugccugccg

SEQ ID NO: 3083940 - RNA, 22 nt, Mycobacterium bovis subsp bovis AF2122/97
gcccggucuauuugccugccgc

SEQ ID NO: 3083941 - RNA, 21 nt, Mycobacterium bovis subsp bovis AF2122/97
gcccggucucgacggcggccg

SEQ ID NO: 3083942 - RNA, 23 nt, Mycobacterium bovis subsp bovis AF2122/97
gcccggucucgacggcggccgcg

SEQ ID NO: 3083943 - RNA, 16 nt, Mycobacterium bovis subsp bovis AF2122/97
gcccggucuugggcgc

SEQ ID NO: 3083944 - RNA, 21 nt, Mycobacterium bovis subsp bovis AF2122/97
gcccggucuugggcgcgggug

SEQ ID NO: 3083945 - RNA, 24 nt, Mycobacterium bovis subsp bovis AF2122/97
gcccggugagcuuagcgcaugggc

SEQ ID NO: 3083946 - RNA, 15 nt, Mycobacterium bovis subsp bovis AF2122/97
gcccggugcagcagu

SEQ ID NO: 3083947 - RNA, 22 nt, Mycobacterium bovis subsp bovis AF2122/97
gcccggugcuaaccgacgcuga

SEQ ID NO: 3083948 - RNA, 14 nt, Mycobacterium bovis subsp bovis AF2122/97
gcccggugcuaccg

SEQ ID NO: 3083949 - RNA, 14 nt, Mycobacterium bovis subsp bovis AF2122/97
gcccgguggcggcu

SEQ ID NO: 3083950 - RNA, 20 nt, Mycobacterium bovis subsp bovis AF2122/97
gcccgguggcggcucacgac

SEQ ID NO: 3083951 - RNA, 15 nt, Mycobacterium bovis subsp bovis AF2122/97
gcccgguggucgucc

SEQ ID NO: 3083952 - RNA, 17 nt, Mycobacterium bovis subsp bovis AF2122/97
gcccgguggugcugucg

SEQ ID NO: 3083953 - RNA, 19 nt, Mycobacterium bovis subsp bovis AF2122/97
gcccggugugcugcacggc

SEQ ID NO: 3083954 - RNA, 20 nt, Mycobacterium bovis subsp bovis AF2122/97
gcccgguguucaucacgccg

SEQ ID NO: 3083955 - RNA, 22 nt, Mycobacterium bovis subsp bovis AF2122/97
gcccgguguucaucacgccgcc

SEQ ID NO: 3083956 - RNA, 18 nt, Mycobacterium bovis subsp bovis AF2122/97
gcccgguucagcgcuggc

SEQ ID NO: 3083957 - RNA, 21 nt, Mycobacterium bovis subsp bovis AF2122/97
gcccgguuguggaaccacggc

SEQ ID NO: 3083958 - RNA, 21 nt, Mycobacterium bovis subsp bovis AF2122/97
gcccguaauugcagguggugu

SEQ ID NO: 3083959 - RNA, 15 nt, Mycobacterium bovis subsp bovis AF2122/97
gcccguagacgccga

SEQ ID NO: 3083960 - RNA, 17 nt, Mycobacterium bovis subsp bovis AF2122/97
gcccguagacgccgagc

SEQ ID NO: 3083961 - RNA, 18 nt, Mycobacterium bovis subsp bovis AF2122/97
gcccguagacgccgagca

SEQ ID NO: 3083962 - RNA, 19 nt, Mycobacterium bovis subsp bovis AF2122/97
gcccguagcacaccggugg

SEQ ID NO: 3083963 - RNA, 15 nt, Mycobacterium bovis subsp bovis AF2122/97
gcccguagcguccgc

SEQ ID NO: 3083964 - RNA, 17 nt, Mycobacterium bovis subsp bovis AF2122/97
gcccguagcugcgcagc

SEQ ID NO: 3083965 - RNA, 19 nt, Mycobacterium bovis subsp bovis AF2122/97
gcccguauaaccggccaug

SEQ ID NO: 3083966 - RNA, 13 nt, Mycobacterium bovis subsp bovis AF2122/97
gcccguaucggcu

SEQ ID NO: 3083967 - RNA, 16 nt, Mycobacterium bovis subsp bovis AF2122/97
gcccgucacaaugccc

SEQ ID NO: 3083968 - RNA, 16 nt, Mycobacterium bovis subsp bovis AF2122/97
gcccgucaccgcgggc

SEQ ID NO: 3083969 - RNA, 13 nt, Mycobacterium bovis subsp bovis AF2122/97
gcccgucacgccc

SEQ ID NO: 3083970 - RNA, 16 nt, Mycobacterium bovis subsp bovis AF2122/97
gcccgucacgcccgcg

SEQ ID NO: 3083971 - RNA, 20 nt, Mycobacterium bovis subsp bovis AF2122/97
gcccgucagcggacaguucg

SEQ ID NO: 3083972 - RNA, 21 nt, Mycobacterium bovis subsp bovis AF2122/97
gcccgucauacucgacaccga

SEQ ID NO: 3083973 - RNA, 23 nt, Mycobacterium bovis subsp bovis AF2122/97
gcccgucauacucgacaccgacu

SEQ ID NO: 3083974 - RNA, 14 nt, Mycobacterium bovis subsp bovis AF2122/97
gcccgucaucgcgu

SEQ ID NO: 3083975 - RNA, 17 nt, Mycobacterium bovis subsp bovis AF2122/97
gcccgucccgcucgagc

SEQ ID NO: 3083976 - RNA, 18 nt, Mycobacterium bovis subsp bovis AF2122/97
gcccgucccgcucgagca

SEQ ID NO: 3083977 - RNA, 19 nt, Mycobacterium bovis subsp bovis AF2122/97
gcccgucccgcucgagcag

SEQ ID NO: 3083978 - RNA, 17 nt, Mycobacterium bovis subsp bovis AF2122/97
gcccguccgcgcgccga

SEQ ID NO: 3083979 - RNA, 17 nt, Mycobacterium bovis subsp bovis AF2122/97
gcccguccggcccccga

SEQ ID NO: 3083980 - RNA, 20 nt, Mycobacterium bovis subsp bovis AF2122/97
gcccguccggcccccgaggc

SEQ ID NO: 3083981 - RNA, 15 nt, Mycobacterium bovis subsp bovis AF2122/97
gcccguccucgucgg

SEQ ID NO: 3083982 - RNA, 20 nt, Mycobacterium bovis subsp bovis AF2122/97
gcccgucgaaccagagguca

SEQ ID NO: 3083983 - RNA, 14 nt, Mycobacterium bovis subsp bovis AF2122/97
gcccgucgcggccg

SEQ ID NO: 3083984 - RNA, 16 nt, Mycobacterium bovis subsp bovis AF2122/97
gcccgucgcggccggc

SEQ ID NO: 3083985 - RNA, 17 nt, Mycobacterium bovis subsp bovis AF2122/97
gcccgucgcggccggcg

SEQ ID NO: 3083986 - RNA, 20 nt, Mycobacterium bovis subsp bovis AF2122/97
gcccgucgcggccggcggcc

SEQ ID NO: 3083987 - RNA, 13 nt, Mycobacterium bovis subsp bovis AF2122/97
gcccgucgcuggg

SEQ ID NO: 3083988 - RNA, 20 nt, Mycobacterium bovis subsp bovis AF2122/97
gcccgucggacauaccgcga

SEQ ID NO: 3083989 - RNA, 23 nt, Mycobacterium bovis subsp bovis AF2122/97
gcccgucggauggaaggcggcca

SEQ ID NO: 3083990 - RNA, 15 nt, Mycobacterium bovis subsp bovis AF2122/97
gcccgucggcgcccg

SEQ ID NO: 3083991 - RNA, 14 nt, Mycobacterium bovis subsp bovis AF2122/97
gcccgucggcgccg

SEQ ID NO: 3083992 - RNA, 16 nt, Mycobacterium bovis subsp bovis AF2122/97
gcccgucggcgccgaa

SEQ ID NO: 3083993 - RNA, 17 nt, Mycobacterium bovis subsp bovis AF2122/97
gcccgucggcgugcgga

SEQ ID NO: 3083994 - RNA, 16 nt, Mycobacterium bovis subsp bovis AF2122/97
gcccgucgggccgucg

SEQ ID NO: 3083995 - RNA, 17 nt, Mycobacterium bovis subsp bovis AF2122/97
gcccgucgggccgucgg

SEQ ID NO: 3083996 - RNA, 13 nt, Mycobacterium bovis subsp bovis AF2122/97
gcccgucgucggc

SEQ ID NO: 3083997 - RNA, 15 nt, Mycobacterium bovis subsp bovis AF2122/97
gcccgucgucggcaa

SEQ ID NO: 3083998 - RNA, 18 nt, Mycobacterium bovis subsp bovis AF2122/97
gcccgucgucggcaacca

SEQ ID NO: 3083999 - RNA, 16 nt, Mycobacterium bovis subsp bovis AF2122/97
gcccgucgucgucgac

SEQ ID NO: 3084000 - RNA, 19 nt, Mycobacterium bovis subsp bovis AF2122/97
gcccgucgucgucgacacg

SEQ ID NO: 3084001 - RNA, 22 nt, Mycobacterium bovis subsp bovis AF2122/97
gcccgucgucgucgacacggug

SEQ ID NO: 3084002 - RNA, 17 nt, Mycobacterium bovis subsp bovis AF2122/97
gcccgucgucgugcacg

SEQ ID NO: 3084003 - RNA, 16 nt, Mycobacterium bovis subsp bovis AF2122/97
gcccgucgugaccgac

SEQ ID NO: 3084004 - RNA, 16 nt, Mycobacterium bovis subsp bovis AF2122/97
gcccgucuccagcacc

SEQ ID NO: 3084005 - RNA, 17 nt, Mycobacterium bovis subsp bovis AF2122/97
gcccgucuccagcacca

SEQ ID NO: 3084006 - RNA, 16 nt, Mycobacterium bovis subsp bovis AF2122/97
gcccgugacuggugaa

SEQ ID NO: 3084007 - RNA, 16 nt, Mycobacterium bovis subsp bovis AF2122/97
gcccgugaucaccacg

SEQ ID NO: 3084008 - RNA, 14 nt, Mycobacterium bovis subsp bovis AF2122/97
gcccgugccacagc

SEQ ID NO: 3084009 - RNA, 14 nt, Mycobacterium bovis subsp bovis AF2122/97
gcccgugccgcccu

SEQ ID NO: 3084010 - RNA, 15 nt, Mycobacterium bovis subsp bovis AF2122/97
gcccgugccgcccuc

SEQ ID NO: 3084011 - RNA, 17 nt, Mycobacterium bovis subsp bovis AF2122/97
gcccgugccgucgcccu

SEQ ID NO: 3084012 - RNA, 18 nt, Mycobacterium bovis subsp bovis AF2122/97
gcccgugccuggccggug

SEQ ID NO: 3084013 - RNA, 19 nt, Mycobacterium bovis subsp bovis AF2122/97
gcccgugccuggccggugc

SEQ ID NO: 3084014 - RNA, 13 nt, Mycobacterium bovis subsp bovis AF2122/97
gcccgugcgaugc

SEQ ID NO: 3084015 - RNA, 18 nt, Mycobacterium bovis subsp bovis AF2122/97
gcccgugcgaugcacaac

SEQ ID NO: 3084016 - RNA, 17 nt, Mycobacterium bovis subsp bovis AF2122/97
gcccgugcggcucgccg

SEQ ID NO: 3084017 - RNA, 18 nt, Mycobacterium bovis subsp bovis AF2122/97
gcccgugcggcucgccgg

SEQ ID NO: 3084018 - RNA, 19 nt, Mycobacterium bovis subsp bovis AF2122/97
gcccgugcggcucgccggc

SEQ ID NO: 3084019 - RNA, 21 nt, Mycobacterium bovis subsp bovis AF2122/97
gcccgugcggcucgccggcgg

SEQ ID NO: 3084020 - RNA, 23 nt, Mycobacterium bovis subsp bovis AF2122/97
gcccgugcggcucgccggcggcc

SEQ ID NO: 3084021 - RNA, 19 nt, Mycobacterium bovis subsp bovis AF2122/97
gcccgugggugcgucuggg

SEQ ID NO: 3084022 - RNA, 21 nt, Mycobacterium bovis subsp bovis AF2122/97
gcccguguggucccggcacga

SEQ ID NO: 3084023 - RNA, 18 nt, Mycobacterium bovis subsp bovis AF2122/97
gcccguguuaaagaagcc

SEQ ID NO: 3084024 - RNA, 21 nt, Mycobacterium bovis subsp bovis AF2122/97
gcccucguuaucgaccgccgc

SEQ ID NO: 3084025 - RNA, 16 nt, Mycobacterium bovis subsp bovis AF2122/97
gcccugaacgguucgg

SEQ ID NO: 3084026 - RNA, 17 nt, Mycobacterium bovis subsp bovis AF2122/97
gcccugaacgguucggc

SEQ ID NO: 3084027 - RNA, 18 nt, Mycobacterium bovis subsp bovis AF2122/97
gcccugaagggccgccuc

SEQ ID NO: 3084028 - RNA, 19 nt, Mycobacterium bovis subsp bovis AF2122/97
gcccugacacaacaccggc

SEQ ID NO: 3084029 - RNA, 21 nt, Mycobacterium bovis subsp bovis AF2122/97
gcccugacacaacaccggcgu

SEQ ID NO: 3084030 - RNA, 14 nt, Mycobacterium bovis subsp bovis AF2122/97
gcccugacacccau

SEQ ID NO: 3084031 - RNA, 20 nt, Mycobacterium bovis subsp bovis AF2122/97
gcccugacacccaucgaccg

SEQ ID NO: 3084032 - RNA, 22 nt, Mycobacterium bovis subsp bovis AF2122/97
gcccugacacccaucgaccgcc

SEQ ID NO: 3084033 - RNA, 18 nt, Mycobacterium bovis subsp bovis AF2122/97
gcccugacccggagccgc

SEQ ID NO: 3084034 - RNA, 20 nt, Mycobacterium bovis subsp bovis AF2122/97
gcccugacccggagccgcca

SEQ ID NO: 3084035 - RNA, 22 nt, Mycobacterium bovis subsp bovis AF2122/97
gcccugacccggagccgccagg

SEQ ID NO: 3084036 - RNA, 21 nt, Mycobacterium bovis subsp bovis AF2122/97
gcccugacgucacguucggcg

SEQ ID NO: 3084037 - RNA, 21 nt, Mycobacterium bovis subsp bovis AF2122/97
gcccugagcagauggguaccc

SEQ ID NO: 3084038 - RNA, 14 nt, Mycobacterium bovis subsp bovis AF2122/97
gcccugagccaccc

SEQ ID NO: 3084039 - RNA, 21 nt, Mycobacterium bovis subsp bovis AF2122/97
gcccugagcgaagugucgcug

SEQ ID NO: 3084040 - RNA, 15 nt, Mycobacterium bovis subsp bovis AF2122/97
gcccugagcugccga

SEQ ID NO: 3084041 - RNA, 17 nt, Mycobacterium bovis subsp bovis AF2122/97
gcccugauugaagcccc

SEQ ID NO: 3084042 - RNA, 18 nt, Mycobacterium bovis subsp bovis AF2122/97
gcccugauugaagccccc

SEQ ID NO: 3084043 - RNA, 16 nt, Mycobacterium bovis subsp bovis AF2122/97
gcccugccgacgcucc

SEQ ID NO: 3084044 - RNA, 20 nt, Mycobacterium bovis subsp bovis AF2122/97
gcccugccgacgcuccaggg

SEQ ID NO: 3084045 - RNA, 15 nt, Mycobacterium bovis subsp bovis AF2122/97
gcccugccgccggcc

SEQ ID NO: 3084046 - RNA, 18 nt, Mycobacterium bovis subsp bovis AF2122/97
gcccugccgccggccccg

SEQ ID NO: 3084047 - RNA, 21 nt, Mycobacterium bovis subsp bovis AF2122/97
gcccugccgccggccccgccg

SEQ ID NO: 3084048 - RNA, 15 nt, Mycobacterium bovis subsp bovis AF2122/97
gcccugcgauaccac

SEQ ID NO: 3084049 - RNA, 15 nt, Mycobacterium bovis subsp bovis AF2122/97
gcccugcgcagccgc

SEQ ID NO: 3084050 - RNA, 16 nt, Mycobacterium bovis subsp bovis AF2122/97
gcccugcgcagccgcc

SEQ ID NO: 3084051 - RNA, 17 nt, Mycobacterium bovis subsp bovis AF2122/97
gcccugcgcagccgccu

SEQ ID NO: 3084052 - RNA, 18 nt, Mycobacterium bovis subsp bovis AF2122/97
gcccugcgccacacccgg

SEQ ID NO: 3084053 - RNA, 21 nt, Mycobacterium bovis subsp bovis AF2122/97
gcccugcggccacgguggcgc

SEQ ID NO: 3084054 - RNA, 19 nt, Mycobacterium bovis subsp bovis AF2122/97
gcccugcuccucgcgggcg

SEQ ID NO: 3084055 - RNA, 23 nt, Mycobacterium bovis subsp bovis AF2122/97
gcccugcuccucgcgggcggcgu

SEQ ID NO: 3084056 - RNA, 13 nt, Mycobacterium bovis subsp bovis AF2122/97
gcccugcucgccg

SEQ ID NO: 3084057 - RNA, 15 nt, Mycobacterium bovis subsp bovis AF2122/97
gcccugcucgccguc

SEQ ID NO: 3084058 - RNA, 19 nt, Mycobacterium bovis subsp bovis AF2122/97
gcccugcuggugucggcuc

SEQ ID NO: 3084059 - RNA, 18 nt, Mycobacterium bovis subsp bovis AF2122/97
gcccuggaauccaggagc

SEQ ID NO: 3084060 - RNA, 17 nt, Mycobacterium bovis subsp bovis AF2122/97
gcccuggacgucggcga

SEQ ID NO: 3084061 - RNA, 17 nt, Mycobacterium bovis subsp bovis AF2122/97
gcccuggcaacgacacg

SEQ ID NO: 3084062 - RNA, 19 nt, Mycobacterium bovis subsp bovis AF2122/97
gcccuggcaacgacacgcc

SEQ ID NO: 3084063 - RNA, 23 nt, Mycobacterium bovis subsp bovis AF2122/97
gcccuggcaacgacacgccgcuc

SEQ ID NO: 3084064 - RNA, 14 nt, Mycobacterium bovis subsp bovis AF2122/97
gcccuggccaccca

SEQ ID NO: 3084065 - RNA, 15 nt, Mycobacterium bovis subsp bovis AF2122/97
gcccuggccacccag

SEQ ID NO: 3084066 - RNA, 14 nt, Mycobacterium bovis subsp bovis AF2122/97
gcccuggccagccc

SEQ ID NO: 3084067 - RNA, 19 nt, Mycobacterium bovis subsp bovis AF2122/97
gcccuggccagcccgagcu

SEQ ID NO: 3084068 - RNA, 14 nt, Mycobacterium bovis subsp bovis AF2122/97
gcccuggcccaucu

SEQ ID NO: 3084069 - RNA, 18 nt, Mycobacterium bovis subsp bovis AF2122/97
gcccuggccgcccagacc

SEQ ID NO: 3084070 - RNA, 15 nt, Mycobacterium bovis subsp bovis AF2122/97
gcccuggccgcccug

SEQ ID NO: 3084071 - RNA, 19 nt, Mycobacterium bovis subsp bovis AF2122/97
gcccuggccgcccuggccg

SEQ ID NO: 3084072 - RNA, 14 nt, Mycobacterium bovis subsp bovis AF2122/97
gcccuggccgccgg

SEQ ID NO: 3084073 - RNA, 19 nt, Mycobacterium bovis subsp bovis AF2122/97
gcccuggccgccggccccg

SEQ ID NO: 3084074 - RNA, 13 nt, Mycobacterium bovis subsp bovis AF2122/97
gcccuggccgcgc

SEQ ID NO: 3084075 - RNA, 15 nt, Mycobacterium bovis subsp bovis AF2122/97
gcccuggcgaccagc

SEQ ID NO: 3084076 - RNA, 22 nt, Mycobacterium bovis subsp bovis AF2122/97
gcccuggggguggcagcgcggc

SEQ ID NO: 3084077 - RNA, 23 nt, Mycobacterium bovis subsp bovis AF2122/97
gcccuggggguggcagcgcggcc

SEQ ID NO: 3084078 - RNA, 18 nt, Mycobacterium bovis subsp bovis AF2122/97
gcccugggugauggccgc

SEQ ID NO: 3084079 - RNA, 20 nt, Mycobacterium bovis subsp bovis AF2122/97
gcccugggugauggccgcgc

SEQ ID NO: 3084080 - RNA, 14 nt, Mycobacterium bovis subsp bovis AF2122/97
gcccugggugguuc

SEQ ID NO: 3084081 - RNA, 22 nt, Mycobacterium bovis subsp bovis AF2122/97
gcccugggugguuccgcgcggc

SEQ ID NO: 3084082 - RNA, 23 nt, Mycobacterium bovis subsp bovis AF2122/97
gcccugggugguuccgcgcggca

SEQ ID NO: 3084083 - RNA, 15 nt, Mycobacterium bovis subsp bovis AF2122/97
gcccugguccaggcc

SEQ ID NO: 3084084 - RNA, 16 nt, Mycobacterium bovis subsp bovis AF2122/97
gcccugguccaggccc

SEQ ID NO: 3084085 - RNA, 19 nt, Mycobacterium bovis subsp bovis AF2122/97
gcccugguccaggcccugg

SEQ ID NO: 3084086 - RNA, 23 nt, Mycobacterium bovis subsp bovis AF2122/97
gcccugguccaggcccuggccag

SEQ ID NO: 3084087 - RNA, 16 nt, Mycobacterium bovis subsp bovis AF2122/97
gcccuggugugccgcg

SEQ ID NO: 3084088 - RNA, 17 nt, Mycobacterium bovis subsp bovis AF2122/97
gcccuggugugccgcgu

SEQ ID NO: 3084089 - RNA, 19 nt, Mycobacterium bovis subsp bovis AF2122/97
gcccuguccggcgccgagg

SEQ ID NO: 3084090 - RNA, 22 nt, Mycobacterium bovis subsp bovis AF2122/97
gcccuguuugacugcgaccggu

SEQ ID NO: 3084091 - RNA, 14 nt, Mycobacterium bovis subsp bovis AF2122/97
gcccuuaagccggc

SEQ ID NO: 3084092 - RNA, 17 nt, Mycobacterium bovis subsp bovis AF2122/97
gcccuucagcacgguga

SEQ ID NO: 3084093 - RNA, 19 nt, Mycobacterium bovis subsp bovis AF2122/97
gcccuucagcacggugauc

SEQ ID NO: 3084094 - RNA, 18 nt, Mycobacterium bovis subsp bovis AF2122/97
gcccuucagcgaagccgg

SEQ ID NO: 3084095 - RNA, 20 nt, Mycobacterium bovis subsp bovis AF2122/97
gcccuucagcguccugguga

SEQ ID NO: 3084096 - RNA, 21 nt, Mycobacterium bovis subsp bovis AF2122/97
gcccuucaguucgacggugcc

SEQ ID NO: 3084097 - RNA, 14 nt, Mycobacterium bovis subsp bovis AF2122/97
gcccuuccggccga

SEQ ID NO: 3084098 - RNA, 17 nt, Mycobacterium bovis subsp bovis AF2122/97
gcccuucgacgaggacg

SEQ ID NO: 3084099 - RNA, 13 nt, Mycobacterium bovis subsp bovis AF2122/97
gcccuucgucggc

SEQ ID NO: 3084100 - RNA, 14 nt, Mycobacterium bovis subsp bovis AF2122/97
gcccuucgucggca

SEQ ID NO: 3084101 - RNA, 15 nt, Mycobacterium bovis subsp bovis AF2122/97
gcccuucgucggcau

SEQ ID NO: 3084102 - RNA, 16 nt, Mycobacterium bovis subsp bovis AF2122/97
gcccuucuucgaccgc

SEQ ID NO: 3084103 - RNA, 13 nt, Mycobacterium bovis subsp bovis AF2122/97
gcccuugaagaaa

SEQ ID NO: 3084104 - RNA, 16 nt, Mycobacterium bovis subsp bovis AF2122/97
gcccuugagccgccgu

SEQ ID NO: 3084105 - RNA, 21 nt, Mycobacterium bovis subsp bovis AF2122/97
gcccuugauguccgcgacggc

SEQ ID NO: 3084106 - RNA, 12 nt, Mycobacterium bovis subsp bovis AF2122/97
gcccuugccgcc

SEQ ID NO: 3084107 - RNA, 14 nt, Mycobacterium bovis subsp bovis AF2122/97
gcccuugccgccag

SEQ ID NO: 3084108 - RNA, 15 nt, Mycobacterium bovis subsp bovis AF2122/97
gcccuugccgccgag

SEQ ID NO: 3084109 - RNA, 15 nt, Mycobacterium bovis subsp bovis AF2122/97
gcccuugccgccggc

SEQ ID NO: 3084110 - RNA, 12 nt, Mycobacterium bovis subsp bovis AF2122/97
gccgaacgccag

SEQ ID NO: 3084111 - RNA, 20 nt, Mycobacterium bovis subsp bovis AF2122/97
gccgaacgccagaccgccga

SEQ ID NO: 3084112 - RNA, 18 nt, Mycobacterium bovis subsp bovis AF2122/97
gccgaacgccucgccggc

SEQ ID NO: 3084113 - RNA, 22 nt, Mycobacterium bovis subsp bovis AF2122/97
gccgaacgccucgccggccacc

SEQ ID NO: 3084114 - RNA, 21 nt, Mycobacterium bovis subsp bovis AF2122/97
gccgaacgccucugcgaucag

SEQ ID NO: 3084115 - RNA, 20 nt, Mycobacterium bovis subsp bovis AF2122/97
gccgaacgggucggcgacca

SEQ ID NO: 3084116 - RNA, 18 nt, Mycobacterium bovis subsp bovis AF2122/97
gccgaacgucgcggccag

SEQ ID NO: 3084117 - RNA, 20 nt, Mycobacterium bovis subsp bovis AF2122/97
gccgaacgucgcggccagca

SEQ ID NO: 3084118 - RNA, 20 nt, Mycobacterium bovis subsp bovis AF2122/97
gccgaacgugaacucacggc

SEQ ID NO: 3084119 - RNA, 20 nt, Mycobacterium bovis subsp bovis AF2122/97
gccgaacgugcaaccacggc

SEQ ID NO: 3084120 - RNA, 22 nt, Mycobacterium bovis subsp bovis AF2122/97
gccgaacgugcaaccauggcgg

SEQ ID NO: 3084121 - RNA, 16 nt, Mycobacterium bovis subsp bovis AF2122/97
gccgaacgugcggugg

SEQ ID NO: 3084122 - RNA, 24 nt, Mycobacterium bovis subsp bovis AF2122/97
gccgaacucaacgacaccauaggc

SEQ ID NO: 3084123 - RNA, 17 nt, Mycobacterium bovis subsp bovis AF2122/97
gccgaagaaccggucgc

SEQ ID NO: 3084124 - RNA, 19 nt, Mycobacterium bovis subsp bovis AF2122/97
gccgaagaaccggucgcag

SEQ ID NO: 3084125 - RNA, 21 nt, Mycobacterium bovis subsp bovis AF2122/97
gccgaagaaccggucgcagug

SEQ ID NO: 3084126 - RNA, 19 nt, Mycobacterium bovis subsp bovis AF2122/97
gccgaagaacucaaagacc

SEQ ID NO: 3084127 - RNA, 16 nt, Mycobacterium bovis subsp bovis AF2122/97
gccgaagacgugccgg

SEQ ID NO: 3084128 - RNA, 21 nt, Mycobacterium bovis subsp bovis AF2122/97
gccgaagacgugccggcucag

SEQ ID NO: 3084129 - RNA, 15 nt, Mycobacterium bovis subsp bovis AF2122/97
gccgaagaggagaac

SEQ ID NO: 3084130 - RNA, 19 nt, Mycobacterium bovis subsp bovis AF2122/97
gccgaagaugaccgcucgu

SEQ ID NO: 3084131 - RNA, 19 nt, Mycobacterium bovis subsp bovis AF2122/97
gccgaagcccccgacguug

SEQ ID NO: 3084132 - RNA, 16 nt, Mycobacterium bovis subsp bovis AF2122/97
gccgaagccgcgcauc

SEQ ID NO: 3084133 - RNA, 13 nt, Mycobacterium bovis subsp bovis AF2122/97
gccgaagccuugc

SEQ ID NO: 3084134 - RNA, 23 nt, Mycobacterium bovis subsp bovis AF2122/97
gccgaagccuugcagcgcccccg

SEQ ID NO: 3084135 - RNA, 16 nt, Mycobacterium bovis subsp bovis AF2122/97
gccgaagcgaugccgu

SEQ ID NO: 3084136 - RNA, 14 nt, Mycobacterium bovis subsp bovis AF2122/97
gccgaagcgcccgu

SEQ ID NO: 3084137 - RNA, 16 nt, Mycobacterium bovis subsp bovis AF2122/97
gccgaagcgcccguug

SEQ ID NO: 3084138 - RNA, 13 nt, Mycobacterium bovis subsp bovis AF2122/97
gccgaagcgccgc

SEQ ID NO: 3084139 - RNA, 18 nt, Mycobacterium bovis subsp bovis AF2122/97
gccgaagcgccgcuuggc

SEQ ID NO: 3084140 - RNA, 15 nt, Mycobacterium bovis subsp bovis AF2122/97
gccgaagcggccacc

SEQ ID NO: 3084141 - RNA, 17 nt, Mycobacterium bovis subsp bovis AF2122/97
gccgaagcggccaccgc

SEQ ID NO: 3084142 - RNA, 19 nt, Mycobacterium bovis subsp bovis AF2122/97
gccgaagcucaucgccgcu

SEQ ID NO: 3084143 - RNA, 16 nt, Mycobacterium bovis subsp bovis AF2122/97
gccgaagcugcccaac

SEQ ID NO: 3084144 - RNA, 21 nt, Mycobacterium bovis subsp bovis AF2122/97
gccgaaggauuuggagcuuuu

SEQ ID NO: 3084145 - RNA, 23 nt, Mycobacterium bovis subsp bovis AF2122/97
gccgaaggccgccacaaacccga

SEQ ID NO: 3084146 - RNA, 18 nt, Mycobacterium bovis subsp bovis AF2122/97
gccgaaguagacgguggu

SEQ ID NO: 3084147 - RNA, 17 nt, Mycobacterium bovis subsp bovis AF2122/97
gccgaaguggucuccgg

SEQ ID NO: 3084148 - RNA, 21 nt, Mycobacterium bovis subsp bovis AF2122/97
gccgaaguuuuggaagcccga

SEQ ID NO: 3084149 - RNA, 22 nt, Mycobacterium bovis subsp bovis AF2122/97
gccgaaguuuuggaagcccgaa

SEQ ID NO: 3084150 - RNA, 17 nt, Mycobacterium bovis subsp bovis AF2122/97
gccgaauaacagcaggc

SEQ ID NO: 3084151 - RNA, 18 nt, Mycobacterium bovis subsp bovis AF2122/97
gccgaauaacagcaggca

SEQ ID NO: 3084152 - RNA, 14 nt, Mycobacterium bovis subsp bovis AF2122/97
gccgaauaccacac

SEQ ID NO: 3084153 - RNA, 19 nt, Mycobacterium bovis subsp bovis AF2122/97
gccgaauaccacaccguga

SEQ ID NO: 3084154 - RNA, 20 nt, Mycobacterium bovis subsp bovis AF2122/97
gccgaauaccacaccgugac

SEQ ID NO: 3084155 - RNA, 16 nt, Mycobacterium bovis subsp bovis AF2122/97
gccgaauaccgguggc

SEQ ID NO: 3084156 - RNA, 21 nt, Mycobacterium bovis subsp bovis AF2122/97
gccgaauaccgguggcagccu

SEQ ID NO: 3084157 - RNA, 15 nt, Mycobacterium bovis subsp bovis AF2122/97
gccgaaucgcugacc

SEQ ID NO: 3084158 - RNA, 17 nt, Mycobacterium bovis subsp bovis AF2122/97
gccgaaucgcugaccgc

SEQ ID NO: 3084159 - RNA, 17 nt, Mycobacterium bovis subsp bovis AF2122/97
gccgaaucucaccguca

SEQ ID NO: 3084160 - RNA, 20 nt, Mycobacterium bovis subsp bovis AF2122/97
gccgaaugccaccucgacgc

SEQ ID NO: 3084161 - RNA, 15 nt, Mycobacterium bovis subsp bovis AF2122/97
gccgaauggcugggc

SEQ ID NO: 3084162 - RNA, 22 nt, Mycobacterium bovis subsp bovis AF2122/97
gccgaauucauccgggcucgca

SEQ ID NO: 3084163 - RNA, 15 nt, Mycobacterium bovis subsp bovis AF2122/97
gccgacaaccccgcc

SEQ ID NO: 3084164 - RNA, 16 nt, Mycobacterium bovis subsp bovis AF2122/97
gccgacaaccccgcca

SEQ ID NO: 3084165 - RNA, 19 nt, Mycobacterium bovis subsp bovis AF2122/97
gccgacaaccccgccagga

SEQ ID NO: 3084166 - RNA, 18 nt, Mycobacterium bovis subsp bovis AF2122/97
gccgacaacccggccggg

SEQ ID NO: 3084167 - RNA, 21 nt, Mycobacterium bovis subsp bovis AF2122/97
gccgacaacccggccgggccu

SEQ ID NO: 3084168 - RNA, 22 nt, Mycobacterium bovis subsp bovis AF2122/97
gccgacaacccggccgggccug

SEQ ID NO: 3084169 - RNA, 18 nt, Mycobacterium bovis subsp bovis AF2122/97
gccgacaaccuuggcgac

SEQ ID NO: 3084170 - RNA, 17 nt, Mycobacterium bovis subsp bovis AF2122/97
gccgacaacgacgucgc

SEQ ID NO: 3084171 - RNA, 20 nt, Mycobacterium bovis subsp bovis AF2122/97
gccgacaacgacgucgccga

SEQ ID NO: 3084172 - RNA, 21 nt, Mycobacterium bovis subsp bovis AF2122/97
gccgacaacgacgucgccgac

SEQ ID NO: 3084173 - RNA, 22 nt, Mycobacterium bovis subsp bovis AF2122/97
gccgacaacgacgucgccgacc

SEQ ID NO: 3084174 - RNA, 23 nt, Mycobacterium bovis subsp bovis AF2122/97
gccgacaacgacgucgccgaccc

SEQ ID NO: 3084175 - RNA, 15 nt, Mycobacterium bovis subsp bovis AF2122/97
gccgacaagucaaga

SEQ ID NO: 3084176 - RNA, 16 nt, Mycobacterium bovis subsp bovis AF2122/97
gccgacaagucaagau

SEQ ID NO: 3084177 - RNA, 15 nt, Mycobacterium bovis subsp bovis AF2122/97
gccgacaccaccggc

SEQ ID NO: 3084178 - RNA, 17 nt, Mycobacterium bovis subsp bovis AF2122/97
gccgacaccaccggcgc

SEQ ID NO: 3084179 - RNA, 19 nt, Mycobacterium bovis subsp bovis AF2122/97
gccgacaccaccggcgccg

SEQ ID NO: 3084180 - RNA, 13 nt, Mycobacterium bovis subsp bovis AF2122/97
gccgacaccgcca

SEQ ID NO: 3084181 - RNA, 16 nt, Mycobacterium bovis subsp bovis AF2122/97
gccgacaccgccacca

SEQ ID NO: 3084182 - RNA, 18 nt, Mycobacterium bovis subsp bovis AF2122/97
gccgacaccgccaccacg

SEQ ID NO: 3084183 - RNA, 20 nt, Mycobacterium bovis subsp bovis AF2122/97
gccgacaccgccaccacgcc

SEQ ID NO: 3084184 - RNA, 22 nt, Mycobacterium bovis subsp bovis AF2122/97
gccgacaccgccaccacgccgu

SEQ ID NO: 3084185 - RNA, 14 nt, Mycobacterium bovis subsp bovis AF2122/97
gccgacaccggcug

SEQ ID NO: 3084186 - RNA, 17 nt, Mycobacterium bovis subsp bovis AF2122/97
gccgacaccggcugacc

SEQ ID NO: 3084187 - RNA, 14 nt, Mycobacterium bovis subsp bovis AF2122/97
gccgacacgccgau

SEQ ID NO: 3084188 - RNA, 15 nt, Mycobacterium bovis subsp bovis AF2122/97
gccgacacgccgaug

SEQ ID NO: 3084189 - RNA, 16 nt, Mycobacterium bovis subsp bovis AF2122/97
gccgacacguugcagc

SEQ ID NO: 3084190 - RNA, 15 nt, Mycobacterium bovis subsp bovis AF2122/97
gccgacagauggucg

SEQ ID NO: 3084191 - RNA, 14 nt, Mycobacterium bovis subsp bovis AF2122/97
gccgacagccaccg

SEQ ID NO: 3084192 - RNA, 15 nt, Mycobacterium bovis subsp bovis AF2122/97
gccgacagcccacga

SEQ ID NO: 3084193 - RNA, 15 nt, Mycobacterium bovis subsp bovis AF2122/97
gccgacaucggcggc

SEQ ID NO: 3084194 - RNA, 16 nt, Mycobacterium bovis subsp bovis AF2122/97
gccgacaucggcggcc

SEQ ID NO: 3084195 - RNA, 18 nt, Mycobacterium bovis subsp bovis AF2122/97
gccgacaucggcggcccu

SEQ ID NO: 3084196 - RNA, 13 nt, Mycobacterium bovis subsp bovis AF2122/97
gccgaccgguggc

SEQ ID NO: 3084197 - RNA, 19 nt, Mycobacterium bovis subsp bovis AF2122/97
gccgaccgguggcaccggc

SEQ ID NO: 3084198 - RNA, 21 nt, Mycobacterium bovis subsp bovis AF2122/97
gccgaccgguggcaccggcgg

SEQ ID NO: 3084199 - RNA, 22 nt, Mycobacterium bovis subsp bovis AF2122/97
gccgaccgguuggguagcaccg

SEQ ID NO: 3084200 - RNA, 16 nt, Mycobacterium bovis subsp bovis AF2122/97
gccgaccguaccgauc

SEQ ID NO: 3084201 - RNA, 23 nt, Mycobacterium bovis subsp bovis AF2122/97
gccgaccguuucuccgccgccca

SEQ ID NO: 3084202 - RNA, 16 nt, Mycobacterium bovis subsp bovis AF2122/97
gccgaccuagcucgcg

SEQ ID NO: 3084203 - RNA, 12 nt, Mycobacterium bovis subsp bovis AF2122/97
gccgaccucgag

SEQ ID NO: 3084204 - RNA, 16 nt, Mycobacterium bovis subsp bovis AF2122/97
gccgaccucggcaacg

SEQ ID NO: 3084205 - RNA, 15 nt, Mycobacterium bovis subsp bovis AF2122/97
gccgaccugcgcgac

SEQ ID NO: 3084206 - RNA, 16 nt, Mycobacterium bovis subsp bovis AF2122/97
gccgaccugcgcgacg

SEQ ID NO: 3084207 - RNA, 19 nt, Mycobacterium bovis subsp bovis AF2122/97
gccgaccugcgcgacggcg

SEQ ID NO: 3084208 - RNA, 21 nt, Mycobacterium bovis subsp bovis AF2122/97
gccgaccugcgcgacggcgcu

SEQ ID NO: 3084209 - RNA, 23 nt, Mycobacterium bovis subsp bovis AF2122/97
gccgaccuggacaaccucgucga

SEQ ID NO: 3084210 - RNA, 19 nt, Mycobacterium bovis subsp bovis AF2122/97
gccgaccuguaugccgcgg

SEQ ID NO: 3084211 - RNA, 20 nt, Mycobacterium bovis subsp bovis AF2122/97
gccgaccuguaugccgcggu

SEQ ID NO: 3084212 - RNA, 17 nt, Mycobacterium bovis subsp bovis AF2122/97
gccgaccuuggcgucga

SEQ ID NO: 3084213 - RNA, 17 nt, Mycobacterium bovis subsp bovis AF2122/97
gccgaccuuuugcggca

SEQ ID NO: 3084214 - RNA, 23 nt, Mycobacterium bovis subsp bovis AF2122/97
gccgacgaacgaaccgccgccgc

SEQ ID NO: 3084215 - RNA, 17 nt, Mycobacterium bovis subsp bovis AF2122/97
gccgacgaacugcagcc

SEQ ID NO: 3084216 - RNA, 17 nt, Mycobacterium bovis subsp bovis AF2122/97
gccgacgacaacagcca

SEQ ID NO: 3084217 - RNA, 18 nt, Mycobacterium bovis subsp bovis AF2122/97
gccgacgacauugggcgc

SEQ ID NO: 3084218 - RNA, 14 nt, Mycobacterium bovis subsp bovis AF2122/97
gccgacgaccagca

SEQ ID NO: 3084219 - RNA, 15 nt, Mycobacterium bovis subsp bovis AF2122/97
gccgacgacuccggc

SEQ ID NO: 3084220 - RNA, 24 nt, Mycobacterium bovis subsp bovis AF2122/97
gccgacgacuccggcaagcacacc

SEQ ID NO: 3084221 - RNA, 16 nt, Mycobacterium bovis subsp bovis AF2122/97
gccgacgagacggcag

SEQ ID NO: 3084222 - RNA, 22 nt, Mycobacterium bovis subsp bovis AF2122/97
gccgacgagaucguccaugggc

SEQ ID NO: 3084223 - RNA, 20 nt, Mycobacterium bovis subsp bovis AF2122/97
gccgacgaucauauggccgc

SEQ ID NO: 3084224 - RNA, 21 nt, Mycobacterium bovis subsp bovis AF2122/97
gccgacgaucauauggccgcc

SEQ ID NO: 3084225 - RNA, 18 nt, Mycobacterium bovis subsp bovis AF2122/97
gccgacgaucgacgccgc

SEQ ID NO: 3084226 - RNA, 22 nt, Mycobacterium bovis subsp bovis AF2122/97
gccgacgaucgacgccgccacc

SEQ ID NO: 3084227 - RNA, 13 nt, Mycobacterium bovis subsp bovis AF2122/97
gccgacgaugacg

SEQ ID NO: 3084228 - RNA, 21 nt, Mycobacterium bovis subsp bovis AF2122/97
gccgacgauuaccagcggcac

SEQ ID NO: 3084229 - RNA, 18 nt, Mycobacterium bovis subsp bovis AF2122/97
gccgacgccaacgccagc

SEQ ID NO: 3084230 - RNA, 12 nt, Mycobacterium bovis subsp bovis AF2122/97
gccgacgcccag

SEQ ID NO: 3084231 - RNA, 13 nt, Mycobacterium bovis subsp bovis AF2122/97
gccgacgccccga

SEQ ID NO: 3084232 - RNA, 18 nt, Mycobacterium bovis subsp bovis AF2122/97
gccgacgccccgaucggc

SEQ ID NO: 3084233 - RNA, 21 nt, Mycobacterium bovis subsp bovis AF2122/97
gccgacgccccgaucggccac

SEQ ID NO: 3084234 - RNA, 13 nt, Mycobacterium bovis subsp bovis AF2122/97
gccgacgcccgac

SEQ ID NO: 3084235 - RNA, 13 nt, Mycobacterium bovis subsp bovis AF2122/97
gccgacgccgaua

SEQ ID NO: 3084236 - RNA, 12 nt, Mycobacterium bovis subsp bovis AF2122/97
gccgacgccgcc

SEQ ID NO: 3084237 - RNA, 13 nt, Mycobacterium bovis subsp bovis AF2122/97
gccgacgccgccg

SEQ ID NO: 3084238 - RNA, 19 nt, Mycobacterium bovis subsp bovis AF2122/97
gccgacgccgccggcaccg

SEQ ID NO: 3084239 - RNA, 16 nt, Mycobacterium bovis subsp bovis AF2122/97
gccgacgccgccggcc

SEQ ID NO: 3084240 - RNA, 18 nt, Mycobacterium bovis subsp bovis AF2122/97
gccgacgccgccggcccc

SEQ ID NO: 3084241 - RNA, 21 nt, Mycobacterium bovis subsp bovis AF2122/97
gccgacgccgccggcgccacc

SEQ ID NO: 3084242 - RNA, 14 nt, Mycobacterium bovis subsp bovis AF2122/97
gccgacgccggugc

SEQ ID NO: 3084243 - RNA, 15 nt, Mycobacterium bovis subsp bovis AF2122/97
gccgacgccggugcc

SEQ ID NO: 3084244 - RNA, 19 nt, Mycobacterium bovis subsp bovis AF2122/97
gccgacgccggugccggcc

SEQ ID NO: 3084245 - RNA, 18 nt, Mycobacterium bovis subsp bovis AF2122/97
gccgacgccguugcccac

SEQ ID NO: 3084246 - RNA, 20 nt, Mycobacterium bovis subsp bovis AF2122/97
gccgacgccuuccagcccga

SEQ ID NO: 3084247 - RNA, 16 nt, Mycobacterium bovis subsp bovis AF2122/97
gccgacgcgaacccau

SEQ ID NO: 3084248 - RNA, 13 nt, Mycobacterium bovis subsp bovis AF2122/97
gccgacgcgcggc

SEQ ID NO: 3084249 - RNA, 17 nt, Mycobacterium bovis subsp bovis AF2122/97
gccgacgcgcggccagc

SEQ ID NO: 3084250 - RNA, 14 nt, Mycobacterium bovis subsp bovis AF2122/97
gccgacgcggcggg

SEQ ID NO: 3084251 - RNA, 22 nt, Mycobacterium bovis subsp bovis AF2122/97
gccgacgcuccaggguccggac

SEQ ID NO: 3084252 - RNA, 13 nt, Mycobacterium bovis subsp bovis AF2122/97
gccgacgcugcug

SEQ ID NO: 3084253 - RNA, 18 nt, Mycobacterium bovis subsp bovis AF2122/97
gccgacgcuggcggugua

SEQ ID NO: 3084254 - RNA, 16 nt, Mycobacterium bovis subsp bovis AF2122/97
gccgacggaucgcccu

SEQ ID NO: 3084255 - RNA, 13 nt, Mycobacterium bovis subsp bovis AF2122/97
gccgacggcaagg

SEQ ID NO: 3084256 - RNA, 22 nt, Mycobacterium bovis subsp bovis AF2122/97
gccgacggcaagggcauacagc

SEQ ID NO: 3084257 - RNA, 17 nt, Mycobacterium bovis subsp bovis AF2122/97
gccgacggcaccgaaau

SEQ ID NO: 3084258 - RNA, 12 nt, Mycobacterium bovis subsp bovis AF2122/97
gccgacggccag

SEQ ID NO: 3084259 - RNA, 15 nt, Mycobacterium bovis subsp bovis AF2122/97
gccgacggccagcag

SEQ ID NO: 3084260 - RNA, 17 nt, Mycobacterium bovis subsp bovis AF2122/97
gccgacggccagcagga

SEQ ID NO: 3084261 - RNA, 18 nt, Mycobacterium bovis subsp bovis AF2122/97
gccgacggccagcaggau

SEQ ID NO: 3084262 - RNA, 12 nt, Mycobacterium bovis subsp bovis AF2122/97
gccgacggcgac

SEQ ID NO: 3084263 - RNA, 16 nt, Mycobacterium bovis subsp bovis AF2122/97
gccgacggcgaccacc

SEQ ID NO: 3084264 - RNA, 17 nt, Mycobacterium bovis subsp bovis AF2122/97
gccgacggcgaccaccg

SEQ ID NO: 3084265 - RNA, 16 nt, Mycobacterium bovis subsp bovis AF2122/97
gccgacggcgcccgcc

SEQ ID NO: 3084266 - RNA, 13 nt, Mycobacterium bovis subsp bovis AF2122/97
gccgacggcgccg

SEQ ID NO: 3084267 - RNA, 17 nt, Mycobacterium bovis subsp bovis AF2122/97
gccgacggcgccgaacc

SEQ ID NO: 3084268 - RNA, 17 nt, Mycobacterium bovis subsp bovis AF2122/97
gccgacggcgggcgauc

SEQ ID NO: 3084269 - RNA, 14 nt, Mycobacterium bovis subsp bovis AF2122/97
gccgacgggacaac

SEQ ID NO: 3084270 - RNA, 14 nt, Mycobacterium bovis subsp bovis AF2122/97
gccgacgggcgcaa

SEQ ID NO: 3084271 - RNA, 15 nt, Mycobacterium bovis subsp bovis AF2122/97
gccgacgggcgcaac

SEQ ID NO: 3084272 - RNA, 17 nt, Mycobacterium bovis subsp bovis AF2122/97
gccgacggugcaagccc

SEQ ID NO: 3084273 - RNA, 18 nt, Mycobacterium bovis subsp bovis AF2122/97
gccgacggugggcgaggu

SEQ ID NO: 3084274 - RNA, 13 nt, Mycobacterium bovis subsp bovis AF2122/97
gccgacgguuacc

SEQ ID NO: 3084275 - RNA, 18 nt, Mycobacterium bovis subsp bovis AF2122/97
gccgacguauagaccagg

SEQ ID NO: 3084276 - RNA, 21 nt, Mycobacterium bovis subsp bovis AF2122/97
gccgacgucgacgccggccag

SEQ ID NO: 3084277 - RNA, 14 nt, Mycobacterium bovis subsp bovis AF2122/97
gccgacgucgccga

SEQ ID NO: 3084278 - RNA, 14 nt, Mycobacterium bovis subsp bovis AF2122/97
gccgacgucgccgg

SEQ ID NO: 3084279 - RNA, 12 nt, Mycobacterium bovis subsp bovis AF2122/97
gccgacgucggc

SEQ ID NO: 3084280 - RNA, 15 nt, Mycobacterium bovis subsp bovis AF2122/97
gccgacgucuaggcc

SEQ ID NO: 3084281 - RNA, 16 nt, Mycobacterium bovis subsp bovis AF2122/97
gccgacgucuaggcca

SEQ ID NO: 3084282 - RNA, 22 nt, Mycobacterium bovis subsp bovis AF2122/97
gccgacgucugguuggcuggcg

SEQ ID NO: 3084283 - RNA, 15 nt, Mycobacterium bovis subsp bovis AF2122/97
gccgagcgaccgucc

SEQ ID NO: 3084284 - RNA, 23 nt, Mycobacterium bovis subsp bovis AF2122/97
gccgagcgagaaucacggucauc

SEQ ID NO: 3084285 - RNA, 23 nt, Mycobacterium bovis subsp bovis AF2122/97
gccgagcgcaacucccagcacgg

SEQ ID NO: 3084286 - RNA, 20 nt, Mycobacterium bovis subsp bovis AF2122/97
gccgagcgcaaggucgacgg

SEQ ID NO: 3084287 - RNA, 22 nt, Mycobacterium bovis subsp bovis AF2122/97
gccgagcgcacuggggaggcca

SEQ ID NO: 3084288 - RNA, 18 nt, Mycobacterium bovis subsp bovis AF2122/97
gccgagcgcccgcuaggc

SEQ ID NO: 3084289 - RNA, 13 nt, Mycobacterium bovis subsp bovis AF2122/97
gccgagcgcgccg

SEQ ID NO: 3084290 - RNA, 16 nt, Mycobacterium bovis subsp bovis AF2122/97
gccgagcggaccaccg

SEQ ID NO: 3084291 - RNA, 22 nt, Mycobacterium bovis subsp bovis AF2122/97
gccgagcggaccaccgcucgcc

SEQ ID NO: 3084292 - RNA, 13 nt, Mycobacterium bovis subsp bovis AF2122/97
gccgagcggcggc

SEQ ID NO: 3084293 - RNA, 13 nt, Mycobacterium bovis subsp bovis AF2122/97
gccgagcggguug

SEQ ID NO: 3084294 - RNA, 15 nt, Mycobacterium bovis subsp bovis AF2122/97
gccgagcggucaacg

SEQ ID NO: 3084295 - RNA, 13 nt, Mycobacterium bovis subsp bovis AF2122/97
gccgagcggugcc

SEQ ID NO: 3084296 - RNA, 20 nt, Mycobacterium bovis subsp bovis AF2122/97
gccgagcggugccggcguag

SEQ ID NO: 3084297 - RNA, 14 nt, Mycobacterium bovis subsp bovis AF2122/97
gccgagcgguugcc

SEQ ID NO: 3084298 - RNA, 21 nt, Mycobacterium bovis subsp bovis AF2122/97
gccgagcgugaaccuggcgac

SEQ ID NO: 3084299 - RNA, 22 nt, Mycobacterium bovis subsp bovis AF2122/97
gccgagcgugaagucacggcgg

SEQ ID NO: 3084300 - RNA, 14 nt, Mycobacterium bovis subsp bovis AF2122/97
gccgagcgugcgcu

SEQ ID NO: 3084301 - RNA, 13 nt, Mycobacterium bovis subsp bovis AF2122/97
gccgagcguggcc

SEQ ID NO: 3084302 - RNA, 20 nt, Mycobacterium bovis subsp bovis AF2122/97
gccgagcuagaucacggagc

SEQ ID NO: 3084303 - RNA, 21 nt, Mycobacterium bovis subsp bovis AF2122/97
gccgagcucacuucacgccgc

SEQ ID NO: 3084304 - RNA, 14 nt, Mycobacterium bovis subsp bovis AF2122/97
gccgagcuccucca

SEQ ID NO: 3084305 - RNA, 16 nt, Mycobacterium bovis subsp bovis AF2122/97
gccgagcucggucacc

SEQ ID NO: 3084306 - RNA, 20 nt, Mycobacterium bovis subsp bovis AF2122/97
gccgagcucggucaccacgg

SEQ ID NO: 3084307 - RNA, 22 nt, Mycobacterium bovis subsp bovis AF2122/97
gccgagcucggucaccacggcg

SEQ ID NO: 3084308 - RNA, 19 nt, Mycobacterium bovis subsp bovis AF2122/97
gccgagcucguaguguucc

SEQ ID NO: 3084309 - RNA, 23 nt, Mycobacterium bovis subsp bovis AF2122/97
gccgagcucguugaccaggaaug

SEQ ID NO: 3084310 - RNA, 21 nt, Mycobacterium bovis subsp bovis AF2122/97
gccgagcucguugcuggcggc

SEQ ID NO: 3084311 - RNA, 21 nt, Mycobacterium bovis subsp bovis AF2122/97
gccgagcuggcaacgccgcgc

SEQ ID NO: 3084312 - RNA, 21 nt, Mycobacterium bovis subsp bovis AF2122/97
gccgagcuggcgcgcggggug

SEQ ID NO: 3084313 - RNA, 19 nt, Mycobacterium bovis subsp bovis AF2122/97
gccgagcugguaaacgggu

SEQ ID NO: 3084314 - RNA, 21 nt, Mycobacterium bovis subsp bovis AF2122/97
gccgagcugguaaacgggugg

SEQ ID NO: 3084315 - RNA, 12 nt, Mycobacterium bovis subsp bovis AF2122/97
gccgagcugguu

SEQ ID NO: 3084316 - RNA, 20 nt, Mycobacterium bovis subsp bovis AF2122/97
gccgagcugguugacggcga

SEQ ID NO: 3084317 - RNA, 21 nt, Mycobacterium bovis subsp bovis AF2122/97
gccgagcugguugacggcgaa

SEQ ID NO: 3084318 - RNA, 22 nt, Mycobacterium bovis subsp bovis AF2122/97
gccgagcugguugacggcgaag

SEQ ID NO: 3084319 - RNA, 21 nt, Mycobacterium bovis subsp bovis AF2122/97
gccgagcugguuggcgccgaa

SEQ ID NO: 3084320 - RNA, 17 nt, Mycobacterium bovis subsp bovis AF2122/97
gccgagcugugcgcaga

SEQ ID NO: 3084321 - RNA, 18 nt, Mycobacterium bovis subsp bovis AF2122/97
gccgagcugugcgcagac

SEQ ID NO: 3084322 - RNA, 19 nt, Mycobacterium bovis subsp bovis AF2122/97
gccgagcuucagcgcgcug

SEQ ID NO: 3084323 - RNA, 18 nt, Mycobacterium bovis subsp bovis AF2122/97
gccgagcuugucgagcag

SEQ ID NO: 3084324 - RNA, 17 nt, Mycobacterium bovis subsp bovis AF2122/97
gccgaggaaaccaccag

SEQ ID NO: 3084325 - RNA, 19 nt, Mycobacterium bovis subsp bovis AF2122/97
gccgaggaaaucgcccucg

SEQ ID NO: 3084326 - RNA, 23 nt, Mycobacterium bovis subsp bovis AF2122/97
gccgaggaauacucucgcgacau

SEQ ID NO: 3084327 - RNA, 15 nt, Mycobacterium bovis subsp bovis AF2122/97
gccgaggaccagagg

SEQ ID NO: 3084328 - RNA, 17 nt, Mycobacterium bovis subsp bovis AF2122/97
gccgaggaccagaggcg

SEQ ID NO: 3084329 - RNA, 15 nt, Mycobacterium bovis subsp bovis AF2122/97
gccgaggacgccggc

SEQ ID NO: 3084330 - RNA, 22 nt, Mycobacterium bovis subsp bovis AF2122/97
gccgaggacuggaaagcagcag

SEQ ID NO: 3084331 - RNA, 20 nt, Mycobacterium bovis subsp bovis AF2122/97
gccgaggcaaccgacacugg

SEQ ID NO: 3084332 - RNA, 19 nt, Mycobacterium bovis subsp bovis AF2122/97
gccgaggcagcgucgucga

SEQ ID NO: 3084333 - RNA, 16 nt, Mycobacterium bovis subsp bovis AF2122/97
gccgaggccgucgcga

SEQ ID NO: 3084334 - RNA, 18 nt, Mycobacterium bovis subsp bovis AF2122/97
gccgaggccuaccaggcg

SEQ ID NO: 3084335 - RNA, 20 nt, Mycobacterium bovis subsp bovis AF2122/97
gccgaggccuaccaggcgcg

SEQ ID NO: 3084336 - RNA, 23 nt, Mycobacterium bovis subsp bovis AF2122/97
gccgaggccuaccaggcgcggcc

SEQ ID NO: 3084337 - RNA, 14 nt, Mycobacterium bovis subsp bovis AF2122/97
gccgaggccucggc

SEQ ID NO: 3084338 - RNA, 18 nt, Mycobacterium bovis subsp bovis AF2122/97
gccgaggccucggccagc

SEQ ID NO: 3084339 - RNA, 17 nt, Mycobacterium bovis subsp bovis AF2122/97
gccgaggcuagcagaga

SEQ ID NO: 3084340 - RNA, 15 nt, Mycobacterium bovis subsp bovis AF2122/97
gccgagggcgccggg

SEQ ID NO: 3084341 - RNA, 18 nt, Mycobacterium bovis subsp bovis AF2122/97
gccgagggcgccgggggc

SEQ ID NO: 3084342 - RNA, 19 nt, Mycobacterium bovis subsp bovis AF2122/97
gccgaggguagacggggcg

SEQ ID NO: 3084343 - RNA, 23 nt, Mycobacterium bovis subsp bovis AF2122/97
gccgaggguagacggggcgagca

SEQ ID NO: 3084344 - RNA, 18 nt, Mycobacterium bovis subsp bovis AF2122/97
gccgagguaacgcagcgg

SEQ ID NO: 3084345 - RNA, 19 nt, Mycobacterium bovis subsp bovis AF2122/97
gccgagguagauggcgaac

SEQ ID NO: 3084346 - RNA, 20 nt, Mycobacterium bovis subsp bovis AF2122/97
gccgaggucgaaccgccggc

SEQ ID NO: 3084347 - RNA, 22 nt, Mycobacterium bovis subsp bovis AF2122/97
gccgaggucgcccgugucguac

SEQ ID NO: 3084348 - RNA, 17 nt, Mycobacterium bovis subsp bovis AF2122/97
gccgaggucgguucggc

SEQ ID NO: 3084349 - RNA, 20 nt, Mycobacterium bovis subsp bovis AF2122/97
gccgaggucgguucggccgg

SEQ ID NO: 3084350 - RNA, 22 nt, Mycobacterium bovis subsp bovis AF2122/97
gccgagguuguuggagaugucg

SEQ ID NO: 3084351 - RNA, 15 nt, Mycobacterium bovis subsp bovis AF2122/97
gccgaguaccagccc

SEQ ID NO: 3084352 - RNA, 21 nt, Mycobacterium bovis subsp bovis AF2122/97
gccgaguaccagcccaccggc

SEQ ID NO: 3084353 - RNA, 15 nt, Mycobacterium bovis subsp bovis AF2122/97
gccgaguaccggcca

SEQ ID NO: 3084354 - RNA, 16 nt, Mycobacterium bovis subsp bovis AF2122/97
gccgaguaccggccag

SEQ ID NO: 3084355 - RNA, 17 nt, Mycobacterium bovis subsp bovis AF2122/97
gccgaguaccggccagc

SEQ ID NO: 3084356 - RNA, 15 nt, Mycobacterium bovis subsp bovis AF2122/97
gccgaguccggcaag

SEQ ID NO: 3084357 - RNA, 14 nt, Mycobacterium bovis subsp bovis AF2122/97
gccgagugcccagc

SEQ ID NO: 3084358 - RNA, 20 nt, Mycobacterium bovis subsp bovis AF2122/97
gccgagugcccagcgaugcg

SEQ ID NO: 3084359 - RNA, 17 nt, Mycobacterium bovis subsp bovis AF2122/97
gccgaguggccgcauua

SEQ ID NO: 3084360 - RNA, 21 nt, Mycobacterium bovis subsp bovis AF2122/97
gccgaguggccgcauuagccu

SEQ ID NO: 3084361 - RNA, 17 nt, Mycobacterium bovis subsp bovis AF2122/97
gccgaguuccugcacgg

SEQ ID NO: 3084362 - RNA, 16 nt, Mycobacterium bovis subsp bovis AF2122/97
gccgaguucgucagcg

SEQ ID NO: 3084363 - RNA, 14 nt, Mycobacterium bovis subsp bovis AF2122/97
gccgaguugaccgc

SEQ ID NO: 3084364 - RNA, 15 nt, Mycobacterium bovis subsp bovis AF2122/97
gccgaguugcccggg

SEQ ID NO: 3084365 - RNA, 23 nt, Mycobacterium bovis subsp bovis AF2122/97
gccgaguugcccgggucggccgg

SEQ ID NO: 3084366 - RNA, 21 nt, Mycobacterium bovis subsp bovis AF2122/97
gccgauacagcacauccagcc

SEQ ID NO: 3084367 - RNA, 24 nt, Mycobacterium bovis subsp bovis AF2122/97
gccgauaccagccaaaacgagcag

SEQ ID NO: 3084368 - RNA, 14 nt, Mycobacterium bovis subsp bovis AF2122/97
gccgauacccagcg

SEQ ID NO: 3084369 - RNA, 13 nt, Mycobacterium bovis subsp bovis AF2122/97
gccgaugcggguc

SEQ ID NO: 3084370 - RNA, 20 nt, Mycobacterium bovis subsp bovis AF2122/97
gccgaugcgggucucgaccu

SEQ ID NO: 3084371 - RNA, 14 nt, Mycobacterium bovis subsp bovis AF2122/97
gccgaugcggugcg

SEQ ID NO: 3084372 - RNA, 15 nt, Mycobacterium bovis subsp bovis AF2122/97
gccgaugcugccgcc

SEQ ID NO: 3084373 - RNA, 18 nt, Mycobacterium bovis subsp bovis AF2122/97
gccgaugcugccgccgcc

SEQ ID NO: 3084374 - RNA, 19 nt, Mycobacterium bovis subsp bovis AF2122/97
gccgaugcugccgccgccg

SEQ ID NO: 3084375 - RNA, 16 nt, Mycobacterium bovis subsp bovis AF2122/97
gccgaugcugcgggcg

SEQ ID NO: 3084376 - RNA, 17 nt, Mycobacterium bovis subsp bovis AF2122/97
gccgauggcgucaagca

SEQ ID NO: 3084377 - RNA, 22 nt, Mycobacterium bovis subsp bovis AF2122/97
gccgauggucaaugcgcuggcg

SEQ ID NO: 3084378 - RNA, 15 nt, Mycobacterium bovis subsp bovis AF2122/97
gccgauggugauggg

SEQ ID NO: 3084379 - RNA, 17 nt, Mycobacterium bovis subsp bovis AF2122/97
gccgauggugauggggg

SEQ ID NO: 3084380 - RNA, 22 nt, Mycobacterium bovis subsp bovis AF2122/97
gccgauguacugugccgccccc

SEQ ID NO: 3084381 - RNA, 15 nt, Mycobacterium bovis subsp bovis AF2122/97
gccgaugucgacgac

SEQ ID NO: 3084382 - RNA, 22 nt, Mycobacterium bovis subsp bovis AF2122/97
gccgaugucgaugccgcgcagc

SEQ ID NO: 3084383 - RNA, 22 nt, Mycobacterium bovis subsp bovis AF2122/97
gccgaugucgucuuuggucagc

SEQ ID NO: 3084384 - RNA, 14 nt, Mycobacterium bovis subsp bovis AF2122/97
gccgauguggccgg

SEQ ID NO: 3084385 - RNA, 19 nt, Mycobacterium bovis subsp bovis AF2122/97
gccgauguggccggcgaug

SEQ ID NO: 3084386 - RNA, 17 nt, Mycobacterium bovis subsp bovis AF2122/97
gccgaugugggcggagc

SEQ ID NO: 3084387 - RNA, 17 nt, Mycobacterium bovis subsp bovis AF2122/97
gccgauguggucggcug

SEQ ID NO: 3084388 - RNA, 19 nt, Mycobacterium bovis subsp bovis AF2122/97
gccgauguggucggcuguc

SEQ ID NO: 3084389 - RNA, 17 nt, Mycobacterium bovis subsp bovis AF2122/97
gccgauguuggcagggc

SEQ ID NO: 3084390 - RNA, 21 nt, Mycobacterium bovis subsp bovis AF2122/97
gccgauuacggugaucgccgg

SEQ ID NO: 3084391 - RNA, 22 nt, Mycobacterium bovis subsp bovis AF2122/97
gccgauuacggugaucgccggc

SEQ ID NO: 3084392 - RNA, 16 nt, Mycobacterium bovis subsp bovis AF2122/97
gccgauuccaccgccg

SEQ ID NO: 3084393 - RNA, 17 nt, Mycobacterium bovis subsp bovis AF2122/97
gccgauuccaccgccga

SEQ ID NO: 3084394 - RNA, 13 nt, Mycobacterium bovis subsp bovis AF2122/97
gccgauuccgcgc

SEQ ID NO: 3084395 - RNA, 16 nt, Mycobacterium bovis subsp bovis AF2122/97
gccgauuccgcgcguc

SEQ ID NO: 3084396 - RNA, 22 nt, Mycobacterium bovis subsp bovis AF2122/97
gccgauuccgcgcguccgucgg

SEQ ID NO: 3084397 - RNA, 23 nt, Mycobacterium bovis subsp bovis AF2122/97
gccgauuccgcgcguccgucggc

SEQ ID NO: 3084398 - RNA, 18 nt, Mycobacterium bovis subsp bovis AF2122/97
gccgauugcguucaucau

SEQ ID NO: 3084399 - RNA, 23 nt, Mycobacterium bovis subsp bovis AF2122/97
gccgauugcuucuucgggccgcu

SEQ ID NO: 3084400 - RNA, 15 nt, Mycobacterium bovis subsp bovis AF2122/97
gccgauuggccugcc

SEQ ID NO: 3084401 - RNA, 22 nt, Mycobacterium bovis subsp bovis AF2122/97
gccgauuuugggaucgugccgg

SEQ ID NO: 3084402 - RNA, 15 nt, Mycobacterium bovis subsp bovis AF2122/97
gccgcaaacgcggcg

SEQ ID NO: 3084403 - RNA, 18 nt, Mycobacterium bovis subsp bovis AF2122/97
gccgcaacaccccccguc

SEQ ID NO: 3084404 - RNA, 23 nt, Mycobacterium bovis subsp bovis AF2122/97
gccgcaacaccccccguccaccg

SEQ ID NO: 3084405 - RNA, 19 nt, Mycobacterium bovis subsp bovis AF2122/97
gccgcaacaugggugaugc

SEQ ID NO: 3084406 - RNA, 22 nt, Mycobacterium bovis subsp bovis AF2122/97
gccgcaacaugggugaugcaac

SEQ ID NO: 3084407 - RNA, 11 nt, Mycobacterium bovis subsp bovis AF2122/97
gccgcaaccau

SEQ ID NO: 3084408 - RNA, 23 nt, Mycobacterium bovis subsp bovis AF2122/97
gccgcaaccauguuaacgcgcgu

SEQ ID NO: 3084409 - RNA, 14 nt, Mycobacterium bovis subsp bovis AF2122/97
gccgcaaccgcgaa

SEQ ID NO: 3084410 - RNA, 14 nt, Mycobacterium bovis subsp bovis AF2122/97
gccgcaaccggcga

SEQ ID NO: 3084411 - RNA, 15 nt, Mycobacterium bovis subsp bovis AF2122/97
gccgcaaccggcgau

SEQ ID NO: 3084412 - RNA, 19 nt, Mycobacterium bovis subsp bovis AF2122/97
gccgcaacgacuuucaucg

SEQ ID NO: 3084413 - RNA, 19 nt, Mycobacterium bovis subsp bovis AF2122/97
gccgcaagccucgugguga

SEQ ID NO: 3084414 - RNA, 19 nt, Mycobacterium bovis subsp bovis AF2122/97
gccgcaaguucacccauca

SEQ ID NO: 3084415 - RNA, 21 nt, Mycobacterium bovis subsp bovis AF2122/97
gccgcaaucagacggcgagua

SEQ ID NO: 3084416 - RNA, 22 nt, Mycobacterium bovis subsp bovis AF2122/97
gccgcaaucagacggcgaguag

SEQ ID NO: 3084417 - RNA, 19 nt, Mycobacterium bovis subsp bovis AF2122/97
gccgcaaucaugucagcgc

SEQ ID NO: 3084418 - RNA, 15 nt, Mycobacterium bovis subsp bovis AF2122/97
gccgcaaugacgucg

SEQ ID NO: 3084419 - RNA, 18 nt, Mycobacterium bovis subsp bovis AF2122/97
gccgcaaugacgucgucg

SEQ ID NO: 3084420 - RNA, 19 nt, Mycobacterium bovis subsp bovis AF2122/97
gccgcaaugacgucgucgg

SEQ ID NO: 3084421 - RNA, 19 nt, Mycobacterium bovis subsp bovis AF2122/97
gccgcaauggaccgaacga

SEQ ID NO: 3084422 - RNA, 15 nt, Mycobacterium bovis subsp bovis AF2122/97
gccgcacaaacgggc

SEQ ID NO: 3084423 - RNA, 23 nt, Mycobacterium bovis subsp bovis AF2122/97
gccgcacacgucaggcaacgaag

SEQ ID NO: 3084424 - RNA, 14 nt, Mycobacterium bovis subsp bovis AF2122/97
gccgcacagcacca

SEQ ID NO: 3084425 - RNA, 16 nt, Mycobacterium bovis subsp bovis AF2122/97
gccgcacaucugcggg

SEQ ID NO: 3084426 - RNA, 17 nt, Mycobacterium bovis subsp bovis AF2122/97
gccgcacaugagcugga

SEQ ID NO: 3084427 - RNA, 20 nt, Mycobacterium bovis subsp bovis AF2122/97
gccgcacauugguguccacc

SEQ ID NO: 3084428 - RNA, 21 nt, Mycobacterium bovis subsp bovis AF2122/97
gccgcacauugguguccacca

SEQ ID NO: 3084429 - RNA, 18 nt, Mycobacterium bovis subsp bovis AF2122/97
gccgcaccaagcagcgac

SEQ ID NO: 3084430 - RNA, 20 nt, Mycobacterium bovis subsp bovis AF2122/97
gccgcaccaagcagcgacca

SEQ ID NO: 3084431 - RNA, 22 nt, Mycobacterium bovis subsp bovis AF2122/97
gccgcaccaagcagcgaccagc

SEQ ID NO: 3084432 - RNA, 23 nt, Mycobacterium bovis subsp bovis AF2122/97
gccgcaccaagcagcgaccagca

SEQ ID NO: 3084433 - RNA, 13 nt, Mycobacterium bovis subsp bovis AF2122/97
gccgcaccaaggc

SEQ ID NO: 3084434 - RNA, 18 nt, Mycobacterium bovis subsp bovis AF2122/97
gccgcaccagaucgucgg

SEQ ID NO: 3084435 - RNA, 16 nt, Mycobacterium bovis subsp bovis AF2122/97
gccgcaccaucggcga

SEQ ID NO: 3084436 - RNA, 17 nt, Mycobacterium bovis subsp bovis AF2122/97
gccgcaccaucggcgag

SEQ ID NO: 3084437 - RNA, 19 nt, Mycobacterium bovis subsp bovis AF2122/97
gccgcaccaucggcgaggc

SEQ ID NO: 3084438 - RNA, 17 nt, Mycobacterium bovis subsp bovis AF2122/97
gccgcaccccgcccgac

SEQ ID NO: 3084439 - RNA, 18 nt, Mycobacterium bovis subsp bovis AF2122/97
gccgcacccgaucgacgg

SEQ ID NO: 3084440 - RNA, 15 nt, Mycobacterium bovis subsp bovis AF2122/97
gccgcacccgggacg

SEQ ID NO: 3084441 - RNA, 14 nt, Mycobacterium bovis subsp bovis AF2122/97
gccgcacccguugc

SEQ ID NO: 3084442 - RNA, 13 nt, Mycobacterium bovis subsp bovis AF2122/97
gccgcaccgccac

SEQ ID NO: 3084443 - RNA, 12 nt, Mycobacterium bovis subsp bovis AF2122/97
gccgcaccgccg

SEQ ID NO: 3084444 - RNA, 13 nt, Mycobacterium bovis subsp bovis AF2122/97
gccgcaccgccgc

SEQ ID NO: 3084445 - RNA, 20 nt, Mycobacterium bovis subsp bovis AF2122/97
gccgcaccgccugcucggcg

SEQ ID NO: 3084446 - RNA, 22 nt, Mycobacterium bovis subsp bovis AF2122/97
gccgcaccgccugcucggcgac

SEQ ID NO: 3084447 - RNA, 13 nt, Mycobacterium bovis subsp bovis AF2122/97
gccgcaccgcugu

SEQ ID NO: 3084448 - RNA, 14 nt, Mycobacterium bovis subsp bovis AF2122/97
gccgcaccggugcu

SEQ ID NO: 3084449 - RNA, 18 nt, Mycobacterium bovis subsp bovis AF2122/97
gccgcacgauagccgaaa

SEQ ID NO: 3084450 - RNA, 20 nt, Mycobacterium bovis subsp bovis AF2122/97
gccgcacgaugccgggaacg

SEQ ID NO: 3084451 - RNA, 13 nt, Mycobacterium bovis subsp bovis AF2122/97
gccgcacgauggc

SEQ ID NO: 3084452 - RNA, 14 nt, Mycobacterium bovis subsp bovis AF2122/97
gccgcacgauggcc

SEQ ID NO: 3084453 - RNA, 16 nt, Mycobacterium bovis subsp bovis AF2122/97
gccgcacgauggccgu

SEQ ID NO: 3084454 - RNA, 18 nt, Mycobacterium bovis subsp bovis AF2122/97
gccgcacgauggccgucg

SEQ ID NO: 3084455 - RNA, 20 nt, Mycobacterium bovis subsp bovis AF2122/97
gccgcaugcucagcaucguc

SEQ ID NO: 3084456 - RNA, 21 nt, Mycobacterium bovis subsp bovis AF2122/97
gccgcauggugggugccggcg

SEQ ID NO: 3084457 - RNA, 15 nt, Mycobacterium bovis subsp bovis AF2122/97
gccgcauucgcgaca

SEQ ID NO: 3084458 - RNA, 21 nt, Mycobacterium bovis subsp bovis AF2122/97
gccgcauucgugacgaguucg

SEQ ID NO: 3084459 - RNA, 20 nt, Mycobacterium bovis subsp bovis AF2122/97
gccgcauugcagaaccgcca

SEQ ID NO: 3084460 - RNA, 18 nt, Mycobacterium bovis subsp bovis AF2122/97
gccgccaaccgcaggccg

SEQ ID NO: 3084461 - RNA, 22 nt, Mycobacterium bovis subsp bovis AF2122/97
gccgccaaccgcaggccgaaga

SEQ ID NO: 3084462 - RNA, 24 nt, Mycobacterium bovis subsp bovis AF2122/97
gccgccaaccgcaggccgaagacg

SEQ ID NO: 3084463 - RNA, 18 nt, Mycobacterium bovis subsp bovis AF2122/97
gccgccaacuucaccacc

SEQ ID NO: 3084464 - RNA, 19 nt, Mycobacterium bovis subsp bovis AF2122/97
gccgccaacuucaccaccc

SEQ ID NO: 3084465 - RNA, 21 nt, Mycobacterium bovis subsp bovis AF2122/97
gccgccaacuucaccacccug

SEQ ID NO: 3084466 - RNA, 17 nt, Mycobacterium bovis subsp bovis AF2122/97
gccgccacaaacccgau

SEQ ID NO: 3084467 - RNA, 15 nt, Mycobacterium bovis subsp bovis AF2122/97
gccgccacaccgccg

SEQ ID NO: 3084468 - RNA, 18 nt, Mycobacterium bovis subsp bovis AF2122/97
gccgccacaccgccgcca

SEQ ID NO: 3084469 - RNA, 12 nt, Mycobacterium bovis subsp bovis AF2122/97
gccgccacagca

SEQ ID NO: 3084470 - RNA, 11 nt, Mycobacterium bovis subsp bovis AF2122/97
gccgccaccac

SEQ ID NO: 3084471 - RNA, 14 nt, Mycobacterium bovis subsp bovis AF2122/97
gccgccaccaccca

SEQ ID NO: 3084472 - RNA, 13 nt, Mycobacterium bovis subsp bovis AF2122/97
gccgccaccaccg

SEQ ID NO: 3084473 - RNA, 23 nt, Mycobacterium bovis subsp bovis AF2122/97
gccgccaccaccgcugccggcgc

SEQ ID NO: 3084474 - RNA, 14 nt, Mycobacterium bovis subsp bovis AF2122/97
gccgccaccaccgg

SEQ ID NO: 3084475 - RNA, 21 nt, Mycobacterium bovis subsp bovis AF2122/97
gccgccaccaccggcgccucc

SEQ ID NO: 3084476 - RNA, 13 nt, Mycobacterium bovis subsp bovis AF2122/97
gccgccaccagcu

SEQ ID NO: 3084477 - RNA, 19 nt, Mycobacterium bovis subsp bovis AF2122/97
gccgccaccagcugcgcga

SEQ ID NO: 3084478 - RNA, 16 nt, Mycobacterium bovis subsp bovis AF2122/97
gccgccaccccgcgcg

SEQ ID NO: 3084479 - RNA, 18 nt, Mycobacterium bovis subsp bovis AF2122/97
gccgccaccccgcgcgcc

SEQ ID NO: 3084480 - RNA, 14 nt, Mycobacterium bovis subsp bovis AF2122/97
gccgccacccgcaa

SEQ ID NO: 3084481 - RNA, 15 nt, Mycobacterium bovis subsp bovis AF2122/97
gccgccacccgcaac

SEQ ID NO: 3084482 - RNA, 17 nt, Mycobacterium bovis subsp bovis AF2122/97
gccgccacccggcgggc

SEQ ID NO: 3084483 - RNA, 18 nt, Mycobacterium bovis subsp bovis AF2122/97
gccgccacccggcgggcg

SEQ ID NO: 3084484 - RNA, 11 nt, Mycobacterium bovis subsp bovis AF2122/97
gccgccaccgc

SEQ ID NO: 3084485 - RNA, 14 nt, Mycobacterium bovis subsp bovis AF2122/97
gccgccaccgcacg

SEQ ID NO: 3084486 - RNA, 15 nt, Mycobacterium bovis subsp bovis AF2122/97
gccgccaccgcacgc

SEQ ID NO: 3084487 - RNA, 18 nt, Mycobacterium bovis subsp bovis AF2122/97
gccgccaccgcacgcacg

SEQ ID NO: 3084488 - RNA, 15 nt, Mycobacterium bovis subsp bovis AF2122/97
gccgccaccgccacc

SEQ ID NO: 3084489 - RNA, 18 nt, Mycobacterium bovis subsp bovis AF2122/97
gccgccaccgccaccgcg

SEQ ID NO: 3084490 - RNA, 13 nt, Mycobacterium bovis subsp bovis AF2122/97
gccgccaccgcga

SEQ ID NO: 3084491 - RNA, 16 nt, Mycobacterium bovis subsp bovis AF2122/97
gccgccaccgcugucg

SEQ ID NO: 3084492 - RNA, 13 nt, Mycobacterium bovis subsp bovis AF2122/97
gccgccaccggcg

SEQ ID NO: 3084493 - RNA, 14 nt, Mycobacterium bovis subsp bovis AF2122/97
gccgccaccggcga

SEQ ID NO: 3084494 - RNA, 15 nt, Mycobacterium bovis subsp bovis AF2122/97
gccgccaccggcgac

SEQ ID NO: 3084495 - RNA, 19 nt, Mycobacterium bovis subsp bovis AF2122/97
gccgccaccggcgacgccg

SEQ ID NO: 3084496 - RNA, 14 nt, Mycobacterium bovis subsp bovis AF2122/97
gccgccaccggcgc

SEQ ID NO: 3084497 - RNA, 15 nt, Mycobacterium bovis subsp bovis AF2122/97
gccgccaccggcgcc

SEQ ID NO: 3084498 - RNA, 16 nt, Mycobacterium bovis subsp bovis AF2122/97
gccgccaccggcgccg

SEQ ID NO: 3084499 - RNA, 15 nt, Mycobacterium bovis subsp bovis AF2122/97
gccgccaccggcguc

SEQ ID NO: 3084500 - RNA, 11 nt, Mycobacterium bovis subsp bovis AF2122/97
gccgccaccgu

SEQ ID NO: 3084501 - RNA, 23 nt, Mycobacterium bovis subsp bovis AF2122/97
gccgccaccucccagggcucggc

SEQ ID NO: 3084502 - RNA, 24 nt, Mycobacterium bovis subsp bovis AF2122/97
gccgccaccucccagggcucggcg

SEQ ID NO: 3084503 - RNA, 19 nt, Mycobacterium bovis subsp bovis AF2122/97
gccgccaccuuggcugggc

SEQ ID NO: 3084504 - RNA, 22 nt, Mycobacterium bovis subsp bovis AF2122/97
gccgccaccuuggcugggcccg

SEQ ID NO: 3084505 - RNA, 21 nt, Mycobacterium bovis subsp bovis AF2122/97
gccgccacggaucgcggcggc

SEQ ID NO: 3084506 - RNA, 13 nt, Mycobacterium bovis subsp bovis AF2122/97
gccgccacgggcg

SEQ ID NO: 3084507 - RNA, 17 nt, Mycobacterium bovis subsp bovis AF2122/97
gccgccacgggcggcca

SEQ ID NO: 3084508 - RNA, 22 nt, Mycobacterium bovis subsp bovis AF2122/97
gccgccacgggcggccaccgca

SEQ ID NO: 3084509 - RNA, 21 nt, Mycobacterium bovis subsp bovis AF2122/97
gccgccacgguacauccagag

SEQ ID NO: 3084510 - RNA, 23 nt, Mycobacterium bovis subsp bovis AF2122/97
gccgccacgguacauccagagac

SEQ ID NO: 3084511 - RNA, 21 nt, Mycobacterium bovis subsp bovis AF2122/97
gccgccacucgcccgcugccg

SEQ ID NO: 3084512 - RNA, 14 nt, Mycobacterium bovis subsp bovis AF2122/97
gccgccagcaccac

SEQ ID NO: 3084513 - RNA, 18 nt, Mycobacterium bovis subsp bovis AF2122/97
gccgccagcaccaccggc

SEQ ID NO: 3084514 - RNA, 21 nt, Mycobacterium bovis subsp bovis AF2122/97
gccgccagcaccucggccagc

SEQ ID NO: 3084515 - RNA, 15 nt, Mycobacterium bovis subsp bovis AF2122/97
gccgccagcccagcc

SEQ ID NO: 3084516 - RNA, 15 nt, Mycobacterium bovis subsp bovis AF2122/97
gccgccagccccacc

SEQ ID NO: 3084517 - RNA, 16 nt, Mycobacterium bovis subsp bovis AF2122/97
gccgccagccccagcg

SEQ ID NO: 3084518 - RNA, 13 nt, Mycobacterium bovis subsp bovis AF2122/97
gccgccagcccgu

SEQ ID NO: 3084519 - RNA, 15 nt, Mycobacterium bovis subsp bovis AF2122/97
gccgccagccggcgc

SEQ ID NO: 3084520 - RNA, 17 nt, Mycobacterium bovis subsp bovis AF2122/97
gccgccagccggcgcac

SEQ ID NO: 3084521 - RNA, 12 nt, Mycobacterium bovis subsp bovis AF2122/97
gccgccagccug

SEQ ID NO: 3084522 - RNA, 17 nt, Mycobacterium bovis subsp bovis AF2122/97
gccgccagcgccgccgg

SEQ ID NO: 3084523 - RNA, 18 nt, Mycobacterium bovis subsp bovis AF2122/97
gccgccagcgccgccggc

SEQ ID NO: 3084524 - RNA, 20 nt, Mycobacterium bovis subsp bovis AF2122/97
gccgccagcgccgccggcgc

SEQ ID NO: 3084525 - RNA, 22 nt, Mycobacterium bovis subsp bovis AF2122/97
gccgccagcgccgccggcgccg

SEQ ID NO: 3084526 - RNA, 21 nt, Mycobacterium bovis subsp bovis AF2122/97
gccgccagcgcgccgaucacg

SEQ ID NO: 3084527 - RNA, 13 nt, Mycobacterium bovis subsp bovis AF2122/97
gccgccagcgcgg

SEQ ID NO: 3084528 - RNA, 14 nt, Mycobacterium bovis subsp bovis AF2122/97
gccgccagcgcggu

SEQ ID NO: 3084529 - RNA, 16 nt, Mycobacterium bovis subsp bovis AF2122/97
gccgccagcgcggugu

SEQ ID NO: 3084530 - RNA, 13 nt, Mycobacterium bovis subsp bovis AF2122/97
gccgccagcggcg

SEQ ID NO: 3084531 - RNA, 14 nt, Mycobacterium bovis subsp bovis AF2122/97
gccgccagcggcga

SEQ ID NO: 3084532 - RNA, 16 nt, Mycobacterium bovis subsp bovis AF2122/97
gccgccagcugcgcag

SEQ ID NO: 3084533 - RNA, 20 nt, Mycobacterium bovis subsp bovis AF2122/97
gccgccaggcgcuuggccgg

SEQ ID NO: 3084534 - RNA, 15 nt, Mycobacterium bovis subsp bovis AF2122/97
gccgccaggcggccg

SEQ ID NO: 3084535 - RNA, 22 nt, Mycobacterium bovis subsp bovis AF2122/97
gccgccagggcccuagccggcg

SEQ ID NO: 3084536 - RNA, 17 nt, Mycobacterium bovis subsp bovis AF2122/97
gccgccagguccgccgg

SEQ ID NO: 3084537 - RNA, 18 nt, Mycobacterium bovis subsp bovis AF2122/97
gccgccagguccgccggu

SEQ ID NO: 3084538 - RNA, 17 nt, Mycobacterium bovis subsp bovis AF2122/97
gccgccaguccgaucgc

SEQ ID NO: 3084539 - RNA, 16 nt, Mycobacterium bovis subsp bovis AF2122/97
gccgccaguccggacg

SEQ ID NO: 3084540 - RNA, 21 nt, Mycobacterium bovis subsp bovis AF2122/97
gccgccaguccggacggcagc

SEQ ID NO: 3084541 - RNA, 14 nt, Mycobacterium bovis subsp bovis AF2122/97
gccgccagucgucc

SEQ ID NO: 3084542 - RNA, 21 nt, Mycobacterium bovis subsp bovis AF2122/97
gccgcccuggccgcccagacc

SEQ ID NO: 3084543 - RNA, 18 nt, Mycobacterium bovis subsp bovis AF2122/97
gccgcccuggccgccggc

SEQ ID NO: 3084544 - RNA, 19 nt, Mycobacterium bovis subsp bovis AF2122/97
gccgcccugguccaggccc

SEQ ID NO: 3084545 - RNA, 22 nt, Mycobacterium bovis subsp bovis AF2122/97
gccgcccuucaucuugccgcga

SEQ ID NO: 3084546 - RNA, 21 nt, Mycobacterium bovis subsp bovis AF2122/97
gccgcccuugauguccgcgac

SEQ ID NO: 3084547 - RNA, 22 nt, Mycobacterium bovis subsp bovis AF2122/97
gccgcccuugauguccgcgacg

SEQ ID NO: 3084548 - RNA, 12 nt, Mycobacterium bovis subsp bovis AF2122/97
gccgcccuugcc

SEQ ID NO: 3084549 - RNA, 14 nt, Mycobacterium bovis subsp bovis AF2122/97
gccgcccuugccgc

SEQ ID NO: 3084550 - RNA, 16 nt, Mycobacterium bovis subsp bovis AF2122/97
gccgcccuugccgccg

SEQ ID NO: 3084551 - RNA, 21 nt, Mycobacterium bovis subsp bovis AF2122/97
gccgcccuugccgccggcccc

SEQ ID NO: 3084552 - RNA, 17 nt, Mycobacterium bovis subsp bovis AF2122/97
gccgccgaaacucacca

SEQ ID NO: 3084553 - RNA, 18 nt, Mycobacterium bovis subsp bovis AF2122/97
gccgccgaaacucaccag

SEQ ID NO: 3084554 - RNA, 15 nt, Mycobacterium bovis subsp bovis AF2122/97
gccgccgaacagcug

SEQ ID NO: 3084555 - RNA, 21 nt, Mycobacterium bovis subsp bovis AF2122/97
gccgccgaacgccucugcgau

SEQ ID NO: 3084556 - RNA, 15 nt, Mycobacterium bovis subsp bovis AF2122/97
gccgccgaagccgac

SEQ ID NO: 3084557 - RNA, 16 nt, Mycobacterium bovis subsp bovis AF2122/97
gccgccgaagccgacg

SEQ ID NO: 3084558 - RNA, 14 nt, Mycobacterium bovis subsp bovis AF2122/97
gccgccgaagccgc

SEQ ID NO: 3084559 - RNA, 17 nt, Mycobacterium bovis subsp bovis AF2122/97
gccgccgaagccgcgca

SEQ ID NO: 3084560 - RNA, 15 nt, Mycobacterium bovis subsp bovis AF2122/97
gccgccgaauccgac

SEQ ID NO: 3084561 - RNA, 20 nt, Mycobacterium bovis subsp bovis AF2122/97
gccgccgaauccgacgucga

SEQ ID NO: 3084562 - RNA, 23 nt, Mycobacterium bovis subsp bovis AF2122/97
gccgccgaauccgacgucgacga

SEQ ID NO: 3084563 - RNA, 16 nt, Mycobacterium bovis subsp bovis AF2122/97
gccgccgacaaccccg

SEQ ID NO: 3084564 - RNA, 15 nt, Mycobacterium bovis subsp bovis AF2122/97
gccgccgacaccacc

SEQ ID NO: 3084565 - RNA, 18 nt, Mycobacterium bovis subsp bovis AF2122/97
gccgccgacaccaccggc

SEQ ID NO: 3084566 - RNA, 20 nt, Mycobacterium bovis subsp bovis AF2122/97
gccgccgacaccaccggcgc

SEQ ID NO: 3084567 - RNA, 22 nt, Mycobacterium bovis subsp bovis AF2122/97
gccgccgacaccaccggcgccg

SEQ ID NO: 3084568 - RNA, 23 nt, Mycobacterium bovis subsp bovis AF2122/97
gccgccgacaccaccggcgccgc

SEQ ID NO: 3084569 - RNA, 13 nt, Mycobacterium bovis subsp bovis AF2122/97
gccgccgacgaag

SEQ ID NO: 3084570 - RNA, 13 nt, Mycobacterium bovis subsp bovis AF2122/97
gccgccgacgccg

SEQ ID NO: 3084571 - RNA, 18 nt, Mycobacterium bovis subsp bovis AF2122/97
gccgccgacgccgccggc

SEQ ID NO: 3084572 - RNA, 22 nt, Mycobacterium bovis subsp bovis AF2122/97
gccgccgacgccgccggcgcca

SEQ ID NO: 3084573 - RNA, 22 nt, Mycobacterium bovis subsp bovis AF2122/97
gccgccgacggaucgcccugac

SEQ ID NO: 3084574 - RNA, 22 nt, Mycobacterium bovis subsp bovis AF2122/97
gccgccgacguuggggaugguc

SEQ ID NO: 3084575 - RNA, 12 nt, Mycobacterium bovis subsp bovis AF2122/97
gccgccgacucg

SEQ ID NO: 3084576 - RNA, 17 nt, Mycobacterium bovis subsp bovis AF2122/97
gccgccgacucggcacc

SEQ ID NO: 3084577 - RNA, 11 nt, Mycobacterium bovis subsp bovis AF2122/97
gccgccgacuu

SEQ ID NO: 3084578 - RNA, 20 nt, Mycobacterium bovis subsp bovis AF2122/97
gccgccgacuugauuucgau

SEQ ID NO: 3084579 - RNA, 15 nt, Mycobacterium bovis subsp bovis AF2122/97
gccgccgagacgacc

SEQ ID NO: 3084580 - RNA, 13 nt, Mycobacterium bovis subsp bovis AF2122/97
gccgccgagcugg

SEQ ID NO: 3084581 - RNA, 14 nt, Mycobacterium bovis subsp bovis AF2122/97
gccgccgagcuggc

SEQ ID NO: 3084582 - RNA, 15 nt, Mycobacterium bovis subsp bovis AF2122/97
gccgccgagcuggcg

SEQ ID NO: 3084583 - RNA, 18 nt, Mycobacterium bovis subsp bovis AF2122/97
gccgccgagcuggcgcgc

SEQ ID NO: 3084584 - RNA, 23 nt, Mycobacterium bovis subsp bovis AF2122/97
gccgccgaggacacauugaccag

SEQ ID NO: 3084585 - RNA, 16 nt, Mycobacterium bovis subsp bovis AF2122/97
gccgccgagggcgccg

SEQ ID NO: 3084586 - RNA, 21 nt, Mycobacterium bovis subsp bovis AF2122/97
gccgccgaggucgguucggcc

SEQ ID NO: 3084587 - RNA, 23 nt, Mycobacterium bovis subsp bovis AF2122/97
gccgccgaggucgguucggccgg

SEQ ID NO: 3084588 - RNA, 14 nt, Mycobacterium bovis subsp bovis AF2122/97
gccgccgauaccgc

SEQ ID NO: 3084589 - RNA, 13 nt, Mycobacterium bovis subsp bovis AF2122/97
gccgccgaucacc

SEQ ID NO: 3084590 - RNA, 18 nt, Mycobacterium bovis subsp bovis AF2122/97
gccgccgaucgacacccg

SEQ ID NO: 3084591 - RNA, 14 nt, Mycobacterium bovis subsp bovis AF2122/97
gccgccgaucugcu

SEQ ID NO: 3084592 - RNA, 19 nt, Mycobacterium bovis subsp bovis AF2122/97
gccgccgaucugcugcagc

SEQ ID NO: 3084593 - RNA, 19 nt, Mycobacterium bovis subsp bovis AF2122/97
gccgccgaugaugugcggu

SEQ ID NO: 3084594 - RNA, 14 nt, Mycobacterium bovis subsp bovis AF2122/97
gccgccgaugccga

SEQ ID NO: 3084595 - RNA, 15 nt, Mycobacterium bovis subsp bovis AF2122/97
gccgccgcacaucug

SEQ ID NO: 3084596 - RNA, 15 nt, Mycobacterium bovis subsp bovis AF2122/97
gccgccgccaccacc

SEQ ID NO: 3084597 - RNA, 17 nt, Mycobacterium bovis subsp bovis AF2122/97
gccgccgccaccaccca

SEQ ID NO: 3084598 - RNA, 17 nt, Mycobacterium bovis subsp bovis AF2122/97
gccgccgccaccggcgc

SEQ ID NO: 3084599 - RNA, 19 nt, Mycobacterium bovis subsp bovis AF2122/97
gccgccgccaccggcgccg

SEQ ID NO: 3084600 - RNA, 20 nt, Mycobacterium bovis subsp bovis AF2122/97
gccgccgccaccggcgccgc

SEQ ID NO: 3084601 - RNA, 12 nt, Mycobacterium bovis subsp bovis AF2122/97
gccgccgccauc

SEQ ID NO: 3084602 - RNA, 17 nt, Mycobacterium bovis subsp bovis AF2122/97
gccgccgccaucgccga

SEQ ID NO: 3084603 - RNA, 20 nt, Mycobacterium bovis subsp bovis AF2122/97
gccgccgccaucgccgauga

SEQ ID NO: 3084604 - RNA, 14 nt, Mycobacterium bovis subsp bovis AF2122/97
gccgccgccccggc

SEQ ID NO: 3084605 - RNA, 20 nt, Mycobacterium bovis subsp bovis AF2122/97
gccgccgccccggcgcuggu

SEQ ID NO: 3084606 - RNA, 13 nt, Mycobacterium bovis subsp bovis AF2122/97
gccgccgcccggg

SEQ ID NO: 3084607 - RNA, 12 nt, Mycobacterium bovis subsp bovis AF2122/97
gccgccgcccgu

SEQ ID NO: 3084608 - RNA, 13 nt, Mycobacterium bovis subsp bovis AF2122/97
gccgccgccgacg

SEQ ID NO: 3084609 - RNA, 14 nt, Mycobacterium bovis subsp bovis AF2122/97
gccgccgccgccgg

SEQ ID NO: 3084610 - RNA, 15 nt, Mycobacterium bovis subsp bovis AF2122/97
gccgccgccgccggc

SEQ ID NO: 3084611 - RNA, 12 nt, Mycobacterium bovis subsp bovis AF2122/97
gccgccgccggc

SEQ ID NO: 3084612 - RNA, 13 nt, Mycobacterium bovis subsp bovis AF2122/97
gccgccgccggcg

SEQ ID NO: 3084613 - RNA, 14 nt, Mycobacterium bovis subsp bovis AF2122/97
gccgccgccggcgc

SEQ ID NO: 3084614 - RNA, 17 nt, Mycobacterium bovis subsp bovis AF2122/97
gccgccgccggcgccca

SEQ ID NO: 3084615 - RNA, 16 nt, Mycobacterium bovis subsp bovis AF2122/97
gccgccgccggcgccg

SEQ ID NO: 3084616 - RNA, 15 nt, Mycobacterium bovis subsp bovis AF2122/97
gccgccgccggcggu

SEQ ID NO: 3084617 - RNA, 15 nt, Mycobacterium bovis subsp bovis AF2122/97
gccgccgccgucggc

SEQ ID NO: 3084618 - RNA, 16 nt, Mycobacterium bovis subsp bovis AF2122/97
gccgccgccgucggcg

SEQ ID NO: 3084619 - RNA, 19 nt, Mycobacterium bovis subsp bovis AF2122/97
gccgccgccuccgccgagg

SEQ ID NO: 3084620 - RNA, 14 nt, Mycobacterium bovis subsp bovis AF2122/97
gccgccgccugcuc

SEQ ID NO: 3084621 - RNA, 12 nt, Mycobacterium bovis subsp bovis AF2122/97
gccgccgcgacg

SEQ ID NO: 3084622 - RNA, 13 nt, Mycobacterium bovis subsp bovis AF2122/97
gccgccgcgacgg

SEQ ID NO: 3084623 - RNA, 16 nt, Mycobacterium bovis subsp bovis AF2122/97
gccgccgcgagcgccg

SEQ ID NO: 3084624 - RNA, 13 nt, Mycobacterium bovis subsp bovis AF2122/97
gccgccgcgcacc

SEQ ID NO: 3084625 - RNA, 15 nt, Mycobacterium bovis subsp bovis AF2122/97
gccgccgcgccggug

SEQ ID NO: 3084626 - RNA, 21 nt, Mycobacterium bovis subsp bovis AF2122/97
gccgccgcgcguucggcgcug

SEQ ID NO: 3084627 - RNA, 11 nt, Mycobacterium bovis subsp bovis AF2122/97
gccgccgcggc

SEQ ID NO: 3084628 - RNA, 14 nt, Mycobacterium bovis subsp bovis AF2122/97
gccgccgcggccac

SEQ ID NO: 3084629 - RNA, 16 nt, Mycobacterium bovis subsp bovis AF2122/97
gccgccggugccaccc

SEQ ID NO: 3084630 - RNA, 20 nt, Mycobacterium bovis subsp bovis AF2122/97
gccgccggugccacccuugc

SEQ ID NO: 3084631 - RNA, 17 nt, Mycobacterium bovis subsp bovis AF2122/97
gccgccggugccaccga

SEQ ID NO: 3084632 - RNA, 21 nt, Mycobacterium bovis subsp bovis AF2122/97
gccgccggugccaccgacgcc

SEQ ID NO: 3084633 - RNA, 17 nt, Mycobacterium bovis subsp bovis AF2122/97
gccgccggugccaccgg

SEQ ID NO: 3084634 - RNA, 15 nt, Mycobacterium bovis subsp bovis AF2122/97
gccgccggugccgau

SEQ ID NO: 3084635 - RNA, 17 nt, Mycobacterium bovis subsp bovis AF2122/97
gccgccggugccgccau

SEQ ID NO: 3084636 - RNA, 18 nt, Mycobacterium bovis subsp bovis AF2122/97
gccgccggugccgcccga

SEQ ID NO: 3084637 - RNA, 16 nt, Mycobacterium bovis subsp bovis AF2122/97
gccgccggugccgccg

SEQ ID NO: 3084638 - RNA, 17 nt, Mycobacterium bovis subsp bovis AF2122/97
gccgccggugccgccga

SEQ ID NO: 3084639 - RNA, 17 nt, Mycobacterium bovis subsp bovis AF2122/97
gccgccggugccgccgg

SEQ ID NO: 3084640 - RNA, 16 nt, Mycobacterium bovis subsp bovis AF2122/97
gccgccggugccgccu

SEQ ID NO: 3084641 - RNA, 20 nt, Mycobacterium bovis subsp bovis AF2122/97
gccgccggugccgccugcgc

SEQ ID NO: 3084642 - RNA, 22 nt, Mycobacterium bovis subsp bovis AF2122/97
gccgccgguggugccggcgccg

SEQ ID NO: 3084643 - RNA, 23 nt, Mycobacterium bovis subsp bovis AF2122/97
gccgccgguggugccggcgccgc

SEQ ID NO: 3084644 - RNA, 20 nt, Mycobacterium bovis subsp bovis AF2122/97
gccgccgguguaacccucga

SEQ ID NO: 3084645 - RNA, 12 nt, Mycobacterium bovis subsp bovis AF2122/97
gccgccgguguc

SEQ ID NO: 3084646 - RNA, 16 nt, Mycobacterium bovis subsp bovis AF2122/97
gccgccggugucgggc

SEQ ID NO: 3084647 - RNA, 21 nt, Mycobacterium bovis subsp bovis AF2122/97
gccgccgguguuagccccgaa

SEQ ID NO: 3084648 - RNA, 14 nt, Mycobacterium bovis subsp bovis AF2122/97
gccgccgguuccgc

SEQ ID NO: 3084649 - RNA, 16 nt, Mycobacterium bovis subsp bovis AF2122/97
gccgccgguuccgccg

SEQ ID NO: 3084650 - RNA, 18 nt, Mycobacterium bovis subsp bovis AF2122/97
gccgccgguuccgccggc

SEQ ID NO: 3084651 - RNA, 19 nt, Mycobacterium bovis subsp bovis AF2122/97
gccgccgguuccgccggcc

SEQ ID NO: 3084652 - RNA, 20 nt, Mycobacterium bovis subsp bovis AF2122/97
gccgccgguuccgccggccc

SEQ ID NO: 3084653 - RNA, 21 nt, Mycobacterium bovis subsp bovis AF2122/97
gccgccguaacggucgcuguc

SEQ ID NO: 3084654 - RNA, 12 nt, Mycobacterium bovis subsp bovis AF2122/97
gccgccgucacc

SEQ ID NO: 3084655 - RNA, 17 nt, Mycobacterium bovis subsp bovis AF2122/97
gccgccgucaccgcccu

SEQ ID NO: 3084656 - RNA, 16 nt, Mycobacterium bovis subsp bovis AF2122/97
gccgccguccagcgcc

SEQ ID NO: 3084657 - RNA, 22 nt, Mycobacterium bovis subsp bovis AF2122/97
gccgccguccagcgccgcggcc

SEQ ID NO: 3084658 - RNA, 14 nt, Mycobacterium bovis subsp bovis AF2122/97
gccgccguccccgc

SEQ ID NO: 3084659 - RNA, 22 nt, Mycobacterium bovis subsp bovis AF2122/97
gccgccguccccgccgacgccg

SEQ ID NO: 3084660 - RNA, 23 nt, Mycobacterium bovis subsp bovis AF2122/97
gccgccguccccgccgacgccga

SEQ ID NO: 3084661 - RNA, 19 nt, Mycobacterium bovis subsp bovis AF2122/97
gccgccguccccgccgucg

SEQ ID NO: 3084662 - RNA, 14 nt, Mycobacterium bovis subsp bovis AF2122/97
gccgccgucgauga

SEQ ID NO: 3084663 - RNA, 12 nt, Mycobacterium bovis subsp bovis AF2122/97
gccgccgucgcc

SEQ ID NO: 3084664 - RNA, 14 nt, Mycobacterium bovis subsp bovis AF2122/97
gccgccgucgccgc

SEQ ID NO: 3084665 - RNA, 16 nt, Mycobacterium bovis subsp bovis AF2122/97
gccgccgucgccgcca

SEQ ID NO: 3084666 - RNA, 17 nt, Mycobacterium bovis subsp bovis AF2122/97
gccgccgucgccgccgc

SEQ ID NO: 3084667 - RNA, 17 nt, Mycobacterium bovis subsp bovis AF2122/97
gccgccgucgccgccgu

SEQ ID NO: 3084668 - RNA, 14 nt, Mycobacterium bovis subsp bovis AF2122/97
gccgccgucggcga

SEQ ID NO: 3084669 - RNA, 16 nt, Mycobacterium bovis subsp bovis AF2122/97
gccgccgucggcgagc

SEQ ID NO: 3084670 - RNA, 20 nt, Mycobacterium bovis subsp bovis AF2122/97
gccgccgucguacaccucga

SEQ ID NO: 3084671 - RNA, 15 nt, Mycobacterium bovis subsp bovis AF2122/97
gccgccguggugauc

SEQ ID NO: 3084672 - RNA, 19 nt, Mycobacterium bovis subsp bovis AF2122/97
gccgccguuaccgagcccg

SEQ ID NO: 3084673 - RNA, 14 nt, Mycobacterium bovis subsp bovis AF2122/97
gccgccguuaccgc

SEQ ID NO: 3084674 - RNA, 20 nt, Mycobacterium bovis subsp bovis AF2122/97
gccgccguuaccgccgcugc

SEQ ID NO: 3084675 - RNA, 17 nt, Mycobacterium bovis subsp bovis AF2122/97
gccgccguuaccgccgg

SEQ ID NO: 3084676 - RNA, 20 nt, Mycobacterium bovis subsp bovis AF2122/97
gccgccguuaccgccggcgc

SEQ ID NO: 3084677 - RNA, 21 nt, Mycobacterium bovis subsp bovis AF2122/97
gccgccguuaccgccggcgcc

SEQ ID NO: 3084678 - RNA, 18 nt, Mycobacterium bovis subsp bovis AF2122/97
gccgccguucccaccacc

SEQ ID NO: 3084679 - RNA, 19 nt, Mycobacterium bovis subsp bovis AF2122/97
gccgccguucccaccacca

SEQ ID NO: 3084680 - RNA, 22 nt, Mycobacterium bovis subsp bovis AF2122/97
gccgccguucccaccaccaccg

SEQ ID NO: 3084681 - RNA, 15 nt, Mycobacterium bovis subsp bovis AF2122/97
gccgccguucccgcc

SEQ ID NO: 3084682 - RNA, 17 nt, Mycobacterium bovis subsp bovis AF2122/97
gccgccguucccgccgg

SEQ ID NO: 3084683 - RNA, 18 nt, Mycobacterium bovis subsp bovis AF2122/97
gccgccguucccgccggc

SEQ ID NO: 3084684 - RNA, 18 nt, Mycobacterium bovis subsp bovis AF2122/97
gccgccguucgggaugca

SEQ ID NO: 3084685 - RNA, 11 nt, Mycobacterium bovis subsp bovis AF2122/97
gccgccguugc

SEQ ID NO: 3084686 - RNA, 19 nt, Mycobacterium bovis subsp bovis AF2122/97
gccgccguugccgaucacc

SEQ ID NO: 3084687 - RNA, 20 nt, Mycobacterium bovis subsp bovis AF2122/97
gccgccguugccgaucacca

SEQ ID NO: 3084688 - RNA, 14 nt, Mycobacterium bovis subsp bovis AF2122/97
gccgccguugccgc

SEQ ID NO: 3084689 - RNA, 15 nt, Mycobacterium bovis subsp bovis AF2122/97
gccgccguugccgcc

SEQ ID NO: 3084690 - RNA, 16 nt, Mycobacterium bovis subsp bovis AF2122/97
gccgccguugccgcca

SEQ ID NO: 3084691 - RNA, 17 nt, Mycobacterium bovis subsp bovis AF2122/97
gccgccguugccgccau

SEQ ID NO: 3084692 - RNA, 16 nt, Mycobacterium bovis subsp bovis AF2122/97
gccgccguugccgccg

SEQ ID NO: 3084693 - RNA, 19 nt, Mycobacterium bovis subsp bovis AF2122/97
gccgccguugccgccggcg

SEQ ID NO: 3084694 - RNA, 20 nt, Mycobacterium bovis subsp bovis AF2122/97
gccgccguugccgccggcgc

SEQ ID NO: 3084695 - RNA, 21 nt, Mycobacterium bovis subsp bovis AF2122/97
gccgccguugccgccggcgcc

SEQ ID NO: 3084696 - RNA, 22 nt, Mycobacterium bovis subsp bovis AF2122/97
gccgccguugccgccggcgccg

SEQ ID NO: 3084697 - RNA, 23 nt, Mycobacterium bovis subsp bovis AF2122/97
gccgccguugccgccggcgccgc

SEQ ID NO: 3084698 - RNA, 17 nt, Mycobacterium bovis subsp bovis AF2122/97
gccgccguugccgccgu

SEQ ID NO: 3084699 - RNA, 20 nt, Mycobacterium bovis subsp bovis AF2122/97
gccgccguugccgccguugc

SEQ ID NO: 3084700 - RNA, 21 nt, Mycobacterium bovis subsp bovis AF2122/97
gccgccguugccgccguugcc

SEQ ID NO: 3084701 - RNA, 21 nt, Mycobacterium bovis subsp bovis AF2122/97
gccgccguugccggcuuggcc

SEQ ID NO: 3084702 - RNA, 21 nt, Mycobacterium bovis subsp bovis AF2122/97
gccgccguugccgucgucgcc

SEQ ID NO: 3084703 - RNA, 23 nt, Mycobacterium bovis subsp bovis AF2122/97
gccgccguugccgucgucgccgu

SEQ ID NO: 3084704 - RNA, 23 nt, Mycobacterium bovis subsp bovis AF2122/97
gccgccguuggcucgagccgccc

SEQ ID NO: 3084705 - RNA, 20 nt, Mycobacterium bovis subsp bovis AF2122/97
gccgccucaaugaccaccgg

SEQ ID NO: 3084706 - RNA, 14 nt, Mycobacterium bovis subsp bovis AF2122/97
gccgccuccgccga

SEQ ID NO: 3084707 - RNA, 16 nt, Mycobacterium bovis subsp bovis AF2122/97
gccgccuccgccgagg

SEQ ID NO: 3084708 - RNA, 22 nt, Mycobacterium bovis subsp bovis AF2122/97
gccgccuccgccgaggccgccg

SEQ ID NO: 3084709 - RNA, 14 nt, Mycobacterium bovis subsp bovis AF2122/97
gccgccuccgccug

SEQ ID NO: 3084710 - RNA, 21 nt, Mycobacterium bovis subsp bovis AF2122/97
gccgccuccgccugccccacc

SEQ ID NO: 3084711 - RNA, 13 nt, Mycobacterium bovis subsp bovis AF2122/97
gccgccuccgcgg

SEQ ID NO: 3084712 - RNA, 18 nt, Mycobacterium bovis subsp bovis AF2122/97
gccgccucgaucgacucg

SEQ ID NO: 3084713 - RNA, 17 nt, Mycobacterium bovis subsp bovis AF2122/97
gccgccucgggcaccug

SEQ ID NO: 3084714 - RNA, 22 nt, Mycobacterium bovis subsp bovis AF2122/97
gccgccucguacggaccgucgc

SEQ ID NO: 3084715 - RNA, 14 nt, Mycobacterium bovis subsp bovis AF2122/97
gccgcgcaccaaca

SEQ ID NO: 3084716 - RNA, 21 nt, Mycobacterium bovis subsp bovis AF2122/97
gccgcgcaccaacaccagcgc

SEQ ID NO: 3084717 - RNA, 13 nt, Mycobacterium bovis subsp bovis AF2122/97
gccgcgcagccgg

SEQ ID NO: 3084718 - RNA, 14 nt, Mycobacterium bovis subsp bovis AF2122/97
gccgcgcagccggc

SEQ ID NO: 3084719 - RNA, 18 nt, Mycobacterium bovis subsp bovis AF2122/97
gccgcgcagccggcccgu

SEQ ID NO: 3084720 - RNA, 14 nt, Mycobacterium bovis subsp bovis AF2122/97
gccgcgcagcgagg

SEQ ID NO: 3084721 - RNA, 21 nt, Mycobacterium bovis subsp bovis AF2122/97
gccgcgcagcgcggcggcauc

SEQ ID NO: 3084722 - RNA, 19 nt, Mycobacterium bovis subsp bovis AF2122/97
gccgcgcccaaugcgggcu

SEQ ID NO: 3084723 - RNA, 19 nt, Mycobacterium bovis subsp bovis AF2122/97
gccgcgccccagacgcgca

SEQ ID NO: 3084724 - RNA, 15 nt, Mycobacterium bovis subsp bovis AF2122/97
gccgcgccccgcggc

SEQ ID NO: 3084725 - RNA, 18 nt, Mycobacterium bovis subsp bovis AF2122/97
gccgcgccccgcggcaga

SEQ ID NO: 3084726 - RNA, 16 nt, Mycobacterium bovis subsp bovis AF2122/97
gccgcgcccgccucga

SEQ ID NO: 3084727 - RNA, 19 nt, Mycobacterium bovis subsp bovis AF2122/97
gccgcgcccgccucgaccg

SEQ ID NO: 3084728 - RNA, 21 nt, Mycobacterium bovis subsp bovis AF2122/97
gccgcgcccgccucgaccgcc

SEQ ID NO: 3084729 - RNA, 12 nt, Mycobacterium bovis subsp bovis AF2122/97
gccgcgcccggc

SEQ ID NO: 3084730 - RNA, 13 nt, Mycobacterium bovis subsp bovis AF2122/97
gccgcgcccggcg

SEQ ID NO: 3084731 - RNA, 18 nt, Mycobacterium bovis subsp bovis AF2122/97
gccgcgcccggcgcaagc

SEQ ID NO: 3084732 - RNA, 17 nt, Mycobacterium bovis subsp bovis AF2122/97
gccgcgcccggcgcuag

SEQ ID NO: 3084733 - RNA, 21 nt, Mycobacterium bovis subsp bovis AF2122/97
gccgcgcccuguccuuggcga

SEQ ID NO: 3084734 - RNA, 14 nt, Mycobacterium bovis subsp bovis AF2122/97
gccgcgccgaaucg

SEQ ID NO: 3084735 - RNA, 12 nt, Mycobacterium bovis subsp bovis AF2122/97
gccgcgccgacc

SEQ ID NO: 3084736 - RNA, 13 nt, Mycobacterium bovis subsp bovis AF2122/97
gccgcgccgcaga

SEQ ID NO: 3084737 - RNA, 16 nt, Mycobacterium bovis subsp bovis AF2122/97
gccgcgccgcggcccg

SEQ ID NO: 3084738 - RNA, 14 nt, Mycobacterium bovis subsp bovis AF2122/97
gccgcgccggcacg

SEQ ID NO: 3084739 - RNA, 15 nt, Mycobacterium bovis subsp bovis AF2122/97
gccgcgccggcacgg

SEQ ID NO: 3084740 - RNA, 12 nt, Mycobacterium bovis subsp bovis AF2122/97
gccgcgccggcc

SEQ ID NO: 3084741 - RNA, 14 nt, Mycobacterium bovis subsp bovis AF2122/97
gccgcgccggcccc

SEQ ID NO: 3084742 - RNA, 14 nt, Mycobacterium bovis subsp bovis AF2122/97
gccgcgccggcggc

SEQ ID NO: 3084743 - RNA, 17 nt, Mycobacterium bovis subsp bovis AF2122/97
gccgcgccggcggccac

SEQ ID NO: 3084744 - RNA, 15 nt, Mycobacterium bovis subsp bovis AF2122/97
gccgcgccggcgggc

SEQ ID NO: 3084745 - RNA, 16 nt, Mycobacterium bovis subsp bovis AF2122/97
gccgcgccggguccgc

SEQ ID NO: 3084746 - RNA, 15 nt, Mycobacterium bovis subsp bovis AF2122/97
gccgcgccggugugc

SEQ ID NO: 3084747 - RNA, 17 nt, Mycobacterium bovis subsp bovis AF2122/97
gccgcgcgacaacccgg

SEQ ID NO: 3084748 - RNA, 15 nt, Mycobacterium bovis subsp bovis AF2122/97
gccgcgcgcaccggu

SEQ ID NO: 3084749 - RNA, 15 nt, Mycobacterium bovis subsp bovis AF2122/97
gccgcgcgcagagcg

SEQ ID NO: 3084750 - RNA, 21 nt, Mycobacterium bovis subsp bovis AF2122/97
gccgcgcgcagggcgucggcg

SEQ ID NO: 3084751 - RNA, 22 nt, Mycobacterium bovis subsp bovis AF2122/97
gccgcgcgcauuuuucgccagc

SEQ ID NO: 3084752 - RNA, 22 nt, Mycobacterium bovis subsp bovis AF2122/97
gccgcgcgccaucgccuccagc

SEQ ID NO: 3084753 - RNA, 13 nt, Mycobacterium bovis subsp bovis AF2122/97
gccgcgcgcccgc

SEQ ID NO: 3084754 - RNA, 22 nt, Mycobacterium bovis subsp bovis AF2122/97
gccgcgcgcccgccucaucggc

SEQ ID NO: 3084755 - RNA, 14 nt, Mycobacterium bovis subsp bovis AF2122/97
gccgcgcgccggcc

SEQ ID NO: 3084756 - RNA, 15 nt, Mycobacterium bovis subsp bovis AF2122/97
gccgcgcgccggcca

SEQ ID NO: 3084757 - RNA, 14 nt, Mycobacterium bovis subsp bovis AF2122/97
gccgcgcgccgguu

SEQ ID NO: 3084758 - RNA, 13 nt, Mycobacterium bovis subsp bovis AF2122/97
gccgcgcgcggcg

SEQ ID NO: 3084759 - RNA, 17 nt, Mycobacterium bovis subsp bovis AF2122/97
gccgcgcgcucgagcag

SEQ ID NO: 3084760 - RNA, 18 nt, Mycobacterium bovis subsp bovis AF2122/97
gccgcgcgcugccgcugc

SEQ ID NO: 3084761 - RNA, 20 nt, Mycobacterium bovis subsp bovis AF2122/97
gccgcgcgcugccgcugcgc

SEQ ID NO: 3084762 - RNA, 12 nt, Mycobacterium bovis subsp bovis AF2122/97
gccgcgcggaac

SEQ ID NO: 3084763 - RNA, 16 nt, Mycobacterium bovis subsp bovis AF2122/97
gccgcgcggaacaccg

SEQ ID NO: 3084764 - RNA, 15 nt, Mycobacterium bovis subsp bovis AF2122/97
gccgcgcggcgacag

SEQ ID NO: 3084765 - RNA, 13 nt, Mycobacterium bovis subsp bovis AF2122/97
gccgcgcggcgag

SEQ ID NO: 3084766 - RNA, 14 nt, Mycobacterium bovis subsp bovis AF2122/97
gccgcgcggcuugu

SEQ ID NO: 3084767 - RNA, 21 nt, Mycobacterium bovis subsp bovis AF2122/97
gccgcgcgggccgccgcaagu

SEQ ID NO: 3084768 - RNA, 13 nt, Mycobacterium bovis subsp bovis AF2122/97
gccgcgcggggug

SEQ ID NO: 3084769 - RNA, 12 nt, Mycobacterium bovis subsp bovis AF2122/97
gccgcgcggguc

SEQ ID NO: 3084770 - RNA, 13 nt, Mycobacterium bovis subsp bovis AF2122/97
gccgcgcggguca

SEQ ID NO: 3084771 - RNA, 13 nt, Mycobacterium bovis subsp bovis AF2122/97
gccgcgcgguacu

SEQ ID NO: 3084772 - RNA, 19 nt, Mycobacterium bovis subsp bovis AF2122/97
gccgcgcgguacugcgcag

SEQ ID NO: 3084773 - RNA, 20 nt, Mycobacterium bovis subsp bovis AF2122/97
gccgcgcgguacugcgcagc

SEQ ID NO: 3084774 - RNA, 16 nt, Mycobacterium bovis subsp bovis AF2122/97
gccgcgcggugauggu

SEQ ID NO: 3084775 - RNA, 14 nt, Mycobacterium bovis subsp bovis AF2122/97
gccgcgcgucgcga

SEQ ID NO: 3084776 - RNA, 21 nt, Mycobacterium bovis subsp bovis AF2122/97
gccgcgcguuccagcacaccc

SEQ ID NO: 3084777 - RNA, 15 nt, Mycobacterium bovis subsp bovis AF2122/97
gccgcgcguucggcg

SEQ ID NO: 3084778 - RNA, 17 nt, Mycobacterium bovis subsp bovis AF2122/97
gccgcgcuacgucaagc

SEQ ID NO: 3084779 - RNA, 22 nt, Mycobacterium bovis subsp bovis AF2122/97
gccgcgcuacgucaagccgugc

SEQ ID NO: 3084780 - RNA, 19 nt, Mycobacterium bovis subsp bovis AF2122/97
gccgcgcucaucgcggcga

SEQ ID NO: 3084781 - RNA, 13 nt, Mycobacterium bovis subsp bovis AF2122/97
gccgcgcucgaac

SEQ ID NO: 3084782 - RNA, 13 nt, Mycobacterium bovis subsp bovis AF2122/97
gccgcgcucgacg

SEQ ID NO: 3084783 - RNA, 14 nt, Mycobacterium bovis subsp bovis AF2122/97
gccgcgcucgacga

SEQ ID NO: 3084784 - RNA, 19 nt, Mycobacterium bovis subsp bovis AF2122/97
gccgcgcucgacgagcacg

SEQ ID NO: 3084785 - RNA, 16 nt, Mycobacterium bovis subsp bovis AF2122/97
gccgcgcucgccgaua

SEQ ID NO: 3084786 - RNA, 14 nt, Mycobacterium bovis subsp bovis AF2122/97
gccgcgcucgucga

SEQ ID NO: 3084787 - RNA, 16 nt, Mycobacterium bovis subsp bovis AF2122/97
gccgcgcucgucgaag

SEQ ID NO: 3084788 - RNA, 20 nt, Mycobacterium bovis subsp bovis AF2122/97
gccgcgcucgucgaaguagc

SEQ ID NO: 3084789 - RNA, 13 nt, Mycobacterium bovis subsp bovis AF2122/97
gccgcgcugagca

SEQ ID NO: 3084790 - RNA, 17 nt, Mycobacterium bovis subsp bovis AF2122/97
gccgcgcugcagcacgg

SEQ ID NO: 3084791 - RNA, 13 nt, Mycobacterium bovis subsp bovis AF2122/97
gccgcgcuggucg

SEQ ID NO: 3084792 - RNA, 12 nt, Mycobacterium bovis subsp bovis AF2122/97
gccgcgcuggug

SEQ ID NO: 3084793 - RNA, 22 nt, Mycobacterium bovis subsp bovis AF2122/97
gccgcgcuggugauucgcagcc

SEQ ID NO: 3084794 - RNA, 23 nt, Mycobacterium bovis subsp bovis AF2122/97
gccgcgcuggugauucgcagccg

SEQ ID NO: 3084795 - RNA, 14 nt, Mycobacterium bovis subsp bovis AF2122/97
gccgcgcuugcgau

SEQ ID NO: 3084796 - RNA, 19 nt, Mycobacterium bovis subsp bovis AF2122/97
gccgcgcuugcgaucgccg

SEQ ID NO: 3084797 - RNA, 20 nt, Mycobacterium bovis subsp bovis AF2122/97
gccgcgcuugcgaucgccgc

SEQ ID NO: 3084798 - RNA, 21 nt, Mycobacterium bovis subsp bovis AF2122/97
gccgcgcuugcgaucgccgcu

SEQ ID NO: 3084799 - RNA, 16 nt, Mycobacterium bovis subsp bovis AF2122/97
gccgcggacguggucg

SEQ ID NO: 3084800 - RNA, 16 nt, Mycobacterium bovis subsp bovis AF2122/97
gccgcggacucgggca

SEQ ID NO: 3084801 - RNA, 21 nt, Mycobacterium bovis subsp bovis AF2122/97
gccgcggacucgggcaggccc

SEQ ID NO: 3084802 - RNA, 15 nt, Mycobacterium bovis subsp bovis AF2122/97
gccgcggagaaggcg

SEQ ID NO: 3084803 - RNA, 19 nt, Mycobacterium bovis subsp bovis AF2122/97
gccgcgguuaucgccgaga

SEQ ID NO: 3084804 - RNA, 21 nt, Mycobacterium bovis subsp bovis AF2122/97
gccgcgguuuggcgacgucga

SEQ ID NO: 3084805 - RNA, 17 nt, Mycobacterium bovis subsp bovis AF2122/97
gccgcguaaaccggcug

SEQ ID NO: 3084806 - RNA, 20 nt, Mycobacterium bovis subsp bovis AF2122/97
gccgcguaaaccggcugacc

SEQ ID NO: 3084807 - RNA, 21 nt, Mycobacterium bovis subsp bovis AF2122/97
gccgcguaccaauucccgcgc

SEQ ID NO: 3084808 - RNA, 21 nt, Mycobacterium bovis subsp bovis AF2122/97
gccgcguaggccuugcucagc

SEQ ID NO: 3084809 - RNA, 22 nt, Mycobacterium bovis subsp bovis AF2122/97
gccgcguaggccuugcucagcc

SEQ ID NO: 3084810 - RNA, 19 nt, Mycobacterium bovis subsp bovis AF2122/97
gccgcguagguggccagcg

SEQ ID NO: 3084811 - RNA, 20 nt, Mycobacterium bovis subsp bovis AF2122/97
gccgcguagguggccagcgc

SEQ ID NO: 3084812 - RNA, 21 nt, Mycobacterium bovis subsp bovis AF2122/97
gccgcguagugcuccguccga

SEQ ID NO: 3084813 - RNA, 14 nt, Mycobacterium bovis subsp bovis AF2122/97
gccgcgucaaccga

SEQ ID NO: 3084814 - RNA, 13 nt, Mycobacterium bovis subsp bovis AF2122/97
gccgcguccagac

SEQ ID NO: 3084815 - RNA, 17 nt, Mycobacterium bovis subsp bovis AF2122/97
gccgcgucgaacugggc

SEQ ID NO: 3084816 - RNA, 21 nt, Mycobacterium bovis subsp bovis AF2122/97
gccgcgucgaacugggcgccc

SEQ ID NO: 3084817 - RNA, 23 nt, Mycobacterium bovis subsp bovis AF2122/97
gccgcgucgaacugggcgcccgc

SEQ ID NO: 3084818 - RNA, 19 nt, Mycobacterium bovis subsp bovis AF2122/97
gccgcgucgagcaccuugg

SEQ ID NO: 3084819 - RNA, 20 nt, Mycobacterium bovis subsp bovis AF2122/97
gccgcgucgcgaaaggccac

SEQ ID NO: 3084820 - RNA, 15 nt, Mycobacterium bovis subsp bovis AF2122/97
gccgcgucgucgaga

SEQ ID NO: 3084821 - RNA, 17 nt, Mycobacterium bovis subsp bovis AF2122/97
gccgcgucucggugcag

SEQ ID NO: 3084822 - RNA, 18 nt, Mycobacterium bovis subsp bovis AF2122/97
gccgcgucucggugcagc

SEQ ID NO: 3084823 - RNA, 17 nt, Mycobacterium bovis subsp bovis AF2122/97
gccgcgugccgcccgcc

SEQ ID NO: 3084824 - RNA, 16 nt, Mycobacterium bovis subsp bovis AF2122/97
gccgcgugcugcggcu

SEQ ID NO: 3084825 - RNA, 19 nt, Mycobacterium bovis subsp bovis AF2122/97
gccgcgugcugcggcuggu

SEQ ID NO: 3084826 - RNA, 15 nt, Mycobacterium bovis subsp bovis AF2122/97
gccgcguggcuggcg

SEQ ID NO: 3084827 - RNA, 20 nt, Mycobacterium bovis subsp bovis AF2122/97
gccgcguggcuggcggcgac

SEQ ID NO: 3084828 - RNA, 18 nt, Mycobacterium bovis subsp bovis AF2122/97
gccgcguucacgcaauug

SEQ ID NO: 3084829 - RNA, 23 nt, Mycobacterium bovis subsp bovis AF2122/97
gccgcguucacgcaauuggccgu

SEQ ID NO: 3084830 - RNA, 11 nt, Mycobacterium bovis subsp bovis AF2122/97
gccgcguucgc

SEQ ID NO: 3084831 - RNA, 18 nt, Mycobacterium bovis subsp bovis AF2122/97
gccgcguucguggaucuc

SEQ ID NO: 3084832 - RNA, 13 nt, Mycobacterium bovis subsp bovis AF2122/97
gccgcguugccgg

SEQ ID NO: 3084833 - RNA, 15 nt, Mycobacterium bovis subsp bovis AF2122/97
gccgcguugccgggg

SEQ ID NO: 3084834 - RNA, 20 nt, Mycobacterium bovis subsp bovis AF2122/97
gccgcguugccgggguuggu

SEQ ID NO: 3084835 - RNA, 17 nt, Mycobacterium bovis subsp bovis AF2122/97
gccgcguugccggucgc

SEQ ID NO: 3084836 - RNA, 20 nt, Mycobacterium bovis subsp bovis AF2122/97
gccgcguuuauaccucgccg

SEQ ID NO: 3084837 - RNA, 18 nt, Mycobacterium bovis subsp bovis AF2122/97
gccgcguuucccggaaua

SEQ ID NO: 3084838 - RNA, 21 nt, Mycobacterium bovis subsp bovis AF2122/97
gccgcuaccccagccggcagc

SEQ ID NO: 3084839 - RNA, 14 nt, Mycobacterium bovis subsp bovis AF2122/97
gccgcuacccccga

SEQ ID NO: 3084840 - RNA, 23 nt, Mycobacterium bovis subsp bovis AF2122/97
gccgcuacccggacagggcggcg

SEQ ID NO: 3084841 - RNA, 18 nt, Mycobacterium bovis subsp bovis AF2122/97
gccgcuaccgaacaguag

SEQ ID NO: 3084842 - RNA, 16 nt, Mycobacterium bovis subsp bovis AF2122/97
gccgcuaccgcccgcg

SEQ ID NO: 3084843 - RNA, 17 nt, Mycobacterium bovis subsp bovis AF2122/97
gccgcuaccgcccgcgc

SEQ ID NO: 3084844 - RNA, 21 nt, Mycobacterium bovis subsp bovis AF2122/97
gccgcuaccgcccgcgccacc

SEQ ID NO: 3084845 - RNA, 13 nt, Mycobacterium bovis subsp bovis AF2122/97
gccgcuaccguca

SEQ ID NO: 3084846 - RNA, 15 nt, Mycobacterium bovis subsp bovis AF2122/97
gccgcuacgccggcc

SEQ ID NO: 3084847 - RNA, 21 nt, Mycobacterium bovis subsp bovis AF2122/97
gccgcuacgccggcccgaggc

SEQ ID NO: 3084848 - RNA, 16 nt, Mycobacterium bovis subsp bovis AF2122/97
gccgcuaggacggcgc

SEQ ID NO: 3084849 - RNA, 18 nt, Mycobacterium bovis subsp bovis AF2122/97
gccgcuaggacggcgcga

SEQ ID NO: 3084850 - RNA, 21 nt, Mycobacterium bovis subsp bovis AF2122/97
gccgcuaggacggcgcgagcc

SEQ ID NO: 3084851 - RNA, 18 nt, Mycobacterium bovis subsp bovis AF2122/97
gccgcuaggaucggaugg

SEQ ID NO: 3084852 - RNA, 21 nt, Mycobacterium bovis subsp bovis AF2122/97
gccgcuaggaucggauggcgg

SEQ ID NO: 3084853 - RNA, 23 nt, Mycobacterium bovis subsp bovis AF2122/97
gccgcuaucgaggaggcggucga

SEQ ID NO: 3084854 - RNA, 15 nt, Mycobacterium bovis subsp bovis AF2122/97
gccgcuauggcccgg

SEQ ID NO: 3084855 - RNA, 23 nt, Mycobacterium bovis subsp bovis AF2122/97
gccgcuauggcccgggccgaagc

SEQ ID NO: 3084856 - RNA, 20 nt, Mycobacterium bovis subsp bovis AF2122/97
gccgcucacauacagcaggc

SEQ ID NO: 3084857 - RNA, 23 nt, Mycobacterium bovis subsp bovis AF2122/97
gccgcucacauacagcaggccgc

SEQ ID NO: 3084858 - RNA, 13 nt, Mycobacterium bovis subsp bovis AF2122/97
gccgcucauccag

SEQ ID NO: 3084859 - RNA, 16 nt, Mycobacterium bovis subsp bovis AF2122/97
gccgcucauccagcgc

SEQ ID NO: 3084860 - RNA, 18 nt, Mycobacterium bovis subsp bovis AF2122/97
gccgcucauccagcgcgu

SEQ ID NO: 3084861 - RNA, 18 nt, Mycobacterium bovis subsp bovis AF2122/97
gccgcucaucgaucccgu

SEQ ID NO: 3084862 - RNA, 20 nt, Mycobacterium bovis subsp bovis AF2122/97
gccgcuccaaaagccucagc

SEQ ID NO: 3084863 - RNA, 15 nt, Mycobacterium bovis subsp bovis AF2122/97
gccgcuccaccacga

SEQ ID NO: 3084864 - RNA, 21 nt, Mycobacterium bovis subsp bovis AF2122/97
gccgcuccaccacgaccgcga

SEQ ID NO: 3084865 - RNA, 15 nt, Mycobacterium bovis subsp bovis AF2122/97
gccgcuccacguacg

SEQ ID NO: 3084866 - RNA, 16 nt, Mycobacterium bovis subsp bovis AF2122/97
gccgcuccacguacgc

SEQ ID NO: 3084867 - RNA, 20 nt, Mycobacterium bovis subsp bovis AF2122/97
gccgcuccacguacgcggcu

SEQ ID NO: 3084868 - RNA, 21 nt, Mycobacterium bovis subsp bovis AF2122/97
gccgcuccacguacgcggcug

SEQ ID NO: 3084869 - RNA, 24 nt, Mycobacterium bovis subsp bovis AF2122/97
gccgcuccacguacgcggcugcgu

SEQ ID NO: 3084870 - RNA, 14 nt, Mycobacterium bovis subsp bovis AF2122/97
gccgcucccgcaca

SEQ ID NO: 3084871 - RNA, 21 nt, Mycobacterium bovis subsp bovis AF2122/97
gccgcucccgcacaagcccag

SEQ ID NO: 3084872 - RNA, 22 nt, Mycobacterium bovis subsp bovis AF2122/97
gccgcucccgcacaagcccagc

SEQ ID NO: 3084873 - RNA, 23 nt, Mycobacterium bovis subsp bovis AF2122/97
gccgcucccgcacaagcccagcc

SEQ ID NO: 3084874 - RNA, 19 nt, Mycobacterium bovis subsp bovis AF2122/97
gccgcucgaaauccuggug

SEQ ID NO: 3084875 - RNA, 20 nt, Mycobacterium bovis subsp bovis AF2122/97
gccgcucgaccccgcgcugg

SEQ ID NO: 3084876 - RNA, 17 nt, Mycobacterium bovis subsp bovis AF2122/97
gccgcucgauggccuga

SEQ ID NO: 3084877 - RNA, 17 nt, Mycobacterium bovis subsp bovis AF2122/97
gccgcucgcacagccgc

SEQ ID NO: 3084878 - RNA, 20 nt, Mycobacterium bovis subsp bovis AF2122/97
gccgcucgccgguaggcggc

SEQ ID NO: 3084879 - RNA, 18 nt, Mycobacterium bovis subsp bovis AF2122/97
gccgcucgccucgauggc

SEQ ID NO: 3084880 - RNA, 13 nt, Mycobacterium bovis subsp bovis AF2122/97
gccgcucggcaac

SEQ ID NO: 3084881 - RNA, 19 nt, Mycobacterium bovis subsp bovis AF2122/97
gccgcucgguccccgcagc

SEQ ID NO: 3084882 - RNA, 17 nt, Mycobacterium bovis subsp bovis AF2122/97
gccgcucguuacgccga

SEQ ID NO: 3084883 - RNA, 19 nt, Mycobacterium bovis subsp bovis AF2122/97
gccgcucguuacgccgagc

SEQ ID NO: 3084884 - RNA, 20 nt, Mycobacterium bovis subsp bovis AF2122/97
gccgcucguuacgccgagca

SEQ ID NO: 3084885 - RNA, 21 nt, Mycobacterium bovis subsp bovis AF2122/97
gccgcucguuacgccgagcac

SEQ ID NO: 3084886 - RNA, 16 nt, Mycobacterium bovis subsp bovis AF2122/97
gccgcucuagcgucgu

SEQ ID NO: 3084887 - RNA, 22 nt, Mycobacterium bovis subsp bovis AF2122/97
gccgcugaauuggcgccgauga

SEQ ID NO: 3084888 - RNA, 20 nt, Mycobacterium bovis subsp bovis AF2122/97
gccgcugacuccugcggcac

SEQ ID NO: 3084889 - RNA, 24 nt, Mycobacterium bovis subsp bovis AF2122/97
gccggaccagcuccugcaugccgg

SEQ ID NO: 3084890 - RNA, 14 nt, Mycobacterium bovis subsp bovis AF2122/97
gccggaccaucagc

SEQ ID NO: 3084891 - RNA, 19 nt, Mycobacterium bovis subsp bovis AF2122/97
gccggaccaucagcgucga

SEQ ID NO: 3084892 - RNA, 19 nt, Mycobacterium bovis subsp bovis AF2122/97
gccggacccaccgucaccc

SEQ ID NO: 3084893 - RNA, 22 nt, Mycobacterium bovis subsp bovis AF2122/97
gccggacccaccgucacccccg

SEQ ID NO: 3084894 - RNA, 13 nt, Mycobacterium bovis subsp bovis AF2122/97
gccggacccgccg

SEQ ID NO: 3084895 - RNA, 20 nt, Mycobacterium bovis subsp bovis AF2122/97
gccggacccgccggguccgc

SEQ ID NO: 3084896 - RNA, 14 nt, Mycobacterium bovis subsp bovis AF2122/97
gccggacccgucga

SEQ ID NO: 3084897 - RNA, 16 nt, Mycobacterium bovis subsp bovis AF2122/97
gccggacccgucgagc

SEQ ID NO: 3084898 - RNA, 21 nt, Mycobacterium bovis subsp bovis AF2122/97
gccggacccgucgagcagcau

SEQ ID NO: 3084899 - RNA, 13 nt, Mycobacterium bovis subsp bovis AF2122/97
gccggaccgcgac

SEQ ID NO: 3084900 - RNA, 17 nt, Mycobacterium bovis subsp bovis AF2122/97
gccggaccgcgacggcg

SEQ ID NO: 3084901 - RNA, 22 nt, Mycobacterium bovis subsp bovis AF2122/97
gccggaccgcgacggcgccggc

SEQ ID NO: 3084902 - RNA, 17 nt, Mycobacterium bovis subsp bovis AF2122/97
gccggacgacaacaggc

SEQ ID NO: 3084903 - RNA, 20 nt, Mycobacterium bovis subsp bovis AF2122/97
gccggacgacaacaggccgu

SEQ ID NO: 3084904 - RNA, 17 nt, Mycobacterium bovis subsp bovis AF2122/97
gccggacgggugcagcg

SEQ ID NO: 3084905 - RNA, 16 nt, Mycobacterium bovis subsp bovis AF2122/97
gccggacuaccgccgg

SEQ ID NO: 3084906 - RNA, 17 nt, Mycobacterium bovis subsp bovis AF2122/97
gccggacuaccgccggc

SEQ ID NO: 3084907 - RNA, 22 nt, Mycobacterium bovis subsp bovis AF2122/97
gccggacuaccgccggcggcgg

SEQ ID NO: 3084908 - RNA, 23 nt, Mycobacterium bovis subsp bovis AF2122/97
gccggacuaccgccggcggcggc

SEQ ID NO: 3084909 - RNA, 14 nt, Mycobacterium bovis subsp bovis AF2122/97
gccggacugccgca

SEQ ID NO: 3084910 - RNA, 17 nt, Mycobacterium bovis subsp bovis AF2122/97
gccggacugccgcagga

SEQ ID NO: 3084911 - RNA, 14 nt, Mycobacterium bovis subsp bovis AF2122/97
gccggacugcggcc

SEQ ID NO: 3084912 - RNA, 15 nt, Mycobacterium bovis subsp bovis AF2122/97
gccggagacacccgc

SEQ ID NO: 3084913 - RNA, 18 nt, Mycobacterium bovis subsp bovis AF2122/97
gccggagacgucgccgca

SEQ ID NO: 3084914 - RNA, 19 nt, Mycobacterium bovis subsp bovis AF2122/97
gccggagacgucgccgcag

SEQ ID NO: 3084915 - RNA, 19 nt, Mycobacterium bovis subsp bovis AF2122/97
gccggagaguaggaccucg

SEQ ID NO: 3084916 - RNA, 23 nt, Mycobacterium bovis subsp bovis AF2122/97
gccggagccgcccaagccgccgg

SEQ ID NO: 3084917 - RNA, 14 nt, Mycobacterium bovis subsp bovis AF2122/97
gccggagccgccgg

SEQ ID NO: 3084918 - RNA, 15 nt, Mycobacterium bovis subsp bovis AF2122/97
gccggagccgccggc

SEQ ID NO: 3084919 - RNA, 21 nt, Mycobacterium bovis subsp bovis AF2122/97
gccggagccgccggccccgcc

SEQ ID NO: 3084920 - RNA, 15 nt, Mycobacterium bovis subsp bovis AF2122/97
gccggagccggugcc

SEQ ID NO: 3084921 - RNA, 19 nt, Mycobacterium bovis subsp bovis AF2122/97
gccggagccggugccgacg

SEQ ID NO: 3084922 - RNA, 23 nt, Mycobacterium bovis subsp bovis AF2122/97
gccggagccggugccgacggcgc

SEQ ID NO: 3084923 - RNA, 15 nt, Mycobacterium bovis subsp bovis AF2122/97
gccggagcgcaccug

SEQ ID NO: 3084924 - RNA, 14 nt, Mycobacterium bovis subsp bovis AF2122/97
gccggaggcaagca

SEQ ID NO: 3084925 - RNA, 19 nt, Mycobacterium bovis subsp bovis AF2122/97
gccggaggcaagcaaccgg

SEQ ID NO: 3084926 - RNA, 13 nt, Mycobacterium bovis subsp bovis AF2122/97
gccggaggcggcg

SEQ ID NO: 3084927 - RNA, 15 nt, Mycobacterium bovis subsp bovis AF2122/97
gccggaggcggcgcu

SEQ ID NO: 3084928 - RNA, 12 nt, Mycobacterium bovis subsp bovis AF2122/97
gccggagucgac

SEQ ID NO: 3084929 - RNA, 22 nt, Mycobacterium bovis subsp bovis AF2122/97
gccggagucgacccugcccagc

SEQ ID NO: 3084930 - RNA, 23 nt, Mycobacterium bovis subsp bovis AF2122/97
gccggagucgacccugcccagca

SEQ ID NO: 3084931 - RNA, 14 nt, Mycobacterium bovis subsp bovis AF2122/97
gccggagucgacga

SEQ ID NO: 3084932 - RNA, 13 nt, Mycobacterium bovis subsp bovis AF2122/97
gccggagucgauc

SEQ ID NO: 3084933 - RNA, 17 nt, Mycobacterium bovis subsp bovis AF2122/97
gccggagucgaucagcu

SEQ ID NO: 3084934 - RNA, 17 nt, Mycobacterium bovis subsp bovis AF2122/97
gccggaguuccgccauu

SEQ ID NO: 3084935 - RNA, 20 nt, Mycobacterium bovis subsp bovis AF2122/97
gccggaguucugcgaucacg

SEQ ID NO: 3084936 - RNA, 18 nt, Mycobacterium bovis subsp bovis AF2122/97
gccggaguugaagaagcc

SEQ ID NO: 3084937 - RNA, 15 nt, Mycobacterium bovis subsp bovis AF2122/97
gccggauacggcgac

SEQ ID NO: 3084938 - RNA, 19 nt, Mycobacterium bovis subsp bovis AF2122/97
gccggauacggcgacaccc

SEQ ID NO: 3084939 - RNA, 14 nt, Mycobacterium bovis subsp bovis AF2122/97
gccggauacgggcu

SEQ ID NO: 3084940 - RNA, 15 nt, Mycobacterium bovis subsp bovis AF2122/97
gccggauagcaccgg

SEQ ID NO: 3084941 - RNA, 15 nt, Mycobacterium bovis subsp bovis AF2122/97
gccggauagcgcagc

SEQ ID NO: 3084942 - RNA, 16 nt, Mycobacterium bovis subsp bovis AF2122/97
gccggauaggucgggc

SEQ ID NO: 3084943 - RNA, 22 nt, Mycobacterium bovis subsp bovis AF2122/97
gccggaucccugugccagcagc

SEQ ID NO: 3084944 - RNA, 16 nt, Mycobacterium bovis subsp bovis AF2122/97
gccggauccgauccgc

SEQ ID NO: 3084945 - RNA, 18 nt, Mycobacterium bovis subsp bovis AF2122/97
gccggaucgacguucggg

SEQ ID NO: 3084946 - RNA, 18 nt, Mycobacterium bovis subsp bovis AF2122/97
gccggaucgccggugaac

SEQ ID NO: 3084947 - RNA, 13 nt, Mycobacterium bovis subsp bovis AF2122/97
gccggaugaaaug

SEQ ID NO: 3084948 - RNA, 20 nt, Mycobacterium bovis subsp bovis AF2122/97
gccggaugacaccgaccggg

SEQ ID NO: 3084949 - RNA, 16 nt, Mycobacterium bovis subsp bovis AF2122/97
gccggaugacgcccag

SEQ ID NO: 3084950 - RNA, 19 nt, Mycobacterium bovis subsp bovis AF2122/97
gccggaugacgcccagggc

SEQ ID NO: 3084951 - RNA, 16 nt, Mycobacterium bovis subsp bovis AF2122/97
gccggaugagcgaacg

SEQ ID NO: 3084952 - RNA, 18 nt, Mycobacterium bovis subsp bovis AF2122/97
gccggauggguggccagc

SEQ ID NO: 3084953 - RNA, 20 nt, Mycobacterium bovis subsp bovis AF2122/97
gccggauggguggccagcaa

SEQ ID NO: 3084954 - RNA, 16 nt, Mycobacterium bovis subsp bovis AF2122/97
gccggauggucggcca

SEQ ID NO: 3084955 - RNA, 18 nt, Mycobacterium bovis subsp bovis AF2122/97
gccggauggucggccacg

SEQ ID NO: 3084956 - RNA, 17 nt, Mycobacterium bovis subsp bovis AF2122/97
gccggaugucgacgagc

SEQ ID NO: 3084957 - RNA, 21 nt, Mycobacterium bovis subsp bovis AF2122/97
gccggaugucgacgagcaccg

SEQ ID NO: 3084958 - RNA, 17 nt, Mycobacterium bovis subsp bovis AF2122/97
gccggauucgcccgggc

SEQ ID NO: 3084959 - RNA, 21 nt, Mycobacterium bovis subsp bovis AF2122/97
gccggauucggcugccaccgc

SEQ ID NO: 3084960 - RNA, 16 nt, Mycobacterium bovis subsp bovis AF2122/97
gccggauucuccgccc

SEQ ID NO: 3084961 - RNA, 20 nt, Mycobacterium bovis subsp bovis AF2122/97
gccggauucuccgcccucag

SEQ ID NO: 3084962 - RNA, 19 nt, Mycobacterium bovis subsp bovis AF2122/97
gccggcaaaggacgucgac

SEQ ID NO: 3084963 - RNA, 22 nt, Mycobacterium bovis subsp bovis AF2122/97
gccggcaaaggacgucgaccug

SEQ ID NO: 3084964 - RNA, 23 nt, Mycobacterium bovis subsp bovis AF2122/97
gccggcaaaggacgucgaccugu

SEQ ID NO: 3084965 - RNA, 21 nt, Mycobacterium bovis subsp bovis AF2122/97
gccggcaaccgggaggccacc

SEQ ID NO: 3084966 - RNA, 21 nt, Mycobacterium bovis subsp bovis AF2122/97
gccggcaaccugaauccagac

SEQ ID NO: 3084967 - RNA, 13 nt, Mycobacterium bovis subsp bovis AF2122/97
gccggcaacggcg

SEQ ID NO: 3084968 - RNA, 16 nt, Mycobacterium bovis subsp bovis AF2122/97
gccggcaacggcgcgc

SEQ ID NO: 3084969 - RNA, 18 nt, Mycobacterium bovis subsp bovis AF2122/97
gccggcaacggcgcgccg

SEQ ID NO: 3084970 - RNA, 17 nt, Mycobacterium bovis subsp bovis AF2122/97
gccggcaacgugcggug

SEQ ID NO: 3084971 - RNA, 18 nt, Mycobacterium bovis subsp bovis AF2122/97
gccggcaagcggaauucc

SEQ ID NO: 3084972 - RNA, 22 nt, Mycobacterium bovis subsp bovis AF2122/97
gccggcaaggcauucgagcacg

SEQ ID NO: 3084973 - RNA, 14 nt, Mycobacterium bovis subsp bovis AF2122/97
gccggcaauaccgc

SEQ ID NO: 3084974 - RNA, 20 nt, Mycobacterium bovis subsp bovis AF2122/97
gccggcaauaccgccagcgc

SEQ ID NO: 3084975 - RNA, 23 nt, Mycobacterium bovis subsp bovis AF2122/97
gccggccagccagcgauccagcg

SEQ ID NO: 3084976 - RNA, 13 nt, Mycobacterium bovis subsp bovis AF2122/97
gccggccagcggc

SEQ ID NO: 3084977 - RNA, 14 nt, Mycobacterium bovis subsp bovis AF2122/97
gccggccagcggcc

SEQ ID NO: 3084978 - RNA, 17 nt, Mycobacterium bovis subsp bovis AF2122/97
gccggccagcggccauc

SEQ ID NO: 3084979 - RNA, 22 nt, Mycobacterium bovis subsp bovis AF2122/97
gccggccaggcuauggugccgg

SEQ ID NO: 3084980 - RNA, 12 nt, Mycobacterium bovis subsp bovis AF2122/97
gccggccaggug

SEQ ID NO: 3084981 - RNA, 20 nt, Mycobacterium bovis subsp bovis AF2122/97
gccggccaggugacguucga

SEQ ID NO: 3084982 - RNA, 15 nt, Mycobacterium bovis subsp bovis AF2122/97
gccggccagucguac

SEQ ID NO: 3084983 - RNA, 17 nt, Mycobacterium bovis subsp bovis AF2122/97
gccggccauacgcgcgc

SEQ ID NO: 3084984 - RNA, 18 nt, Mycobacterium bovis subsp bovis AF2122/97
gccggccauacgcgcgcg

SEQ ID NO: 3084985 - RNA, 22 nt, Mycobacterium bovis subsp bovis AF2122/97
gccggccauacgcgcgcggucg

SEQ ID NO: 3084986 - RNA, 20 nt, Mycobacterium bovis subsp bovis AF2122/97
gccggcccaguucugcagga

SEQ ID NO: 3084987 - RNA, 23 nt, Mycobacterium bovis subsp bovis AF2122/97
gccggcccauucaucuugcggca

SEQ ID NO: 3084988 - RNA, 20 nt, Mycobacterium bovis subsp bovis AF2122/97
gccggccccaccgguaccgc

SEQ ID NO: 3084989 - RNA, 18 nt, Mycobacterium bovis subsp bovis AF2122/97
gccggccccaccggugcc

SEQ ID NO: 3084990 - RNA, 20 nt, Mycobacterium bovis subsp bovis AF2122/97
gccggccccaccggugccgc

SEQ ID NO: 3084991 - RNA, 15 nt, Mycobacterium bovis subsp bovis AF2122/97
gccggccccgccagc

SEQ ID NO: 3084992 - RNA, 16 nt, Mycobacterium bovis subsp bovis AF2122/97
gccggccccgccagcg

SEQ ID NO: 3084993 - RNA, 17 nt, Mycobacterium bovis subsp bovis AF2122/97
gccggccccgccagcgc

SEQ ID NO: 3084994 - RNA, 21 nt, Mycobacterium bovis subsp bovis AF2122/97
gccggccccgccagcgccgcc

SEQ ID NO: 3084995 - RNA, 17 nt, Mycobacterium bovis subsp bovis AF2122/97
gccggccccgcccgcgc

SEQ ID NO: 3084996 - RNA, 19 nt, Mycobacterium bovis subsp bovis AF2122/97
gccggccccgcccgcgcgg

SEQ ID NO: 3084997 - RNA, 16 nt, Mycobacterium bovis subsp bovis AF2122/97
gccggccccgccgaug

SEQ ID NO: 3084998 - RNA, 19 nt, Mycobacterium bovis subsp bovis AF2122/97
gccggccccgccgcuaccg

SEQ ID NO: 3084999 - RNA, 15 nt, Mycobacterium bovis subsp bovis AF2122/97
gccggccccgccggc

SEQ ID NO: 3085000 - RNA, 23 nt, Mycobacterium bovis subsp bovis AF2122/97
gccggccccgccggccccgccgu

SEQ ID NO: 3085001 - RNA, 19 nt, Mycobacterium bovis subsp bovis AF2122/97
gccggccccgccggcgccg

SEQ ID NO: 3085002 - RNA, 21 nt, Mycobacterium bovis subsp bovis AF2122/97
gccggccccgccggcgccgcc

SEQ ID NO: 3085003 - RNA, 22 nt, Mycobacterium bovis subsp bovis AF2122/97
gccggccccgccgucaccgccg

SEQ ID NO: 3085004 - RNA, 23 nt, Mycobacterium bovis subsp bovis AF2122/97
gccggccccgccgucaccgccgu

SEQ ID NO: 3085005 - RNA, 17 nt, Mycobacterium bovis subsp bovis AF2122/97
gccggccccgccgucgc

SEQ ID NO: 3085006 - RNA, 19 nt, Mycobacterium bovis subsp bovis AF2122/97
gccggccccgccgucgccg

SEQ ID NO: 3085007 - RNA, 22 nt, Mycobacterium bovis subsp bovis AF2122/97
gccggccccgccgucgccgccg

SEQ ID NO: 3085008 - RNA, 20 nt, Mycobacterium bovis subsp bovis AF2122/97
gccggccccgccguuaccgc

SEQ ID NO: 3085009 - RNA, 12 nt, Mycobacterium bovis subsp bovis AF2122/97
gccggcccgcaa

SEQ ID NO: 3085010 - RNA, 22 nt, Mycobacterium bovis subsp bovis AF2122/97
gccggcccgcaggcuuccccga

SEQ ID NO: 3085011 - RNA, 13 nt, Mycobacterium bovis subsp bovis AF2122/97
gccggcccgcggg

SEQ ID NO: 3085012 - RNA, 15 nt, Mycobacterium bovis subsp bovis AF2122/97
gccggcccgcgggcg

SEQ ID NO: 3085013 - RNA, 14 nt, Mycobacterium bovis subsp bovis AF2122/97
gccggcccgucgcg

SEQ ID NO: 3085014 - RNA, 19 nt, Mycobacterium bovis subsp bovis AF2122/97
gccggcccugcggccaaug

SEQ ID NO: 3085015 - RNA, 15 nt, Mycobacterium bovis subsp bovis AF2122/97
gccggcccugcucgc

SEQ ID NO: 3085016 - RNA, 18 nt, Mycobacterium bovis subsp bovis AF2122/97
gccggcccugcucgccgu

SEQ ID NO: 3085017 - RNA, 18 nt, Mycobacterium bovis subsp bovis AF2122/97
gccggcccugcucggcca

SEQ ID NO: 3085018 - RNA, 14 nt, Mycobacterium bovis subsp bovis AF2122/97
gccggccgaucggc

SEQ ID NO: 3085019 - RNA, 17 nt, Mycobacterium bovis subsp bovis AF2122/97
gccggccgaucggccgg

SEQ ID NO: 3085020 - RNA, 21 nt, Mycobacterium bovis subsp bovis AF2122/97
gccggccgcacgccggccagc

SEQ ID NO: 3085021 - RNA, 22 nt, Mycobacterium bovis subsp bovis AF2122/97
gccggccgcacgccggccagcg

SEQ ID NO: 3085022 - RNA, 16 nt, Mycobacterium bovis subsp bovis AF2122/97
gccggccgccagcgca

SEQ ID NO: 3085023 - RNA, 13 nt, Mycobacterium bovis subsp bovis AF2122/97
gccggccgcccgc

SEQ ID NO: 3085024 - RNA, 15 nt, Mycobacterium bovis subsp bovis AF2122/97
gccggccgcgaccgc

SEQ ID NO: 3085025 - RNA, 14 nt, Mycobacterium bovis subsp bovis AF2122/97
gccggccgcgcaga

SEQ ID NO: 3085026 - RNA, 16 nt, Mycobacterium bovis subsp bovis AF2122/97
gccggccgcgcuggug

SEQ ID NO: 3085027 - RNA, 14 nt, Mycobacterium bovis subsp bovis AF2122/97
gccggccgcgggcg

SEQ ID NO: 3085028 - RNA, 17 nt, Mycobacterium bovis subsp bovis AF2122/97
gccggccgcggggcauc

SEQ ID NO: 3085029 - RNA, 20 nt, Mycobacterium bovis subsp bovis AF2122/97
gccggccgcgggucgcugcg

SEQ ID NO: 3085030 - RNA, 14 nt, Mycobacterium bovis subsp bovis AF2122/97
gccggccgcucacc

SEQ ID NO: 3085031 - RNA, 20 nt, Mycobacterium bovis subsp bovis AF2122/97
gccggccgcucaccccgcgc

SEQ ID NO: 3085032 - RNA, 20 nt, Mycobacterium bovis subsp bovis AF2122/97
gccggccgcuuggccgcugc

SEQ ID NO: 3085033 - RNA, 13 nt, Mycobacterium bovis subsp bovis AF2122/97
gccggccggaacg

SEQ ID NO: 3085034 - RNA, 18 nt, Mycobacterium bovis subsp bovis AF2122/97
gccggccggaacgcccgg

SEQ ID NO: 3085035 - RNA, 22 nt, Mycobacterium bovis subsp bovis AF2122/97
gccggccggaguccgucgggga

SEQ ID NO: 3085036 - RNA, 12 nt, Mycobacterium bovis subsp bovis AF2122/97
gccggccggcag

SEQ ID NO: 3085037 - RNA, 16 nt, Mycobacterium bovis subsp bovis AF2122/97
gccggccggcccauuc

SEQ ID NO: 3085038 - RNA, 11 nt, Mycobacterium bovis subsp bovis AF2122/97
gccggccggcg

SEQ ID NO: 3085039 - RNA, 12 nt, Mycobacterium bovis subsp bovis AF2122/97
gccggccggcgg

SEQ ID NO: 3085040 - RNA, 13 nt, Mycobacterium bovis subsp bovis AF2122/97
gccggccggcggg

SEQ ID NO: 3085041 - RNA, 19 nt, Mycobacterium bovis subsp bovis AF2122/97
gccggccgggaaccucgcg

SEQ ID NO: 3085042 - RNA, 20 nt, Mycobacterium bovis subsp bovis AF2122/97
gccggccgggaaccucgcgu

SEQ ID NO: 3085043 - RNA, 14 nt, Mycobacterium bovis subsp bovis AF2122/97
gccggccgggugua

SEQ ID NO: 3085044 - RNA, 14 nt, Mycobacterium bovis subsp bovis AF2122/97
gccggccggucagg

SEQ ID NO: 3085045 - RNA, 14 nt, Mycobacterium bovis subsp bovis AF2122/97
gccggccgucggcc

SEQ ID NO: 3085046 - RNA, 18 nt, Mycobacterium bovis subsp bovis AF2122/97
gccggccguucgugggca

SEQ ID NO: 3085047 - RNA, 16 nt, Mycobacterium bovis subsp bovis AF2122/97
gccggccuaccgagcu

SEQ ID NO: 3085048 - RNA, 19 nt, Mycobacterium bovis subsp bovis AF2122/97
gccggccuaccgagcuacg

SEQ ID NO: 3085049 - RNA, 16 nt, Mycobacterium bovis subsp bovis AF2122/97
gccggccuagccgaug

SEQ ID NO: 3085050 - RNA, 21 nt, Mycobacterium bovis subsp bovis AF2122/97
gccggccuagccgauggcuac

SEQ ID NO: 3085051 - RNA, 24 nt, Mycobacterium bovis subsp bovis AF2122/97
gccggccuccucgacgagucggcg

SEQ ID NO: 3085052 - RNA, 15 nt, Mycobacterium bovis subsp bovis AF2122/97
gccggccucgccgaa

SEQ ID NO: 3085053 - RNA, 19 nt, Mycobacterium bovis subsp bovis AF2122/97
gccggccucgccgaagcgg

SEQ ID NO: 3085054 - RNA, 13 nt, Mycobacterium bovis subsp bovis AF2122/97
gccggccucugga

SEQ ID NO: 3085055 - RNA, 14 nt, Mycobacterium bovis subsp bovis AF2122/97
gccggccugcucgg

SEQ ID NO: 3085056 - RNA, 13 nt, Mycobacterium bovis subsp bovis AF2122/97
gccggccuggccg

SEQ ID NO: 3085057 - RNA, 14 nt, Mycobacterium bovis subsp bovis AF2122/97
gccggccuggccgc

SEQ ID NO: 3085058 - RNA, 17 nt, Mycobacterium bovis subsp bovis AF2122/97
gccggccuugagcaccc

SEQ ID NO: 3085059 - RNA, 19 nt, Mycobacterium bovis subsp bovis AF2122/97
gccggcgaaccccagcgca

SEQ ID NO: 3085060 - RNA, 13 nt, Mycobacterium bovis subsp bovis AF2122/97
gccggcgaacucg

SEQ ID NO: 3085061 - RNA, 18 nt, Mycobacterium bovis subsp bovis AF2122/97
gccggcgaacucgcgccg

SEQ ID NO: 3085062 - RNA, 23 nt, Mycobacterium bovis subsp bovis AF2122/97
gccggcgcguaguaaugcucgac

SEQ ID NO: 3085063 - RNA, 12 nt, Mycobacterium bovis subsp bovis AF2122/97
gccggcgcucgc

SEQ ID NO: 3085064 - RNA, 13 nt, Mycobacterium bovis subsp bovis AF2122/97
gccggcgcucgca

SEQ ID NO: 3085065 - RNA, 22 nt, Mycobacterium bovis subsp bovis AF2122/97
gccggcgcucgcggcggcgcug

SEQ ID NO: 3085066 - RNA, 15 nt, Mycobacterium bovis subsp bovis AF2122/97
gccggcgcugcccgg

SEQ ID NO: 3085067 - RNA, 17 nt, Mycobacterium bovis subsp bovis AF2122/97
gccggcgcugcccgggc

SEQ ID NO: 3085068 - RNA, 23 nt, Mycobacterium bovis subsp bovis AF2122/97
gccggcgcuggcgggcgaucgcg

SEQ ID NO: 3085069 - RNA, 19 nt, Mycobacterium bovis subsp bovis AF2122/97
gccggcggaaauggcgucg

SEQ ID NO: 3085070 - RNA, 18 nt, Mycobacterium bovis subsp bovis AF2122/97
gccggcggaagcggcggc

SEQ ID NO: 3085071 - RNA, 21 nt, Mycobacterium bovis subsp bovis AF2122/97
gccggcggaagcggcggcccu

SEQ ID NO: 3085072 - RNA, 14 nt, Mycobacterium bovis subsp bovis AF2122/97
gccggcggacgccc

SEQ ID NO: 3085073 - RNA, 18 nt, Mycobacterium bovis subsp bovis AF2122/97
gccggcggacgcccggcg

SEQ ID NO: 3085074 - RNA, 21 nt, Mycobacterium bovis subsp bovis AF2122/97
gccggcggacgcccggcgcac

SEQ ID NO: 3085075 - RNA, 17 nt, Mycobacterium bovis subsp bovis AF2122/97
gccggcggaucugaucg

SEQ ID NO: 3085076 - RNA, 22 nt, Mycobacterium bovis subsp bovis AF2122/97
gccggcggaucugaucggcgcg

SEQ ID NO: 3085077 - RNA, 22 nt, Mycobacterium bovis subsp bovis AF2122/97
gccggcggcaaagaacagccgg

SEQ ID NO: 3085078 - RNA, 23 nt, Mycobacterium bovis subsp bovis AF2122/97
gccggcggcaaagaacagccggc

SEQ ID NO: 3085079 - RNA, 15 nt, Mycobacterium bovis subsp bovis AF2122/97
gccggcggccaccuc

SEQ ID NO: 3085080 - RNA, 14 nt, Mycobacterium bovis subsp bovis AF2122/97
gccggcggcccgcu

SEQ ID NO: 3085081 - RNA, 17 nt, Mycobacterium bovis subsp bovis AF2122/97
gccggcggccgcccaga

SEQ ID NO: 3085082 - RNA, 18 nt, Mycobacterium bovis subsp bovis AF2122/97
gccggcggccgcccagau

SEQ ID NO: 3085083 - RNA, 14 nt, Mycobacterium bovis subsp bovis AF2122/97
gccggcggccgcgg

SEQ ID NO: 3085084 - RNA, 20 nt, Mycobacterium bovis subsp bovis AF2122/97
gccggcggccuugcgggcuc

SEQ ID NO: 3085085 - RNA, 11 nt, Mycobacterium bovis subsp bovis AF2122/97
gccggcggcga

SEQ ID NO: 3085086 - RNA, 12 nt, Mycobacterium bovis subsp bovis AF2122/97
gccggcggcgac

SEQ ID NO: 3085087 - RNA, 13 nt, Mycobacterium bovis subsp bovis AF2122/97
gccggcggcgacc

SEQ ID NO: 3085088 - RNA, 12 nt, Mycobacterium bovis subsp bovis AF2122/97
gccggcggcggc

SEQ ID NO: 3085089 - RNA, 13 nt, Mycobacterium bovis subsp bovis AF2122/97
gccggcggcggcc

SEQ ID NO: 3085090 - RNA, 14 nt, Mycobacterium bovis subsp bovis AF2122/97
gccggcggcggccg

SEQ ID NO: 3085091 - RNA, 20 nt, Mycobacterium bovis subsp bovis AF2122/97
gccggcggcggcgcucggcc

SEQ ID NO: 3085092 - RNA, 12 nt, Mycobacterium bovis subsp bovis AF2122/97
gccggcggcggu

SEQ ID NO: 3085093 - RNA, 22 nt, Mycobacterium bovis subsp bovis AF2122/97
gccggcggcgguaccggaaucg

SEQ ID NO: 3085094 - RNA, 15 nt, Mycobacterium bovis subsp bovis AF2122/97
gccggcggcgguggu

SEQ ID NO: 3085095 - RNA, 20 nt, Mycobacterium bovis subsp bovis AF2122/97
gccggcggcucgggugcgcc

SEQ ID NO: 3085096 - RNA, 23 nt, Mycobacterium bovis subsp bovis AF2122/97
gccggcggcucgggugcgcccgg

SEQ ID NO: 3085097 - RNA, 18 nt, Mycobacterium bovis subsp bovis AF2122/97
gccggcggcuguggucgc

SEQ ID NO: 3085098 - RNA, 15 nt, Mycobacterium bovis subsp bovis AF2122/97
gccggcgggccaccg

SEQ ID NO: 3085099 - RNA, 23 nt, Mycobacterium bovis subsp bovis AF2122/97
gccggcgggcgagugucagcaga

SEQ ID NO: 3085100 - RNA, 17 nt, Mycobacterium bovis subsp bovis AF2122/97
gccggcgggcgcgggcg

SEQ ID NO: 3085101 - RNA, 20 nt, Mycobacterium bovis subsp bovis AF2122/97
gccggcgggcguaccuucga

SEQ ID NO: 3085102 - RNA, 14 nt, Mycobacterium bovis subsp bovis AF2122/97
gccggcgggcucgc

SEQ ID NO: 3085103 - RNA, 16 nt, Mycobacterium bovis subsp bovis AF2122/97
gccggcgggcucgccc

SEQ ID NO: 3085104 - RNA, 18 nt, Mycobacterium bovis subsp bovis AF2122/97
gccggcgggcucgcccgc

SEQ ID NO: 3085105 - RNA, 20 nt, Mycobacterium bovis subsp bovis AF2122/97
gccggcgggcucgcccgcua

SEQ ID NO: 3085106 - RNA, 24 nt, Mycobacterium bovis subsp bovis AF2122/97
gccggcgggcucgcccgcuacggc

SEQ ID NO: 3085107 - RNA, 22 nt, Mycobacterium bovis subsp bovis AF2122/97
gccggcggguggcccccgccgg

SEQ ID NO: 3085108 - RNA, 18 nt, Mycobacterium bovis subsp bovis AF2122/97
gccggcgguagucggcca

SEQ ID NO: 3085109 - RNA, 19 nt, Mycobacterium bovis subsp bovis AF2122/97
gccggcgguagucggccag

SEQ ID NO: 3085110 - RNA, 20 nt, Mycobacterium bovis subsp bovis AF2122/97
gccggcgguagucggccagc

SEQ ID NO: 3085111 - RNA, 23 nt, Mycobacterium bovis subsp bovis AF2122/97
gccggcgguagucggccagcucg

SEQ ID NO: 3085112 - RNA, 12 nt, Mycobacterium bovis subsp bovis AF2122/97
gccggcggucgc

SEQ ID NO: 3085113 - RNA, 15 nt, Mycobacterium bovis subsp bovis AF2122/97
gccggcggucgccag

SEQ ID NO: 3085114 - RNA, 13 nt, Mycobacterium bovis subsp bovis AF2122/97
gccggcggucgcg

SEQ ID NO: 3085115 - RNA, 14 nt, Mycobacterium bovis subsp bovis AF2122/97
gccggcggucgggc

SEQ ID NO: 3085116 - RNA, 17 nt, Mycobacterium bovis subsp bovis AF2122/97
gccggcggucgggcccg

SEQ ID NO: 3085117 - RNA, 20 nt, Mycobacterium bovis subsp bovis AF2122/97
gccggcggucgggcccggcg

SEQ ID NO: 3085118 - RNA, 21 nt, Mycobacterium bovis subsp bovis AF2122/97
gccggcggucgggcccggcga

SEQ ID NO: 3085119 - RNA, 23 nt, Mycobacterium bovis subsp bovis AF2122/97
gccggcggucgggcccggcgagc

SEQ ID NO: 3085120 - RNA, 21 nt, Mycobacterium bovis subsp bovis AF2122/97
gccggcggugacggcggcaac

SEQ ID NO: 3085121 - RNA, 22 nt, Mycobacterium bovis subsp bovis AF2122/97
gccggcggugacggcggcaacg

SEQ ID NO: 3085122 - RNA, 13 nt, Mycobacterium bovis subsp bovis AF2122/97
gccggcgguggcc

SEQ ID NO: 3085123 - RNA, 15 nt, Mycobacterium bovis subsp bovis AF2122/97
gccggcgguggccga

SEQ ID NO: 3085124 - RNA, 21 nt, Mycobacterium bovis subsp bovis AF2122/97
gccggcgguguuagcgcgaac

SEQ ID NO: 3085125 - RNA, 23 nt, Mycobacterium bovis subsp bovis AF2122/97
gccggcguacuucgacagcggcg

SEQ ID NO: 3085126 - RNA, 15 nt, Mycobacterium bovis subsp bovis AF2122/97
gccggcguagcggcg

SEQ ID NO: 3085127 - RNA, 16 nt, Mycobacterium bovis subsp bovis AF2122/97
gccggcguagcggcga

SEQ ID NO: 3085128 - RNA, 17 nt, Mycobacterium bovis subsp bovis AF2122/97
gccggcguagcggcgau

SEQ ID NO: 3085129 - RNA, 22 nt, Mycobacterium bovis subsp bovis AF2122/97
gccggcguagcggcgauaccgg

SEQ ID NO: 3085130 - RNA, 13 nt, Mycobacterium bovis subsp bovis AF2122/97
gccggcgucagcc

SEQ ID NO: 3085131 - RNA, 15 nt, Mycobacterium bovis subsp bovis AF2122/97
gccggcgucagcccc

SEQ ID NO: 3085132 - RNA, 16 nt, Mycobacterium bovis subsp bovis AF2122/97
gccggcgucagccccg

SEQ ID NO: 3085133 - RNA, 21 nt, Mycobacterium bovis subsp bovis AF2122/97
gccggcgucagccccgacugc

SEQ ID NO: 3085134 - RNA, 13 nt, Mycobacterium bovis subsp bovis AF2122/97
gccggcgucgagc

SEQ ID NO: 3085135 - RNA, 16 nt, Mycobacterium bovis subsp bovis AF2122/97
gccggcgucgagccgg

SEQ ID NO: 3085136 - RNA, 21 nt, Mycobacterium bovis subsp bovis AF2122/97
gccggcgucgaugacgacgcc

SEQ ID NO: 3085137 - RNA, 16 nt, Mycobacterium bovis subsp bovis AF2122/97
gccggcgucgcuggcc

SEQ ID NO: 3085138 - RNA, 17 nt, Mycobacterium bovis subsp bovis AF2122/97
gccggcgucgcuggcca

SEQ ID NO: 3085139 - RNA, 12 nt, Mycobacterium bovis subsp bovis AF2122/97
gccggcgucggc

SEQ ID NO: 3085140 - RNA, 14 nt, Mycobacterium bovis subsp bovis AF2122/97
gccggcgucggcgc

SEQ ID NO: 3085141 - RNA, 17 nt, Mycobacterium bovis subsp bovis AF2122/97
gccggcgucggcgccca

SEQ ID NO: 3085142 - RNA, 19 nt, Mycobacterium bovis subsp bovis AF2122/97
gccggcgucggcgcccagc

SEQ ID NO: 3085143 - RNA, 20 nt, Mycobacterium bovis subsp bovis AF2122/97
gccggcgucggcgcccagcu

SEQ ID NO: 3085144 - RNA, 21 nt, Mycobacterium bovis subsp bovis AF2122/97
gccggcgucggcgcccagcuc

SEQ ID NO: 3085145 - RNA, 14 nt, Mycobacterium bovis subsp bovis AF2122/97
gccggcgucggcgu

SEQ ID NO: 3085146 - RNA, 13 nt, Mycobacterium bovis subsp bovis AF2122/97
gccggcgugcgcg

SEQ ID NO: 3085147 - RNA, 15 nt, Mycobacterium bovis subsp bovis AF2122/97
gccggcgugcgcgag

SEQ ID NO: 3085148 - RNA, 16 nt, Mycobacterium bovis subsp bovis AF2122/97
gccgggcaaccagcag

SEQ ID NO: 3085149 - RNA, 18 nt, Mycobacterium bovis subsp bovis AF2122/97
gccgggcaaccagcagca

SEQ ID NO: 3085150 - RNA, 20 nt, Mycobacterium bovis subsp bovis AF2122/97
gccgggcaaccagcagcagg

SEQ ID NO: 3085151 - RNA, 16 nt, Mycobacterium bovis subsp bovis AF2122/97
gccgggcaacgcgaac

SEQ ID NO: 3085152 - RNA, 23 nt, Mycobacterium bovis subsp bovis AF2122/97
gccgggcaacgcgaaccggccau

SEQ ID NO: 3085153 - RNA, 23 nt, Mycobacterium bovis subsp bovis AF2122/97
gccgggcaaggccaccgucgcgg

SEQ ID NO: 3085154 - RNA, 15 nt, Mycobacterium bovis subsp bovis AF2122/97
gccgggcaaggcccg

SEQ ID NO: 3085155 - RNA, 18 nt, Mycobacterium bovis subsp bovis AF2122/97
gccgggcaccaccacacc

SEQ ID NO: 3085156 - RNA, 14 nt, Mycobacterium bovis subsp bovis AF2122/97
gccgggcaccaccc

SEQ ID NO: 3085157 - RNA, 16 nt, Mycobacterium bovis subsp bovis AF2122/97
gccgggcaccacccuu

SEQ ID NO: 3085158 - RNA, 22 nt, Mycobacterium bovis subsp bovis AF2122/97
gccgggcacccacuuuucggug

SEQ ID NO: 3085159 - RNA, 16 nt, Mycobacterium bovis subsp bovis AF2122/97
gccgggcacgcgaggc

SEQ ID NO: 3085160 - RNA, 13 nt, Mycobacterium bovis subsp bovis AF2122/97
gccgggcacgggc

SEQ ID NO: 3085161 - RNA, 18 nt, Mycobacterium bovis subsp bovis AF2122/97
gccgggcagucaggccua

SEQ ID NO: 3085162 - RNA, 17 nt, Mycobacterium bovis subsp bovis AF2122/97
gccgggcagugcgcggc

SEQ ID NO: 3085163 - RNA, 18 nt, Mycobacterium bovis subsp bovis AF2122/97
gccgggcaguuuggcggc

SEQ ID NO: 3085164 - RNA, 15 nt, Mycobacterium bovis subsp bovis AF2122/97
gccgggccaaccggu

SEQ ID NO: 3085165 - RNA, 13 nt, Mycobacterium bovis subsp bovis AF2122/97
gccgggccacggc

SEQ ID NO: 3085166 - RNA, 18 nt, Mycobacterium bovis subsp bovis AF2122/97
gccgggccacggcugacc

SEQ ID NO: 3085167 - RNA, 15 nt, Mycobacterium bovis subsp bovis AF2122/97
gccgggccaggccga

SEQ ID NO: 3085168 - RNA, 22 nt, Mycobacterium bovis subsp bovis AF2122/97
gccgggccaggccgaugccgac

SEQ ID NO: 3085169 - RNA, 16 nt, Mycobacterium bovis subsp bovis AF2122/97
gccgggcccgucggac

SEQ ID NO: 3085170 - RNA, 13 nt, Mycobacterium bovis subsp bovis AF2122/97
gccgggccgccga

SEQ ID NO: 3085171 - RNA, 14 nt, Mycobacterium bovis subsp bovis AF2122/97
gccgggccgccgag

SEQ ID NO: 3085172 - RNA, 16 nt, Mycobacterium bovis subsp bovis AF2122/97
gccgggccgccgagcg

SEQ ID NO: 3085173 - RNA, 17 nt, Mycobacterium bovis subsp bovis AF2122/97
gccgggccgccgagcgg

SEQ ID NO: 3085174 - RNA, 12 nt, Mycobacterium bovis subsp bovis AF2122/97
gccgggccgcgc

SEQ ID NO: 3085175 - RNA, 22 nt, Mycobacterium bovis subsp bovis AF2122/97
gccgggccgcgcgggccgccgc

SEQ ID NO: 3085176 - RNA, 13 nt, Mycobacterium bovis subsp bovis AF2122/97
gccgggccggcca

SEQ ID NO: 3085177 - RNA, 16 nt, Mycobacterium bovis subsp bovis AF2122/97
gccgggccggccacgu

SEQ ID NO: 3085178 - RNA, 12 nt, Mycobacterium bovis subsp bovis AF2122/97
gccgggccgucc

SEQ ID NO: 3085179 - RNA, 17 nt, Mycobacterium bovis subsp bovis AF2122/97
gccgggccguguccgcc

SEQ ID NO: 3085180 - RNA, 19 nt, Mycobacterium bovis subsp bovis AF2122/97
gccgggccugcaccacggc

SEQ ID NO: 3085181 - RNA, 22 nt, Mycobacterium bovis subsp bovis AF2122/97
gccgggcgacgguuucgaccac

SEQ ID NO: 3085182 - RNA, 20 nt, Mycobacterium bovis subsp bovis AF2122/97
gccgggcgaguacaggcgca

SEQ ID NO: 3085183 - RNA, 16 nt, Mycobacterium bovis subsp bovis AF2122/97
gccgggcgaugcuggg

SEQ ID NO: 3085184 - RNA, 13 nt, Mycobacterium bovis subsp bovis AF2122/97
gccgggcgcacgc

SEQ ID NO: 3085185 - RNA, 17 nt, Mycobacterium bovis subsp bovis AF2122/97
gccgggcgcacgcccgc

SEQ ID NO: 3085186 - RNA, 21 nt, Mycobacterium bovis subsp bovis AF2122/97
gccgggcgcccuuaagccggc

SEQ ID NO: 3085187 - RNA, 22 nt, Mycobacterium bovis subsp bovis AF2122/97
gccgggcgcccuuaagccggcg

SEQ ID NO: 3085188 - RNA, 15 nt, Mycobacterium bovis subsp bovis AF2122/97
gccgggcgcgccggc

SEQ ID NO: 3085189 - RNA, 22 nt, Mycobacterium bovis subsp bovis AF2122/97
gccgggcgcuugcaccaggggc

SEQ ID NO: 3085190 - RNA, 13 nt, Mycobacterium bovis subsp bovis AF2122/97
gccgggcggcagc

SEQ ID NO: 3085191 - RNA, 21 nt, Mycobacterium bovis subsp bovis AF2122/97
gccgggcggccaggcgcgacg

SEQ ID NO: 3085192 - RNA, 14 nt, Mycobacterium bovis subsp bovis AF2122/97
gccgggcggcgcga

SEQ ID NO: 3085193 - RNA, 12 nt, Mycobacterium bovis subsp bovis AF2122/97
gccgggcgguag

SEQ ID NO: 3085194 - RNA, 17 nt, Mycobacterium bovis subsp bovis AF2122/97
gccgggcguccucgucg

SEQ ID NO: 3085195 - RNA, 18 nt, Mycobacterium bovis subsp bovis AF2122/97
gccgggcuccccaagucg

SEQ ID NO: 3085196 - RNA, 16 nt, Mycobacterium bovis subsp bovis AF2122/97
gccgggcuccucuggu

SEQ ID NO: 3085197 - RNA, 24 nt, Mycobacterium bovis subsp bovis AF2122/97
gccgggcucuaucagacgauucgg

SEQ ID NO: 3085198 - RNA, 12 nt, Mycobacterium bovis subsp bovis AF2122/97
gccgggcuggcc

SEQ ID NO: 3085199 - RNA, 18 nt, Mycobacterium bovis subsp bovis AF2122/97
gccgggcuggccgacucg

SEQ ID NO: 3085200 - RNA, 21 nt, Mycobacterium bovis subsp bovis AF2122/97
gccgggcuguucggccauggc

SEQ ID NO: 3085201 - RNA, 19 nt, Mycobacterium bovis subsp bovis AF2122/97
gccgggcuuaggccgcggc

SEQ ID NO: 3085202 - RNA, 13 nt, Mycobacterium bovis subsp bovis AF2122/97
gccgggcuuggcc

SEQ ID NO: 3085203 - RNA, 16 nt, Mycobacterium bovis subsp bovis AF2122/97
gccgggcuuggccgcg

SEQ ID NO: 3085204 - RNA, 19 nt, Mycobacterium bovis subsp bovis AF2122/97
gccggggaacuuaccgagg

SEQ ID NO: 3085205 - RNA, 16 nt, Mycobacterium bovis subsp bovis AF2122/97
gccggggaccacggug

SEQ ID NO: 3085206 - RNA, 16 nt, Mycobacterium bovis subsp bovis AF2122/97
gccggggacgccgcgg

SEQ ID NO: 3085207 - RNA, 18 nt, Mycobacterium bovis subsp bovis AF2122/97
gccggggacgccgcggcg

SEQ ID NO: 3085208 - RNA, 15 nt, Mycobacterium bovis subsp bovis AF2122/97
gccggggaguggaaa

SEQ ID NO: 3085209 - RNA, 23 nt, Mycobacterium bovis subsp bovis AF2122/97
gccggggaguggaaacccgccga

SEQ ID NO: 3085210 - RNA, 22 nt, Mycobacterium bovis subsp bovis AF2122/97
gccggggauaucacgacgccga

SEQ ID NO: 3085211 - RNA, 15 nt, Mycobacterium bovis subsp bovis AF2122/97
gccggggcaaacggg

SEQ ID NO: 3085212 - RNA, 13 nt, Mycobacterium bovis subsp bovis AF2122/97
gccggggcaacga

SEQ ID NO: 3085213 - RNA, 22 nt, Mycobacterium bovis subsp bovis AF2122/97
gccggggccacccgcagaccgg

SEQ ID NO: 3085214 - RNA, 13 nt, Mycobacterium bovis subsp bovis AF2122/97
gccggggccccau

SEQ ID NO: 3085215 - RNA, 13 nt, Mycobacterium bovis subsp bovis AF2122/97
gccggggccgccg

SEQ ID NO: 3085216 - RNA, 14 nt, Mycobacterium bovis subsp bovis AF2122/97
gccggggccgccga

SEQ ID NO: 3085217 - RNA, 16 nt, Mycobacterium bovis subsp bovis AF2122/97
gccggggccgcuggcg

SEQ ID NO: 3085218 - RNA, 20 nt, Mycobacterium bovis subsp bovis AF2122/97
gccggggcgaugucggcugg

SEQ ID NO: 3085219 - RNA, 21 nt, Mycobacterium bovis subsp bovis AF2122/97
gccggggcgaugucggcuggu

SEQ ID NO: 3085220 - RNA, 19 nt, Mycobacterium bovis subsp bovis AF2122/97
gccggggcgucgcaacccg

SEQ ID NO: 3085221 - RNA, 16 nt, Mycobacterium bovis subsp bovis AF2122/97
gccggggcugccgccg

SEQ ID NO: 3085222 - RNA, 17 nt, Mycobacterium bovis subsp bovis AF2122/97
gccggggcugccgccgu

SEQ ID NO: 3085223 - RNA, 13 nt, Mycobacterium bovis subsp bovis AF2122/97
gccgggggcaccg

SEQ ID NO: 3085224 - RNA, 14 nt, Mycobacterium bovis subsp bovis AF2122/97
gccgggggcgccgc

SEQ ID NO: 3085225 - RNA, 15 nt, Mycobacterium bovis subsp bovis AF2122/97
gccgggggcgccgcc

SEQ ID NO: 3085226 - RNA, 16 nt, Mycobacterium bovis subsp bovis AF2122/97
gccgggggcgccgccg

SEQ ID NO: 3085227 - RNA, 17 nt, Mycobacterium bovis subsp bovis AF2122/97
gccgggggcgccgccgu

SEQ ID NO: 3085228 - RNA, 20 nt, Mycobacterium bovis subsp bovis AF2122/97
gccgggguagacgccccgga

SEQ ID NO: 3085229 - RNA, 18 nt, Mycobacterium bovis subsp bovis AF2122/97
gccgggguaggggucgag

SEQ ID NO: 3085230 - RNA, 13 nt, Mycobacterium bovis subsp bovis AF2122/97
gccggggucgaac

SEQ ID NO: 3085231 - RNA, 16 nt, Mycobacterium bovis subsp bovis AF2122/97
gccggggucggcccgc

SEQ ID NO: 3085232 - RNA, 13 nt, Mycobacterium bovis subsp bovis AF2122/97
gccggggugugca

SEQ ID NO: 3085233 - RNA, 13 nt, Mycobacterium bovis subsp bovis AF2122/97
gccggggugugcg

SEQ ID NO: 3085234 - RNA, 17 nt, Mycobacterium bovis subsp bovis AF2122/97
gccgggguucaccgucg

SEQ ID NO: 3085235 - RNA, 18 nt, Mycobacterium bovis subsp bovis AF2122/97
gccgguccccucggugcc

SEQ ID NO: 3085236 - RNA, 14 nt, Mycobacterium bovis subsp bovis AF2122/97
gccggucccgcgug

SEQ ID NO: 3085237 - RNA, 18 nt, Mycobacterium bovis subsp bovis AF2122/97
gccggucccggacgugcc

SEQ ID NO: 3085238 - RNA, 14 nt, Mycobacterium bovis subsp bovis AF2122/97
gccgguccucgucg

SEQ ID NO: 3085239 - RNA, 19 nt, Mycobacterium bovis subsp bovis AF2122/97
gccgguccucgucggcgaa

SEQ ID NO: 3085240 - RNA, 14 nt, Mycobacterium bovis subsp bovis AF2122/97
gccggucgagacgc

SEQ ID NO: 3085241 - RNA, 15 nt, Mycobacterium bovis subsp bovis AF2122/97
gccggucgagacgcu

SEQ ID NO: 3085242 - RNA, 15 nt, Mycobacterium bovis subsp bovis AF2122/97
gccggucgaggugac

SEQ ID NO: 3085243 - RNA, 14 nt, Mycobacterium bovis subsp bovis AF2122/97
gccggucgaugacc

SEQ ID NO: 3085244 - RNA, 18 nt, Mycobacterium bovis subsp bovis AF2122/97
gccggucgaugucggcga

SEQ ID NO: 3085245 - RNA, 14 nt, Mycobacterium bovis subsp bovis AF2122/97
gccggucgcauggu

SEQ ID NO: 3085246 - RNA, 17 nt, Mycobacterium bovis subsp bovis AF2122/97
gccggucgcauggucga

SEQ ID NO: 3085247 - RNA, 21 nt, Mycobacterium bovis subsp bovis AF2122/97
gccggucgcauggucgacgaa

SEQ ID NO: 3085248 - RNA, 23 nt, Mycobacterium bovis subsp bovis AF2122/97
gccggucgcauggucgacgaaca

SEQ ID NO: 3085249 - RNA, 12 nt, Mycobacterium bovis subsp bovis AF2122/97
gccggucgccga

SEQ ID NO: 3085250 - RNA, 13 nt, Mycobacterium bovis subsp bovis AF2122/97
gccggucgggcag

SEQ ID NO: 3085251 - RNA, 14 nt, Mycobacterium bovis subsp bovis AF2122/97
gccggucgggcaga

SEQ ID NO: 3085252 - RNA, 19 nt, Mycobacterium bovis subsp bovis AF2122/97
gccggucggugagccgugc

SEQ ID NO: 3085253 - RNA, 14 nt, Mycobacterium bovis subsp bovis AF2122/97
gccggucggugcgg

SEQ ID NO: 3085254 - RNA, 17 nt, Mycobacterium bovis subsp bovis AF2122/97
gccggucggugcggaac

SEQ ID NO: 3085255 - RNA, 23 nt, Mycobacterium bovis subsp bovis AF2122/97
gccggucgucaguaauucggcca

SEQ ID NO: 3085256 - RNA, 24 nt, Mycobacterium bovis subsp bovis AF2122/97
gccggucgucaguaauucggccau

SEQ ID NO: 3085257 - RNA, 15 nt, Mycobacterium bovis subsp bovis AF2122/97
gccggucgugccggg

SEQ ID NO: 3085258 - RNA, 22 nt, Mycobacterium bovis subsp bovis AF2122/97
gccggucgugccggggcugccg

SEQ ID NO: 3085259 - RNA, 21 nt, Mycobacterium bovis subsp bovis AF2122/97
gccggucguuugcgccaggag

SEQ ID NO: 3085260 - RNA, 22 nt, Mycobacterium bovis subsp bovis AF2122/97
gccggucuucgcgggacgcgac

SEQ ID NO: 3085261 - RNA, 16 nt, Mycobacterium bovis subsp bovis AF2122/97
gccggucuugcaucgc

SEQ ID NO: 3085262 - RNA, 19 nt, Mycobacterium bovis subsp bovis AF2122/97
gccggucuuggacagcagc

SEQ ID NO: 3085263 - RNA, 19 nt, Mycobacterium bovis subsp bovis AF2122/97
gccggugaacggcagcacg

SEQ ID NO: 3085264 - RNA, 17 nt, Mycobacterium bovis subsp bovis AF2122/97
gccggugaacgucacgu

SEQ ID NO: 3085265 - RNA, 14 nt, Mycobacterium bovis subsp bovis AF2122/97
gccggugacaagug

SEQ ID NO: 3085266 - RNA, 20 nt, Mycobacterium bovis subsp bovis AF2122/97
gccggugacaaguggugccc

SEQ ID NO: 3085267 - RNA, 16 nt, Mycobacterium bovis subsp bovis AF2122/97
gccggugaccgcgaug

SEQ ID NO: 3085268 - RNA, 15 nt, Mycobacterium bovis subsp bovis AF2122/97
gccggugacgacguc

SEQ ID NO: 3085269 - RNA, 18 nt, Mycobacterium bovis subsp bovis AF2122/97
gccggugacgacgucgcc

SEQ ID NO: 3085270 - RNA, 22 nt, Mycobacterium bovis subsp bovis AF2122/97
gccggugacgacgucgccgccg

SEQ ID NO: 3085271 - RNA, 19 nt, Mycobacterium bovis subsp bovis AF2122/97
gccggugacgaugaccgcg

SEQ ID NO: 3085272 - RNA, 15 nt, Mycobacterium bovis subsp bovis AF2122/97
gccggugacggggcu

SEQ ID NO: 3085273 - RNA, 17 nt, Mycobacterium bovis subsp bovis AF2122/97
gccggugacggggcuga

SEQ ID NO: 3085274 - RNA, 22 nt, Mycobacterium bovis subsp bovis AF2122/97
gccggugacggggcugaccgcc

SEQ ID NO: 3085275 - RNA, 22 nt, Mycobacterium bovis subsp bovis AF2122/97
gccggugacgggguugaccgcc

SEQ ID NO: 3085276 - RNA, 13 nt, Mycobacterium bovis subsp bovis AF2122/97
gccggugacggug

SEQ ID NO: 3085277 - RNA, 14 nt, Mycobacterium bovis subsp bovis AF2122/97
gccggugacggugu

SEQ ID NO: 3085278 - RNA, 15 nt, Mycobacterium bovis subsp bovis AF2122/97
gccggugacguggug

SEQ ID NO: 3085279 - RNA, 14 nt, Mycobacterium bovis subsp bovis AF2122/97
gccggugagcgagc

SEQ ID NO: 3085280 - RNA, 15 nt, Mycobacterium bovis subsp bovis AF2122/97
gccggugagcgagcg

SEQ ID NO: 3085281 - RNA, 17 nt, Mycobacterium bovis subsp bovis AF2122/97
gccggugagcgagcgcg

SEQ ID NO: 3085282 - RNA, 22 nt, Mycobacterium bovis subsp bovis AF2122/97
gccggugagcgagcgcgcguag

SEQ ID NO: 3085283 - RNA, 18 nt, Mycobacterium bovis subsp bovis AF2122/97
gccggugaggcgaccgga

SEQ ID NO: 3085284 - RNA, 19 nt, Mycobacterium bovis subsp bovis AF2122/97
gccggugaucggcggcaac

SEQ ID NO: 3085285 - RNA, 21 nt, Mycobacterium bovis subsp bovis AF2122/97
gccggugaucggcggcaaccg

SEQ ID NO: 3085286 - RNA, 20 nt, Mycobacterium bovis subsp bovis AF2122/97
gccggugauggccgaccagc

SEQ ID NO: 3085287 - RNA, 18 nt, Mycobacterium bovis subsp bovis AF2122/97
gccggugauguccgcaca

SEQ ID NO: 3085288 - RNA, 22 nt, Mycobacterium bovis subsp bovis AF2122/97
gccggugauguccgcacaacga

SEQ ID NO: 3085289 - RNA, 12 nt, Mycobacterium bovis subsp bovis AF2122/97
gccggugccacc

SEQ ID NO: 3085290 - RNA, 13 nt, Mycobacterium bovis subsp bovis AF2122/97
gccggugccaccc

SEQ ID NO: 3085291 - RNA, 14 nt, Mycobacterium bovis subsp bovis AF2122/97
gccggugccaccga

SEQ ID NO: 3085292 - RNA, 15 nt, Mycobacterium bovis subsp bovis AF2122/97
gccggugccaccgac

SEQ ID NO: 3085293 - RNA, 15 nt, Mycobacterium bovis subsp bovis AF2122/97
gccggugccaccggc

SEQ ID NO: 3085294 - RNA, 17 nt, Mycobacterium bovis subsp bovis AF2122/97
gccggugccaccggcug

SEQ ID NO: 3085295 - RNA, 19 nt, Mycobacterium bovis subsp bovis AF2122/97
gccggugccaccggcuggu

SEQ ID NO: 3085296 - RNA, 12 nt, Mycobacterium bovis subsp bovis AF2122/97
gccggugccgac

SEQ ID NO: 3085297 - RNA, 18 nt, Mycobacterium bovis subsp bovis AF2122/97
gccggugccgacggcgcc

SEQ ID NO: 3085298 - RNA, 20 nt, Mycobacterium bovis subsp bovis AF2122/97
gccggugccgacggcgccga

SEQ ID NO: 3085299 - RNA, 16 nt, Mycobacterium bovis subsp bovis AF2122/97
gccggugccgaucagc

SEQ ID NO: 3085300 - RNA, 12 nt, Mycobacterium bovis subsp bovis AF2122/97
gccggugccgcc

SEQ ID NO: 3085301 - RNA, 14 nt, Mycobacterium bovis subsp bovis AF2122/97
gccggugccgccau

SEQ ID NO: 3085302 - RNA, 15 nt, Mycobacterium bovis subsp bovis AF2122/97
gccggugccgccauc

SEQ ID NO: 3085303 - RNA, 16 nt, Mycobacterium bovis subsp bovis AF2122/97
gccggugccgccaucg

SEQ ID NO: 3085304 - RNA, 17 nt, Mycobacterium bovis subsp bovis AF2122/97
gccggugccgccaucgc

SEQ ID NO: 3085305 - RNA, 21 nt, Mycobacterium bovis subsp bovis AF2122/97
gccggugccgccaucgccgcc

SEQ ID NO: 3085306 - RNA, 23 nt, Mycobacterium bovis subsp bovis AF2122/97
gccggugccgccaucgccgccgg

SEQ ID NO: 3085307 - RNA, 15 nt, Mycobacterium bovis subsp bovis AF2122/97
gccggugccgccauu

SEQ ID NO: 3085308 - RNA, 13 nt, Mycobacterium bovis subsp bovis AF2122/97
gccggugccgccg

SEQ ID NO: 3085309 - RNA, 14 nt, Mycobacterium bovis subsp bovis AF2122/97
gccggugccgccga

SEQ ID NO: 3085310 - RNA, 14 nt, Mycobacterium bovis subsp bovis AF2122/97
gccggugccgccgc

SEQ ID NO: 3085311 - RNA, 17 nt, Mycobacterium bovis subsp bovis AF2122/97
gccggugccgccgccug

SEQ ID NO: 3085312 - RNA, 23 nt, Mycobacterium bovis subsp bovis AF2122/97
gccggugccgccgccugcuccuc

SEQ ID NO: 3085313 - RNA, 16 nt, Mycobacterium bovis subsp bovis AF2122/97
gccggugccgccgcgg

SEQ ID NO: 3085314 - RNA, 17 nt, Mycobacterium bovis subsp bovis AF2122/97
gccggugccgccgcggc

SEQ ID NO: 3085315 - RNA, 20 nt, Mycobacterium bovis subsp bovis AF2122/97
gccggugccgccgcggccac

SEQ ID NO: 3085316 - RNA, 15 nt, Mycobacterium bovis subsp bovis AF2122/97
gccggugccgccggg

SEQ ID NO: 3085317 - RNA, 18 nt, Mycobacterium bovis subsp bovis AF2122/97
gccggugccgccggugcc

SEQ ID NO: 3085318 - RNA, 14 nt, Mycobacterium bovis subsp bovis AF2122/97
gccggugccgccgu

SEQ ID NO: 3085319 - RNA, 16 nt, Mycobacterium bovis subsp bovis AF2122/97
gccggugccgccgucg

SEQ ID NO: 3085320 - RNA, 17 nt, Mycobacterium bovis subsp bovis AF2122/97
gccggugccgccgucgc

SEQ ID NO: 3085321 - RNA, 17 nt, Mycobacterium bovis subsp bovis AF2122/97
gccggugccgccguucc

SEQ ID NO: 3085322 - RNA, 15 nt, Mycobacterium bovis subsp bovis AF2122/97
gccgucagcgucggc

SEQ ID NO: 3085323 - RNA, 17 nt, Mycobacterium bovis subsp bovis AF2122/97
gccgucagcucaccacc

SEQ ID NO: 3085324 - RNA, 17 nt, Mycobacterium bovis subsp bovis AF2122/97
gccgucaggcgugccgg

SEQ ID NO: 3085325 - RNA, 13 nt, Mycobacterium bovis subsp bovis AF2122/97
gccgucagggugu

SEQ ID NO: 3085326 - RNA, 17 nt, Mycobacterium bovis subsp bovis AF2122/97
gccgucauagcaggccu

SEQ ID NO: 3085327 - RNA, 19 nt, Mycobacterium bovis subsp bovis AF2122/97
gccgucauagcaggccucc

SEQ ID NO: 3085328 - RNA, 14 nt, Mycobacterium bovis subsp bovis AF2122/97
gccgucaucgccgg

SEQ ID NO: 3085329 - RNA, 16 nt, Mycobacterium bovis subsp bovis AF2122/97
gccgucauggcccgau

SEQ ID NO: 3085330 - RNA, 21 nt, Mycobacterium bovis subsp bovis AF2122/97
gccguccaagccagcguuggc

SEQ ID NO: 3085331 - RNA, 19 nt, Mycobacterium bovis subsp bovis AF2122/97
gccguccaauuccgcagag

SEQ ID NO: 3085332 - RNA, 20 nt, Mycobacterium bovis subsp bovis AF2122/97
gccguccaauuccgcagaga

SEQ ID NO: 3085333 - RNA, 17 nt, Mycobacterium bovis subsp bovis AF2122/97
gccguccaccgauaccc

SEQ ID NO: 3085334 - RNA, 14 nt, Mycobacterium bovis subsp bovis AF2122/97
gccguccacgccga

SEQ ID NO: 3085335 - RNA, 14 nt, Mycobacterium bovis subsp bovis AF2122/97
gccguccagcaaua

SEQ ID NO: 3085336 - RNA, 11 nt, Mycobacterium bovis subsp bovis AF2122/97
gccguccagcg

SEQ ID NO: 3085337 - RNA, 16 nt, Mycobacterium bovis subsp bovis AF2122/97
gccguccagcgccgcg

SEQ ID NO: 3085338 - RNA, 19 nt, Mycobacterium bovis subsp bovis AF2122/97
gccguccagcgccgcggcc

SEQ ID NO: 3085339 - RNA, 14 nt, Mycobacterium bovis subsp bovis AF2122/97
gccguccaggacgg

SEQ ID NO: 3085340 - RNA, 18 nt, Mycobacterium bovis subsp bovis AF2122/97
gccguccaggacggaucg

SEQ ID NO: 3085341 - RNA, 19 nt, Mycobacterium bovis subsp bovis AF2122/97
gccguccaggacggaucgu

SEQ ID NO: 3085342 - RNA, 20 nt, Mycobacterium bovis subsp bovis AF2122/97
gccguccagucggucgguac

SEQ ID NO: 3085343 - RNA, 15 nt, Mycobacterium bovis subsp bovis AF2122/97
gccgucccaccagcc

SEQ ID NO: 3085344 - RNA, 15 nt, Mycobacterium bovis subsp bovis AF2122/97
gccguccccgccgac

SEQ ID NO: 3085345 - RNA, 16 nt, Mycobacterium bovis subsp bovis AF2122/97
gccguccccgccgacg

SEQ ID NO: 3085346 - RNA, 20 nt, Mycobacterium bovis subsp bovis AF2122/97
gccguccccgccgacgccga

SEQ ID NO: 3085347 - RNA, 21 nt, Mycobacterium bovis subsp bovis AF2122/97
gccguccccgccgucgccacc

SEQ ID NO: 3085348 - RNA, 21 nt, Mycobacterium bovis subsp bovis AF2122/97
gccgucccgauacggccggcc

SEQ ID NO: 3085349 - RNA, 20 nt, Mycobacterium bovis subsp bovis AF2122/97
gccgucccgcgagcagcccg

SEQ ID NO: 3085350 - RNA, 22 nt, Mycobacterium bovis subsp bovis AF2122/97
gccgucccgcgagcagcccggc

SEQ ID NO: 3085351 - RNA, 20 nt, Mycobacterium bovis subsp bovis AF2122/97
gccgucccggcucgagcucg

SEQ ID NO: 3085352 - RNA, 20 nt, Mycobacterium bovis subsp bovis AF2122/97
gccgucccgguugacgccgg

SEQ ID NO: 3085353 - RNA, 14 nt, Mycobacterium bovis subsp bovis AF2122/97
gccguccggcgccc

SEQ ID NO: 3085354 - RNA, 16 nt, Mycobacterium bovis subsp bovis AF2122/97
gccguccggcgcccac

SEQ ID NO: 3085355 - RNA, 19 nt, Mycobacterium bovis subsp bovis AF2122/97
gccguccggcuuggcggcg

SEQ ID NO: 3085356 - RNA, 16 nt, Mycobacterium bovis subsp bovis AF2122/97
gccguccgggcggccu

SEQ ID NO: 3085357 - RNA, 18 nt, Mycobacterium bovis subsp bovis AF2122/97
gccguccgggcggccucc

SEQ ID NO: 3085358 - RNA, 20 nt, Mycobacterium bovis subsp bovis AF2122/97
gccguccgggcggccucccg

SEQ ID NO: 3085359 - RNA, 20 nt, Mycobacterium bovis subsp bovis AF2122/97
gccguccgguggaccgccga

SEQ ID NO: 3085360 - RNA, 19 nt, Mycobacterium bovis subsp bovis AF2122/97
gccguccgguguggcgcug

SEQ ID NO: 3085361 - RNA, 14 nt, Mycobacterium bovis subsp bovis AF2122/97
gccguccucccaca

SEQ ID NO: 3085362 - RNA, 14 nt, Mycobacterium bovis subsp bovis AF2122/97
gccguccucgguca

SEQ ID NO: 3085363 - RNA, 20 nt, Mycobacterium bovis subsp bovis AF2122/97
gccguccucggucagcucgu

SEQ ID NO: 3085364 - RNA, 17 nt, Mycobacterium bovis subsp bovis AF2122/97
gccgucgaaauacccgg

SEQ ID NO: 3085365 - RNA, 19 nt, Mycobacterium bovis subsp bovis AF2122/97
gccgucgaaccaguccucg

SEQ ID NO: 3085366 - RNA, 21 nt, Mycobacterium bovis subsp bovis AF2122/97
gccgucgaaccaguccucggg

SEQ ID NO: 3085367 - RNA, 23 nt, Mycobacterium bovis subsp bovis AF2122/97
gccgucgaagacgaacgugucgg

SEQ ID NO: 3085368 - RNA, 14 nt, Mycobacterium bovis subsp bovis AF2122/97
gccgucgaccggcg

SEQ ID NO: 3085369 - RNA, 17 nt, Mycobacterium bovis subsp bovis AF2122/97
gccgucgaccggcggga

SEQ ID NO: 3085370 - RNA, 15 nt, Mycobacterium bovis subsp bovis AF2122/97
gccgucgacgcaugg

SEQ ID NO: 3085371 - RNA, 16 nt, Mycobacterium bovis subsp bovis AF2122/97
gccgucgacgcauggg

SEQ ID NO: 3085372 - RNA, 14 nt, Mycobacterium bovis subsp bovis AF2122/97
gccgucgacgcggc

SEQ ID NO: 3085373 - RNA, 15 nt, Mycobacterium bovis subsp bovis AF2122/97
gccgucgacgcggcc

SEQ ID NO: 3085374 - RNA, 16 nt, Mycobacterium bovis subsp bovis AF2122/97
gccgucgacgcggccg

SEQ ID NO: 3085375 - RNA, 19 nt, Mycobacterium bovis subsp bovis AF2122/97
gccgucgacgcggccggcc

SEQ ID NO: 3085376 - RNA, 19 nt, Mycobacterium bovis subsp bovis AF2122/97
gccgucgacgucgauggug

SEQ ID NO: 3085377 - RNA, 21 nt, Mycobacterium bovis subsp bovis AF2122/97
gccgucgacgucgauggugcg

SEQ ID NO: 3085378 - RNA, 12 nt, Mycobacterium bovis subsp bovis AF2122/97
gccgucgagcaa

SEQ ID NO: 3085379 - RNA, 14 nt, Mycobacterium bovis subsp bovis AF2122/97
gccgucgagcaacg

SEQ ID NO: 3085380 - RNA, 22 nt, Mycobacterium bovis subsp bovis AF2122/97
gccgucgagcaacgugacccgg

SEQ ID NO: 3085381 - RNA, 17 nt, Mycobacterium bovis subsp bovis AF2122/97
gccgucgagcacgguga

SEQ ID NO: 3085382 - RNA, 18 nt, Mycobacterium bovis subsp bovis AF2122/97
gccgucgagcagccgagc

SEQ ID NO: 3085383 - RNA, 18 nt, Mycobacterium bovis subsp bovis AF2122/97
gccgucgagcauccaccc

SEQ ID NO: 3085384 - RNA, 22 nt, Mycobacterium bovis subsp bovis AF2122/97
cgacgucaggcagcuccgccgc

SEQ ID NO: 3085385 - RNA, 13 nt, Mycobacterium bovis subsp bovis AF2122/97
cgacgucagggua

SEQ ID NO: 3085386 - RNA, 22 nt, Mycobacterium bovis subsp bovis AF2122/97
cgacgucaggguauccacgccg

SEQ ID NO: 3085387 - RNA, 16 nt, Mycobacterium bovis subsp bovis AF2122/97
cgacgucaucgccgac

SEQ ID NO: 3085388 - RNA, 17 nt, Mycobacterium bovis subsp bovis AF2122/97
cgacgucaucgccgacc

SEQ ID NO: 3085389 - RNA, 12 nt, Mycobacterium bovis subsp bovis AF2122/97
cgacguccacca

SEQ ID NO: 3085390 - RNA, 13 nt, Mycobacterium bovis subsp bovis AF2122/97
cgacguccaccag

SEQ ID NO: 3085391 - RNA, 16 nt, Mycobacterium bovis subsp bovis AF2122/97
cgacguccaccagccg

SEQ ID NO: 3085392 - RNA, 18 nt, Mycobacterium bovis subsp bovis AF2122/97
cgacguccaucccggcgc

SEQ ID NO: 3085393 - RNA, 14 nt, Mycobacterium bovis subsp bovis AF2122/97
cgacguccgcgacu

SEQ ID NO: 3085394 - RNA, 15 nt, Mycobacterium bovis subsp bovis AF2122/97
cgacguccgcgacuu

SEQ ID NO: 3085395 - RNA, 23 nt, Mycobacterium bovis subsp bovis AF2122/97
cgacguccgcgacuuccuguaca

SEQ ID NO: 3085396 - RNA, 17 nt, Mycobacterium bovis subsp bovis AF2122/97
cgacguccucgacgauc

SEQ ID NO: 3085397 - RNA, 13 nt, Mycobacterium bovis subsp bovis AF2122/97
cgacgucgacaau

SEQ ID NO: 3085398 - RNA, 16 nt, Mycobacterium bovis subsp bovis AF2122/97
cgacgucgaccacugc

SEQ ID NO: 3085399 - RNA, 15 nt, Mycobacterium bovis subsp bovis AF2122/97
cgacgucgacggcga

SEQ ID NO: 3085400 - RNA, 23 nt, Mycobacterium bovis subsp bovis AF2122/97
cgacgucgagcgccuugucgauc

SEQ ID NO: 3085401 - RNA, 17 nt, Mycobacterium bovis subsp bovis AF2122/97
cgacgucgauggugcgg

SEQ ID NO: 3085402 - RNA, 18 nt, Mycobacterium bovis subsp bovis AF2122/97
cgacgucgauuucggcga

SEQ ID NO: 3085403 - RNA, 19 nt, Mycobacterium bovis subsp bovis AF2122/97
cgacgucgauuucggcgac

SEQ ID NO: 3085404 - RNA, 22 nt, Mycobacterium bovis subsp bovis AF2122/97
cgacgucgauuucggcgaccgg

SEQ ID NO: 3085405 - RNA, 12 nt, Mycobacterium bovis subsp bovis AF2122/97
cgacgucgccaa

SEQ ID NO: 3085406 - RNA, 13 nt, Mycobacterium bovis subsp bovis AF2122/97
cgacgucgccgac

SEQ ID NO: 3085407 - RNA, 14 nt, Mycobacterium bovis subsp bovis AF2122/97
cgacgucgccgacc

SEQ ID NO: 3085408 - RNA, 14 nt, Mycobacterium bovis subsp bovis AF2122/97
cgacgucgccgccg

SEQ ID NO: 3085409 - RNA, 15 nt, Mycobacterium bovis subsp bovis AF2122/97
cgacgucgccgccgc

SEQ ID NO: 3085410 - RNA, 22 nt, Mycobacterium bovis subsp bovis AF2122/97
cgacgucgccgccgcgggcgcc

SEQ ID NO: 3085411 - RNA, 14 nt, Mycobacterium bovis subsp bovis AF2122/97
cgacgucgccggac

SEQ ID NO: 3085412 - RNA, 15 nt, Mycobacterium bovis subsp bovis AF2122/97
cgacgucgccggacg

SEQ ID NO: 3085413 - RNA, 16 nt, Mycobacterium bovis subsp bovis AF2122/97
cgacgucgcgcaucgc

SEQ ID NO: 3085414 - RNA, 13 nt, Mycobacterium bovis subsp bovis AF2122/97
cgacgucgcgggu

SEQ ID NO: 3085415 - RNA, 14 nt, Mycobacterium bovis subsp bovis AF2122/97
cgacgucgcgggug

SEQ ID NO: 3085416 - RNA, 23 nt, Mycobacterium bovis subsp bovis AF2122/97
cgacgucgcgggugaugacgccg

SEQ ID NO: 3085417 - RNA, 19 nt, Mycobacterium bovis subsp bovis AF2122/97
cgacgucgcuagaucccag

SEQ ID NO: 3085418 - RNA, 22 nt, Mycobacterium bovis subsp bovis AF2122/97
cgacgucgcuguaggccagccc

SEQ ID NO: 3085419 - RNA, 18 nt, Mycobacterium bovis subsp bovis AF2122/97
cgacgucggcaucggcgg

SEQ ID NO: 3085420 - RNA, 22 nt, Mycobacterium bovis subsp bovis AF2122/97
cgacgucggccgcaucgcccaa

SEQ ID NO: 3085421 - RNA, 23 nt, Mycobacterium bovis subsp bovis AF2122/97
cgacgucggccgcaucgcccaac

SEQ ID NO: 3085422 - RNA, 12 nt, Mycobacterium bovis subsp bovis AF2122/97
cgacgucggcga

SEQ ID NO: 3085423 - RNA, 12 nt, Mycobacterium bovis subsp bovis AF2122/97
cgacgucggcgc

SEQ ID NO: 3085424 - RNA, 14 nt, Mycobacterium bovis subsp bovis AF2122/97
cgacgucggcggug

SEQ ID NO: 3085425 - RNA, 16 nt, Mycobacterium bovis subsp bovis AF2122/97
cgacgucggcggugac

SEQ ID NO: 3085426 - RNA, 19 nt, Mycobacterium bovis subsp bovis AF2122/97
cgacgucgguaagcgccaa

SEQ ID NO: 3085427 - RNA, 17 nt, Mycobacterium bovis subsp bovis AF2122/97
cgacgucggugaccucg

SEQ ID NO: 3085428 - RNA, 22 nt, Mycobacterium bovis subsp bovis AF2122/97
cgacgucgucgccgccgaaaac

SEQ ID NO: 3085429 - RNA, 12 nt, Mycobacterium bovis subsp bovis AF2122/97
cgacgucgucgu

SEQ ID NO: 3085430 - RNA, 18 nt, Mycobacterium bovis subsp bovis AF2122/97
cgacgucgucgucgacgg

SEQ ID NO: 3085431 - RNA, 20 nt, Mycobacterium bovis subsp bovis AF2122/97
cgacgucguucuuugucggg

SEQ ID NO: 3085432 - RNA, 21 nt, Mycobacterium bovis subsp bovis AF2122/97
cgacgucguucuuugucggga

SEQ ID NO: 3085433 - RNA, 18 nt, Mycobacterium bovis subsp bovis AF2122/97
gagccgcacaaacgggcg

SEQ ID NO: 3085434 - RNA, 13 nt, Mycobacterium bovis subsp bovis AF2122/97
gagccgcagcacc

SEQ ID NO: 3085435 - RNA, 11 nt, Mycobacterium bovis subsp bovis AF2122/97
gagccgcagcc

SEQ ID NO: 3085436 - RNA, 16 nt, Mycobacterium bovis subsp bovis AF2122/97
gagccgcagcucgccg

SEQ ID NO: 3085437 - RNA, 17 nt, Mycobacterium bovis subsp bovis AF2122/97
gagccgcagcucgccga

SEQ ID NO: 3085438 - RNA, 19 nt, Mycobacterium bovis subsp bovis AF2122/97
gagccgcaucuggccggcg

SEQ ID NO: 3085439 - RNA, 20 nt, Mycobacterium bovis subsp bovis AF2122/97
gagccgccaggugcucgucg

SEQ ID NO: 3085440 - RNA, 14 nt, Mycobacterium bovis subsp bovis AF2122/97
gagccgcccaagcc

SEQ ID NO: 3085441 - RNA, 16 nt, Mycobacterium bovis subsp bovis AF2122/97
gagccgcccaagccgc

SEQ ID NO: 3085442 - RNA, 15 nt, Mycobacterium bovis subsp bovis AF2122/97
gagccgcccgcccgg

SEQ ID NO: 3085443 - RNA, 17 nt, Mycobacterium bovis subsp bovis AF2122/97
gagccgcccgcccggac

SEQ ID NO: 3085444 - RNA, 19 nt, Mycobacterium bovis subsp bovis AF2122/97
gagccgcccgcccggacgc

SEQ ID NO: 3085445 - RNA, 22 nt, Mycobacterium bovis subsp bovis AF2122/97
gagccgccgacucggcaccgcg

SEQ ID NO: 3085446 - RNA, 13 nt, Mycobacterium bovis subsp bovis AF2122/97
gagccgccggauc

SEQ ID NO: 3085447 - RNA, 17 nt, Mycobacterium bovis subsp bovis AF2122/97
gagccgccggaucgcca

SEQ ID NO: 3085448 - RNA, 18 nt, Mycobacterium bovis subsp bovis AF2122/97
gagccgccggaucgccac

SEQ ID NO: 3085449 - RNA, 19 nt, Mycobacterium bovis subsp bovis AF2122/97
gagccgccguggaacacga

SEQ ID NO: 3085450 - RNA, 12 nt, Mycobacterium bovis subsp bovis AF2122/97
gagccgccguug

SEQ ID NO: 3085451 - RNA, 14 nt, Mycobacterium bovis subsp bovis AF2122/97
gagccgcgcccaau

SEQ ID NO: 3085452 - RNA, 15 nt, Mycobacterium bovis subsp bovis AF2122/97
gagccgcggucggcg

SEQ ID NO: 3085453 - RNA, 21 nt, Mycobacterium bovis subsp bovis AF2122/97
gagccgcggucggcgugcagg

SEQ ID NO: 3085454 - RNA, 14 nt, Mycobacterium bovis subsp bovis AF2122/97
gagccgcguucgcg

SEQ ID NO: 3085455 - RNA, 22 nt, Mycobacterium bovis subsp bovis AF2122/97
gagccgcuacguuacgccgaga

SEQ ID NO: 3085456 - RNA, 16 nt, Mycobacterium bovis subsp bovis AF2122/97
gagccgcucuagcguc

SEQ ID NO: 3085457 - RNA, 14 nt, Mycobacterium bovis subsp bovis AF2122/97
gagccgcugcgaca

SEQ ID NO: 3085458 - RNA, 22 nt, Mycobacterium bovis subsp bovis AF2122/97
gagccgcugcgacaaaucggcg

SEQ ID NO: 3085459 - RNA, 14 nt, Mycobacterium bovis subsp bovis AF2122/97
gagccgcugcggca

SEQ ID NO: 3085460 - RNA, 20 nt, Mycobacterium bovis subsp bovis AF2122/97
gagccgcugcggcaccgagc

SEQ ID NO: 3085461 - RNA, 15 nt, Mycobacterium bovis subsp bovis AF2122/97
gagccggaccggcuu

SEQ ID NO: 3085462 - RNA, 22 nt, Mycobacterium bovis subsp bovis AF2122/97
gagccggauucggcugccaccg

SEQ ID NO: 3085463 - RNA, 23 nt, Mycobacterium bovis subsp bovis AF2122/97
gagccggauucggcugccaccgc

SEQ ID NO: 3085464 - RNA, 12 nt, Mycobacterium bovis subsp bovis AF2122/97
gagccggcaacc

SEQ ID NO: 3085465 - RNA, 14 nt, Mycobacterium bovis subsp bovis AF2122/97
gagccggccaccuc

SEQ ID NO: 3085466 - RNA, 13 nt, Mycobacterium bovis subsp bovis AF2122/97
gagccggcgccgg

SEQ ID NO: 3085467 - RNA, 14 nt, Mycobacterium bovis subsp bovis AF2122/97
gagccggcgcgcaa

SEQ ID NO: 3085468 - RNA, 21 nt, Mycobacterium bovis subsp bovis AF2122/97
gagccggcgcgcaagugcugg

SEQ ID NO: 3085469 - RNA, 13 nt, Mycobacterium bovis subsp bovis AF2122/97
gagccggcucaga

SEQ ID NO: 3085470 - RNA, 20 nt, Mycobacterium bovis subsp bovis AF2122/97
gagccggcucagacgacgau

SEQ ID NO: 3085471 - RNA, 14 nt, Mycobacterium bovis subsp bovis AF2122/97
gagccgggcaacca

SEQ ID NO: 3085472 - RNA, 17 nt, Mycobacterium bovis subsp bovis AF2122/97
gagccgggcaaccagca

SEQ ID NO: 3085473 - RNA, 18 nt, Mycobacterium bovis subsp bovis AF2122/97
gagccgggcaaccagcag

SEQ ID NO: 3085474 - RNA, 17 nt, Mycobacterium bovis subsp bovis AF2122/97
gagccgggccguccggg

SEQ ID NO: 3085475 - RNA, 18 nt, Mycobacterium bovis subsp bovis AF2122/97
gagccgggcuggccgacu

SEQ ID NO: 3085476 - RNA, 19 nt, Mycobacterium bovis subsp bovis AF2122/97
gagccgguaaccgcgucga

SEQ ID NO: 3085477 - RNA, 19 nt, Mycobacterium bovis subsp bovis AF2122/97
gagccgguagaucagcgcc

SEQ ID NO: 3085478 - RNA, 15 nt, Mycobacterium bovis subsp bovis AF2122/97
gagccgguagcuguc

SEQ ID NO: 3085479 - RNA, 20 nt, Mycobacterium bovis subsp bovis AF2122/97
gagccggugacgguguuggu

SEQ ID NO: 3085480 - RNA, 19 nt, Mycobacterium bovis subsp bovis AF2122/97
gagccggugauccggucgu

SEQ ID NO: 3085481 - RNA, 22 nt, Mycobacterium bovis subsp bovis AF2122/97
gagccguccaauuccgcagaga

SEQ ID NO: 3085482 - RNA, 18 nt, Mycobacterium bovis subsp bovis AF2122/97
gagccguccgaccaggga

SEQ ID NO: 3085483 - RNA, 20 nt, Mycobacterium bovis subsp bovis AF2122/97
gagccgucgagcagccgagc

SEQ ID NO: 3085484 - RNA, 13 nt, Mycobacterium bovis subsp bovis AF2122/97
gagccgugccagc

SEQ ID NO: 3085485 - RNA, 16 nt, Mycobacterium bovis subsp bovis AF2122/97
gagccgugccgccagc

SEQ ID NO: 3085486 - RNA, 17 nt, Mycobacterium bovis subsp bovis AF2122/97
gagccgugccgccagca

SEQ ID NO: 3085487 - RNA, 20 nt, Mycobacterium bovis subsp bovis AF2122/97
gagccgugccgccagcaacc

SEQ ID NO: 3085488 - RNA, 18 nt, Mycobacterium bovis subsp bovis AF2122/97
gagccgugccucgaggac

SEQ ID NO: 3085489 - RNA, 19 nt, Mycobacterium bovis subsp bovis AF2122/97
gagccgugcggucgcgccc

SEQ ID NO: 3085490 - RNA, 20 nt, Mycobacterium bovis subsp bovis AF2122/97
gagccgugucaaccggucgg

SEQ ID NO: 3085491 - RNA, 18 nt, Mycobacterium bovis subsp bovis AF2122/97
gagccuccagcgcaccgg

SEQ ID NO: 3085492 - RNA, 24 nt, Mycobacterium bovis subsp bovis AF2122/97
gagccucgcgcgugugccugaguu

SEQ ID NO: 3085493 - RNA, 12 nt, Mycobacterium bovis subsp bovis AF2122/97
gagccucggcga

SEQ ID NO: 3085494 - RNA, 14 nt, Mycobacterium bovis subsp bovis AF2122/97
gagccucggcgagc

SEQ ID NO: 3085495 - RNA, 17 nt, Mycobacterium bovis subsp bovis AF2122/97
gagccucggcgagccgu

SEQ ID NO: 3085496 - RNA, 20 nt, Mycobacterium bovis subsp bovis AF2122/97
gagccugauaaagcccggcg

SEQ ID NO: 3085497 - RNA, 22 nt, Mycobacterium bovis subsp bovis AF2122/97
gagccugauaaagcccggcggc

SEQ ID NO: 3085498 - RNA, 23 nt, Mycobacterium bovis subsp bovis AF2122/97
gagccugauaaagcccggcggca

SEQ ID NO: 3085499 - RNA, 19 nt, Mycobacterium bovis subsp bovis AF2122/97
gagccugcaggccgccggc

SEQ ID NO: 3085500 - RNA, 13 nt, Mycobacterium bovis subsp bovis AF2122/97
gagccugcucgca

SEQ ID NO: 3085501 - RNA, 17 nt, Mycobacterium bovis subsp bovis AF2122/97
gagccugguguccgagc

SEQ ID NO: 3085502 - RNA, 14 nt, Mycobacterium bovis subsp bovis AF2122/97
gagcgaacccccgc

SEQ ID NO: 3085503 - RNA, 13 nt, Mycobacterium bovis subsp bovis AF2122/97
gagcgaacccgcg

SEQ ID NO: 3085504 - RNA, 14 nt, Mycobacterium bovis subsp bovis AF2122/97
gagcgaacggcgca

SEQ ID NO: 3085505 - RNA, 19 nt, Mycobacterium bovis subsp bovis AF2122/97
gagcgaccccacacgccga

SEQ ID NO: 3085506 - RNA, 14 nt, Mycobacterium bovis subsp bovis AF2122/97
gagcgacccccagc

SEQ ID NO: 3085507 - RNA, 19 nt, Mycobacterium bovis subsp bovis AF2122/97
gagcgacccccagcgcccg

SEQ ID NO: 3085508 - RNA, 19 nt, Mycobacterium bovis subsp bovis AF2122/97
gagcgaccgcgagggccag

SEQ ID NO: 3085509 - RNA, 21 nt, Mycobacterium bovis subsp bovis AF2122/97
gagcgaccgcgagggccagca

SEQ ID NO: 3085510 - RNA, 18 nt, Mycobacterium bovis subsp bovis AF2122/97
gagcgacguuaaugacgc

SEQ ID NO: 3085511 - RNA, 21 nt, Mycobacterium bovis subsp bovis AF2122/97
gagcgacugcagcggcgcaua

SEQ ID NO: 3085512 - RNA, 18 nt, Mycobacterium bovis subsp bovis AF2122/97
gagcgagaaucacgguca

SEQ ID NO: 3085513 - RNA, 15 nt, Mycobacterium bovis subsp bovis AF2122/97
gagcgagcgcgcgua

SEQ ID NO: 3085514 - RNA, 22 nt, Mycobacterium bovis subsp bovis AF2122/97
gagcgaggcucccccaccaggg

SEQ ID NO: 3085515 - RNA, 21 nt, Mycobacterium bovis subsp bovis AF2122/97
gagcgaguugcagucgcgagg

SEQ ID NO: 3085516 - RNA, 18 nt, Mycobacterium bovis subsp bovis AF2122/97
gagcgauacgucgucagc

SEQ ID NO: 3085517 - RNA, 19 nt, Mycobacterium bovis subsp bovis AF2122/97
gagcgauacgucgucagcc

SEQ ID NO: 3085518 - RNA, 14 nt, Mycobacterium bovis subsp bovis AF2122/97
gagcgauccggcaa

SEQ ID NO: 3085519 - RNA, 20 nt, Mycobacterium bovis subsp bovis AF2122/97
gagcgcaacucccagcacgg

SEQ ID NO: 3085520 - RNA, 15 nt, Mycobacterium bovis subsp bovis AF2122/97
gagcguaggccagcg

SEQ ID NO: 3085521 - RNA, 21 nt, Mycobacterium bovis subsp bovis AF2122/97
gagcgucaaccacggccgccg

SEQ ID NO: 3085522 - RNA, 14 nt, Mycobacterium bovis subsp bovis AF2122/97
gagcguccgguggu

SEQ ID NO: 3085523 - RNA, 22 nt, Mycobacterium bovis subsp bovis AF2122/97
gagcgugaaccuggcgacgcga

SEQ ID NO: 3085524 - RNA, 21 nt, Mycobacterium bovis subsp bovis AF2122/97
gagcgugaagucacggcggcu

SEQ ID NO: 3085525 - RNA, 17 nt, Mycobacterium bovis subsp bovis AF2122/97
gagcgugagccaugccg

SEQ ID NO: 3085526 - RNA, 20 nt, Mycobacterium bovis subsp bovis AF2122/97
gagcgugagccaugccgcuc

SEQ ID NO: 3085527 - RNA, 14 nt, Mycobacterium bovis subsp bovis AF2122/97
gagcgugagcgccg

SEQ ID NO: 3085528 - RNA, 12 nt, Mycobacterium bovis subsp bovis AF2122/97
gagcgugccgca

SEQ ID NO: 3085529 - RNA, 15 nt, Mycobacterium bovis subsp bovis AF2122/97
gagcgugccgcagcg

SEQ ID NO: 3085530 - RNA, 16 nt, Mycobacterium bovis subsp bovis AF2122/97
gagcgugccgcagcgg

SEQ ID NO: 3085531 - RNA, 21 nt, Mycobacterium bovis subsp bovis AF2122/97
gagcgugccgcagcggcggca

SEQ ID NO: 3085532 - RNA, 13 nt, Mycobacterium bovis subsp bovis AF2122/97
gagcgugcgguga

SEQ ID NO: 3085533 - RNA, 23 nt, Mycobacterium bovis subsp bovis AF2122/97
gagcguggccaauccggcggcga

SEQ ID NO: 3085534 - RNA, 17 nt, Mycobacterium bovis subsp bovis AF2122/97
gagcgugucggccggcc

SEQ ID NO: 3085535 - RNA, 13 nt, Mycobacterium bovis subsp bovis AF2122/97
gagcguguugaaa

SEQ ID NO: 3085536 - RNA, 19 nt, Mycobacterium bovis subsp bovis AF2122/97
gagcguucuucagccaggg

SEQ ID NO: 3085537 - RNA, 20 nt, Mycobacterium bovis subsp bovis AF2122/97
gagcguuuuggugcggaccu

SEQ ID NO: 3085538 - RNA, 14 nt, Mycobacterium bovis subsp bovis AF2122/97
gagcuacgacgagu

SEQ ID NO: 3085539 - RNA, 18 nt, Mycobacterium bovis subsp bovis AF2122/97
gagcuagccguucggcug

SEQ ID NO: 3085540 - RNA, 14 nt, Mycobacterium bovis subsp bovis AF2122/97
gagcuaugcuggca

SEQ ID NO: 3085541 - RNA, 18 nt, Mycobacterium bovis subsp bovis AF2122/97
gagcuauucggugucgcc

SEQ ID NO: 3085542 - RNA, 22 nt, Mycobacterium bovis subsp bovis AF2122/97
gagcuauucggugucgccaccc

SEQ ID NO: 3085543 - RNA, 17 nt, Mycobacterium bovis subsp bovis AF2122/97
gagcucaccugcgggug

SEQ ID NO: 3085544 - RNA, 20 nt, Mycobacterium bovis subsp bovis AF2122/97
gagcucacuucacgccgccc

SEQ ID NO: 3085545 - RNA, 19 nt, Mycobacterium bovis subsp bovis AF2122/97
gagcucagcaaguucgucg

SEQ ID NO: 3085546 - RNA, 20 nt, Mycobacterium bovis subsp bovis AF2122/97
gagcucagcgaugcggcccu

SEQ ID NO: 3085547 - RNA, 17 nt, Mycobacterium bovis subsp bovis AF2122/97
gagcucaucuucgguca

SEQ ID NO: 3085548 - RNA, 14 nt, Mycobacterium bovis subsp bovis AF2122/97
gagcuccgcggcga

SEQ ID NO: 3085549 - RNA, 15 nt, Mycobacterium bovis subsp bovis AF2122/97
gagcucgccgcagcg

SEQ ID NO: 3085550 - RNA, 17 nt, Mycobacterium bovis subsp bovis AF2122/97
gagcucggcgcccagcu

SEQ ID NO: 3085551 - RNA, 16 nt, Mycobacterium bovis subsp bovis AF2122/97
gagcucggucaccacg

SEQ ID NO: 3085552 - RNA, 17 nt, Mycobacterium bovis subsp bovis AF2122/97
gagcucggucaccacgg

SEQ ID NO: 3085553 - RNA, 18 nt, Mycobacterium bovis subsp bovis AF2122/97
gagcucggucaccacggc

SEQ ID NO: 3085554 - RNA, 20 nt, Mycobacterium bovis subsp bovis AF2122/97
gagcucggucaccacggcgg

SEQ ID NO: 3085555 - RNA, 21 nt, Mycobacterium bovis subsp bovis AF2122/97
gagcucguugcuggcggccag

SEQ ID NO: 3085556 - RNA, 22 nt, Mycobacterium bovis subsp bovis AF2122/97
gagcucguugcuggcggccagc

SEQ ID NO: 3085557 - RNA, 16 nt, Mycobacterium bovis subsp bovis AF2122/97
gagcugaaggcccguu

SEQ ID NO: 3085558 - RNA, 16 nt, Mycobacterium bovis subsp bovis AF2122/97
gagcugaccugguucc

SEQ ID NO: 3085559 - RNA, 16 nt, Mycobacterium bovis subsp bovis AF2122/97
gagcugacgccgagcu

SEQ ID NO: 3085560 - RNA, 16 nt, Mycobacterium bovis subsp bovis AF2122/97
gagcugagcggccagc

SEQ ID NO: 3085561 - RNA, 13 nt, Mycobacterium bovis subsp bovis AF2122/97
gagcugaucacgc

SEQ ID NO: 3085562 - RNA, 14 nt, Mycobacterium bovis subsp bovis AF2122/97
gagcugauccaagu

SEQ ID NO: 3085563 - RNA, 15 nt, Mycobacterium bovis subsp bovis AF2122/97
gagcugauccgggug

SEQ ID NO: 3085564 - RNA, 15 nt, Mycobacterium bovis subsp bovis AF2122/97
gagcugccaacgccc

SEQ ID NO: 3085565 - RNA, 22 nt, Mycobacterium bovis subsp bovis AF2122/97
gagcugccaacgcccguguuga

SEQ ID NO: 3085566 - RNA, 16 nt, Mycobacterium bovis subsp bovis AF2122/97
gagcugccgucgcugc

SEQ ID NO: 3085567 - RNA, 16 nt, Mycobacterium bovis subsp bovis AF2122/97
gagcugcggcggccau

SEQ ID NO: 3085568 - RNA, 13 nt, Mycobacterium bovis subsp bovis AF2122/97
gagcugcucgccg

SEQ ID NO: 3085569 - RNA, 15 nt, Mycobacterium bovis subsp bovis AF2122/97
gagcugcucgccggc

SEQ ID NO: 3085570 - RNA, 14 nt, Mycobacterium bovis subsp bovis AF2122/97
gagcugcuggcgcg

SEQ ID NO: 3085571 - RNA, 16 nt, Mycobacterium bovis subsp bovis AF2122/97
gagcugcuggcgcgcc

SEQ ID NO: 3085572 - RNA, 18 nt, Mycobacterium bovis subsp bovis AF2122/97
gagcuggcaacgccgcgc

SEQ ID NO: 3085573 - RNA, 13 nt, Mycobacterium bovis subsp bovis AF2122/97
gagcuggccguca

SEQ ID NO: 3085574 - RNA, 20 nt, Mycobacterium bovis subsp bovis AF2122/97
gagcuggccgucagcgucgg

SEQ ID NO: 3085575 - RNA, 14 nt, Mycobacterium bovis subsp bovis AF2122/97
gagcuggcgaccug

SEQ ID NO: 3085576 - RNA, 22 nt, Mycobacterium bovis subsp bovis AF2122/97
gagcuggcgaccuggucgcugg

SEQ ID NO: 3085577 - RNA, 14 nt, Mycobacterium bovis subsp bovis AF2122/97
gagcuggcgcgcgg

SEQ ID NO: 3085578 - RNA, 13 nt, Mycobacterium bovis subsp bovis AF2122/97
gagcuggugcaga

SEQ ID NO: 3085579 - RNA, 17 nt, Mycobacterium bovis subsp bovis AF2122/97
gagcugguugacggcga

SEQ ID NO: 3085580 - RNA, 16 nt, Mycobacterium bovis subsp bovis AF2122/97
gagcuguaggucagcg

SEQ ID NO: 3085581 - RNA, 23 nt, Mycobacterium bovis subsp bovis AF2122/97
gagcugucgcaacgcaucgaugc

SEQ ID NO: 3085582 - RNA, 17 nt, Mycobacterium bovis subsp bovis AF2122/97
gagcuuccgcgcgcaga

SEQ ID NO: 3085583 - RNA, 14 nt, Mycobacterium bovis subsp bovis AF2122/97
gagcuucgccgcgc

SEQ ID NO: 3085584 - RNA, 23 nt, Mycobacterium bovis subsp bovis AF2122/97
gagcuugagcgugagcgccgcgg

SEQ ID NO: 3085585 - RNA, 14 nt, Mycobacterium bovis subsp bovis AF2122/97
gagcuugccgucgc

SEQ ID NO: 3085586 - RNA, 20 nt, Mycobacterium bovis subsp bovis AF2122/97
gagcuuggccagcagcagcg

SEQ ID NO: 3085587 - RNA, 15 nt, Mycobacterium bovis subsp bovis AF2122/97
gagcuuggcccagcg

SEQ ID NO: 3085588 - RNA, 16 nt, Mycobacterium bovis subsp bovis AF2122/97
gagcuugggccggugc

SEQ ID NO: 3085589 - RNA, 15 nt, Mycobacterium bovis subsp bovis AF2122/97
gagcuuuaucugcau

SEQ ID NO: 3085590 - RNA, 17 nt, Mycobacterium bovis subsp bovis AF2122/97
gaggaaagucaccgucc

SEQ ID NO: 3085591 - RNA, 21 nt, Mycobacterium bovis subsp bovis AF2122/97
gaggaaccccggucgggguuu

SEQ ID NO: 3085592 - RNA, 22 nt, Mycobacterium bovis subsp bovis AF2122/97
gaggaacuugcauccggcccac

SEQ ID NO: 3085593 - RNA, 17 nt, Mycobacterium bovis subsp bovis AF2122/97
gaggaagaucaccuccc

SEQ ID NO: 3085594 - RNA, 10 nt, Mycobacterium bovis subsp bovis AF2122/97
gaggaagccc

SEQ ID NO: 3085595 - RNA, 22 nt, Mycobacterium bovis subsp bovis AF2122/97
gaggaagcccgaugcgccaccg

SEQ ID NO: 3085596 - RNA, 15 nt, Mycobacterium bovis subsp bovis AF2122/97
gaggaagcggcggca

SEQ ID NO: 3085597 - RNA, 22 nt, Mycobacterium bovis subsp bovis AF2122/97
gaggaaggucgaaucgcugccg

SEQ ID NO: 3085598 - RNA, 14 nt, Mycobacterium bovis subsp bovis AF2122/97
gaggaaguccagcu

SEQ ID NO: 3085599 - RNA, 22 nt, Mycobacterium bovis subsp bovis AF2122/97
gaggaaguccagcuggccgggu

SEQ ID NO: 3085600 - RNA, 15 nt, Mycobacterium bovis subsp bovis AF2122/97
gaggaaucguucggg

SEQ ID NO: 3085601 - RNA, 19 nt, Mycobacterium bovis subsp bovis AF2122/97
gaggaaucguucggggugg

SEQ ID NO: 3085602 - RNA, 23 nt, Mycobacterium bovis subsp bovis AF2122/97
gaggaauuccgcuaccgcacagg

SEQ ID NO: 3085603 - RNA, 16 nt, Mycobacterium bovis subsp bovis AF2122/97
gaggaauucgaucugg

SEQ ID NO: 3085604 - RNA, 16 nt, Mycobacterium bovis subsp bovis AF2122/97
gaggacauccggcgcc

SEQ ID NO: 3085605 - RNA, 20 nt, Mycobacterium bovis subsp bovis AF2122/97
gaggacccgugcacgaucgc

SEQ ID NO: 3085606 - RNA, 23 nt, Mycobacterium bovis subsp bovis AF2122/97
gaggaccucgucaccggucagcg

SEQ ID NO: 3085607 - RNA, 22 nt, Mycobacterium bovis subsp bovis AF2122/97
gaggcuagcagagacaugccgg

SEQ ID NO: 3085608 - RNA, 20 nt, Mycobacterium bovis subsp bovis AF2122/97
gaggcuaggcguuuggugug

SEQ ID NO: 3085609 - RNA, 21 nt, Mycobacterium bovis subsp bovis AF2122/97
gaggcuaggcguuugguguga

SEQ ID NO: 3085610 - RNA, 21 nt, Mycobacterium bovis subsp bovis AF2122/97
gaggcuccuggucgccguggg

SEQ ID NO: 3085611 - RNA, 17 nt, Mycobacterium bovis subsp bovis AF2122/97
gaggcucguggcgacgg

SEQ ID NO: 3085612 - RNA, 15 nt, Mycobacterium bovis subsp bovis AF2122/97
gaggcugaccguggc

SEQ ID NO: 3085613 - RNA, 17 nt, Mycobacterium bovis subsp bovis AF2122/97
gaggcugaccguggcgc

SEQ ID NO: 3085614 - RNA, 15 nt, Mycobacterium bovis subsp bovis AF2122/97
gaggcuggcaucccg

SEQ ID NO: 3085615 - RNA, 17 nt, Mycobacterium bovis subsp bovis AF2122/97
gaggcugggcugagggu

SEQ ID NO: 3085616 - RNA, 19 nt, Mycobacterium bovis subsp bovis AF2122/97
gaggcugggcugagggugg

SEQ ID NO: 3085617 - RNA, 16 nt, Mycobacterium bovis subsp bovis AF2122/97
gaggcuggucugcagg

SEQ ID NO: 3085618 - RNA, 21 nt, Mycobacterium bovis subsp bovis AF2122/97
gaggcugugccccagggcagu

SEQ ID NO: 3085619 - RNA, 23 nt, Mycobacterium bovis subsp bovis AF2122/97
gaggcugugccccagggcagugc

SEQ ID NO: 3085620 - RNA, 18 nt, Mycobacterium bovis subsp bovis AF2122/97
gaggcuuacaugcccugc

SEQ ID NO: 3085621 - RNA, 22 nt, Mycobacterium bovis subsp bovis AF2122/97
gaggcuuacaugcccugcgcuc

SEQ ID NO: 3085622 - RNA, 14 nt, Mycobacterium bovis subsp bovis AF2122/97
gaggcuugcaacac

SEQ ID NO: 3085623 - RNA, 21 nt, Mycobacterium bovis subsp bovis AF2122/97
gaggcuuucgauauagccgcc

SEQ ID NO: 3085624 - RNA, 22 nt, Mycobacterium bovis subsp bovis AF2122/97
gaggcuuucgauauagccgccg

SEQ ID NO: 3085625 - RNA, 21 nt, Mycobacterium bovis subsp bovis AF2122/97
gagggaacccacaguggcucg

SEQ ID NO: 3085626 - RNA, 15 nt, Mycobacterium bovis subsp bovis AF2122/97
gagggaccacccggu

SEQ ID NO: 3085627 - RNA, 16 nt, Mycobacterium bovis subsp bovis AF2122/97
gagggauguagugcug

SEQ ID NO: 3085628 - RNA, 19 nt, Mycobacterium bovis subsp bovis AF2122/97
gagggcaaggacaagccgc

SEQ ID NO: 3085629 - RNA, 13 nt, Mycobacterium bovis subsp bovis AF2122/97
gagggccagcagc

SEQ ID NO: 3085630 - RNA, 15 nt, Mycobacterium bovis subsp bovis AF2122/97
gagggccagcagccg

SEQ ID NO: 3085631 - RNA, 18 nt, Mycobacterium bovis subsp bovis AF2122/97
gagggcccggccggacgg

SEQ ID NO: 3085632 - RNA, 18 nt, Mycobacterium bovis subsp bovis AF2122/97
gagggccgcgguuuggcg

SEQ ID NO: 3085633 - RNA, 21 nt, Mycobacterium bovis subsp bovis AF2122/97
gagggccgcgguuuggcgacg

SEQ ID NO: 3085634 - RNA, 20 nt, Mycobacterium bovis subsp bovis AF2122/97
gagggccgucacaggccgcc

SEQ ID NO: 3085635 - RNA, 20 nt, Mycobacterium bovis subsp bovis AF2122/97
gagggccugccgcacugggc

SEQ ID NO: 3085636 - RNA, 20 nt, Mycobacterium bovis subsp bovis AF2122/97
gagggcggaaaaucggcugg

SEQ ID NO: 3085637 - RNA, 19 nt, Mycobacterium bovis subsp bovis AF2122/97
gagggcggaauaucggccg

SEQ ID NO: 3085638 - RNA, 22 nt, Mycobacterium bovis subsp bovis AF2122/97
gagggcggaauaucggccgaau

SEQ ID NO: 3085639 - RNA, 21 nt, Mycobacterium bovis subsp bovis AF2122/97
gagggcggcgucgauggccac

SEQ ID NO: 3085640 - RNA, 15 nt, Mycobacterium bovis subsp bovis AF2122/97
gagggcgucgccgcc

SEQ ID NO: 3085641 - RNA, 19 nt, Mycobacterium bovis subsp bovis AF2122/97
gagggcgucgccgccguug

SEQ ID NO: 3085642 - RNA, 15 nt, Mycobacterium bovis subsp bovis AF2122/97
gagggcuaccggcgc

SEQ ID NO: 3085643 - RNA, 16 nt, Mycobacterium bovis subsp bovis AF2122/97
gagggcuaccggcgcc

SEQ ID NO: 3085644 - RNA, 17 nt, Mycobacterium bovis subsp bovis AF2122/97
gagggcuaccggcgccg

SEQ ID NO: 3085645 - RNA, 18 nt, Mycobacterium bovis subsp bovis AF2122/97
gagggcuaccggcgccgc

SEQ ID NO: 3085646 - RNA, 20 nt, Mycobacterium bovis subsp bovis AF2122/97
gagggcuaccggcgccgcgc

SEQ ID NO: 3085647 - RNA, 23 nt, Mycobacterium bovis subsp bovis AF2122/97
gagggcuaccggcgccgcgcggc

SEQ ID NO: 3085648 - RNA, 18 nt, Mycobacterium bovis subsp bovis AF2122/97
gagggcuguugacgccac

SEQ ID NO: 3085649 - RNA, 16 nt, Mycobacterium bovis subsp bovis AF2122/97
gagggcuugcaccugc

SEQ ID NO: 3085650 - RNA, 21 nt, Mycobacterium bovis subsp bovis AF2122/97
gagggcuuuagugucugcucg

SEQ ID NO: 3085651 - RNA, 12 nt, Mycobacterium bovis subsp bovis AF2122/97
gaggggacccag

SEQ ID NO: 3085652 - RNA, 14 nt, Mycobacterium bovis subsp bovis AF2122/97
gagggggacgcuga

SEQ ID NO: 3085653 - RNA, 20 nt, Mycobacterium bovis subsp bovis AF2122/97
gagggggguguugaggccgg

SEQ ID NO: 3085654 - RNA, 21 nt, Mycobacterium bovis subsp bovis AF2122/97
gagggggguguugaggccggu

SEQ ID NO: 3085655 - RNA, 24 nt, Mycobacterium bovis subsp bovis AF2122/97
gagggggguguugaggccggugaa

SEQ ID NO: 3085656 - RNA, 14 nt, Mycobacterium bovis subsp bovis AF2122/97
gagggucccacggc

SEQ ID NO: 3085657 - RNA, 22 nt, Mycobacterium bovis subsp bovis AF2122/97
gagggugaagacaccggcgucg

SEQ ID NO: 3085658 - RNA, 17 nt, Mycobacterium bovis subsp bovis AF2122/97
gagggugaccaacgucg

SEQ ID NO: 3085659 - RNA, 13 nt, Mycobacterium bovis subsp bovis AF2122/97
gagggugcccgag

SEQ ID NO: 3085660 - RNA, 22 nt, Mycobacterium bovis subsp bovis AF2122/97
gagggugugagguagucggcgc

SEQ ID NO: 3085661 - RNA, 21 nt, Mycobacterium bovis subsp bovis AF2122/97
gaggguucgccgaagccggac

SEQ ID NO: 3085662 - RNA, 14 nt, Mycobacterium bovis subsp bovis AF2122/97
gaggguuuccaagu

SEQ ID NO: 3085663 - RNA, 22 nt, Mycobacterium bovis subsp bovis AF2122/97
gaggguuuucgcauagugcggc

SEQ ID NO: 3085664 - RNA, 14 nt, Mycobacterium bovis subsp bovis AF2122/97
gagguacacgccga

SEQ ID NO: 3085665 - RNA, 21 nt, Mycobacterium bovis subsp bovis AF2122/97
gagguacccaucgucgagccg

SEQ ID NO: 3085666 - RNA, 20 nt, Mycobacterium bovis subsp bovis AF2122/97
gagguagcugcgcgggucgu

SEQ ID NO: 3085667 - RNA, 17 nt, Mycobacterium bovis subsp bovis AF2122/97
gagguaggucgccgccg

SEQ ID NO: 3085668 - RNA, 13 nt, Mycobacterium bovis subsp bovis AF2122/97
gagguagucggcg

SEQ ID NO: 3085669 - RNA, 19 nt, Mycobacterium bovis subsp bovis AF2122/97
gagguauucguggucggcc

SEQ ID NO: 3085670 - RNA, 22 nt, Mycobacterium bovis subsp bovis AF2122/97
gagguauucguggucggccucg

SEQ ID NO: 3085671 - RNA, 17 nt, Mycobacterium bovis subsp bovis AF2122/97
gaggucaaaaucagggu

SEQ ID NO: 3085672 - RNA, 19 nt, Mycobacterium bovis subsp bovis AF2122/97
gaggucaccggcgaccggu

SEQ ID NO: 3085673 - RNA, 13 nt, Mycobacterium bovis subsp bovis AF2122/97
gagguccagcaug

SEQ ID NO: 3085674 - RNA, 17 nt, Mycobacterium bovis subsp bovis AF2122/97
gaggucccggccgagcg

SEQ ID NO: 3085675 - RNA, 16 nt, Mycobacterium bovis subsp bovis AF2122/97
gaggucccggcuggga

SEQ ID NO: 3085676 - RNA, 14 nt, Mycobacterium bovis subsp bovis AF2122/97
gagguccucgacga

SEQ ID NO: 3085677 - RNA, 20 nt, Mycobacterium bovis subsp bovis AF2122/97
gagguccuugaggauccgca

SEQ ID NO: 3085678 - RNA, 22 nt, Mycobacterium bovis subsp bovis AF2122/97
gaggucgagcgccuuugcccga

SEQ ID NO: 3085679 - RNA, 14 nt, Mycobacterium bovis subsp bovis AF2122/97
gaggucgaucaggg

SEQ ID NO: 3085680 - RNA, 19 nt, Mycobacterium bovis subsp bovis AF2122/97
gaggucgccgcaucggcgg

SEQ ID NO: 3085681 - RNA, 19 nt, Mycobacterium bovis subsp bovis AF2122/97
gaggucgcggucuuugagc

SEQ ID NO: 3085682 - RNA, 23 nt, Mycobacterium bovis subsp bovis AF2122/97
gaggucgcggucuuugagccggu

SEQ ID NO: 3085683 - RNA, 17 nt, Mycobacterium bovis subsp bovis AF2122/97
gaggucggccagcagca

SEQ ID NO: 3085684 - RNA, 20 nt, Mycobacterium bovis subsp bovis AF2122/97
gaggucggccagcagcagug

SEQ ID NO: 3085685 - RNA, 14 nt, Mycobacterium bovis subsp bovis AF2122/97
gaggucggcggcgc

SEQ ID NO: 3085686 - RNA, 15 nt, Mycobacterium bovis subsp bovis AF2122/97
gaggucggucagcca

SEQ ID NO: 3085687 - RNA, 22 nt, Mycobacterium bovis subsp bovis AF2122/97
gaggucgguguuuggccgccga

SEQ ID NO: 3085688 - RNA, 19 nt, Mycobacterium bovis subsp bovis AF2122/97
gaggucguugaugucggua

SEQ ID NO: 3085689 - RNA, 20 nt, Mycobacterium bovis subsp bovis AF2122/97
gaggucuuugcucucggucu

SEQ ID NO: 3085690 - RNA, 22 nt, Mycobacterium bovis subsp bovis AF2122/97
gaggugacggugacgaucaggc

SEQ ID NO: 3085691 - RNA, 18 nt, Mycobacterium bovis subsp bovis AF2122/97
gaggugacucggcaccug

SEQ ID NO: 3085692 - RNA, 21 nt, Mycobacterium bovis subsp bovis AF2122/97
gaggugcccaaggccaggauc

SEQ ID NO: 3085693 - RNA, 13 nt, Mycobacterium bovis subsp bovis AF2122/97
gagugccaguccg

SEQ ID NO: 3085694 - RNA, 16 nt, Mycobacterium bovis subsp bovis AF2122/97
gagugcccagggccga

SEQ ID NO: 3085695 - RNA, 15 nt, Mycobacterium bovis subsp bovis AF2122/97
gagugcccauagccg

SEQ ID NO: 3085696 - RNA, 16 nt, Mycobacterium bovis subsp bovis AF2122/97
gagugccggcgugcgc

SEQ ID NO: 3085697 - RNA, 16 nt, Mycobacterium bovis subsp bovis AF2122/97
gagugcggacuucgcc

SEQ ID NO: 3085698 - RNA, 19 nt, Mycobacterium bovis subsp bovis AF2122/97
gagugcggacuucgccgcc

SEQ ID NO: 3085699 - RNA, 13 nt, Mycobacterium bovis subsp bovis AF2122/97
gagugcggcgacc

SEQ ID NO: 3085700 - RNA, 22 nt, Mycobacterium bovis subsp bovis AF2122/97
gagugcggcguauugcggccug

SEQ ID NO: 3085701 - RNA, 15 nt, Mycobacterium bovis subsp bovis AF2122/97
gagugcucagcgcgc

SEQ ID NO: 3085702 - RNA, 16 nt, Mycobacterium bovis subsp bovis AF2122/97
gaguggaaacccgccg

SEQ ID NO: 3085703 - RNA, 13 nt, Mycobacterium bovis subsp bovis AF2122/97
gaguggaugcgcc

SEQ ID NO: 3085704 - RNA, 16 nt, Mycobacterium bovis subsp bovis AF2122/97
gaguggaugcgccgca

SEQ ID NO: 3085705 - RNA, 19 nt, Mycobacterium bovis subsp bovis AF2122/97
gaguggcaaucccgccauc

SEQ ID NO: 3085706 - RNA, 12 nt, Mycobacterium bovis subsp bovis AF2122/97
gaguggccgggc

SEQ ID NO: 3085707 - RNA, 14 nt, Mycobacterium bovis subsp bovis AF2122/97
gaguggccucgucc

SEQ ID NO: 3085708 - RNA, 22 nt, Mycobacterium bovis subsp bovis AF2122/97
gaguggcucgcucugcgcggcu

SEQ ID NO: 3085709 - RNA, 22 nt, Mycobacterium bovis subsp bovis AF2122/97
gagugguacggcucggcgcuga

SEQ ID NO: 3085710 - RNA, 17 nt, Mycobacterium bovis subsp bovis AF2122/97
gagugguugcccgcacc

SEQ ID NO: 3085711 - RNA, 16 nt, Mycobacterium bovis subsp bovis AF2122/97
gagugucuuagccagc

SEQ ID NO: 3085712 - RNA, 16 nt, Mycobacterium bovis subsp bovis AF2122/97
gagugugacggcggcc

SEQ ID NO: 3085713 - RNA, 15 nt, Mycobacterium bovis subsp bovis AF2122/97
gaguguugccgacga

SEQ ID NO: 3085714 - RNA, 22 nt, Mycobacterium bovis subsp bovis AF2122/97
gaguuagugacguagaccacgc

SEQ ID NO: 3085715 - RNA, 19 nt, Mycobacterium bovis subsp bovis AF2122/97
gaguucacguucggcgcug

SEQ ID NO: 3085716 - RNA, 23 nt, Mycobacterium bovis subsp bovis AF2122/97
gaguucacguucggcgcugccag

SEQ ID NO: 3085717 - RNA, 13 nt, Mycobacterium bovis subsp bovis AF2122/97
gaguucccgaaac

SEQ ID NO: 3085718 - RNA, 20 nt, Mycobacterium bovis subsp bovis AF2122/97
gaguuccgcaucggccccca

SEQ ID NO: 3085719 - RNA, 22 nt, Mycobacterium bovis subsp bovis AF2122/97
gaguuccggucgacuccagcac

SEQ ID NO: 3085720 - RNA, 18 nt, Mycobacterium bovis subsp bovis AF2122/97
gaguuccuugaugcggcc

SEQ ID NO: 3085721 - RNA, 16 nt, Mycobacterium bovis subsp bovis AF2122/97
gaguucgcaaugccug

SEQ ID NO: 3085722 - RNA, 17 nt, Mycobacterium bovis subsp bovis AF2122/97
gaguucgcgcacgucgg

SEQ ID NO: 3085723 - RNA, 16 nt, Mycobacterium bovis subsp bovis AF2122/97
gaguucgcgcagcacc

SEQ ID NO: 3085724 - RNA, 22 nt, Mycobacterium bovis subsp bovis AF2122/97
gaguucggcagcgggcuccccg

SEQ ID NO: 3085725 - RNA, 14 nt, Mycobacterium bovis subsp bovis AF2122/97
gaguucggccacca

SEQ ID NO: 3085726 - RNA, 17 nt, Mycobacterium bovis subsp bovis AF2122/97
gaguucggccaccaacc

SEQ ID NO: 3085727 - RNA, 17 nt, Mycobacterium bovis subsp bovis AF2122/97
gaguucgggcugcggca

SEQ ID NO: 3085728 - RNA, 14 nt, Mycobacterium bovis subsp bovis AF2122/97
gaguucggugcugu

SEQ ID NO: 3085729 - RNA, 20 nt, Mycobacterium bovis subsp bovis AF2122/97
gaguucgguguagaucagca

SEQ ID NO: 3085730 - RNA, 17 nt, Mycobacterium bovis subsp bovis AF2122/97
gaguucgguugccccca

SEQ ID NO: 3085731 - RNA, 22 nt, Mycobacterium bovis subsp bovis AF2122/97
gaguucguagucggcaucgucg

SEQ ID NO: 3085732 - RNA, 23 nt, Mycobacterium bovis subsp bovis AF2122/97
gaguucgucaccguuggccgcgc

SEQ ID NO: 3085733 - RNA, 20 nt, Mycobacterium bovis subsp bovis AF2122/97
gaguucucgcugaucagcau

SEQ ID NO: 3085734 - RNA, 21 nt, Mycobacterium bovis subsp bovis AF2122/97
gaguucuggaauccggccaga

SEQ ID NO: 3085735 - RNA, 20 nt, Mycobacterium bovis subsp bovis AF2122/97
gaguugaacguucccucggc

SEQ ID NO: 3085736 - RNA, 20 nt, Mycobacterium bovis subsp bovis AF2122/97
gaguugaagaagccgguguu

SEQ ID NO: 3085737 - RNA, 22 nt, Mycobacterium bovis subsp bovis AF2122/97
gaguugaagaagccgguguuga

SEQ ID NO: 3085738 - RNA, 17 nt, Mycobacterium bovis subsp bovis AF2122/97
gaguugaauggcgcuga

SEQ ID NO: 3085739 - RNA, 16 nt, Mycobacterium bovis subsp bovis AF2122/97
gaguugagcaugucgu

SEQ ID NO: 3085740 - RNA, 14 nt, Mycobacterium bovis subsp bovis AF2122/97
gaguugagcgccaa

SEQ ID NO: 3085741 - RNA, 15 nt, Mycobacterium bovis subsp bovis AF2122/97
gaguugagcugucgc

SEQ ID NO: 3085742 - RNA, 19 nt, Mycobacterium bovis subsp bovis AF2122/97
gaguugcccguucaugcgg

SEQ ID NO: 3085743 - RNA, 22 nt, Mycobacterium bovis subsp bovis AF2122/97
gaguugcgaaccaugaccacca

SEQ ID NO: 3085744 - RNA, 12 nt, Mycobacterium bovis subsp bovis AF2122/97
gaguuggccaag

SEQ ID NO: 3085745 - RNA, 23 nt, Mycobacterium bovis subsp bovis AF2122/97
gaguuggccaagcaggcggggga

SEQ ID NO: 3085746 - RNA, 15 nt, Mycobacterium bovis subsp bovis AF2122/97
gaguuggcccgacgc

SEQ ID NO: 3085747 - RNA, 19 nt, Mycobacterium bovis subsp bovis AF2122/97
gaguugguguuauugaugc

SEQ ID NO: 3085748 - RNA, 22 nt, Mycobacterium bovis subsp bovis AF2122/97
gaguugguguuauugaugcccg

SEQ ID NO: 3085749 - RNA, 15 nt, Mycobacterium bovis subsp bovis AF2122/97
gaguuguugcugccc

SEQ ID NO: 3085750 - RNA, 19 nt, Mycobacterium bovis subsp bovis AF2122/97
gaguuugauuucgcacgga

SEQ ID NO: 3085751 - RNA, 15 nt, Mycobacterium bovis subsp bovis AF2122/97
gaguuugcgauaccc

SEQ ID NO: 3085752 - RNA, 22 nt, Mycobacterium bovis subsp bovis AF2122/97
gaguuuggcgacgaggcgacgu

SEQ ID NO: 3085753 - RNA, 14 nt, Mycobacterium bovis subsp bovis AF2122/97
gaguuuguuuuugc

SEQ ID NO: 3085754 - RNA, 17 nt, Mycobacterium bovis subsp bovis AF2122/97
gauaaacugccgcggca

SEQ ID NO: 3085755 - RNA, 15 nt, Mycobacterium bovis subsp bovis AF2122/97
gauaaagcccggcgg

SEQ ID NO: 3085756 - RNA, 23 nt, Mycobacterium bovis subsp bovis AF2122/97
gauaaauggccgaugagcccagc

SEQ ID NO: 3085757 - RNA, 23 nt, Mycobacterium bovis subsp bovis AF2122/97
gauaacaaggccgccgccgucgg

SEQ ID NO: 3085758 - RNA, 16 nt, Mycobacterium bovis subsp bovis AF2122/97
gauaacccaaccgcgc

SEQ ID NO: 3085759 - RNA, 13 nt, Mycobacterium bovis subsp bovis AF2122/97
gauaacccagcac

SEQ ID NO: 3085760 - RNA, 16 nt, Mycobacterium bovis subsp bovis AF2122/97
gauaacccagcaccac

SEQ ID NO: 3085761 - RNA, 15 nt, Mycobacterium bovis subsp bovis AF2122/97
gauaacccagcggcg

SEQ ID NO: 3085762 - RNA, 14 nt, Mycobacterium bovis subsp bovis AF2122/97
gauaaccgcgacca

SEQ ID NO: 3085763 - RNA, 19 nt, Mycobacterium bovis subsp bovis AF2122/97
gauaaccgcgaccagcugg

SEQ ID NO: 3085764 - RNA, 20 nt, Mycobacterium bovis subsp bovis AF2122/97
gauaaccuggcggucccgca

SEQ ID NO: 3085765 - RNA, 16 nt, Mycobacterium bovis subsp bovis AF2122/97
gauaacuccgcggcga

SEQ ID NO: 3085766 - RNA, 24 nt, Mycobacterium bovis subsp bovis AF2122/97
gauaagccugggaaacugggucua

SEQ ID NO: 3085767 - RNA, 22 nt, Mycobacterium bovis subsp bovis AF2122/97
gauaaggaccgcgcccagaccg

SEQ ID NO: 3085768 - RNA, 21 nt, Mycobacterium bovis subsp bovis AF2122/97
gauaaggcaaggcauccaacg

SEQ ID NO: 3085769 - RNA, 23 nt, Mycobacterium bovis subsp bovis AF2122/97
gauaauccaugacacuggggugc

SEQ ID NO: 3085770 - RNA, 16 nt, Mycobacterium bovis subsp bovis AF2122/97
gauaaugaucucggca

SEQ ID NO: 3085771 - RNA, 19 nt, Mycobacterium bovis subsp bovis AF2122/97
gauaauucaacagcaccgc

SEQ ID NO: 3085772 - RNA, 19 nt, Mycobacterium bovis subsp bovis AF2122/97
gauacagcacauccagccc

SEQ ID NO: 3085773 - RNA, 16 nt, Mycobacterium bovis subsp bovis AF2122/97
gauacagccgccgccg

SEQ ID NO: 3085774 - RNA, 14 nt, Mycobacterium bovis subsp bovis AF2122/97
gauacagucgaccg

SEQ ID NO: 3085775 - RNA, 19 nt, Mycobacterium bovis subsp bovis AF2122/97
gauacaugguccggccgcg

SEQ ID NO: 3085776 - RNA, 22 nt, Mycobacterium bovis subsp bovis AF2122/97
gauaccaccgccgcugccggua

SEQ ID NO: 3085777 - RNA, 21 nt, Mycobacterium bovis subsp bovis AF2122/97
gauacccagcgcccggccacu

SEQ ID NO: 3085778 - RNA, 17 nt, Mycobacterium bovis subsp bovis AF2122/97
gauacccagcgggucgc

SEQ ID NO: 3085779 - RNA, 19 nt, Mycobacterium bovis subsp bovis AF2122/97
gaucaacuuccgcagcgcc

SEQ ID NO: 3085780 - RNA, 20 nt, Mycobacterium bovis subsp bovis AF2122/97
gaucaagccuucgucgaugc

SEQ ID NO: 3085781 - RNA, 22 nt, Mycobacterium bovis subsp bovis AF2122/97
gaucaagcuggcccgcucauac

SEQ ID NO: 3085782 - RNA, 21 nt, Mycobacterium bovis subsp bovis AF2122/97
gaucaaggaccgcucugcggc

SEQ ID NO: 3085783 - RNA, 13 nt, Mycobacterium bovis subsp bovis AF2122/97
gaucaaugcgaug

SEQ ID NO: 3085784 - RNA, 17 nt, Mycobacterium bovis subsp bovis AF2122/97
gaucacacccacgucga

SEQ ID NO: 3085785 - RNA, 20 nt, Mycobacterium bovis subsp bovis AF2122/97
gaucacacccacgucgagca

SEQ ID NO: 3085786 - RNA, 15 nt, Mycobacterium bovis subsp bovis AF2122/97
gaucacaccgagcgc

SEQ ID NO: 3085787 - RNA, 20 nt, Mycobacterium bovis subsp bovis AF2122/97
gaucacacgguccgccacgg

SEQ ID NO: 3085788 - RNA, 22 nt, Mycobacterium bovis subsp bovis AF2122/97
gaucacacguccgcgcaccgca

SEQ ID NO: 3085789 - RNA, 14 nt, Mycobacterium bovis subsp bovis AF2122/97
gaucacacuggccu

SEQ ID NO: 3085790 - RNA, 23 nt, Mycobacterium bovis subsp bovis AF2122/97
gaucacauucagcacgucuugcu

SEQ ID NO: 3085791 - RNA, 14 nt, Mycobacterium bovis subsp bovis AF2122/97
gaucaccaacccgu

SEQ ID NO: 3085792 - RNA, 14 nt, Mycobacterium bovis subsp bovis AF2122/97
gaucaccaccggca

SEQ ID NO: 3085793 - RNA, 17 nt, Mycobacterium bovis subsp bovis AF2122/97
gaucaccaccggcagau

SEQ ID NO: 3085794 - RNA, 23 nt, Mycobacterium bovis subsp bovis AF2122/97
gaucaccacggcguugccgccgg

SEQ ID NO: 3085795 - RNA, 18 nt, Mycobacterium bovis subsp bovis AF2122/97
gaucaccaggguuggcac

SEQ ID NO: 3085796 - RNA, 20 nt, Mycobacterium bovis subsp bovis AF2122/97
gaucaccaggguuggcaccg

SEQ ID NO: 3085797 - RNA, 15 nt, Mycobacterium bovis subsp bovis AF2122/97
gaucaccauccagcc

SEQ ID NO: 3085798 - RNA, 21 nt, Mycobacterium bovis subsp bovis AF2122/97
gaucaccauccagcccauccc

SEQ ID NO: 3085799 - RNA, 13 nt, Mycobacterium bovis subsp bovis AF2122/97
gaucaccaucgcc

SEQ ID NO: 3085800 - RNA, 21 nt, Mycobacterium bovis subsp bovis AF2122/97
gaucaccaucgccgccgcgcg

SEQ ID NO: 3085801 - RNA, 15 nt, Mycobacterium bovis subsp bovis AF2122/97
gaucaccaugaucag

SEQ ID NO: 3085802 - RNA, 14 nt, Mycobacterium bovis subsp bovis AF2122/97
gaucacccacucga

SEQ ID NO: 3085803 - RNA, 17 nt, Mycobacterium bovis subsp bovis AF2122/97
gaucacccacucgacgu

SEQ ID NO: 3085804 - RNA, 16 nt, Mycobacterium bovis subsp bovis AF2122/97
gaucaccccggccggc

SEQ ID NO: 3085805 - RNA, 20 nt, Mycobacterium bovis subsp bovis AF2122/97
gaucaccccggucggcccgc

SEQ ID NO: 3085806 - RNA, 23 nt, Mycobacterium bovis subsp bovis AF2122/97
gaucacccgcacuccacgaucgg

SEQ ID NO: 3085807 - RNA, 19 nt, Mycobacterium bovis subsp bovis AF2122/97
gaucacccgcaucggcacg

SEQ ID NO: 3085808 - RNA, 20 nt, Mycobacterium bovis subsp bovis AF2122/97
gaucacccgcaucggcacgc

SEQ ID NO: 3085809 - RNA, 16 nt, Mycobacterium bovis subsp bovis AF2122/97
gaucacccgccgcgug

SEQ ID NO: 3085810 - RNA, 14 nt, Mycobacterium bovis subsp bovis AF2122/97
gaucaccgacaccg

SEQ ID NO: 3085811 - RNA, 15 nt, Mycobacterium bovis subsp bovis AF2122/97
gaucaccgacaccgu

SEQ ID NO: 3085812 - RNA, 18 nt, Mycobacterium bovis subsp bovis AF2122/97
gaucaccgacaccgugcc

SEQ ID NO: 3085813 - RNA, 19 nt, Mycobacterium bovis subsp bovis AF2122/97
gaucaccgacaccgugccg

SEQ ID NO: 3085814 - RNA, 22 nt, Mycobacterium bovis subsp bovis AF2122/97
gaucaccgagucgacggccagu

SEQ ID NO: 3085815 - RNA, 15 nt, Mycobacterium bovis subsp bovis AF2122/97
gaucaccgccaccac

SEQ ID NO: 3085816 - RNA, 17 nt, Mycobacterium bovis subsp bovis AF2122/97
gaucaccgccaccacca

SEQ ID NO: 3085817 - RNA, 20 nt, Mycobacterium bovis subsp bovis AF2122/97
gaucaccgccaccaccaggg

SEQ ID NO: 3085818 - RNA, 23 nt, Mycobacterium bovis subsp bovis AF2122/97
gaucaccgccagcugggcagcca

SEQ ID NO: 3085819 - RNA, 18 nt, Mycobacterium bovis subsp bovis AF2122/97
gaucaccgccggggcugg

SEQ ID NO: 3085820 - RNA, 12 nt, Mycobacterium bovis subsp bovis AF2122/97
gaucaccgcgcc

SEQ ID NO: 3085821 - RNA, 13 nt, Mycobacterium bovis subsp bovis AF2122/97
gaucaccgcgccc

SEQ ID NO: 3085822 - RNA, 14 nt, Mycobacterium bovis subsp bovis AF2122/97
gaucaccgcgcccg

SEQ ID NO: 3085823 - RNA, 16 nt, Mycobacterium bovis subsp bovis AF2122/97
gaucaccgcgcccgcc

SEQ ID NO: 3085824 - RNA, 18 nt, Mycobacterium bovis subsp bovis AF2122/97
gaucaccgcgcccgccgc

SEQ ID NO: 3085825 - RNA, 22 nt, Mycobacterium bovis subsp bovis AF2122/97
gaucaccgcgccggagaucguc

SEQ ID NO: 3085826 - RNA, 21 nt, Mycobacterium bovis subsp bovis AF2122/97
gaucaccgcguaguccaggcc

SEQ ID NO: 3085827 - RNA, 20 nt, Mycobacterium bovis subsp bovis AF2122/97
gaucaccggaguucucgcug

SEQ ID NO: 3085828 - RNA, 22 nt, Mycobacterium bovis subsp bovis AF2122/97
gaucaccggcaucccggaacgc

SEQ ID NO: 3085829 - RNA, 16 nt, Mycobacterium bovis subsp bovis AF2122/97
gaucaccgguucggug

SEQ ID NO: 3085830 - RNA, 12 nt, Mycobacterium bovis subsp bovis AF2122/97
gaucaccgucga

SEQ ID NO: 3085831 - RNA, 23 nt, Mycobacterium bovis subsp bovis AF2122/97
gaucaccgucguacucggcggcc

SEQ ID NO: 3085832 - RNA, 22 nt, Mycobacterium bovis subsp bovis AF2122/97
gaucaccgugguggcguaucgg

SEQ ID NO: 3085833 - RNA, 18 nt, Mycobacterium bovis subsp bovis AF2122/97
gaucaccucccgcggcac

SEQ ID NO: 3085834 - RNA, 20 nt, Mycobacterium bovis subsp bovis AF2122/97
gaucaccucccgcggcaccu

SEQ ID NO: 3085835 - RNA, 16 nt, Mycobacterium bovis subsp bovis AF2122/97
gaucaccucgcgggug

SEQ ID NO: 3085836 - RNA, 16 nt, Mycobacterium bovis subsp bovis AF2122/97
gaucaccucggcgacg

SEQ ID NO: 3085837 - RNA, 22 nt, Mycobacterium bovis subsp bovis AF2122/97
gaucaccucggugccggccgca

SEQ ID NO: 3085838 - RNA, 17 nt, Mycobacterium bovis subsp bovis AF2122/97
gaucaccuucgucgcgg

SEQ ID NO: 3085839 - RNA, 19 nt, Mycobacterium bovis subsp bovis AF2122/97
gaucaccuucgucgcggcc

SEQ ID NO: 3085840 - RNA, 11 nt, Mycobacterium bovis subsp bovis AF2122/97
gaucacgacgu

SEQ ID NO: 3085841 - RNA, 18 nt, Mycobacterium bovis subsp bovis AF2122/97
gaucacgaucacaccacg

SEQ ID NO: 3085842 - RNA, 17 nt, Mycobacterium bovis subsp bovis AF2122/97
gaucacgccgccggcga

SEQ ID NO: 3085843 - RNA, 16 nt, Mycobacterium bovis subsp bovis AF2122/97
gaucacgccggccucg

SEQ ID NO: 3085844 - RNA, 20 nt, Mycobacterium bovis subsp bovis AF2122/97
gaucacgccggccucgccga

SEQ ID NO: 3085845 - RNA, 15 nt, Mycobacterium bovis subsp bovis AF2122/97
gaucacgccgggcga

SEQ ID NO: 3085846 - RNA, 16 nt, Mycobacterium bovis subsp bovis AF2122/97
gaucacgccgggcgag

SEQ ID NO: 3085847 - RNA, 18 nt, Mycobacterium bovis subsp bovis AF2122/97
gaucacgcgucgugccac

SEQ ID NO: 3085848 - RNA, 15 nt, Mycobacterium bovis subsp bovis AF2122/97
gaucacggagcucuu

SEQ ID NO: 3085849 - RNA, 13 nt, Mycobacterium bovis subsp bovis AF2122/97
gaucacggcggcc

SEQ ID NO: 3085850 - RNA, 19 nt, Mycobacterium bovis subsp bovis AF2122/97
gaucacggcggccccggca

SEQ ID NO: 3085851 - RNA, 18 nt, Mycobacterium bovis subsp bovis AF2122/97
gaucacgggcuaccggca

SEQ ID NO: 3085852 - RNA, 23 nt, Mycobacterium bovis subsp bovis AF2122/97
gaucacggugggcgccgacaccg

SEQ ID NO: 3085853 - RNA, 17 nt, Mycobacterium bovis subsp bovis AF2122/97
gaucacguacgccgccg

SEQ ID NO: 3085854 - RNA, 18 nt, Mycobacterium bovis subsp bovis AF2122/97
gaucacguacgccgccga

SEQ ID NO: 3085855 - RNA, 22 nt, Mycobacterium bovis subsp bovis AF2122/97
gaucacgucggauccgcccgcc

SEQ ID NO: 3085856 - RNA, 16 nt, Mycobacterium bovis subsp bovis AF2122/97
gaucacgucggcguug

SEQ ID NO: 3085857 - RNA, 13 nt, Mycobacterium bovis subsp bovis AF2122/97
gaucacgugccgg

SEQ ID NO: 3085858 - RNA, 22 nt, Mycobacterium bovis subsp bovis AF2122/97
gaucacgugguccaaccgggcc

SEQ ID NO: 3085859 - RNA, 19 nt, Mycobacterium bovis subsp bovis AF2122/97
gaucacucacccgggcagc

SEQ ID NO: 3085860 - RNA, 14 nt, Mycobacterium bovis subsp bovis AF2122/97
gaucacugcucguc

SEQ ID NO: 3085861 - RNA, 16 nt, Mycobacterium bovis subsp bovis AF2122/97
gaucagaacgcggccu

SEQ ID NO: 3085862 - RNA, 17 nt, Mycobacterium bovis subsp bovis AF2122/97
gaucagaacgcggccuc

SEQ ID NO: 3085863 - RNA, 15 nt, Mycobacterium bovis subsp bovis AF2122/97
gaucagacccagcgc

SEQ ID NO: 3085864 - RNA, 13 nt, Mycobacterium bovis subsp bovis AF2122/97
gaucagaucguca

SEQ ID NO: 3085865 - RNA, 16 nt, Mycobacterium bovis subsp bovis AF2122/97
gauccacaacagcccg

SEQ ID NO: 3085866 - RNA, 21 nt, Mycobacterium bovis subsp bovis AF2122/97
gauccacaacagcccguagca

SEQ ID NO: 3085867 - RNA, 21 nt, Mycobacterium bovis subsp bovis AF2122/97
gauccaccaagcucgcaaccg

SEQ ID NO: 3085868 - RNA, 21 nt, Mycobacterium bovis subsp bovis AF2122/97
gauccaccacgcuggccucgu

SEQ ID NO: 3085869 - RNA, 23 nt, Mycobacterium bovis subsp bovis AF2122/97
gauccaccacgcuggccucgucg

SEQ ID NO: 3085870 - RNA, 14 nt, Mycobacterium bovis subsp bovis AF2122/97
gauccacccgacga

SEQ ID NO: 3085871 - RNA, 19 nt, Mycobacterium bovis subsp bovis AF2122/97
gauccacccgacgacguau

SEQ ID NO: 3085872 - RNA, 22 nt, Mycobacterium bovis subsp bovis AF2122/97
gauccacggcgaugcagccaca

SEQ ID NO: 3085873 - RNA, 17 nt, Mycobacterium bovis subsp bovis AF2122/97
gauccacuccggcgauc

SEQ ID NO: 3085874 - RNA, 16 nt, Mycobacterium bovis subsp bovis AF2122/97
gauccacucggcgauc

SEQ ID NO: 3085875 - RNA, 18 nt, Mycobacterium bovis subsp bovis AF2122/97
gauccagaacaacggcgc

SEQ ID NO: 3085876 - RNA, 13 nt, Mycobacterium bovis subsp bovis AF2122/97
gauccagcaacgc

SEQ ID NO: 3085877 - RNA, 21 nt, Mycobacterium bovis subsp bovis AF2122/97
gauccagcaacgcgguggacc

SEQ ID NO: 3085878 - RNA, 12 nt, Mycobacterium bovis subsp bovis AF2122/97
gauccagcaggc

SEQ ID NO: 3085879 - RNA, 20 nt, Mycobacterium bovis subsp bovis AF2122/97
gauccagccaugcgguuugc

SEQ ID NO: 3085880 - RNA, 22 nt, Mycobacterium bovis subsp bovis AF2122/97
gauccagcccaacucggccagc

SEQ ID NO: 3085881 - RNA, 19 nt, Mycobacterium bovis subsp bovis AF2122/97
gauccagcccgacgcccga

SEQ ID NO: 3085882 - RNA, 14 nt, Mycobacterium bovis subsp bovis AF2122/97
gauccagccgucgg

SEQ ID NO: 3085883 - RNA, 16 nt, Mycobacterium bovis subsp bovis AF2122/97
gauccagccgucggcg

SEQ ID NO: 3085884 - RNA, 14 nt, Mycobacterium bovis subsp bovis AF2122/97
gauccagcgcaccg

SEQ ID NO: 3085885 - RNA, 17 nt, Mycobacterium bovis subsp bovis AF2122/97
gauccagcgcaccggcg

SEQ ID NO: 3085886 - RNA, 22 nt, Mycobacterium bovis subsp bovis AF2122/97
gauccagcggguauguaccgaa

SEQ ID NO: 3085887 - RNA, 20 nt, Mycobacterium bovis subsp bovis AF2122/97
gauccaggacuucugcugca

SEQ ID NO: 3085888 - RNA, 21 nt, Mycobacterium bovis subsp bovis AF2122/97
gauccaggccaguuuggcgcu

SEQ ID NO: 3085889 - RNA, 14 nt, Mycobacterium bovis subsp bovis AF2122/97
gauccaggccucgc

SEQ ID NO: 3085890 - RNA, 21 nt, Mycobacterium bovis subsp bovis AF2122/97
gauccaggccucgcaccggau

SEQ ID NO: 3085891 - RNA, 18 nt, Mycobacterium bovis subsp bovis AF2122/97
gauccaggcgucggugac

SEQ ID NO: 3085892 - RNA, 17 nt, Mycobacterium bovis subsp bovis AF2122/97
gauccagggagcggcug

SEQ ID NO: 3085893 - RNA, 19 nt, Mycobacterium bovis subsp bovis AF2122/97
gauccagggagcggcugca

SEQ ID NO: 3085894 - RNA, 16 nt, Mycobacterium bovis subsp bovis AF2122/97
gauccagggccgacgc

SEQ ID NO: 3085895 - RNA, 21 nt, Mycobacterium bovis subsp bovis AF2122/97
gauccagugguaggccgccgg

SEQ ID NO: 3085896 - RNA, 17 nt, Mycobacterium bovis subsp bovis AF2122/97
gauccaguucaccgcgc

SEQ ID NO: 3085897 - RNA, 16 nt, Mycobacterium bovis subsp bovis AF2122/97
gauccaugcggguggu

SEQ ID NO: 3085898 - RNA, 16 nt, Mycobacterium bovis subsp bovis AF2122/97
gaucccaacgcccggg

SEQ ID NO: 3085899 - RNA, 17 nt, Mycobacterium bovis subsp bovis AF2122/97
gaucccaacgcccgggc

SEQ ID NO: 3085900 - RNA, 15 nt, Mycobacterium bovis subsp bovis AF2122/97
gaucccaccaccgcu

SEQ ID NO: 3085901 - RNA, 20 nt, Mycobacterium bovis subsp bovis AF2122/97
gaucccaccaccgcucgucg

SEQ ID NO: 3085902 - RNA, 13 nt, Mycobacterium bovis subsp bovis AF2122/97
gaucccaccggcu

SEQ ID NO: 3085903 - RNA, 16 nt, Mycobacterium bovis subsp bovis AF2122/97
gaucccacgaguuggc

SEQ ID NO: 3085904 - RNA, 16 nt, Mycobacterium bovis subsp bovis AF2122/97
gaucccacggcgggcg

SEQ ID NO: 3085905 - RNA, 15 nt, Mycobacterium bovis subsp bovis AF2122/97
gaucccagcgcagcg

SEQ ID NO: 3085906 - RNA, 20 nt, Mycobacterium bovis subsp bovis AF2122/97
gauccccaggccgcuugccc

SEQ ID NO: 3085907 - RNA, 14 nt, Mycobacterium bovis subsp bovis AF2122/97
gaucccccaggcga

SEQ ID NO: 3085908 - RNA, 20 nt, Mycobacterium bovis subsp bovis AF2122/97
gauccccgcgcugagcacgc

SEQ ID NO: 3085909 - RNA, 15 nt, Mycobacterium bovis subsp bovis AF2122/97
gaucccgaaccguuc

SEQ ID NO: 3085910 - RNA, 13 nt, Mycobacterium bovis subsp bovis AF2122/97
gaucccgaucgcg

SEQ ID NO: 3085911 - RNA, 18 nt, Mycobacterium bovis subsp bovis AF2122/97
gaucccgaucgcgcuggg

SEQ ID NO: 3085912 - RNA, 13 nt, Mycobacterium bovis subsp bovis AF2122/97
gaucccgaugguc

SEQ ID NO: 3085913 - RNA, 14 nt, Mycobacterium bovis subsp bovis AF2122/97
gaucccgaugguca

SEQ ID NO: 3085914 - RNA, 18 nt, Mycobacterium bovis subsp bovis AF2122/97
gaucccgccgcugccgcc

SEQ ID NO: 3085915 - RNA, 20 nt, Mycobacterium bovis subsp bovis AF2122/97
gaucccgccgcugccgccgg

SEQ ID NO: 3085916 - RNA, 23 nt, Mycobacterium bovis subsp bovis AF2122/97
gaucccgccgcugccgccggugc

SEQ ID NO: 3085917 - RNA, 13 nt, Mycobacterium bovis subsp bovis AF2122/97
gaucccgccgggg

SEQ ID NO: 3085918 - RNA, 15 nt, Mycobacterium bovis subsp bovis AF2122/97
gaucccgccggggcc

SEQ ID NO: 3085919 - RNA, 13 nt, Mycobacterium bovis subsp bovis AF2122/97
gaucccggccagc

SEQ ID NO: 3085920 - RNA, 16 nt, Mycobacterium bovis subsp bovis AF2122/97
gaucccggccagcucc

SEQ ID NO: 3085921 - RNA, 15 nt, Mycobacterium bovis subsp bovis AF2122/97
gaucccggccaggcc

SEQ ID NO: 3085922 - RNA, 16 nt, Mycobacterium bovis subsp bovis AF2122/97
gaucccggccaggccg

SEQ ID NO: 3085923 - RNA, 20 nt, Mycobacterium bovis subsp bovis AF2122/97
gaucccggccgggucgagug

SEQ ID NO: 3085924 - RNA, 18 nt, Mycobacterium bovis subsp bovis AF2122/97
gaucccggccgucgccgg

SEQ ID NO: 3085925 - RNA, 13 nt, Mycobacterium bovis subsp bovis AF2122/97
gaucccggcgagc

SEQ ID NO: 3085926 - RNA, 11 nt, Mycobacterium bovis subsp bovis AF2122/97
gaucccggcgg

SEQ ID NO: 3085927 - RNA, 21 nt, Mycobacterium bovis subsp bovis AF2122/97
gaucccggucuuuaauccagc

SEQ ID NO: 3085928 - RNA, 19 nt, Mycobacterium bovis subsp bovis AF2122/97
gaucccgucgggcacaccg

SEQ ID NO: 3085929 - RNA, 22 nt, Mycobacterium bovis subsp bovis AF2122/97
gaucccgucgggcacaccgacg

SEQ ID NO: 3085930 - RNA, 18 nt, Mycobacterium bovis subsp bovis AF2122/97
gaucccgugguggcgcca

SEQ ID NO: 3085931 - RNA, 20 nt, Mycobacterium bovis subsp bovis AF2122/97
gaucccguucggggccccgc

SEQ ID NO: 3085932 - RNA, 16 nt, Mycobacterium bovis subsp bovis AF2122/97
gaucccugugccagca

SEQ ID NO: 3085933 - RNA, 21 nt, Mycobacterium bovis subsp bovis AF2122/97
gaucccuugucgaaguacugg

SEQ ID NO: 3085934 - RNA, 18 nt, Mycobacterium bovis subsp bovis AF2122/97
gauccgaagagccagcaa

SEQ ID NO: 3085935 - RNA, 20 nt, Mycobacterium bovis subsp bovis AF2122/97
gauccgacaguggcucaccc

SEQ ID NO: 3085936 - RNA, 16 nt, Mycobacterium bovis subsp bovis AF2122/97
gauccgaccccgcgcc

SEQ ID NO: 3085937 - RNA, 22 nt, Mycobacterium bovis subsp bovis AF2122/97
gauccgauacagugcgcggauc

SEQ ID NO: 3085938 - RNA, 15 nt, Mycobacterium bovis subsp bovis AF2122/97
gauccgcaacaacgc

SEQ ID NO: 3085939 - RNA, 22 nt, Mycobacterium bovis subsp bovis AF2122/97
gauccgcaacaacgccgcgacg

SEQ ID NO: 3085940 - RNA, 23 nt, Mycobacterium bovis subsp bovis AF2122/97
gauccgcaacaacgccgcgacgu

SEQ ID NO: 3085941 - RNA, 23 nt, Mycobacterium bovis subsp bovis AF2122/97
gauccgcaccccauacucggcgg

SEQ ID NO: 3085942 - RNA, 20 nt, Mycobacterium bovis subsp bovis AF2122/97
gauccgcacccggccgcgca

SEQ ID NO: 3085943 - RNA, 19 nt, Mycobacterium bovis subsp bovis AF2122/97
gauccgcaucaugucgaag

SEQ ID NO: 3085944 - RNA, 19 nt, Mycobacterium bovis subsp bovis AF2122/97
gauccgccagaccgcggcg

SEQ ID NO: 3085945 - RNA, 19 nt, Mycobacterium bovis subsp bovis AF2122/97
gauccgcgauucgaccggu

SEQ ID NO: 3085946 - RNA, 17 nt, Mycobacterium bovis subsp bovis AF2122/97
gauccgcgcgcuggacc

SEQ ID NO: 3085947 - RNA, 16 nt, Mycobacterium bovis subsp bovis AF2122/97
gauccgcuagccccga

SEQ ID NO: 3085948 - RNA, 14 nt, Mycobacterium bovis subsp bovis AF2122/97
gauccgcucacccg

SEQ ID NO: 3085949 - RNA, 17 nt, Mycobacterium bovis subsp bovis AF2122/97
gauccgcucacccgccc

SEQ ID NO: 3085950 - RNA, 20 nt, Mycobacterium bovis subsp bovis AF2122/97
gauccgcugcgccgaggcau

SEQ ID NO: 3085951 - RNA, 14 nt, Mycobacterium bovis subsp bovis AF2122/97
gaucgcagugggca

SEQ ID NO: 3085952 - RNA, 14 nt, Mycobacterium bovis subsp bovis AF2122/97
gaucgcaucgacgu

SEQ ID NO: 3085953 - RNA, 21 nt, Mycobacterium bovis subsp bovis AF2122/97
gaucgcaucgacgugcgcggc

SEQ ID NO: 3085954 - RNA, 17 nt, Mycobacterium bovis subsp bovis AF2122/97
gaucgccaacgacucac

SEQ ID NO: 3085955 - RNA, 18 nt, Mycobacterium bovis subsp bovis AF2122/97
gaucgccaacgacucacc

SEQ ID NO: 3085956 - RNA, 12 nt, Mycobacterium bovis subsp bovis AF2122/97
gaucgccaccgg

SEQ ID NO: 3085957 - RNA, 15 nt, Mycobacterium bovis subsp bovis AF2122/97
gaucgccaccggcgc

SEQ ID NO: 3085958 - RNA, 16 nt, Mycobacterium bovis subsp bovis AF2122/97
gaucgccaccggcgcc

SEQ ID NO: 3085959 - RNA, 19 nt, Mycobacterium bovis subsp bovis AF2122/97
gaucgccaccggcgccacc

SEQ ID NO: 3085960 - RNA, 16 nt, Mycobacterium bovis subsp bovis AF2122/97
gaucgccaccgguacc

SEQ ID NO: 3085961 - RNA, 12 nt, Mycobacterium bovis subsp bovis AF2122/97
gaucgccaggcc

SEQ ID NO: 3085962 - RNA, 15 nt, Mycobacterium bovis subsp bovis AF2122/97
gaucgccaggccguc

SEQ ID NO: 3085963 - RNA, 16 nt, Mycobacterium bovis subsp bovis AF2122/97
gaucgccccagccaug

SEQ ID NO: 3085964 - RNA, 18 nt, Mycobacterium bovis subsp bovis AF2122/97
gaucgccccagccaugcu

SEQ ID NO: 3085965 - RNA, 23 nt, Mycobacterium bovis subsp bovis AF2122/97
gaucgcccgaguugaagaagccg

SEQ ID NO: 3085966 - RNA, 20 nt, Mycobacterium bovis subsp bovis AF2122/97
gaucgccgaaucggcaguug

SEQ ID NO: 3085967 - RNA, 12 nt, Mycobacterium bovis subsp bovis AF2122/97
gaucgccgagca

SEQ ID NO: 3085968 - RNA, 20 nt, Mycobacterium bovis subsp bovis AF2122/97
gaucgccgagcaggucggca

SEQ ID NO: 3085969 - RNA, 21 nt, Mycobacterium bovis subsp bovis AF2122/97
gaucgccgagcaggucggcaa

SEQ ID NO: 3085970 - RNA, 22 nt, Mycobacterium bovis subsp bovis AF2122/97
gaucgccgagcgugaaccuggc

SEQ ID NO: 3085971 - RNA, 15 nt, Mycobacterium bovis subsp bovis AF2122/97
gaucgccgaggcagc

SEQ ID NO: 3085972 - RNA, 14 nt, Mycobacterium bovis subsp bovis AF2122/97
gaucgccgccggcg

SEQ ID NO: 3085973 - RNA, 16 nt, Mycobacterium bovis subsp bovis AF2122/97
gaucgccgcgauggcg

SEQ ID NO: 3085974 - RNA, 17 nt, Mycobacterium bovis subsp bovis AF2122/97
gaucgccgcgauggcgg

SEQ ID NO: 3085975 - RNA, 19 nt, Mycobacterium bovis subsp bovis AF2122/97
gaucgccgcuaacgcaccu

SEQ ID NO: 3085976 - RNA, 20 nt, Mycobacterium bovis subsp bovis AF2122/97
gaucgccgcuaacgcaccug

SEQ ID NO: 3085977 - RNA, 13 nt, Mycobacterium bovis subsp bovis AF2122/97
gaucgccggccgc

SEQ ID NO: 3085978 - RNA, 14 nt, Mycobacterium bovis subsp bovis AF2122/97
gaucgccggccugc

SEQ ID NO: 3085979 - RNA, 22 nt, Mycobacterium bovis subsp bovis AF2122/97
gaucgccggccugcucggcgag

SEQ ID NO: 3085980 - RNA, 15 nt, Mycobacterium bovis subsp bovis AF2122/97
gaucgccggcuucgc

SEQ ID NO: 3085981 - RNA, 11 nt, Mycobacterium bovis subsp bovis AF2122/97
gaucgccgggg

SEQ ID NO: 3085982 - RNA, 23 nt, Mycobacterium bovis subsp bovis AF2122/97
gaucgccggggacgccgcggcgc

SEQ ID NO: 3085983 - RNA, 19 nt, Mycobacterium bovis subsp bovis AF2122/97
gaucgccguugccggcgac

SEQ ID NO: 3085984 - RNA, 14 nt, Mycobacterium bovis subsp bovis AF2122/97
gaucgccucgacgc

SEQ ID NO: 3085985 - RNA, 14 nt, Mycobacterium bovis subsp bovis AF2122/97
gaucgccucggaca

SEQ ID NO: 3085986 - RNA, 21 nt, Mycobacterium bovis subsp bovis AF2122/97
gaucgccucggacacggcagc

SEQ ID NO: 3085987 - RNA, 22 nt, Mycobacterium bovis subsp bovis AF2122/97
gaucgccucggacacggcagcc

SEQ ID NO: 3085988 - RNA, 20 nt, Mycobacterium bovis subsp bovis AF2122/97
gaucgccugagcgccgcggc

SEQ ID NO: 3085989 - RNA, 18 nt, Mycobacterium bovis subsp bovis AF2122/97
gaucgccugggcuuggcg

SEQ ID NO: 3085990 - RNA, 20 nt, Mycobacterium bovis subsp bovis AF2122/97
gaucgccugggcuuggcgac

SEQ ID NO: 3085991 - RNA, 17 nt, Mycobacterium bovis subsp bovis AF2122/97
gaucgcgaacaucgcca

SEQ ID NO: 3085992 - RNA, 19 nt, Mycobacterium bovis subsp bovis AF2122/97
gaucgcgaacaucgccagc

SEQ ID NO: 3085993 - RNA, 21 nt, Mycobacterium bovis subsp bovis AF2122/97
gaucgcgaacaucgccagcgc

SEQ ID NO: 3085994 - RNA, 23 nt, Mycobacterium bovis subsp bovis AF2122/97
gaucgcgaacaucgccagcgccg

SEQ ID NO: 3085995 - RNA, 18 nt, Mycobacterium bovis subsp bovis AF2122/97
gaucgcgacacggccauc

SEQ ID NO: 3085996 - RNA, 15 nt, Mycobacterium bovis subsp bovis AF2122/97
gaucgcgacccgauc

SEQ ID NO: 3085997 - RNA, 13 nt, Mycobacterium bovis subsp bovis AF2122/97
gaucgcgagcgcc

SEQ ID NO: 3085998 - RNA, 18 nt, Mycobacterium bovis subsp bovis AF2122/97
gaucgcgcagcgccgcca

SEQ ID NO: 3085999 - RNA, 16 nt, Mycobacterium bovis subsp bovis AF2122/97
gaucgcgccaggccac

SEQ ID NO: 3086000 - RNA, 18 nt, Mycobacterium bovis subsp bovis AF2122/97
gaucgcgcccgcugagcc

SEQ ID NO: 3086001 - RNA, 23 nt, Mycobacterium bovis subsp bovis AF2122/97
gaucgcgcccugagccaccccgg

SEQ ID NO: 3086002 - RNA, 14 nt, Mycobacterium bovis subsp bovis AF2122/97
gaucgcgcccugcg

SEQ ID NO: 3086003 - RNA, 20 nt, Mycobacterium bovis subsp bovis AF2122/97
gaucgcgcccugcggaucgg

SEQ ID NO: 3086004 - RNA, 23 nt, Mycobacterium bovis subsp bovis AF2122/97
gaucgcgcccugcggaucggaca

SEQ ID NO: 3086005 - RNA, 14 nt, Mycobacterium bovis subsp bovis AF2122/97
gaucgcgccgucgg

SEQ ID NO: 3086006 - RNA, 18 nt, Mycobacterium bovis subsp bovis AF2122/97
gaucgcgccgucggcgau

SEQ ID NO: 3086007 - RNA, 23 nt, Mycobacterium bovis subsp bovis AF2122/97
gaucgcgccgucgucgaccacga

SEQ ID NO: 3086008 - RNA, 14 nt, Mycobacterium bovis subsp bovis AF2122/97
gaucgcgcgagcga

SEQ ID NO: 3086009 - RNA, 14 nt, Mycobacterium bovis subsp bovis AF2122/97
gaucgcgcgcaccg

SEQ ID NO: 3086010 - RNA, 21 nt, Mycobacterium bovis subsp bovis AF2122/97
gaucgcgcugaaggccgguag

SEQ ID NO: 3086011 - RNA, 19 nt, Mycobacterium bovis subsp bovis AF2122/97
gaucgcgcugaucagccca

SEQ ID NO: 3086012 - RNA, 17 nt, Mycobacterium bovis subsp bovis AF2122/97
gaucgcggcgagcacca

SEQ ID NO: 3086013 - RNA, 18 nt, Mycobacterium bovis subsp bovis AF2122/97
gaucgcggcggcgauccg

SEQ ID NO: 3086014 - RNA, 14 nt, Mycobacterium bovis subsp bovis AF2122/97
gaucgcggcggcgu

SEQ ID NO: 3086015 - RNA, 23 nt, Mycobacterium bovis subsp bovis AF2122/97
gaucgcggucaaauccagcagcc

SEQ ID NO: 3086016 - RNA, 13 nt, Mycobacterium bovis subsp bovis AF2122/97
gaucgcggucagc

SEQ ID NO: 3086017 - RNA, 14 nt, Mycobacterium bovis subsp bovis AF2122/97
gaucgcggucagcg

SEQ ID NO: 3086018 - RNA, 15 nt, Mycobacterium bovis subsp bovis AF2122/97
gaucgcgguccaaca

SEQ ID NO: 3086019 - RNA, 18 nt, Mycobacterium bovis subsp bovis AF2122/97
gaucgcgguccaacagcg

SEQ ID NO: 3086020 - RNA, 20 nt, Mycobacterium bovis subsp bovis AF2122/97
gaucgcgguccgagcggcau

SEQ ID NO: 3086021 - RNA, 23 nt, Mycobacterium bovis subsp bovis AF2122/97
gaucgcgguccgagcggcaucgg

SEQ ID NO: 3086022 - RNA, 16 nt, Mycobacterium bovis subsp bovis AF2122/97
gaucgcguagcuggcc

SEQ ID NO: 3086023 - RNA, 21 nt, Mycobacterium bovis subsp bovis AF2122/97
gaucgcguccgccucgggugc

SEQ ID NO: 3086024 - RNA, 16 nt, Mycobacterium bovis subsp bovis AF2122/97
gaucgcgucgggcucg

SEQ ID NO: 3086025 - RNA, 17 nt, Mycobacterium bovis subsp bovis AF2122/97
gaucgcgucgggcucgg

SEQ ID NO: 3086026 - RNA, 19 nt, Mycobacterium bovis subsp bovis AF2122/97
gaucgcgucgggcucggcg

SEQ ID NO: 3086027 - RNA, 15 nt, Mycobacterium bovis subsp bovis AF2122/97
gaucgcgugcggugc

SEQ ID NO: 3086028 - RNA, 13 nt, Mycobacterium bovis subsp bovis AF2122/97
gaucgcguggcgc

SEQ ID NO: 3086029 - RNA, 19 nt, Mycobacterium bovis subsp bovis AF2122/97
gaucgcguuuguggcuggg

SEQ ID NO: 3086030 - RNA, 14 nt, Mycobacterium bovis subsp bovis AF2122/97
gaucgcuacgucga

SEQ ID NO: 3086031 - RNA, 20 nt, Mycobacterium bovis subsp bovis AF2122/97
gaucgcucauucgugcccgg

SEQ ID NO: 3086032 - RNA, 19 nt, Mycobacterium bovis subsp bovis AF2122/97
gaucgcuccgcggcgcagc

SEQ ID NO: 3086033 - RNA, 20 nt, Mycobacterium bovis subsp bovis AF2122/97
gaucgcuccgcggcgcagca

SEQ ID NO: 3086034 - RNA, 21 nt, Mycobacterium bovis subsp bovis AF2122/97
gaucgcuccgcggcgcagcac

SEQ ID NO: 3086035 - RNA, 13 nt, Mycobacterium bovis subsp bovis AF2122/97
gaucgcugccagc

SEQ ID NO: 3086036 - RNA, 17 nt, Mycobacterium bovis subsp bovis AF2122/97
gaucgcugccagcggcc

SEQ ID NO: 3086037 - RNA, 19 nt, Mycobacterium bovis subsp bovis AF2122/97
gaucgucaguuacgcaucg

SEQ ID NO: 3086038 - RNA, 14 nt, Mycobacterium bovis subsp bovis AF2122/97
gaucguccaccgcc

SEQ ID NO: 3086039 - RNA, 17 nt, Mycobacterium bovis subsp bovis AF2122/97
gaucguccaccgccgac

SEQ ID NO: 3086040 - RNA, 14 nt, Mycobacterium bovis subsp bovis AF2122/97
gaucguccagccca

SEQ ID NO: 3086041 - RNA, 14 nt, Mycobacterium bovis subsp bovis AF2122/97
gaucguccggccgg

SEQ ID NO: 3086042 - RNA, 16 nt, Mycobacterium bovis subsp bovis AF2122/97
gaucgucgaacagcac

SEQ ID NO: 3086043 - RNA, 19 nt, Mycobacterium bovis subsp bovis AF2122/97
gaucgucgacccaccaugu

SEQ ID NO: 3086044 - RNA, 12 nt, Mycobacterium bovis subsp bovis AF2122/97
gaucgucgacgc

SEQ ID NO: 3086045 - RNA, 18 nt, Mycobacterium bovis subsp bovis AF2122/97
gaucgucgagccgaucgc

SEQ ID NO: 3086046 - RNA, 19 nt, Mycobacterium bovis subsp bovis AF2122/97
gaucgucgagccgaucgcc

SEQ ID NO: 3086047 - RNA, 14 nt, Mycobacterium bovis subsp bovis AF2122/97
gaucgucgccgauc

SEQ ID NO: 3086048 - RNA, 15 nt, Mycobacterium bovis subsp bovis AF2122/97
gaucgucgugcacgg

SEQ ID NO: 3086049 - RNA, 18 nt, Mycobacterium bovis subsp bovis AF2122/97
gaucgucgugcacggcgg

SEQ ID NO: 3086050 - RNA, 15 nt, Mycobacterium bovis subsp bovis AF2122/97
gaucgucucggccac

SEQ ID NO: 3086051 - RNA, 17 nt, Mycobacterium bovis subsp bovis AF2122/97
gaucgugaacacgucgc

SEQ ID NO: 3086052 - RNA, 17 nt, Mycobacterium bovis subsp bovis AF2122/97
gaucgugagacgccguc

SEQ ID NO: 3086053 - RNA, 16 nt, Mycobacterium bovis subsp bovis AF2122/97
gaucgugaucgaccgg

SEQ ID NO: 3086054 - RNA, 17 nt, Mycobacterium bovis subsp bovis AF2122/97
gaucgugaucgaccgga

SEQ ID NO: 3086055 - RNA, 13 nt, Mycobacterium bovis subsp bovis AF2122/97
gaucgugccggcg

SEQ ID NO: 3086056 - RNA, 15 nt, Mycobacterium bovis subsp bovis AF2122/97
gaucgugccggcgaa

SEQ ID NO: 3086057 - RNA, 15 nt, Mycobacterium bovis subsp bovis AF2122/97
gaucgugccgggacc

SEQ ID NO: 3086058 - RNA, 16 nt, Mycobacterium bovis subsp bovis AF2122/97
gaucgugccgggaccg

SEQ ID NO: 3086059 - RNA, 20 nt, Mycobacterium bovis subsp bovis AF2122/97
gaucgugccgggaccggugu

SEQ ID NO: 3086060 - RNA, 16 nt, Mycobacterium bovis subsp bovis AF2122/97
gaucgugcugcccgca

SEQ ID NO: 3086061 - RNA, 22 nt, Mycobacterium bovis subsp bovis AF2122/97
gaucgugcuggugguaucggcg

SEQ ID NO: 3086062 - RNA, 23 nt, Mycobacterium bovis subsp bovis AF2122/97
gaucgugcuggugguaucggcgu

SEQ ID NO: 3086063 - RNA, 22 nt, Mycobacterium bovis subsp bovis AF2122/97
gaucgugugaggccuucgccga

SEQ ID NO: 3086064 - RNA, 22 nt, Mycobacterium bovis subsp bovis AF2122/97
gaucguuaugaccucgacgucg

SEQ ID NO: 3086065 - RNA, 14 nt, Mycobacterium bovis subsp bovis AF2122/97
gaucguuggccagu

SEQ ID NO: 3086066 - RNA, 20 nt, Mycobacterium bovis subsp bovis AF2122/97
gaucuagaggcggcccccgg

SEQ ID NO: 3086067 - RNA, 20 nt, Mycobacterium bovis subsp bovis AF2122/97
gaucucacccagcucgcgca

SEQ ID NO: 3086068 - RNA, 23 nt, Mycobacterium bovis subsp bovis AF2122/97
gaucucacccagcucgcgcaccc

SEQ ID NO: 3086069 - RNA, 15 nt, Mycobacterium bovis subsp bovis AF2122/97
gaucucaccuggagc

SEQ ID NO: 3086070 - RNA, 15 nt, Mycobacterium bovis subsp bovis AF2122/97
gaucucaucgggcca

SEQ ID NO: 3086071 - RNA, 21 nt, Mycobacterium bovis subsp bovis AF2122/97
gaucucaucgggccacagcaa

SEQ ID NO: 3086072 - RNA, 17 nt, Mycobacterium bovis subsp bovis AF2122/97
gaucuccaccggcgauc

SEQ ID NO: 3086073 - RNA, 23 nt, Mycobacterium bovis subsp bovis AF2122/97
gaucuccaccuucugguccagca

SEQ ID NO: 3086074 - RNA, 19 nt, Mycobacterium bovis subsp bovis AF2122/97
gaucuccagcgguucggug

SEQ ID NO: 3086075 - RNA, 17 nt, Mycobacterium bovis subsp bovis AF2122/97
gaucuccaggcccggcg

SEQ ID NO: 3086076 - RNA, 20 nt, Mycobacterium bovis subsp bovis AF2122/97
gaucuccccgaccgcgcccg

SEQ ID NO: 3086077 - RNA, 19 nt, Mycobacterium bovis subsp bovis AF2122/97
gaucuccccguccugccag

SEQ ID NO: 3086078 - RNA, 18 nt, Mycobacterium bovis subsp bovis AF2122/97
gaucuccgggucgauguc

SEQ ID NO: 3086079 - RNA, 15 nt, Mycobacterium bovis subsp bovis AF2122/97
gaucuccucgaguug

SEQ ID NO: 3086080 - RNA, 23 nt, Mycobacterium bovis subsp bovis AF2122/97
gaucuccucgaguugcgcggcag

SEQ ID NO: 3086081 - RNA, 21 nt, Mycobacterium bovis subsp bovis AF2122/97
gaucuccuuggccguucggcg

SEQ ID NO: 3086082 - RNA, 13 nt, Mycobacterium bovis subsp bovis AF2122/97
gaucucgaccagc

SEQ ID NO: 3086083 - RNA, 16 nt, Mycobacterium bovis subsp bovis AF2122/97
gaucucgaccagcgcc

SEQ ID NO: 3086084 - RNA, 17 nt, Mycobacterium bovis subsp bovis AF2122/97
gaucucgaccagcgccg

SEQ ID NO: 3086085 - RNA, 16 nt, Mycobacterium bovis subsp bovis AF2122/97
gaucucgaccggcuug

SEQ ID NO: 3086086 - RNA, 23 nt, Mycobacterium bovis subsp bovis AF2122/97
gaucucgaccguauugaccagcg

SEQ ID NO: 3086087 - RNA, 15 nt, Mycobacterium bovis subsp bovis AF2122/97
gaucucgagcaggcg

SEQ ID NO: 3086088 - RNA, 16 nt, Mycobacterium bovis subsp bovis AF2122/97
gaucucgagccgcggc

SEQ ID NO: 3086089 - RNA, 23 nt, Mycobacterium bovis subsp bovis AF2122/97
gaucucgaucaucaugucggcgc

SEQ ID NO: 3086090 - RNA, 16 nt, Mycobacterium bovis subsp bovis AF2122/97
gaucucgaucgacccg

SEQ ID NO: 3086091 - RNA, 19 nt, Mycobacterium bovis subsp bovis AF2122/97
gaucucgauguacagcggg

SEQ ID NO: 3086092 - RNA, 16 nt, Mycobacterium bovis subsp bovis AF2122/97
gaucucgcccaccucc

SEQ ID NO: 3086093 - RNA, 14 nt, Mycobacterium bovis subsp bovis AF2122/97
gaucucgcccagcg

SEQ ID NO: 3086094 - RNA, 19 nt, Mycobacterium bovis subsp bovis AF2122/97
gaucucgcccagcgagcgc

SEQ ID NO: 3086095 - RNA, 22 nt, Mycobacterium bovis subsp bovis AF2122/97
gaucucgcccagcgagcgccag

SEQ ID NO: 3086096 - RNA, 15 nt, Mycobacterium bovis subsp bovis AF2122/97
gaucucgccccagug

SEQ ID NO: 3086097 - RNA, 13 nt, Mycobacterium bovis subsp bovis AF2122/97
gaucucgccgcca

SEQ ID NO: 3086098 - RNA, 16 nt, Mycobacterium bovis subsp bovis AF2122/97
gaucucgccgccagcg

SEQ ID NO: 3086099 - RNA, 17 nt, Mycobacterium bovis subsp bovis AF2122/97
gaucucgccgccagcgc

SEQ ID NO: 3086100 - RNA, 14 nt, Mycobacterium bovis subsp bovis AF2122/97
gaucucgccggcga

SEQ ID NO: 3086101 - RNA, 16 nt, Mycobacterium bovis subsp bovis AF2122/97
gaucucgcgcgcggcg

SEQ ID NO: 3086102 - RNA, 19 nt, Mycobacterium bovis subsp bovis AF2122/97
gaucucgcgcgcggcgacg

SEQ ID NO: 3086103 - RNA, 13 nt, Mycobacterium bovis subsp bovis AF2122/97
gaucucggcgagc

SEQ ID NO: 3086104 - RNA, 14 nt, Mycobacterium bovis subsp bovis AF2122/97
gaucucggcgagca

SEQ ID NO: 3086105 - RNA, 13 nt, Mycobacterium bovis subsp bovis AF2122/97
gaucucggcgucg

SEQ ID NO: 3086106 - RNA, 20 nt, Mycobacterium bovis subsp bovis AF2122/97
gaucucggucgacggguuca

SEQ ID NO: 3086107 - RNA, 17 nt, Mycobacterium bovis subsp bovis AF2122/97
gaucucggugguuuggc

SEQ ID NO: 3086108 - RNA, 18 nt, Mycobacterium bovis subsp bovis AF2122/97
gaucucggugguuuggcg

SEQ ID NO: 3086109 - RNA, 21 nt, Mycobacterium bovis subsp bovis AF2122/97
gaucucggugguuuggcgcgc

SEQ ID NO: 3086110 - RNA, 16 nt, Mycobacterium bovis subsp bovis AF2122/97
gaucucguagccgccg

SEQ ID NO: 3086111 - RNA, 19 nt, Mycobacterium bovis subsp bovis AF2122/97
gaucucgucccacugcgcg

SEQ ID NO: 3086112 - RNA, 20 nt, Mycobacterium bovis subsp bovis AF2122/97
gaucucguggaucugccucu

SEQ ID NO: 3086113 - RNA, 21 nt, Mycobacterium bovis subsp bovis AF2122/97
gaucucguggaucugccucuc

SEQ ID NO: 3086114 - RNA, 18 nt, Mycobacterium bovis subsp bovis AF2122/97
gaucucuaccagccgccc

SEQ ID NO: 3086115 - RNA, 19 nt, Mycobacterium bovis subsp bovis AF2122/97
gaucucuccuggaaaggac

SEQ ID NO: 3086116 - RNA, 23 nt, Mycobacterium bovis subsp bovis AF2122/97
gaucucuccuggaaaggacggcc

SEQ ID NO: 3086117 - RNA, 23 nt, Mycobacterium bovis subsp bovis AF2122/97
gaucugaaacagucgaccgaggc

SEQ ID NO: 3086118 - RNA, 15 nt, Mycobacterium bovis subsp bovis AF2122/97
gaucugacggcgccg

SEQ ID NO: 3086119 - RNA, 17 nt, Mycobacterium bovis subsp bovis AF2122/97
gaucugacggcgccguc

SEQ ID NO: 3086120 - RNA, 21 nt, Mycobacterium bovis subsp bovis AF2122/97
gaucugagcgcggguggcagc

SEQ ID NO: 3086121 - RNA, 17 nt, Mycobacterium bovis subsp bovis AF2122/97
gaucugagggcucggug

SEQ ID NO: 3086122 - RNA, 18 nt, Mycobacterium bovis subsp bovis AF2122/97
gaucugagggcucggugg

SEQ ID NO: 3086123 - RNA, 16 nt, Mycobacterium bovis subsp bovis AF2122/97
gaugaccucggcgacg

SEQ ID NO: 3086124 - RNA, 11 nt, Mycobacterium bovis subsp bovis AF2122/97
gaugaccugcc

SEQ ID NO: 3086125 - RNA, 19 nt, Mycobacterium bovis subsp bovis AF2122/97
gaugaccugcccgucccgc

SEQ ID NO: 3086126 - RNA, 18 nt, Mycobacterium bovis subsp bovis AF2122/97
gaugaccuguagaucagc

SEQ ID NO: 3086127 - RNA, 17 nt, Mycobacterium bovis subsp bovis AF2122/97
gaugaccuucccgucga

SEQ ID NO: 3086128 - RNA, 16 nt, Mycobacterium bovis subsp bovis AF2122/97
gaugaccuugcccacc

SEQ ID NO: 3086129 - RNA, 19 nt, Mycobacterium bovis subsp bovis AF2122/97
gaugaccuuggccgugccc

SEQ ID NO: 3086130 - RNA, 16 nt, Mycobacterium bovis subsp bovis AF2122/97
gaugacgaccgaucgg

SEQ ID NO: 3086131 - RNA, 17 nt, Mycobacterium bovis subsp bovis AF2122/97
gaugacgacgccgucgg

SEQ ID NO: 3086132 - RNA, 13 nt, Mycobacterium bovis subsp bovis AF2122/97
gaugacgaucugg

SEQ ID NO: 3086133 - RNA, 17 nt, Mycobacterium bovis subsp bovis AF2122/97
gaugacgaucuggucaa

SEQ ID NO: 3086134 - RNA, 14 nt, Mycobacterium bovis subsp bovis AF2122/97
gaugacgaugcccu

SEQ ID NO: 3086135 - RNA, 17 nt, Mycobacterium bovis subsp bovis AF2122/97
gaugacgaugccgccga

SEQ ID NO: 3086136 - RNA, 20 nt, Mycobacterium bovis subsp bovis AF2122/97
gaugacgcccagggcgucgg

SEQ ID NO: 3086137 - RNA, 21 nt, Mycobacterium bovis subsp bovis AF2122/97
gaugacgccgucggcgcgcac

SEQ ID NO: 3086138 - RNA, 15 nt, Mycobacterium bovis subsp bovis AF2122/97
gaugacggcggcccg

SEQ ID NO: 3086139 - RNA, 14 nt, Mycobacterium bovis subsp bovis AF2122/97
gaugacggcgucga

SEQ ID NO: 3086140 - RNA, 17 nt, Mycobacterium bovis subsp bovis AF2122/97
gaugacggugccgaccg

SEQ ID NO: 3086141 - RNA, 16 nt, Mycobacterium bovis subsp bovis AF2122/97
gaugacgguggugacg

SEQ ID NO: 3086142 - RNA, 18 nt, Mycobacterium bovis subsp bovis AF2122/97
gaugacguugcagccggc

SEQ ID NO: 3086143 - RNA, 15 nt, Mycobacterium bovis subsp bovis AF2122/97
gaugacuagccugcu

SEQ ID NO: 3086144 - RNA, 12 nt, Mycobacterium bovis subsp bovis AF2122/97
gaugagaucauc

SEQ ID NO: 3086145 - RNA, 20 nt, Mycobacterium bovis subsp bovis AF2122/97
gaugagcaugcccagcgcac

SEQ ID NO: 3086146 - RNA, 17 nt, Mycobacterium bovis subsp bovis AF2122/97
gaugagcccagccgcgg

SEQ ID NO: 3086147 - RNA, 13 nt, Mycobacterium bovis subsp bovis AF2122/97
gaugagcgcgacu

SEQ ID NO: 3086148 - RNA, 15 nt, Mycobacterium bovis subsp bovis AF2122/97
gaugagcgcuucugc

SEQ ID NO: 3086149 - RNA, 14 nt, Mycobacterium bovis subsp bovis AF2122/97
gaugagcggcgcgg

SEQ ID NO: 3086150 - RNA, 17 nt, Mycobacterium bovis subsp bovis AF2122/97
gaugagcgugccgcagc

SEQ ID NO: 3086151 - RNA, 14 nt, Mycobacterium bovis subsp bovis AF2122/97
gaugagcucguuca

SEQ ID NO: 3086152 - RNA, 16 nt, Mycobacterium bovis subsp bovis AF2122/97
gaugagguggccgcgc

SEQ ID NO: 3086153 - RNA, 17 nt, Mycobacterium bovis subsp bovis AF2122/97
gaugagguucaucgccg

SEQ ID NO: 3086154 - RNA, 21 nt, Mycobacterium bovis subsp bovis AF2122/97
gaugaguagcagacgcagcca

SEQ ID NO: 3086155 - RNA, 22 nt, Mycobacterium bovis subsp bovis AF2122/97
gaugagugacgguccguucgau

SEQ ID NO: 3086156 - RNA, 23 nt, Mycobacterium bovis subsp bovis AF2122/97
gaugaucaugaacgcaagcagcg

SEQ ID NO: 3086157 - RNA, 23 nt, Mycobacterium bovis subsp bovis AF2122/97
gaugaucccgccaccgaacaguc

SEQ ID NO: 3086158 - RNA, 19 nt, Mycobacterium bovis subsp bovis AF2122/97
gaugaucgguucgggacgc

SEQ ID NO: 3086159 - RNA, 16 nt, Mycobacterium bovis subsp bovis AF2122/97
gaugaugaacagacgc

SEQ ID NO: 3086160 - RNA, 16 nt, Mycobacterium bovis subsp bovis AF2122/97
gaugaugacggcggcc

SEQ ID NO: 3086161 - RNA, 18 nt, Mycobacterium bovis subsp bovis AF2122/97
gaugaugacggcggcccg

SEQ ID NO: 3086162 - RNA, 17 nt, Mycobacterium bovis subsp bovis AF2122/97
gaugaugcaacgccaaa

SEQ ID NO: 3086163 - RNA, 12 nt, Mycobacterium bovis subsp bovis AF2122/97
gaugaugccgga

SEQ ID NO: 3086164 - RNA, 13 nt, Mycobacterium bovis subsp bovis AF2122/97
gaugaugccggcg

SEQ ID NO: 3086165 - RNA, 16 nt, Mycobacterium bovis subsp bovis AF2122/97
gaugaugccggcguug

SEQ ID NO: 3086166 - RNA, 14 nt, Mycobacterium bovis subsp bovis AF2122/97
gaugaugccgucgu

SEQ ID NO: 3086167 - RNA, 16 nt, Mycobacterium bovis subsp bovis AF2122/97
gaugaugcgcucggcc

SEQ ID NO: 3086168 - RNA, 13 nt, Mycobacterium bovis subsp bovis AF2122/97
gaugaugcugccg

SEQ ID NO: 3086169 - RNA, 20 nt, Mycobacterium bovis subsp bovis AF2122/97
gaugauggcgcgaucggugc

SEQ ID NO: 3086170 - RNA, 15 nt, Mycobacterium bovis subsp bovis AF2122/97
gaugaugugcgguga

SEQ ID NO: 3086171 - RNA, 16 nt, Mycobacterium bovis subsp bovis AF2122/97
gaugaugugcggugac

SEQ ID NO: 3086172 - RNA, 22 nt, Mycobacterium bovis subsp bovis AF2122/97
gaugauguggugugccugcguc

SEQ ID NO: 3086173 - RNA, 16 nt, Mycobacterium bovis subsp bovis AF2122/97
gaugauuucgccgagc

SEQ ID NO: 3086174 - RNA, 14 nt, Mycobacterium bovis subsp bovis AF2122/97
gaugcaacccggug

SEQ ID NO: 3086175 - RNA, 15 nt, Mycobacterium bovis subsp bovis AF2122/97
gaugcaacgccaaaa

SEQ ID NO: 3086176 - RNA, 16 nt, Mycobacterium bovis subsp bovis AF2122/97
gaugcaacgccaaaau

SEQ ID NO: 3086177 - RNA, 18 nt, Mycobacterium bovis subsp bovis AF2122/97
gaugcaacgccaaaaugg

SEQ ID NO: 3086178 - RNA, 19 nt, Mycobacterium bovis subsp bovis AF2122/97
gaugcaacucgaauccggc

SEQ ID NO: 3086179 - RNA, 16 nt, Mycobacterium bovis subsp bovis AF2122/97
gaugcaauagcugcgc

SEQ ID NO: 3086180 - RNA, 19 nt, Mycobacterium bovis subsp bovis AF2122/97
gaugcacaaccgcugcugc

SEQ ID NO: 3086181 - RNA, 21 nt, Mycobacterium bovis subsp bovis AF2122/97
gaugcaccucgcccugcagac

SEQ ID NO: 3086182 - RNA, 14 nt, Mycobacterium bovis subsp bovis AF2122/97
gaugcagccacaua

SEQ ID NO: 3086183 - RNA, 12 nt, Mycobacterium bovis subsp bovis AF2122/97
gaugcagcgcgc

SEQ ID NO: 3086184 - RNA, 14 nt, Mycobacterium bovis subsp bovis AF2122/97
gaugcagcgcgccc

SEQ ID NO: 3086185 - RNA, 17 nt, Mycobacterium bovis subsp bovis AF2122/97
gaugcagcgggucgccg

SEQ ID NO: 3086186 - RNA, 22 nt, Mycobacterium bovis subsp bovis AF2122/97
gaugcagcgguccagacaucag

SEQ ID NO: 3086187 - RNA, 18 nt, Mycobacterium bovis subsp bovis AF2122/97
gaugcagggcccgcaaca

SEQ ID NO: 3086188 - RNA, 21 nt, Mycobacterium bovis subsp bovis AF2122/97
gaugcagggcccgcaacaucg

SEQ ID NO: 3086189 - RNA, 16 nt, Mycobacterium bovis subsp bovis AF2122/97
gaugcagugcgacccg

SEQ ID NO: 3086190 - RNA, 20 nt, Mycobacterium bovis subsp bovis AF2122/97
gaugcauccagcugcugccg

SEQ ID NO: 3086191 - RNA, 21 nt, Mycobacterium bovis subsp bovis AF2122/97
gaugcaucccaacgagaugug

SEQ ID NO: 3086192 - RNA, 22 nt, Mycobacterium bovis subsp bovis AF2122/97
gaugcaucggugcagcccgccg

SEQ ID NO: 3086193 - RNA, 22 nt, Mycobacterium bovis subsp bovis AF2122/97
gaugcauggcuugcucugcgca

SEQ ID NO: 3086194 - RNA, 18 nt, Mycobacterium bovis subsp bovis AF2122/97
gaugccacaucccacggu

SEQ ID NO: 3086195 - RNA, 13 nt, Mycobacterium bovis subsp bovis AF2122/97
gaugccacaucgu

SEQ ID NO: 3086196 - RNA, 18 nt, Mycobacterium bovis subsp bovis AF2122/97
gaugccacccaacagcgc

SEQ ID NO: 3086197 - RNA, 19 nt, Mycobacterium bovis subsp bovis AF2122/97
gaugccacccagaugcagc

SEQ ID NO: 3086198 - RNA, 15 nt, Mycobacterium bovis subsp bovis AF2122/97
gaugccacggcgucg

SEQ ID NO: 3086199 - RNA, 21 nt, Mycobacterium bovis subsp bovis AF2122/97
gaugccagugcaucggucagc

SEQ ID NO: 3086200 - RNA, 19 nt, Mycobacterium bovis subsp bovis AF2122/97
gaugccaucaacgacuucg

SEQ ID NO: 3086201 - RNA, 20 nt, Mycobacterium bovis subsp bovis AF2122/97
gaugccaucggugaugaguc

SEQ ID NO: 3086202 - RNA, 17 nt, Mycobacterium bovis subsp bovis AF2122/97
gaugccauuucgucguc

SEQ ID NO: 3086203 - RNA, 18 nt, Mycobacterium bovis subsp bovis AF2122/97
gaugcccacggugccggc

SEQ ID NO: 3086204 - RNA, 20 nt, Mycobacterium bovis subsp bovis AF2122/97
gaugcccacggugccggcac

SEQ ID NO: 3086205 - RNA, 13 nt, Mycobacterium bovis subsp bovis AF2122/97
gaugcccagcgcc

SEQ ID NO: 3086206 - RNA, 19 nt, Mycobacterium bovis subsp bovis AF2122/97
gaugcccaucacgccccag

SEQ ID NO: 3086207 - RNA, 16 nt, Mycobacterium bovis subsp bovis AF2122/97
gaugcccauccggccg

SEQ ID NO: 3086208 - RNA, 22 nt, Mycobacterium bovis subsp bovis AF2122/97
gaugcccauccggccgucgggc

SEQ ID NO: 3086209 - RNA, 15 nt, Mycobacterium bovis subsp bovis AF2122/97
gaugccccacggugc

SEQ ID NO: 3086210 - RNA, 20 nt, Mycobacterium bovis subsp bovis AF2122/97
gaugcgggccgccaggcggc

SEQ ID NO: 3086211 - RNA, 22 nt, Mycobacterium bovis subsp bovis AF2122/97
gaugcgggccgccaggcggccg

SEQ ID NO: 3086212 - RNA, 14 nt, Mycobacterium bovis subsp bovis AF2122/97
gaugcgggcuguga

SEQ ID NO: 3086213 - RNA, 23 nt, Mycobacterium bovis subsp bovis AF2122/97
gaugcgguaucggucgacuggga

SEQ ID NO: 3086214 - RNA, 15 nt, Mycobacterium bovis subsp bovis AF2122/97
gaugcggucggccac

SEQ ID NO: 3086215 - RNA, 21 nt, Mycobacterium bovis subsp bovis AF2122/97
gaugcggucgucacggaccgc

SEQ ID NO: 3086216 - RNA, 22 nt, Mycobacterium bovis subsp bovis AF2122/97
gaugcggucgucacggaccgcc

SEQ ID NO: 3086217 - RNA, 12 nt, Mycobacterium bovis subsp bovis AF2122/97
gaugcggugcgg

SEQ ID NO: 3086218 - RNA, 23 nt, Mycobacterium bovis subsp bovis AF2122/97
gaugcgguuccgauagccgacca

SEQ ID NO: 3086219 - RNA, 22 nt, Mycobacterium bovis subsp bovis AF2122/97
gaugcguagacauuggcuccga

SEQ ID NO: 3086220 - RNA, 16 nt, Mycobacterium bovis subsp bovis AF2122/97
gaugcguagugcggcg

SEQ ID NO: 3086221 - RNA, 16 nt, Mycobacterium bovis subsp bovis AF2122/97
gaugcguccgcccagc

SEQ ID NO: 3086222 - RNA, 17 nt, Mycobacterium bovis subsp bovis AF2122/97
gaugcgucucgcgcgau

SEQ ID NO: 3086223 - RNA, 12 nt, Mycobacterium bovis subsp bovis AF2122/97
gaugcguucggc

SEQ ID NO: 3086224 - RNA, 13 nt, Mycobacterium bovis subsp bovis AF2122/97
gaugcguucggcc

SEQ ID NO: 3086225 - RNA, 17 nt, Mycobacterium bovis subsp bovis AF2122/97
gaugcguucggccgggc

SEQ ID NO: 3086226 - RNA, 20 nt, Mycobacterium bovis subsp bovis AF2122/97
gaugcucacuacccgcaacg

SEQ ID NO: 3086227 - RNA, 21 nt, Mycobacterium bovis subsp bovis AF2122/97
gaugcucaggucaccggccgc

SEQ ID NO: 3086228 - RNA, 20 nt, Mycobacterium bovis subsp bovis AF2122/97
gaugcucccuauugcugcgg

SEQ ID NO: 3086229 - RNA, 23 nt, Mycobacterium bovis subsp bovis AF2122/97
gaugcucgucccagaaccggcuc

SEQ ID NO: 3086230 - RNA, 20 nt, Mycobacterium bovis subsp bovis AF2122/97
gaugcugaacacgcagccga

SEQ ID NO: 3086231 - RNA, 14 nt, Mycobacterium bovis subsp bovis AF2122/97
gaugcugaccuuca

SEQ ID NO: 3086232 - RNA, 14 nt, Mycobacterium bovis subsp bovis AF2122/97
gaugcugacggugg

SEQ ID NO: 3086233 - RNA, 17 nt, Mycobacterium bovis subsp bovis AF2122/97
gaugcugagcgccaggc

SEQ ID NO: 3086234 - RNA, 22 nt, Mycobacterium bovis subsp bovis AF2122/97
gaugcugagcgccaggccgcac

SEQ ID NO: 3086235 - RNA, 13 nt, Mycobacterium bovis subsp bovis AF2122/97
gaugcugccagcc

SEQ ID NO: 3086236 - RNA, 19 nt, Mycobacterium bovis subsp bovis AF2122/97
gaugcugccagccauggcc

SEQ ID NO: 3086237 - RNA, 14 nt, Mycobacterium bovis subsp bovis AF2122/97
gaugcugcccgagu

SEQ ID NO: 3086238 - RNA, 15 nt, Mycobacterium bovis subsp bovis AF2122/97
gaugcugccgccgcc

SEQ ID NO: 3086239 - RNA, 16 nt, Mycobacterium bovis subsp bovis AF2122/97
gaugcugccgccgccg

SEQ ID NO: 3086240 - RNA, 21 nt, Mycobacterium bovis subsp bovis AF2122/97
gaugcugccgccgccgccggc

SEQ ID NO: 3086241 - RNA, 14 nt, Mycobacterium bovis subsp bovis AF2122/97
gaugcugccggcac

SEQ ID NO: 3086242 - RNA, 16 nt, Mycobacterium bovis subsp bovis AF2122/97
gaugcugccggcacca

SEQ ID NO: 3086243 - RNA, 13 nt, Mycobacterium bovis subsp bovis AF2122/97
gaugcugcgggcg

SEQ ID NO: 3086244 - RNA, 23 nt, Mycobacterium bovis subsp bovis AF2122/97
gaugcuggcaaaguaucgcagca

SEQ ID NO: 3086245 - RNA, 21 nt, Mycobacterium bovis subsp bovis AF2122/97
gaugcugucagacggcgucug

SEQ ID NO: 3086246 - RNA, 21 nt, Mycobacterium bovis subsp bovis AF2122/97
gaugcuuucguauucggccgc

SEQ ID NO: 3086247 - RNA, 22 nt, Mycobacterium bovis subsp bovis AF2122/97
gauggaaaacgccaugccggga

SEQ ID NO: 3086248 - RNA, 13 nt, Mycobacterium bovis subsp bovis AF2122/97
gauggaaggcggc

SEQ ID NO: 3086249 - RNA, 16 nt, Mycobacterium bovis subsp bovis AF2122/97
gauggaaggcggccag

SEQ ID NO: 3086250 - RNA, 17 nt, Mycobacterium bovis subsp bovis AF2122/97
gauggaaggcggccagg

SEQ ID NO: 3086251 - RNA, 18 nt, Mycobacterium bovis subsp bovis AF2122/97
gauggaaggcggccaggu

SEQ ID NO: 3086252 - RNA, 14 nt, Mycobacterium bovis subsp bovis AF2122/97
gauggacaccaccu

SEQ ID NO: 3086253 - RNA, 15 nt, Mycobacterium bovis subsp bovis AF2122/97
gauggacagcugcgg

SEQ ID NO: 3086254 - RNA, 14 nt, Mycobacterium bovis subsp bovis AF2122/97
gauggacggcagcc

SEQ ID NO: 3086255 - RNA, 14 nt, Mycobacterium bovis subsp bovis AF2122/97
gauggagccgguga

SEQ ID NO: 3086256 - RNA, 16 nt, Mycobacterium bovis subsp bovis AF2122/97
gauggagccggugacg

SEQ ID NO: 3086257 - RNA, 19 nt, Mycobacterium bovis subsp bovis AF2122/97
gauggaugggucgaccgga

SEQ ID NO: 3086258 - RNA, 15 nt, Mycobacterium bovis subsp bovis AF2122/97
gauggauuggcguca

SEQ ID NO: 3086259 - RNA, 17 nt, Mycobacterium bovis subsp bovis AF2122/97
gauggcaaacgcaccca

SEQ ID NO: 3086260 - RNA, 19 nt, Mycobacterium bovis subsp bovis AF2122/97
gauggcaauauccgggagu

SEQ ID NO: 3086261 - RNA, 12 nt, Mycobacterium bovis subsp bovis AF2122/97
gauggcaccacc

SEQ ID NO: 3086262 - RNA, 16 nt, Mycobacterium bovis subsp bovis AF2122/97
gauggcaccgcccccg

SEQ ID NO: 3086263 - RNA, 13 nt, Mycobacterium bovis subsp bovis AF2122/97
gauggcagcgccg

SEQ ID NO: 3086264 - RNA, 15 nt, Mycobacterium bovis subsp bovis AF2122/97
gauggcaggggcgau

SEQ ID NO: 3086265 - RNA, 16 nt, Mycobacterium bovis subsp bovis AF2122/97
gauggcaucggccauc

SEQ ID NO: 3086266 - RNA, 15 nt, Mycobacterium bovis subsp bovis AF2122/97
gauggccagcgcggc

SEQ ID NO: 3086267 - RNA, 20 nt, Mycobacterium bovis subsp bovis AF2122/97
gauggccagcgcggcgucgc

SEQ ID NO: 3086268 - RNA, 13 nt, Mycobacterium bovis subsp bovis AF2122/97
gauggccagguug

SEQ ID NO: 3086269 - RNA, 10 nt, Mycobacterium bovis subsp bovis AF2122/97
gauggccccg

SEQ ID NO: 3086270 - RNA, 18 nt, Mycobacterium bovis subsp bovis AF2122/97
gauggccccgggcgguga

SEQ ID NO: 3086271 - RNA, 21 nt, Mycobacterium bovis subsp bovis AF2122/97
gauggccgaacccaccacgaa

SEQ ID NO: 3086272 - RNA, 14 nt, Mycobacterium bovis subsp bovis AF2122/97
gauggccgaccagc

SEQ ID NO: 3086273 - RNA, 22 nt, Mycobacterium bovis subsp bovis AF2122/97
gauggccgacgcugcugauggu

SEQ ID NO: 3086274 - RNA, 14 nt, Mycobacterium bovis subsp bovis AF2122/97
gauggccgccaggc

SEQ ID NO: 3086275 - RNA, 16 nt, Mycobacterium bovis subsp bovis AF2122/97
gauggccgccaggcgc

SEQ ID NO: 3086276 - RNA, 12 nt, Mycobacterium bovis subsp bovis AF2122/97
gauggccgccga

SEQ ID NO: 3086277 - RNA, 13 nt, Mycobacterium bovis subsp bovis AF2122/97
gauggccgccgac

SEQ ID NO: 3086278 - RNA, 17 nt, Mycobacterium bovis subsp bovis AF2122/97
gauggccgccgacaacc

SEQ ID NO: 3086279 - RNA, 18 nt, Mycobacterium bovis subsp bovis AF2122/97
gauggccgccgacaaccc

SEQ ID NO: 3086280 - RNA, 13 nt, Mycobacterium bovis subsp bovis AF2122/97
gauggccgcgccc

SEQ ID NO: 3086281 - RNA, 17 nt, Mycobacterium bovis subsp bovis AF2122/97
gauggccgcgcccgccu

SEQ ID NO: 3086282 - RNA, 19 nt, Mycobacterium bovis subsp bovis AF2122/97
gauggccgggucgaugcgc

SEQ ID NO: 3086283 - RNA, 18 nt, Mycobacterium bovis subsp bovis AF2122/97
gauggccguccgaccgau

SEQ ID NO: 3086284 - RNA, 23 nt, Mycobacterium bovis subsp bovis AF2122/97
gauggccguccgaccgauaacac

SEQ ID NO: 3086285 - RNA, 11 nt, Mycobacterium bovis subsp bovis AF2122/97
gauggccucga

SEQ ID NO: 3086286 - RNA, 19 nt, Mycobacterium bovis subsp bovis AF2122/97
gauggccucgaacgccgcc

SEQ ID NO: 3086287 - RNA, 14 nt, Mycobacterium bovis subsp bovis AF2122/97
gauggccucggcga

SEQ ID NO: 3086288 - RNA, 18 nt, Mycobacterium bovis subsp bovis AF2122/97
gauggcgauacgcgcguc

SEQ ID NO: 3086289 - RNA, 20 nt, Mycobacterium bovis subsp bovis AF2122/97
gauggcgcaccggcgucggc

SEQ ID NO: 3086290 - RNA, 18 nt, Mycobacterium bovis subsp bovis AF2122/97
gauggcgcccugcgccac

SEQ ID NO: 3086291 - RNA, 15 nt, Mycobacterium bovis subsp bovis AF2122/97
gauggcgcgcugggc

SEQ ID NO: 3086292 - RNA, 14 nt, Mycobacterium bovis subsp bovis AF2122/97
gauggcgcugcacc

SEQ ID NO: 3086293 - RNA, 15 nt, Mycobacterium bovis subsp bovis AF2122/97
gauggcgcugcaccg

SEQ ID NO: 3086294 - RNA, 17 nt, Mycobacterium bovis subsp bovis AF2122/97
gauggcgcugcaccgua

SEQ ID NO: 3086295 - RNA, 12 nt, Mycobacterium bovis subsp bovis AF2122/97
gauggcggccac

SEQ ID NO: 3086296 - RNA, 14 nt, Mycobacterium bovis subsp bovis AF2122/97
gauggcggccacca

SEQ ID NO: 3086297 - RNA, 23 nt, Mycobacterium bovis subsp bovis AF2122/97
gauggugugcacggcuucggcga

SEQ ID NO: 3086298 - RNA, 18 nt, Mycobacterium bovis subsp bovis AF2122/97
gauggugugcccgcaccg

SEQ ID NO: 3086299 - RNA, 22 nt, Mycobacterium bovis subsp bovis AF2122/97
gaugguucaugaacaucggccg

SEQ ID NO: 3086300 - RNA, 15 nt, Mycobacterium bovis subsp bovis AF2122/97
gaugguugcgacggc

SEQ ID NO: 3086301 - RNA, 21 nt, Mycobacterium bovis subsp bovis AF2122/97
gaugguugcucgagcgguggc

SEQ ID NO: 3086302 - RNA, 23 nt, Mycobacterium bovis subsp bovis AF2122/97
gauguaaccguagcccugcucag

SEQ ID NO: 3086303 - RNA, 14 nt, Mycobacterium bovis subsp bovis AF2122/97
gauguaaugcgggc

SEQ ID NO: 3086304 - RNA, 14 nt, Mycobacterium bovis subsp bovis AF2122/97
gauguaccccagcg

SEQ ID NO: 3086305 - RNA, 15 nt, Mycobacterium bovis subsp bovis AF2122/97
gauguagcggcguuc

SEQ ID NO: 3086306 - RNA, 21 nt, Mycobacterium bovis subsp bovis AF2122/97
gauguagcggcguuccgggcc

SEQ ID NO: 3086307 - RNA, 22 nt, Mycobacterium bovis subsp bovis AF2122/97
gauguagcggcguuccgggccg

SEQ ID NO: 3086308 - RNA, 21 nt, Mycobacterium bovis subsp bovis AF2122/97
gauguaguuggcgaccugcgc

SEQ ID NO: 3086309 - RNA, 21 nt, Mycobacterium bovis subsp bovis AF2122/97
gauguaguuggugaugccgau

SEQ ID NO: 3086310 - RNA, 16 nt, Mycobacterium bovis subsp bovis AF2122/97
gauguaugacagguca

SEQ ID NO: 3086311 - RNA, 20 nt, Mycobacterium bovis subsp bovis AF2122/97
gaugucagugaucaccaacc

SEQ ID NO: 3086312 - RNA, 13 nt, Mycobacterium bovis subsp bovis AF2122/97
gauguccaggagu

SEQ ID NO: 3086313 - RNA, 19 nt, Mycobacterium bovis subsp bovis AF2122/97
gauguccaggagugcgggc

SEQ ID NO: 3086314 - RNA, 15 nt, Mycobacterium bovis subsp bovis AF2122/97
gauguccagguggcg

SEQ ID NO: 3086315 - RNA, 21 nt, Mycobacterium bovis subsp bovis AF2122/97
gaugucccaucgcgucggcga

SEQ ID NO: 3086316 - RNA, 23 nt, Mycobacterium bovis subsp bovis AF2122/97
gauguccccgacggacuccggcc

SEQ ID NO: 3086317 - RNA, 15 nt, Mycobacterium bovis subsp bovis AF2122/97
gauguccccggcggc

SEQ ID NO: 3086318 - RNA, 20 nt, Mycobacterium bovis subsp bovis AF2122/97
gauguccccggcggcagcau

SEQ ID NO: 3086319 - RNA, 15 nt, Mycobacterium bovis subsp bovis AF2122/97
gaugucccgagcccg

SEQ ID NO: 3086320 - RNA, 12 nt, Mycobacterium bovis subsp bovis AF2122/97
gauguccgacgc

SEQ ID NO: 3086321 - RNA, 17 nt, Mycobacterium bovis subsp bovis AF2122/97
gauguccgacgcaccaa

SEQ ID NO: 3086322 - RNA, 15 nt, Mycobacterium bovis subsp bovis AF2122/97
gauguccgcacaacg

SEQ ID NO: 3086323 - RNA, 14 nt, Mycobacterium bovis subsp bovis AF2122/97
gauguccgcagcac

SEQ ID NO: 3086324 - RNA, 16 nt, Mycobacterium bovis subsp bovis AF2122/97
gauguccgcagcaccg

SEQ ID NO: 3086325 - RNA, 19 nt, Mycobacterium bovis subsp bovis AF2122/97
gauguccgcagcaccgucg

SEQ ID NO: 3086326 - RNA, 20 nt, Mycobacterium bovis subsp bovis AF2122/97
gauguccgcagcaccgucgg

SEQ ID NO: 3086327 - RNA, 18 nt, Mycobacterium bovis subsp bovis AF2122/97
gauguccgcggccaccac

SEQ ID NO: 3086328 - RNA, 16 nt, Mycobacterium bovis subsp bovis AF2122/97
gauguccucgacaccc

SEQ ID NO: 3086329 - RNA, 14 nt, Mycobacterium bovis subsp bovis AF2122/97
gauguccucgagca

SEQ ID NO: 3086330 - RNA, 16 nt, Mycobacterium bovis subsp bovis AF2122/97
gauguccucgagcacc

SEQ ID NO: 3086331 - RNA, 19 nt, Mycobacterium bovis subsp bovis AF2122/97
gauguccucgagcaccgcg

SEQ ID NO: 3086332 - RNA, 14 nt, Mycobacterium bovis subsp bovis AF2122/97
gauguccucgaugc

SEQ ID NO: 3086333 - RNA, 15 nt, Mycobacterium bovis subsp bovis AF2122/97
gauguccuugcgguc

SEQ ID NO: 3086334 - RNA, 14 nt, Mycobacterium bovis subsp bovis AF2122/97
gaugucgaagucgu

SEQ ID NO: 3086335 - RNA, 14 nt, Mycobacterium bovis subsp bovis AF2122/97
gaugucgacgacaa

SEQ ID NO: 3086336 - RNA, 16 nt, Mycobacterium bovis subsp bovis AF2122/97
gaugucgagcccgucg

SEQ ID NO: 3086337 - RNA, 13 nt, Mycobacterium bovis subsp bovis AF2122/97
gaugucgagcgcg

SEQ ID NO: 3086338 - RNA, 12 nt, Mycobacterium bovis subsp bovis AF2122/97
gaugucgaggua

SEQ ID NO: 3086339 - RNA, 18 nt, Mycobacterium bovis subsp bovis AF2122/97
gaugucgaucagccgcau

SEQ ID NO: 3086340 - RNA, 17 nt, Mycobacterium bovis subsp bovis AF2122/97
gaugucgaugccgcgca

SEQ ID NO: 3086341 - RNA, 16 nt, Mycobacterium bovis subsp bovis AF2122/97
gaugucgcccaaccga

SEQ ID NO: 3086342 - RNA, 12 nt, Mycobacterium bovis subsp bovis AF2122/97
gaugucgccgau

SEQ ID NO: 3086343 - RNA, 16 nt, Mycobacterium bovis subsp bovis AF2122/97
gaugucgccggcgacc

SEQ ID NO: 3086344 - RNA, 15 nt, Mycobacterium bovis subsp bovis AF2122/97
gaugucgccgguguc

SEQ ID NO: 3086345 - RNA, 14 nt, Mycobacterium bovis subsp bovis AF2122/97
gaugucgcgcgcua

SEQ ID NO: 3086346 - RNA, 19 nt, Mycobacterium bovis subsp bovis AF2122/97
gaugucgcgcgcuaggugc

SEQ ID NO: 3086347 - RNA, 19 nt, Mycobacterium bovis subsp bovis AF2122/97
gaugucgcggucgaggucc

SEQ ID NO: 3086348 - RNA, 17 nt, Mycobacterium bovis subsp bovis AF2122/97
gaugucggcaccauagc

SEQ ID NO: 3086349 - RNA, 14 nt, Mycobacterium bovis subsp bovis AF2122/97
gaugucggcaggua

SEQ ID NO: 3086350 - RNA, 13 nt, Mycobacterium bovis subsp bovis AF2122/97
gaugucggccagg

SEQ ID NO: 3086351 - RNA, 15 nt, Mycobacterium bovis subsp bovis AF2122/97
gaugucggcucggcc

SEQ ID NO: 3086352 - RNA, 14 nt, Mycobacterium bovis subsp bovis AF2122/97
gaugucggcuggug

SEQ ID NO: 3086353 - RNA, 13 nt, Mycobacterium bovis subsp bovis AF2122/97
gaugucgggaagg

SEQ ID NO: 3086354 - RNA, 19 nt, Mycobacterium bovis subsp bovis AF2122/97
gaugucgggaaggugacgc

SEQ ID NO: 3086355 - RNA, 23 nt, Mycobacterium bovis subsp bovis AF2122/97
gaugucggggccgucgucgguca

SEQ ID NO: 3086356 - RNA, 15 nt, Mycobacterium bovis subsp bovis AF2122/97
gaugucggugcgucc

SEQ ID NO: 3086357 - RNA, 17 nt, Mycobacterium bovis subsp bovis AF2122/97
gaugucgucgacaucaa

SEQ ID NO: 3086358 - RNA, 20 nt, Mycobacterium bovis subsp bovis AF2122/97
gaugucgucuuuggucagcc

SEQ ID NO: 3086359 - RNA, 22 nt, Mycobacterium bovis subsp bovis AF2122/97
gaugucgugcgggcgcaccagg

SEQ ID NO: 3086360 - RNA, 15 nt, Mycobacterium bovis subsp bovis AF2122/97
gaugucguuggccac

SEQ ID NO: 3086361 - RNA, 20 nt, Mycobacterium bovis subsp bovis AF2122/97
gaugucguuggccaccucgg

SEQ ID NO: 3086362 - RNA, 20 nt, Mycobacterium bovis subsp bovis AF2122/97
gaugucuaccaacaccgccc

SEQ ID NO: 3086363 - RNA, 17 nt, Mycobacterium bovis subsp bovis AF2122/97
gaugugcacggugugca

SEQ ID NO: 3086364 - RNA, 12 nt, Mycobacterium bovis subsp bovis AF2122/97
gaugugccgcgc

SEQ ID NO: 3086365 - RNA, 14 nt, Mycobacterium bovis subsp bovis AF2122/97
gaugugcgccaccu

SEQ ID NO: 3086366 - RNA, 16 nt, Mycobacterium bovis subsp bovis AF2122/97
gaugugcgccaccucg

SEQ ID NO: 3086367 - RNA, 14 nt, Mycobacterium bovis subsp bovis AF2122/97
gauguggccggcga

SEQ ID NO: 3086368 - RNA, 16 nt, Mycobacterium bovis subsp bovis AF2122/97
gaugugggcggagccg

SEQ ID NO: 3086369 - RNA, 17 nt, Mycobacterium bovis subsp bovis AF2122/97
gaugugguccaucgcgc

SEQ ID NO: 3086370 - RNA, 19 nt, Mycobacterium bovis subsp bovis AF2122/97
gaugugguccaucgcgcug

SEQ ID NO: 3086371 - RNA, 22 nt, Mycobacterium bovis subsp bovis AF2122/97
gaugugguccaucgcgcugcgg

SEQ ID NO: 3086372 - RNA, 15 nt, Mycobacterium bovis subsp bovis AF2122/97
gauguggucggacag

SEQ ID NO: 3086373 - RNA, 16 nt, Mycobacterium bovis subsp bovis AF2122/97
gauguggucggacagc

SEQ ID NO: 3086374 - RNA, 15 nt, Mycobacterium bovis subsp bovis AF2122/97
gauguggugugccug

SEQ ID NO: 3086375 - RNA, 18 nt, Mycobacterium bovis subsp bovis AF2122/97
gauguggugugccugcgu

SEQ ID NO: 3086376 - RNA, 17 nt, Mycobacterium bovis subsp bovis AF2122/97
gaugugguuggugcugg

SEQ ID NO: 3086377 - RNA, 20 nt, Mycobacterium bovis subsp bovis AF2122/97
gauguguccggcaucgguga

SEQ ID NO: 3086378 - RNA, 15 nt, Mycobacterium bovis subsp bovis AF2122/97
gaugugucgaugagg

SEQ ID NO: 3086379 - RNA, 23 nt, Mycobacterium bovis subsp bovis AF2122/97
gaugugucggcgagggcgcgccg

SEQ ID NO: 3086380 - RNA, 19 nt, Mycobacterium bovis subsp bovis AF2122/97
gauguuacacuaaccgaau

SEQ ID NO: 3086381 - RNA, 19 nt, Mycobacterium bovis subsp bovis AF2122/97
gauguucagcgccacgucc

SEQ ID NO: 3086382 - RNA, 20 nt, Mycobacterium bovis subsp bovis AF2122/97
gauguucauccgcaguccgg

SEQ ID NO: 3086383 - RNA, 15 nt, Mycobacterium bovis subsp bovis AF2122/97
gauguucgaucagcg

SEQ ID NO: 3086384 - RNA, 14 nt, Mycobacterium bovis subsp bovis AF2122/97
gauugcggccgccg

SEQ ID NO: 3086385 - RNA, 18 nt, Mycobacterium bovis subsp bovis AF2122/97
gauugcgggacuugucgg

SEQ ID NO: 3086386 - RNA, 20 nt, Mycobacterium bovis subsp bovis AF2122/97
gauugcggucguccccgucg

SEQ ID NO: 3086387 - RNA, 18 nt, Mycobacterium bovis subsp bovis AF2122/97
gauugcguagcgggucag

SEQ ID NO: 3086388 - RNA, 19 nt, Mycobacterium bovis subsp bovis AF2122/97
gauugcuguacugcggugc

SEQ ID NO: 3086389 - RNA, 16 nt, Mycobacterium bovis subsp bovis AF2122/97
gauuggcagaccggug

SEQ ID NO: 3086390 - RNA, 19 nt, Mycobacterium bovis subsp bovis AF2122/97
gauuggccaaccccauggc

SEQ ID NO: 3086391 - RNA, 20 nt, Mycobacterium bovis subsp bovis AF2122/97
gauuggccaaccccauggcc

SEQ ID NO: 3086392 - RNA, 15 nt, Mycobacterium bovis subsp bovis AF2122/97
gauuggcccaccgcc

SEQ ID NO: 3086393 - RNA, 11 nt, Mycobacterium bovis subsp bovis AF2122/97
gauuggccccg

SEQ ID NO: 3086394 - RNA, 19 nt, Mycobacterium bovis subsp bovis AF2122/97
gauuggcgaucuugcgacg

SEQ ID NO: 3086395 - RNA, 20 nt, Mycobacterium bovis subsp bovis AF2122/97
gauuggcgaucuugcgacgc

SEQ ID NO: 3086396 - RNA, 15 nt, Mycobacterium bovis subsp bovis AF2122/97
gauuggcgcugcccg

SEQ ID NO: 3086397 - RNA, 12 nt, Mycobacterium bovis subsp bovis AF2122/97
gauuggcucgcc

SEQ ID NO: 3086398 - RNA, 13 nt, Mycobacterium bovis subsp bovis AF2122/97
gauuggcucgccg

SEQ ID NO: 3086399 - RNA, 15 nt, Mycobacterium bovis subsp bovis AF2122/97
gauuggcucgccgaa

SEQ ID NO: 3086400 - RNA, 17 nt, Mycobacterium bovis subsp bovis AF2122/97
gauuggcucgccgaacc

SEQ ID NO: 3086401 - RNA, 12 nt, Mycobacterium bovis subsp bovis AF2122/97
gauuggcucggg

SEQ ID NO: 3086402 - RNA, 14 nt, Mycobacterium bovis subsp bovis AF2122/97
gauuggcugcgccg

SEQ ID NO: 3086403 - RNA, 19 nt, Mycobacterium bovis subsp bovis AF2122/97
gauuggugggccagcagca

SEQ ID NO: 3086404 - RNA, 20 nt, Mycobacterium bovis subsp bovis AF2122/97
gauugugagcaauggcgcga

SEQ ID NO: 3086405 - RNA, 13 nt, Mycobacterium bovis subsp bovis AF2122/97
gauuguggccagc

SEQ ID NO: 3086406 - RNA, 17 nt, Mycobacterium bovis subsp bovis AF2122/97
gauuguggccagcgcuu

SEQ ID NO: 3086407 - RNA, 22 nt, Mycobacterium bovis subsp bovis AF2122/97
gauugugucccauggugagcug

SEQ ID NO: 3086408 - RNA, 20 nt, Mycobacterium bovis subsp bovis AF2122/97
gauuguguuccaccagcgcc

SEQ ID NO: 3086409 - RNA, 22 nt, Mycobacterium bovis subsp bovis AF2122/97
gauuguguuccaccagcgcccg

SEQ ID NO: 3086410 - RNA, 20 nt, Mycobacterium bovis subsp bovis AF2122/97
gauuuauugagucggcuggu

SEQ ID NO: 3086411 - RNA, 20 nt, Mycobacterium bovis subsp bovis AF2122/97
gauuuccaucgcgaccucgg

SEQ ID NO: 3086412 - RNA, 20 nt, Mycobacterium bovis subsp bovis AF2122/97
gauuucgagcgcugcucccg

SEQ ID NO: 3086413 - RNA, 17 nt, Mycobacterium bovis subsp bovis AF2122/97
gauuucgaugacgaaca

SEQ ID NO: 3086414 - RNA, 20 nt, Mycobacterium bovis subsp bovis AF2122/97
gauuucggcgaccggccggc

SEQ ID NO: 3086415 - RNA, 16 nt, Mycobacterium bovis subsp bovis AF2122/97
gauuucggcggcgaug

SEQ ID NO: 3086416 - RNA, 23 nt, Mycobacterium bovis subsp bovis AF2122/97
gauuucggcggcgaugaccgggc

SEQ ID NO: 3086417 - RNA, 22 nt, Mycobacterium bovis subsp bovis AF2122/97
gauuucgucgcugagcacggcg

SEQ ID NO: 3086418 - RNA, 16 nt, Mycobacterium bovis subsp bovis AF2122/97
gauuucuugaccgcgg

SEQ ID NO: 3086419 - RNA, 22 nt, Mycobacterium bovis subsp bovis AF2122/97
gauuucuuuaaaccccuggcga

SEQ ID NO: 3086420 - RNA, 22 nt, Mycobacterium bovis subsp bovis AF2122/97
gauuugccccguugagcagcac

SEQ ID NO: 3086421 - RNA, 14 nt, Mycobacterium bovis subsp bovis AF2122/97
gauuuggagcuuuu

SEQ ID NO: 3086422 - RNA, 18 nt, Mycobacterium bovis subsp bovis AF2122/97
gauuuggccgucaucucc

SEQ ID NO: 3086423 - RNA, 19 nt, Mycobacterium bovis subsp bovis AF2122/97
gauuuuccgccuguacggc

SEQ ID NO: 3086424 - RNA, 14 nt, Mycobacterium bovis subsp bovis AF2122/97
gauuuucucggugc

SEQ ID NO: 3086425 - RNA, 20 nt, Mycobacterium bovis subsp bovis AF2122/97
gauuuugcgucugcucgccg

SEQ ID NO: 3086426 - RNA, 19 nt, Mycobacterium bovis subsp bovis AF2122/97
gauuuugcgucugcucgcg

SEQ ID NO: 3086427 - RNA, 16 nt, Mycobacterium bovis subsp bovis AF2122/97
gauuuugugucugcuc

SEQ ID NO: 3086428 - RNA, 17 nt, Mycobacterium bovis subsp bovis AF2122/97
gauuuugugucugcucg

SEQ ID NO: 3086429 - RNA, 20 nt, Mycobacterium bovis subsp bovis AF2122/97
gauuuugugucugcucgccg

SEQ ID NO: 3086430 - RNA, 21 nt, Mycobacterium bovis subsp bovis AF2122/97
gcaaaacccgcuccaccccua

SEQ ID NO: 3086431 - RNA, 18 nt, Mycobacterium bovis subsp bovis AF2122/97
gcaaaagugcgaguagga

SEQ ID NO: 3086432 - RNA, 20 nt, Mycobacterium bovis subsp bovis AF2122/97
gcaaaaucgaugacgguccu

SEQ ID NO: 3086433 - RNA, 15 nt, Mycobacterium bovis subsp bovis AF2122/97
gcaaaaucgcccaau

SEQ ID NO: 3086434 - RNA, 21 nt, Mycobacterium bovis subsp bovis AF2122/97
gcaaaaucgucagcgccgccg

SEQ ID NO: 3086435 - RNA, 13 nt, Mycobacterium bovis subsp bovis AF2122/97
gcaaaauggccac

SEQ ID NO: 3086436 - RNA, 19 nt, Mycobacterium bovis subsp bovis AF2122/97
gcaaaauggccaccggcgg

SEQ ID NO: 3086437 - RNA, 13 nt, Mycobacterium bovis subsp bovis AF2122/97
gcaaacaccagcc

SEQ ID NO: 3086438 - RNA, 16 nt, Mycobacterium bovis subsp bovis AF2122/97
gcaaacauccacccgc

SEQ ID NO: 3086439 - RNA, 19 nt, Mycobacterium bovis subsp bovis AF2122/97
gcaaacauccacccgcggu

SEQ ID NO: 3086440 - RNA, 21 nt, Mycobacterium bovis subsp bovis AF2122/97
gcaaacauccacccgcgguga

SEQ ID NO: 3086441 - RNA, 15 nt, Mycobacterium bovis subsp bovis AF2122/97
gcaaacaucgcaggc

SEQ ID NO: 3086442 - RNA, 17 nt, Mycobacterium bovis subsp bovis AF2122/97
gcaaaccaagcgcgcca

SEQ ID NO: 3086443 - RNA, 13 nt, Mycobacterium bovis subsp bovis AF2122/97
gcaaaccacccgc

SEQ ID NO: 3086444 - RNA, 20 nt, Mycobacterium bovis subsp bovis AF2122/97
gcaaaccacccgcaacacau

SEQ ID NO: 3086445 - RNA, 13 nt, Mycobacterium bovis subsp bovis AF2122/97
gcaaaccccggac

SEQ ID NO: 3086446 - RNA, 19 nt, Mycobacterium bovis subsp bovis AF2122/97
gcaaaccccggaccaucga

SEQ ID NO: 3086447 - RNA, 20 nt, Mycobacterium bovis subsp bovis AF2122/97
gcaaacccgccgacaaaagc

SEQ ID NO: 3086448 - RNA, 23 nt, Mycobacterium bovis subsp bovis AF2122/97
gcaaaccgaucaauccgcccuug

SEQ ID NO: 3086449 - RNA, 17 nt, Mycobacterium bovis subsp bovis AF2122/97
gcaaacgcacccaucgu

SEQ ID NO: 3086450 - RNA, 22 nt, Mycobacterium bovis subsp bovis AF2122/97
gcaaacgcacccaucgugcuga

SEQ ID NO: 3086451 - RNA, 20 nt, Mycobacterium bovis subsp bovis AF2122/97
gcaaacguaccgucauggcg

SEQ ID NO: 3086452 - RNA, 17 nt, Mycobacterium bovis subsp bovis AF2122/97
gcaaacugggcaccggc

SEQ ID NO: 3086453 - RNA, 16 nt, Mycobacterium bovis subsp bovis AF2122/97
gcaaagacagcgcggg

SEQ ID NO: 3086454 - RNA, 22 nt, Mycobacterium bovis subsp bovis AF2122/97
gcaaagccagcgcagccaggcu

SEQ ID NO: 3086455 - RNA, 15 nt, Mycobacterium bovis subsp bovis AF2122/97
gcaaaggacgucgac

SEQ ID NO: 3086456 - RNA, 17 nt, Mycobacterium bovis subsp bovis AF2122/97
gcaaaggaugaugaaca

SEQ ID NO: 3086457 - RNA, 18 nt, Mycobacterium bovis subsp bovis AF2122/97
gcaaaggccccggugacg

SEQ ID NO: 3086458 - RNA, 12 nt, Mycobacterium bovis subsp bovis AF2122/97
gcaaaggcgcuc

SEQ ID NO: 3086459 - RNA, 15 nt, Mycobacterium bovis subsp bovis AF2122/97
gcaaaguaucgcagc

SEQ ID NO: 3086460 - RNA, 16 nt, Mycobacterium bovis subsp bovis AF2122/97
gcaaagucggugucac

SEQ ID NO: 3086461 - RNA, 17 nt, Mycobacterium bovis subsp bovis AF2122/97
gcaaauaggacugcgcc

SEQ ID NO: 3086462 - RNA, 19 nt, Mycobacterium bovis subsp bovis AF2122/97
gcaaauaggacugcgccac

SEQ ID NO: 3086463 - RNA, 12 nt, Mycobacterium bovis subsp bovis AF2122/97
gcaaaucaagca

SEQ ID NO: 3086464 - RNA, 18 nt, Mycobacterium bovis subsp bovis AF2122/97
gcaaaucggugcgauccu

SEQ ID NO: 3086465 - RNA, 13 nt, Mycobacterium bovis subsp bovis AF2122/97
gcaaaugcggcgc

SEQ ID NO: 3086466 - RNA, 15 nt, Mycobacterium bovis subsp bovis AF2122/97
gcaaauucugguguc

SEQ ID NO: 3086467 - RNA, 15 nt, Mycobacterium bovis subsp bovis AF2122/97
gcaacaacgccgcga

SEQ ID NO: 3086468 - RNA, 19 nt, Mycobacterium bovis subsp bovis AF2122/97
gcaacaacgccgcgacgug

SEQ ID NO: 3086469 - RNA, 18 nt, Mycobacterium bovis subsp bovis AF2122/97
gcaacaacgucugcagcc

SEQ ID NO: 3086470 - RNA, 20 nt, Mycobacterium bovis subsp bovis AF2122/97
gcaacgaggucugcggccga

SEQ ID NO: 3086471 - RNA, 12 nt, Mycobacterium bovis subsp bovis AF2122/97
gcaacgcccaac

SEQ ID NO: 3086472 - RNA, 20 nt, Mycobacterium bovis subsp bovis AF2122/97
gcaacgcccaacgucgccag

SEQ ID NO: 3086473 - RNA, 23 nt, Mycobacterium bovis subsp bovis AF2122/97
gcaacgcccaacgucgccagguc

SEQ ID NO: 3086474 - RNA, 24 nt, Mycobacterium bovis subsp bovis AF2122/97
gcaacgcccaacgucgccagguca

SEQ ID NO: 3086475 - RNA, 13 nt, Mycobacterium bovis subsp bovis AF2122/97
gcaacgccgcgcc

SEQ ID NO: 3086476 - RNA, 16 nt, Mycobacterium bovis subsp bovis AF2122/97
gcaacgccgcggacca

SEQ ID NO: 3086477 - RNA, 13 nt, Mycobacterium bovis subsp bovis AF2122/97
gcaacgcgaaccg

SEQ ID NO: 3086478 - RNA, 15 nt, Mycobacterium bovis subsp bovis AF2122/97
gcaacgcgaaccggc

SEQ ID NO: 3086479 - RNA, 17 nt, Mycobacterium bovis subsp bovis AF2122/97
gcaacgcgaaccggcca

SEQ ID NO: 3086480 - RNA, 18 nt, Mycobacterium bovis subsp bovis AF2122/97
gcaacgcgaaccggccau

SEQ ID NO: 3086481 - RNA, 17 nt, Mycobacterium bovis subsp bovis AF2122/97
gcaacgcgaccaucucg

SEQ ID NO: 3086482 - RNA, 14 nt, Mycobacterium bovis subsp bovis AF2122/97
gcaacgcggccuug

SEQ ID NO: 3086483 - RNA, 22 nt, Mycobacterium bovis subsp bovis AF2122/97
gcaacgcggccuugcgcacagg

SEQ ID NO: 3086484 - RNA, 20 nt, Mycobacterium bovis subsp bovis AF2122/97
gcaacgcguauucggcaucg

SEQ ID NO: 3086485 - RNA, 14 nt, Mycobacterium bovis subsp bovis AF2122/97
gcaacgcgucgucg

SEQ ID NO: 3086486 - RNA, 13 nt, Mycobacterium bovis subsp bovis AF2122/97
gcaacgcugcggc

SEQ ID NO: 3086487 - RNA, 16 nt, Mycobacterium bovis subsp bovis AF2122/97
gcaacgcuggaggcga

SEQ ID NO: 3086488 - RNA, 21 nt, Mycobacterium bovis subsp bovis AF2122/97
gcaacgcuggaggcgaucugc

SEQ ID NO: 3086489 - RNA, 16 nt, Mycobacterium bovis subsp bovis AF2122/97
gcaacgcuucggcagc

SEQ ID NO: 3086490 - RNA, 17 nt, Mycobacterium bovis subsp bovis AF2122/97
gcaacgcuucggcagcu

SEQ ID NO: 3086491 - RNA, 18 nt, Mycobacterium bovis subsp bovis AF2122/97
gcaacgcuucggcagcuc

SEQ ID NO: 3086492 - RNA, 20 nt, Mycobacterium bovis subsp bovis AF2122/97
gcaacggaggugccggcgcc

SEQ ID NO: 3086493 - RNA, 21 nt, Mycobacterium bovis subsp bovis AF2122/97
gcaacggaggugccggcgcca

SEQ ID NO: 3086494 - RNA, 20 nt, Mycobacterium bovis subsp bovis AF2122/97
gcaacggauaacccguggcg

SEQ ID NO: 3086495 - RNA, 20 nt, Mycobacterium bovis subsp bovis AF2122/97
gcaacggcagcccguggucg

SEQ ID NO: 3086496 - RNA, 14 nt, Mycobacterium bovis subsp bovis AF2122/97
gcaacggcgcgccg

SEQ ID NO: 3086497 - RNA, 15 nt, Mycobacterium bovis subsp bovis AF2122/97
gcaacggcgcgccga

SEQ ID NO: 3086498 - RNA, 16 nt, Mycobacterium bovis subsp bovis AF2122/97
gcaacggcgcgccgac

SEQ ID NO: 3086499 - RNA, 17 nt, Mycobacterium bovis subsp bovis AF2122/97
gcaacggcgcgccgacc

SEQ ID NO: 3086500 - RNA, 12 nt, Mycobacterium bovis subsp bovis AF2122/97
gcaacggcggca

SEQ ID NO: 3086501 - RNA, 13 nt, Mycobacterium bovis subsp bovis AF2122/97
gcaacggcggcaa

SEQ ID NO: 3086502 - RNA, 23 nt, Mycobacterium bovis subsp bovis AF2122/97
gcaacggcggcaacggcggcauc

SEQ ID NO: 3086503 - RNA, 15 nt, Mycobacterium bovis subsp bovis AF2122/97
gcaacggcggcaucg

SEQ ID NO: 3086504 - RNA, 16 nt, Mycobacterium bovis subsp bovis AF2122/97
gcaacggcggcaucgg

SEQ ID NO: 3086505 - RNA, 13 nt, Mycobacterium bovis subsp bovis AF2122/97
gcaacggcggcga

SEQ ID NO: 3086506 - RNA, 18 nt, Mycobacterium bovis subsp bovis AF2122/97
gcaacggcggcgacggcg

SEQ ID NO: 3086507 - RNA, 13 nt, Mycobacterium bovis subsp bovis AF2122/97
gcaacggcggggc

SEQ ID NO: 3086508 - RNA, 15 nt, Mycobacterium bovis subsp bovis AF2122/97
gcaacggcggggccg

SEQ ID NO: 3086509 - RNA, 19 nt, Mycobacterium bovis subsp bovis AF2122/97
gcaacggcggggccggcgg

SEQ ID NO: 3086510 - RNA, 21 nt, Mycobacterium bovis subsp bovis AF2122/97
gcaacggcggggccggcggcu

SEQ ID NO: 3086511 - RNA, 22 nt, Mycobacterium bovis subsp bovis AF2122/97
gcaacggcggggccggcggcuc

SEQ ID NO: 3086512 - RNA, 14 nt, Mycobacterium bovis subsp bovis AF2122/97
gcaacggcggugaa

SEQ ID NO: 3086513 - RNA, 20 nt, Mycobacterium bovis subsp bovis AF2122/97
gcaacgggggcgccggagcc

SEQ ID NO: 3086514 - RNA, 23 nt, Mycobacterium bovis subsp bovis AF2122/97
gcaacggguacacccgcucgccc

SEQ ID NO: 3086515 - RNA, 16 nt, Mycobacterium bovis subsp bovis AF2122/97
gcaacggguccgacgg

SEQ ID NO: 3086516 - RNA, 18 nt, Mycobacterium bovis subsp bovis AF2122/97
gcaacggguccgacggug

SEQ ID NO: 3086517 - RNA, 19 nt, Mycobacterium bovis subsp bovis AF2122/97
gcaacggguccgacggugu

SEQ ID NO: 3086518 - RNA, 22 nt, Mycobacterium bovis subsp bovis AF2122/97
gcaacgggucgaugucggcaau

SEQ ID NO: 3086519 - RNA, 15 nt, Mycobacterium bovis subsp bovis AF2122/97
gcaacgggucggcau

SEQ ID NO: 3086520 - RNA, 14 nt, Mycobacterium bovis subsp bovis AF2122/97
gcaacgggucgggu

SEQ ID NO: 3086521 - RNA, 20 nt, Mycobacterium bovis subsp bovis AF2122/97
gcaacggugaucagccaccg

SEQ ID NO: 3086522 - RNA, 16 nt, Mycobacterium bovis subsp bovis AF2122/97
gcaacgguuggucgaa

SEQ ID NO: 3086523 - RNA, 18 nt, Mycobacterium bovis subsp bovis AF2122/97
gcaacgguuggucgaaca

SEQ ID NO: 3086524 - RNA, 13 nt, Mycobacterium bovis subsp bovis AF2122/97
gcaacgucgcuga

SEQ ID NO: 3086525 - RNA, 17 nt, Mycobacterium bovis subsp bovis AF2122/97
gcaacgugugcaccauc

SEQ ID NO: 3086526 - RNA, 17 nt, Mycobacterium bovis subsp bovis AF2122/97
gcaacguguuaaccggg

SEQ ID NO: 3086527 - RNA, 21 nt, Mycobacterium bovis subsp bovis AF2122/97
gcaacguguuaaccgggcacg

SEQ ID NO: 3086528 - RNA, 19 nt, Mycobacterium bovis subsp bovis AF2122/97
gcaacuacggcguccccga

SEQ ID NO: 3086529 - RNA, 16 nt, Mycobacterium bovis subsp bovis AF2122/97
gcaacuagccgcugcc

SEQ ID NO: 3086530 - RNA, 21 nt, Mycobacterium bovis subsp bovis AF2122/97
gcaacuagccgcugccuggcc

SEQ ID NO: 3086531 - RNA, 14 nt, Mycobacterium bovis subsp bovis AF2122/97
gcaacuaucgcacc

SEQ ID NO: 3086532 - RNA, 21 nt, Mycobacterium bovis subsp bovis AF2122/97
gcaacucgccacggucgccga

SEQ ID NO: 3086533 - RNA, 22 nt, Mycobacterium bovis subsp bovis AF2122/97
gcaacucggccacggcgucggc

SEQ ID NO: 3086534 - RNA, 17 nt, Mycobacterium bovis subsp bovis AF2122/97
gcaacucguccagcagu

SEQ ID NO: 3086535 - RNA, 19 nt, Mycobacterium bovis subsp bovis AF2122/97
gcaacucuucccauuucgg

SEQ ID NO: 3086536 - RNA, 15 nt, Mycobacterium bovis subsp bovis AF2122/97
gcaacugggcggccu

SEQ ID NO: 3086537 - RNA, 16 nt, Mycobacterium bovis subsp bovis AF2122/97
gcaacugggcggccug

SEQ ID NO: 3086538 - RNA, 17 nt, Mycobacterium bovis subsp bovis AF2122/97
gcaacuucagcaacggc

SEQ ID NO: 3086539 - RNA, 22 nt, Mycobacterium bovis subsp bovis AF2122/97
gcaacuucuucagcagcggcgg

SEQ ID NO: 3086540 - RNA, 23 nt, Mycobacterium bovis subsp bovis AF2122/97
gcaacuucuucagcagcggcgga

SEQ ID NO: 3086541 - RNA, 16 nt, Mycobacterium bovis subsp bovis AF2122/97
gcaacuuugagcagaa

SEQ ID NO: 3086542 - RNA, 23 nt, Mycobacterium bovis subsp bovis AF2122/97
gcaagaaacagguaagcagccag

SEQ ID NO: 3086543 - RNA, 23 nt, Mycobacterium bovis subsp bovis AF2122/97
gcaagaaaguuccacgacaaccg

SEQ ID NO: 3086544 - RNA, 15 nt, Mycobacterium bovis subsp bovis AF2122/97
gcaagaaucagcagc

SEQ ID NO: 3086545 - RNA, 16 nt, Mycobacterium bovis subsp bovis AF2122/97
gcaagaaucagcagca

SEQ ID NO: 3086546 - RNA, 17 nt, Mycobacterium bovis subsp bovis AF2122/97
gcaagaaucagcagcag

SEQ ID NO: 3086547 - RNA, 14 nt, Mycobacterium bovis subsp bovis AF2122/97
gcaagaaugccgcc

SEQ ID NO: 3086548 - RNA, 16 nt, Mycobacterium bovis subsp bovis AF2122/97
gcaagaaugccgccga

SEQ ID NO: 3086549 - RNA, 16 nt, Mycobacterium bovis subsp bovis AF2122/97
gcaagaccgcgccaac

SEQ ID NO: 3086550 - RNA, 19 nt, Mycobacterium bovis subsp bovis AF2122/97
gcaagaccguuacaccauc

SEQ ID NO: 3086551 - RNA, 20 nt, Mycobacterium bovis subsp bovis AF2122/97
gcaagagccgcagccacguc

SEQ ID NO: 3086552 - RNA, 18 nt, Mycobacterium bovis subsp bovis AF2122/97
gcaagaucggcagcgugg

SEQ ID NO: 3086553 - RNA, 21 nt, Mycobacterium bovis subsp bovis AF2122/97
gcaagaucguuuccguagacg

SEQ ID NO: 3086554 - RNA, 18 nt, Mycobacterium bovis subsp bovis AF2122/97
gcaagcaaauucuggugu

SEQ ID NO: 3086555 - RNA, 12 nt, Mycobacterium bovis subsp bovis AF2122/97
gcaagcacaccg

SEQ ID NO: 3086556 - RNA, 16 nt, Mycobacterium bovis subsp bovis AF2122/97
gcaaucaggaaccgcu

SEQ ID NO: 3086557 - RNA, 20 nt, Mycobacterium bovis subsp bovis AF2122/97
gcaaucauccgaucgccgcg

SEQ ID NO: 3086558 - RNA, 21 nt, Mycobacterium bovis subsp bovis AF2122/97
gcaaucauccgaucgccgcga

SEQ ID NO: 3086559 - RNA, 19 nt, Mycobacterium bovis subsp bovis AF2122/97
gcaaucaucucccgaccgc

SEQ ID NO: 3086560 - RNA, 20 nt, Mycobacterium bovis subsp bovis AF2122/97
gcaaucaucucccgaccgcc

SEQ ID NO: 3086561 - RNA, 16 nt, Mycobacterium bovis subsp bovis AF2122/97
gcaaucaugucagcgc

SEQ ID NO: 3086562 - RNA, 22 nt, Mycobacterium bovis subsp bovis AF2122/97
gcaaucaugucagcgcugagcc

SEQ ID NO: 3086563 - RNA, 20 nt, Mycobacterium bovis subsp bovis AF2122/97
gcaauccccuggaaagggcc

SEQ ID NO: 3086564 - RNA, 20 nt, Mycobacterium bovis subsp bovis AF2122/97
gcaaucccgccaucugccug

SEQ ID NO: 3086565 - RNA, 23 nt, Mycobacterium bovis subsp bovis AF2122/97
gcaaucccgcggucgaucaggcc

SEQ ID NO: 3086566 - RNA, 11 nt, Mycobacterium bovis subsp bovis AF2122/97
gcaauccgcaa

SEQ ID NO: 3086567 - RNA, 19 nt, Mycobacterium bovis subsp bovis AF2122/97
gcaauccgcacagcgacga

SEQ ID NO: 3086568 - RNA, 16 nt, Mycobacterium bovis subsp bovis AF2122/97
gcaauccggucagcgc

SEQ ID NO: 3086569 - RNA, 14 nt, Mycobacterium bovis subsp bovis AF2122/97
gcaaucgaccacga

SEQ ID NO: 3086570 - RNA, 16 nt, Mycobacterium bovis subsp bovis AF2122/97
gcaaucgcgggcgaug

SEQ ID NO: 3086571 - RNA, 21 nt, Mycobacterium bovis subsp bovis AF2122/97
gcaaucgcucugugucgccga

SEQ ID NO: 3086572 - RNA, 17 nt, Mycobacterium bovis subsp bovis AF2122/97
gcaaucggauacccagc

SEQ ID NO: 3086573 - RNA, 21 nt, Mycobacterium bovis subsp bovis AF2122/97
gcaaucggauacccagccggc

SEQ ID NO: 3086574 - RNA, 19 nt, Mycobacterium bovis subsp bovis AF2122/97
gcaaucgugguucggcguc

SEQ ID NO: 3086575 - RNA, 20 nt, Mycobacterium bovis subsp bovis AF2122/97
gcaaucgugguucggcgucg

SEQ ID NO: 3086576 - RNA, 21 nt, Mycobacterium bovis subsp bovis AF2122/97
gcaaucucccgaaucgugcgg

SEQ ID NO: 3086577 - RNA, 15 nt, Mycobacterium bovis subsp bovis AF2122/97
gcaaugacccgcggg

SEQ ID NO: 3086578 - RNA, 15 nt, Mycobacterium bovis subsp bovis AF2122/97
gcaaugaccugcagc

SEQ ID NO: 3086579 - RNA, 19 nt, Mycobacterium bovis subsp bovis AF2122/97
gcaaugaccuggccgcccg

SEQ ID NO: 3086580 - RNA, 23 nt, Mycobacterium bovis subsp bovis AF2122/97
gcaaugaccuggccgcccgcugc

SEQ ID NO: 3086581 - RNA, 22 nt, Mycobacterium bovis subsp bovis AF2122/97
gcaaugacguacggggucgccg

SEQ ID NO: 3086582 - RNA, 23 nt, Mycobacterium bovis subsp bovis AF2122/97
gcaaugacguacggggucgccgg

SEQ ID NO: 3086583 - RNA, 16 nt, Mycobacterium bovis subsp bovis AF2122/97
gcaaugacgucgucgg

SEQ ID NO: 3086584 - RNA, 17 nt, Mycobacterium bovis subsp bovis AF2122/97
gcaaugacgucgucggc

SEQ ID NO: 3086585 - RNA, 18 nt, Mycobacterium bovis subsp bovis AF2122/97
gcaaugacuugcgacccg

SEQ ID NO: 3086586 - RNA, 18 nt, Mycobacterium bovis subsp bovis AF2122/97
gcaaugcaucgcggcggc

SEQ ID NO: 3086587 - RNA, 19 nt, Mycobacterium bovis subsp bovis AF2122/97
gcaaugcaucgcggcggcg

SEQ ID NO: 3086588 - RNA, 15 nt, Mycobacterium bovis subsp bovis AF2122/97
gcaaugcccgaccgg

SEQ ID NO: 3086589 - RNA, 16 nt, Mycobacterium bovis subsp bovis AF2122/97
gcaaugcccgcaccgc

SEQ ID NO: 3086590 - RNA, 17 nt, Mycobacterium bovis subsp bovis AF2122/97
gcaaugccgacgccaac

SEQ ID NO: 3086591 - RNA, 16 nt, Mycobacterium bovis subsp bovis AF2122/97
gcaaugccucgaccac

SEQ ID NO: 3086592 - RNA, 15 nt, Mycobacterium bovis subsp bovis AF2122/97
gcaaugcgagcgcgc

SEQ ID NO: 3086593 - RNA, 14 nt, Mycobacterium bovis subsp bovis AF2122/97
gcaaugcgcgcgau

SEQ ID NO: 3086594 - RNA, 20 nt, Mycobacterium bovis subsp bovis AF2122/97
gcaaugcggcccggguggcc

SEQ ID NO: 3086595 - RNA, 15 nt, Mycobacterium bovis subsp bovis AF2122/97
gcaaugcuuccagca

SEQ ID NO: 3086596 - RNA, 16 nt, Mycobacterium bovis subsp bovis AF2122/97
gcaauggccagcacca

SEQ ID NO: 3086597 - RNA, 13 nt, Mycobacterium bovis subsp bovis AF2122/97
gcaauggcgcggu

SEQ ID NO: 3086598 - RNA, 14 nt, Mycobacterium bovis subsp bovis AF2122/97
gcaauggcggccuu

SEQ ID NO: 3086599 - RNA, 15 nt, Mycobacterium bovis subsp bovis AF2122/97
gcaaugucgacaccg

SEQ ID NO: 3086600 - RNA, 19 nt, Mycobacterium bovis subsp bovis AF2122/97
gcaaugucgacaccggcgc

SEQ ID NO: 3086601 - RNA, 17 nt, Mycobacterium bovis subsp bovis AF2122/97
gcaauuaggucgaccac

SEQ ID NO: 3086602 - RNA, 17 nt, Mycobacterium bovis subsp bovis AF2122/97
gcaauuccacgaucggc

SEQ ID NO: 3086603 - RNA, 13 nt, Mycobacterium bovis subsp bovis AF2122/97
gcaauuccgccga

SEQ ID NO: 3086604 - RNA, 17 nt, Mycobacterium bovis subsp bovis AF2122/97
gcaauuguucgcggccg

SEQ ID NO: 3086605 - RNA, 18 nt, Mycobacterium bovis subsp bovis AF2122/97
gcacaaacauacgccacc

SEQ ID NO: 3086606 - RNA, 15 nt, Mycobacterium bovis subsp bovis AF2122/97
gcacaaacgggcgug

SEQ ID NO: 3086607 - RNA, 23 nt, Mycobacterium bovis subsp bovis AF2122/97
gcacaaacgggcgugggccgcug

SEQ ID NO: 3086608 - RNA, 15 nt, Mycobacterium bovis subsp bovis AF2122/97
gcacaacaucgccgc

SEQ ID NO: 3086609 - RNA, 17 nt, Mycobacterium bovis subsp bovis AF2122/97
gcacaacaucgccgcag

SEQ ID NO: 3086610 - RNA, 18 nt, Mycobacterium bovis subsp bovis AF2122/97
gcacaacaucgccgcagu

SEQ ID NO: 3086611 - RNA, 12 nt, Mycobacterium bovis subsp bovis AF2122/97
gcacaacccguc

SEQ ID NO: 3086612 - RNA, 17 nt, Mycobacterium bovis subsp bovis AF2122/97
gcacaacccgucgagcc

SEQ ID NO: 3086613 - RNA, 13 nt, Mycobacterium bovis subsp bovis AF2122/97
gcacaacccgugc

SEQ ID NO: 3086614 - RNA, 17 nt, Mycobacterium bovis subsp bovis AF2122/97
gcacaaccgcugcugcu

SEQ ID NO: 3086615 - RNA, 13 nt, Mycobacterium bovis subsp bovis AF2122/97
gcacaagcccagc

SEQ ID NO: 3086616 - RNA, 17 nt, Mycobacterium bovis subsp bovis AF2122/97
gcacaaguggucgauga

SEQ ID NO: 3086617 - RNA, 17 nt, Mycobacterium bovis subsp bovis AF2122/97
gcacaauacggucagca

SEQ ID NO: 3086618 - RNA, 18 nt, Mycobacterium bovis subsp bovis AF2122/97
gcacaauacggucagcag

SEQ ID NO: 3086619 - RNA, 19 nt, Mycobacterium bovis subsp bovis AF2122/97
gcacaauacggucagcaga

SEQ ID NO: 3086620 - RNA, 20 nt, Mycobacterium bovis subsp bovis AF2122/97
gcacaauacggucagcagac

SEQ ID NO: 3086621 - RNA, 15 nt, Mycobacterium bovis subsp bovis AF2122/97
gcacaaucaccgccg

SEQ ID NO: 3086622 - RNA, 17 nt, Mycobacterium bovis subsp bovis AF2122/97
gcacaaucaccgccgcg

SEQ ID NO: 3086623 - RNA, 19 nt, Mycobacterium bovis subsp bovis AF2122/97
gcacaaucaccgccgcgac

SEQ ID NO: 3086624 - RNA, 20 nt, Mycobacterium bovis subsp bovis AF2122/97
gcacaaucggauagccgugc

SEQ ID NO: 3086625 - RNA, 16 nt, Mycobacterium bovis subsp bovis AF2122/97
gcacaaucgguugcac

SEQ ID NO: 3086626 - RNA, 20 nt, Mycobacterium bovis subsp bovis AF2122/97
gcacaaucgguugcacccgc

SEQ ID NO: 3086627 - RNA, 15 nt, Mycobacterium bovis subsp bovis AF2122/97
gcacaauggcggcgc

SEQ ID NO: 3086628 - RNA, 17 nt, Mycobacterium bovis subsp bovis AF2122/97
gcacaauggcggcgccg

SEQ ID NO: 3086629 - RNA, 16 nt, Mycobacterium bovis subsp bovis AF2122/97
gcacacagaccgugac

SEQ ID NO: 3086630 - RNA, 16 nt, Mycobacterium bovis subsp bovis AF2122/97
gcacaccaacaccgcg

SEQ ID NO: 3086631 - RNA, 18 nt, Mycobacterium bovis subsp bovis AF2122/97
gcacaccaacaccgcggc

SEQ ID NO: 3086632 - RNA, 11 nt, Mycobacterium bovis subsp bovis AF2122/97
gcacaccaccg

SEQ ID NO: 3086633 - RNA, 15 nt, Mycobacterium bovis subsp bovis AF2122/97
gcacacccaucaccg

SEQ ID NO: 3086634 - RNA, 16 nt, Mycobacterium bovis subsp bovis AF2122/97
gcacacccaucaccgc

SEQ ID NO: 3086635 - RNA, 19 nt, Mycobacterium bovis subsp bovis AF2122/97
gcacacccaucaccgccag

SEQ ID NO: 3086636 - RNA, 18 nt, Mycobacterium bovis subsp bovis AF2122/97
gcacacccccgucugcgu

SEQ ID NO: 3086637 - RNA, 22 nt, Mycobacterium bovis subsp bovis AF2122/97
gcacacccgcaaugaccgcgga

SEQ ID NO: 3086638 - RNA, 14 nt, Mycobacterium bovis subsp bovis AF2122/97
gcacacccgcaccg

SEQ ID NO: 3086639 - RNA, 15 nt, Mycobacterium bovis subsp bovis AF2122/97
gcacacccgcaccgg

SEQ ID NO: 3086640 - RNA, 16 nt, Mycobacterium bovis subsp bovis AF2122/97
gcacacccgguuggcc

SEQ ID NO: 3086641 - RNA, 23 nt, Mycobacterium bovis subsp bovis AF2122/97
gcacacccgucaugcccaccgcc

SEQ ID NO: 3086642 - RNA, 21 nt, Mycobacterium bovis subsp bovis AF2122/97
gcacacccuccacagcggcca

SEQ ID NO: 3086643 - RNA, 15 nt, Mycobacterium bovis subsp bovis AF2122/97
gcaccaacgccaccg

SEQ ID NO: 3086644 - RNA, 19 nt, Mycobacterium bovis subsp bovis AF2122/97
gcaccaacgccaccgucgc

SEQ ID NO: 3086645 - RNA, 16 nt, Mycobacterium bovis subsp bovis AF2122/97
gcaccaacgcgaucag

SEQ ID NO: 3086646 - RNA, 15 nt, Mycobacterium bovis subsp bovis AF2122/97
gcaccaagacgccac

SEQ ID NO: 3086647 - RNA, 16 nt, Mycobacterium bovis subsp bovis AF2122/97
gcaccaagacgccacc

SEQ ID NO: 3086648 - RNA, 19 nt, Mycobacterium bovis subsp bovis AF2122/97
gcaccaagcagcgaccagc

SEQ ID NO: 3086649 - RNA, 19 nt, Mycobacterium bovis subsp bovis AF2122/97
gcaccaaggccgugaugcc

SEQ ID NO: 3086650 - RNA, 20 nt, Mycobacterium bovis subsp bovis AF2122/97
gcaccaaggccgugaugcca

SEQ ID NO: 3086651 - RNA, 23 nt, Mycobacterium bovis subsp bovis AF2122/97
gcaccaagguacuugcgcaaccg

SEQ ID NO: 3086652 - RNA, 17 nt, Mycobacterium bovis subsp bovis AF2122/97
gcaccaaggucuucagg

SEQ ID NO: 3086653 - RNA, 16 nt, Mycobacterium bovis subsp bovis AF2122/97
gcaccaauaccgcacc

SEQ ID NO: 3086654 - RNA, 14 nt, Mycobacterium bovis subsp bovis AF2122/97
gcaccaaugcggug

SEQ ID NO: 3086655 - RNA, 22 nt, Mycobacterium bovis subsp bovis AF2122/97
gcaccacaaacaccccacacag

SEQ ID NO: 3086656 - RNA, 18 nt, Mycobacterium bovis subsp bovis AF2122/97
gcaccacaacgucggcac

SEQ ID NO: 3086657 - RNA, 17 nt, Mycobacterium bovis subsp bovis AF2122/97
gcaccacaauccacgca

SEQ ID NO: 3086658 - RNA, 12 nt, Mycobacterium bovis subsp bovis AF2122/97
gcaccacaucgg

SEQ ID NO: 3086659 - RNA, 19 nt, Mycobacterium bovis subsp bovis AF2122/97
gcaccacauuggcgaucag

SEQ ID NO: 3086660 - RNA, 23 nt, Mycobacterium bovis subsp bovis AF2122/97
gcaccaccaagguguggccuugc

SEQ ID NO: 3086661 - RNA, 15 nt, Mycobacterium bovis subsp bovis AF2122/97
gcaccaccacccgau

SEQ ID NO: 3086662 - RNA, 19 nt, Mycobacterium bovis subsp bovis AF2122/97
gcaccaccacccgauccac

SEQ ID NO: 3086663 - RNA, 20 nt, Mycobacterium bovis subsp bovis AF2122/97
gcaccaccacgugaucagau

SEQ ID NO: 3086664 - RNA, 17 nt, Mycobacterium bovis subsp bovis AF2122/97
gcaccaccccagcggcc

SEQ ID NO: 3086665 - RNA, 16 nt, Mycobacterium bovis subsp bovis AF2122/97
gcaccaccccgaggcc

SEQ ID NO: 3086666 - RNA, 21 nt, Mycobacterium bovis subsp bovis AF2122/97
gcaccaccccgaggccgaccu

SEQ ID NO: 3086667 - RNA, 23 nt, Mycobacterium bovis subsp bovis AF2122/97
gcaccaccccgaggccgaccucg

SEQ ID NO: 3086668 - RNA, 12 nt, Mycobacterium bovis subsp bovis AF2122/97
gcaccacccgau

SEQ ID NO: 3086669 - RNA, 13 nt, Mycobacterium bovis subsp bovis AF2122/97
gcaccacccgggc

SEQ ID NO: 3086670 - RNA, 14 nt, Mycobacterium bovis subsp bovis AF2122/97
gcaccacccgggcc

SEQ ID NO: 3086671 - RNA, 21 nt, Mycobacterium bovis subsp bovis AF2122/97
gcaccacccgggccucggcgc

SEQ ID NO: 3086672 - RNA, 14 nt, Mycobacterium bovis subsp bovis AF2122/97
gcaccaccgagccg

SEQ ID NO: 3086673 - RNA, 16 nt, Mycobacterium bovis subsp bovis AF2122/97
gcaccaccgagccgau

SEQ ID NO: 3086674 - RNA, 12 nt, Mycobacterium bovis subsp bovis AF2122/97
gcaccaccgccc

SEQ ID NO: 3086675 - RNA, 18 nt, Mycobacterium bovis subsp bovis AF2122/97
gcaccaccgccccgcgcc

SEQ ID NO: 3086676 - RNA, 17 nt, Mycobacterium bovis subsp bovis AF2122/97
gcaccaccgcgaccucg

SEQ ID NO: 3086677 - RNA, 19 nt, Mycobacterium bovis subsp bovis AF2122/97
gcaccaccgcgaccucgcg

SEQ ID NO: 3086678 - RNA, 12 nt, Mycobacterium bovis subsp bovis AF2122/97
gcaccaccggaa

SEQ ID NO: 3086679 - RNA, 14 nt, Mycobacterium bovis subsp bovis AF2122/97
gcaccaccggcccc

SEQ ID NO: 3086680 - RNA, 17 nt, Mycobacterium bovis subsp bovis AF2122/97
gcaccaccggcucccgg

SEQ ID NO: 3086681 - RNA, 19 nt, Mycobacterium bovis subsp bovis AF2122/97
gcaccaccgucucgccgcg

SEQ ID NO: 3086682 - RNA, 24 nt, Mycobacterium bovis subsp bovis AF2122/97
gcaccaccgucucgccgcgcaccg

SEQ ID NO: 3086683 - RNA, 14 nt, Mycobacterium bovis subsp bovis AF2122/97
gcaccacgaccgac

SEQ ID NO: 3086684 - RNA, 14 nt, Mycobacterium bovis subsp bovis AF2122/97
gcaccacgagcagc

SEQ ID NO: 3086685 - RNA, 17 nt, Mycobacterium bovis subsp bovis AF2122/97
gcaccacgagcagccga

SEQ ID NO: 3086686 - RNA, 18 nt, Mycobacterium bovis subsp bovis AF2122/97
gcaccacgagcagccgau

SEQ ID NO: 3086687 - RNA, 21 nt, Mycobacterium bovis subsp bovis AF2122/97
gcaccacgccagcccguccgg

SEQ ID NO: 3086688 - RNA, 13 nt, Mycobacterium bovis subsp bovis AF2122/97
gcaccacgcugug

SEQ ID NO: 3086689 - RNA, 16 nt, Mycobacterium bovis subsp bovis AF2122/97
gcaccacggcgcgcgc

SEQ ID NO: 3086690 - RNA, 20 nt, Mycobacterium bovis subsp bovis AF2122/97
gcaccacggcgcgcgcgccg

SEQ ID NO: 3086691 - RNA, 21 nt, Mycobacterium bovis subsp bovis AF2122/97
gcaccacggcgcgcgcgccgg

SEQ ID NO: 3086692 - RNA, 22 nt, Mycobacterium bovis subsp bovis AF2122/97
gcaccacggcgcgcgcgccggc

SEQ ID NO: 3086693 - RNA, 17 nt, Mycobacterium bovis subsp bovis AF2122/97
gcaccacggcggccacc

SEQ ID NO: 3086694 - RNA, 23 nt, Mycobacterium bovis subsp bovis AF2122/97
gcaccacgucgaccaauaccagu

SEQ ID NO: 3086695 - RNA, 20 nt, Mycobacterium bovis subsp bovis AF2122/97
gcaccagagugguguucucc

SEQ ID NO: 3086696 - RNA, 23 nt, Mycobacterium bovis subsp bovis AF2122/97
gcaccagauagaucgugaucgac

SEQ ID NO: 3086697 - RNA, 15 nt, Mycobacterium bovis subsp bovis AF2122/97
gcaccagaucgucgg

SEQ ID NO: 3086698 - RNA, 15 nt, Mycobacterium bovis subsp bovis AF2122/97
gcaccagcacacccg

SEQ ID NO: 3086699 - RNA, 17 nt, Mycobacterium bovis subsp bovis AF2122/97
gcaccagcacacccguc

SEQ ID NO: 3086700 - RNA, 13 nt, Mycobacterium bovis subsp bovis AF2122/97
gcaccagcaccgu

SEQ ID NO: 3086701 - RNA, 13 nt, Mycobacterium bovis subsp bovis AF2122/97
gcaccagcaccug

SEQ ID NO: 3086702 - RNA, 18 nt, Mycobacterium bovis subsp bovis AF2122/97
gcaccagcacggcaacca

SEQ ID NO: 3086703 - RNA, 21 nt, Mycobacterium bovis subsp bovis AF2122/97
gcaccagcacggcaaccagcg

SEQ ID NO: 3086704 - RNA, 15 nt, Mycobacterium bovis subsp bovis AF2122/97
gcaccagcagcacca

SEQ ID NO: 3086705 - RNA, 16 nt, Mycobacterium bovis subsp bovis AF2122/97
gcaccagcagcaccaa

SEQ ID NO: 3086706 - RNA, 18 nt, Mycobacterium bovis subsp bovis AF2122/97
gcaccagcagccagccca

SEQ ID NO: 3086707 - RNA, 22 nt, Mycobacterium bovis subsp bovis AF2122/97
gcaccagcauucucgccgacgg

SEQ ID NO: 3086708 - RNA, 13 nt, Mycobacterium bovis subsp bovis AF2122/97
gcaccagccagcc

SEQ ID NO: 3086709 - RNA, 19 nt, Mycobacterium bovis subsp bovis AF2122/97
gcaccagccagccugcugg

SEQ ID NO: 3086710 - RNA, 17 nt, Mycobacterium bovis subsp bovis AF2122/97
gcaccagcgaauccagc

SEQ ID NO: 3086711 - RNA, 20 nt, Mycobacterium bovis subsp bovis AF2122/97
gcaccagcgaauccagccgc

SEQ ID NO: 3086712 - RNA, 13 nt, Mycobacterium bovis subsp bovis AF2122/97
gcaccagcgacca

SEQ ID NO: 3086713 - RNA, 16 nt, Mycobacterium bovis subsp bovis AF2122/97
gcaccagcgaccaggu

SEQ ID NO: 3086714 - RNA, 19 nt, Mycobacterium bovis subsp bovis AF2122/97
gcaccagcgaccaggucgc

SEQ ID NO: 3086715 - RNA, 13 nt, Mycobacterium bovis subsp bovis AF2122/97
gcaccagcgaguu

SEQ ID NO: 3086716 - RNA, 21 nt, Mycobacterium bovis subsp bovis AF2122/97
gcaccagcgccuugaccagca

SEQ ID NO: 3086717 - RNA, 23 nt, Mycobacterium bovis subsp bovis AF2122/97
gcaccagcgccuugaccagcagc

SEQ ID NO: 3086718 - RNA, 16 nt, Mycobacterium bovis subsp bovis AF2122/97
gcaccagcgcgcgccg

SEQ ID NO: 3086719 - RNA, 18 nt, Mycobacterium bovis subsp bovis AF2122/97
gcaccagcgcgcgccgag

SEQ ID NO: 3086720 - RNA, 13 nt, Mycobacterium bovis subsp bovis AF2122/97
gcaccagcggcac

SEQ ID NO: 3086721 - RNA, 14 nt, Mycobacterium bovis subsp bovis AF2122/97
gcaccagcggcacc

SEQ ID NO: 3086722 - RNA, 19 nt, Mycobacterium bovis subsp bovis AF2122/97
gcaccagcggcaccgcggc

SEQ ID NO: 3086723 - RNA, 22 nt, Mycobacterium bovis subsp bovis AF2122/97
gcaccagcggcaccgcggccag

SEQ ID NO: 3086724 - RNA, 22 nt, Mycobacterium bovis subsp bovis AF2122/97
gcaccagcggcugaccgggcag

SEQ ID NO: 3086725 - RNA, 23 nt, Mycobacterium bovis subsp bovis AF2122/97
gcaccagcgggucggcggugccg

SEQ ID NO: 3086726 - RNA, 14 nt, Mycobacterium bovis subsp bovis AF2122/97
gcaccagcgucgcg

SEQ ID NO: 3086727 - RNA, 19 nt, Mycobacterium bovis subsp bovis AF2122/97
gcaccagcugcucgucguc

SEQ ID NO: 3086728 - RNA, 14 nt, Mycobacterium bovis subsp bovis AF2122/97
gcaccagcugucgg

SEQ ID NO: 3086729 - RNA, 17 nt, Mycobacterium bovis subsp bovis AF2122/97
gcacccgcacggccucc

SEQ ID NO: 3086730 - RNA, 13 nt, Mycobacterium bovis subsp bovis AF2122/97
gcacccgcacggu

SEQ ID NO: 3086731 - RNA, 12 nt, Mycobacterium bovis subsp bovis AF2122/97
gcacccgcagcc

SEQ ID NO: 3086732 - RNA, 17 nt, Mycobacterium bovis subsp bovis AF2122/97
gcacccgcagccgcgag

SEQ ID NO: 3086733 - RNA, 16 nt, Mycobacterium bovis subsp bovis AF2122/97
gcacccgcaguggucg

SEQ ID NO: 3086734 - RNA, 15 nt, Mycobacterium bovis subsp bovis AF2122/97
gcacccgccagggcg

SEQ ID NO: 3086735 - RNA, 20 nt, Mycobacterium bovis subsp bovis AF2122/97
gcacccgccgugcccccggc

SEQ ID NO: 3086736 - RNA, 13 nt, Mycobacterium bovis subsp bovis AF2122/97
gcacccgcggcga

SEQ ID NO: 3086737 - RNA, 23 nt, Mycobacterium bovis subsp bovis AF2122/97
gcacccgcgggucguccggcggc

SEQ ID NO: 3086738 - RNA, 17 nt, Mycobacterium bovis subsp bovis AF2122/97
gcacccgcuccagcucg

SEQ ID NO: 3086739 - RNA, 13 nt, Mycobacterium bovis subsp bovis AF2122/97
gcacccgcucccg

SEQ ID NO: 3086740 - RNA, 16 nt, Mycobacterium bovis subsp bovis AF2122/97
gcacccgcucggcgcg

SEQ ID NO: 3086741 - RNA, 20 nt, Mycobacterium bovis subsp bovis AF2122/97
gcacccgcucggcgcgcggg

SEQ ID NO: 3086742 - RNA, 21 nt, Mycobacterium bovis subsp bovis AF2122/97
gcacccgcucggcgcgcgggu

SEQ ID NO: 3086743 - RNA, 12 nt, Mycobacterium bovis subsp bovis AF2122/97
gcacccgcucgu

SEQ ID NO: 3086744 - RNA, 12 nt, Mycobacterium bovis subsp bovis AF2122/97
gcacccgcuggc

SEQ ID NO: 3086745 - RNA, 13 nt, Mycobacterium bovis subsp bovis AF2122/97
gcacccgcuggcg

SEQ ID NO: 3086746 - RNA, 13 nt, Mycobacterium bovis subsp bovis AF2122/97
gcacccgcugguc

SEQ ID NO: 3086747 - RNA, 16 nt, Mycobacterium bovis subsp bovis AF2122/97
gcacccgcuggucgag

SEQ ID NO: 3086748 - RNA, 19 nt, Mycobacterium bovis subsp bovis AF2122/97
gcacccgcuggucgagcag

SEQ ID NO: 3086749 - RNA, 21 nt, Mycobacterium bovis subsp bovis AF2122/97
gcacccggaucuggugggugc

SEQ ID NO: 3086750 - RNA, 23 nt, Mycobacterium bovis subsp bovis AF2122/97
gcacccggcagagcacgcgcggc

SEQ ID NO: 3086751 - RNA, 13 nt, Mycobacterium bovis subsp bovis AF2122/97
gcacccggccacc

SEQ ID NO: 3086752 - RNA, 17 nt, Mycobacterium bovis subsp bovis AF2122/97
gcacccggccaccggac

SEQ ID NO: 3086753 - RNA, 18 nt, Mycobacterium bovis subsp bovis AF2122/97
gcacccggccaccggacg

SEQ ID NO: 3086754 - RNA, 23 nt, Mycobacterium bovis subsp bovis AF2122/97
gcacccggccaccggacgaaacg

SEQ ID NO: 3086755 - RNA, 14 nt, Mycobacterium bovis subsp bovis AF2122/97
gcacccggccgcgc

SEQ ID NO: 3086756 - RNA, 15 nt, Mycobacterium bovis subsp bovis AF2122/97
gcacccggccgcgca

SEQ ID NO: 3086757 - RNA, 22 nt, Mycobacterium bovis subsp bovis AF2122/97
gcacccggcgauuggaccgcca

SEQ ID NO: 3086758 - RNA, 12 nt, Mycobacterium bovis subsp bovis AF2122/97
gcacccgggacg

SEQ ID NO: 3086759 - RNA, 18 nt, Mycobacterium bovis subsp bovis AF2122/97
gcacccgggccacgucga

SEQ ID NO: 3086760 - RNA, 14 nt, Mycobacterium bovis subsp bovis AF2122/97
gcacccgggccugg

SEQ ID NO: 3086761 - RNA, 17 nt, Mycobacterium bovis subsp bovis AF2122/97
gcacccgggccugggac

SEQ ID NO: 3086762 - RNA, 15 nt, Mycobacterium bovis subsp bovis AF2122/97
gcacccggggugccc

SEQ ID NO: 3086763 - RNA, 17 nt, Mycobacterium bovis subsp bovis AF2122/97
gcacccggggugcccgg

SEQ ID NO: 3086764 - RNA, 19 nt, Mycobacterium bovis subsp bovis AF2122/97
gcacccggggugcccggcc

SEQ ID NO: 3086765 - RNA, 23 nt, Mycobacterium bovis subsp bovis AF2122/97
gcacccggggugcccggccgcca

SEQ ID NO: 3086766 - RNA, 22 nt, Mycobacterium bovis subsp bovis AF2122/97
gcacccgggugcgcucuucucc

SEQ ID NO: 3086767 - RNA, 14 nt, Mycobacterium bovis subsp bovis AF2122/97
gcacccggucggcc

SEQ ID NO: 3086768 - RNA, 21 nt, Mycobacterium bovis subsp bovis AF2122/97
gcacccggugagaagaagccc

SEQ ID NO: 3086769 - RNA, 21 nt, Mycobacterium bovis subsp bovis AF2122/97
gcacccgguugugcgcgcgcc

SEQ ID NO: 3086770 - RNA, 22 nt, Mycobacterium bovis subsp bovis AF2122/97
gcacccgguugugcgcgcgccc

SEQ ID NO: 3086771 - RNA, 20 nt, Mycobacterium bovis subsp bovis AF2122/97
gcacccgucacaagcugaca

SEQ ID NO: 3086772 - RNA, 16 nt, Mycobacterium bovis subsp bovis AF2122/97
gcacccguccgccgca

SEQ ID NO: 3086773 - RNA, 19 nt, Mycobacterium bovis subsp bovis AF2122/97
gcacccguccgccgcagac

SEQ ID NO: 3086774 - RNA, 12 nt, Mycobacterium bovis subsp bovis AF2122/97
gcacccgucggg

SEQ ID NO: 3086775 - RNA, 18 nt, Mycobacterium bovis subsp bovis AF2122/97
gcacccguucgugagcgg

SEQ ID NO: 3086776 - RNA, 16 nt, Mycobacterium bovis subsp bovis AF2122/97
gcacccguugaucgcg

SEQ ID NO: 3086777 - RNA, 18 nt, Mycobacterium bovis subsp bovis AF2122/97
gcacccguugcgacaccu

SEQ ID NO: 3086778 - RNA, 13 nt, Mycobacterium bovis subsp bovis AF2122/97
gcacccucaggca

SEQ ID NO: 3086779 - RNA, 19 nt, Mycobacterium bovis subsp bovis AF2122/97
gcacccucaggcaaucgcg

SEQ ID NO: 3086780 - RNA, 23 nt, Mycobacterium bovis subsp bovis AF2122/97
gcacccucaggcaaucgcgggcg

SEQ ID NO: 3086781 - RNA, 15 nt, Mycobacterium bovis subsp bovis AF2122/97
gcacccugcggcacc

SEQ ID NO: 3086782 - RNA, 14 nt, Mycobacterium bovis subsp bovis AF2122/97
gcacccugcgggcc

SEQ ID NO: 3086783 - RNA, 24 nt, Mycobacterium bovis subsp bovis AF2122/97
gcacccugcgggccgagaucacgc

SEQ ID NO: 3086784 - RNA, 21 nt, Mycobacterium bovis subsp bovis AF2122/97
gcacccuggguauccaccgcg

SEQ ID NO: 3086785 - RNA, 22 nt, Mycobacterium bovis subsp bovis AF2122/97
gcacccuggguauccaccgcga

SEQ ID NO: 3086786 - RNA, 19 nt, Mycobacterium bovis subsp bovis AF2122/97
gcacccuugccgauuccgg

SEQ ID NO: 3086787 - RNA, 17 nt, Mycobacterium bovis subsp bovis AF2122/97
gcaccgaaaaacaccag

SEQ ID NO: 3086788 - RNA, 21 nt, Mycobacterium bovis subsp bovis AF2122/97
gcaccgaaaaacaccagcgag

SEQ ID NO: 3086789 - RNA, 18 nt, Mycobacterium bovis subsp bovis AF2122/97
gcaccgaaaccaugccgc

SEQ ID NO: 3086790 - RNA, 19 nt, Mycobacterium bovis subsp bovis AF2122/97
gcaccgaaaccaugccgcc

SEQ ID NO: 3086791 - RNA, 21 nt, Mycobacterium bovis subsp bovis AF2122/97
gcaccgaaaccaugccgccga

SEQ ID NO: 3086792 - RNA, 22 nt, Mycobacterium bovis subsp bovis AF2122/97
gcaccgaaaccaugccgccgaa

SEQ ID NO: 3086793 - RNA, 17 nt, Mycobacterium bovis subsp bovis AF2122/97
gcaccgaaacgccgacc

SEQ ID NO: 3086794 - RNA, 23 nt, Mycobacterium bovis subsp bovis AF2122/97
gcaccgaaacgccgaccuucggc

SEQ ID NO: 3086795 - RNA, 17 nt, Mycobacterium bovis subsp bovis AF2122/97
gcaccgaacccgccacc

SEQ ID NO: 3086796 - RNA, 18 nt, Mycobacterium bovis subsp bovis AF2122/97
gcaccgaacccgccaccg

SEQ ID NO: 3086797 - RNA, 19 nt, Mycobacterium bovis subsp bovis AF2122/97
gcaccgaacccgccaccgc

SEQ ID NO: 3086798 - RNA, 20 nt, Mycobacterium bovis subsp bovis AF2122/97
gcaccgaacccgccaccgcg

SEQ ID NO: 3086799 - RNA, 22 nt, Mycobacterium bovis subsp bovis AF2122/97
gcaccgaacguguucuggucgc

SEQ ID NO: 3086800 - RNA, 22 nt, Mycobacterium bovis subsp bovis AF2122/97
gcaccgaacuccuuaucgucga

SEQ ID NO: 3086801 - RNA, 18 nt, Mycobacterium bovis subsp bovis AF2122/97
gcaccgaagauggccagc

SEQ ID NO: 3086802 - RNA, 19 nt, Mycobacterium bovis subsp bovis AF2122/97
gcaccgaagauggccagcg

SEQ ID NO: 3086803 - RNA, 20 nt, Mycobacterium bovis subsp bovis AF2122/97
gcaccgaagauggccagcgc

SEQ ID NO: 3086804 - RNA, 23 nt, Mycobacterium bovis subsp bovis AF2122/97
gcaccgaagauggccagcgcggc

SEQ ID NO: 3086805 - RNA, 24 nt, Mycobacterium bovis subsp bovis AF2122/97
gcaccgaauuacgcaccgaggccg

SEQ ID NO: 3086806 - RNA, 15 nt, Mycobacterium bovis subsp bovis AF2122/97
gcaccgacaccggcc

SEQ ID NO: 3086807 - RNA, 17 nt, Mycobacterium bovis subsp bovis AF2122/97
gcaccgacaccggccgc

SEQ ID NO: 3086808 - RNA, 21 nt, Mycobacterium bovis subsp bovis AF2122/97
gcaccgacaccggccgcgacg

SEQ ID NO: 3086809 - RNA, 23 nt, Mycobacterium bovis subsp bovis AF2122/97
gcaccgacaccggccgcgacgga

SEQ ID NO: 3086810 - RNA, 14 nt, Mycobacterium bovis subsp bovis AF2122/97
gcaccgacaucguc

SEQ ID NO: 3086811 - RNA, 12 nt, Mycobacterium bovis subsp bovis AF2122/97
gcaccgaccgca

SEQ ID NO: 3086812 - RNA, 14 nt, Mycobacterium bovis subsp bovis AF2122/97
gcaccgaccgcacc

SEQ ID NO: 3086813 - RNA, 15 nt, Mycobacterium bovis subsp bovis AF2122/97
gcaccgaccgcaccg

SEQ ID NO: 3086814 - RNA, 20 nt, Mycobacterium bovis subsp bovis AF2122/97
gcaccgaccgcaccgugccg

SEQ ID NO: 3086815 - RNA, 15 nt, Mycobacterium bovis subsp bovis AF2122/97
gcaccgcuacgacca

SEQ ID NO: 3086816 - RNA, 21 nt, Mycobacterium bovis subsp bovis AF2122/97
gcaccgcugaccccggcagcg

SEQ ID NO: 3086817 - RNA, 14 nt, Mycobacterium bovis subsp bovis AF2122/97
gcaccgcugccgcu

SEQ ID NO: 3086818 - RNA, 17 nt, Mycobacterium bovis subsp bovis AF2122/97
gcaccgcugccgcugcc

SEQ ID NO: 3086819 - RNA, 18 nt, Mycobacterium bovis subsp bovis AF2122/97
gcaccgcuggcagcgacu

SEQ ID NO: 3086820 - RNA, 22 nt, Mycobacterium bovis subsp bovis AF2122/97
gcaccgcuguugcaucgccgcg

SEQ ID NO: 3086821 - RNA, 17 nt, Mycobacterium bovis subsp bovis AF2122/97
gcaccggagucgcccgg

SEQ ID NO: 3086822 - RNA, 21 nt, Mycobacterium bovis subsp bovis AF2122/97
gcaccggagucgcccgguccg

SEQ ID NO: 3086823 - RNA, 19 nt, Mycobacterium bovis subsp bovis AF2122/97
gcaccggagucggcgucga

SEQ ID NO: 3086824 - RNA, 17 nt, Mycobacterium bovis subsp bovis AF2122/97
gcaccggauacagccac

SEQ ID NO: 3086825 - RNA, 20 nt, Mycobacterium bovis subsp bovis AF2122/97
gcaccggauacagccacgca

SEQ ID NO: 3086826 - RNA, 22 nt, Mycobacterium bovis subsp bovis AF2122/97
gcaccggaucgaccaauucgac

SEQ ID NO: 3086827 - RNA, 15 nt, Mycobacterium bovis subsp bovis AF2122/97
gcaccggaucgccgu

SEQ ID NO: 3086828 - RNA, 19 nt, Mycobacterium bovis subsp bovis AF2122/97
gcaccggaucgccgucgcg

SEQ ID NO: 3086829 - RNA, 15 nt, Mycobacterium bovis subsp bovis AF2122/97
gcaccggaucggcua

SEQ ID NO: 3086830 - RNA, 21 nt, Mycobacterium bovis subsp bovis AF2122/97
gcaccggcaauaccggcaucg

SEQ ID NO: 3086831 - RNA, 12 nt, Mycobacterium bovis subsp bovis AF2122/97
gcaccggcaccc

SEQ ID NO: 3086832 - RNA, 19 nt, Mycobacterium bovis subsp bovis AF2122/97
gcaccggcacccgcacggc

SEQ ID NO: 3086833 - RNA, 14 nt, Mycobacterium bovis subsp bovis AF2122/97
gcaccggcaggcgg

SEQ ID NO: 3086834 - RNA, 20 nt, Mycobacterium bovis subsp bovis AF2122/97
gcaccggccgaaggcgcugc

SEQ ID NO: 3086835 - RNA, 13 nt, Mycobacterium bovis subsp bovis AF2122/97
gcaccggccgcua

SEQ ID NO: 3086836 - RNA, 14 nt, Mycobacterium bovis subsp bovis AF2122/97
gcaccggccgugcc

SEQ ID NO: 3086837 - RNA, 17 nt, Mycobacterium bovis subsp bovis AF2122/97
gcaccggccgugccgcc

SEQ ID NO: 3086838 - RNA, 19 nt, Mycobacterium bovis subsp bovis AF2122/97
gcaccggccgugccgccga

SEQ ID NO: 3086839 - RNA, 20 nt, Mycobacterium bovis subsp bovis AF2122/97
gcaccggccgugccgccgac

SEQ ID NO: 3086840 - RNA, 22 nt, Mycobacterium bovis subsp bovis AF2122/97
gcaccggccgugccgccgacac

SEQ ID NO: 3086841 - RNA, 13 nt, Mycobacterium bovis subsp bovis AF2122/97
gcaccggcgcggg

SEQ ID NO: 3086842 - RNA, 22 nt, Mycobacterium bovis subsp bovis AF2122/97
gcaccggcgcgggcacgcccuc

SEQ ID NO: 3086843 - RNA, 14 nt, Mycobacterium bovis subsp bovis AF2122/97
gcaccggcggcgac

SEQ ID NO: 3086844 - RNA, 15 nt, Mycobacterium bovis subsp bovis AF2122/97
gcaccggcggcgacg

SEQ ID NO: 3086845 - RNA, 19 nt, Mycobacterium bovis subsp bovis AF2122/97
gcaccggcggcgacggugc

SEQ ID NO: 3086846 - RNA, 23 nt, Mycobacterium bovis subsp bovis AF2122/97
gcaccggcggcgacggugccacc

SEQ ID NO: 3086847 - RNA, 14 nt, Mycobacterium bovis subsp bovis AF2122/97
gcaccggcggucug

SEQ ID NO: 3086848 - RNA, 14 nt, Mycobacterium bovis subsp bovis AF2122/97
gcaccggcgucggc

SEQ ID NO: 3086849 - RNA, 15 nt, Mycobacterium bovis subsp bovis AF2122/97
gcaccggcgucggcg

SEQ ID NO: 3086850 - RNA, 21 nt, Mycobacterium bovis subsp bovis AF2122/97
gcaccggcgugguagacggcc

SEQ ID NO: 3086851 - RNA, 17 nt, Mycobacterium bovis subsp bovis AF2122/97
gcaccggcugcggggcg

SEQ ID NO: 3086852 - RNA, 17 nt, Mycobacterium bovis subsp bovis AF2122/97
gcaccggcuggcccagc

SEQ ID NO: 3086853 - RNA, 22 nt, Mycobacterium bovis subsp bovis AF2122/97
gcaccggcuggcccagcgacca

SEQ ID NO: 3086854 - RNA, 16 nt, Mycobacterium bovis subsp bovis AF2122/97
gcaccggcuugggcca

SEQ ID NO: 3086855 - RNA, 21 nt, Mycobacterium bovis subsp bovis AF2122/97
gcaccggcuugggccaggccc

SEQ ID NO: 3086856 - RNA, 22 nt, Mycobacterium bovis subsp bovis AF2122/97
gcaccgggaagucggggucgcg

SEQ ID NO: 3086857 - RNA, 19 nt, Mycobacterium bovis subsp bovis AF2122/97
gcaccgggaugugcggcug

SEQ ID NO: 3086858 - RNA, 14 nt, Mycobacterium bovis subsp bovis AF2122/97
gcaccgggcucaga

SEQ ID NO: 3086859 - RNA, 13 nt, Mycobacterium bovis subsp bovis AF2122/97
gcaccggggcugc

SEQ ID NO: 3086860 - RNA, 15 nt, Mycobacterium bovis subsp bovis AF2122/97
gcaccggggcugccc

SEQ ID NO: 3086861 - RNA, 20 nt, Mycobacterium bovis subsp bovis AF2122/97
gcaccggggcugcccgcgga

SEQ ID NO: 3086862 - RNA, 18 nt, Mycobacterium bovis subsp bovis AF2122/97
gcaccggggugugcgggc

SEQ ID NO: 3086863 - RNA, 20 nt, Mycobacterium bovis subsp bovis AF2122/97
gcaccggggugugcgggcgg

SEQ ID NO: 3086864 - RNA, 18 nt, Mycobacterium bovis subsp bovis AF2122/97
gcaccggguugagccgcc

SEQ ID NO: 3086865 - RNA, 20 nt, Mycobacterium bovis subsp bovis AF2122/97
gcaccggguugagccgccgc

SEQ ID NO: 3086866 - RNA, 21 nt, Mycobacterium bovis subsp bovis AF2122/97
gcaccggguugagccgccgcg

SEQ ID NO: 3086867 - RNA, 22 nt, Mycobacterium bovis subsp bovis AF2122/97
gcaccggguugagccgccgcga

SEQ ID NO: 3086868 - RNA, 17 nt, Mycobacterium bovis subsp bovis AF2122/97
gcaccgguauguucggc

SEQ ID NO: 3086869 - RNA, 15 nt, Mycobacterium bovis subsp bovis AF2122/97
gcaccggugacgcac

SEQ ID NO: 3086870 - RNA, 18 nt, Mycobacterium bovis subsp bovis AF2122/97
gcaccggugacgcacagc

SEQ ID NO: 3086871 - RNA, 17 nt, Mycobacterium bovis subsp bovis AF2122/97
gcaccggugauggugac

SEQ ID NO: 3086872 - RNA, 20 nt, Mycobacterium bovis subsp bovis AF2122/97
gcaccggugcccaccaccga

SEQ ID NO: 3086873 - RNA, 23 nt, Mycobacterium bovis subsp bovis AF2122/97
gcaccggugcccaccaccgacag

SEQ ID NO: 3086874 - RNA, 12 nt, Mycobacterium bovis subsp bovis AF2122/97
gcaccggugcuc

SEQ ID NO: 3086875 - RNA, 17 nt, Mycobacterium bovis subsp bovis AF2122/97
gcaccggugcucgucga

SEQ ID NO: 3086876 - RNA, 20 nt, Mycobacterium bovis subsp bovis AF2122/97
gcaccguagagcaugccgcc

SEQ ID NO: 3086877 - RNA, 15 nt, Mycobacterium bovis subsp bovis AF2122/97
gcaccgucagaccau

SEQ ID NO: 3086878 - RNA, 18 nt, Mycobacterium bovis subsp bovis AF2122/97
gcaccgucagaccaucca

SEQ ID NO: 3086879 - RNA, 23 nt, Mycobacterium bovis subsp bovis AF2122/97
gcaccgucagcccgacguugcgu

SEQ ID NO: 3086880 - RNA, 14 nt, Mycobacterium bovis subsp bovis AF2122/97
gcaccgucccagug

SEQ ID NO: 3086881 - RNA, 18 nt, Mycobacterium bovis subsp bovis AF2122/97
gcaccgucccagugugcg

SEQ ID NO: 3086882 - RNA, 22 nt, Mycobacterium bovis subsp bovis AF2122/97
gcaccgucgcuaugcgccgcau

SEQ ID NO: 3086883 - RNA, 12 nt, Mycobacterium bovis subsp bovis AF2122/97
gcaccgucggca

SEQ ID NO: 3086884 - RNA, 20 nt, Mycobacterium bovis subsp bovis AF2122/97
gcaccgucggcaccagcagc

SEQ ID NO: 3086885 - RNA, 23 nt, Mycobacterium bovis subsp bovis AF2122/97
gcaccgucgggauggacggcagc

SEQ ID NO: 3086886 - RNA, 21 nt, Mycobacterium bovis subsp bovis AF2122/97
gcaccgucguuaagacggcga

SEQ ID NO: 3086887 - RNA, 17 nt, Mycobacterium bovis subsp bovis AF2122/97
gcaccgucucgcaccgc

SEQ ID NO: 3086888 - RNA, 19 nt, Mycobacterium bovis subsp bovis AF2122/97
gcaccgucucgcaccgcgu

SEQ ID NO: 3086889 - RNA, 17 nt, Mycobacterium bovis subsp bovis AF2122/97
gcaccgugacagcggca

SEQ ID NO: 3086890 - RNA, 18 nt, Mycobacterium bovis subsp bovis AF2122/97
gcaccgugacagcggcau

SEQ ID NO: 3086891 - RNA, 16 nt, Mycobacterium bovis subsp bovis AF2122/97
gcaccgugccgacgcc

SEQ ID NO: 3086892 - RNA, 17 nt, Mycobacterium bovis subsp bovis AF2122/97
gcaccgugccgacgccc

SEQ ID NO: 3086893 - RNA, 17 nt, Mycobacterium bovis subsp bovis AF2122/97
gcaccgugcggaucgcg

SEQ ID NO: 3086894 - RNA, 22 nt, Mycobacterium bovis subsp bovis AF2122/97
gcaccgugcggaucgcgcugcg

SEQ ID NO: 3086895 - RNA, 18 nt, Mycobacterium bovis subsp bovis AF2122/97
gcaccguggcggaucgcg

SEQ ID NO: 3086896 - RNA, 22 nt, Mycobacterium bovis subsp bovis AF2122/97
gcaccgugggcccuucacuguu

SEQ ID NO: 3086897 - RNA, 17 nt, Mycobacterium bovis subsp bovis AF2122/97
gcaccgugucgacgguc

SEQ ID NO: 3086898 - RNA, 20 nt, Mycobacterium bovis subsp bovis AF2122/97
gcaccgugucuacgccggga

SEQ ID NO: 3086899 - RNA, 17 nt, Mycobacterium bovis subsp bovis AF2122/97
gcaccgugugggccccg

SEQ ID NO: 3086900 - RNA, 18 nt, Mycobacterium bovis subsp bovis AF2122/97
gcaccgugugggccccgc

SEQ ID NO: 3086901 - RNA, 16 nt, Mycobacterium bovis subsp bovis AF2122/97
gcacgcagccgauaca

SEQ ID NO: 3086902 - RNA, 19 nt, Mycobacterium bovis subsp bovis AF2122/97
gcacgcaguucggucagcg

SEQ ID NO: 3086903 - RNA, 12 nt, Mycobacterium bovis subsp bovis AF2122/97
gcacgcaugccg

SEQ ID NO: 3086904 - RNA, 14 nt, Mycobacterium bovis subsp bovis AF2122/97
gcacgcaugccggu

SEQ ID NO: 3086905 - RNA, 16 nt, Mycobacterium bovis subsp bovis AF2122/97
gcacgccaccgggacg

SEQ ID NO: 3086906 - RNA, 17 nt, Mycobacterium bovis subsp bovis AF2122/97
gcacgccauaccggcug

SEQ ID NO: 3086907 - RNA, 19 nt, Mycobacterium bovis subsp bovis AF2122/97
gcacgcccaggcgaccgcu

SEQ ID NO: 3086908 - RNA, 12 nt, Mycobacterium bovis subsp bovis AF2122/97
gcacgcccggcg

SEQ ID NO: 3086909 - RNA, 20 nt, Mycobacterium bovis subsp bovis AF2122/97
gcacgcccucgacgcgcucg

SEQ ID NO: 3086910 - RNA, 21 nt, Mycobacterium bovis subsp bovis AF2122/97
gcacgcccucgacgcgcucgg

SEQ ID NO: 3086911 - RNA, 15 nt, Mycobacterium bovis subsp bovis AF2122/97
gcacgcccucgucga

SEQ ID NO: 3086912 - RNA, 17 nt, Mycobacterium bovis subsp bovis AF2122/97
gcacgccgaccaauucg

SEQ ID NO: 3086913 - RNA, 14 nt, Mycobacterium bovis subsp bovis AF2122/97
gcacgccgaccggc

SEQ ID NO: 3086914 - RNA, 19 nt, Mycobacterium bovis subsp bovis AF2122/97
gcacgccgaccggcccgca

SEQ ID NO: 3086915 - RNA, 22 nt, Mycobacterium bovis subsp bovis AF2122/97
gcacgccgaccggcccgcaucc

SEQ ID NO: 3086916 - RNA, 24 nt, Mycobacterium bovis subsp bovis AF2122/97
gcacgccgaccggcccgcauccgc

SEQ ID NO: 3086917 - RNA, 15 nt, Mycobacterium bovis subsp bovis AF2122/97
gcacgccgagcccgc

SEQ ID NO: 3086918 - RNA, 14 nt, Mycobacterium bovis subsp bovis AF2122/97
gcacgccgccgacg

SEQ ID NO: 3086919 - RNA, 12 nt, Mycobacterium bovis subsp bovis AF2122/97
gcacgccgccgg

SEQ ID NO: 3086920 - RNA, 15 nt, Mycobacterium bovis subsp bovis AF2122/97
gcacgccgccggccg

SEQ ID NO: 3086921 - RNA, 17 nt, Mycobacterium bovis subsp bovis AF2122/97
gcacgccgccggccgcc

SEQ ID NO: 3086922 - RNA, 16 nt, Mycobacterium bovis subsp bovis AF2122/97
gcacgccggcaugcca

SEQ ID NO: 3086923 - RNA, 18 nt, Mycobacterium bovis subsp bovis AF2122/97
gcacgccggcaugccagc

SEQ ID NO: 3086924 - RNA, 13 nt, Mycobacterium bovis subsp bovis AF2122/97
gcacgccggcgcu

SEQ ID NO: 3086925 - RNA, 14 nt, Mycobacterium bovis subsp bovis AF2122/97
gcacgccggcgcug

SEQ ID NO: 3086926 - RNA, 17 nt, Mycobacterium bovis subsp bovis AF2122/97
gcacgccggcgcuggag

SEQ ID NO: 3086927 - RNA, 12 nt, Mycobacterium bovis subsp bovis AF2122/97
gcacgccggcgg

SEQ ID NO: 3086928 - RNA, 15 nt, Mycobacterium bovis subsp bovis AF2122/97
gcacgccggcggcgg

SEQ ID NO: 3086929 - RNA, 12 nt, Mycobacterium bovis subsp bovis AF2122/97
gcacgccgggca

SEQ ID NO: 3086930 - RNA, 22 nt, Mycobacterium bovis subsp bovis AF2122/97
gcacgccguagcaucgggcgag

SEQ ID NO: 3086931 - RNA, 16 nt, Mycobacterium bovis subsp bovis AF2122/97
gcacgccuugagccga

SEQ ID NO: 3086932 - RNA, 20 nt, Mycobacterium bovis subsp bovis AF2122/97
gcacgccuugagccgaggcg

SEQ ID NO: 3086933 - RNA, 21 nt, Mycobacterium bovis subsp bovis AF2122/97
gcacgcgaaaugccugcgcga

SEQ ID NO: 3086934 - RNA, 22 nt, Mycobacterium bovis subsp bovis AF2122/97
gcacgcgaaaugccugcgcgau

SEQ ID NO: 3086935 - RNA, 22 nt, Mycobacterium bovis subsp bovis AF2122/97
gcacgcgaggcgcucacccgcc

SEQ ID NO: 3086936 - RNA, 19 nt, Mycobacterium bovis subsp bovis AF2122/97
gcacgcgcaguuuggcggc

SEQ ID NO: 3086937 - RNA, 21 nt, Mycobacterium bovis subsp bovis AF2122/97
gcacgcgcgcaggccgccgcc

SEQ ID NO: 3086938 - RNA, 22 nt, Mycobacterium bovis subsp bovis AF2122/97
gcacgcgcgcaggccgccgcca

SEQ ID NO: 3086939 - RNA, 14 nt, Mycobacterium bovis subsp bovis AF2122/97
gcacgcgcgcgacc

SEQ ID NO: 3086940 - RNA, 13 nt, Mycobacterium bovis subsp bovis AF2122/97
gcacgcgcucgcg

SEQ ID NO: 3086941 - RNA, 19 nt, Mycobacterium bovis subsp bovis AF2122/97
gcacgcggaaaggcuuccg

SEQ ID NO: 3086942 - RNA, 13 nt, Mycobacterium bovis subsp bovis AF2122/97
gcacgcggacaug

SEQ ID NO: 3086943 - RNA, 18 nt, Mycobacterium bovis subsp bovis AF2122/97
gcacgcgggaagugcacc

SEQ ID NO: 3086944 - RNA, 12 nt, Mycobacterium bovis subsp bovis AF2122/97
gcacgcgggcac

SEQ ID NO: 3086945 - RNA, 17 nt, Mycobacterium bovis subsp bovis AF2122/97
gcacgcgggcacuggug

SEQ ID NO: 3086946 - RNA, 18 nt, Mycobacterium bovis subsp bovis AF2122/97
gcacgcgguucaccacgu

SEQ ID NO: 3086947 - RNA, 22 nt, Mycobacterium bovis subsp bovis AF2122/97
gcacgcgguucaccacgucguc

SEQ ID NO: 3086948 - RNA, 23 nt, Mycobacterium bovis subsp bovis AF2122/97
gcacgcgguucaccacgucgucg

SEQ ID NO: 3086949 - RNA, 16 nt, Mycobacterium bovis subsp bovis AF2122/97
gcacgcgugccgcaac

SEQ ID NO: 3086950 - RNA, 16 nt, Mycobacterium bovis subsp bovis AF2122/97
gcacgcguucaacgaa

SEQ ID NO: 3086951 - RNA, 14 nt, Mycobacterium bovis subsp bovis AF2122/97
gcacgcuagccgac

SEQ ID NO: 3086952 - RNA, 18 nt, Mycobacterium bovis subsp bovis AF2122/97
gcacgcuagccgacagcu

SEQ ID NO: 3086953 - RNA, 16 nt, Mycobacterium bovis subsp bovis AF2122/97
gcacgcuccagcucgg

SEQ ID NO: 3086954 - RNA, 14 nt, Mycobacterium bovis subsp bovis AF2122/97
gcacgcucgcgcac

SEQ ID NO: 3086955 - RNA, 14 nt, Mycobacterium bovis subsp bovis AF2122/97
gcacgcucggcacg

SEQ ID NO: 3086956 - RNA, 14 nt, Mycobacterium bovis subsp bovis AF2122/97
gcacgcucugcgcc

SEQ ID NO: 3086957 - RNA, 18 nt, Mycobacterium bovis subsp bovis AF2122/97
gcacgcucugcgccacag

SEQ ID NO: 3086958 - RNA, 15 nt, Mycobacterium bovis subsp bovis AF2122/97
gcacgcugaccggau

SEQ ID NO: 3086959 - RNA, 21 nt, Mycobacterium bovis subsp bovis AF2122/97
gcacgcugagcguccgacaac

SEQ ID NO: 3086960 - RNA, 19 nt, Mycobacterium bovis subsp bovis AF2122/97
gcacgcugaguccccaggu

SEQ ID NO: 3086961 - RNA, 22 nt, Mycobacterium bovis subsp bovis AF2122/97
gcacgcugaguccccagguggg

SEQ ID NO: 3086962 - RNA, 23 nt, Mycobacterium bovis subsp bovis AF2122/97
gcacgcugaguccccaggugggc

SEQ ID NO: 3086963 - RNA, 15 nt, Mycobacterium bovis subsp bovis AF2122/97
gcacgcugcugcggg

SEQ ID NO: 3086964 - RNA, 16 nt, Mycobacterium bovis subsp bovis AF2122/97
gcacgcuggaacuugg

SEQ ID NO: 3086965 - RNA, 14 nt, Mycobacterium bovis subsp bovis AF2122/97
gcacgcuggcgggc

SEQ ID NO: 3086966 - RNA, 15 nt, Mycobacterium bovis subsp bovis AF2122/97
gcacgcuggcgggca

SEQ ID NO: 3086967 - RNA, 16 nt, Mycobacterium bovis subsp bovis AF2122/97
gcacgcuggcgggcac

SEQ ID NO: 3086968 - RNA, 22 nt, Mycobacterium bovis subsp bovis AF2122/97
gcacgcuggcgggcacucagca

SEQ ID NO: 3086969 - RNA, 12 nt, Mycobacterium bovis subsp bovis AF2122/97
gcacgcuggcgu

SEQ ID NO: 3086970 - RNA, 21 nt, Mycobacterium bovis subsp bovis AF2122/97
gcacggaaggcccggcgcggc

SEQ ID NO: 3086971 - RNA, 22 nt, Mycobacterium bovis subsp bovis AF2122/97
gcacggaaggcccggcgcggcc

SEQ ID NO: 3086972 - RNA, 20 nt, Mycobacterium bovis subsp bovis AF2122/97
gcacggaaggucgacauggg

SEQ ID NO: 3086973 - RNA, 20 nt, Mycobacterium bovis subsp bovis AF2122/97
gcacggaaguacuccaccca

SEQ ID NO: 3086974 - RNA, 23 nt, Mycobacterium bovis subsp bovis AF2122/97
gcacggaaucgcaucuagguuca

SEQ ID NO: 3086975 - RNA, 17 nt, Mycobacterium bovis subsp bovis AF2122/97
gcacggaccgcgucgcg

SEQ ID NO: 3086976 - RNA, 18 nt, Mycobacterium bovis subsp bovis AF2122/97
gcacggaccgcgucgcgg

SEQ ID NO: 3086977 - RNA, 14 nt, Mycobacterium bovis subsp bovis AF2122/97
gcacggagccgccg

SEQ ID NO: 3086978 - RNA, 15 nt, Mycobacterium bovis subsp bovis AF2122/97
gcacggagccgccgg

SEQ ID NO: 3086979 - RNA, 17 nt, Mycobacterium bovis subsp bovis AF2122/97
gcacggagccgccggcg

SEQ ID NO: 3086980 - RNA, 18 nt, Mycobacterium bovis subsp bovis AF2122/97
gcacggagccgccggcgg

SEQ ID NO: 3086981 - RNA, 20 nt, Mycobacterium bovis subsp bovis AF2122/97
gcacggaugaugccgguguu

SEQ ID NO: 3086982 - RNA, 19 nt, Mycobacterium bovis subsp bovis AF2122/97
gcacggaugcgauggccga

SEQ ID NO: 3086983 - RNA, 21 nt, Mycobacterium bovis subsp bovis AF2122/97
gcacggaugucgcccaaccga

SEQ ID NO: 3086984 - RNA, 21 nt, Mycobacterium bovis subsp bovis AF2122/97
gcacggauucaucacgggacg

SEQ ID NO: 3086985 - RNA, 21 nt, Mycobacterium bovis subsp bovis AF2122/97
gcacggauuuucgcaguccgg

SEQ ID NO: 3086986 - RNA, 18 nt, Mycobacterium bovis subsp bovis AF2122/97
gcacggcaaccagcgagc

SEQ ID NO: 3086987 - RNA, 19 nt, Mycobacterium bovis subsp bovis AF2122/97
gcacggcaaccagcgagcc

SEQ ID NO: 3086988 - RNA, 15 nt, Mycobacterium bovis subsp bovis AF2122/97
gcacguccgaucggc

SEQ ID NO: 3086989 - RNA, 22 nt, Mycobacterium bovis subsp bovis AF2122/97
gcacguccgaucggcgcgccga

SEQ ID NO: 3086990 - RNA, 19 nt, Mycobacterium bovis subsp bovis AF2122/97
gcacguccgcggagcucaa

SEQ ID NO: 3086991 - RNA, 16 nt, Mycobacterium bovis subsp bovis AF2122/97
gcacgucgaaaucggu

SEQ ID NO: 3086992 - RNA, 23 nt, Mycobacterium bovis subsp bovis AF2122/97
gcacgucgaaaucggugcacaac

SEQ ID NO: 3086993 - RNA, 14 nt, Mycobacterium bovis subsp bovis AF2122/97
gcacgucgaacucg

SEQ ID NO: 3086994 - RNA, 18 nt, Mycobacterium bovis subsp bovis AF2122/97
gcacgucgacccccugcc

SEQ ID NO: 3086995 - RNA, 14 nt, Mycobacterium bovis subsp bovis AF2122/97
gcacgucgaccucg

SEQ ID NO: 3086996 - RNA, 13 nt, Mycobacterium bovis subsp bovis AF2122/97
gcacgucgagcag

SEQ ID NO: 3086997 - RNA, 15 nt, Mycobacterium bovis subsp bovis AF2122/97
gcacgucgaggcggc

SEQ ID NO: 3086998 - RNA, 23 nt, Mycobacterium bovis subsp bovis AF2122/97
gcacgucggcccauaacagcugg

SEQ ID NO: 3086999 - RNA, 15 nt, Mycobacterium bovis subsp bovis AF2122/97
gcacgucggcgggcg

SEQ ID NO: 3087000 - RNA, 16 nt, Mycobacterium bovis subsp bovis AF2122/97
gcacgucggcugccgc

SEQ ID NO: 3087001 - RNA, 17 nt, Mycobacterium bovis subsp bovis AF2122/97
gcacgucgggcccgaug

SEQ ID NO: 3087002 - RNA, 14 nt, Mycobacterium bovis subsp bovis AF2122/97
gcacgucuugcugc

SEQ ID NO: 3087003 - RNA, 19 nt, Mycobacterium bovis subsp bovis AF2122/97
gcacgucuugcugcacgcu

SEQ ID NO: 3087004 - RNA, 24 nt, Mycobacterium bovis subsp bovis AF2122/97
gcacgucuugcugcacgcucugcg

SEQ ID NO: 3087005 - RNA, 15 nt, Mycobacterium bovis subsp bovis AF2122/97
gcacgugcacggcga

SEQ ID NO: 3087006 - RNA, 22 nt, Mycobacterium bovis subsp bovis AF2122/97
gcacgugccccaugcgcagguu

SEQ ID NO: 3087007 - RNA, 15 nt, Mycobacterium bovis subsp bovis AF2122/97
gcacguggccacggc

SEQ ID NO: 3087008 - RNA, 16 nt, Mycobacterium bovis subsp bovis AF2122/97
gcacguggccacggca

SEQ ID NO: 3087009 - RNA, 13 nt, Mycobacterium bovis subsp bovis AF2122/97
gcacguggcgacc

SEQ ID NO: 3087010 - RNA, 20 nt, Mycobacterium bovis subsp bovis AF2122/97
gcacguggcgaccggcgacc

SEQ ID NO: 3087011 - RNA, 20 nt, Mycobacterium bovis subsp bovis AF2122/97
gcacguggcgguacaccgac

SEQ ID NO: 3087012 - RNA, 20 nt, Mycobacterium bovis subsp bovis AF2122/97
gcacguucaccgcgcgcucg

SEQ ID NO: 3087013 - RNA, 23 nt, Mycobacterium bovis subsp bovis AF2122/97
gcacguucaccgcgcgcucgccc

SEQ ID NO: 3087014 - RNA, 20 nt, Mycobacterium bovis subsp bovis AF2122/97
gcacguucacgcgcggaucg

SEQ ID NO: 3087015 - RNA, 17 nt, Mycobacterium bovis subsp bovis AF2122/97
gcacguucagccaggcg

SEQ ID NO: 3087016 - RNA, 21 nt, Mycobacterium bovis subsp bovis AF2122/97
gcacguucagccaggcgugca

SEQ ID NO: 3087017 - RNA, 14 nt, Mycobacterium bovis subsp bovis AF2122/97
gcacguucggcgau

SEQ ID NO: 3087018 - RNA, 15 nt, Mycobacterium bovis subsp bovis AF2122/97
gcacguugauucggg

SEQ ID NO: 3087019 - RNA, 15 nt, Mycobacterium bovis subsp bovis AF2122/97
gcacguugccgaacg

SEQ ID NO: 3087020 - RNA, 14 nt, Mycobacterium bovis subsp bovis AF2122/97
gcacguuggcggcc

SEQ ID NO: 3087021 - RNA, 15 nt, Mycobacterium bovis subsp bovis AF2122/97
gcacguuggcggcca

SEQ ID NO: 3087022 - RNA, 23 nt, Mycobacterium bovis subsp bovis AF2122/97
gcacucagcaggggaucguccgg

SEQ ID NO: 3087023 - RNA, 23 nt, Mycobacterium bovis subsp bovis AF2122/97
gcacucaugaugccggacgccau

SEQ ID NO: 3087024 - RNA, 13 nt, Mycobacterium bovis subsp bovis AF2122/97
gcacuccaccgcu

SEQ ID NO: 3087025 - RNA, 16 nt, Mycobacterium bovis subsp bovis AF2122/97
gcacuccaccgcuggc

SEQ ID NO: 3087026 - RNA, 17 nt, Mycobacterium bovis subsp bovis AF2122/97
gcacuccaccgcuggcc

SEQ ID NO: 3087027 - RNA, 20 nt, Mycobacterium bovis subsp bovis AF2122/97
gcacuccaccgcuggcccgg

SEQ ID NO: 3087028 - RNA, 15 nt, Mycobacterium bovis subsp bovis AF2122/97
gcacuccacgaucgg

SEQ ID NO: 3087029 - RNA, 16 nt, Mycobacterium bovis subsp bovis AF2122/97
gcacuccacgaucggc

SEQ ID NO: 3087030 - RNA, 22 nt, Mycobacterium bovis subsp bovis AF2122/97
gcacuccacgaucggcccagcc

SEQ ID NO: 3087031 - RNA, 13 nt, Mycobacterium bovis subsp bovis AF2122/97
gcacuccagcggc

SEQ ID NO: 3087032 - RNA, 14 nt, Mycobacterium bovis subsp bovis AF2122/97
gcacuccagcggcg

SEQ ID NO: 3087033 - RNA, 20 nt, Mycobacterium bovis subsp bovis AF2122/97
gcacuccagcggcgggggcg

SEQ ID NO: 3087034 - RNA, 13 nt, Mycobacterium bovis subsp bovis AF2122/97
gcacucccgagcc

SEQ ID NO: 3087035 - RNA, 15 nt, Mycobacterium bovis subsp bovis AF2122/97
gcacucccgagccac

SEQ ID NO: 3087036 - RNA, 17 nt, Mycobacterium bovis subsp bovis AF2122/97
gcacucccggaguggcc

SEQ ID NO: 3087037 - RNA, 14 nt, Mycobacterium bovis subsp bovis AF2122/97
gcacucccggcucg

SEQ ID NO: 3087038 - RNA, 16 nt, Mycobacterium bovis subsp bovis AF2122/97
gcacucccggcucggc

SEQ ID NO: 3087039 - RNA, 19 nt, Mycobacterium bovis subsp bovis AF2122/97
gcacucccggcucggccag

SEQ ID NO: 3087040 - RNA, 13 nt, Mycobacterium bovis subsp bovis AF2122/97
gcacuccggcgac

SEQ ID NO: 3087041 - RNA, 14 nt, Mycobacterium bovis subsp bovis AF2122/97
gcacuccggcgacg

SEQ ID NO: 3087042 - RNA, 20 nt, Mycobacterium bovis subsp bovis AF2122/97
gcacuccggcgacgaucucg

SEQ ID NO: 3087043 - RNA, 21 nt, Mycobacterium bovis subsp bovis AF2122/97
gcacuccggcgacgaucucgc

SEQ ID NO: 3087044 - RNA, 22 nt, Mycobacterium bovis subsp bovis AF2122/97
gcacuccgggcucggcgucgcc

SEQ ID NO: 3087045 - RNA, 21 nt, Mycobacterium bovis subsp bovis AF2122/97
gcacucgaagaugucgucacc

SEQ ID NO: 3087046 - RNA, 21 nt, Mycobacterium bovis subsp bovis AF2122/97
gcacucgcccaagcgcagccu

SEQ ID NO: 3087047 - RNA, 15 nt, Mycobacterium bovis subsp bovis AF2122/97
gcacucggccacgac

SEQ ID NO: 3087048 - RNA, 12 nt, Mycobacterium bovis subsp bovis AF2122/97
gcacucggcccg

SEQ ID NO: 3087049 - RNA, 15 nt, Mycobacterium bovis subsp bovis AF2122/97
gcacucggcccggcc

SEQ ID NO: 3087050 - RNA, 20 nt, Mycobacterium bovis subsp bovis AF2122/97
gcacucgggauucggcagcg

SEQ ID NO: 3087051 - RNA, 20 nt, Mycobacterium bovis subsp bovis AF2122/97
gcacucggucgggggugcuc

SEQ ID NO: 3087052 - RNA, 19 nt, Mycobacterium bovis subsp bovis AF2122/97
gcacucguagaacgucugg

SEQ ID NO: 3087053 - RNA, 21 nt, Mycobacterium bovis subsp bovis AF2122/97
gcacucguugccgaccaugca

SEQ ID NO: 3087054 - RNA, 13 nt, Mycobacterium bovis subsp bovis AF2122/97
gcacugaacgucg

SEQ ID NO: 3087055 - RNA, 16 nt, Mycobacterium bovis subsp bovis AF2122/97
gcacugaccgcgauga

SEQ ID NO: 3087056 - RNA, 17 nt, Mycobacterium bovis subsp bovis AF2122/97
gcacugacgggccguca

SEQ ID NO: 3087057 - RNA, 13 nt, Mycobacterium bovis subsp bovis AF2122/97
gcacugaugucac

SEQ ID NO: 3087058 - RNA, 13 nt, Mycobacterium bovis subsp bovis AF2122/97
gcacugcccagca

SEQ ID NO: 3087059 - RNA, 17 nt, Mycobacterium bovis subsp bovis AF2122/97
gcacugcccagcagacc

SEQ ID NO: 3087060 - RNA, 14 nt, Mycobacterium bovis subsp bovis AF2122/97
gcacugccgagcac

SEQ ID NO: 3087061 - RNA, 13 nt, Mycobacterium bovis subsp bovis AF2122/97
gcacugccgccgg

SEQ ID NO: 3087062 - RNA, 14 nt, Mycobacterium bovis subsp bovis AF2122/97
gcacugccgccggu

SEQ ID NO: 3087063 - RNA, 24 nt, Mycobacterium bovis subsp bovis AF2122/97
gcacugccgccgguuccgccggcc

SEQ ID NO: 3087064 - RNA, 12 nt, Mycobacterium bovis subsp bovis AF2122/97
gcacugccggca

SEQ ID NO: 3087065 - RNA, 16 nt, Mycobacterium bovis subsp bovis AF2122/97
gcacugccgggugggc

SEQ ID NO: 3087066 - RNA, 13 nt, Mycobacterium bovis subsp bovis AF2122/97
gcacugcgaaccc

SEQ ID NO: 3087067 - RNA, 14 nt, Mycobacterium bovis subsp bovis AF2122/97
gcacugcgaacccu

SEQ ID NO: 3087068 - RNA, 16 nt, Mycobacterium bovis subsp bovis AF2122/97
gcacugcgaacccugc

SEQ ID NO: 3087069 - RNA, 13 nt, Mycobacterium bovis subsp bovis AF2122/97
gcacugcgaucgc

SEQ ID NO: 3087070 - RNA, 16 nt, Mycobacterium bovis subsp bovis AF2122/97
gcacugcgaucgcgac

SEQ ID NO: 3087071 - RNA, 12 nt, Mycobacterium bovis subsp bovis AF2122/97
gcacugcgccgg

SEQ ID NO: 3087072 - RNA, 13 nt, Mycobacterium bovis subsp bovis AF2122/97
gcacugcgccggc

SEQ ID NO: 3087073 - RNA, 14 nt, Mycobacterium bovis subsp bovis AF2122/97
gcacugcgcgugcu

SEQ ID NO: 3087074 - RNA, 16 nt, Mycobacterium bovis subsp bovis AF2122/97
gcacugcgcgugcucg

SEQ ID NO: 3087075 - RNA, 14 nt, Mycobacterium bovis subsp bovis AF2122/97
gcagaccgccaccg

SEQ ID NO: 3087076 - RNA, 15 nt, Mycobacterium bovis subsp bovis AF2122/97
gcagaccggcaucga

SEQ ID NO: 3087077 - RNA, 12 nt, Mycobacterium bovis subsp bovis AF2122/97
gcagaccgggug

SEQ ID NO: 3087078 - RNA, 13 nt, Mycobacterium bovis subsp bovis AF2122/97
gcagaccgggugg

SEQ ID NO: 3087079 - RNA, 19 nt, Mycobacterium bovis subsp bovis AF2122/97
gcagaccggugagcaccgg

SEQ ID NO: 3087080 - RNA, 17 nt, Mycobacterium bovis subsp bovis AF2122/97
gcagaccguccagcaac

SEQ ID NO: 3087081 - RNA, 18 nt, Mycobacterium bovis subsp bovis AF2122/97
gcagaccuguccggcaua

SEQ ID NO: 3087082 - RNA, 20 nt, Mycobacterium bovis subsp bovis AF2122/97
gcagacgacgaucagcccca

SEQ ID NO: 3087083 - RNA, 15 nt, Mycobacterium bovis subsp bovis AF2122/97
gcagacgcaaaagcc

SEQ ID NO: 3087084 - RNA, 19 nt, Mycobacterium bovis subsp bovis AF2122/97
gcagacgcaaaagcccccu

SEQ ID NO: 3087085 - RNA, 21 nt, Mycobacterium bovis subsp bovis AF2122/97
gcagacgcaaaagcccccuaa

SEQ ID NO: 3087086 - RNA, 18 nt, Mycobacterium bovis subsp bovis AF2122/97
gcagacgcaaaauccccu

SEQ ID NO: 3087087 - RNA, 20 nt, Mycobacterium bovis subsp bovis AF2122/97
gcagacgcagaagcccccaa

SEQ ID NO: 3087088 - RNA, 21 nt, Mycobacterium bovis subsp bovis AF2122/97
gcagacgcagaaucgcacgcg

SEQ ID NO: 3087089 - RNA, 20 nt, Mycobacterium bovis subsp bovis AF2122/97
gcagacgcagaaucgcauug

SEQ ID NO: 3087090 - RNA, 19 nt, Mycobacterium bovis subsp bovis AF2122/97
gcagacgcagaaucgccca

SEQ ID NO: 3087091 - RNA, 20 nt, Mycobacterium bovis subsp bovis AF2122/97
gcagacgcagaaucgcccaa

SEQ ID NO: 3087092 - RNA, 18 nt, Mycobacterium bovis subsp bovis AF2122/97
gcagacgcagaaucgccu

SEQ ID NO: 3087093 - RNA, 21 nt, Mycobacterium bovis subsp bovis AF2122/97
gcagacgcagccacgucucgc

SEQ ID NO: 3087094 - RNA, 19 nt, Mycobacterium bovis subsp bovis AF2122/97
gcagacgcauaagcccccg

SEQ ID NO: 3087095 - RNA, 14 nt, Mycobacterium bovis subsp bovis AF2122/97
gcagacgccgcguu

SEQ ID NO: 3087096 - RNA, 17 nt, Mycobacterium bovis subsp bovis AF2122/97
gcagacgccguagccgg

SEQ ID NO: 3087097 - RNA, 20 nt, Mycobacterium bovis subsp bovis AF2122/97
gcagacgcgaaagcacccca

SEQ ID NO: 3087098 - RNA, 21 nt, Mycobacterium bovis subsp bovis AF2122/97
gcagacgcgaaagcaccccaa

SEQ ID NO: 3087099 - RNA, 19 nt, Mycobacterium bovis subsp bovis AF2122/97
gcagacgcgaaaucccccg

SEQ ID NO: 3087100 - RNA, 20 nt, Mycobacterium bovis subsp bovis AF2122/97
gcagacgcgaaaucccccga

SEQ ID NO: 3087101 - RNA, 20 nt, Mycobacterium bovis subsp bovis AF2122/97
gcagacgcggaaucgcaucg

SEQ ID NO: 3087102 - RNA, 19 nt, Mycobacterium bovis subsp bovis AF2122/97
gcagacgcuaaagcccccg

SEQ ID NO: 3087103 - RNA, 17 nt, Mycobacterium bovis subsp bovis AF2122/97
gcagacggcugccacgc

SEQ ID NO: 3087104 - RNA, 13 nt, Mycobacterium bovis subsp bovis AF2122/97
gcagacucgaggu

SEQ ID NO: 3087105 - RNA, 15 nt, Mycobacterium bovis subsp bovis AF2122/97
gcagacucgccaccg

SEQ ID NO: 3087106 - RNA, 16 nt, Mycobacterium bovis subsp bovis AF2122/97
gcagacucgccaccgc

SEQ ID NO: 3087107 - RNA, 19 nt, Mycobacterium bovis subsp bovis AF2122/97
gcagacucgccaccgcggc

SEQ ID NO: 3087108 - RNA, 21 nt, Mycobacterium bovis subsp bovis AF2122/97
gcagacucgccaccgcggcga

SEQ ID NO: 3087109 - RNA, 14 nt, Mycobacterium bovis subsp bovis AF2122/97
gcagacucggcgau

SEQ ID NO: 3087110 - RNA, 19 nt, Mycobacterium bovis subsp bovis AF2122/97
gcagagaacuccgccacca

SEQ ID NO: 3087111 - RNA, 17 nt, Mycobacterium bovis subsp bovis AF2122/97
gcagagacaugccggcg

SEQ ID NO: 3087112 - RNA, 13 nt, Mycobacterium bovis subsp bovis AF2122/97
gcagagaccaagg

SEQ ID NO: 3087113 - RNA, 20 nt, Mycobacterium bovis subsp bovis AF2122/97
gcagagcacgcgcggcgucg

SEQ ID NO: 3087114 - RNA, 20 nt, Mycobacterium bovis subsp bovis AF2122/97
gcagagccaacucccgcggu

SEQ ID NO: 3087115 - RNA, 12 nt, Mycobacterium bovis subsp bovis AF2122/97
gcagagccccgg

SEQ ID NO: 3087116 - RNA, 18 nt, Mycobacterium bovis subsp bovis AF2122/97
gcagagcggcacgcacgc

SEQ ID NO: 3087117 - RNA, 19 nt, Mycobacterium bovis subsp bovis AF2122/97
gcagagcggcacgcacgcg

SEQ ID NO: 3087118 - RNA, 17 nt, Mycobacterium bovis subsp bovis AF2122/97
gcagagcguuccgcucg

SEQ ID NO: 3087119 - RNA, 12 nt, Mycobacterium bovis subsp bovis AF2122/97
gcagaggcggcu

SEQ ID NO: 3087120 - RNA, 16 nt, Mycobacterium bovis subsp bovis AF2122/97
gcagagucaacagaua

SEQ ID NO: 3087121 - RNA, 20 nt, Mycobacterium bovis subsp bovis AF2122/97
gcagagucgcacugcgccgg

SEQ ID NO: 3087122 - RNA, 21 nt, Mycobacterium bovis subsp bovis AF2122/97
gcagagucgcacugcgccggc

SEQ ID NO: 3087123 - RNA, 23 nt, Mycobacterium bovis subsp bovis AF2122/97
gcagagucgcacugcgccggccg

SEQ ID NO: 3087124 - RNA, 20 nt, Mycobacterium bovis subsp bovis AF2122/97
gcagauacuccgcgguuguu

SEQ ID NO: 3087125 - RNA, 16 nt, Mycobacterium bovis subsp bovis AF2122/97
gcagauacucggcgac

SEQ ID NO: 3087126 - RNA, 17 nt, Mycobacterium bovis subsp bovis AF2122/97
gcagauacuuguugaag

SEQ ID NO: 3087127 - RNA, 19 nt, Mycobacterium bovis subsp bovis AF2122/97
gcagauaugacggcagacc

SEQ ID NO: 3087128 - RNA, 14 nt, Mycobacterium bovis subsp bovis AF2122/97
gcagaucaccgcca

SEQ ID NO: 3087129 - RNA, 16 nt, Mycobacterium bovis subsp bovis AF2122/97
gcagaucaccgccagc

SEQ ID NO: 3087130 - RNA, 16 nt, Mycobacterium bovis subsp bovis AF2122/97
gcagaucacgggugug

SEQ ID NO: 3087131 - RNA, 19 nt, Mycobacterium bovis subsp bovis AF2122/97
gcagaucaggacgcgaucg

SEQ ID NO: 3087132 - RNA, 21 nt, Mycobacterium bovis subsp bovis AF2122/97
gcagaucaggacgcgaucggc

SEQ ID NO: 3087133 - RNA, 14 nt, Mycobacterium bovis subsp bovis AF2122/97
gcagaucagggugg

SEQ ID NO: 3087134 - RNA, 16 nt, Mycobacterium bovis subsp bovis AF2122/97
gcagauccaggcgucg

SEQ ID NO: 3087135 - RNA, 14 nt, Mycobacterium bovis subsp bovis AF2122/97
gcagauccccgcca

SEQ ID NO: 3087136 - RNA, 15 nt, Mycobacterium bovis subsp bovis AF2122/97
gcagauccccgccac

SEQ ID NO: 3087137 - RNA, 16 nt, Mycobacterium bovis subsp bovis AF2122/97
gcagauccccgccacc

SEQ ID NO: 3087138 - RNA, 17 nt, Mycobacterium bovis subsp bovis AF2122/97
gcagauccccgccaccg

SEQ ID NO: 3087139 - RNA, 20 nt, Mycobacterium bovis subsp bovis AF2122/97
gcagauccccgccaccgaac

SEQ ID NO: 3087140 - RNA, 20 nt, Mycobacterium bovis subsp bovis AF2122/97
gcagaucgaaaucagcccgc

SEQ ID NO: 3087141 - RNA, 22 nt, Mycobacterium bovis subsp bovis AF2122/97
gcagaucgaaaucagcccgcgc

SEQ ID NO: 3087142 - RNA, 18 nt, Mycobacterium bovis subsp bovis AF2122/97
gcagaucgauaccgucgu

SEQ ID NO: 3087143 - RNA, 12 nt, Mycobacterium bovis subsp bovis AF2122/97
gcagaucgcccc

SEQ ID NO: 3087144 - RNA, 15 nt, Mycobacterium bovis subsp bovis AF2122/97
gcagaucggccggau

SEQ ID NO: 3087145 - RNA, 18 nt, Mycobacterium bovis subsp bovis AF2122/97
gcagaucggcucaccgaa

SEQ ID NO: 3087146 - RNA, 20 nt, Mycobacterium bovis subsp bovis AF2122/97
gcagaucggcucaccgaacg

SEQ ID NO: 3087147 - RNA, 19 nt, Mycobacterium bovis subsp bovis AF2122/97
gcagaucguagugcgcgcc

SEQ ID NO: 3087148 - RNA, 19 nt, Mycobacterium bovis subsp bovis AF2122/97
gcagaucguccaccgccga

SEQ ID NO: 3087149 - RNA, 14 nt, Mycobacterium bovis subsp bovis AF2122/97
gcagaucucacgga

SEQ ID NO: 3087150 - RNA, 15 nt, Mycobacterium bovis subsp bovis AF2122/97
gcagaucucacggag

SEQ ID NO: 3087151 - RNA, 19 nt, Mycobacterium bovis subsp bovis AF2122/97
gcagaugaugccguucgga

SEQ ID NO: 3087152 - RNA, 23 nt, Mycobacterium bovis subsp bovis AF2122/97
gcagaugcggcugaauucggcga

SEQ ID NO: 3087153 - RNA, 20 nt, Mycobacterium bovis subsp bovis AF2122/97
gcagauggcauugcgcccac

SEQ ID NO: 3087154 - RNA, 23 nt, Mycobacterium bovis subsp bovis AF2122/97
gcagauggcauugcgcccaccga

SEQ ID NO: 3087155 - RNA, 20 nt, Mycobacterium bovis subsp bovis AF2122/97
gcagauggcgaggucgguga

SEQ ID NO: 3087156 - RNA, 21 nt, Mycobacterium bovis subsp bovis AF2122/97
gcagauggcgaggucggugag

SEQ ID NO: 3087157 - RNA, 13 nt, Mycobacterium bovis subsp bovis AF2122/97
gcagaugggccuc

SEQ ID NO: 3087158 - RNA, 17 nt, Mycobacterium bovis subsp bovis AF2122/97
gcagaugggccuccacc

SEQ ID NO: 3087159 - RNA, 13 nt, Mycobacterium bovis subsp bovis AF2122/97
gcagauggugguc

SEQ ID NO: 3087160 - RNA, 15 nt, Mycobacterium bovis subsp bovis AF2122/97
gcagauuccucuuca

SEQ ID NO: 3087161 - RNA, 16 nt, Mycobacterium bovis subsp bovis AF2122/97
gcagcagugccaccgg

SEQ ID NO: 3087162 - RNA, 13 nt, Mycobacterium bovis subsp bovis AF2122/97
gcagcagugccgu

SEQ ID NO: 3087163 - RNA, 22 nt, Mycobacterium bovis subsp bovis AF2122/97
gcagcagugcgaacucaucgug

SEQ ID NO: 3087164 - RNA, 15 nt, Mycobacterium bovis subsp bovis AF2122/97
gcagcaguuggucgc

SEQ ID NO: 3087165 - RNA, 16 nt, Mycobacterium bovis subsp bovis AF2122/97
gcagcaguuggucgcg

SEQ ID NO: 3087166 - RNA, 17 nt, Mycobacterium bovis subsp bovis AF2122/97
gcagcauaaagaggucg

SEQ ID NO: 3087167 - RNA, 14 nt, Mycobacterium bovis subsp bovis AF2122/97
gcagcauauccgcc

SEQ ID NO: 3087168 - RNA, 15 nt, Mycobacterium bovis subsp bovis AF2122/97
gcagcaucaacaccg

SEQ ID NO: 3087169 - RNA, 18 nt, Mycobacterium bovis subsp bovis AF2122/97
gcagcaucacguccgcgg

SEQ ID NO: 3087170 - RNA, 21 nt, Mycobacterium bovis subsp bovis AF2122/97
gcagcauccccgcagcgucca

SEQ ID NO: 3087171 - RNA, 20 nt, Mycobacterium bovis subsp bovis AF2122/97
gcagcaucggcaccccggcc

SEQ ID NO: 3087172 - RNA, 23 nt, Mycobacterium bovis subsp bovis AF2122/97
gcagcaucggcacgucguugggc

SEQ ID NO: 3087173 - RNA, 16 nt, Mycobacterium bovis subsp bovis AF2122/97
gcagcaucggcgacag

SEQ ID NO: 3087174 - RNA, 19 nt, Mycobacterium bovis subsp bovis AF2122/97
gcagcaucggucacaccga

SEQ ID NO: 3087175 - RNA, 14 nt, Mycobacterium bovis subsp bovis AF2122/97
gcagcaucgucgcc

SEQ ID NO: 3087176 - RNA, 18 nt, Mycobacterium bovis subsp bovis AF2122/97
gcagcaucgucgccacga

SEQ ID NO: 3087177 - RNA, 15 nt, Mycobacterium bovis subsp bovis AF2122/97
gcagcaucuccgccg

SEQ ID NO: 3087178 - RNA, 17 nt, Mycobacterium bovis subsp bovis AF2122/97
gcagcaucuccgucggc

SEQ ID NO: 3087179 - RNA, 21 nt, Mycobacterium bovis subsp bovis AF2122/97
gcagcaucuccgucggccagg

SEQ ID NO: 3087180 - RNA, 22 nt, Mycobacterium bovis subsp bovis AF2122/97
gcagcaucuccgucggccaggc

SEQ ID NO: 3087181 - RNA, 15 nt, Mycobacterium bovis subsp bovis AF2122/97
gcagcaucucgucga

SEQ ID NO: 3087182 - RNA, 19 nt, Mycobacterium bovis subsp bovis AF2122/97
gcagcauggugcggcggcg

SEQ ID NO: 3087183 - RNA, 20 nt, Mycobacterium bovis subsp bovis AF2122/97
gcagcauggugcggcggcgu

SEQ ID NO: 3087184 - RNA, 16 nt, Mycobacterium bovis subsp bovis AF2122/97
gcagcauguccgcagc

SEQ ID NO: 3087185 - RNA, 18 nt, Mycobacterium bovis subsp bovis AF2122/97
gcagcauguccgcagcgg

SEQ ID NO: 3087186 - RNA, 21 nt, Mycobacterium bovis subsp bovis AF2122/97
gcagcauguccgcagcggugc

SEQ ID NO: 3087187 - RNA, 17 nt, Mycobacterium bovis subsp bovis AF2122/97
gcagcauguggccgccg

SEQ ID NO: 3087188 - RNA, 18 nt, Mycobacterium bovis subsp bovis AF2122/97
gcagcauguggccgccgu

SEQ ID NO: 3087189 - RNA, 21 nt, Mycobacterium bovis subsp bovis AF2122/97
gcagccaaaaacgcugccgcc

SEQ ID NO: 3087190 - RNA, 23 nt, Mycobacterium bovis subsp bovis AF2122/97
gcagccaaaaacgcugccgccgu

SEQ ID NO: 3087191 - RNA, 15 nt, Mycobacterium bovis subsp bovis AF2122/97
gcagccaaccggcgc

SEQ ID NO: 3087192 - RNA, 16 nt, Mycobacterium bovis subsp bovis AF2122/97
gcagccaaccggcgca

SEQ ID NO: 3087193 - RNA, 21 nt, Mycobacterium bovis subsp bovis AF2122/97
gcagccacauacaggcccgcc

SEQ ID NO: 3087194 - RNA, 13 nt, Mycobacterium bovis subsp bovis AF2122/97
gcagccaccagcg

SEQ ID NO: 3087195 - RNA, 19 nt, Mycobacterium bovis subsp bovis AF2122/97
gcagccaccagcgacgacc

SEQ ID NO: 3087196 - RNA, 14 nt, Mycobacterium bovis subsp bovis AF2122/97
gcagccacccgaca

SEQ ID NO: 3087197 - RNA, 15 nt, Mycobacterium bovis subsp bovis AF2122/97
gcagccacgauccuu

SEQ ID NO: 3087198 - RNA, 19 nt, Mycobacterium bovis subsp bovis AF2122/97
gcagccacguagacaaggc

SEQ ID NO: 3087199 - RNA, 20 nt, Mycobacterium bovis subsp bovis AF2122/97
gcagccacguagacaaggcc

SEQ ID NO: 3087200 - RNA, 17 nt, Mycobacterium bovis subsp bovis AF2122/97
gcagccacgucucgcga

SEQ ID NO: 3087201 - RNA, 15 nt, Mycobacterium bovis subsp bovis AF2122/97
gcagccacguuacgc

SEQ ID NO: 3087202 - RNA, 19 nt, Mycobacterium bovis subsp bovis AF2122/97
gcagccacguuacgcucgc

SEQ ID NO: 3087203 - RNA, 20 nt, Mycobacterium bovis subsp bovis AF2122/97
gcagccacguuacgcucgcg

SEQ ID NO: 3087204 - RNA, 16 nt, Mycobacterium bovis subsp bovis AF2122/97
gcagccagaucuccag

SEQ ID NO: 3087205 - RNA, 12 nt, Mycobacterium bovis subsp bovis AF2122/97
gcagccagcaac

SEQ ID NO: 3087206 - RNA, 18 nt, Mycobacterium bovis subsp bovis AF2122/97
gcagccagcaacaccaga

SEQ ID NO: 3087207 - RNA, 14 nt, Mycobacterium bovis subsp bovis AF2122/97
gcagccagcccagc

SEQ ID NO: 3087208 - RNA, 15 nt, Mycobacterium bovis subsp bovis AF2122/97
gcagccagcccagcc

SEQ ID NO: 3087209 - RNA, 16 nt, Mycobacterium bovis subsp bovis AF2122/97
gcagccagcggcgaag

SEQ ID NO: 3087210 - RNA, 21 nt, Mycobacterium bovis subsp bovis AF2122/97
gcagccagcguccauggucgc

SEQ ID NO: 3087211 - RNA, 17 nt, Mycobacterium bovis subsp bovis AF2122/97
gcagccagcugaacacg

SEQ ID NO: 3087212 - RNA, 13 nt, Mycobacterium bovis subsp bovis AF2122/97
gcagccaggcacg

SEQ ID NO: 3087213 - RNA, 14 nt, Mycobacterium bovis subsp bovis AF2122/97
gcagccaggcugcg

SEQ ID NO: 3087214 - RNA, 16 nt, Mycobacterium bovis subsp bovis AF2122/97
gcagccaggcugcgga

SEQ ID NO: 3087215 - RNA, 18 nt, Mycobacterium bovis subsp bovis AF2122/97
gcagccaggcugcggaua

SEQ ID NO: 3087216 - RNA, 15 nt, Mycobacterium bovis subsp bovis AF2122/97
gcagccagggcgccg

SEQ ID NO: 3087217 - RNA, 18 nt, Mycobacterium bovis subsp bovis AF2122/97
gcagccaggugucgucga

SEQ ID NO: 3087218 - RNA, 21 nt, Mycobacterium bovis subsp bovis AF2122/97
gcagcccaaagcgccagcagc

SEQ ID NO: 3087219 - RNA, 22 nt, Mycobacterium bovis subsp bovis AF2122/97
gcagcccaaagcgccagcagcc

SEQ ID NO: 3087220 - RNA, 15 nt, Mycobacterium bovis subsp bovis AF2122/97
gcagcccaugggcga

SEQ ID NO: 3087221 - RNA, 17 nt, Mycobacterium bovis subsp bovis AF2122/97
gcagccccugccgaucc

SEQ ID NO: 3087222 - RNA, 19 nt, Mycobacterium bovis subsp bovis AF2122/97
gcagcccgcacccacuuuc

SEQ ID NO: 3087223 - RNA, 13 nt, Mycobacterium bovis subsp bovis AF2122/97
gcagcccgccgga

SEQ ID NO: 3087224 - RNA, 13 nt, Mycobacterium bovis subsp bovis AF2122/97
gcagcccgccggg

SEQ ID NO: 3087225 - RNA, 18 nt, Mycobacterium bovis subsp bovis AF2122/97
gcagcccgcgaguauggg

SEQ ID NO: 3087226 - RNA, 16 nt, Mycobacterium bovis subsp bovis AF2122/97
gcagcccgcggaucac

SEQ ID NO: 3087227 - RNA, 14 nt, Mycobacterium bovis subsp bovis AF2122/97
gcagcccgcuggcc

SEQ ID NO: 3087228 - RNA, 23 nt, Mycobacterium bovis subsp bovis AF2122/97
gcagcccggcgaauacgaccguc

SEQ ID NO: 3087229 - RNA, 15 nt, Mycobacterium bovis subsp bovis AF2122/97
gcagcccgggcagca

SEQ ID NO: 3087230 - RNA, 18 nt, Mycobacterium bovis subsp bovis AF2122/97
gcagcccgggcagcacca

SEQ ID NO: 3087231 - RNA, 16 nt, Mycobacterium bovis subsp bovis AF2122/97
gcagcccgggcagccc

SEQ ID NO: 3087232 - RNA, 20 nt, Mycobacterium bovis subsp bovis AF2122/97
gcagcccgggcagccccucc

SEQ ID NO: 3087233 - RNA, 19 nt, Mycobacterium bovis subsp bovis AF2122/97
gcagcccgguggugcuguc

SEQ ID NO: 3087234 - RNA, 16 nt, Mycobacterium bovis subsp bovis AF2122/97
gcagcccgucggaccc

SEQ ID NO: 3087235 - RNA, 16 nt, Mycobacterium bovis subsp bovis AF2122/97
gcagcccgucggcgcc

SEQ ID NO: 3087236 - RNA, 13 nt, Mycobacterium bovis subsp bovis AF2122/97
gcagcccugcgca

SEQ ID NO: 3087237 - RNA, 15 nt, Mycobacterium bovis subsp bovis AF2122/97
gcagcccugcgcagc

SEQ ID NO: 3087238 - RNA, 12 nt, Mycobacterium bovis subsp bovis AF2122/97
gcagccgaaccg

SEQ ID NO: 3087239 - RNA, 14 nt, Mycobacterium bovis subsp bovis AF2122/97
gcagccgaaccggc

SEQ ID NO: 3087240 - RNA, 17 nt, Mycobacterium bovis subsp bovis AF2122/97
gcagccgaaccggcacc

SEQ ID NO: 3087241 - RNA, 20 nt, Mycobacterium bovis subsp bovis AF2122/97
gcagccgaaccggcaccagc

SEQ ID NO: 3087242 - RNA, 21 nt, Mycobacterium bovis subsp bovis AF2122/97
gcagccgaaccggcaccagcg

SEQ ID NO: 3087243 - RNA, 19 nt, Mycobacterium bovis subsp bovis AF2122/97
gcagccgaaguggcgccuu

SEQ ID NO: 3087244 - RNA, 13 nt, Mycobacterium bovis subsp bovis AF2122/97
gcagccgaccgaa

SEQ ID NO: 3087245 - RNA, 23 nt, Mycobacterium bovis subsp bovis AF2122/97
gcagccgaccgaaucagcacggu

SEQ ID NO: 3087246 - RNA, 21 nt, Mycobacterium bovis subsp bovis AF2122/97
gcagccgauacaggccacgca

SEQ ID NO: 3087247 - RNA, 14 nt, Mycobacterium bovis subsp bovis AF2122/97
gcagccgaugcucg

SEQ ID NO: 3087248 - RNA, 16 nt, Mycobacterium bovis subsp bovis AF2122/97
gcagcgccgacagccg

SEQ ID NO: 3087249 - RNA, 22 nt, Mycobacterium bovis subsp bovis AF2122/97
gcagcgccgacagccgauccga

SEQ ID NO: 3087250 - RNA, 14 nt, Mycobacterium bovis subsp bovis AF2122/97
gcagcgccgccacc

SEQ ID NO: 3087251 - RNA, 21 nt, Mycobacterium bovis subsp bovis AF2122/97
gcagcgccgcguggcuggcgg

SEQ ID NO: 3087252 - RNA, 14 nt, Mycobacterium bovis subsp bovis AF2122/97
gcagcgccggcacc

SEQ ID NO: 3087253 - RNA, 15 nt, Mycobacterium bovis subsp bovis AF2122/97
gcagcgccggcaccg

SEQ ID NO: 3087254 - RNA, 13 nt, Mycobacterium bovis subsp bovis AF2122/97
gcagcgccggucg

SEQ ID NO: 3087255 - RNA, 14 nt, Mycobacterium bovis subsp bovis AF2122/97
gcagcgccgucagc

SEQ ID NO: 3087256 - RNA, 20 nt, Mycobacterium bovis subsp bovis AF2122/97
gcagcgccuaccagcaccgg

SEQ ID NO: 3087257 - RNA, 23 nt, Mycobacterium bovis subsp bovis AF2122/97
gcagcgccuaccagcaccgggau

SEQ ID NO: 3087258 - RNA, 14 nt, Mycobacterium bovis subsp bovis AF2122/97
gcagcgccugcggc

SEQ ID NO: 3087259 - RNA, 17 nt, Mycobacterium bovis subsp bovis AF2122/97
gcagcgccugcggcagc

SEQ ID NO: 3087260 - RNA, 20 nt, Mycobacterium bovis subsp bovis AF2122/97
gcagcgccugcggcagcacc

SEQ ID NO: 3087261 - RNA, 18 nt, Mycobacterium bovis subsp bovis AF2122/97
gcagcgcgaaggucagcg

SEQ ID NO: 3087262 - RNA, 19 nt, Mycobacterium bovis subsp bovis AF2122/97
gcagcgcgaaggucagcga

SEQ ID NO: 3087263 - RNA, 13 nt, Mycobacterium bovis subsp bovis AF2122/97
gcagcgcgaggcu

SEQ ID NO: 3087264 - RNA, 15 nt, Mycobacterium bovis subsp bovis AF2122/97
gcagcgcgaggcucg

SEQ ID NO: 3087265 - RNA, 16 nt, Mycobacterium bovis subsp bovis AF2122/97
gcagcgcgaucaccga

SEQ ID NO: 3087266 - RNA, 14 nt, Mycobacterium bovis subsp bovis AF2122/97
gcagcgcgaucgcg

SEQ ID NO: 3087267 - RNA, 14 nt, Mycobacterium bovis subsp bovis AF2122/97
gcagcgcgaucugc

SEQ ID NO: 3087268 - RNA, 13 nt, Mycobacterium bovis subsp bovis AF2122/97
gcagcgcgauggc

SEQ ID NO: 3087269 - RNA, 15 nt, Mycobacterium bovis subsp bovis AF2122/97
gcagcgcgaugucgc

SEQ ID NO: 3087270 - RNA, 19 nt, Mycobacterium bovis subsp bovis AF2122/97
gcagcgcgaugucgccggc

SEQ ID NO: 3087271 - RNA, 20 nt, Mycobacterium bovis subsp bovis AF2122/97
gcagcgcgaugucgccggcg

SEQ ID NO: 3087272 - RNA, 22 nt, Mycobacterium bovis subsp bovis AF2122/97
gcagcgcgaugucgccggcgac

SEQ ID NO: 3087273 - RNA, 12 nt, Mycobacterium bovis subsp bovis AF2122/97
gcagcgcgcccg

SEQ ID NO: 3087274 - RNA, 13 nt, Mycobacterium bovis subsp bovis AF2122/97
gcagcgcgcccga

SEQ ID NO: 3087275 - RNA, 18 nt, Mycobacterium bovis subsp bovis AF2122/97
gcagcgcgcccgacaccc

SEQ ID NO: 3087276 - RNA, 13 nt, Mycobacterium bovis subsp bovis AF2122/97
gcagcgcgcccug

SEQ ID NO: 3087277 - RNA, 18 nt, Mycobacterium bovis subsp bovis AF2122/97
gcagcgcgcccugcgcgu

SEQ ID NO: 3087278 - RNA, 18 nt, Mycobacterium bovis subsp bovis AF2122/97
gcagcgcgccguucgccu

SEQ ID NO: 3087279 - RNA, 16 nt, Mycobacterium bovis subsp bovis AF2122/97
gcagcgcggauucggu

SEQ ID NO: 3087280 - RNA, 20 nt, Mycobacterium bovis subsp bovis AF2122/97
gcagcgcggccacccgcgac

SEQ ID NO: 3087281 - RNA, 17 nt, Mycobacterium bovis subsp bovis AF2122/97
gcagcgcggccagagcc

SEQ ID NO: 3087282 - RNA, 21 nt, Mycobacterium bovis subsp bovis AF2122/97
gcagcgcggccagagccgcgc

SEQ ID NO: 3087283 - RNA, 12 nt, Mycobacterium bovis subsp bovis AF2122/97
gcagcgcggccg

SEQ ID NO: 3087284 - RNA, 13 nt, Mycobacterium bovis subsp bovis AF2122/97
gcagcgcggccgg

SEQ ID NO: 3087285 - RNA, 16 nt, Mycobacterium bovis subsp bovis AF2122/97
gcagcgcggccgggcg

SEQ ID NO: 3087286 - RNA, 20 nt, Mycobacterium bovis subsp bovis AF2122/97
gcagcgcggcuggggccccg

SEQ ID NO: 3087287 - RNA, 15 nt, Mycobacterium bovis subsp bovis AF2122/97
gcagcgcgggaucug

SEQ ID NO: 3087288 - RNA, 15 nt, Mycobacterium bovis subsp bovis AF2122/97
gcagcgcgucgccga

SEQ ID NO: 3087289 - RNA, 18 nt, Mycobacterium bovis subsp bovis AF2122/97
gcagcgcguucggcaccu

SEQ ID NO: 3087290 - RNA, 15 nt, Mycobacterium bovis subsp bovis AF2122/97
gcagcgcucguuccg

SEQ ID NO: 3087291 - RNA, 19 nt, Mycobacterium bovis subsp bovis AF2122/97
gcagcgcucguuccggcgg

SEQ ID NO: 3087292 - RNA, 20 nt, Mycobacterium bovis subsp bovis AF2122/97
gcagcgcucguuccggcggu

SEQ ID NO: 3087293 - RNA, 12 nt, Mycobacterium bovis subsp bovis AF2122/97
gcagcgcuggcu

SEQ ID NO: 3087294 - RNA, 18 nt, Mycobacterium bovis subsp bovis AF2122/97
gcagcgcuucggcggucg

SEQ ID NO: 3087295 - RNA, 21 nt, Mycobacterium bovis subsp bovis AF2122/97
gcagcgcuucggcggucgccg

SEQ ID NO: 3087296 - RNA, 20 nt, Mycobacterium bovis subsp bovis AF2122/97
gcagcggaccgcugccugcc

SEQ ID NO: 3087297 - RNA, 18 nt, Mycobacterium bovis subsp bovis AF2122/97
gcagcggcaucggccagc

SEQ ID NO: 3087298 - RNA, 16 nt, Mycobacterium bovis subsp bovis AF2122/97
gcagcggccagcccag

SEQ ID NO: 3087299 - RNA, 18 nt, Mycobacterium bovis subsp bovis AF2122/97
gcagcggccagcccagcc

SEQ ID NO: 3087300 - RNA, 20 nt, Mycobacterium bovis subsp bovis AF2122/97
gcagcggccagggcacccau

SEQ ID NO: 3087301 - RNA, 18 nt, Mycobacterium bovis subsp bovis AF2122/97
gcagcggccugaccggcu

SEQ ID NO: 3087302 - RNA, 20 nt, Mycobacterium bovis subsp bovis AF2122/97
gcagcggcgaagucuuucuc

SEQ ID NO: 3087303 - RNA, 17 nt, Mycobacterium bovis subsp bovis AF2122/97
gcagcggcgaccgcggu

SEQ ID NO: 3087304 - RNA, 13 nt, Mycobacterium bovis subsp bovis AF2122/97
gcagcggcgagcc

SEQ ID NO: 3087305 - RNA, 11 nt, Mycobacterium bovis subsp bovis AF2122/97
gcagcggcgau

SEQ ID NO: 3087306 - RNA, 23 nt, Mycobacterium bovis subsp bovis AF2122/97
gcagcggcgcauaggcggccauc

SEQ ID NO: 3087307 - RNA, 14 nt, Mycobacterium bovis subsp bovis AF2122/97
gcagcggcgcgcug

SEQ ID NO: 3087308 - RNA, 13 nt, Mycobacterium bovis subsp bovis AF2122/97
gcagcggcgcggu

SEQ ID NO: 3087309 - RNA, 15 nt, Mycobacterium bovis subsp bovis AF2122/97
gcagcggcgcucggc

SEQ ID NO: 3087310 - RNA, 11 nt, Mycobacterium bovis subsp bovis AF2122/97
gcagcggcgga

SEQ ID NO: 3087311 - RNA, 18 nt, Mycobacterium bovis subsp bovis AF2122/97
gcagcggcgggcgaugac

SEQ ID NO: 3087312 - RNA, 12 nt, Mycobacterium bovis subsp bovis AF2122/97
gcagcggcgucg

SEQ ID NO: 3087313 - RNA, 18 nt, Mycobacterium bovis subsp bovis AF2122/97
gcagcggcuaacgaagcc

SEQ ID NO: 3087314 - RNA, 15 nt, Mycobacterium bovis subsp bovis AF2122/97
gcagcggcucggcgg

SEQ ID NO: 3087315 - RNA, 16 nt, Mycobacterium bovis subsp bovis AF2122/97
gcagcggcucggcggc

SEQ ID NO: 3087316 - RNA, 20 nt, Mycobacterium bovis subsp bovis AF2122/97
gcagcggcucuauccggcgc

SEQ ID NO: 3087317 - RNA, 15 nt, Mycobacterium bovis subsp bovis AF2122/97
gcagcgggacaucca

SEQ ID NO: 3087318 - RNA, 22 nt, Mycobacterium bovis subsp bovis AF2122/97
gcagcgggaucaugaccaucga

SEQ ID NO: 3087319 - RNA, 19 nt, Mycobacterium bovis subsp bovis AF2122/97
gcagcgggccacugagcca

SEQ ID NO: 3087320 - RNA, 20 nt, Mycobacterium bovis subsp bovis AF2122/97
gcagcgggccgaagccccga

SEQ ID NO: 3087321 - RNA, 14 nt, Mycobacterium bovis subsp bovis AF2122/97
gcagcgggcgcgcu

SEQ ID NO: 3087322 - RNA, 15 nt, Mycobacterium bovis subsp bovis AF2122/97
gcagcgggcgcgcua

SEQ ID NO: 3087323 - RNA, 14 nt, Mycobacterium bovis subsp bovis AF2122/97
gcagcgggcggugu

SEQ ID NO: 3087324 - RNA, 15 nt, Mycobacterium bovis subsp bovis AF2122/97
gcagcgggcgguguc

SEQ ID NO: 3087325 - RNA, 18 nt, Mycobacterium bovis subsp bovis AF2122/97
gcagcgggucgccgggcc

SEQ ID NO: 3087326 - RNA, 15 nt, Mycobacterium bovis subsp bovis AF2122/97
gcagcggguugcggu

SEQ ID NO: 3087327 - RNA, 20 nt, Mycobacterium bovis subsp bovis AF2122/97
gcagcggguugcggucaccg

SEQ ID NO: 3087328 - RNA, 15 nt, Mycobacterium bovis subsp bovis AF2122/97
gcagcgguccagaca

SEQ ID NO: 3087329 - RNA, 13 nt, Mycobacterium bovis subsp bovis AF2122/97
gcagcgguccgcc

SEQ ID NO: 3087330 - RNA, 18 nt, Mycobacterium bovis subsp bovis AF2122/97
gcagcgguccgccgccuu

SEQ ID NO: 3087331 - RNA, 15 nt, Mycobacterium bovis subsp bovis AF2122/97
gcagcggugcagccc

SEQ ID NO: 3087332 - RNA, 17 nt, Mycobacterium bovis subsp bovis AF2122/97
gcagcggugcagcccgc

SEQ ID NO: 3087333 - RNA, 18 nt, Mycobacterium bovis subsp bovis AF2122/97
gcagcggugcagcccgcc

SEQ ID NO: 3087334 - RNA, 22 nt, Mycobacterium bovis subsp bovis AF2122/97
gcagcgguggcuugccccgccg

SEQ ID NO: 3087335 - RNA, 19 nt, Mycobacterium bovis subsp bovis AF2122/97
gcagcugggcaucaccgcc

SEQ ID NO: 3087336 - RNA, 21 nt, Mycobacterium bovis subsp bovis AF2122/97
gcagcugggcaucaccgccgc

SEQ ID NO: 3087337 - RNA, 13 nt, Mycobacterium bovis subsp bovis AF2122/97
gcagcuggggcgg

SEQ ID NO: 3087338 - RNA, 21 nt, Mycobacterium bovis subsp bovis AF2122/97
gcagcugggugcgccauugcg

SEQ ID NO: 3087339 - RNA, 23 nt, Mycobacterium bovis subsp bovis AF2122/97
gcagcugguaggucaccggucac

SEQ ID NO: 3087340 - RNA, 14 nt, Mycobacterium bovis subsp bovis AF2122/97
gcagcuggucggug

SEQ ID NO: 3087341 - RNA, 22 nt, Mycobacterium bovis subsp bovis AF2122/97
gcagcuggucgugggccaccac

SEQ ID NO: 3087342 - RNA, 18 nt, Mycobacterium bovis subsp bovis AF2122/97
gcagcugguuugcggugc

SEQ ID NO: 3087343 - RNA, 14 nt, Mycobacterium bovis subsp bovis AF2122/97
gcagcuguucggcc

SEQ ID NO: 3087344 - RNA, 16 nt, Mycobacterium bovis subsp bovis AF2122/97
gcagcuuagucagggc

SEQ ID NO: 3087345 - RNA, 19 nt, Mycobacterium bovis subsp bovis AF2122/97
gcagcuuagucagggccga

SEQ ID NO: 3087346 - RNA, 15 nt, Mycobacterium bovis subsp bovis AF2122/97
gcagcuucaacaccg

SEQ ID NO: 3087347 - RNA, 22 nt, Mycobacterium bovis subsp bovis AF2122/97
gcagcuucaacaccggcaucgg

SEQ ID NO: 3087348 - RNA, 15 nt, Mycobacterium bovis subsp bovis AF2122/97
gcagcuucucgccga

SEQ ID NO: 3087349 - RNA, 16 nt, Mycobacterium bovis subsp bovis AF2122/97
gcagcuucucgccgac

SEQ ID NO: 3087350 - RNA, 18 nt, Mycobacterium bovis subsp bovis AF2122/97
gcagcuucucgccgacga

SEQ ID NO: 3087351 - RNA, 15 nt, Mycobacterium bovis subsp bovis AF2122/97
gcagcuucucggcga

SEQ ID NO: 3087352 - RNA, 14 nt, Mycobacterium bovis subsp bovis AF2122/97
gcagcuugacaucg

SEQ ID NO: 3087353 - RNA, 18 nt, Mycobacterium bovis subsp bovis AF2122/97
gcagcuugacaucgguca

SEQ ID NO: 3087354 - RNA, 17 nt, Mycobacterium bovis subsp bovis AF2122/97
gcagcuuggacucaucg

SEQ ID NO: 3087355 - RNA, 14 nt, Mycobacterium bovis subsp bovis AF2122/97
gcagcuuggccagc

SEQ ID NO: 3087356 - RNA, 15 nt, Mycobacterium bovis subsp bovis AF2122/97
gcagcuuggccagcc

SEQ ID NO: 3087357 - RNA, 16 nt, Mycobacterium bovis subsp bovis AF2122/97
gcagcuuggccucagc

SEQ ID NO: 3087358 - RNA, 17 nt, Mycobacterium bovis subsp bovis AF2122/97
gcagcuuggccucagcc

SEQ ID NO: 3087359 - RNA, 21 nt, Mycobacterium bovis subsp bovis AF2122/97
gcagcuuggccucagccaccg

SEQ ID NO: 3087360 - RNA, 21 nt, Mycobacterium bovis subsp bovis AF2122/97
gcagcuugguggcguggcccu

SEQ ID NO: 3087361 - RNA, 19 nt, Mycobacterium bovis subsp bovis AF2122/97
gcagcuuguuuuccaccag

SEQ ID NO: 3087362 - RNA, 21 nt, Mycobacterium bovis subsp bovis AF2122/97
gcagcuuguuuuccaccagcg

SEQ ID NO: 3087363 - RNA, 23 nt, Mycobacterium bovis subsp bovis AF2122/97
gcagcuuugacgcccucggcgac

SEQ ID NO: 3087364 - RNA, 23 nt, Mycobacterium bovis subsp bovis AF2122/97
gcagcuuugagucccgguagacc

SEQ ID NO: 3087365 - RNA, 23 nt, Mycobacterium bovis subsp bovis AF2122/97
gcaggaacacccauaccuucggc

SEQ ID NO: 3087366 - RNA, 22 nt, Mycobacterium bovis subsp bovis AF2122/97
gcaggaagaaaccgcagucgcg

SEQ ID NO: 3087367 - RNA, 16 nt, Mycobacterium bovis subsp bovis AF2122/97
gcaggaaucgggucag

SEQ ID NO: 3087368 - RNA, 21 nt, Mycobacterium bovis subsp bovis AF2122/97
gcaggaaucgggucagcacca

SEQ ID NO: 3087369 - RNA, 18 nt, Mycobacterium bovis subsp bovis AF2122/97
gcaggaaugccgcgggga

SEQ ID NO: 3087370 - RNA, 19 nt, Mycobacterium bovis subsp bovis AF2122/97
gcaggaaugggugaucgaa

SEQ ID NO: 3087371 - RNA, 15 nt, Mycobacterium bovis subsp bovis AF2122/97
gcaggaauucgccau

SEQ ID NO: 3087372 - RNA, 23 nt, Mycobacterium bovis subsp bovis AF2122/97
gcaggaauucgccauagcgggcg

SEQ ID NO: 3087373 - RNA, 15 nt, Mycobacterium bovis subsp bovis AF2122/97
gcaggaccagcaccg

SEQ ID NO: 3087374 - RNA, 17 nt, Mycobacterium bovis subsp bovis AF2122/97
gcaggaccagcaccgcc

SEQ ID NO: 3087375 - RNA, 12 nt, Mycobacterium bovis subsp bovis AF2122/97
gcaggaccugcg

SEQ ID NO: 3087376 - RNA, 15 nt, Mycobacterium bovis subsp bovis AF2122/97
gcaggaccugcguca

SEQ ID NO: 3087377 - RNA, 19 nt, Mycobacterium bovis subsp bovis AF2122/97
gcaggaccugcgucaucgc

SEQ ID NO: 3087378 - RNA, 20 nt, Mycobacterium bovis subsp bovis AF2122/97
gcaggacgaugaugaucacc

SEQ ID NO: 3087379 - RNA, 13 nt, Mycobacterium bovis subsp bovis AF2122/97
gcaggacgcccac

SEQ ID NO: 3087380 - RNA, 12 nt, Mycobacterium bovis subsp bovis AF2122/97
gcaggacgcugc

SEQ ID NO: 3087381 - RNA, 15 nt, Mycobacterium bovis subsp bovis AF2122/97
gcaggacgcugccgg

SEQ ID NO: 3087382 - RNA, 21 nt, Mycobacterium bovis subsp bovis AF2122/97
gcaggacguuugagaccccaa

SEQ ID NO: 3087383 - RNA, 20 nt, Mycobacterium bovis subsp bovis AF2122/97
gcaggagcagcacgucgaac

SEQ ID NO: 3087384 - RNA, 20 nt, Mycobacterium bovis subsp bovis AF2122/97
gcaggagcgcgaugaccucg

SEQ ID NO: 3087385 - RNA, 22 nt, Mycobacterium bovis subsp bovis AF2122/97
gcaggagcgcgaugaccucggc

SEQ ID NO: 3087386 - RNA, 20 nt, Mycobacterium bovis subsp bovis AF2122/97
gcaggagguugggaacagcc

SEQ ID NO: 3087387 - RNA, 22 nt, Mycobacterium bovis subsp bovis AF2122/97
gcaggaucaaaaccucgugcgc

SEQ ID NO: 3087388 - RNA, 17 nt, Mycobacterium bovis subsp bovis AF2122/97
gcaggaucacgccgccg

SEQ ID NO: 3087389 - RNA, 19 nt, Mycobacterium bovis subsp bovis AF2122/97
gcaggaucgccugagcgcc

SEQ ID NO: 3087390 - RNA, 22 nt, Mycobacterium bovis subsp bovis AF2122/97
gcaggaucgccugagcgccgcg

SEQ ID NO: 3087391 - RNA, 23 nt, Mycobacterium bovis subsp bovis AF2122/97
gcaggaucgccugagcgccgcgg

SEQ ID NO: 3087392 - RNA, 15 nt, Mycobacterium bovis subsp bovis AF2122/97
gcaggaucggcuugg

SEQ ID NO: 3087393 - RNA, 21 nt, Mycobacterium bovis subsp bovis AF2122/97
gcaggaucggcuugggaaacc

SEQ ID NO: 3087394 - RNA, 16 nt, Mycobacterium bovis subsp bovis AF2122/97
gcaggaucuccggguc

SEQ ID NO: 3087395 - RNA, 17 nt, Mycobacterium bovis subsp bovis AF2122/97
gcaggaugaugaccgcc

SEQ ID NO: 3087396 - RNA, 19 nt, Mycobacterium bovis subsp bovis AF2122/97
gcaggaugcgaucgucacg

SEQ ID NO: 3087397 - RNA, 20 nt, Mycobacterium bovis subsp bovis AF2122/97
gcaggaugcgaucgucacgc

SEQ ID NO: 3087398 - RNA, 17 nt, Mycobacterium bovis subsp bovis AF2122/97
gcaggauucccagucca

SEQ ID NO: 3087399 - RNA, 21 nt, Mycobacterium bovis subsp bovis AF2122/97
gcaggauucccaguccaggac

SEQ ID NO: 3087400 - RNA, 22 nt, Mycobacterium bovis subsp bovis AF2122/97
gcaggauucccagucgcggcgc

SEQ ID NO: 3087401 - RNA, 21 nt, Mycobacterium bovis subsp bovis AF2122/97
gcaggauucccucgacagugc

SEQ ID NO: 3087402 - RNA, 14 nt, Mycobacterium bovis subsp bovis AF2122/97
gcaggcacaucgcg

SEQ ID NO: 3087403 - RNA, 16 nt, Mycobacterium bovis subsp bovis AF2122/97
gcaggcacaucgcgaa

SEQ ID NO: 3087404 - RNA, 20 nt, Mycobacterium bovis subsp bovis AF2122/97
gcaggcaccccgaucacccg

SEQ ID NO: 3087405 - RNA, 22 nt, Mycobacterium bovis subsp bovis AF2122/97
gcaggcaccccgaucacccgca

SEQ ID NO: 3087406 - RNA, 18 nt, Mycobacterium bovis subsp bovis AF2122/97
gcaggcagggcagcccgg

SEQ ID NO: 3087407 - RNA, 20 nt, Mycobacterium bovis subsp bovis AF2122/97
gcaggcagggcagcccggcg

SEQ ID NO: 3087408 - RNA, 10 nt, Mycobacterium bovis subsp bovis AF2122/97
gcaggcaggu

SEQ ID NO: 3087409 - RNA, 21 nt, Mycobacterium bovis subsp bovis AF2122/97
gcaggcagguuggccaccgcc

SEQ ID NO: 3087410 - RNA, 23 nt, Mycobacterium bovis subsp bovis AF2122/97
gcaggcagguuggccaccgccca

SEQ ID NO: 3087411 - RNA, 23 nt, Mycobacterium bovis subsp bovis AF2122/97
gcaggcagugagggucccacggc

SEQ ID NO: 3087412 - RNA, 12 nt, Mycobacterium bovis subsp bovis AF2122/97
gcaggccacugc

SEQ ID NO: 3087413 - RNA, 14 nt, Mycobacterium bovis subsp bovis AF2122/97
gcaggcccaacgcg

SEQ ID NO: 3087414 - RNA, 17 nt, Mycobacterium bovis subsp bovis AF2122/97
gcaggcccacccgggcg

SEQ ID NO: 3087415 - RNA, 22 nt, Mycobacterium bovis subsp bovis AF2122/97
gcaggccccacuggugcagcgc

SEQ ID NO: 3087416 - RNA, 18 nt, Mycobacterium bovis subsp bovis AF2122/97
gcaggcccgacggcgccc

SEQ ID NO: 3087417 - RNA, 19 nt, Mycobacterium bovis subsp bovis AF2122/97
gcaggcccgacggcgccca

SEQ ID NO: 3087418 - RNA, 17 nt, Mycobacterium bovis subsp bovis AF2122/97
gcaggcccgccaucaug

SEQ ID NO: 3087419 - RNA, 18 nt, Mycobacterium bovis subsp bovis AF2122/97
gcaggcccuucaguucga

SEQ ID NO: 3087420 - RNA, 16 nt, Mycobacterium bovis subsp bovis AF2122/97
gcaggcccuuggcgau

SEQ ID NO: 3087421 - RNA, 19 nt, Mycobacterium bovis subsp bovis AF2122/97
gcaggggaguugcuugcag

SEQ ID NO: 3087422 - RNA, 13 nt, Mycobacterium bovis subsp bovis AF2122/97
gcaggggcggcgu

SEQ ID NO: 3087423 - RNA, 18 nt, Mycobacterium bovis subsp bovis AF2122/97
gcagggggacccggaccu

SEQ ID NO: 3087424 - RNA, 23 nt, Mycobacterium bovis subsp bovis AF2122/97
gcagggggacccggaccuucggc

SEQ ID NO: 3087425 - RNA, 14 nt, Mycobacterium bovis subsp bovis AF2122/97
gcagggugccggcg

SEQ ID NO: 3087426 - RNA, 18 nt, Mycobacterium bovis subsp bovis AF2122/97
gcagggugccggcgccgc

SEQ ID NO: 3087427 - RNA, 17 nt, Mycobacterium bovis subsp bovis AF2122/97
gcaggguggccagcagg

SEQ ID NO: 3087428 - RNA, 19 nt, Mycobacterium bovis subsp bovis AF2122/97
gcaggguggggcgguggcc

SEQ ID NO: 3087429 - RNA, 22 nt, Mycobacterium bovis subsp bovis AF2122/97
gcaggguggggcgguggccggc

SEQ ID NO: 3087430 - RNA, 12 nt, Mycobacterium bovis subsp bovis AF2122/97
gcagggugugcg

SEQ ID NO: 3087431 - RNA, 19 nt, Mycobacterium bovis subsp bovis AF2122/97
gcaggguguuuauggcccu

SEQ ID NO: 3087432 - RNA, 20 nt, Mycobacterium bovis subsp bovis AF2122/97
gcaggguguuuauggcccug

SEQ ID NO: 3087433 - RNA, 14 nt, Mycobacterium bovis subsp bovis AF2122/97
gcaggguuccccau

SEQ ID NO: 3087434 - RNA, 18 nt, Mycobacterium bovis subsp bovis AF2122/97
gcaggguuccggauccga

SEQ ID NO: 3087435 - RNA, 16 nt, Mycobacterium bovis subsp bovis AF2122/97
gcaggguucgucggga

SEQ ID NO: 3087436 - RNA, 16 nt, Mycobacterium bovis subsp bovis AF2122/97
gcagguacaucaccac

SEQ ID NO: 3087437 - RNA, 18 nt, Mycobacterium bovis subsp bovis AF2122/97
gcagguacaucaccacga

SEQ ID NO: 3087438 - RNA, 20 nt, Mycobacterium bovis subsp bovis AF2122/97
gcagguaccaccgcggugug

SEQ ID NO: 3087439 - RNA, 17 nt, Mycobacterium bovis subsp bovis AF2122/97
gcagguagcggguuggg

SEQ ID NO: 3087440 - RNA, 13 nt, Mycobacterium bovis subsp bovis AF2122/97
gcagguaggcgcg

SEQ ID NO: 3087441 - RNA, 15 nt, Mycobacterium bovis subsp bovis AF2122/97
gcagguaggcgcgau

SEQ ID NO: 3087442 - RNA, 23 nt, Mycobacterium bovis subsp bovis AF2122/97
gcagguagguauagccgguuguc

SEQ ID NO: 3087443 - RNA, 15 nt, Mycobacterium bovis subsp bovis AF2122/97
gcagguagucgacga

SEQ ID NO: 3087444 - RNA, 17 nt, Mycobacterium bovis subsp bovis AF2122/97
gcagguccaucuggcgc

SEQ ID NO: 3087445 - RNA, 22 nt, Mycobacterium bovis subsp bovis AF2122/97
gcagguccaucuggcgcgccgu

SEQ ID NO: 3087446 - RNA, 12 nt, Mycobacterium bovis subsp bovis AF2122/97
gcagguccgcgg

SEQ ID NO: 3087447 - RNA, 13 nt, Mycobacterium bovis subsp bovis AF2122/97
gcagguccgcggc

SEQ ID NO: 3087448 - RNA, 17 nt, Mycobacterium bovis subsp bovis AF2122/97
gcagguccgcggccgcg

SEQ ID NO: 3087449 - RNA, 16 nt, Mycobacterium bovis subsp bovis AF2122/97
gcaggucgacggccac

SEQ ID NO: 3087450 - RNA, 22 nt, Mycobacterium bovis subsp bovis AF2122/97
gcaggucgagcgcccacuggug

SEQ ID NO: 3087451 - RNA, 22 nt, Mycobacterium bovis subsp bovis AF2122/97
gcaggucgaucugcgccaucac

SEQ ID NO: 3087452 - RNA, 12 nt, Mycobacterium bovis subsp bovis AF2122/97
gcaggucgcacc

SEQ ID NO: 3087453 - RNA, 15 nt, Mycobacterium bovis subsp bovis AF2122/97
gcaggucgcaccaca

SEQ ID NO: 3087454 - RNA, 19 nt, Mycobacterium bovis subsp bovis AF2122/97
gcaggucgccugcccccgc

SEQ ID NO: 3087455 - RNA, 13 nt, Mycobacterium bovis subsp bovis AF2122/97
gcaggucgcuggc

SEQ ID NO: 3087456 - RNA, 17 nt, Mycobacterium bovis subsp bovis AF2122/97
gcaggucguccaucgcg

SEQ ID NO: 3087457 - RNA, 13 nt, Mycobacterium bovis subsp bovis AF2122/97
gcaggucgucggc

SEQ ID NO: 3087458 - RNA, 20 nt, Mycobacterium bovis subsp bovis AF2122/97
gcaggucgucggcgucgcgg

SEQ ID NO: 3087459 - RNA, 15 nt, Mycobacterium bovis subsp bovis AF2122/97
gcaggucgucguacc

SEQ ID NO: 3087460 - RNA, 18 nt, Mycobacterium bovis subsp bovis AF2122/97
gcaggugaacgccggugc

SEQ ID NO: 3087461 - RNA, 19 nt, Mycobacterium bovis subsp bovis AF2122/97
gcaggugaacgccggugcg

SEQ ID NO: 3087462 - RNA, 22 nt, Mycobacterium bovis subsp bovis AF2122/97
gcaggugacauguugccgcuga

SEQ ID NO: 3087463 - RNA, 22 nt, Mycobacterium bovis subsp bovis AF2122/97
gcaggugacgaucaggucgccg

SEQ ID NO: 3087464 - RNA, 15 nt, Mycobacterium bovis subsp bovis AF2122/97
gcaggugagugcggc

SEQ ID NO: 3087465 - RNA, 17 nt, Mycobacterium bovis subsp bovis AF2122/97
gcaggugauguucagcg

SEQ ID NO: 3087466 - RNA, 13 nt, Mycobacterium bovis subsp bovis AF2122/97
gcaggugcaucgc

SEQ ID NO: 3087467 - RNA, 16 nt, Mycobacterium bovis subsp bovis AF2122/97
gcaggugccaaccgcg

SEQ ID NO: 3087468 - RNA, 15 nt, Mycobacterium bovis subsp bovis AF2122/97
gcaggugcccaucgg

SEQ ID NO: 3087469 - RNA, 13 nt, Mycobacterium bovis subsp bovis AF2122/97
gcaggugccuucu

SEQ ID NO: 3087470 - RNA, 16 nt, Mycobacterium bovis subsp bovis AF2122/97
gcaggugccuuucggc

SEQ ID NO: 3087471 - RNA, 13 nt, Mycobacterium bovis subsp bovis AF2122/97
gcaggugcugggc

SEQ ID NO: 3087472 - RNA, 15 nt, Mycobacterium bovis subsp bovis AF2122/97
gcaggugcugguugc

SEQ ID NO: 3087473 - RNA, 19 nt, Mycobacterium bovis subsp bovis AF2122/97
gcagguggagugcacagac

SEQ ID NO: 3087474 - RNA, 15 nt, Mycobacterium bovis subsp bovis AF2122/97
gcagguggccgucgc

SEQ ID NO: 3087475 - RNA, 17 nt, Mycobacterium bovis subsp bovis AF2122/97
gcaggugggcguuggcg

SEQ ID NO: 3087476 - RNA, 18 nt, Mycobacterium bovis subsp bovis AF2122/97
gcaggugggcguuggcga

SEQ ID NO: 3087477 - RNA, 16 nt, Mycobacterium bovis subsp bovis AF2122/97
gcagguuaggguccag

SEQ ID NO: 3087478 - RNA, 23 nt, Mycobacterium bovis subsp bovis AF2122/97
gcagguuccacggccaggucgac

SEQ ID NO: 3087479 - RNA, 22 nt, Mycobacterium bovis subsp bovis AF2122/97
gcagguucgagggugaccccca

SEQ ID NO: 3087480 - RNA, 18 nt, Mycobacterium bovis subsp bovis AF2122/97
gcagguucucggugccga

SEQ ID NO: 3087481 - RNA, 20 nt, Mycobacterium bovis subsp bovis AF2122/97
gcagguucuugaccagcagc

SEQ ID NO: 3087482 - RNA, 18 nt, Mycobacterium bovis subsp bovis AF2122/97
gcagguugcguugcagga

SEQ ID NO: 3087483 - RNA, 14 nt, Mycobacterium bovis subsp bovis AF2122/97
gcagguuggcaagc

SEQ ID NO: 3087484 - RNA, 18 nt, Mycobacterium bovis subsp bovis AF2122/97
gcagguuggcaagcacgg

SEQ ID NO: 3087485 - RNA, 18 nt, Mycobacterium bovis subsp bovis AF2122/97
gcagguuggccaccgccc

SEQ ID NO: 3087486 - RNA, 22 nt, Mycobacterium bovis subsp bovis AF2122/97
gcagguuggccaccgcccagug

SEQ ID NO: 3087487 - RNA, 14 nt, Mycobacterium bovis subsp bovis AF2122/97
gcagguuggcgagc

SEQ ID NO: 3087488 - RNA, 17 nt, Mycobacterium bovis subsp bovis AF2122/97
gcagguuggucaccacc

SEQ ID NO: 3087489 - RNA, 20 nt, Mycobacterium bovis subsp bovis AF2122/97
gcagguuggucaccaccugg

SEQ ID NO: 3087490 - RNA, 21 nt, Mycobacterium bovis subsp bovis AF2122/97
gcagguuguaguccgcgccga

SEQ ID NO: 3087491 - RNA, 15 nt, Mycobacterium bovis subsp bovis AF2122/97
gcaguaacgucgucg

SEQ ID NO: 3087492 - RNA, 21 nt, Mycobacterium bovis subsp bovis AF2122/97
gcaguaacuucaccggcucgu

SEQ ID NO: 3087493 - RNA, 18 nt, Mycobacterium bovis subsp bovis AF2122/97
gcaguacaccgcccggcc

SEQ ID NO: 3087494 - RNA, 17 nt, Mycobacterium bovis subsp bovis AF2122/97
gcaguacaccggcgugc

SEQ ID NO: 3087495 - RNA, 16 nt, Mycobacterium bovis subsp bovis AF2122/97
gcaguacuagcagcgg

SEQ ID NO: 3087496 - RNA, 23 nt, Mycobacterium bovis subsp bovis AF2122/97
gcaguagaucggaucgaagucca

SEQ ID NO: 3087497 - RNA, 13 nt, Mycobacterium bovis subsp bovis AF2122/97
gcaguagccgacc

SEQ ID NO: 3087498 - RNA, 14 nt, Mycobacterium bovis subsp bovis AF2122/97
gcaguagccgacca

SEQ ID NO: 3087499 - RNA, 13 nt, Mycobacterium bovis subsp bovis AF2122/97
gcaguagcuagca

SEQ ID NO: 3087500 - RNA, 13 nt, Mycobacterium bovis subsp bovis AF2122/97
gcaguagcugcuc

SEQ ID NO: 3087501 - RNA, 22 nt, Mycobacterium bovis subsp bovis AF2122/97
gcaguagcugcucaucgcgccc

SEQ ID NO: 3087502 - RNA, 20 nt, Mycobacterium bovis subsp bovis AF2122/97
gcaguaguagcgcaaccgcg

SEQ ID NO: 3087503 - RNA, 21 nt, Mycobacterium bovis subsp bovis AF2122/97
gcaguaucaucggcgcuggca

SEQ ID NO: 3087504 - RNA, 22 nt, Mycobacterium bovis subsp bovis AF2122/97
gcaguauucacagucgcucgcu

SEQ ID NO: 3087505 - RNA, 14 nt, Mycobacterium bovis subsp bovis AF2122/97
gcagucaacucccg

SEQ ID NO: 3087506 - RNA, 17 nt, Mycobacterium bovis subsp bovis AF2122/97
gcagucaacucccgaac

SEQ ID NO: 3087507 - RNA, 17 nt, Mycobacterium bovis subsp bovis AF2122/97
gcagucauguccauagc

SEQ ID NO: 3087508 - RNA, 19 nt, Mycobacterium bovis subsp bovis AF2122/97
gcauacgcggcuuugacgc

SEQ ID NO: 3087509 - RNA, 18 nt, Mycobacterium bovis subsp bovis AF2122/97
gcauacgguugaugcauc

SEQ ID NO: 3087510 - RNA, 16 nt, Mycobacterium bovis subsp bovis AF2122/97
gcauagccgaacagcg

SEQ ID NO: 3087511 - RNA, 18 nt, Mycobacterium bovis subsp bovis AF2122/97
gcauagcggcccaucggg

SEQ ID NO: 3087512 - RNA, 19 nt, Mycobacterium bovis subsp bovis AF2122/97
gcauaggccccgccagcgc

SEQ ID NO: 3087513 - RNA, 21 nt, Mycobacterium bovis subsp bovis AF2122/97
gcauaggccccgccagcgccg

SEQ ID NO: 3087514 - RNA, 15 nt, Mycobacterium bovis subsp bovis AF2122/97
gcauaggccgcgucg

SEQ ID NO: 3087515 - RNA, 13 nt, Mycobacterium bovis subsp bovis AF2122/97
gcauaggcgcggu

SEQ ID NO: 3087516 - RNA, 21 nt, Mycobacterium bovis subsp bovis AF2122/97
gcauaggcggccaucgacgac

SEQ ID NO: 3087517 - RNA, 13 nt, Mycobacterium bovis subsp bovis AF2122/97
gcauaggcuuccg

SEQ ID NO: 3087518 - RNA, 17 nt, Mycobacterium bovis subsp bovis AF2122/97
gcauaggcuuccggcgc

SEQ ID NO: 3087519 - RNA, 19 nt, Mycobacterium bovis subsp bovis AF2122/97
gcauagguaguugcucggc

SEQ ID NO: 3087520 - RNA, 15 nt, Mycobacterium bovis subsp bovis AF2122/97
gcauaucaaccccgg

SEQ ID NO: 3087521 - RNA, 15 nt, Mycobacterium bovis subsp bovis AF2122/97
gcauauccgcaggcc

SEQ ID NO: 3087522 - RNA, 16 nt, Mycobacterium bovis subsp bovis AF2122/97
gcauauccgccggcga

SEQ ID NO: 3087523 - RNA, 21 nt, Mycobacterium bovis subsp bovis AF2122/97
gcauaucgauucgggcgucgg

SEQ ID NO: 3087524 - RNA, 23 nt, Mycobacterium bovis subsp bovis AF2122/97
gcauauugcggcgccgugaucag

SEQ ID NO: 3087525 - RNA, 15 nt, Mycobacterium bovis subsp bovis AF2122/97
gcaucaacaccggcu

SEQ ID NO: 3087526 - RNA, 14 nt, Mycobacterium bovis subsp bovis AF2122/97
gcaucaacgcgggc

SEQ ID NO: 3087527 - RNA, 21 nt, Mycobacterium bovis subsp bovis AF2122/97
gcaucaacgcgggcgcuugcc

SEQ ID NO: 3087528 - RNA, 16 nt, Mycobacterium bovis subsp bovis AF2122/97
gcaucacaagggugcc

SEQ ID NO: 3087529 - RNA, 15 nt, Mycobacterium bovis subsp bovis AF2122/97
gcaucaccacccgac

SEQ ID NO: 3087530 - RNA, 17 nt, Mycobacterium bovis subsp bovis AF2122/97
gcaucaccacccgaccg

SEQ ID NO: 3087531 - RNA, 22 nt, Mycobacterium bovis subsp bovis AF2122/97
gcaucaccacuggacccgccca

SEQ ID NO: 3087532 - RNA, 14 nt, Mycobacterium bovis subsp bovis AF2122/97
gcaucaccgacgcg

SEQ ID NO: 3087533 - RNA, 23 nt, Mycobacterium bovis subsp bovis AF2122/97
gcaucaccgacgcgucggcgacg

SEQ ID NO: 3087534 - RNA, 14 nt, Mycobacterium bovis subsp bovis AF2122/97
gcaucaccgccgcg

SEQ ID NO: 3087535 - RNA, 15 nt, Mycobacterium bovis subsp bovis AF2122/97
gcaucagcagagccc

SEQ ID NO: 3087536 - RNA, 16 nt, Mycobacterium bovis subsp bovis AF2122/97
gcaucagcccggcgcu

SEQ ID NO: 3087537 - RNA, 18 nt, Mycobacterium bovis subsp bovis AF2122/97
gcaucagcgccagcgagc

SEQ ID NO: 3087538 - RNA, 14 nt, Mycobacterium bovis subsp bovis AF2122/97
gcaucagcggcgcc

SEQ ID NO: 3087539 - RNA, 17 nt, Mycobacterium bovis subsp bovis AF2122/97
gcaucagcggcgccagu

SEQ ID NO: 3087540 - RNA, 22 nt, Mycobacterium bovis subsp bovis AF2122/97
gcaucagcggcgccaguauggc

SEQ ID NO: 3087541 - RNA, 16 nt, Mycobacterium bovis subsp bovis AF2122/97
gcaucagcuuuugcac

SEQ ID NO: 3087542 - RNA, 22 nt, Mycobacterium bovis subsp bovis AF2122/97
gcaucagcuuuugcaccggacc

SEQ ID NO: 3087543 - RNA, 18 nt, Mycobacterium bovis subsp bovis AF2122/97
gcaucaguuugacgccga

SEQ ID NO: 3087544 - RNA, 24 nt, Mycobacterium bovis subsp bovis AF2122/97
gcaucauagacagggccgcucgcc

SEQ ID NO: 3087545 - RNA, 16 nt, Mycobacterium bovis subsp bovis AF2122/97
gcaucaucagcggcgc

SEQ ID NO: 3087546 - RNA, 14 nt, Mycobacterium bovis subsp bovis AF2122/97
gcaucaucgcccac

SEQ ID NO: 3087547 - RNA, 22 nt, Mycobacterium bovis subsp bovis AF2122/97
gcaucaucgcugugcgcugguc

SEQ ID NO: 3087548 - RNA, 15 nt, Mycobacterium bovis subsp bovis AF2122/97
gcaucaugccgccca

SEQ ID NO: 3087549 - RNA, 20 nt, Mycobacterium bovis subsp bovis AF2122/97
gcaucaugggagucgucgug

SEQ ID NO: 3087550 - RNA, 16 nt, Mycobacterium bovis subsp bovis AF2122/97
gcauccaacgcggcgc

SEQ ID NO: 3087551 - RNA, 16 nt, Mycobacterium bovis subsp bovis AF2122/97
gcauccaauaucgcuu

SEQ ID NO: 3087552 - RNA, 24 nt, Mycobacterium bovis subsp bovis AF2122/97
gcauccacccauagacccggcuga

SEQ ID NO: 3087553 - RNA, 15 nt, Mycobacterium bovis subsp bovis AF2122/97
gcauccacugcggcg

SEQ ID NO: 3087554 - RNA, 16 nt, Mycobacterium bovis subsp bovis AF2122/97
gcauccacugcggcgc

SEQ ID NO: 3087555 - RNA, 19 nt, Mycobacterium bovis subsp bovis AF2122/97
gcauccacugcggcgcugg

SEQ ID NO: 3087556 - RNA, 19 nt, Mycobacterium bovis subsp bovis AF2122/97
gcauccagaaguaggcgac

SEQ ID NO: 3087557 - RNA, 14 nt, Mycobacterium bovis subsp bovis AF2122/97
gcauccagcagcgc

SEQ ID NO: 3087558 - RNA, 16 nt, Mycobacterium bovis subsp bovis AF2122/97
gcauccagccgugcgg

SEQ ID NO: 3087559 - RNA, 20 nt, Mycobacterium bovis subsp bovis AF2122/97
gcauccagccgugcggcggc

SEQ ID NO: 3087560 - RNA, 22 nt, Mycobacterium bovis subsp bovis AF2122/97
gcauccagccgugcggcggcug

SEQ ID NO: 3087561 - RNA, 13 nt, Mycobacterium bovis subsp bovis AF2122/97
gcauccagcgcgc

SEQ ID NO: 3087562 - RNA, 23 nt, Mycobacterium bovis subsp bovis AF2122/97
gcauccagcgcgcgcugagccgu

SEQ ID NO: 3087563 - RNA, 14 nt, Mycobacterium bovis subsp bovis AF2122/97
gcauccagcugcug

SEQ ID NO: 3087564 - RNA, 18 nt, Mycobacterium bovis subsp bovis AF2122/97
gcauccagcugcugccga

SEQ ID NO: 3087565 - RNA, 17 nt, Mycobacterium bovis subsp bovis AF2122/97
gcauccaggcugucgcg

SEQ ID NO: 3087566 - RNA, 19 nt, Mycobacterium bovis subsp bovis AF2122/97
gcauccccgguacgucgag

SEQ ID NO: 3087567 - RNA, 18 nt, Mycobacterium bovis subsp bovis AF2122/97
gcaucccgaauggccgau

SEQ ID NO: 3087568 - RNA, 16 nt, Mycobacterium bovis subsp bovis AF2122/97
gcaucccgguccagcc

SEQ ID NO: 3087569 - RNA, 16 nt, Mycobacterium bovis subsp bovis AF2122/97
gcauccggucucggcc

SEQ ID NO: 3087570 - RNA, 18 nt, Mycobacterium bovis subsp bovis AF2122/97
gcauccgguucgccgccg

SEQ ID NO: 3087571 - RNA, 19 nt, Mycobacterium bovis subsp bovis AF2122/97
gcauccgguucgccgccgu

SEQ ID NO: 3087572 - RNA, 21 nt, Mycobacterium bovis subsp bovis AF2122/97
gcauccgguuuggucgccgcg

SEQ ID NO: 3087573 - RNA, 17 nt, Mycobacterium bovis subsp bovis AF2122/97
gcauccuccucgucgac

SEQ ID NO: 3087574 - RNA, 23 nt, Mycobacterium bovis subsp bovis AF2122/97
gcauccugcacgacccgcugguc

SEQ ID NO: 3087575 - RNA, 19 nt, Mycobacterium bovis subsp bovis AF2122/97
gcauccuucaccagcugcg

SEQ ID NO: 3087576 - RNA, 18 nt, Mycobacterium bovis subsp bovis AF2122/97
gcauccuugccaaucgcc

SEQ ID NO: 3087577 - RNA, 20 nt, Mycobacterium bovis subsp bovis AF2122/97
gcaucgaacgcccugacggu

SEQ ID NO: 3087578 - RNA, 19 nt, Mycobacterium bovis subsp bovis AF2122/97
gcaucgaagugcggcccgg

SEQ ID NO: 3087579 - RNA, 22 nt, Mycobacterium bovis subsp bovis AF2122/97
gcaucgaauuccagccagccgc

SEQ ID NO: 3087580 - RNA, 16 nt, Mycobacterium bovis subsp bovis AF2122/97
gcaucgacgaacccca

SEQ ID NO: 3087581 - RNA, 18 nt, Mycobacterium bovis subsp bovis AF2122/97
gcaucgacgugcgcggca

SEQ ID NO: 3087582 - RNA, 15 nt, Mycobacterium bovis subsp bovis AF2122/97
gcaucgacucacgga

SEQ ID NO: 3087583 - RNA, 19 nt, Mycobacterium bovis subsp bovis AF2122/97
gcaucgacugccagcgccg

SEQ ID NO: 3087584 - RNA, 21 nt, Mycobacterium bovis subsp bovis AF2122/97
gcaucgacugccagcgccgcg

SEQ ID NO: 3087585 - RNA, 15 nt, Mycobacterium bovis subsp bovis AF2122/97
gcaucgagacgagcc

SEQ ID NO: 3087586 - RNA, 17 nt, Mycobacterium bovis subsp bovis AF2122/97
gcaucgagacgcacggc

SEQ ID NO: 3087587 - RNA, 20 nt, Mycobacterium bovis subsp bovis AF2122/97
gcaucgagacgcacggccac

SEQ ID NO: 3087588 - RNA, 21 nt, Mycobacterium bovis subsp bovis AF2122/97
gcaucgagacgcacggccacc

SEQ ID NO: 3087589 - RNA, 17 nt, Mycobacterium bovis subsp bovis AF2122/97
gcaucgagcagcccggg

SEQ ID NO: 3087590 - RNA, 20 nt, Mycobacterium bovis subsp bovis AF2122/97
gcaucgaguucggcccgcaa

SEQ ID NO: 3087591 - RNA, 18 nt, Mycobacterium bovis subsp bovis AF2122/97
gcaucgauaauggccgag

SEQ ID NO: 3087592 - RNA, 21 nt, Mycobacterium bovis subsp bovis AF2122/97
gcaucgauucgauguccucga

SEQ ID NO: 3087593 - RNA, 14 nt, Mycobacterium bovis subsp bovis AF2122/97
gcaucgcacgggcc

SEQ ID NO: 3087594 - RNA, 15 nt, Mycobacterium bovis subsp bovis AF2122/97
gcaucuggccggcgg

SEQ ID NO: 3087595 - RNA, 16 nt, Mycobacterium bovis subsp bovis AF2122/97
gcaucuggccggcggu

SEQ ID NO: 3087596 - RNA, 19 nt, Mycobacterium bovis subsp bovis AF2122/97
gcaucugggguccggugac

SEQ ID NO: 3087597 - RNA, 16 nt, Mycobacterium bovis subsp bovis AF2122/97
gcaucugucgcgcggc

SEQ ID NO: 3087598 - RNA, 21 nt, Mycobacterium bovis subsp bovis AF2122/97
gcaucuucgcgcagccgccgc

SEQ ID NO: 3087599 - RNA, 22 nt, Mycobacterium bovis subsp bovis AF2122/97
gcaucuucgcgcagccgccgcg

SEQ ID NO: 3087600 - RNA, 15 nt, Mycobacterium bovis subsp bovis AF2122/97
gcaucuuuggcggcc

SEQ ID NO: 3087601 - RNA, 20 nt, Mycobacterium bovis subsp bovis AF2122/97
gcaugaacgcaaccgagggc

SEQ ID NO: 3087602 - RNA, 20 nt, Mycobacterium bovis subsp bovis AF2122/97
gcaugaacugcucgccgagg

SEQ ID NO: 3087603 - RNA, 14 nt, Mycobacterium bovis subsp bovis AF2122/97
gcaugaagucccgg

SEQ ID NO: 3087604 - RNA, 23 nt, Mycobacterium bovis subsp bovis AF2122/97
gcaugaagucccggauacgggcg

SEQ ID NO: 3087605 - RNA, 17 nt, Mycobacterium bovis subsp bovis AF2122/97
gcaugacaccggccacc

SEQ ID NO: 3087606 - RNA, 22 nt, Mycobacterium bovis subsp bovis AF2122/97
gcaugaccccgucagcgggcag

SEQ ID NO: 3087607 - RNA, 23 nt, Mycobacterium bovis subsp bovis AF2122/97
gcaugaccccgucagcgggcagc

SEQ ID NO: 3087608 - RNA, 19 nt, Mycobacterium bovis subsp bovis AF2122/97
gcaugagcguucagcacgg

SEQ ID NO: 3087609 - RNA, 20 nt, Mycobacterium bovis subsp bovis AF2122/97
gcaugauguugaaacaccgc

SEQ ID NO: 3087610 - RNA, 18 nt, Mycobacterium bovis subsp bovis AF2122/97
gcaugcaaugcuggcggc

SEQ ID NO: 3087611 - RNA, 20 nt, Mycobacterium bovis subsp bovis AF2122/97
gcaugcaaugcuggcggcgc

SEQ ID NO: 3087612 - RNA, 21 nt, Mycobacterium bovis subsp bovis AF2122/97
gcaugcacgucaucggcuggc

SEQ ID NO: 3087613 - RNA, 14 nt, Mycobacterium bovis subsp bovis AF2122/97
gcaugccacacacu

SEQ ID NO: 3087614 - RNA, 15 nt, Mycobacterium bovis subsp bovis AF2122/97
gcaugccaccgagca

SEQ ID NO: 3087615 - RNA, 22 nt, Mycobacterium bovis subsp bovis AF2122/97
gcaugccagccacgaacugauc

SEQ ID NO: 3087616 - RNA, 20 nt, Mycobacterium bovis subsp bovis AF2122/97
gcaugcccagaaaaccgccg

SEQ ID NO: 3087617 - RNA, 12 nt, Mycobacterium bovis subsp bovis AF2122/97
gcaugcccagcg

SEQ ID NO: 3087618 - RNA, 17 nt, Mycobacterium bovis subsp bovis AF2122/97
gcaugcccagcgcacgg

SEQ ID NO: 3087619 - RNA, 16 nt, Mycobacterium bovis subsp bovis AF2122/97
gcaugccccgaccgcg

SEQ ID NO: 3087620 - RNA, 14 nt, Mycobacterium bovis subsp bovis AF2122/97
gcaugcccgccauc

SEQ ID NO: 3087621 - RNA, 16 nt, Mycobacterium bovis subsp bovis AF2122/97
gcaugcccuggaccag

SEQ ID NO: 3087622 - RNA, 13 nt, Mycobacterium bovis subsp bovis AF2122/97
gcaugccgacccg

SEQ ID NO: 3087623 - RNA, 19 nt, Mycobacterium bovis subsp bovis AF2122/97
gcaugccgccaugcgcacc

SEQ ID NO: 3087624 - RNA, 21 nt, Mycobacterium bovis subsp bovis AF2122/97
gcaugccgccaugcgcaccag

SEQ ID NO: 3087625 - RNA, 15 nt, Mycobacterium bovis subsp bovis AF2122/97
gcaugccgcccgcgc

SEQ ID NO: 3087626 - RNA, 16 nt, Mycobacterium bovis subsp bovis AF2122/97
gcaugccgcccgcgcc

SEQ ID NO: 3087627 - RNA, 12 nt, Mycobacterium bovis subsp bovis AF2122/97
gcaugccgcggc

SEQ ID NO: 3087628 - RNA, 16 nt, Mycobacterium bovis subsp bovis AF2122/97
gcaugccggcgaagcc

SEQ ID NO: 3087629 - RNA, 17 nt, Mycobacterium bovis subsp bovis AF2122/97
gcaugccggcgcaccac

SEQ ID NO: 3087630 - RNA, 19 nt, Mycobacterium bovis subsp bovis AF2122/97
gcaugccggcgugcggcga

SEQ ID NO: 3087631 - RNA, 20 nt, Mycobacterium bovis subsp bovis AF2122/97
gcaugccggcuagcucggcg

SEQ ID NO: 3087632 - RNA, 17 nt, Mycobacterium bovis subsp bovis AF2122/97
gcaugccggucuucgcg

SEQ ID NO: 3087633 - RNA, 21 nt, Mycobacterium bovis subsp bovis AF2122/97
gcaugccggucuucgcgggac

SEQ ID NO: 3087634 - RNA, 12 nt, Mycobacterium bovis subsp bovis AF2122/97
gcaugccguuga

SEQ ID NO: 3087635 - RNA, 12 nt, Mycobacterium bovis subsp bovis AF2122/97
gcaugccguugc

SEQ ID NO: 3087636 - RNA, 13 nt, Mycobacterium bovis subsp bovis AF2122/97
gcaugccuucggc

SEQ ID NO: 3087637 - RNA, 19 nt, Mycobacterium bovis subsp bovis AF2122/97
gcaugcgacagaugccggg

SEQ ID NO: 3087638 - RNA, 14 nt, Mycobacterium bovis subsp bovis AF2122/97
gcaugcgacgucag

SEQ ID NO: 3087639 - RNA, 16 nt, Mycobacterium bovis subsp bovis AF2122/97
gcaugcgaggggcggc

SEQ ID NO: 3087640 - RNA, 18 nt, Mycobacterium bovis subsp bovis AF2122/97
gcaugcgaggggcggcaa

SEQ ID NO: 3087641 - RNA, 19 nt, Mycobacterium bovis subsp bovis AF2122/97
gcaugcgaggggcggcaau

SEQ ID NO: 3087642 - RNA, 17 nt, Mycobacterium bovis subsp bovis AF2122/97
gcaugcgauacacggcg

SEQ ID NO: 3087643 - RNA, 17 nt, Mycobacterium bovis subsp bovis AF2122/97
gcaugcgcgcgccggug

SEQ ID NO: 3087644 - RNA, 12 nt, Mycobacterium bovis subsp bovis AF2122/97
gcaugcgcuccg

SEQ ID NO: 3087645 - RNA, 16 nt, Mycobacterium bovis subsp bovis AF2122/97
gcaugcggaucggcgg

SEQ ID NO: 3087646 - RNA, 18 nt, Mycobacterium bovis subsp bovis AF2122/97
gcaugcguaugcccacga

SEQ ID NO: 3087647 - RNA, 22 nt, Mycobacterium bovis subsp bovis AF2122/97
gcaugcguaugcccacgaaccg

SEQ ID NO: 3087648 - RNA, 14 nt, Mycobacterium bovis subsp bovis AF2122/97
gcaugcgugacccg

SEQ ID NO: 3087649 - RNA, 22 nt, Mycobacterium bovis subsp bovis AF2122/97
gcaugcgugacccgacaugguc

SEQ ID NO: 3087650 - RNA, 14 nt, Mycobacterium bovis subsp bovis AF2122/97
gcaugcgugccggc

SEQ ID NO: 3087651 - RNA, 15 nt, Mycobacterium bovis subsp bovis AF2122/97
gcaugcguuggggca

SEQ ID NO: 3087652 - RNA, 21 nt, Mycobacterium bovis subsp bovis AF2122/97
gcaugcucacgaucugcgcgu

SEQ ID NO: 3087653 - RNA, 14 nt, Mycobacterium bovis subsp bovis AF2122/97
gcaugcucgaucgc

SEQ ID NO: 3087654 - RNA, 15 nt, Mycobacterium bovis subsp bovis AF2122/97
gcaugcucgaucgcg

SEQ ID NO: 3087655 - RNA, 21 nt, Mycobacterium bovis subsp bovis AF2122/97
gcaugcucgaucgcguucugc

SEQ ID NO: 3087656 - RNA, 16 nt, Mycobacterium bovis subsp bovis AF2122/97
gcaugcuggcgaucgc

SEQ ID NO: 3087657 - RNA, 17 nt, Mycobacterium bovis subsp bovis AF2122/97
gcaugcuggcgaucgcg

SEQ ID NO: 3087658 - RNA, 15 nt, Mycobacterium bovis subsp bovis AF2122/97
gcauggacaacagcu

SEQ ID NO: 3087659 - RNA, 20 nt, Mycobacterium bovis subsp bovis AF2122/97
gcauggacaacagcuuggag

SEQ ID NO: 3087660 - RNA, 17 nt, Mycobacterium bovis subsp bovis AF2122/97
gcauggcaggcgaaggc

SEQ ID NO: 3087661 - RNA, 13 nt, Mycobacterium bovis subsp bovis AF2122/97
gcauggccugggu

SEQ ID NO: 3087662 - RNA, 19 nt, Mycobacterium bovis subsp bovis AF2122/97
gcauggcgaacacgucggc

SEQ ID NO: 3087663 - RNA, 20 nt, Mycobacterium bovis subsp bovis AF2122/97
gcauggcgaacacgucggcc

SEQ ID NO: 3087664 - RNA, 15 nt, Mycobacterium bovis subsp bovis AF2122/97
gcauggcgccguugc

SEQ ID NO: 3087665 - RNA, 12 nt, Mycobacterium bovis subsp bovis AF2122/97
gcauggcggcgu

SEQ ID NO: 3087666 - RNA, 14 nt, Mycobacterium bovis subsp bovis AF2122/97
gcaugggacaucca

SEQ ID NO: 3087667 - RNA, 15 nt, Mycobacterium bovis subsp bovis AF2122/97
gcaugggacauccag

SEQ ID NO: 3087668 - RNA, 13 nt, Mycobacterium bovis subsp bovis AF2122/97
gcaugggccaggu

SEQ ID NO: 3087669 - RNA, 22 nt, Mycobacterium bovis subsp bovis AF2122/97
gcaugggcccugcacagcagcg

SEQ ID NO: 3087670 - RNA, 23 nt, Mycobacterium bovis subsp bovis AF2122/97
gcaugggccggcgccgcaccaag

SEQ ID NO: 3087671 - RNA, 17 nt, Mycobacterium bovis subsp bovis AF2122/97
gcauggucaggcggccg

SEQ ID NO: 3087672 - RNA, 15 nt, Mycobacterium bovis subsp bovis AF2122/97
gcaugguccacagcc

SEQ ID NO: 3087673 - RNA, 18 nt, Mycobacterium bovis subsp bovis AF2122/97
gcaugguccacagccggc

SEQ ID NO: 3087674 - RNA, 22 nt, Mycobacterium bovis subsp bovis AF2122/97
gcaugguccagcacaucggcga

SEQ ID NO: 3087675 - RNA, 15 nt, Mycobacterium bovis subsp bovis AF2122/97
gcauggugcggcggc

SEQ ID NO: 3087676 - RNA, 22 nt, Mycobacterium bovis subsp bovis AF2122/97
gcauggugggugccggcgucgc

SEQ ID NO: 3087677 - RNA, 14 nt, Mycobacterium bovis subsp bovis AF2122/97
gcauggugguggcc

SEQ ID NO: 3087678 - RNA, 17 nt, Mycobacterium bovis subsp bovis AF2122/97
gcaugguggugggugau

SEQ ID NO: 3087679 - RNA, 19 nt, Mycobacterium bovis subsp bovis AF2122/97
gcauguccauguuuugcug

SEQ ID NO: 3087680 - RNA, 21 nt, Mycobacterium bovis subsp bovis AF2122/97
gcaugucgccgaacgccacca

SEQ ID NO: 3087681 - RNA, 15 nt, Mycobacterium bovis subsp bovis AF2122/97
gccaacagucgcagc

SEQ ID NO: 3087682 - RNA, 21 nt, Mycobacterium bovis subsp bovis AF2122/97
gccaacauccgguggugcucg

SEQ ID NO: 3087683 - RNA, 12 nt, Mycobacterium bovis subsp bovis AF2122/97
gccaacaucucc

SEQ ID NO: 3087684 - RNA, 19 nt, Mycobacterium bovis subsp bovis AF2122/97
gccaacaucuccgcgucgg

SEQ ID NO: 3087685 - RNA, 14 nt, Mycobacterium bovis subsp bovis AF2122/97
gccaaccagcccgg

SEQ ID NO: 3087686 - RNA, 15 nt, Mycobacterium bovis subsp bovis AF2122/97
gccaaccagcccggc

SEQ ID NO: 3087687 - RNA, 20 nt, Mycobacterium bovis subsp bovis AF2122/97
gccaaccagcccggccgccg

SEQ ID NO: 3087688 - RNA, 16 nt, Mycobacterium bovis subsp bovis AF2122/97
gccaacccaauuggga

SEQ ID NO: 3087689 - RNA, 21 nt, Mycobacterium bovis subsp bovis AF2122/97
gccaacccaauugggacgcgc

SEQ ID NO: 3087690 - RNA, 18 nt, Mycobacterium bovis subsp bovis AF2122/97
gccaacccaucccgaucc

SEQ ID NO: 3087691 - RNA, 15 nt, Mycobacterium bovis subsp bovis AF2122/97
gccaaccccaacauc

SEQ ID NO: 3087692 - RNA, 17 nt, Mycobacterium bovis subsp bovis AF2122/97
gccaacccgggccgcca

SEQ ID NO: 3087693 - RNA, 20 nt, Mycobacterium bovis subsp bovis AF2122/97
gccaacccgucuuaucggcg

SEQ ID NO: 3087694 - RNA, 21 nt, Mycobacterium bovis subsp bovis AF2122/97
gccaacccgucuuaucggcgu

SEQ ID NO: 3087695 - RNA, 17 nt, Mycobacterium bovis subsp bovis AF2122/97
gccaacccugcggcguc

SEQ ID NO: 3087696 - RNA, 12 nt, Mycobacterium bovis subsp bovis AF2122/97
gccaaccgcggc

SEQ ID NO: 3087697 - RNA, 13 nt, Mycobacterium bovis subsp bovis AF2122/97
gccaaccgcggcg

SEQ ID NO: 3087698 - RNA, 16 nt, Mycobacterium bovis subsp bovis AF2122/97
gccaaccgcggcgauc

SEQ ID NO: 3087699 - RNA, 12 nt, Mycobacterium bovis subsp bovis AF2122/97
gccaaccggcgc

SEQ ID NO: 3087700 - RNA, 24 nt, Mycobacterium bovis subsp bovis AF2122/97
gccaaccggcgcaguagccgacca

SEQ ID NO: 3087701 - RNA, 14 nt, Mycobacterium bovis subsp bovis AF2122/97
gccaaccgggugug

SEQ ID NO: 3087702 - RNA, 12 nt, Mycobacterium bovis subsp bovis AF2122/97
gccaaccugggc

SEQ ID NO: 3087703 - RNA, 21 nt, Mycobacterium bovis subsp bovis AF2122/97
gccaacgaaccgcucagcgca

SEQ ID NO: 3087704 - RNA, 22 nt, Mycobacterium bovis subsp bovis AF2122/97
gccaacgaaccgcucagcgcag

SEQ ID NO: 3087705 - RNA, 19 nt, Mycobacterium bovis subsp bovis AF2122/97
gccaacgacaggcgcccac

SEQ ID NO: 3087706 - RNA, 23 nt, Mycobacterium bovis subsp bovis AF2122/97
gccaacgacgccaugagcgcgcc

SEQ ID NO: 3087707 - RNA, 15 nt, Mycobacterium bovis subsp bovis AF2122/97
gccaacgagcgcgcu

SEQ ID NO: 3087708 - RNA, 18 nt, Mycobacterium bovis subsp bovis AF2122/97
gccaacgaugaugaugac

SEQ ID NO: 3087709 - RNA, 20 nt, Mycobacterium bovis subsp bovis AF2122/97
gccaacgccaaaacggucga

SEQ ID NO: 3087710 - RNA, 14 nt, Mycobacterium bovis subsp bovis AF2122/97
gccaacgccagcac

SEQ ID NO: 3087711 - RNA, 16 nt, Mycobacterium bovis subsp bovis AF2122/97
gccaacgccagcacca

SEQ ID NO: 3087712 - RNA, 14 nt, Mycobacterium bovis subsp bovis AF2122/97
gccaacgccagcgg

SEQ ID NO: 3087713 - RNA, 15 nt, Mycobacterium bovis subsp bovis AF2122/97
gccaacgccagcggg

SEQ ID NO: 3087714 - RNA, 22 nt, Mycobacterium bovis subsp bovis AF2122/97
gccaacgccagcggguccccgg

SEQ ID NO: 3087715 - RNA, 17 nt, Mycobacterium bovis subsp bovis AF2122/97
gccaacgcgucccgccg

SEQ ID NO: 3087716 - RNA, 18 nt, Mycobacterium bovis subsp bovis AF2122/97
gccaacgcgucccgccgc

SEQ ID NO: 3087717 - RNA, 19 nt, Mycobacterium bovis subsp bovis AF2122/97
gccaacggcacccugcggc

SEQ ID NO: 3087718 - RNA, 16 nt, Mycobacterium bovis subsp bovis AF2122/97
gccaacggcuccgggc

SEQ ID NO: 3087719 - RNA, 22 nt, Mycobacterium bovis subsp bovis AF2122/97
gccaacgggaacaacggcguaa

SEQ ID NO: 3087720 - RNA, 15 nt, Mycobacterium bovis subsp bovis AF2122/97
gccaacgggcugccc

SEQ ID NO: 3087721 - RNA, 16 nt, Mycobacterium bovis subsp bovis AF2122/97
gccaacgugacgccgg

SEQ ID NO: 3087722 - RNA, 17 nt, Mycobacterium bovis subsp bovis AF2122/97
gccaacgugacgccggc

SEQ ID NO: 3087723 - RNA, 19 nt, Mycobacterium bovis subsp bovis AF2122/97
gccaacgugacgccggcca

SEQ ID NO: 3087724 - RNA, 21 nt, Mycobacterium bovis subsp bovis AF2122/97
gccaacgugacgccggccagu

SEQ ID NO: 3087725 - RNA, 15 nt, Mycobacterium bovis subsp bovis AF2122/97
gccaacguugcgcca

SEQ ID NO: 3087726 - RNA, 16 nt, Mycobacterium bovis subsp bovis AF2122/97
gccaacucaggccggu

SEQ ID NO: 3087727 - RNA, 15 nt, Mycobacterium bovis subsp bovis AF2122/97
gccaacuccagcacc

SEQ ID NO: 3087728 - RNA, 16 nt, Mycobacterium bovis subsp bovis AF2122/97
gccaacuccagcaccc

SEQ ID NO: 3087729 - RNA, 18 nt, Mycobacterium bovis subsp bovis AF2122/97
gccaacuccagcacccgc

SEQ ID NO: 3087730 - RNA, 21 nt, Mycobacterium bovis subsp bovis AF2122/97
gccaacuccagcacccgcugc

SEQ ID NO: 3087731 - RNA, 15 nt, Mycobacterium bovis subsp bovis AF2122/97
gccaacucgaccgac

SEQ ID NO: 3087732 - RNA, 19 nt, Mycobacterium bovis subsp bovis AF2122/97
gccaacucggcgaugacau

SEQ ID NO: 3087733 - RNA, 18 nt, Mycobacterium bovis subsp bovis AF2122/97
gccaacucuucagcaagc

SEQ ID NO: 3087734 - RNA, 19 nt, Mycobacterium bovis subsp bovis AF2122/97
gccaacugggccgagcgcg

SEQ ID NO: 3087735 - RNA, 16 nt, Mycobacterium bovis subsp bovis AF2122/97
gccaacuggucgccaa

SEQ ID NO: 3087736 - RNA, 19 nt, Mycobacterium bovis subsp bovis AF2122/97
gccaacuggucgccaacgc

SEQ ID NO: 3087737 - RNA, 18 nt, Mycobacterium bovis subsp bovis AF2122/97
gccaacuugacccgggga

SEQ ID NO: 3087738 - RNA, 17 nt, Mycobacterium bovis subsp bovis AF2122/97
gccaacuuggcggccag

SEQ ID NO: 3087739 - RNA, 19 nt, Mycobacterium bovis subsp bovis AF2122/97
gccaacuuggcggccagcc

SEQ ID NO: 3087740 - RNA, 23 nt, Mycobacterium bovis subsp bovis AF2122/97
gccaacuuggcggccagccgcuc

SEQ ID NO: 3087741 - RNA, 20 nt, Mycobacterium bovis subsp bovis AF2122/97
gccaagaaucacggccaacc

SEQ ID NO: 3087742 - RNA, 16 nt, Mycobacterium bovis subsp bovis AF2122/97
gccaagaccagaagcc

SEQ ID NO: 3087743 - RNA, 14 nt, Mycobacterium bovis subsp bovis AF2122/97
gccaagacgucggc

SEQ ID NO: 3087744 - RNA, 15 nt, Mycobacterium bovis subsp bovis AF2122/97
gccaagacgucggcg

SEQ ID NO: 3087745 - RNA, 17 nt, Mycobacterium bovis subsp bovis AF2122/97
gccaagacgucggcgug

SEQ ID NO: 3087746 - RNA, 15 nt, Mycobacterium bovis subsp bovis AF2122/97
gccaagaucgggugg

SEQ ID NO: 3087747 - RNA, 13 nt, Mycobacterium bovis subsp bovis AF2122/97
gccaagcagcugg

SEQ ID NO: 3087748 - RNA, 20 nt, Mycobacterium bovis subsp bovis AF2122/97
gccaagcagcugggcaucac

SEQ ID NO: 3087749 - RNA, 14 nt, Mycobacterium bovis subsp bovis AF2122/97
gccaagcaggcggg

SEQ ID NO: 3087750 - RNA, 13 nt, Mycobacterium bovis subsp bovis AF2122/97
gccaagccgcggc

SEQ ID NO: 3087751 - RNA, 19 nt, Mycobacterium bovis subsp bovis AF2122/97
gccaagccgcggcuaggcc

SEQ ID NO: 3087752 - RNA, 12 nt, Mycobacterium bovis subsp bovis AF2122/97
gccaagccggcg

SEQ ID NO: 3087753 - RNA, 14 nt, Mycobacterium bovis subsp bovis AF2122/97
gccaagccggcgag

SEQ ID NO: 3087754 - RNA, 19 nt, Mycobacterium bovis subsp bovis AF2122/97
gccaagcgacucgccggcg

SEQ ID NO: 3087755 - RNA, 21 nt, Mycobacterium bovis subsp bovis AF2122/97
gccaagcgacucgccggcgaa

SEQ ID NO: 3087756 - RNA, 22 nt, Mycobacterium bovis subsp bovis AF2122/97
gccaagcgacucgccggcgaau

SEQ ID NO: 3087757 - RNA, 21 nt, Mycobacterium bovis subsp bovis AF2122/97
gccaagcgagcggucgacgug

SEQ ID NO: 3087758 - RNA, 13 nt, Mycobacterium bovis subsp bovis AF2122/97
gccaagcgccaac

SEQ ID NO: 3087759 - RNA, 20 nt, Mycobacterium bovis subsp bovis AF2122/97
gccaagcucggccaccagcg

SEQ ID NO: 3087760 - RNA, 16 nt, Mycobacterium bovis subsp bovis AF2122/97
gccaagcucggcccag

SEQ ID NO: 3087761 - RNA, 18 nt, Mycobacterium bovis subsp bovis AF2122/97
gccaagcucggcccagcg

SEQ ID NO: 3087762 - RNA, 21 nt, Mycobacterium bovis subsp bovis AF2122/97
gccaagcucggcccagcgcgc

SEQ ID NO: 3087763 - RNA, 18 nt, Mycobacterium bovis subsp bovis AF2122/97
gccaaggaggccaucauc

SEQ ID NO: 3087764 - RNA, 23 nt, Mycobacterium bovis subsp bovis AF2122/97
gccaaggcuuccuccgacgcgau

SEQ ID NO: 3087765 - RNA, 14 nt, Mycobacterium bovis subsp bovis AF2122/97
gccaagggccggau

SEQ ID NO: 3087766 - RNA, 21 nt, Mycobacterium bovis subsp bovis AF2122/97
gccaagggugcuugucgccgc

SEQ ID NO: 3087767 - RNA, 14 nt, Mycobacterium bovis subsp bovis AF2122/97
gccaagguggccac

SEQ ID NO: 3087768 - RNA, 23 nt, Mycobacterium bovis subsp bovis AF2122/97
gccacaugaccugauccggccgg

SEQ ID NO: 3087769 - RNA, 13 nt, Mycobacterium bovis subsp bovis AF2122/97
gccacaugccaca

SEQ ID NO: 3087770 - RNA, 23 nt, Mycobacterium bovis subsp bovis AF2122/97
gccacauguugucgacggucggc

SEQ ID NO: 3087771 - RNA, 17 nt, Mycobacterium bovis subsp bovis AF2122/97
gccacauuucaccaccg

SEQ ID NO: 3087772 - RNA, 21 nt, Mycobacterium bovis subsp bovis AF2122/97
gccacauuucaccaccguggc

SEQ ID NO: 3087773 - RNA, 22 nt, Mycobacterium bovis subsp bovis AF2122/97
gccacauuucaccaccguggcc

SEQ ID NO: 3087774 - RNA, 16 nt, Mycobacterium bovis subsp bovis AF2122/97
gccaccaaaccccaau

SEQ ID NO: 3087775 - RNA, 22 nt, Mycobacterium bovis subsp bovis AF2122/97
gccaccaaccucaucgcggucg

SEQ ID NO: 3087776 - RNA, 23 nt, Mycobacterium bovis subsp bovis AF2122/97
gccaccaaccucaucgcggucgc

SEQ ID NO: 3087777 - RNA, 18 nt, Mycobacterium bovis subsp bovis AF2122/97
gccaccaacucggcgacc

SEQ ID NO: 3087778 - RNA, 17 nt, Mycobacterium bovis subsp bovis AF2122/97
gccaccacaucgcgggc

SEQ ID NO: 3087779 - RNA, 18 nt, Mycobacterium bovis subsp bovis AF2122/97
gccaccacaugcgagucg

SEQ ID NO: 3087780 - RNA, 14 nt, Mycobacterium bovis subsp bovis AF2122/97
gccaccaccacggc

SEQ ID NO: 3087781 - RNA, 18 nt, Mycobacterium bovis subsp bovis AF2122/97
gccaccaccaggcugacg

SEQ ID NO: 3087782 - RNA, 20 nt, Mycobacterium bovis subsp bovis AF2122/97
gccaccaccagggcaacggc

SEQ ID NO: 3087783 - RNA, 14 nt, Mycobacterium bovis subsp bovis AF2122/97
gccaccaccagguc

SEQ ID NO: 3087784 - RNA, 21 nt, Mycobacterium bovis subsp bovis AF2122/97
gccaccacccaacagcccacc

SEQ ID NO: 3087785 - RNA, 23 nt, Mycobacterium bovis subsp bovis AF2122/97
gccaccacccaacagcccaccgg

SEQ ID NO: 3087786 - RNA, 15 nt, Mycobacterium bovis subsp bovis AF2122/97
gccaccacccaggcc

SEQ ID NO: 3087787 - RNA, 16 nt, Mycobacterium bovis subsp bovis AF2122/97
gccaccaccccgucga

SEQ ID NO: 3087788 - RNA, 17 nt, Mycobacterium bovis subsp bovis AF2122/97
gccaccacccggcgcag

SEQ ID NO: 3087789 - RNA, 19 nt, Mycobacterium bovis subsp bovis AF2122/97
gccaccacccggcgcagcu

SEQ ID NO: 3087790 - RNA, 12 nt, Mycobacterium bovis subsp bovis AF2122/97
gccaccaccgcc

SEQ ID NO: 3087791 - RNA, 14 nt, Mycobacterium bovis subsp bovis AF2122/97
gccaccaccgccga

SEQ ID NO: 3087792 - RNA, 17 nt, Mycobacterium bovis subsp bovis AF2122/97
gccaccaccgccgccgg

SEQ ID NO: 3087793 - RNA, 18 nt, Mycobacterium bovis subsp bovis AF2122/97
gccaccaccgccgccggc

SEQ ID NO: 3087794 - RNA, 15 nt, Mycobacterium bovis subsp bovis AF2122/97
gccaccaccgcgccg

SEQ ID NO: 3087795 - RNA, 17 nt, Mycobacterium bovis subsp bovis AF2122/97
gccaccaccgcgccguc

SEQ ID NO: 3087796 - RNA, 17 nt, Mycobacterium bovis subsp bovis AF2122/97
gccaccaccgcugccgg

SEQ ID NO: 3087797 - RNA, 20 nt, Mycobacterium bovis subsp bovis AF2122/97
gccaccaccgcugccggcgc

SEQ ID NO: 3087798 - RNA, 21 nt, Mycobacterium bovis subsp bovis AF2122/97
gccaccaccgcugccggcgcc

SEQ ID NO: 3087799 - RNA, 22 nt, Mycobacterium bovis subsp bovis AF2122/97
gccaccaccgcugccggcgccg

SEQ ID NO: 3087800 - RNA, 14 nt, Mycobacterium bovis subsp bovis AF2122/97
gccaccaccggcgc

SEQ ID NO: 3087801 - RNA, 21 nt, Mycobacterium bovis subsp bovis AF2122/97
gccaccaccggcgccuccggc

SEQ ID NO: 3087802 - RNA, 20 nt, Mycobacterium bovis subsp bovis AF2122/97
gccaccaccgugaagcccug

SEQ ID NO: 3087803 - RNA, 21 nt, Mycobacterium bovis subsp bovis AF2122/97
gccaccaccgugaagcccugg

SEQ ID NO: 3087804 - RNA, 16 nt, Mycobacterium bovis subsp bovis AF2122/97
gccaccaccuucgggu

SEQ ID NO: 3087805 - RNA, 20 nt, Mycobacterium bovis subsp bovis AF2122/97
gccaccacgcaugcgcgcgc

SEQ ID NO: 3087806 - RNA, 21 nt, Mycobacterium bovis subsp bovis AF2122/97
gccaccacgcaugcgcgcgcc

SEQ ID NO: 3087807 - RNA, 15 nt, Mycobacterium bovis subsp bovis AF2122/97
gccaccacgcgccgc

SEQ ID NO: 3087808 - RNA, 17 nt, Mycobacterium bovis subsp bovis AF2122/97
gccaccacgcgccgcac

SEQ ID NO: 3087809 - RNA, 20 nt, Mycobacterium bovis subsp bovis AF2122/97
gccaccacggucaagccggc

SEQ ID NO: 3087810 - RNA, 17 nt, Mycobacterium bovis subsp bovis AF2122/97
gccaccacugcgcccgc

SEQ ID NO: 3087811 - RNA, 16 nt, Mycobacterium bovis subsp bovis AF2122/97
gccaccagaaccagcg

SEQ ID NO: 3087812 - RNA, 13 nt, Mycobacterium bovis subsp bovis AF2122/97
gccaccagaaucc

SEQ ID NO: 3087813 - RNA, 16 nt, Mycobacterium bovis subsp bovis AF2122/97
gccaccagacaacgcc

SEQ ID NO: 3087814 - RNA, 21 nt, Mycobacterium bovis subsp bovis AF2122/97
gccaccagacaacgccgucga

SEQ ID NO: 3087815 - RNA, 14 nt, Mycobacterium bovis subsp bovis AF2122/97
gccaccagcaccgc

SEQ ID NO: 3087816 - RNA, 18 nt, Mycobacterium bovis subsp bovis AF2122/97
gccaccagccgguccagc

SEQ ID NO: 3087817 - RNA, 22 nt, Mycobacterium bovis subsp bovis AF2122/97
gccaccagccgguccagcagcu

SEQ ID NO: 3087818 - RNA, 15 nt, Mycobacterium bovis subsp bovis AF2122/97
gccaccagcgacgac

SEQ ID NO: 3087819 - RNA, 16 nt, Mycobacterium bovis subsp bovis AF2122/97
gccaccagcgcccggc

SEQ ID NO: 3087820 - RNA, 19 nt, Mycobacterium bovis subsp bovis AF2122/97
gccaccagcgcccggcccg

SEQ ID NO: 3087821 - RNA, 22 nt, Mycobacterium bovis subsp bovis AF2122/97
gccaccagcgcccggcccgcca

SEQ ID NO: 3087822 - RNA, 13 nt, Mycobacterium bovis subsp bovis AF2122/97
gccaccagcgcga

SEQ ID NO: 3087823 - RNA, 17 nt, Mycobacterium bovis subsp bovis AF2122/97
gccaccagcgcgagccc

SEQ ID NO: 3087824 - RNA, 20 nt, Mycobacterium bovis subsp bovis AF2122/97
gccaccagcgucgcacgcgc

SEQ ID NO: 3087825 - RNA, 23 nt, Mycobacterium bovis subsp bovis AF2122/97
gccaccagcgucgcacgcgcgca

SEQ ID NO: 3087826 - RNA, 16 nt, Mycobacterium bovis subsp bovis AF2122/97
gccaccagcugcgcga

SEQ ID NO: 3087827 - RNA, 16 nt, Mycobacterium bovis subsp bovis AF2122/97
gccaccagcuggcgau

SEQ ID NO: 3087828 - RNA, 20 nt, Mycobacterium bovis subsp bovis AF2122/97
gccaccagggccaccgcgcc

SEQ ID NO: 3087829 - RNA, 21 nt, Mycobacterium bovis subsp bovis AF2122/97
gccaccagggccaccgcgccg

SEQ ID NO: 3087830 - RNA, 17 nt, Mycobacterium bovis subsp bovis AF2122/97
gccaccagggccgcagu

SEQ ID NO: 3087831 - RNA, 14 nt, Mycobacterium bovis subsp bovis AF2122/97
gccaccagggcggc

SEQ ID NO: 3087832 - RNA, 17 nt, Mycobacterium bovis subsp bovis AF2122/97
gccaccaggggaccgcg

SEQ ID NO: 3087833 - RNA, 19 nt, Mycobacterium bovis subsp bovis AF2122/97
gccaccaggggaccgcggc

SEQ ID NO: 3087834 - RNA, 21 nt, Mycobacterium bovis subsp bovis AF2122/97
gccaccaggggaccgcggcgc

SEQ ID NO: 3087835 - RNA, 22 nt, Mycobacterium bovis subsp bovis AF2122/97
gccaccaggggaccgcggcgcg

SEQ ID NO: 3087836 - RNA, 14 nt, Mycobacterium bovis subsp bovis AF2122/97
gccaccaucgcccc

SEQ ID NO: 3087837 - RNA, 13 nt, Mycobacterium bovis subsp bovis AF2122/97
gccaccaucgccg

SEQ ID NO: 3087838 - RNA, 17 nt, Mycobacterium bovis subsp bovis AF2122/97
gccaccaucgccgccgu

SEQ ID NO: 3087839 - RNA, 19 nt, Mycobacterium bovis subsp bovis AF2122/97
gccaccaucgccgccguug

SEQ ID NO: 3087840 - RNA, 20 nt, Mycobacterium bovis subsp bovis AF2122/97
gccaccaucgccgccguugc

SEQ ID NO: 3087841 - RNA, 19 nt, Mycobacterium bovis subsp bovis AF2122/97
gccaccaucgccucggcgc

SEQ ID NO: 3087842 - RNA, 19 nt, Mycobacterium bovis subsp bovis AF2122/97
gccaccaucggggaagggg

SEQ ID NO: 3087843 - RNA, 17 nt, Mycobacterium bovis subsp bovis AF2122/97
gccaccaucguugccgg

SEQ ID NO: 3087844 - RNA, 16 nt, Mycobacterium bovis subsp bovis AF2122/97
gccacccaacagcgcu

SEQ ID NO: 3087845 - RNA, 20 nt, Mycobacterium bovis subsp bovis AF2122/97
gccacccacauggcggcccg

SEQ ID NO: 3087846 - RNA, 15 nt, Mycobacterium bovis subsp bovis AF2122/97
gccacccaccgacau

SEQ ID NO: 3087847 - RNA, 21 nt, Mycobacterium bovis subsp bovis AF2122/97
gccacccagcaccagggcgcg

SEQ ID NO: 3087848 - RNA, 16 nt, Mycobacterium bovis subsp bovis AF2122/97
gccacccagcacgcgc

SEQ ID NO: 3087849 - RNA, 18 nt, Mycobacterium bovis subsp bovis AF2122/97
gccacccagggccuuccc

SEQ ID NO: 3087850 - RNA, 21 nt, Mycobacterium bovis subsp bovis AF2122/97
gccacccagggccuucccgau

SEQ ID NO: 3087851 - RNA, 12 nt, Mycobacterium bovis subsp bovis AF2122/97
gccacccaucgc

SEQ ID NO: 3087852 - RNA, 19 nt, Mycobacterium bovis subsp bovis AF2122/97
gccaccccauacgcaccgg

SEQ ID NO: 3087853 - RNA, 18 nt, Mycobacterium bovis subsp bovis AF2122/97
gccacccccaccgucgcg

SEQ ID NO: 3087854 - RNA, 18 nt, Mycobacterium bovis subsp bovis AF2122/97
gccaccgcugccggcacg

SEQ ID NO: 3087855 - RNA, 20 nt, Mycobacterium bovis subsp bovis AF2122/97
gccaccgcugccggcacgca

SEQ ID NO: 3087856 - RNA, 23 nt, Mycobacterium bovis subsp bovis AF2122/97
gccaccggaauccuggccgccgc

SEQ ID NO: 3087857 - RNA, 23 nt, Mycobacterium bovis subsp bovis AF2122/97
gccaccggaggugcgccgcgggc

SEQ ID NO: 3087858 - RNA, 18 nt, Mycobacterium bovis subsp bovis AF2122/97
gccaccggcaaucggcgg

SEQ ID NO: 3087859 - RNA, 21 nt, Mycobacterium bovis subsp bovis AF2122/97
gccaccggcaaucggcggcac

SEQ ID NO: 3087860 - RNA, 13 nt, Mycobacterium bovis subsp bovis AF2122/97
gccaccggcaccg

SEQ ID NO: 3087861 - RNA, 14 nt, Mycobacterium bovis subsp bovis AF2122/97
gccaccggcaccgc

SEQ ID NO: 3087862 - RNA, 20 nt, Mycobacterium bovis subsp bovis AF2122/97
gccaccggcaccgccugcgc

SEQ ID NO: 3087863 - RNA, 15 nt, Mycobacterium bovis subsp bovis AF2122/97
gccaccggccgcggc

SEQ ID NO: 3087864 - RNA, 15 nt, Mycobacterium bovis subsp bovis AF2122/97
gccaccggccggcgc

SEQ ID NO: 3087865 - RNA, 16 nt, Mycobacterium bovis subsp bovis AF2122/97
gccaccggccggcgca

SEQ ID NO: 3087866 - RNA, 17 nt, Mycobacterium bovis subsp bovis AF2122/97
gccaccggccggcgcag

SEQ ID NO: 3087867 - RNA, 16 nt, Mycobacterium bovis subsp bovis AF2122/97
gccaccggcgacgccg

SEQ ID NO: 3087868 - RNA, 16 nt, Mycobacterium bovis subsp bovis AF2122/97
gccaccggcgccaccg

SEQ ID NO: 3087869 - RNA, 18 nt, Mycobacterium bovis subsp bovis AF2122/97
gccaccggcgccaccggc

SEQ ID NO: 3087870 - RNA, 22 nt, Mycobacterium bovis subsp bovis AF2122/97
gccaccggcgccaccggcgccg

SEQ ID NO: 3087871 - RNA, 23 nt, Mycobacterium bovis subsp bovis AF2122/97
gccaccggcgccaccggcgccgc

SEQ ID NO: 3087872 - RNA, 14 nt, Mycobacterium bovis subsp bovis AF2122/97
gccaccggcgccgc

SEQ ID NO: 3087873 - RNA, 16 nt, Mycobacterium bovis subsp bovis AF2122/97
gccaccggcgccgccc

SEQ ID NO: 3087874 - RNA, 20 nt, Mycobacterium bovis subsp bovis AF2122/97
gccaccggcgccgcccgcgc

SEQ ID NO: 3087875 - RNA, 21 nt, Mycobacterium bovis subsp bovis AF2122/97
gccaccggcgccgcccgcgcc

SEQ ID NO: 3087876 - RNA, 17 nt, Mycobacterium bovis subsp bovis AF2122/97
gccaccggcgccgccgu

SEQ ID NO: 3087877 - RNA, 21 nt, Mycobacterium bovis subsp bovis AF2122/97
gccaccggcgccgccgucgcc

SEQ ID NO: 3087878 - RNA, 23 nt, Mycobacterium bovis subsp bovis AF2122/97
gccaccggcgccgccgucgccgc

SEQ ID NO: 3087879 - RNA, 12 nt, Mycobacterium bovis subsp bovis AF2122/97
gccaccggcgcg

SEQ ID NO: 3087880 - RNA, 17 nt, Mycobacterium bovis subsp bovis AF2122/97
gccaccggcgcgaccgc

SEQ ID NO: 3087881 - RNA, 20 nt, Mycobacterium bovis subsp bovis AF2122/97
gccaccggcgcgaccgcggc

SEQ ID NO: 3087882 - RNA, 13 nt, Mycobacterium bovis subsp bovis AF2122/97
gccaccggcgucg

SEQ ID NO: 3087883 - RNA, 16 nt, Mycobacterium bovis subsp bovis AF2122/97
gccaccggcgucgacg

SEQ ID NO: 3087884 - RNA, 16 nt, Mycobacterium bovis subsp bovis AF2122/97
gccaccggcgucugcc

SEQ ID NO: 3087885 - RNA, 21 nt, Mycobacterium bovis subsp bovis AF2122/97
gccaccggcguuguugaccag

SEQ ID NO: 3087886 - RNA, 17 nt, Mycobacterium bovis subsp bovis AF2122/97
gccaccggcugcaacca

SEQ ID NO: 3087887 - RNA, 15 nt, Mycobacterium bovis subsp bovis AF2122/97
gccaccggcuggugc

SEQ ID NO: 3087888 - RNA, 20 nt, Mycobacterium bovis subsp bovis AF2122/97
gccaccgggcgugcggcggc

SEQ ID NO: 3087889 - RNA, 22 nt, Mycobacterium bovis subsp bovis AF2122/97
gccaccggggaagaucucggcc

SEQ ID NO: 3087890 - RNA, 15 nt, Mycobacterium bovis subsp bovis AF2122/97
gccaccggggucacc

SEQ ID NO: 3087891 - RNA, 19 nt, Mycobacterium bovis subsp bovis AF2122/97
gccaccgguaccgaucagc

SEQ ID NO: 3087892 - RNA, 17 nt, Mycobacterium bovis subsp bovis AF2122/97
gccaccgguaccgccgg

SEQ ID NO: 3087893 - RNA, 20 nt, Mycobacterium bovis subsp bovis AF2122/97
gccaccgguaccgccggcuc

SEQ ID NO: 3087894 - RNA, 16 nt, Mycobacterium bovis subsp bovis AF2122/97
gccaccgguaccggcg

SEQ ID NO: 3087895 - RNA, 17 nt, Mycobacterium bovis subsp bovis AF2122/97
gccaccgguaccggcga

SEQ ID NO: 3087896 - RNA, 18 nt, Mycobacterium bovis subsp bovis AF2122/97
gccaccgguaccggcgac

SEQ ID NO: 3087897 - RNA, 14 nt, Mycobacterium bovis subsp bovis AF2122/97
gccaccggugccgg

SEQ ID NO: 3087898 - RNA, 19 nt, Mycobacterium bovis subsp bovis AF2122/97
gccaccggugccggcgacg

SEQ ID NO: 3087899 - RNA, 19 nt, Mycobacterium bovis subsp bovis AF2122/97
gccaccgguuuggagcuca

SEQ ID NO: 3087900 - RNA, 21 nt, Mycobacterium bovis subsp bovis AF2122/97
gccaccguaaacagcgcgccg

SEQ ID NO: 3087901 - RNA, 17 nt, Mycobacterium bovis subsp bovis AF2122/97
gccaccguagccgaggg

SEQ ID NO: 3087902 - RNA, 14 nt, Mycobacterium bovis subsp bovis AF2122/97
gccaccgucaccgc

SEQ ID NO: 3087903 - RNA, 22 nt, Mycobacterium bovis subsp bovis AF2122/97
gccaccgucaccgccguugccg

SEQ ID NO: 3087904 - RNA, 13 nt, Mycobacterium bovis subsp bovis AF2122/97
gccaccgucagcg

SEQ ID NO: 3087905 - RNA, 19 nt, Mycobacterium bovis subsp bovis AF2122/97
gccaccgucagcgcgaccg

SEQ ID NO: 3087906 - RNA, 14 nt, Mycobacterium bovis subsp bovis AF2122/97
gccaccgucaugcc

SEQ ID NO: 3087907 - RNA, 16 nt, Mycobacterium bovis subsp bovis AF2122/97
gccaccgucaugccga

SEQ ID NO: 3087908 - RNA, 19 nt, Mycobacterium bovis subsp bovis AF2122/97
gccaccgucaugccgacga

SEQ ID NO: 3087909 - RNA, 13 nt, Mycobacterium bovis subsp bovis AF2122/97
gccaccgucaugg

SEQ ID NO: 3087910 - RNA, 15 nt, Mycobacterium bovis subsp bovis AF2122/97
gccaccgucauggcg

SEQ ID NO: 3087911 - RNA, 12 nt, Mycobacterium bovis subsp bovis AF2122/97
gccaccgucgcc

SEQ ID NO: 3087912 - RNA, 17 nt, Mycobacterium bovis subsp bovis AF2122/97
gccaccgucgccguaca

SEQ ID NO: 3087913 - RNA, 13 nt, Mycobacterium bovis subsp bovis AF2122/97
gccaccgucgcgg

SEQ ID NO: 3087914 - RNA, 16 nt, Mycobacterium bovis subsp bovis AF2122/97
gccaccgucgcggcgg

SEQ ID NO: 3087915 - RNA, 17 nt, Mycobacterium bovis subsp bovis AF2122/97
gccaccgucgcggcggc

SEQ ID NO: 3087916 - RNA, 19 nt, Mycobacterium bovis subsp bovis AF2122/97
gccaccgucgcggcggcac

SEQ ID NO: 3087917 - RNA, 15 nt, Mycobacterium bovis subsp bovis AF2122/97
gccaccgucgcugcc

SEQ ID NO: 3087918 - RNA, 20 nt, Mycobacterium bovis subsp bovis AF2122/97
gccaccgucgcugcccgcgc

SEQ ID NO: 3087919 - RNA, 22 nt, Mycobacterium bovis subsp bovis AF2122/97
gccaccgucgcugcccgcgcgg

SEQ ID NO: 3087920 - RNA, 23 nt, Mycobacterium bovis subsp bovis AF2122/97
gccaccgugguggacgaccgcgc

SEQ ID NO: 3087921 - RNA, 20 nt, Mycobacterium bovis subsp bovis AF2122/97
gccaccgugucacgcgacca

SEQ ID NO: 3087922 - RNA, 23 nt, Mycobacterium bovis subsp bovis AF2122/97
gccaccgugucacgcgaccaccg

SEQ ID NO: 3087923 - RNA, 13 nt, Mycobacterium bovis subsp bovis AF2122/97
gccaccgugugca

SEQ ID NO: 3087924 - RNA, 17 nt, Mycobacterium bovis subsp bovis AF2122/97
gccaccguuaccgccgu

SEQ ID NO: 3087925 - RNA, 16 nt, Mycobacterium bovis subsp bovis AF2122/97
gccaccguugccgccg

SEQ ID NO: 3087926 - RNA, 17 nt, Mycobacterium bovis subsp bovis AF2122/97
gccaccguugggccgac

SEQ ID NO: 3087927 - RNA, 18 nt, Mycobacterium bovis subsp bovis AF2122/97
gccaccguugggccgacu

SEQ ID NO: 3087928 - RNA, 14 nt, Mycobacterium bovis subsp bovis AF2122/97
gccaccuacgaagc

SEQ ID NO: 3087929 - RNA, 19 nt, Mycobacterium bovis subsp bovis AF2122/97
gccaccucccacgccgccg

SEQ ID NO: 3087930 - RNA, 20 nt, Mycobacterium bovis subsp bovis AF2122/97
gccaccucccacgccgccgu

SEQ ID NO: 3087931 - RNA, 22 nt, Mycobacterium bovis subsp bovis AF2122/97
gccaccucccagggcucggcgg

SEQ ID NO: 3087932 - RNA, 21 nt, Mycobacterium bovis subsp bovis AF2122/97
gccaccuccgaggccgccauc

SEQ ID NO: 3087933 - RNA, 23 nt, Mycobacterium bovis subsp bovis AF2122/97
gccaccuccgaggccgccaucgc

SEQ ID NO: 3087934 - RNA, 18 nt, Mycobacterium bovis subsp bovis AF2122/97
gccaccucgacggugacg

SEQ ID NO: 3087935 - RNA, 13 nt, Mycobacterium bovis subsp bovis AF2122/97
gccaccucgccgg

SEQ ID NO: 3087936 - RNA, 21 nt, Mycobacterium bovis subsp bovis AF2122/97
gccaccucgccggccgucagc

SEQ ID NO: 3087937 - RNA, 23 nt, Mycobacterium bovis subsp bovis AF2122/97
gccaccucgccggccgucagcac

SEQ ID NO: 3087938 - RNA, 18 nt, Mycobacterium bovis subsp bovis AF2122/97
gccaccucuaccgguggu

SEQ ID NO: 3087939 - RNA, 13 nt, Mycobacterium bovis subsp bovis AF2122/97
gccaccucuucga

SEQ ID NO: 3087940 - RNA, 19 nt, Mycobacterium bovis subsp bovis AF2122/97
gccacggcuguggccgcaa

SEQ ID NO: 3087941 - RNA, 21 nt, Mycobacterium bovis subsp bovis AF2122/97
gccacggcuguggccgcaauc

SEQ ID NO: 3087942 - RNA, 19 nt, Mycobacterium bovis subsp bovis AF2122/97
gccacggcuuugcggcgcg

SEQ ID NO: 3087943 - RNA, 20 nt, Mycobacterium bovis subsp bovis AF2122/97
gccacggcuuugcggcgcga

SEQ ID NO: 3087944 - RNA, 22 nt, Mycobacterium bovis subsp bovis AF2122/97
gccacggcuuugcggcgcgacc

SEQ ID NO: 3087945 - RNA, 15 nt, Mycobacterium bovis subsp bovis AF2122/97
gccacgggcggccac

SEQ ID NO: 3087946 - RNA, 17 nt, Mycobacterium bovis subsp bovis AF2122/97
gccacgggcggccaccg

SEQ ID NO: 3087947 - RNA, 16 nt, Mycobacterium bovis subsp bovis AF2122/97
gccacggggauuggcg

SEQ ID NO: 3087948 - RNA, 19 nt, Mycobacterium bovis subsp bovis AF2122/97
gccacggggcugccgguga

SEQ ID NO: 3087949 - RNA, 20 nt, Mycobacterium bovis subsp bovis AF2122/97
gccacggguagcugccgcgg

SEQ ID NO: 3087950 - RNA, 21 nt, Mycobacterium bovis subsp bovis AF2122/97
gccacggguagcugccgcggc

SEQ ID NO: 3087951 - RNA, 16 nt, Mycobacterium bovis subsp bovis AF2122/97
gccacgguacauccag

SEQ ID NO: 3087952 - RNA, 14 nt, Mycobacterium bovis subsp bovis AF2122/97
gccacgguccggcc

SEQ ID NO: 3087953 - RNA, 15 nt, Mycobacterium bovis subsp bovis AF2122/97
gccacgguccggccc

SEQ ID NO: 3087954 - RNA, 20 nt, Mycobacterium bovis subsp bovis AF2122/97
gccacgguccggcccaccag

SEQ ID NO: 3087955 - RNA, 15 nt, Mycobacterium bovis subsp bovis AF2122/97
gccacggucgccgac

SEQ ID NO: 3087956 - RNA, 18 nt, Mycobacterium bovis subsp bovis AF2122/97
gccacgguggagcgcgcc

SEQ ID NO: 3087957 - RNA, 19 nt, Mycobacterium bovis subsp bovis AF2122/97
gccacgguggagcgcgccu

SEQ ID NO: 3087958 - RNA, 17 nt, Mycobacterium bovis subsp bovis AF2122/97
gccacgguucgggcagc

SEQ ID NO: 3087959 - RNA, 18 nt, Mycobacterium bovis subsp bovis AF2122/97
gccacgguucgggcagca

SEQ ID NO: 3087960 - RNA, 19 nt, Mycobacterium bovis subsp bovis AF2122/97
gccacgguucgggcagcac

SEQ ID NO: 3087961 - RNA, 23 nt, Mycobacterium bovis subsp bovis AF2122/97
gccacgguucgggcagcacccgc

SEQ ID NO: 3087962 - RNA, 19 nt, Mycobacterium bovis subsp bovis AF2122/97
gccacgguugguccaaugc

SEQ ID NO: 3087963 - RNA, 21 nt, Mycobacterium bovis subsp bovis AF2122/97
gccacguacuuggacgacccg

SEQ ID NO: 3087964 - RNA, 16 nt, Mycobacterium bovis subsp bovis AF2122/97
gccacguagcagcgcc

SEQ ID NO: 3087965 - RNA, 21 nt, Mycobacterium bovis subsp bovis AF2122/97
gccacguagcagcgccggcac

SEQ ID NO: 3087966 - RNA, 22 nt, Mycobacterium bovis subsp bovis AF2122/97
gccacguagcagcgccggcacc

SEQ ID NO: 3087967 - RNA, 20 nt, Mycobacterium bovis subsp bovis AF2122/97
gccacguccaacucggcccg

SEQ ID NO: 3087968 - RNA, 18 nt, Mycobacterium bovis subsp bovis AF2122/97
gccacguccaucaccggc

SEQ ID NO: 3087969 - RNA, 20 nt, Mycobacterium bovis subsp bovis AF2122/97
gccacguccaucaccggcgg

SEQ ID NO: 3087970 - RNA, 23 nt, Mycobacterium bovis subsp bovis AF2122/97
gccacguccaucaccggcggccc

SEQ ID NO: 3087971 - RNA, 20 nt, Mycobacterium bovis subsp bovis AF2122/97
gccacgucccaggacuccgg

SEQ ID NO: 3087972 - RNA, 22 nt, Mycobacterium bovis subsp bovis AF2122/97
gccacgucccaggacuccggcc

SEQ ID NO: 3087973 - RNA, 21 nt, Mycobacterium bovis subsp bovis AF2122/97
gccacguccucagccgugccc

SEQ ID NO: 3087974 - RNA, 13 nt, Mycobacterium bovis subsp bovis AF2122/97
gccacguccugcc

SEQ ID NO: 3087975 - RNA, 21 nt, Mycobacterium bovis subsp bovis AF2122/97
gccacguccugcccgucgucg

SEQ ID NO: 3087976 - RNA, 22 nt, Mycobacterium bovis subsp bovis AF2122/97
gccacguccugcccgucgucgg

SEQ ID NO: 3087977 - RNA, 13 nt, Mycobacterium bovis subsp bovis AF2122/97
gccacgucgacgg

SEQ ID NO: 3087978 - RNA, 16 nt, Mycobacterium bovis subsp bovis AF2122/97
gccacgucgacggucu

SEQ ID NO: 3087979 - RNA, 15 nt, Mycobacterium bovis subsp bovis AF2122/97
gccacgucgagcacc

SEQ ID NO: 3087980 - RNA, 15 nt, Mycobacterium bovis subsp bovis AF2122/97
gccacgucgaugugc

SEQ ID NO: 3087981 - RNA, 16 nt, Mycobacterium bovis subsp bovis AF2122/97
gccacgucgaugugcg

SEQ ID NO: 3087982 - RNA, 14 nt, Mycobacterium bovis subsp bovis AF2122/97
gccacgucgccggc

SEQ ID NO: 3087983 - RNA, 14 nt, Mycobacterium bovis subsp bovis AF2122/97
gccacgucggcgaa

SEQ ID NO: 3087984 - RNA, 15 nt, Mycobacterium bovis subsp bovis AF2122/97
gccacgucggcgaac

SEQ ID NO: 3087985 - RNA, 16 nt, Mycobacterium bovis subsp bovis AF2122/97
gccacgucgucgccca

SEQ ID NO: 3087986 - RNA, 14 nt, Mycobacterium bovis subsp bovis AF2122/97
gccacgucucgcga

SEQ ID NO: 3087987 - RNA, 20 nt, Mycobacterium bovis subsp bovis AF2122/97
gccacguggucgagcaggcg

SEQ ID NO: 3087988 - RNA, 19 nt, Mycobacterium bovis subsp bovis AF2122/97
gccacguuacgcucgcggg

SEQ ID NO: 3087989 - RNA, 21 nt, Mycobacterium bovis subsp bovis AF2122/97
gccacguuacgcucgcgggcc

SEQ ID NO: 3087990 - RNA, 15 nt, Mycobacterium bovis subsp bovis AF2122/97
gccacguucgcggcc

SEQ ID NO: 3087991 - RNA, 16 nt, Mycobacterium bovis subsp bovis AF2122/97
gccacguucgcggcca

SEQ ID NO: 3087992 - RNA, 18 nt, Mycobacterium bovis subsp bovis AF2122/97
gccacguucgcggccaac

SEQ ID NO: 3087993 - RNA, 19 nt, Mycobacterium bovis subsp bovis AF2122/97
gccacguugaucccgaacc

SEQ ID NO: 3087994 - RNA, 17 nt, Mycobacterium bovis subsp bovis AF2122/97
gccacguuguccgcgac

SEQ ID NO: 3087995 - RNA, 20 nt, Mycobacterium bovis subsp bovis AF2122/97
gccacuagcauugucgccgg

SEQ ID NO: 3087996 - RNA, 14 nt, Mycobacterium bovis subsp bovis AF2122/97
gccacuagcccuga

SEQ ID NO: 3087997 - RNA, 19 nt, Mycobacterium bovis subsp bovis AF2122/97
gccacuagcccugagcgaa

SEQ ID NO: 3087998 - RNA, 15 nt, Mycobacterium bovis subsp bovis AF2122/97
gccacucagcccgac

SEQ ID NO: 3087999 - RNA, 20 nt, Mycobacterium bovis subsp bovis AF2122/97
gccacuccaggagccgagga

SEQ ID NO: 3088000 - RNA, 20 nt, Mycobacterium bovis subsp bovis AF2122/97
gccacuccaugagccguagu

SEQ ID NO: 3088001 - RNA, 14 nt, Mycobacterium bovis subsp bovis AF2122/97
gccacucccagcca

SEQ ID NO: 3088002 - RNA, 22 nt, Mycobacterium bovis subsp bovis AF2122/97
gccacuccgguggccaacaccg

SEQ ID NO: 3088003 - RNA, 17 nt, Mycobacterium bovis subsp bovis AF2122/97
gccacuccucggugugc

SEQ ID NO: 3088004 - RNA, 24 nt, Mycobacterium bovis subsp bovis AF2122/97
gccacuccucggugugcucgccga

SEQ ID NO: 3088005 - RNA, 16 nt, Mycobacterium bovis subsp bovis AF2122/97
gccacucgaucaccgg

SEQ ID NO: 3088006 - RNA, 18 nt, Mycobacterium bovis subsp bovis AF2122/97
gccacucgaucaccggca

SEQ ID NO: 3088007 - RNA, 16 nt, Mycobacterium bovis subsp bovis AF2122/97
gccacucgcccgcugc

SEQ ID NO: 3088008 - RNA, 17 nt, Mycobacterium bovis subsp bovis AF2122/97
gccacucgcccgcugcc

SEQ ID NO: 3088009 - RNA, 13 nt, Mycobacterium bovis subsp bovis AF2122/97
gccacucgcgcac

SEQ ID NO: 3088010 - RNA, 16 nt, Mycobacterium bovis subsp bovis AF2122/97
gccacucggcccggca

SEQ ID NO: 3088011 - RNA, 14 nt, Mycobacterium bovis subsp bovis AF2122/97
gccacugaccgcga

SEQ ID NO: 3088012 - RNA, 20 nt, Mycobacterium bovis subsp bovis AF2122/97
gccacugaccgcgaucgccg

SEQ ID NO: 3088013 - RNA, 22 nt, Mycobacterium bovis subsp bovis AF2122/97
gccacugaccgcgaucgccgac

SEQ ID NO: 3088014 - RNA, 17 nt, Mycobacterium bovis subsp bovis AF2122/97
gccacugauucgcaggc

SEQ ID NO: 3088015 - RNA, 13 nt, Mycobacterium bovis subsp bovis AF2122/97
gccacugccagcc

SEQ ID NO: 3088016 - RNA, 15 nt, Mycobacterium bovis subsp bovis AF2122/97
gccacugccagccgu

SEQ ID NO: 3088017 - RNA, 15 nt, Mycobacterium bovis subsp bovis AF2122/97
gccacugccgaccag

SEQ ID NO: 3088018 - RNA, 18 nt, Mycobacterium bovis subsp bovis AF2122/97
gccacugcggcauggcag

SEQ ID NO: 3088019 - RNA, 14 nt, Mycobacterium bovis subsp bovis AF2122/97
gccacugcugggcu

SEQ ID NO: 3088020 - RNA, 18 nt, Mycobacterium bovis subsp bovis AF2122/97
gccacugcuuccggaaca

SEQ ID NO: 3088021 - RNA, 22 nt, Mycobacterium bovis subsp bovis AF2122/97
gccacuggccgguucgcccgag

SEQ ID NO: 3088022 - RNA, 14 nt, Mycobacterium bovis subsp bovis AF2122/97
gccacuggcgccgg

SEQ ID NO: 3088023 - RNA, 23 nt, Mycobacterium bovis subsp bovis AF2122/97
gccacuggcgccggugccgccgg

SEQ ID NO: 3088024 - RNA, 18 nt, Mycobacterium bovis subsp bovis AF2122/97
gccacuguugaagaagcc

SEQ ID NO: 3088025 - RNA, 20 nt, Mycobacterium bovis subsp bovis AF2122/97
gccacuguugaagaagcccg

SEQ ID NO: 3088026 - RNA, 21 nt, Mycobacterium bovis subsp bovis AF2122/97
gccagcacuccaccgcuggcc

SEQ ID NO: 3088027 - RNA, 16 nt, Mycobacterium bovis subsp bovis AF2122/97
gccagcacuccgcggg

SEQ ID NO: 3088028 - RNA, 19 nt, Mycobacterium bovis subsp bovis AF2122/97
gccagcacugccaucgcgg

SEQ ID NO: 3088029 - RNA, 15 nt, Mycobacterium bovis subsp bovis AF2122/97
gccagcagagcggca

SEQ ID NO: 3088030 - RNA, 16 nt, Mycobacterium bovis subsp bovis AF2122/97
gccagcagagcggcac

SEQ ID NO: 3088031 - RNA, 21 nt, Mycobacterium bovis subsp bovis AF2122/97
gccagcagcaaacaucgcagg

SEQ ID NO: 3088032 - RNA, 22 nt, Mycobacterium bovis subsp bovis AF2122/97
gccagcagcaaacaucgcaggc

SEQ ID NO: 3088033 - RNA, 15 nt, Mycobacterium bovis subsp bovis AF2122/97
gccagcagcaaccgc

SEQ ID NO: 3088034 - RNA, 21 nt, Mycobacterium bovis subsp bovis AF2122/97
gccagcagcaaucagccgccu

SEQ ID NO: 3088035 - RNA, 11 nt, Mycobacterium bovis subsp bovis AF2122/97
gccagcagcag

SEQ ID NO: 3088036 - RNA, 17 nt, Mycobacterium bovis subsp bovis AF2122/97
gccagcagcagaugcga

SEQ ID NO: 3088037 - RNA, 12 nt, Mycobacterium bovis subsp bovis AF2122/97
gccagcagcagc

SEQ ID NO: 3088038 - RNA, 13 nt, Mycobacterium bovis subsp bovis AF2122/97
gccagcagcagcg

SEQ ID NO: 3088039 - RNA, 15 nt, Mycobacterium bovis subsp bovis AF2122/97
gccagcagcagcgcc

SEQ ID NO: 3088040 - RNA, 18 nt, Mycobacterium bovis subsp bovis AF2122/97
gccagcagcagcgccgcg

SEQ ID NO: 3088041 - RNA, 19 nt, Mycobacterium bovis subsp bovis AF2122/97
gccagcagcagcgccgcgu

SEQ ID NO: 3088042 - RNA, 14 nt, Mycobacterium bovis subsp bovis AF2122/97
gccagcagccgcga

SEQ ID NO: 3088043 - RNA, 16 nt, Mycobacterium bovis subsp bovis AF2122/97
gccagcagccgcgaca

SEQ ID NO: 3088044 - RNA, 13 nt, Mycobacterium bovis subsp bovis AF2122/97
gccagcagcgacu

SEQ ID NO: 3088045 - RNA, 17 nt, Mycobacterium bovis subsp bovis AF2122/97
gccagcagcgacuccag

SEQ ID NO: 3088046 - RNA, 18 nt, Mycobacterium bovis subsp bovis AF2122/97
gccagcagcgacuccagc

SEQ ID NO: 3088047 - RNA, 21 nt, Mycobacterium bovis subsp bovis AF2122/97
gccagcagcgcgggaucugag

SEQ ID NO: 3088048 - RNA, 14 nt, Mycobacterium bovis subsp bovis AF2122/97
gccagcagcggcga

SEQ ID NO: 3088049 - RNA, 15 nt, Mycobacterium bovis subsp bovis AF2122/97
gccagcagcggcgag

SEQ ID NO: 3088050 - RNA, 17 nt, Mycobacterium bovis subsp bovis AF2122/97
gccagcagcggcgagcc

SEQ ID NO: 3088051 - RNA, 19 nt, Mycobacterium bovis subsp bovis AF2122/97
gccagcagcggcgagccaa

SEQ ID NO: 3088052 - RNA, 13 nt, Mycobacterium bovis subsp bovis AF2122/97
gccagcagcggcu

SEQ ID NO: 3088053 - RNA, 14 nt, Mycobacterium bovis subsp bovis AF2122/97
gccagcagcggcuc

SEQ ID NO: 3088054 - RNA, 20 nt, Mycobacterium bovis subsp bovis AF2122/97
gccagcaggaugaugaccgc

SEQ ID NO: 3088055 - RNA, 13 nt, Mycobacterium bovis subsp bovis AF2122/97
gccagcaggccga

SEQ ID NO: 3088056 - RNA, 16 nt, Mycobacterium bovis subsp bovis AF2122/97
gccagcaggccgaaga

SEQ ID NO: 3088057 - RNA, 13 nt, Mycobacterium bovis subsp bovis AF2122/97
gccagcaggcggc

SEQ ID NO: 3088058 - RNA, 18 nt, Mycobacterium bovis subsp bovis AF2122/97
gccagcaggcggcugaac

SEQ ID NO: 3088059 - RNA, 22 nt, Mycobacterium bovis subsp bovis AF2122/97
gccagcaggcggcugaacggca

SEQ ID NO: 3088060 - RNA, 23 nt, Mycobacterium bovis subsp bovis AF2122/97
gccagcaggcggcugaacggcag

SEQ ID NO: 3088061 - RNA, 13 nt, Mycobacterium bovis subsp bovis AF2122/97
gccagcagggcca

SEQ ID NO: 3088062 - RNA, 15 nt, Mycobacterium bovis subsp bovis AF2122/97
gccagcagggccacc

SEQ ID NO: 3088063 - RNA, 15 nt, Mycobacterium bovis subsp bovis AF2122/97
gccagcagggccaga

SEQ ID NO: 3088064 - RNA, 20 nt, Mycobacterium bovis subsp bovis AF2122/97
gccagcaggggacgggcggc

SEQ ID NO: 3088065 - RNA, 21 nt, Mycobacterium bovis subsp bovis AF2122/97
gccagcaggggacgggcggcc

SEQ ID NO: 3088066 - RNA, 15 nt, Mycobacterium bovis subsp bovis AF2122/97
gccagcagguauuug

SEQ ID NO: 3088067 - RNA, 21 nt, Mycobacterium bovis subsp bovis AF2122/97
gccagcagguauuugccgugc

SEQ ID NO: 3088068 - RNA, 14 nt, Mycobacterium bovis subsp bovis AF2122/97
gccagcagugcggu

SEQ ID NO: 3088069 - RNA, 18 nt, Mycobacterium bovis subsp bovis AF2122/97
gccagcaucagcccggcg

SEQ ID NO: 3088070 - RNA, 19 nt, Mycobacterium bovis subsp bovis AF2122/97
gccagcaucagcccggcgc

SEQ ID NO: 3088071 - RNA, 20 nt, Mycobacterium bovis subsp bovis AF2122/97
gccagcaucagcccggcgcu

SEQ ID NO: 3088072 - RNA, 16 nt, Mycobacterium bovis subsp bovis AF2122/97
gccagcaucagcgcca

SEQ ID NO: 3088073 - RNA, 22 nt, Mycobacterium bovis subsp bovis AF2122/97
gccagcaucagcgccagcgagc

SEQ ID NO: 3088074 - RNA, 19 nt, Mycobacterium bovis subsp bovis AF2122/97
gccagcaucggcagcagcg

SEQ ID NO: 3088075 - RNA, 21 nt, Mycobacterium bovis subsp bovis AF2122/97
gccagcaucggcagcagcgca

SEQ ID NO: 3088076 - RNA, 14 nt, Mycobacterium bovis subsp bovis AF2122/97
gccagcaucgugug

SEQ ID NO: 3088077 - RNA, 15 nt, Mycobacterium bovis subsp bovis AF2122/97
gccagcaugacaccg

SEQ ID NO: 3088078 - RNA, 17 nt, Mycobacterium bovis subsp bovis AF2122/97
gccagcaugacaccggc

SEQ ID NO: 3088079 - RNA, 18 nt, Mycobacterium bovis subsp bovis AF2122/97
gccagcaugacaccggcc

SEQ ID NO: 3088080 - RNA, 19 nt, Mycobacterium bovis subsp bovis AF2122/97
gccagcauuagccaggccc

SEQ ID NO: 3088081 - RNA, 17 nt, Mycobacterium bovis subsp bovis AF2122/97
gccagcauugacccgac

SEQ ID NO: 3088082 - RNA, 15 nt, Mycobacterium bovis subsp bovis AF2122/97
gccagccaaccgucc

SEQ ID NO: 3088083 - RNA, 20 nt, Mycobacterium bovis subsp bovis AF2122/97
gccagccaaccguccggggc

SEQ ID NO: 3088084 - RNA, 21 nt, Mycobacterium bovis subsp bovis AF2122/97
gccagccaaccguccggggcc

SEQ ID NO: 3088085 - RNA, 22 nt, Mycobacterium bovis subsp bovis AF2122/97
gccagccaaccguccggggccg

SEQ ID NO: 3088086 - RNA, 21 nt, Mycobacterium bovis subsp bovis AF2122/97
gccagccaacgcgucccgccg

SEQ ID NO: 3088087 - RNA, 15 nt, Mycobacterium bovis subsp bovis AF2122/97
gccagccaccacauc

SEQ ID NO: 3088088 - RNA, 16 nt, Mycobacterium bovis subsp bovis AF2122/97
gccagccacuccucgg

SEQ ID NO: 3088089 - RNA, 14 nt, Mycobacterium bovis subsp bovis AF2122/97
gccagccagcgggc

SEQ ID NO: 3088090 - RNA, 22 nt, Mycobacterium bovis subsp bovis AF2122/97
gccagccauggcagcgccgcag

SEQ ID NO: 3088091 - RNA, 19 nt, Mycobacterium bovis subsp bovis AF2122/97
gccagcccacucgucgaac

SEQ ID NO: 3088092 - RNA, 15 nt, Mycobacterium bovis subsp bovis AF2122/97
gccagcccagcacgc

SEQ ID NO: 3088093 - RNA, 15 nt, Mycobacterium bovis subsp bovis AF2122/97
gccagcccagcaggu

SEQ ID NO: 3088094 - RNA, 14 nt, Mycobacterium bovis subsp bovis AF2122/97
gccagcccagccgc

SEQ ID NO: 3088095 - RNA, 16 nt, Mycobacterium bovis subsp bovis AF2122/97
gccagcccaggguguc

SEQ ID NO: 3088096 - RNA, 23 nt, Mycobacterium bovis subsp bovis AF2122/97
gccagccccagcguucccgccgg

SEQ ID NO: 3088097 - RNA, 20 nt, Mycobacterium bovis subsp bovis AF2122/97
gccagccccauugccgucgc

SEQ ID NO: 3088098 - RNA, 15 nt, Mycobacterium bovis subsp bovis AF2122/97
gccagcccgcccaga

SEQ ID NO: 3088099 - RNA, 13 nt, Mycobacterium bovis subsp bovis AF2122/97
gccagcccggcgu

SEQ ID NO: 3088100 - RNA, 20 nt, Mycobacterium bovis subsp bovis AF2122/97
gccagcccgucaucgcguaa

SEQ ID NO: 3088101 - RNA, 14 nt, Mycobacterium bovis subsp bovis AF2122/97
gccagcccguccgg

SEQ ID NO: 3088102 - RNA, 22 nt, Mycobacterium bovis subsp bovis AF2122/97
gccagcccguccggcccccgag

SEQ ID NO: 3088103 - RNA, 20 nt, Mycobacterium bovis subsp bovis AF2122/97
gccagccgacaacuguccug

SEQ ID NO: 3088104 - RNA, 15 nt, Mycobacterium bovis subsp bovis AF2122/97
gccagccgcgagccg

SEQ ID NO: 3088105 - RNA, 14 nt, Mycobacterium bovis subsp bovis AF2122/97
gccagccgcggccc

SEQ ID NO: 3088106 - RNA, 15 nt, Mycobacterium bovis subsp bovis AF2122/97
gccagccgcggcccu

SEQ ID NO: 3088107 - RNA, 14 nt, Mycobacterium bovis subsp bovis AF2122/97
gccagccgcucacc

SEQ ID NO: 3088108 - RNA, 23 nt, Mycobacterium bovis subsp bovis AF2122/97
gccagccgcucacccggucgcac

SEQ ID NO: 3088109 - RNA, 18 nt, Mycobacterium bovis subsp bovis AF2122/97
gccagccgcugccacagg

SEQ ID NO: 3088110 - RNA, 23 nt, Mycobacterium bovis subsp bovis AF2122/97
gccagccgcugccacaggugacc

SEQ ID NO: 3088111 - RNA, 14 nt, Mycobacterium bovis subsp bovis AF2122/97
gccagccggccuca

SEQ ID NO: 3088112 - RNA, 12 nt, Mycobacterium bovis subsp bovis AF2122/97
gccagccggcgc

SEQ ID NO: 3088113 - RNA, 19 nt, Mycobacterium bovis subsp bovis AF2122/97
gccagcgguggaccaccgg

SEQ ID NO: 3088114 - RNA, 16 nt, Mycobacterium bovis subsp bovis AF2122/97
gccagcgucaacagcg

SEQ ID NO: 3088115 - RNA, 18 nt, Mycobacterium bovis subsp bovis AF2122/97
gccagcgucaacagcgug

SEQ ID NO: 3088116 - RNA, 24 nt, Mycobacterium bovis subsp bovis AF2122/97
gccagcgucagcuguuugccggcu

SEQ ID NO: 3088117 - RNA, 19 nt, Mycobacterium bovis subsp bovis AF2122/97
gccagcguccauggucgcg

SEQ ID NO: 3088118 - RNA, 15 nt, Mycobacterium bovis subsp bovis AF2122/97
gccagcgucgacaca

SEQ ID NO: 3088119 - RNA, 21 nt, Mycobacterium bovis subsp bovis AF2122/97
gccagcgucgcaaggcccgca

SEQ ID NO: 3088120 - RNA, 22 nt, Mycobacterium bovis subsp bovis AF2122/97
gccagcgucgcgauugccgcgg

SEQ ID NO: 3088121 - RNA, 16 nt, Mycobacterium bovis subsp bovis AF2122/97
gccagcgucucaaggc

SEQ ID NO: 3088122 - RNA, 19 nt, Mycobacterium bovis subsp bovis AF2122/97
gccagcgucucaaggccuu

SEQ ID NO: 3088123 - RNA, 15 nt, Mycobacterium bovis subsp bovis AF2122/97
gccagcguggugauc

SEQ ID NO: 3088124 - RNA, 15 nt, Mycobacterium bovis subsp bovis AF2122/97
gccagcguguccgcc

SEQ ID NO: 3088125 - RNA, 18 nt, Mycobacterium bovis subsp bovis AF2122/97
gccagcguuaggucgccg

SEQ ID NO: 3088126 - RNA, 22 nt, Mycobacterium bovis subsp bovis AF2122/97
gccagcguuaggucgccggcug

SEQ ID NO: 3088127 - RNA, 12 nt, Mycobacterium bovis subsp bovis AF2122/97
gccagcguuggc

SEQ ID NO: 3088128 - RNA, 13 nt, Mycobacterium bovis subsp bovis AF2122/97
gccagcguuggcg

SEQ ID NO: 3088129 - RNA, 16 nt, Mycobacterium bovis subsp bovis AF2122/97
gccagcguuggcggcg

SEQ ID NO: 3088130 - RNA, 17 nt, Mycobacterium bovis subsp bovis AF2122/97
gccagcguugugcgucc

SEQ ID NO: 3088131 - RNA, 21 nt, Mycobacterium bovis subsp bovis AF2122/97
gccagcucacggacgcugggc

SEQ ID NO: 3088132 - RNA, 22 nt, Mycobacterium bovis subsp bovis AF2122/97
gccagcucacggacgcugggcg

SEQ ID NO: 3088133 - RNA, 14 nt, Mycobacterium bovis subsp bovis AF2122/97
gccagcucccgggc

SEQ ID NO: 3088134 - RNA, 18 nt, Mycobacterium bovis subsp bovis AF2122/97
gccagcucccgggcggcg

SEQ ID NO: 3088135 - RNA, 22 nt, Mycobacterium bovis subsp bovis AF2122/97
gccagcucccgggcggcggccu

SEQ ID NO: 3088136 - RNA, 21 nt, Mycobacterium bovis subsp bovis AF2122/97
gccagcuccgccugccgcugg

SEQ ID NO: 3088137 - RNA, 20 nt, Mycobacterium bovis subsp bovis AF2122/97
gccagcuccgugacaccggg

SEQ ID NO: 3088138 - RNA, 15 nt, Mycobacterium bovis subsp bovis AF2122/97
gccagcuccucagcc

SEQ ID NO: 3088139 - RNA, 16 nt, Mycobacterium bovis subsp bovis AF2122/97
gccagcuccucagcca

SEQ ID NO: 3088140 - RNA, 18 nt, Mycobacterium bovis subsp bovis AF2122/97
gccagcuccucagccacc

SEQ ID NO: 3088141 - RNA, 14 nt, Mycobacterium bovis subsp bovis AF2122/97
gccagcucgccggc

SEQ ID NO: 3088142 - RNA, 16 nt, Mycobacterium bovis subsp bovis AF2122/97
gccagcucgccggccg

SEQ ID NO: 3088143 - RNA, 18 nt, Mycobacterium bovis subsp bovis AF2122/97
gccagcucgccggccggg

SEQ ID NO: 3088144 - RNA, 16 nt, Mycobacterium bovis subsp bovis AF2122/97
gccagcucgcgggccg

SEQ ID NO: 3088145 - RNA, 16 nt, Mycobacterium bovis subsp bovis AF2122/97
gccagcucggcacccg

SEQ ID NO: 3088146 - RNA, 17 nt, Mycobacterium bovis subsp bovis AF2122/97
gccagcucggcacccgc

SEQ ID NO: 3088147 - RNA, 19 nt, Mycobacterium bovis subsp bovis AF2122/97
gccagcucggcacccgccg

SEQ ID NO: 3088148 - RNA, 20 nt, Mycobacterium bovis subsp bovis AF2122/97
gccagcucggcacccgccgg

SEQ ID NO: 3088149 - RNA, 15 nt, Mycobacterium bovis subsp bovis AF2122/97
gccagcucggcggca

SEQ ID NO: 3088150 - RNA, 20 nt, Mycobacterium bovis subsp bovis AF2122/97
gccagcucuucggggaugac

SEQ ID NO: 3088151 - RNA, 17 nt, Mycobacterium bovis subsp bovis AF2122/97
gccagcugacacccgca

SEQ ID NO: 3088152 - RNA, 20 nt, Mycobacterium bovis subsp bovis AF2122/97
gccagcugacacccgcagcu

SEQ ID NO: 3088153 - RNA, 14 nt, Mycobacterium bovis subsp bovis AF2122/97
gccagcugcagcag

SEQ ID NO: 3088154 - RNA, 17 nt, Mycobacterium bovis subsp bovis AF2122/97
gccagcugcagcagacc

SEQ ID NO: 3088155 - RNA, 15 nt, Mycobacterium bovis subsp bovis AF2122/97
gccagcugcgcagcg

SEQ ID NO: 3088156 - RNA, 16 nt, Mycobacterium bovis subsp bovis AF2122/97
gccagcugcgcagcgc

SEQ ID NO: 3088157 - RNA, 22 nt, Mycobacterium bovis subsp bovis AF2122/97
gccagcugcgcagcgcaacauc

SEQ ID NO: 3088158 - RNA, 13 nt, Mycobacterium bovis subsp bovis AF2122/97
gccagcugcggcu

SEQ ID NO: 3088159 - RNA, 21 nt, Mycobacterium bovis subsp bovis AF2122/97
gccagcugcggcuccggcggc

SEQ ID NO: 3088160 - RNA, 15 nt, Mycobacterium bovis subsp bovis AF2122/97
gccagcugcguggcg

SEQ ID NO: 3088161 - RNA, 15 nt, Mycobacterium bovis subsp bovis AF2122/97
gccagcugcuccacc

SEQ ID NO: 3088162 - RNA, 16 nt, Mycobacterium bovis subsp bovis AF2122/97
gccagcuggacuccgg

SEQ ID NO: 3088163 - RNA, 17 nt, Mycobacterium bovis subsp bovis AF2122/97
gccagcugggcagccag

SEQ ID NO: 3088164 - RNA, 19 nt, Mycobacterium bovis subsp bovis AF2122/97
gccagcuguugcggggugc

SEQ ID NO: 3088165 - RNA, 16 nt, Mycobacterium bovis subsp bovis AF2122/97
gccagcuucccgcugg

SEQ ID NO: 3088166 - RNA, 13 nt, Mycobacterium bovis subsp bovis AF2122/97
gccagcuugaggu

SEQ ID NO: 3088167 - RNA, 22 nt, Mycobacterium bovis subsp bovis AF2122/97
gccagcuugagguccgucgcgc

SEQ ID NO: 3088168 - RNA, 16 nt, Mycobacterium bovis subsp bovis AF2122/97
gccagcuugcggagcc

SEQ ID NO: 3088169 - RNA, 20 nt, Mycobacterium bovis subsp bovis AF2122/97
gccagcuugcggagccgccg

SEQ ID NO: 3088170 - RNA, 21 nt, Mycobacterium bovis subsp bovis AF2122/97
gccagcuugcggagccgccgc

SEQ ID NO: 3088171 - RNA, 13 nt, Mycobacterium bovis subsp bovis AF2122/97
gccaggaacccgu

SEQ ID NO: 3088172 - RNA, 15 nt, Mycobacterium bovis subsp bovis AF2122/97
gccaggaacccgugg

SEQ ID NO: 3088173 - RNA, 17 nt, Mycobacterium bovis subsp bovis AF2122/97
gccaggaacucggccca

SEQ ID NO: 3088174 - RNA, 15 nt, Mycobacterium bovis subsp bovis AF2122/97
gccaggaagucccgg

SEQ ID NO: 3088175 - RNA, 15 nt, Mycobacterium bovis subsp bovis AF2122/97
gccaggaccgcgccg

SEQ ID NO: 3088176 - RNA, 16 nt, Mycobacterium bovis subsp bovis AF2122/97
gccaggaccgcgccga

SEQ ID NO: 3088177 - RNA, 17 nt, Mycobacterium bovis subsp bovis AF2122/97
gccaggaccgcgccgau

SEQ ID NO: 3088178 - RNA, 16 nt, Mycobacterium bovis subsp bovis AF2122/97
gccaggacgacgccga

SEQ ID NO: 3088179 - RNA, 17 nt, Mycobacterium bovis subsp bovis AF2122/97
gccaggacgacgccgac

SEQ ID NO: 3088180 - RNA, 22 nt, Mycobacterium bovis subsp bovis AF2122/97
gccaggacgacgccgacgauga

SEQ ID NO: 3088181 - RNA, 15 nt, Mycobacterium bovis subsp bovis AF2122/97
gccaggagccgauca

SEQ ID NO: 3088182 - RNA, 15 nt, Mycobacterium bovis subsp bovis AF2122/97
gccaggagcgcggcc

SEQ ID NO: 3088183 - RNA, 24 nt, Mycobacterium bovis subsp bovis AF2122/97
gccaggagcgcggcccgccucggc

SEQ ID NO: 3088184 - RNA, 16 nt, Mycobacterium bovis subsp bovis AF2122/97
gccaggagcgugucgg

SEQ ID NO: 3088185 - RNA, 15 nt, Mycobacterium bovis subsp bovis AF2122/97
gccaggaguggccac

SEQ ID NO: 3088186 - RNA, 23 nt, Mycobacterium bovis subsp bovis AF2122/97
gccaggaguuugaccaccugguu

SEQ ID NO: 3088187 - RNA, 16 nt, Mycobacterium bovis subsp bovis AF2122/97
gccaggauaaguccgg

SEQ ID NO: 3088188 - RNA, 23 nt, Mycobacterium bovis subsp bovis AF2122/97
gccaggaucgaucguagcuccuu

SEQ ID NO: 3088189 - RNA, 14 nt, Mycobacterium bovis subsp bovis AF2122/97
gccaggaucgcggc

SEQ ID NO: 3088190 - RNA, 18 nt, Mycobacterium bovis subsp bovis AF2122/97
gccaggaucgcggcgccg

SEQ ID NO: 3088191 - RNA, 13 nt, Mycobacterium bovis subsp bovis AF2122/97
gccaggaugaaga

SEQ ID NO: 3088192 - RNA, 20 nt, Mycobacterium bovis subsp bovis AF2122/97
gccaggaugaauuuggugaa

SEQ ID NO: 3088193 - RNA, 20 nt, Mycobacterium bovis subsp bovis AF2122/97
gccaggaugccugccacccg

SEQ ID NO: 3088194 - RNA, 15 nt, Mycobacterium bovis subsp bovis AF2122/97
gccaggcaccacgac

SEQ ID NO: 3088195 - RNA, 16 nt, Mycobacterium bovis subsp bovis AF2122/97
gccaggcacguccgau

SEQ ID NO: 3088196 - RNA, 20 nt, Mycobacterium bovis subsp bovis AF2122/97
gccaggcacguccgaucggc

SEQ ID NO: 3088197 - RNA, 14 nt, Mycobacterium bovis subsp bovis AF2122/97
gccaggccacgggc

SEQ ID NO: 3088198 - RNA, 20 nt, Mycobacterium bovis subsp bovis AF2122/97
gccaggcccaagccguggcc

SEQ ID NO: 3088199 - RNA, 13 nt, Mycobacterium bovis subsp bovis AF2122/97
gccaggcccagcu

SEQ ID NO: 3088200 - RNA, 18 nt, Mycobacterium bovis subsp bovis AF2122/97
gccagguugaucguggcg

SEQ ID NO: 3088201 - RNA, 16 nt, Mycobacterium bovis subsp bovis AF2122/97
gccagguugccgucgg

SEQ ID NO: 3088202 - RNA, 16 nt, Mycobacterium bovis subsp bovis AF2122/97
gccagguuuugccgcg

SEQ ID NO: 3088203 - RNA, 17 nt, Mycobacterium bovis subsp bovis AF2122/97
gccagguuuugccgcgu

SEQ ID NO: 3088204 - RNA, 17 nt, Mycobacterium bovis subsp bovis AF2122/97
gccaguaacgcccacaa

SEQ ID NO: 3088205 - RNA, 18 nt, Mycobacterium bovis subsp bovis AF2122/97
gccaguaugcggugcccg

SEQ ID NO: 3088206 - RNA, 20 nt, Mycobacterium bovis subsp bovis AF2122/97
gccagucaggaaaccggcgc

SEQ ID NO: 3088207 - RNA, 21 nt, Mycobacterium bovis subsp bovis AF2122/97
gccaguccagcgcgccaccca

SEQ ID NO: 3088208 - RNA, 16 nt, Mycobacterium bovis subsp bovis AF2122/97
gccagucccccgcucg

SEQ ID NO: 3088209 - RNA, 15 nt, Mycobacterium bovis subsp bovis AF2122/97
gccagucccggcgca

SEQ ID NO: 3088210 - RNA, 16 nt, Mycobacterium bovis subsp bovis AF2122/97
gccagucccggcgcac

SEQ ID NO: 3088211 - RNA, 21 nt, Mycobacterium bovis subsp bovis AF2122/97
gccagucccucgccaaccagu

SEQ ID NO: 3088212 - RNA, 19 nt, Mycobacterium bovis subsp bovis AF2122/97
gccaguccgaaagccgccg

SEQ ID NO: 3088213 - RNA, 20 nt, Mycobacterium bovis subsp bovis AF2122/97
gccaguccgcagcguccagc

SEQ ID NO: 3088214 - RNA, 14 nt, Mycobacterium bovis subsp bovis AF2122/97
gccaguccgcgcgc

SEQ ID NO: 3088215 - RNA, 19 nt, Mycobacterium bovis subsp bovis AF2122/97
gccaguccggacggcagcc

SEQ ID NO: 3088216 - RNA, 22 nt, Mycobacterium bovis subsp bovis AF2122/97
gccagucgaaucgucaucccga

SEQ ID NO: 3088217 - RNA, 14 nt, Mycobacterium bovis subsp bovis AF2122/97
gccagucgagcacc

SEQ ID NO: 3088218 - RNA, 17 nt, Mycobacterium bovis subsp bovis AF2122/97
gccagucgagcaccugc

SEQ ID NO: 3088219 - RNA, 17 nt, Mycobacterium bovis subsp bovis AF2122/97
gccagucgaucgcggcc

SEQ ID NO: 3088220 - RNA, 23 nt, Mycobacterium bovis subsp bovis AF2122/97
gccagucgaucgcggcccgcagc

SEQ ID NO: 3088221 - RNA, 19 nt, Mycobacterium bovis subsp bovis AF2122/97
gccagucgcaggaucggcg

SEQ ID NO: 3088222 - RNA, 12 nt, Mycobacterium bovis subsp bovis AF2122/97
gccagucgccga

SEQ ID NO: 3088223 - RNA, 21 nt, Mycobacterium bovis subsp bovis AF2122/97
gccagucgugcuugcccgguu

SEQ ID NO: 3088224 - RNA, 23 nt, Mycobacterium bovis subsp bovis AF2122/97
gccagugaaaccaccggccgucc

SEQ ID NO: 3088225 - RNA, 16 nt, Mycobacterium bovis subsp bovis AF2122/97
gccagugaacgcgcgu

SEQ ID NO: 3088226 - RNA, 18 nt, Mycobacterium bovis subsp bovis AF2122/97
gccagugaacgcgcgugc

SEQ ID NO: 3088227 - RNA, 20 nt, Mycobacterium bovis subsp bovis AF2122/97
gccagugacaaccguuguac

SEQ ID NO: 3088228 - RNA, 13 nt, Mycobacterium bovis subsp bovis AF2122/97
gccagugccaccu

SEQ ID NO: 3088229 - RNA, 15 nt, Mycobacterium bovis subsp bovis AF2122/97
gccagugccaccugg

SEQ ID NO: 3088230 - RNA, 18 nt, Mycobacterium bovis subsp bovis AF2122/97
gccagugccagcguccgu

SEQ ID NO: 3088231 - RNA, 23 nt, Mycobacterium bovis subsp bovis AF2122/97
gccagugcccgcacugccgccgg

SEQ ID NO: 3088232 - RNA, 13 nt, Mycobacterium bovis subsp bovis AF2122/97
gccagugccgccc

SEQ ID NO: 3088233 - RNA, 14 nt, Mycobacterium bovis subsp bovis AF2122/97
gccagugccgccca

SEQ ID NO: 3088234 - RNA, 19 nt, Mycobacterium bovis subsp bovis AF2122/97
gccagugccgcccaccaca

SEQ ID NO: 3088235 - RNA, 13 nt, Mycobacterium bovis subsp bovis AF2122/97
gccagugcgcagc

SEQ ID NO: 3088236 - RNA, 16 nt, Mycobacterium bovis subsp bovis AF2122/97
gccagugcgcagcccg

SEQ ID NO: 3088237 - RNA, 12 nt, Mycobacterium bovis subsp bovis AF2122/97
gccagugcgcgc

SEQ ID NO: 3088238 - RNA, 22 nt, Mycobacterium bovis subsp bovis AF2122/97
gccagugcucgcaaucguuggc

SEQ ID NO: 3088239 - RNA, 17 nt, Mycobacterium bovis subsp bovis AF2122/97
gccagugcugcaccgau

SEQ ID NO: 3088240 - RNA, 15 nt, Mycobacterium bovis subsp bovis AF2122/97
gccagugggccgacg

SEQ ID NO: 3088241 - RNA, 15 nt, Mycobacterium bovis subsp bovis AF2122/97
gccagugucagcacg

SEQ ID NO: 3088242 - RNA, 17 nt, Mycobacterium bovis subsp bovis AF2122/97
gccagugucagcacgac

SEQ ID NO: 3088243 - RNA, 19 nt, Mycobacterium bovis subsp bovis AF2122/97
gccaguguugcaguggcga

SEQ ID NO: 3088244 - RNA, 20 nt, Mycobacterium bovis subsp bovis AF2122/97
gccaguguugcaguggcgac

SEQ ID NO: 3088245 - RNA, 22 nt, Mycobacterium bovis subsp bovis AF2122/97
gccaguguugcaguggcgacga

SEQ ID NO: 3088246 - RNA, 16 nt, Mycobacterium bovis subsp bovis AF2122/97
gccaguuacguuguac

SEQ ID NO: 3088247 - RNA, 15 nt, Mycobacterium bovis subsp bovis AF2122/97
gccaguuccggugac

SEQ ID NO: 3088248 - RNA, 14 nt, Mycobacterium bovis subsp bovis AF2122/97
gccaguucgcggcu

SEQ ID NO: 3088249 - RNA, 16 nt, Mycobacterium bovis subsp bovis AF2122/97
gccaguucggcggccg

SEQ ID NO: 3088250 - RNA, 18 nt, Mycobacterium bovis subsp bovis AF2122/97
gccaguucggcggccgcc

SEQ ID NO: 3088251 - RNA, 19 nt, Mycobacterium bovis subsp bovis AF2122/97
gccaguucggcggccgccg

SEQ ID NO: 3088252 - RNA, 22 nt, Mycobacterium bovis subsp bovis AF2122/97
gccaguucggcgucguccgcgc

SEQ ID NO: 3088253 - RNA, 15 nt, Mycobacterium bovis subsp bovis AF2122/97
gccaguucggugagc

SEQ ID NO: 3088254 - RNA, 17 nt, Mycobacterium bovis subsp bovis AF2122/97
gccaguucuaccaccuu

SEQ ID NO: 3088255 - RNA, 22 nt, Mycobacterium bovis subsp bovis AF2122/97
gccaguugaucaggccgaugcg

SEQ ID NO: 3088256 - RNA, 19 nt, Mycobacterium bovis subsp bovis AF2122/97
gccaguugcguuguccacc

SEQ ID NO: 3088257 - RNA, 18 nt, Mycobacterium bovis subsp bovis AF2122/97
gccaguugguagccgccc

SEQ ID NO: 3088258 - RNA, 18 nt, Mycobacterium bovis subsp bovis AF2122/97
gccaguuuccagaugcac

SEQ ID NO: 3088259 - RNA, 20 nt, Mycobacterium bovis subsp bovis AF2122/97
gccauaauucgcccgcucgc

SEQ ID NO: 3088260 - RNA, 17 nt, Mycobacterium bovis subsp bovis AF2122/97
gccauaccgcaauuggc

SEQ ID NO: 3088261 - RNA, 16 nt, Mycobacterium bovis subsp bovis AF2122/97
gccauaccggccgcca

SEQ ID NO: 3088262 - RNA, 19 nt, Mycobacterium bovis subsp bovis AF2122/97
gccauaccggccgccauca

SEQ ID NO: 3088263 - RNA, 15 nt, Mycobacterium bovis subsp bovis AF2122/97
gccauaccggcuggc

SEQ ID NO: 3088264 - RNA, 16 nt, Mycobacterium bovis subsp bovis AF2122/97
gccauaccucggcgac

SEQ ID NO: 3088265 - RNA, 13 nt, Mycobacterium bovis subsp bovis AF2122/97
gccauacuccgag

SEQ ID NO: 3088266 - RNA, 14 nt, Mycobacterium bovis subsp bovis AF2122/97
gccauacuggcggu

SEQ ID NO: 3088267 - RNA, 15 nt, Mycobacterium bovis subsp bovis AF2122/97
gccauagcccgagcg

SEQ ID NO: 3088268 - RNA, 20 nt, Mycobacterium bovis subsp bovis AF2122/97
gccauagccgcgacccgcgc

SEQ ID NO: 3088269 - RNA, 13 nt, Mycobacterium bovis subsp bovis AF2122/97
gccauagcgccgc

SEQ ID NO: 3088270 - RNA, 15 nt, Mycobacterium bovis subsp bovis AF2122/97
gccauagcgccgcgc

SEQ ID NO: 3088271 - RNA, 16 nt, Mycobacterium bovis subsp bovis AF2122/97
gccauagcgccgcgcc

SEQ ID NO: 3088272 - RNA, 17 nt, Mycobacterium bovis subsp bovis AF2122/97
gccauaggcccacggca

SEQ ID NO: 3088273 - RNA, 19 nt, Mycobacterium bovis subsp bovis AF2122/97
gccauaggcccacggcagc

SEQ ID NO: 3088274 - RNA, 23 nt, Mycobacterium bovis subsp bovis AF2122/97
gccauaggcccacggcagcgccg

SEQ ID NO: 3088275 - RNA, 17 nt, Mycobacterium bovis subsp bovis AF2122/97
gccauagugaggccgac

SEQ ID NO: 3088276 - RNA, 22 nt, Mycobacterium bovis subsp bovis AF2122/97
gccauagugaggccgaccagca

SEQ ID NO: 3088277 - RNA, 20 nt, Mycobacterium bovis subsp bovis AF2122/97
gccauauugauuccgacccc

SEQ ID NO: 3088278 - RNA, 21 nt, Mycobacterium bovis subsp bovis AF2122/97
gccaucaacaggccucgaccg

SEQ ID NO: 3088279 - RNA, 21 nt, Mycobacterium bovis subsp bovis AF2122/97
gccaucaacgacuucgggaac

SEQ ID NO: 3088280 - RNA, 16 nt, Mycobacterium bovis subsp bovis AF2122/97
gccaucaagcgauccg

SEQ ID NO: 3088281 - RNA, 15 nt, Mycobacterium bovis subsp bovis AF2122/97
gccaucacgaccagg

SEQ ID NO: 3088282 - RNA, 20 nt, Mycobacterium bovis subsp bovis AF2122/97
gccaucacgacucccccggc

SEQ ID NO: 3088283 - RNA, 12 nt, Mycobacterium bovis subsp bovis AF2122/97
gccaucacgcgc

SEQ ID NO: 3088284 - RNA, 15 nt, Mycobacterium bovis subsp bovis AF2122/97
gccaucacgcgcuca

SEQ ID NO: 3088285 - RNA, 23 nt, Mycobacterium bovis subsp bovis AF2122/97
gccaucacggcggggaucgcugg

SEQ ID NO: 3088286 - RNA, 17 nt, Mycobacterium bovis subsp bovis AF2122/97
gccauggcccgugcggu

SEQ ID NO: 3088287 - RNA, 21 nt, Mycobacterium bovis subsp bovis AF2122/97
gccauggcccgugcgguuguu

SEQ ID NO: 3088288 - RNA, 13 nt, Mycobacterium bovis subsp bovis AF2122/97
gccauggcggcgc

SEQ ID NO: 3088289 - RNA, 18 nt, Mycobacterium bovis subsp bovis AF2122/97
gccauggcggcgccggug

SEQ ID NO: 3088290 - RNA, 19 nt, Mycobacterium bovis subsp bovis AF2122/97
gccauggcggcgccggugg

SEQ ID NO: 3088291 - RNA, 20 nt, Mycobacterium bovis subsp bovis AF2122/97
gccauggcggcgccgguggu

SEQ ID NO: 3088292 - RNA, 15 nt, Mycobacterium bovis subsp bovis AF2122/97
gccauggcguucugc

SEQ ID NO: 3088293 - RNA, 21 nt, Mycobacterium bovis subsp bovis AF2122/97
gccaugggaaccgacauccca

SEQ ID NO: 3088294 - RNA, 19 nt, Mycobacterium bovis subsp bovis AF2122/97
gccaugggaguucaucgca

SEQ ID NO: 3088295 - RNA, 22 nt, Mycobacterium bovis subsp bovis AF2122/97
gccaugggaguucaucgcacga

SEQ ID NO: 3088296 - RNA, 17 nt, Mycobacterium bovis subsp bovis AF2122/97
gccauggguagccgccc

SEQ ID NO: 3088297 - RNA, 14 nt, Mycobacterium bovis subsp bovis AF2122/97
gccauggucagaua

SEQ ID NO: 3088298 - RNA, 13 nt, Mycobacterium bovis subsp bovis AF2122/97
gccauggugagug

SEQ ID NO: 3088299 - RNA, 17 nt, Mycobacterium bovis subsp bovis AF2122/97
gccaugguggcgccgac

SEQ ID NO: 3088300 - RNA, 22 nt, Mycobacterium bovis subsp bovis AF2122/97
gccaugguguucggcagcgcgg

SEQ ID NO: 3088301 - RNA, 19 nt, Mycobacterium bovis subsp bovis AF2122/97
gccauguagccguugccgc

SEQ ID NO: 3088302 - RNA, 22 nt, Mycobacterium bovis subsp bovis AF2122/97
gccauguagccguugccgccga

SEQ ID NO: 3088303 - RNA, 17 nt, Mycobacterium bovis subsp bovis AF2122/97
gccaugucagcggccug

SEQ ID NO: 3088304 - RNA, 15 nt, Mycobacterium bovis subsp bovis AF2122/97
gccauguccaccagc

SEQ ID NO: 3088305 - RNA, 20 nt, Mycobacterium bovis subsp bovis AF2122/97
gccaugucgauguccacgcc

SEQ ID NO: 3088306 - RNA, 20 nt, Mycobacterium bovis subsp bovis AF2122/97
gccaugucuccgacauuggc

SEQ ID NO: 3088307 - RNA, 21 nt, Mycobacterium bovis subsp bovis AF2122/97
gccauguggcgucgcucgucg

SEQ ID NO: 3088308 - RNA, 23 nt, Mycobacterium bovis subsp bovis AF2122/97
gccauguggcgucgcucgucguc

SEQ ID NO: 3088309 - RNA, 17 nt, Mycobacterium bovis subsp bovis AF2122/97
gccauguguauucgauc

SEQ ID NO: 3088310 - RNA, 22 nt, Mycobacterium bovis subsp bovis AF2122/97
gccaugugugcaaaggcgccgu

SEQ ID NO: 3088311 - RNA, 21 nt, Mycobacterium bovis subsp bovis AF2122/97
gccauuaaaaagcccagcgau

SEQ ID NO: 3088312 - RNA, 16 nt, Mycobacterium bovis subsp bovis AF2122/97
gccauuagcagcaccc

SEQ ID NO: 3088313 - RNA, 17 nt, Mycobacterium bovis subsp bovis AF2122/97
gccauucaucggcaucg

SEQ ID NO: 3088314 - RNA, 20 nt, Mycobacterium bovis subsp bovis AF2122/97
gccauuccagaucaacgcgu

SEQ ID NO: 3088315 - RNA, 23 nt, Mycobacterium bovis subsp bovis AF2122/97
gccauuccagccggugccgccgu

SEQ ID NO: 3088316 - RNA, 20 nt, Mycobacterium bovis subsp bovis AF2122/97
gccauuccaucgcgcaccgc

SEQ ID NO: 3088317 - RNA, 16 nt, Mycobacterium bovis subsp bovis AF2122/97
gccauucuucgaucag

SEQ ID NO: 3088318 - RNA, 23 nt, Mycobacterium bovis subsp bovis AF2122/97
gccauucuuggugaucgcgaacu

SEQ ID NO: 3088319 - RNA, 14 nt, Mycobacterium bovis subsp bovis AF2122/97
gccauugacgccgu

SEQ ID NO: 3088320 - RNA, 21 nt, Mycobacterium bovis subsp bovis AF2122/97
gccauugacgccguugccgcc

SEQ ID NO: 3088321 - RNA, 22 nt, Mycobacterium bovis subsp bovis AF2122/97
gccauugaggaagccguuggcg

SEQ ID NO: 3088322 - RNA, 23 nt, Mycobacterium bovis subsp bovis AF2122/97
gccauugaggaagccguuggcga

SEQ ID NO: 3088323 - RNA, 12 nt, Mycobacterium bovis subsp bovis AF2122/97
gccauugccgcc

SEQ ID NO: 3088324 - RNA, 15 nt, Mycobacterium bovis subsp bovis AF2122/97
gccauugccgccggc

SEQ ID NO: 3088325 - RNA, 15 nt, Mycobacterium bovis subsp bovis AF2122/97
gccauugccgccggu

SEQ ID NO: 3088326 - RNA, 14 nt, Mycobacterium bovis subsp bovis AF2122/97
gccauugccgccgu

SEQ ID NO: 3088327 - RNA, 20 nt, Mycobacterium bovis subsp bovis AF2122/97
gccauugccucccgcgccgg

SEQ ID NO: 3088328 - RNA, 23 nt, Mycobacterium bovis subsp bovis AF2122/97
gccauugccucccgcgccggcgu

SEQ ID NO: 3088329 - RNA, 15 nt, Mycobacterium bovis subsp bovis AF2122/97
gccauugccugggcg

SEQ ID NO: 3088330 - RNA, 14 nt, Mycobacterium bovis subsp bovis AF2122/97
gccauuggacagcg

SEQ ID NO: 3088331 - RNA, 23 nt, Mycobacterium bovis subsp bovis AF2122/97
gccauuggccugucaggcggcgg

SEQ ID NO: 3088332 - RNA, 15 nt, Mycobacterium bovis subsp bovis AF2122/97
gccauuggcgguggu

SEQ ID NO: 3088333 - RNA, 15 nt, Mycobacterium bovis subsp bovis AF2122/97
gccauuguugggccg

SEQ ID NO: 3088334 - RNA, 17 nt, Mycobacterium bovis subsp bovis AF2122/97
gccauuuccuuggcgcu

SEQ ID NO: 3088335 - RNA, 13 nt, Mycobacterium bovis subsp bovis AF2122/97
gcggcggcgacga

SEQ ID NO: 3088336 - RNA, 14 nt, Mycobacterium bovis subsp bovis AF2122/97
gcggcggcgcccgg

SEQ ID NO: 3088337 - RNA, 15 nt, Mycobacterium bovis subsp bovis AF2122/97
gcggcggcgcccggc

SEQ ID NO: 3088338 - RNA, 14 nt, Mycobacterium bovis subsp bovis AF2122/97
gcggcggcgccggc

SEQ ID NO: 3088339 - RNA, 12 nt, Mycobacterium bovis subsp bovis AF2122/97
gcggcggcgccu

SEQ ID NO: 3088340 - RNA, 18 nt, Mycobacterium bovis subsp bovis AF2122/97
gcggcggcgcgaucgacg

SEQ ID NO: 3088341 - RNA, 15 nt, Mycobacterium bovis subsp bovis AF2122/97
gcggcggcgcucggc

SEQ ID NO: 3088342 - RNA, 14 nt, Mycobacterium bovis subsp bovis AF2122/97
gcggcggcgcucgu

SEQ ID NO: 3088343 - RNA, 12 nt, Mycobacterium bovis subsp bovis AF2122/97
gcggcggcggca

SEQ ID NO: 3088344 - RNA, 13 nt, Mycobacterium bovis subsp bovis AF2122/97
gcggcggcggcaa

SEQ ID NO: 3088345 - RNA, 14 nt, Mycobacterium bovis subsp bovis AF2122/97
gcggcggcggcacg

SEQ ID NO: 3088346 - RNA, 13 nt, Mycobacterium bovis subsp bovis AF2122/97
gcggcggcggccc

SEQ ID NO: 3088347 - RNA, 15 nt, Mycobacterium bovis subsp bovis AF2122/97
gcggcggcguccacc

SEQ ID NO: 3088348 - RNA, 13 nt, Mycobacterium bovis subsp bovis AF2122/97
gcggcggcgucgg

SEQ ID NO: 3088349 - RNA, 20 nt, Mycobacterium bovis subsp bovis AF2122/97
gcggcggcuuuggccgccgu

SEQ ID NO: 3088350 - RNA, 24 nt, Mycobacterium bovis subsp bovis AF2122/97
gcggcggcuuuggccgccguggcg

SEQ ID NO: 3088351 - RNA, 21 nt, Mycobacterium bovis subsp bovis AF2122/97
gcggcgggcaccgugauggcg

SEQ ID NO: 3088352 - RNA, 12 nt, Mycobacterium bovis subsp bovis AF2122/97
gcggcgggcccg

SEQ ID NO: 3088353 - RNA, 16 nt, Mycobacterium bovis subsp bovis AF2122/97
gcggcgggcucgcuuc

SEQ ID NO: 3088354 - RNA, 12 nt, Mycobacterium bovis subsp bovis AF2122/97
gcggcgggggcg

SEQ ID NO: 3088355 - RNA, 20 nt, Mycobacterium bovis subsp bovis AF2122/97
gcggcgggggcggcggcugu

SEQ ID NO: 3088356 - RNA, 20 nt, Mycobacterium bovis subsp bovis AF2122/97
gcggcgggggcgucgccgcc

SEQ ID NO: 3088357 - RNA, 21 nt, Mycobacterium bovis subsp bovis AF2122/97
gcggcgggggcgucgccgccg

SEQ ID NO: 3088358 - RNA, 22 nt, Mycobacterium bovis subsp bovis AF2122/97
gcggcgggggcgucgccgccgg

SEQ ID NO: 3088359 - RNA, 23 nt, Mycobacterium bovis subsp bovis AF2122/97
gcggcggggggugaucgccaccg

SEQ ID NO: 3088360 - RNA, 22 nt, Mycobacterium bovis subsp bovis AF2122/97
gcggcggggguucgcucuggug

SEQ ID NO: 3088361 - RNA, 17 nt, Mycobacterium bovis subsp bovis AF2122/97
gcggcggguagauccgc

SEQ ID NO: 3088362 - RNA, 17 nt, Mycobacterium bovis subsp bovis AF2122/97
gcggcgggucccgccac

SEQ ID NO: 3088363 - RNA, 14 nt, Mycobacterium bovis subsp bovis AF2122/97
gcggcggguccucg

SEQ ID NO: 3088364 - RNA, 23 nt, Mycobacterium bovis subsp bovis AF2122/97
gcggcgguaaaccuggcuaucgc

SEQ ID NO: 3088365 - RNA, 21 nt, Mycobacterium bovis subsp bovis AF2122/97
gcggcgguaccggaaucggcg

SEQ ID NO: 3088366 - RNA, 14 nt, Mycobacterium bovis subsp bovis AF2122/97
gcggcgguaguacu

SEQ ID NO: 3088367 - RNA, 21 nt, Mycobacterium bovis subsp bovis AF2122/97
gcggcgguaucggcauaccca

SEQ ID NO: 3088368 - RNA, 19 nt, Mycobacterium bovis subsp bovis AF2122/97
gcggcgguaugccacaggc

SEQ ID NO: 3088369 - RNA, 22 nt, Mycobacterium bovis subsp bovis AF2122/97
gcggcgguaugccacaggcugc

SEQ ID NO: 3088370 - RNA, 22 nt, Mycobacterium bovis subsp bovis AF2122/97
gcggcgguaugcucgcuggcgc

SEQ ID NO: 3088371 - RNA, 23 nt, Mycobacterium bovis subsp bovis AF2122/97
gcggcgguaugcucgcuggcgcu

SEQ ID NO: 3088372 - RNA, 18 nt, Mycobacterium bovis subsp bovis AF2122/97
gcggcggucaccaccgac

SEQ ID NO: 3088373 - RNA, 15 nt, Mycobacterium bovis subsp bovis AF2122/97
gcggcggucaugggc

SEQ ID NO: 3088374 - RNA, 16 nt, Mycobacterium bovis subsp bovis AF2122/97
gcggcggucaugggcg

SEQ ID NO: 3088375 - RNA, 13 nt, Mycobacterium bovis subsp bovis AF2122/97
gcggcggucgagc

SEQ ID NO: 3088376 - RNA, 16 nt, Mycobacterium bovis subsp bovis AF2122/97
gcggcggucggcuggg

SEQ ID NO: 3088377 - RNA, 17 nt, Mycobacterium bovis subsp bovis AF2122/97
gcggcggucggcugggc

SEQ ID NO: 3088378 - RNA, 18 nt, Mycobacterium bovis subsp bovis AF2122/97
gcggcggucggcugggcg

SEQ ID NO: 3088379 - RNA, 19 nt, Mycobacterium bovis subsp bovis AF2122/97
gcggcggucucggcgucga

SEQ ID NO: 3088380 - RNA, 17 nt, Mycobacterium bovis subsp bovis AF2122/97
gcggcggucucgucaac

SEQ ID NO: 3088381 - RNA, 20 nt, Mycobacterium bovis subsp bovis AF2122/97
gcggcggucucgucaaccug

SEQ ID NO: 3088382 - RNA, 22 nt, Mycobacterium bovis subsp bovis AF2122/97
gcggcggucugagacucgucga

SEQ ID NO: 3088383 - RNA, 15 nt, Mycobacterium bovis subsp bovis AF2122/97
gcggcggucugggug

SEQ ID NO: 3088384 - RNA, 18 nt, Mycobacterium bovis subsp bovis AF2122/97
gcggcggucugggugagc

SEQ ID NO: 3088385 - RNA, 22 nt, Mycobacterium bovis subsp bovis AF2122/97
gcggcggucuuuuugggcuugc

SEQ ID NO: 3088386 - RNA, 19 nt, Mycobacterium bovis subsp bovis AF2122/97
gcggcggugcagcagggcg

SEQ ID NO: 3088387 - RNA, 21 nt, Mycobacterium bovis subsp bovis AF2122/97
gcggcggugccacgaucggcg

SEQ ID NO: 3088388 - RNA, 14 nt, Mycobacterium bovis subsp bovis AF2122/97
gcggcggugcgccc

SEQ ID NO: 3088389 - RNA, 15 nt, Mycobacterium bovis subsp bovis AF2122/97
gcggcgguggccagc

SEQ ID NO: 3088390 - RNA, 20 nt, Mycobacterium bovis subsp bovis AF2122/97
gcggcgguggccagcgucgc

SEQ ID NO: 3088391 - RNA, 22 nt, Mycobacterium bovis subsp bovis AF2122/97
gcggcgguggccagcgucgcga

SEQ ID NO: 3088392 - RNA, 16 nt, Mycobacterium bovis subsp bovis AF2122/97
gcggcgguggugucgc

SEQ ID NO: 3088393 - RNA, 21 nt, Mycobacterium bovis subsp bovis AF2122/97
gcggcggugucacgacccaag

SEQ ID NO: 3088394 - RNA, 21 nt, Mycobacterium bovis subsp bovis AF2122/97
gcggcgguuucggugguaacg

SEQ ID NO: 3088395 - RNA, 18 nt, Mycobacterium bovis subsp bovis AF2122/97
gcggcguauugcggccug

SEQ ID NO: 3088396 - RNA, 18 nt, Mycobacterium bovis subsp bovis AF2122/97
gcggcgucaaaugugcga

SEQ ID NO: 3088397 - RNA, 14 nt, Mycobacterium bovis subsp bovis AF2122/97
gcggcguccagcag

SEQ ID NO: 3088398 - RNA, 19 nt, Mycobacterium bovis subsp bovis AF2122/97
gcggcguccaucgcgcgcc

SEQ ID NO: 3088399 - RNA, 24 nt, Mycobacterium bovis subsp bovis AF2122/97
gcggcguccaucgcgcgccgaccg

SEQ ID NO: 3088400 - RNA, 14 nt, Mycobacterium bovis subsp bovis AF2122/97
gcggcgucgaacgu

SEQ ID NO: 3088401 - RNA, 19 nt, Mycobacterium bovis subsp bovis AF2122/97
gcggcgucgagcaccucca

SEQ ID NO: 3088402 - RNA, 15 nt, Mycobacterium bovis subsp bovis AF2122/97
gcggcgucgaugagg

SEQ ID NO: 3088403 - RNA, 22 nt, Mycobacterium bovis subsp bovis AF2122/97
gcggcgucgaugagguucaucg

SEQ ID NO: 3088404 - RNA, 19 nt, Mycobacterium bovis subsp bovis AF2122/97
gcggcgucgaugucauccg

SEQ ID NO: 3088405 - RNA, 13 nt, Mycobacterium bovis subsp bovis AF2122/97
gcggcgucgcggu

SEQ ID NO: 3088406 - RNA, 15 nt, Mycobacterium bovis subsp bovis AF2122/97
gcggcgucgcgguug

SEQ ID NO: 3088407 - RNA, 17 nt, Mycobacterium bovis subsp bovis AF2122/97
gcggcgucggucgggug

SEQ ID NO: 3088408 - RNA, 13 nt, Mycobacterium bovis subsp bovis AF2122/97
gcggcgucgguga

SEQ ID NO: 3088409 - RNA, 18 nt, Mycobacterium bovis subsp bovis AF2122/97
gcggcgucggugagcgcg

SEQ ID NO: 3088410 - RNA, 20 nt, Mycobacterium bovis subsp bovis AF2122/97
gcggcgucggugagcgcguc

SEQ ID NO: 3088411 - RNA, 16 nt, Mycobacterium bovis subsp bovis AF2122/97
gcggcgucgucgucga

SEQ ID NO: 3088412 - RNA, 18 nt, Mycobacterium bovis subsp bovis AF2122/97
gcggcgucguggaucuuc

SEQ ID NO: 3088413 - RNA, 20 nt, Mycobacterium bovis subsp bovis AF2122/97
gcggcgucguggaucuucgc

SEQ ID NO: 3088414 - RNA, 17 nt, Mycobacterium bovis subsp bovis AF2122/97
gcggcgucguucgagac

SEQ ID NO: 3088415 - RNA, 16 nt, Mycobacterium bovis subsp bovis AF2122/97
gcggcgucuucgucgg

SEQ ID NO: 3088416 - RNA, 22 nt, Mycobacterium bovis subsp bovis AF2122/97
gcggcgucuucgucggagucuu

SEQ ID NO: 3088417 - RNA, 20 nt, Mycobacterium bovis subsp bovis AF2122/97
gcggcgugaagugagcucgg

SEQ ID NO: 3088418 - RNA, 16 nt, Mycobacterium bovis subsp bovis AF2122/97
gcggcgugcuccugcc

SEQ ID NO: 3088419 - RNA, 21 nt, Mycobacterium bovis subsp bovis AF2122/97
gcggcgugcuuaacacaugca

SEQ ID NO: 3088420 - RNA, 19 nt, Mycobacterium bovis subsp bovis AF2122/97
gcggcgugggagguggcgc

SEQ ID NO: 3088421 - RNA, 22 nt, Mycobacterium bovis subsp bovis AF2122/97
gcggcgugguauccgccguucu

SEQ ID NO: 3088422 - RNA, 16 nt, Mycobacterium bovis subsp bovis AF2122/97
gcggcguguacgucga

SEQ ID NO: 3088423 - RNA, 17 nt, Mycobacterium bovis subsp bovis AF2122/97
gcggcguguacgucgau

SEQ ID NO: 3088424 - RNA, 18 nt, Mycobacterium bovis subsp bovis AF2122/97
gcggcguguacgucgauc

SEQ ID NO: 3088425 - RNA, 17 nt, Mycobacterium bovis subsp bovis AF2122/97
gcggcguuaccaccguc

SEQ ID NO: 3088426 - RNA, 15 nt, Mycobacterium bovis subsp bovis AF2122/97
gcggcguuccccgag

SEQ ID NO: 3088427 - RNA, 16 nt, Mycobacterium bovis subsp bovis AF2122/97
gcggcguuccccgaga

SEQ ID NO: 3088428 - RNA, 22 nt, Mycobacterium bovis subsp bovis AF2122/97
gcggcguuccccgagaacggcg

SEQ ID NO: 3088429 - RNA, 17 nt, Mycobacterium bovis subsp bovis AF2122/97
gcggcguuccgggccga

SEQ ID NO: 3088430 - RNA, 20 nt, Mycobacterium bovis subsp bovis AF2122/97
gcggcguuccgggccgauca

SEQ ID NO: 3088431 - RNA, 22 nt, Mycobacterium bovis subsp bovis AF2122/97
gcggcguuccgggccgaucacc

SEQ ID NO: 3088432 - RNA, 16 nt, Mycobacterium bovis subsp bovis AF2122/97
gcggcguugagcuggc

SEQ ID NO: 3088433 - RNA, 21 nt, Mycobacterium bovis subsp bovis AF2122/97
gcggcguugagcuggcgguug

SEQ ID NO: 3088434 - RNA, 19 nt, Mycobacterium bovis subsp bovis AF2122/97
gcggcguuggugcagucgg

SEQ ID NO: 3088435 - RNA, 21 nt, Mycobacterium bovis subsp bovis AF2122/97
gcggcguuggugcagucggug

SEQ ID NO: 3088436 - RNA, 20 nt, Mycobacterium bovis subsp bovis AF2122/97
gcggcguugugaccgccgau

SEQ ID NO: 3088437 - RNA, 18 nt, Mycobacterium bovis subsp bovis AF2122/97
gcggcguuguggcgugug

SEQ ID NO: 3088438 - RNA, 20 nt, Mycobacterium bovis subsp bovis AF2122/97
gcggcguuucccggguccug

SEQ ID NO: 3088439 - RNA, 20 nt, Mycobacterium bovis subsp bovis AF2122/97
gcggcuaacgaagccagauc

SEQ ID NO: 3088440 - RNA, 22 nt, Mycobacterium bovis subsp bovis AF2122/97
gcggcuacaucggcggcgucga

SEQ ID NO: 3088441 - RNA, 16 nt, Mycobacterium bovis subsp bovis AF2122/97
gcggcuaccgagauca

SEQ ID NO: 3088442 - RNA, 22 nt, Mycobacterium bovis subsp bovis AF2122/97
gcggcuacuccaacugaucccg

SEQ ID NO: 3088443 - RNA, 16 nt, Mycobacterium bovis subsp bovis AF2122/97
gcggcuaggcaccagc

SEQ ID NO: 3088444 - RNA, 16 nt, Mycobacterium bovis subsp bovis AF2122/97
gcggcuaggccagcac

SEQ ID NO: 3088445 - RNA, 17 nt, Mycobacterium bovis subsp bovis AF2122/97
gcggcuaggccagcacg

SEQ ID NO: 3088446 - RNA, 17 nt, Mycobacterium bovis subsp bovis AF2122/97
gcggcuauggcgccgcg

SEQ ID NO: 3088447 - RNA, 18 nt, Mycobacterium bovis subsp bovis AF2122/97
gcggcuauggcgccgcgg

SEQ ID NO: 3088448 - RNA, 21 nt, Mycobacterium bovis subsp bovis AF2122/97
gcggcucaaccucuggcggcg

SEQ ID NO: 3088449 - RNA, 17 nt, Mycobacterium bovis subsp bovis AF2122/97
gcggcucaaucuccucc

SEQ ID NO: 3088450 - RNA, 18 nt, Mycobacterium bovis subsp bovis AF2122/97
gcggcucaaucuccuccg

SEQ ID NO: 3088451 - RNA, 12 nt, Mycobacterium bovis subsp bovis AF2122/97
gcggcucacgac

SEQ ID NO: 3088452 - RNA, 14 nt, Mycobacterium bovis subsp bovis AF2122/97
gcggcucacgaccg

SEQ ID NO: 3088453 - RNA, 14 nt, Mycobacterium bovis subsp bovis AF2122/97
gcggcuccaccggg

SEQ ID NO: 3088454 - RNA, 20 nt, Mycobacterium bovis subsp bovis AF2122/97
gcggcuccaccgggcccgcc

SEQ ID NO: 3088455 - RNA, 19 nt, Mycobacterium bovis subsp bovis AF2122/97
gcggcuccgaucucuggug

SEQ ID NO: 3088456 - RNA, 14 nt, Mycobacterium bovis subsp bovis AF2122/97
gcggcuccgcccgg

SEQ ID NO: 3088457 - RNA, 15 nt, Mycobacterium bovis subsp bovis AF2122/97
gcggcuccgcccggc

SEQ ID NO: 3088458 - RNA, 17 nt, Mycobacterium bovis subsp bovis AF2122/97
gcggcuccggcggcagc

SEQ ID NO: 3088459 - RNA, 14 nt, Mycobacterium bovis subsp bovis AF2122/97
gcggcucgccggcg

SEQ ID NO: 3088460 - RNA, 15 nt, Mycobacterium bovis subsp bovis AF2122/97
gcggcucgccggcgg

SEQ ID NO: 3088461 - RNA, 14 nt, Mycobacterium bovis subsp bovis AF2122/97
gcggcucggcggcg

SEQ ID NO: 3088462 - RNA, 15 nt, Mycobacterium bovis subsp bovis AF2122/97
gcggcucggcggcgc

SEQ ID NO: 3088463 - RNA, 18 nt, Mycobacterium bovis subsp bovis AF2122/97
gcggcucgggugcgcccg

SEQ ID NO: 3088464 - RNA, 21 nt, Mycobacterium bovis subsp bovis AF2122/97
gcggcucgggugcgcccggcc

SEQ ID NO: 3088465 - RNA, 14 nt, Mycobacterium bovis subsp bovis AF2122/97
gcggcucguugcgg

SEQ ID NO: 3088466 - RNA, 17 nt, Mycobacterium bovis subsp bovis AF2122/97
gcggcucguugcgggcg

SEQ ID NO: 3088467 - RNA, 18 nt, Mycobacterium bovis subsp bovis AF2122/97
gcggcucguugcgggcgg

SEQ ID NO: 3088468 - RNA, 18 nt, Mycobacterium bovis subsp bovis AF2122/97
gcggcucuagaucgccga

SEQ ID NO: 3088469 - RNA, 13 nt, Mycobacterium bovis subsp bovis AF2122/97
gcggcugaaccgc

SEQ ID NO: 3088470 - RNA, 17 nt, Mycobacterium bovis subsp bovis AF2122/97
gcggcugaaccgcuggg

SEQ ID NO: 3088471 - RNA, 21 nt, Mycobacterium bovis subsp bovis AF2122/97
gcggcugaaccgcugggacaa

SEQ ID NO: 3088472 - RNA, 17 nt, Mycobacterium bovis subsp bovis AF2122/97
gcggcugaauucggcga

SEQ ID NO: 3088473 - RNA, 18 nt, Mycobacterium bovis subsp bovis AF2122/97
gcggcugaccucccaccc

SEQ ID NO: 3088474 - RNA, 14 nt, Mycobacterium bovis subsp bovis AF2122/97
gcggcugcaccggc

SEQ ID NO: 3088475 - RNA, 15 nt, Mycobacterium bovis subsp bovis AF2122/97
gcggcugcaccggcu

SEQ ID NO: 3088476 - RNA, 12 nt, Mycobacterium bovis subsp bovis AF2122/97
gcggcugcagcc

SEQ ID NO: 3088477 - RNA, 14 nt, Mycobacterium bovis subsp bovis AF2122/97
gcggcugcagccga

SEQ ID NO: 3088478 - RNA, 17 nt, Mycobacterium bovis subsp bovis AF2122/97
gcggcugcagccgaccg

SEQ ID NO: 3088479 - RNA, 15 nt, Mycobacterium bovis subsp bovis AF2122/97
gcggcugccagaaug

SEQ ID NO: 3088480 - RNA, 22 nt, Mycobacterium bovis subsp bovis AF2122/97
gcggcugccagugccgcccacc

SEQ ID NO: 3088481 - RNA, 23 nt, Mycobacterium bovis subsp bovis AF2122/97
gcggcugccagugccgcccacca

SEQ ID NO: 3088482 - RNA, 15 nt, Mycobacterium bovis subsp bovis AF2122/97
gcggcugccaucccg

SEQ ID NO: 3088483 - RNA, 23 nt, Mycobacterium bovis subsp bovis AF2122/97
gcggcugccaucccgaucccggc

SEQ ID NO: 3088484 - RNA, 17 nt, Mycobacterium bovis subsp bovis AF2122/97
gcggcugcccgagaucg

SEQ ID NO: 3088485 - RNA, 17 nt, Mycobacterium bovis subsp bovis AF2122/97
gcggcugcuccgucgcc

SEQ ID NO: 3088486 - RNA, 19 nt, Mycobacterium bovis subsp bovis AF2122/97
gcggcugcuccgucgccga

SEQ ID NO: 3088487 - RNA, 21 nt, Mycobacterium bovis subsp bovis AF2122/97
gcggcugcuccgucgccgaac

SEQ ID NO: 3088488 - RNA, 16 nt, Mycobacterium bovis subsp bovis AF2122/97
gcggcugcuuggucgc

SEQ ID NO: 3088489 - RNA, 21 nt, Mycobacterium bovis subsp bovis AF2122/97
gcggcugcuuggucgcccagc

SEQ ID NO: 3088490 - RNA, 22 nt, Mycobacterium bovis subsp bovis AF2122/97
gcggcugcuuggucgcccagcc

SEQ ID NO: 3088491 - RNA, 19 nt, Mycobacterium bovis subsp bovis AF2122/97
gcggcuggcccgcaugccg

SEQ ID NO: 3088492 - RNA, 20 nt, Mycobacterium bovis subsp bovis AF2122/97
gcggcuggcccgcaugccgg

SEQ ID NO: 3088493 - RNA, 16 nt, Mycobacterium bovis subsp bovis AF2122/97
gcggcugggcggucgg

SEQ ID NO: 3088494 - RNA, 19 nt, Mycobacterium bovis subsp bovis AF2122/97
gcggcuggggccccgcgcc

SEQ ID NO: 3088495 - RNA, 21 nt, Mycobacterium bovis subsp bovis AF2122/97
gcggcuggggccccgcgccgg

SEQ ID NO: 3088496 - RNA, 18 nt, Mycobacterium bovis subsp bovis AF2122/97
gcggcugggggauaccgc

SEQ ID NO: 3088497 - RNA, 22 nt, Mycobacterium bovis subsp bovis AF2122/97
gcggcugggggauaccgcuggg

SEQ ID NO: 3088498 - RNA, 13 nt, Mycobacterium bovis subsp bovis AF2122/97
gcggcugucacgc

SEQ ID NO: 3088499 - RNA, 20 nt, Mycobacterium bovis subsp bovis AF2122/97
gcggcugucacgccugccac

SEQ ID NO: 3088500 - RNA, 14 nt, Mycobacterium bovis subsp bovis AF2122/97
gcggcugugcccga

SEQ ID NO: 3088501 - RNA, 19 nt, Mycobacterium bovis subsp bovis AF2122/97
gcggcugugcccgaucagc

SEQ ID NO: 3088502 - RNA, 16 nt, Mycobacterium bovis subsp bovis AF2122/97
gcggcuguugaagagg

SEQ ID NO: 3088503 - RNA, 19 nt, Mycobacterium bovis subsp bovis AF2122/97
gcggcuguugaagaggcgc

SEQ ID NO: 3088504 - RNA, 23 nt, Mycobacterium bovis subsp bovis AF2122/97
gcggcuguugaagaggcgcaccu

SEQ ID NO: 3088505 - RNA, 17 nt, Mycobacterium bovis subsp bovis AF2122/97
gcggcuguugcggcggc

SEQ ID NO: 3088506 - RNA, 23 nt, Mycobacterium bovis subsp bovis AF2122/97
gcggcuucacugcuaguggucug

SEQ ID NO: 3088507 - RNA, 21 nt, Mycobacterium bovis subsp bovis AF2122/97
gcggcuuccucgagcgaaccg

SEQ ID NO: 3088508 - RNA, 15 nt, Mycobacterium bovis subsp bovis AF2122/97
gcggcuucgacgucg

SEQ ID NO: 3088509 - RNA, 17 nt, Mycobacterium bovis subsp bovis AF2122/97
gcggcuucgacgucggc

SEQ ID NO: 3088510 - RNA, 15 nt, Mycobacterium bovis subsp bovis AF2122/97
gcggcuucgccgacg

SEQ ID NO: 3088511 - RNA, 22 nt, Mycobacterium bovis subsp bovis AF2122/97
gcggcuucgcuuuugaaccggg

SEQ ID NO: 3088512 - RNA, 18 nt, Mycobacterium bovis subsp bovis AF2122/97
gcggcuucgucgacaucg

SEQ ID NO: 3088513 - RNA, 22 nt, Mycobacterium bovis subsp bovis AF2122/97
gcggcuucgucgacaucgccau

SEQ ID NO: 3088514 - RNA, 16 nt, Mycobacterium bovis subsp bovis AF2122/97
gcggcuucguggcggc

SEQ ID NO: 3088515 - RNA, 19 nt, Mycobacterium bovis subsp bovis AF2122/97
gcggcuucguggcggcgcg

SEQ ID NO: 3088516 - RNA, 22 nt, Mycobacterium bovis subsp bovis AF2122/97
gcggcuucguggcggcgcgcgc

SEQ ID NO: 3088517 - RNA, 15 nt, Mycobacterium bovis subsp bovis AF2122/97
gcggcuugaacagcu

SEQ ID NO: 3088518 - RNA, 15 nt, Mycobacterium bovis subsp bovis AF2122/97
gcggcuuggaucuca

SEQ ID NO: 3088519 - RNA, 18 nt, Mycobacterium bovis subsp bovis AF2122/97
gcggcuuggccaucacgg

SEQ ID NO: 3088520 - RNA, 12 nt, Mycobacterium bovis subsp bovis AF2122/97
gcggcuuggccg

SEQ ID NO: 3088521 - RNA, 13 nt, Mycobacterium bovis subsp bovis AF2122/97
gcggcuuggccgc

SEQ ID NO: 3088522 - RNA, 21 nt, Mycobacterium bovis subsp bovis AF2122/97
gcggcuuggccuagccgcggc

SEQ ID NO: 3088523 - RNA, 20 nt, Mycobacterium bovis subsp bovis AF2122/97
gcggcuugggcuugcgccgg

SEQ ID NO: 3088524 - RNA, 15 nt, Mycobacterium bovis subsp bovis AF2122/97
gcggcuugucgcccc

SEQ ID NO: 3088525 - RNA, 17 nt, Mycobacterium bovis subsp bovis AF2122/97
gcggcuugucgccccau

SEQ ID NO: 3088526 - RNA, 18 nt, Mycobacterium bovis subsp bovis AF2122/97
gcggcuugucgccccaug

SEQ ID NO: 3088527 - RNA, 21 nt, Mycobacterium bovis subsp bovis AF2122/97
gcgggaaaauauaugcgcacu

SEQ ID NO: 3088528 - RNA, 17 nt, Mycobacterium bovis subsp bovis AF2122/97
gcgggaaacacguucuc

SEQ ID NO: 3088529 - RNA, 18 nt, Mycobacterium bovis subsp bovis AF2122/97
gcgggaaacccaugcaug

SEQ ID NO: 3088530 - RNA, 22 nt, Mycobacterium bovis subsp bovis AF2122/97
gcgggaaacccaugcaugcguu

SEQ ID NO: 3088531 - RNA, 16 nt, Mycobacterium bovis subsp bovis AF2122/97
gcgggaacacaccgca

SEQ ID NO: 3088532 - RNA, 17 nt, Mycobacterium bovis subsp bovis AF2122/97
gcgggaacgagccacgc

SEQ ID NO: 3088533 - RNA, 22 nt, Mycobacterium bovis subsp bovis AF2122/97
gcgggaacgagccacgccagcg

SEQ ID NO: 3088534 - RNA, 22 nt, Mycobacterium bovis subsp bovis AF2122/97
gcgggaacgaucgaugaccuuu

SEQ ID NO: 3088535 - RNA, 19 nt, Mycobacterium bovis subsp bovis AF2122/97
gcgggaacgaugccgccgg

SEQ ID NO: 3088536 - RNA, 20 nt, Mycobacterium bovis subsp bovis AF2122/97
gcgggaacgaugccgccggc

SEQ ID NO: 3088537 - RNA, 21 nt, Mycobacterium bovis subsp bovis AF2122/97
gcgggaacgaugccgccggcg

SEQ ID NO: 3088538 - RNA, 14 nt, Mycobacterium bovis subsp bovis AF2122/97
gcgggaacgcggcg

SEQ ID NO: 3088539 - RNA, 16 nt, Mycobacterium bovis subsp bovis AF2122/97
gcgggaacgcggcggc

SEQ ID NO: 3088540 - RNA, 23 nt, Mycobacterium bovis subsp bovis AF2122/97
gcgggaacgcggcggcgaacucg

SEQ ID NO: 3088541 - RNA, 20 nt, Mycobacterium bovis subsp bovis AF2122/97
gcgggaacggugccgaucgg

SEQ ID NO: 3088542 - RNA, 21 nt, Mycobacterium bovis subsp bovis AF2122/97
gcgggaacggugccgaucggg

SEQ ID NO: 3088543 - RNA, 20 nt, Mycobacterium bovis subsp bovis AF2122/97
gcgggaagaacaucaccucg

SEQ ID NO: 3088544 - RNA, 15 nt, Mycobacterium bovis subsp bovis AF2122/97
gcgggaagacgucgg

SEQ ID NO: 3088545 - RNA, 21 nt, Mycobacterium bovis subsp bovis AF2122/97
gcgggaagacgucgggaucgc

SEQ ID NO: 3088546 - RNA, 19 nt, Mycobacterium bovis subsp bovis AF2122/97
gcgggaaggguggaccggg

SEQ ID NO: 3088547 - RNA, 15 nt, Mycobacterium bovis subsp bovis AF2122/97
gcgggaagucccgag

SEQ ID NO: 3088548 - RNA, 20 nt, Mycobacterium bovis subsp bovis AF2122/97
gcgggaagucccgaguggcc

SEQ ID NO: 3088549 - RNA, 18 nt, Mycobacterium bovis subsp bovis AF2122/97
gcgggacaaaaucagcag

SEQ ID NO: 3088550 - RNA, 16 nt, Mycobacterium bovis subsp bovis AF2122/97
gcgggacaaccgggcg

SEQ ID NO: 3088551 - RNA, 14 nt, Mycobacterium bovis subsp bovis AF2122/97
gcgggacaccaccg

SEQ ID NO: 3088552 - RNA, 22 nt, Mycobacterium bovis subsp bovis AF2122/97
gcgggacacgucgcgccaggcg

SEQ ID NO: 3088553 - RNA, 19 nt, Mycobacterium bovis subsp bovis AF2122/97
gcgggacagauggcggccg

SEQ ID NO: 3088554 - RNA, 20 nt, Mycobacterium bovis subsp bovis AF2122/97
gcgggacagauggcggccga

SEQ ID NO: 3088555 - RNA, 22 nt, Mycobacterium bovis subsp bovis AF2122/97
gcgggacagauggcggccgagg

SEQ ID NO: 3088556 - RNA, 20 nt, Mycobacterium bovis subsp bovis AF2122/97
gcgggacauccagugcggug

SEQ ID NO: 3088557 - RNA, 13 nt, Mycobacterium bovis subsp bovis AF2122/97
gcgggacgccccg

SEQ ID NO: 3088558 - RNA, 13 nt, Mycobacterium bovis subsp bovis AF2122/97
gcgggacgccgaa

SEQ ID NO: 3088559 - RNA, 23 nt, Mycobacterium bovis subsp bovis AF2122/97
gcgggacgccgaauacggcugcc

SEQ ID NO: 3088560 - RNA, 21 nt, Mycobacterium bovis subsp bovis AF2122/97
gcgggacgggggcuguccacc

SEQ ID NO: 3088561 - RNA, 17 nt, Mycobacterium bovis subsp bovis AF2122/97
gcgggacgucgucguug

SEQ ID NO: 3088562 - RNA, 15 nt, Mycobacterium bovis subsp bovis AF2122/97
gcgggacucggcgag

SEQ ID NO: 3088563 - RNA, 22 nt, Mycobacterium bovis subsp bovis AF2122/97
gcgggacugcagcgcggugguc

SEQ ID NO: 3088564 - RNA, 13 nt, Mycobacterium bovis subsp bovis AF2122/97
gcgggacuggcug

SEQ ID NO: 3088565 - RNA, 20 nt, Mycobacterium bovis subsp bovis AF2122/97
gcgggacuggcugaucggcg

SEQ ID NO: 3088566 - RNA, 16 nt, Mycobacterium bovis subsp bovis AF2122/97
gcgggacuugucgggg

SEQ ID NO: 3088567 - RNA, 19 nt, Mycobacterium bovis subsp bovis AF2122/97
gcgggagaaaacggcggcg

SEQ ID NO: 3088568 - RNA, 14 nt, Mycobacterium bovis subsp bovis AF2122/97
gcgggagaucgucg

SEQ ID NO: 3088569 - RNA, 21 nt, Mycobacterium bovis subsp bovis AF2122/97
gcgggagcaccgaccagggcc

SEQ ID NO: 3088570 - RNA, 19 nt, Mycobacterium bovis subsp bovis AF2122/97
gcgggagcggaauggcgcc

SEQ ID NO: 3088571 - RNA, 21 nt, Mycobacterium bovis subsp bovis AF2122/97
gcgggagguacccccagcacc

SEQ ID NO: 3088572 - RNA, 19 nt, Mycobacterium bovis subsp bovis AF2122/97
gcgggaguucggggugcgc

SEQ ID NO: 3088573 - RNA, 23 nt, Mycobacterium bovis subsp bovis AF2122/97
gcgggaguucggggugcgcccag

SEQ ID NO: 3088574 - RNA, 18 nt, Mycobacterium bovis subsp bovis AF2122/97
gcgggauccaggcccagc

SEQ ID NO: 3088575 - RNA, 22 nt, Mycobacterium bovis subsp bovis AF2122/97
gcgggauccucgaaggcguucg

SEQ ID NO: 3088576 - RNA, 20 nt, Mycobacterium bovis subsp bovis AF2122/97
gcgggaucgguggcggcacg

SEQ ID NO: 3088577 - RNA, 22 nt, Mycobacterium bovis subsp bovis AF2122/97
gcgggaucugagggcucggugg

SEQ ID NO: 3088578 - RNA, 16 nt, Mycobacterium bovis subsp bovis AF2122/97
gcgggauggccgccga

SEQ ID NO: 3088579 - RNA, 17 nt, Mycobacterium bovis subsp bovis AF2122/97
gcgggauggccgccgac

SEQ ID NO: 3088580 - RNA, 19 nt, Mycobacterium bovis subsp bovis AF2122/97
gcgggauggccgccgacaa

SEQ ID NO: 3088581 - RNA, 13 nt, Mycobacterium bovis subsp bovis AF2122/97
gcgggauucuggc

SEQ ID NO: 3088582 - RNA, 15 nt, Mycobacterium bovis subsp bovis AF2122/97
gcgggauugcgcgcu

SEQ ID NO: 3088583 - RNA, 16 nt, Mycobacterium bovis subsp bovis AF2122/97
gcgggauugcgcgcug

SEQ ID NO: 3088584 - RNA, 18 nt, Mycobacterium bovis subsp bovis AF2122/97
gcgggcaacugcagcaug

SEQ ID NO: 3088585 - RNA, 20 nt, Mycobacterium bovis subsp bovis AF2122/97
gcgggcaacugcagcauggc

SEQ ID NO: 3088586 - RNA, 17 nt, Mycobacterium bovis subsp bovis AF2122/97
gcgggcaaucaccgccg

SEQ ID NO: 3088587 - RNA, 18 nt, Mycobacterium bovis subsp bovis AF2122/97
gcgggcaaucaccgccgg

SEQ ID NO: 3088588 - RNA, 21 nt, Mycobacterium bovis subsp bovis AF2122/97
gcgggcaaucaccgccggcgg

SEQ ID NO: 3088589 - RNA, 16 nt, Mycobacterium bovis subsp bovis AF2122/97
gcgggcaccuccgcgu

SEQ ID NO: 3088590 - RNA, 18 nt, Mycobacterium bovis subsp bovis AF2122/97
gcgggcacgcacaaguuc

SEQ ID NO: 3088591 - RNA, 19 nt, Mycobacterium bovis subsp bovis AF2122/97
gcgggcacgcccucgucga

SEQ ID NO: 3088592 - RNA, 15 nt, Mycobacterium bovis subsp bovis AF2122/97
gcgggcacgccgccg

SEQ ID NO: 3088593 - RNA, 18 nt, Mycobacterium bovis subsp bovis AF2122/97
gcgggcacgccgccgacg

SEQ ID NO: 3088594 - RNA, 17 nt, Mycobacterium bovis subsp bovis AF2122/97
gcgggcacucagcaggg

SEQ ID NO: 3088595 - RNA, 11 nt, Mycobacterium bovis subsp bovis AF2122/97
gcgggcagcag

SEQ ID NO: 3088596 - RNA, 13 nt, Mycobacterium bovis subsp bovis AF2122/97
gcgggcagcaggc

SEQ ID NO: 3088597 - RNA, 12 nt, Mycobacterium bovis subsp bovis AF2122/97
gcgggcagccgc

SEQ ID NO: 3088598 - RNA, 14 nt, Mycobacterium bovis subsp bovis AF2122/97
gcgggcagccgccc

SEQ ID NO: 3088599 - RNA, 19 nt, Mycobacterium bovis subsp bovis AF2122/97
gcgggcagccgcccgccag

SEQ ID NO: 3088600 - RNA, 12 nt, Mycobacterium bovis subsp bovis AF2122/97
gcgggcagggcc

SEQ ID NO: 3088601 - RNA, 18 nt, Mycobacterium bovis subsp bovis AF2122/97
gcgggcaguagcuguggc

SEQ ID NO: 3088602 - RNA, 19 nt, Mycobacterium bovis subsp bovis AF2122/97
gcgggcaguagcuguggcc

SEQ ID NO: 3088603 - RNA, 23 nt, Mycobacterium bovis subsp bovis AF2122/97
gcgggcaguagcuguggcccgcg

SEQ ID NO: 3088604 - RNA, 15 nt, Mycobacterium bovis subsp bovis AF2122/97
gcgggcaguggcagc

SEQ ID NO: 3088605 - RNA, 18 nt, Mycobacterium bovis subsp bovis AF2122/97
gcgggcaguggcagcccg

SEQ ID NO: 3088606 - RNA, 20 nt, Mycobacterium bovis subsp bovis AF2122/97
gcgggcaguuguugacagac

SEQ ID NO: 3088607 - RNA, 12 nt, Mycobacterium bovis subsp bovis AF2122/97
gcgggcaucgcg

SEQ ID NO: 3088608 - RNA, 15 nt, Mycobacterium bovis subsp bovis AF2122/97
gcgggcaugccggcg

SEQ ID NO: 3088609 - RNA, 13 nt, Mycobacterium bovis subsp bovis AF2122/97
gcgggccaacucg

SEQ ID NO: 3088610 - RNA, 21 nt, Mycobacterium bovis subsp bovis AF2122/97
gcgggccaccacgcgccgcac

SEQ ID NO: 3088611 - RNA, 20 nt, Mycobacterium bovis subsp bovis AF2122/97
gcgggccaccguaaacagcg

SEQ ID NO: 3088612 - RNA, 13 nt, Mycobacterium bovis subsp bovis AF2122/97
gcgggccagcacc

SEQ ID NO: 3088613 - RNA, 15 nt, Mycobacterium bovis subsp bovis AF2122/97
gcgggccagcacccg

SEQ ID NO: 3088614 - RNA, 13 nt, Mycobacterium bovis subsp bovis AF2122/97
gcgggccaggccc

SEQ ID NO: 3088615 - RNA, 17 nt, Mycobacterium bovis subsp bovis AF2122/97
gcgggccaggcccucga

SEQ ID NO: 3088616 - RNA, 23 nt, Mycobacterium bovis subsp bovis AF2122/97
gcgggccccaucgccuggaugcc

SEQ ID NO: 3088617 - RNA, 15 nt, Mycobacterium bovis subsp bovis AF2122/97
gcgggcccgaugagg

SEQ ID NO: 3088618 - RNA, 17 nt, Mycobacterium bovis subsp bovis AF2122/97
gcgggcccgaugaggac

SEQ ID NO: 3088619 - RNA, 17 nt, Mycobacterium bovis subsp bovis AF2122/97
gcgggcccgcaggucgg

SEQ ID NO: 3088620 - RNA, 18 nt, Mycobacterium bovis subsp bovis AF2122/97
gcgggcccgcaggucggc

SEQ ID NO: 3088621 - RNA, 13 nt, Mycobacterium bovis subsp bovis AF2122/97
gcgggcccgccgg

SEQ ID NO: 3088622 - RNA, 14 nt, Mycobacterium bovis subsp bovis AF2122/97
gcgggcccgccggc

SEQ ID NO: 3088623 - RNA, 19 nt, Mycobacterium bovis subsp bovis AF2122/97
gcgggcccgccggccccgc

SEQ ID NO: 3088624 - RNA, 17 nt, Mycobacterium bovis subsp bovis AF2122/97
gcgggcccgcgcggcgg

SEQ ID NO: 3088625 - RNA, 22 nt, Mycobacterium bovis subsp bovis AF2122/97
gcgggcccucuaugcgggcagc

SEQ ID NO: 3088626 - RNA, 23 nt, Mycobacterium bovis subsp bovis AF2122/97
gcgggcccucuaugcgggcagcg

SEQ ID NO: 3088627 - RNA, 21 nt, Mycobacterium bovis subsp bovis AF2122/97
gcgggccgaccagagcuucgc

SEQ ID NO: 3088628 - RNA, 15 nt, Mycobacterium bovis subsp bovis AF2122/97
gcgggccgacgcagg

SEQ ID NO: 3088629 - RNA, 17 nt, Mycobacterium bovis subsp bovis AF2122/97
gcgggccgacgcaggug

SEQ ID NO: 3088630 - RNA, 14 nt, Mycobacterium bovis subsp bovis AF2122/97
gcgggccgagauca

SEQ ID NO: 3088631 - RNA, 23 nt, Mycobacterium bovis subsp bovis AF2122/97
gcgggccgagaucacgccgggcg

SEQ ID NO: 3088632 - RNA, 16 nt, Mycobacterium bovis subsp bovis AF2122/97
gcgggccgaggccguc

SEQ ID NO: 3088633 - RNA, 21 nt, Mycobacterium bovis subsp bovis AF2122/97
gcgggccgccaggcggccggg

SEQ ID NO: 3088634 - RNA, 12 nt, Mycobacterium bovis subsp bovis AF2122/97
gcgggccgccgc

SEQ ID NO: 3088635 - RNA, 13 nt, Mycobacterium bovis subsp bovis AF2122/97
gcgggccgccgca

SEQ ID NO: 3088636 - RNA, 15 nt, Mycobacterium bovis subsp bovis AF2122/97
gcgggccgcgcggcg

SEQ ID NO: 3088637 - RNA, 16 nt, Mycobacterium bovis subsp bovis AF2122/97
gcgggccgcgcggcga

SEQ ID NO: 3088638 - RNA, 19 nt, Mycobacterium bovis subsp bovis AF2122/97
gcgggccgcguccagaccg

SEQ ID NO: 3088639 - RNA, 14 nt, Mycobacterium bovis subsp bovis AF2122/97
gcgggccgcgucga

SEQ ID NO: 3088640 - RNA, 16 nt, Mycobacterium bovis subsp bovis AF2122/97
gcgggccgcgucgaac

SEQ ID NO: 3088641 - RNA, 13 nt, Mycobacterium bovis subsp bovis AF2122/97
gcgggccggcgac

SEQ ID NO: 3088642 - RNA, 13 nt, Mycobacterium bovis subsp bovis AF2122/97
gcgggccggucgu

SEQ ID NO: 3088643 - RNA, 14 nt, Mycobacterium bovis subsp bovis AF2122/97
gcgggccuccugcu

SEQ ID NO: 3088644 - RNA, 14 nt, Mycobacterium bovis subsp bovis AF2122/97
gcgggccucggcga

SEQ ID NO: 3088645 - RNA, 22 nt, Mycobacterium bovis subsp bovis AF2122/97
gcgggccucggcgaccaucuga

SEQ ID NO: 3088646 - RNA, 16 nt, Mycobacterium bovis subsp bovis AF2122/97
gcgggccugcacgccg

SEQ ID NO: 3088647 - RNA, 21 nt, Mycobacterium bovis subsp bovis AF2122/97
gcgggccugcacgccggcgcu

SEQ ID NO: 3088648 - RNA, 16 nt, Mycobacterium bovis subsp bovis AF2122/97
gcgggccugcccggga

SEQ ID NO: 3088649 - RNA, 23 nt, Mycobacterium bovis subsp bovis AF2122/97
gcgggccugcccgggaugcuccc

SEQ ID NO: 3088650 - RNA, 15 nt, Mycobacterium bovis subsp bovis AF2122/97
gcgggccuggcccac

SEQ ID NO: 3088651 - RNA, 18 nt, Mycobacterium bovis subsp bovis AF2122/97
gcgggccuggcccacgcc

SEQ ID NO: 3088652 - RNA, 14 nt, Mycobacterium bovis subsp bovis AF2122/97
gcgggcgaacgcuu

SEQ ID NO: 3088653 - RNA, 22 nt, Mycobacterium bovis subsp bovis AF2122/97
gcgggcgacaucgagaucgccg

SEQ ID NO: 3088654 - RNA, 13 nt, Mycobacterium bovis subsp bovis AF2122/97
gcgggcgaccacc

SEQ ID NO: 3088655 - RNA, 14 nt, Mycobacterium bovis subsp bovis AF2122/97
gcgggcgaccaccg

SEQ ID NO: 3088656 - RNA, 15 nt, Mycobacterium bovis subsp bovis AF2122/97
gcgggcgaccaccgc

SEQ ID NO: 3088657 - RNA, 16 nt, Mycobacterium bovis subsp bovis AF2122/97
gcgggcgaccaccgcg

SEQ ID NO: 3088658 - RNA, 13 nt, Mycobacterium bovis subsp bovis AF2122/97
gcgggcgacccgu

SEQ ID NO: 3088659 - RNA, 22 nt, Mycobacterium bovis subsp bovis AF2122/97
gcgggcgacccguucucgguga

SEQ ID NO: 3088660 - RNA, 20 nt, Mycobacterium bovis subsp bovis AF2122/97
gcgggcgaucgcggcgagca

SEQ ID NO: 3088661 - RNA, 12 nt, Mycobacterium bovis subsp bovis AF2122/97
gcgggcgaucgg

SEQ ID NO: 3088662 - RNA, 15 nt, Mycobacterium bovis subsp bovis AF2122/97
gcgggcgaucggcau

SEQ ID NO: 3088663 - RNA, 15 nt, Mycobacterium bovis subsp bovis AF2122/97
gcgggcgaugagcgc

SEQ ID NO: 3088664 - RNA, 20 nt, Mycobacterium bovis subsp bovis AF2122/97
gcgggcgaugagcgcgaucu

SEQ ID NO: 3088665 - RNA, 16 nt, Mycobacterium bovis subsp bovis AF2122/97
gcgggcgaugcgggcc

SEQ ID NO: 3088666 - RNA, 17 nt, Mycobacterium bovis subsp bovis AF2122/97
gcgggcgaugcgggccg

SEQ ID NO: 3088667 - RNA, 21 nt, Mycobacterium bovis subsp bovis AF2122/97
gcgggcgauuucggcgccggc

SEQ ID NO: 3088668 - RNA, 14 nt, Mycobacterium bovis subsp bovis AF2122/97
gcgggcgcaccagg

SEQ ID NO: 3088669 - RNA, 17 nt, Mycobacterium bovis subsp bovis AF2122/97
gcgggcgcccuugagcc

SEQ ID NO: 3088670 - RNA, 17 nt, Mycobacterium bovis subsp bovis AF2122/97
gcgggcgccgcuaggug

SEQ ID NO: 3088671 - RNA, 14 nt, Mycobacterium bovis subsp bovis AF2122/97
gcgggcgccgggaa

SEQ ID NO: 3088672 - RNA, 19 nt, Mycobacterium bovis subsp bovis AF2122/97
gcgggcgccuuccaggcgg

SEQ ID NO: 3088673 - RNA, 20 nt, Mycobacterium bovis subsp bovis AF2122/97
gcgggcgccuuggucgccgc

SEQ ID NO: 3088674 - RNA, 21 nt, Mycobacterium bovis subsp bovis AF2122/97
gcgggcgccuuggucgccgcc

SEQ ID NO: 3088675 - RNA, 23 nt, Mycobacterium bovis subsp bovis AF2122/97
gcgggcgcgcuaucaugaccacc

SEQ ID NO: 3088676 - RNA, 15 nt, Mycobacterium bovis subsp bovis AF2122/97
gcgggcgcgggcgcc

SEQ ID NO: 3088677 - RNA, 20 nt, Mycobacterium bovis subsp bovis AF2122/97
gcgggcgcuguagucgcgcc

SEQ ID NO: 3088678 - RNA, 18 nt, Mycobacterium bovis subsp bovis AF2122/97
gcgggcggaucgccgggg

SEQ ID NO: 3088679 - RNA, 14 nt, Mycobacterium bovis subsp bovis AF2122/97
gcgggcggcaagcu

SEQ ID NO: 3088680 - RNA, 17 nt, Mycobacterium bovis subsp bovis AF2122/97
gcgggcggcaucgccga

SEQ ID NO: 3088681 - RNA, 19 nt, Mycobacterium bovis subsp bovis AF2122/97
gcgggcggcaucgccgagg

SEQ ID NO: 3088682 - RNA, 12 nt, Mycobacterium bovis subsp bovis AF2122/97
gcgggcggcgcu

SEQ ID NO: 3088683 - RNA, 12 nt, Mycobacterium bovis subsp bovis AF2122/97
gcgggcgggaac

SEQ ID NO: 3088684 - RNA, 20 nt, Mycobacterium bovis subsp bovis AF2122/97
gcgggcgggaaccccggcca

SEQ ID NO: 3088685 - RNA, 22 nt, Mycobacterium bovis subsp bovis AF2122/97
gcgggcgguccaaaacaccgcc

SEQ ID NO: 3088686 - RNA, 23 nt, Mycobacterium bovis subsp bovis AF2122/97
gcgggcggugcacaccgucgcac

SEQ ID NO: 3088687 - RNA, 19 nt, Mycobacterium bovis subsp bovis AF2122/97
gcgggcggugggcagcagc

SEQ ID NO: 3088688 - RNA, 13 nt, Mycobacterium bovis subsp bovis AF2122/97
gcgggcgucccgc

SEQ ID NO: 3088689 - RNA, 18 nt, Mycobacterium bovis subsp bovis AF2122/97
gcgggcgugccgaccagc

SEQ ID NO: 3088690 - RNA, 16 nt, Mycobacterium bovis subsp bovis AF2122/97
gcgggcgugcuacacc

SEQ ID NO: 3088691 - RNA, 18 nt, Mycobacterium bovis subsp bovis AF2122/97
gcgggcgugcuacacccg

SEQ ID NO: 3088692 - RNA, 13 nt, Mycobacterium bovis subsp bovis AF2122/97
gcgggcgugugca

SEQ ID NO: 3088693 - RNA, 15 nt, Mycobacterium bovis subsp bovis AF2122/97
gcgggcgugugcagu

SEQ ID NO: 3088694 - RNA, 16 nt, Mycobacterium bovis subsp bovis AF2122/97
gcgggcgugugcaguc

SEQ ID NO: 3088695 - RNA, 20 nt, Mycobacterium bovis subsp bovis AF2122/97
gcgggcguugcugauggugc

SEQ ID NO: 3088696 - RNA, 16 nt, Mycobacterium bovis subsp bovis AF2122/97
gcgggcguuggccagc

SEQ ID NO: 3088697 - RNA, 15 nt, Mycobacterium bovis subsp bovis AF2122/97
gcgggcuaaugcgac

SEQ ID NO: 3088698 - RNA, 16 nt, Mycobacterium bovis subsp bovis AF2122/97
gcgggcuaggcggcgu

SEQ ID NO: 3088699 - RNA, 13 nt, Mycobacterium bovis subsp bovis AF2122/97
gcgggcuccccgg

SEQ ID NO: 3088700 - RNA, 20 nt, Mycobacterium bovis subsp bovis AF2122/97
gcgggcucgcccgcuacggc

SEQ ID NO: 3088701 - RNA, 21 nt, Mycobacterium bovis subsp bovis AF2122/97
gcgggcucgcuucaggcaccg

SEQ ID NO: 3088702 - RNA, 23 nt, Mycobacterium bovis subsp bovis AF2122/97
gcgggcucgcuucaggcaccgga

SEQ ID NO: 3088703 - RNA, 13 nt, Mycobacterium bovis subsp bovis AF2122/97
gcgggcucggugg

SEQ ID NO: 3088704 - RNA, 20 nt, Mycobacterium bovis subsp bovis AF2122/97
gcgggcucgguggcggacgg

SEQ ID NO: 3088705 - RNA, 16 nt, Mycobacterium bovis subsp bovis AF2122/97
gcgggcucguguccgc

SEQ ID NO: 3088706 - RNA, 21 nt, Mycobacterium bovis subsp bovis AF2122/97
gcgggcucguguccgccguca

SEQ ID NO: 3088707 - RNA, 20 nt, Mycobacterium bovis subsp bovis AF2122/97
gcgggcucuacucgcggccg

SEQ ID NO: 3088708 - RNA, 13 nt, Mycobacterium bovis subsp bovis AF2122/97
gcgggcucucggc

SEQ ID NO: 3088709 - RNA, 17 nt, Mycobacterium bovis subsp bovis AF2122/97
gcgggcugaccaaccca

SEQ ID NO: 3088710 - RNA, 18 nt, Mycobacterium bovis subsp bovis AF2122/97
gcgggcugauuucgugcg

SEQ ID NO: 3088711 - RNA, 18 nt, Mycobacterium bovis subsp bovis AF2122/97
gcgggcugcagccgacag

SEQ ID NO: 3088712 - RNA, 15 nt, Mycobacterium bovis subsp bovis AF2122/97
gcgggcugcgcuacc

SEQ ID NO: 3088713 - RNA, 23 nt, Mycobacterium bovis subsp bovis AF2122/97
gcgggcugcgcuacccagcgcgu

SEQ ID NO: 3088714 - RNA, 13 nt, Mycobacterium bovis subsp bovis AF2122/97
gcgggcugguucg

SEQ ID NO: 3088715 - RNA, 12 nt, Mycobacterium bovis subsp bovis AF2122/97
gcgggcuugagc

SEQ ID NO: 3088716 - RNA, 15 nt, Mycobacterium bovis subsp bovis AF2122/97
gcgggcuugagcgcc

SEQ ID NO: 3088717 - RNA, 22 nt, Mycobacterium bovis subsp bovis AF2122/97
gcgggcuugccgucuucgccgc

SEQ ID NO: 3088718 - RNA, 17 nt, Mycobacterium bovis subsp bovis AF2122/97
gcgggcuuggcgucgac

SEQ ID NO: 3088719 - RNA, 20 nt, Mycobacterium bovis subsp bovis AF2122/97
gcgggcuuggggucccgccg

SEQ ID NO: 3088720 - RNA, 23 nt, Mycobacterium bovis subsp bovis AF2122/97
gcgggcuuggggucccgccgggu

SEQ ID NO: 3088721 - RNA, 18 nt, Mycobacterium bovis subsp bovis AF2122/97
gcgggcuuugagcgcccg

SEQ ID NO: 3088722 - RNA, 24 nt, Mycobacterium bovis subsp bovis AF2122/97
gcggggaaguuggcugagcagcgc

SEQ ID NO: 3088723 - RNA, 15 nt, Mycobacterium bovis subsp bovis AF2122/97
gcggggaaucaccca

SEQ ID NO: 3088724 - RNA, 12 nt, Mycobacterium bovis subsp bovis AF2122/97
gcggggacggcg

SEQ ID NO: 3088725 - RNA, 15 nt, Mycobacterium bovis subsp bovis AF2122/97
gcggggacggcggca

SEQ ID NO: 3088726 - RNA, 18 nt, Mycobacterium bovis subsp bovis AF2122/97
gcggggaucacaccccag

SEQ ID NO: 3088727 - RNA, 13 nt, Mycobacterium bovis subsp bovis AF2122/97
gcggggaucagcg

SEQ ID NO: 3088728 - RNA, 17 nt, Mycobacterium bovis subsp bovis AF2122/97
gcggggaucgcuggccg

SEQ ID NO: 3088729 - RNA, 17 nt, Mycobacterium bovis subsp bovis AF2122/97
gcggggaugcgaccgcc

SEQ ID NO: 3088730 - RNA, 21 nt, Mycobacterium bovis subsp bovis AF2122/97
gcggggauguccgcggccacc

SEQ ID NO: 3088731 - RNA, 17 nt, Mycobacterium bovis subsp bovis AF2122/97
gcggggauuggugccca

SEQ ID NO: 3088732 - RNA, 19 nt, Mycobacterium bovis subsp bovis AF2122/97
gcggggcagaagucguugc

SEQ ID NO: 3088733 - RNA, 20 nt, Mycobacterium bovis subsp bovis AF2122/97
gcggggcagaagucguugcg

SEQ ID NO: 3088734 - RNA, 17 nt, Mycobacterium bovis subsp bovis AF2122/97
gcggggcaucggugcgg

SEQ ID NO: 3088735 - RNA, 12 nt, Mycobacterium bovis subsp bovis AF2122/97
gcggggcccaca

SEQ ID NO: 3088736 - RNA, 13 nt, Mycobacterium bovis subsp bovis AF2122/97
gcggggccgccgc

SEQ ID NO: 3088737 - RNA, 14 nt, Mycobacterium bovis subsp bovis AF2122/97
gcggggccgccgcg

SEQ ID NO: 3088738 - RNA, 21 nt, Mycobacterium bovis subsp bovis AF2122/97
gcggggccgccgcggccggcg

SEQ ID NO: 3088739 - RNA, 12 nt, Mycobacterium bovis subsp bovis AF2122/97
gcggggccggcg

SEQ ID NO: 3088740 - RNA, 13 nt, Mycobacterium bovis subsp bovis AF2122/97
gcggggccggcgg

SEQ ID NO: 3088741 - RNA, 23 nt, Mycobacterium bovis subsp bovis AF2122/97
gcggggccggcggcucgggugcg

SEQ ID NO: 3088742 - RNA, 13 nt, Mycobacterium bovis subsp bovis AF2122/97
gcggggccgggcg

SEQ ID NO: 3088743 - RNA, 12 nt, Mycobacterium bovis subsp bovis AF2122/97
gcggggcggccu

SEQ ID NO: 3088744 - RNA, 21 nt, Mycobacterium bovis subsp bovis AF2122/97
gcggggcuagucgggguggga

SEQ ID NO: 3088745 - RNA, 17 nt, Mycobacterium bovis subsp bovis AF2122/97
gcggggcucaaccccgu

SEQ ID NO: 3088746 - RNA, 22 nt, Mycobacterium bovis subsp bovis AF2122/97
gcggggcugggcgccaugcgcc

SEQ ID NO: 3088747 - RNA, 16 nt, Mycobacterium bovis subsp bovis AF2122/97
gcgggggaccccgcca

SEQ ID NO: 3088748 - RNA, 16 nt, Mycobacterium bovis subsp bovis AF2122/97
gcgggggaccgcccga

SEQ ID NO: 3088749 - RNA, 22 nt, Mycobacterium bovis subsp bovis AF2122/97
gcgggggagcgaacggcgcagu

SEQ ID NO: 3088750 - RNA, 21 nt, Mycobacterium bovis subsp bovis AF2122/97
gcgggggaguaguggugggcg

SEQ ID NO: 3088751 - RNA, 21 nt, Mycobacterium bovis subsp bovis AF2122/97
gcgggggaucucgagccgcgg

SEQ ID NO: 3088752 - RNA, 12 nt, Mycobacterium bovis subsp bovis AF2122/97
gcgggggcagcg

SEQ ID NO: 3088753 - RNA, 16 nt, Mycobacterium bovis subsp bovis AF2122/97
gcgggggcgaccuggu

SEQ ID NO: 3088754 - RNA, 12 nt, Mycobacterium bovis subsp bovis AF2122/97
gcgggggcggcc

SEQ ID NO: 3088755 - RNA, 13 nt, Mycobacterium bovis subsp bovis AF2122/97
gcgggggcgucgc

SEQ ID NO: 3088756 - RNA, 17 nt, Mycobacterium bovis subsp bovis AF2122/97
gcggggguacgucaccg

SEQ ID NO: 3088757 - RNA, 12 nt, Mycobacterium bovis subsp bovis AF2122/97
gcgggggugggc

SEQ ID NO: 3088758 - RNA, 18 nt, Mycobacterium bovis subsp bovis AF2122/97
gcggggguucgcucuggu

SEQ ID NO: 3088759 - RNA, 14 nt, Mycobacterium bovis subsp bovis AF2122/97
gcgggguaggccca

SEQ ID NO: 3088760 - RNA, 17 nt, Mycobacterium bovis subsp bovis AF2122/97
gcgggguaggcccagca

SEQ ID NO: 3088761 - RNA, 19 nt, Mycobacterium bovis subsp bovis AF2122/97
gcggggucgaacagcucga

SEQ ID NO: 3088762 - RNA, 19 nt, Mycobacterium bovis subsp bovis AF2122/97
gcggggucuugacggcgcc

SEQ ID NO: 3088763 - RNA, 17 nt, Mycobacterium bovis subsp bovis AF2122/97
gcggggugcgcgcgacc

SEQ ID NO: 3088764 - RNA, 14 nt, Mycobacterium bovis subsp bovis AF2122/97
gcggggugcucagc

SEQ ID NO: 3088765 - RNA, 15 nt, Mycobacterium bovis subsp bovis AF2122/97
gcgggguggcggcgc

SEQ ID NO: 3088766 - RNA, 13 nt, Mycobacterium bovis subsp bovis AF2122/97
gcgggguggguga

SEQ ID NO: 3088767 - RNA, 14 nt, Mycobacterium bovis subsp bovis AF2122/97
gcggggugugcggu

SEQ ID NO: 3088768 - RNA, 18 nt, Mycobacterium bovis subsp bovis AF2122/97
gcggggugugcgguugcu

SEQ ID NO: 3088769 - RNA, 22 nt, Mycobacterium bovis subsp bovis AF2122/97
gcgggguugaucaccgacaccg

SEQ ID NO: 3088770 - RNA, 19 nt, Mycobacterium bovis subsp bovis AF2122/97
gcgggguuggccguggucg

SEQ ID NO: 3088771 - RNA, 24 nt, Mycobacterium bovis subsp bovis AF2122/97
gcgggguuggccguggucgaggug

SEQ ID NO: 3088772 - RNA, 16 nt, Mycobacterium bovis subsp bovis AF2122/97
gcggguaagacgucgg

SEQ ID NO: 3088773 - RNA, 20 nt, Mycobacterium bovis subsp bovis AF2122/97
gcggguagaaccagcccggc

SEQ ID NO: 3088774 - RNA, 15 nt, Mycobacterium bovis subsp bovis AF2122/97
gcggguagccgucga

SEQ ID NO: 3088775 - RNA, 18 nt, Mycobacterium bovis subsp bovis AF2122/97
gcggguaggugacgacgu

SEQ ID NO: 3088776 - RNA, 18 nt, Mycobacterium bovis subsp bovis AF2122/97
gcggguauauggugcgcc

SEQ ID NO: 3088777 - RNA, 13 nt, Mycobacterium bovis subsp bovis AF2122/97
gcgggucagcgcc

SEQ ID NO: 3088778 - RNA, 15 nt, Mycobacterium bovis subsp bovis AF2122/97
gcgggucagcgccga

SEQ ID NO: 3088779 - RNA, 23 nt, Mycobacterium bovis subsp bovis AF2122/97
gcgggucagcugacgggccgcug

SEQ ID NO: 3088780 - RNA, 16 nt, Mycobacterium bovis subsp bovis AF2122/97
gcgggucaggccaggg

SEQ ID NO: 3088781 - RNA, 21 nt, Mycobacterium bovis subsp bovis AF2122/97
gcggguccagccaccgacccc

SEQ ID NO: 3088782 - RNA, 21 nt, Mycobacterium bovis subsp bovis AF2122/97
gcgggucccaaucgucggcca

SEQ ID NO: 3088783 - RNA, 15 nt, Mycobacterium bovis subsp bovis AF2122/97
gcgggucccgccacc

SEQ ID NO: 3088784 - RNA, 16 nt, Mycobacterium bovis subsp bovis AF2122/97
gcgggucccgccacca

SEQ ID NO: 3088785 - RNA, 21 nt, Mycobacterium bovis subsp bovis AF2122/97
gcggguccucgcggagccguc

SEQ ID NO: 3088786 - RNA, 23 nt, Mycobacterium bovis subsp bovis AF2122/97
gcggguccucgcggagccgucgc

SEQ ID NO: 3088787 - RNA, 20 nt, Mycobacterium bovis subsp bovis AF2122/97
gcggguccuucugccgggag

SEQ ID NO: 3088788 - RNA, 14 nt, Mycobacterium bovis subsp bovis AF2122/97
gcgggucgccgcca

SEQ ID NO: 3088789 - RNA, 14 nt, Mycobacterium bovis subsp bovis AF2122/97
gcgggucgcgcgaa

SEQ ID NO: 3088790 - RNA, 20 nt, Mycobacterium bovis subsp bovis AF2122/97
gcgggucgcugcgacuggug

SEQ ID NO: 3088791 - RNA, 22 nt, Mycobacterium bovis subsp bovis AF2122/97
gcgggucgcugcgacuggugcc

SEQ ID NO: 3088792 - RNA, 13 nt, Mycobacterium bovis subsp bovis AF2122/97
gcgggucggcgac

SEQ ID NO: 3088793 - RNA, 12 nt, Mycobacterium bovis subsp bovis AF2122/97
gcgggucggcgg

SEQ ID NO: 3088794 - RNA, 21 nt, Mycobacterium bovis subsp bovis AF2122/97
gcgggucggucgguaacggcg

SEQ ID NO: 3088795 - RNA, 15 nt, Mycobacterium bovis subsp bovis AF2122/97
gcgggucguccggcg

SEQ ID NO: 3088796 - RNA, 15 nt, Mycobacterium bovis subsp bovis AF2122/97
gcgggucgugccagc

SEQ ID NO: 3088797 - RNA, 20 nt, Mycobacterium bovis subsp bovis AF2122/97
gcgggucgugccccggcgcg

SEQ ID NO: 3088798 - RNA, 23 nt, Mycobacterium bovis subsp bovis AF2122/97
gcgggucgugccccggcgcgguc

SEQ ID NO: 3088799 - RNA, 18 nt, Mycobacterium bovis subsp bovis AF2122/97
gcgggucucgccgaccuu

SEQ ID NO: 3088800 - RNA, 20 nt, Mycobacterium bovis subsp bovis AF2122/97
gcgggucucgccgaccuugg

SEQ ID NO: 3088801 - RNA, 17 nt, Mycobacterium bovis subsp bovis AF2122/97
gcgggucuuggcacaca

SEQ ID NO: 3088802 - RNA, 21 nt, Mycobacterium bovis subsp bovis AF2122/97
gcgggucuuggcgaucuccag

SEQ ID NO: 3088803 - RNA, 16 nt, Mycobacterium bovis subsp bovis AF2122/97
gcgggugaccaggcgg

SEQ ID NO: 3088804 - RNA, 19 nt, Mycobacterium bovis subsp bovis AF2122/97
gcgggugaccaggcggcgc

SEQ ID NO: 3088805 - RNA, 22 nt, Mycobacterium bovis subsp bovis AF2122/97
gcgggugaccaggcggcgcggg

SEQ ID NO: 3088806 - RNA, 18 nt, Mycobacterium bovis subsp bovis AF2122/97
gcgggugacuucguggcc

SEQ ID NO: 3088807 - RNA, 19 nt, Mycobacterium bovis subsp bovis AF2122/97
gcgggugacuucguggccu

SEQ ID NO: 3088808 - RNA, 23 nt, Mycobacterium bovis subsp bovis AF2122/97
gcgggugaucuccaccggcgauc

SEQ ID NO: 3088809 - RNA, 18 nt, Mycobacterium bovis subsp bovis AF2122/97
gcgggugaucugggcggu

SEQ ID NO: 3088810 - RNA, 21 nt, Mycobacterium bovis subsp bovis AF2122/97
gcgggugaugacgccgucggc

SEQ ID NO: 3088811 - RNA, 22 nt, Mycobacterium bovis subsp bovis AF2122/97
gcgggugaugacgccgucggcg

SEQ ID NO: 3088812 - RNA, 16 nt, Mycobacterium bovis subsp bovis AF2122/97
gcgggugaugcaguga

SEQ ID NO: 3088813 - RNA, 12 nt, Mycobacterium bovis subsp bovis AF2122/97
gcgggugccagc

SEQ ID NO: 3088814 - RNA, 13 nt, Mycobacterium bovis subsp bovis AF2122/97
gcgggugccagcc

SEQ ID NO: 3088815 - RNA, 21 nt, Mycobacterium bovis subsp bovis AF2122/97
gcgggugccaucggugguggc

SEQ ID NO: 3088816 - RNA, 14 nt, Mycobacterium bovis subsp bovis AF2122/97
gcgggugcgccggc

SEQ ID NO: 3088817 - RNA, 18 nt, Mycobacterium bovis subsp bovis AF2122/97
gcgggugcgcugcagcga

SEQ ID NO: 3088818 - RNA, 18 nt, Mycobacterium bovis subsp bovis AF2122/97
gcgggugcggacaccgag

SEQ ID NO: 3088819 - RNA, 14 nt, Mycobacterium bovis subsp bovis AF2122/97
gcgggugcggcaau

SEQ ID NO: 3088820 - RNA, 18 nt, Mycobacterium bovis subsp bovis AF2122/97
gcgggugcuggucaacag

SEQ ID NO: 3088821 - RNA, 22 nt, Mycobacterium bovis subsp bovis AF2122/97
gcgggugcuggucaacagcggc

SEQ ID NO: 3088822 - RNA, 23 nt, Mycobacterium bovis subsp bovis AF2122/97
gcgggugcuggucaacagcggca

SEQ ID NO: 3088823 - RNA, 12 nt, Mycobacterium bovis subsp bovis AF2122/97
gcggguggcagc

SEQ ID NO: 3088824 - RNA, 21 nt, Mycobacterium bovis subsp bovis AF2122/97
gcggguggcagcggcgaucgg

SEQ ID NO: 3088825 - RNA, 13 nt, Mycobacterium bovis subsp bovis AF2122/97
gcggguggccggg

SEQ ID NO: 3088826 - RNA, 18 nt, Mycobacterium bovis subsp bovis AF2122/97
gcggguggcgccggugcg

SEQ ID NO: 3088827 - RNA, 14 nt, Mycobacterium bovis subsp bovis AF2122/97
gcgggugguccagc

SEQ ID NO: 3088828 - RNA, 23 nt, Mycobacterium bovis subsp bovis AF2122/97
gcggguggugaaguagucggcgc

SEQ ID NO: 3088829 - RNA, 13 nt, Mycobacterium bovis subsp bovis AF2122/97
gcggguggugagc

SEQ ID NO: 3088830 - RNA, 16 nt, Mycobacterium bovis subsp bovis AF2122/97
gcggguggugccggcg

SEQ ID NO: 3088831 - RNA, 20 nt, Mycobacterium bovis subsp bovis AF2122/97
gcgggugguuugcgcccuga

SEQ ID NO: 3088832 - RNA, 13 nt, Mycobacterium bovis subsp bovis AF2122/97
gcgggugugagug

SEQ ID NO: 3088833 - RNA, 17 nt, Mycobacterium bovis subsp bovis AF2122/97
gcggguguggcuacgac

SEQ ID NO: 3088834 - RNA, 17 nt, Mycobacterium bovis subsp bovis AF2122/97
gcggguguuccacacca

SEQ ID NO: 3088835 - RNA, 17 nt, Mycobacterium bovis subsp bovis AF2122/97
gcggguucaacgcgcgc

SEQ ID NO: 3088836 - RNA, 16 nt, Mycobacterium bovis subsp bovis AF2122/97
gcggguucacuuccgg

SEQ ID NO: 3088837 - RNA, 17 nt, Mycobacterium bovis subsp bovis AF2122/97
gcggguuccacacccag

SEQ ID NO: 3088838 - RNA, 15 nt, Mycobacterium bovis subsp bovis AF2122/97
gcggguucgacguug

SEQ ID NO: 3088839 - RNA, 20 nt, Mycobacterium bovis subsp bovis AF2122/97
gcggguucgacguugaucgc

SEQ ID NO: 3088840 - RNA, 21 nt, Mycobacterium bovis subsp bovis AF2122/97
gcggguucgacguugaucgcc

SEQ ID NO: 3088841 - RNA, 22 nt, Mycobacterium bovis subsp bovis AF2122/97
gcggguucgagucccgucacuc

SEQ ID NO: 3088842 - RNA, 14 nt, Mycobacterium bovis subsp bovis AF2122/97
gcggguugggugug

SEQ ID NO: 3088843 - RNA, 14 nt, Mycobacterium bovis subsp bovis AF2122/97
gcggguuggucccg

SEQ ID NO: 3088844 - RNA, 16 nt, Mycobacterium bovis subsp bovis AF2122/97
gcggguugucggcgac

SEQ ID NO: 3088845 - RNA, 18 nt, Mycobacterium bovis subsp bovis AF2122/97
gcggguuguggcacccgg

SEQ ID NO: 3088846 - RNA, 19 nt, Mycobacterium bovis subsp bovis AF2122/97
gcggguuucgcucgcaccg

SEQ ID NO: 3088847 - RNA, 18 nt, Mycobacterium bovis subsp bovis AF2122/97
gcggguuugaucuccacc

SEQ ID NO: 3088848 - RNA, 21 nt, Mycobacterium bovis subsp bovis AF2122/97
gcggguuugcccauccccggu

SEQ ID NO: 3088849 - RNA, 16 nt, Mycobacterium bovis subsp bovis AF2122/97
gcggguuugccgggcg

SEQ ID NO: 3088850 - RNA, 22 nt, Mycobacterium bovis subsp bovis AF2122/97
gcggguuugccgggcgcuggac

SEQ ID NO: 3088851 - RNA, 24 nt, Mycobacterium bovis subsp bovis AF2122/97
gcggguuugccgggcgcuggacgg

SEQ ID NO: 3088852 - RNA, 17 nt, Mycobacterium bovis subsp bovis AF2122/97
gcggguuuuccagccuu

SEQ ID NO: 3088853 - RNA, 21 nt, Mycobacterium bovis subsp bovis AF2122/97
gcgguaaagaucuugucgcgu

SEQ ID NO: 3088854 - RNA, 14 nt, Mycobacterium bovis subsp bovis AF2122/97
gcgguaaagccccg

SEQ ID NO: 3088855 - RNA, 20 nt, Mycobacterium bovis subsp bovis AF2122/97
gcgguaaagccccgcuccgc

SEQ ID NO: 3088856 - RNA, 19 nt, Mycobacterium bovis subsp bovis AF2122/97
gcgguaaccacgcggauca

SEQ ID NO: 3088857 - RNA, 23 nt, Mycobacterium bovis subsp bovis AF2122/97
gcgguaagaaucgaagcggcugc

SEQ ID NO: 3088858 - RNA, 21 nt, Mycobacterium bovis subsp bovis AF2122/97
gcgguaaucgcgagaccaaca

SEQ ID NO: 3088859 - RNA, 14 nt, Mycobacterium bovis subsp bovis AF2122/97
gcgguaaugccagc

SEQ ID NO: 3088860 - RNA, 17 nt, Mycobacterium bovis subsp bovis AF2122/97
gcgguaaugccagcggc

SEQ ID NO: 3088861 - RNA, 18 nt, Mycobacterium bovis subsp bovis AF2122/97
gcgguaccaucaccgcgc

SEQ ID NO: 3088862 - RNA, 19 nt, Mycobacterium bovis subsp bovis AF2122/97
gcgguaccaucaccgcgcc

SEQ ID NO: 3088863 - RNA, 18 nt, Mycobacterium bovis subsp bovis AF2122/97
gcgguaccccccagcgac

SEQ ID NO: 3088864 - RNA, 20 nt, Mycobacterium bovis subsp bovis AF2122/97
gcgguaccccccagcgacgg

SEQ ID NO: 3088865 - RNA, 21 nt, Mycobacterium bovis subsp bovis AF2122/97
gcgguaccccccagcgacggc

SEQ ID NO: 3088866 - RNA, 13 nt, Mycobacterium bovis subsp bovis AF2122/97
gcgguaccgccgc

SEQ ID NO: 3088867 - RNA, 19 nt, Mycobacterium bovis subsp bovis AF2122/97
gcgguaccgccgcggucgg

SEQ ID NO: 3088868 - RNA, 21 nt, Mycobacterium bovis subsp bovis AF2122/97
gcgguaccgccgcggucggac

SEQ ID NO: 3088869 - RNA, 23 nt, Mycobacterium bovis subsp bovis AF2122/97
gcgguaccgccgcggucggacca

SEQ ID NO: 3088870 - RNA, 16 nt, Mycobacterium bovis subsp bovis AF2122/97
gcgguaccgcucgggc

SEQ ID NO: 3088871 - RNA, 17 nt, Mycobacterium bovis subsp bovis AF2122/97
gcgguaccgcucgggcg

SEQ ID NO: 3088872 - RNA, 18 nt, Mycobacterium bovis subsp bovis AF2122/97
gcgguaccgcucgggcgc

SEQ ID NO: 3088873 - RNA, 20 nt, Mycobacterium bovis subsp bovis AF2122/97
gcgguaccggaaucggcggc

SEQ ID NO: 3088874 - RNA, 23 nt, Mycobacterium bovis subsp bovis AF2122/97
gcgguaccggaaucggcggcgga

SEQ ID NO: 3088875 - RNA, 14 nt, Mycobacterium bovis subsp bovis AF2122/97
gcgguaccgguguc

SEQ ID NO: 3088876 - RNA, 20 nt, Mycobacterium bovis subsp bovis AF2122/97
gcgguacgccggucggugcg

SEQ ID NO: 3088877 - RNA, 14 nt, Mycobacterium bovis subsp bovis AF2122/97
gcgguacugcgcag

SEQ ID NO: 3088878 - RNA, 14 nt, Mycobacterium bovis subsp bovis AF2122/97
gcgguagacgccgc

SEQ ID NO: 3088879 - RNA, 20 nt, Mycobacterium bovis subsp bovis AF2122/97
gcgguagcagccgcugagcg

SEQ ID NO: 3088880 - RNA, 17 nt, Mycobacterium bovis subsp bovis AF2122/97
gcgguagccgaccagcg

SEQ ID NO: 3088881 - RNA, 23 nt, Mycobacterium bovis subsp bovis AF2122/97
gcgguagccgaccgaccgcacga

SEQ ID NO: 3088882 - RNA, 14 nt, Mycobacterium bovis subsp bovis AF2122/97
gcgguagccgagcu

SEQ ID NO: 3088883 - RNA, 12 nt, Mycobacterium bovis subsp bovis AF2122/97
gcgguagcgccg

SEQ ID NO: 3088884 - RNA, 17 nt, Mycobacterium bovis subsp bovis AF2122/97
gcgguagcggaccugcg

SEQ ID NO: 3088885 - RNA, 19 nt, Mycobacterium bovis subsp bovis AF2122/97
gcgguagcggaccugcgag

SEQ ID NO: 3088886 - RNA, 23 nt, Mycobacterium bovis subsp bovis AF2122/97
gcgguagcggaccugcgagaucg

SEQ ID NO: 3088887 - RNA, 17 nt, Mycobacterium bovis subsp bovis AF2122/97
gcgguagcucauugccg

SEQ ID NO: 3088888 - RNA, 17 nt, Mycobacterium bovis subsp bovis AF2122/97
gcgguagcugcccagcg

SEQ ID NO: 3088889 - RNA, 17 nt, Mycobacterium bovis subsp bovis AF2122/97
gcgguagcuuccgcgac

SEQ ID NO: 3088890 - RNA, 21 nt, Mycobacterium bovis subsp bovis AF2122/97
gcgguagcuuccgcgacgcuc

SEQ ID NO: 3088891 - RNA, 16 nt, Mycobacterium bovis subsp bovis AF2122/97
gcgguaggagcgggug

SEQ ID NO: 3088892 - RNA, 18 nt, Mycobacterium bovis subsp bovis AF2122/97
gcgguaggagcggguggc

SEQ ID NO: 3088893 - RNA, 15 nt, Mycobacterium bovis subsp bovis AF2122/97
gcgguaggcgggaga

SEQ ID NO: 3088894 - RNA, 17 nt, Mycobacterium bovis subsp bovis AF2122/97
gcgguaggcggugaccc

SEQ ID NO: 3088895 - RNA, 20 nt, Mycobacterium bovis subsp bovis AF2122/97
gcgguaggcuugcaaggucg

SEQ ID NO: 3088896 - RNA, 21 nt, Mycobacterium bovis subsp bovis AF2122/97
gcgguaggcuugcaaggucgc

SEQ ID NO: 3088897 - RNA, 17 nt, Mycobacterium bovis subsp bovis AF2122/97
gcgguagucggccagcu

SEQ ID NO: 3088898 - RNA, 21 nt, Mycobacterium bovis subsp bovis AF2122/97
gcgguagucggccagcucgcg

SEQ ID NO: 3088899 - RNA, 17 nt, Mycobacterium bovis subsp bovis AF2122/97
gcgguagucgucgacag

SEQ ID NO: 3088900 - RNA, 23 nt, Mycobacterium bovis subsp bovis AF2122/97
gcgguaguugcaguacuagcagc

SEQ ID NO: 3088901 - RNA, 18 nt, Mycobacterium bovis subsp bovis AF2122/97
gcgguaguugucccgccg

SEQ ID NO: 3088902 - RNA, 19 nt, Mycobacterium bovis subsp bovis AF2122/97
gcgguaucccccagccgcg

SEQ ID NO: 3088903 - RNA, 22 nt, Mycobacterium bovis subsp bovis AF2122/97
gcgguaucccccagccgcggcg

SEQ ID NO: 3088904 - RNA, 13 nt, Mycobacterium bovis subsp bovis AF2122/97
gcgguaucggcau

SEQ ID NO: 3088905 - RNA, 15 nt, Mycobacterium bovis subsp bovis AF2122/97
gcgguaucggucagc

SEQ ID NO: 3088906 - RNA, 16 nt, Mycobacterium bovis subsp bovis AF2122/97
gcgguaucggucagcc

SEQ ID NO: 3088907 - RNA, 17 nt, Mycobacterium bovis subsp bovis AF2122/97
gcgguaucggucagcca

SEQ ID NO: 3088908 - RNA, 15 nt, Mycobacterium bovis subsp bovis AF2122/97
gcgguaucggucgac

SEQ ID NO: 3088909 - RNA, 18 nt, Mycobacterium bovis subsp bovis AF2122/97
gcgguauuugaacgcccg

SEQ ID NO: 3088910 - RNA, 14 nt, Mycobacterium bovis subsp bovis AF2122/97
gcggucaacgacag

SEQ ID NO: 3088911 - RNA, 15 nt, Mycobacterium bovis subsp bovis AF2122/97
gcggucaacgacagc

SEQ ID NO: 3088912 - RNA, 20 nt, Mycobacterium bovis subsp bovis AF2122/97
gcggucaauguggcgcuucg

SEQ ID NO: 3088913 - RNA, 21 nt, Mycobacterium bovis subsp bovis AF2122/97
gcggucaccaccguggcgccc

SEQ ID NO: 3088914 - RNA, 21 nt, Mycobacterium bovis subsp bovis AF2122/97
gcggucaccccggcucggcca

SEQ ID NO: 3088915 - RNA, 17 nt, Mycobacterium bovis subsp bovis AF2122/97
gcggucaccgacgcaga

SEQ ID NO: 3088916 - RNA, 13 nt, Mycobacterium bovis subsp bovis AF2122/97
gcggucaccgcgu

SEQ ID NO: 3088917 - RNA, 19 nt, Mycobacterium bovis subsp bovis AF2122/97
gcggucaccggagagccgg

SEQ ID NO: 3088918 - RNA, 16 nt, Mycobacterium bovis subsp bovis AF2122/97
gcggucagcagcgccg

SEQ ID NO: 3088919 - RNA, 17 nt, Mycobacterium bovis subsp bovis AF2122/97
gcggucagcagcgccgu

SEQ ID NO: 3088920 - RNA, 22 nt, Mycobacterium bovis subsp bovis AF2122/97
gcggucagcagcgccgucagca

SEQ ID NO: 3088921 - RNA, 14 nt, Mycobacterium bovis subsp bovis AF2122/97
gcggucagccggcc

SEQ ID NO: 3088922 - RNA, 20 nt, Mycobacterium bovis subsp bovis AF2122/97
gcggucagcggauccaggcc

SEQ ID NO: 3088923 - RNA, 13 nt, Mycobacterium bovis subsp bovis AF2122/97
gcggucagcggcc

SEQ ID NO: 3088924 - RNA, 18 nt, Mycobacterium bovis subsp bovis AF2122/97
gcggucagcggcucggcg

SEQ ID NO: 3088925 - RNA, 18 nt, Mycobacterium bovis subsp bovis AF2122/97
gcggucagcggcugggcg

SEQ ID NO: 3088926 - RNA, 19 nt, Mycobacterium bovis subsp bovis AF2122/97
gcggucagcucggcagcau

SEQ ID NO: 3088927 - RNA, 19 nt, Mycobacterium bovis subsp bovis AF2122/97
gcggucagguugcgccaua

SEQ ID NO: 3088928 - RNA, 15 nt, Mycobacterium bovis subsp bovis AF2122/97
gcggucaucgccucg

SEQ ID NO: 3088929 - RNA, 17 nt, Mycobacterium bovis subsp bovis AF2122/97
gcggucaucggcgccaa

SEQ ID NO: 3088930 - RNA, 16 nt, Mycobacterium bovis subsp bovis AF2122/97
gcggucauggcgacgg

SEQ ID NO: 3088931 - RNA, 13 nt, Mycobacterium bovis subsp bovis AF2122/97
gcggucaugggcg

SEQ ID NO: 3088932 - RNA, 18 nt, Mycobacterium bovis subsp bovis AF2122/97
gcgguccaaucgccgggu

SEQ ID NO: 3088933 - RNA, 15 nt, Mycobacterium bovis subsp bovis AF2122/97
gcgguccaccggccc

SEQ ID NO: 3088934 - RNA, 20 nt, Mycobacterium bovis subsp bovis AF2122/97
gcgguccaccggcccucgcc

SEQ ID NO: 3088935 - RNA, 21 nt, Mycobacterium bovis subsp bovis AF2122/97
gcgguccaccggcccucgcca

SEQ ID NO: 3088936 - RNA, 13 nt, Mycobacterium bovis subsp bovis AF2122/97
gcgguccagaaug

SEQ ID NO: 3088937 - RNA, 23 nt, Mycobacterium bovis subsp bovis AF2122/97
gcgguccagacaucagugcgccg

SEQ ID NO: 3088938 - RNA, 19 nt, Mycobacterium bovis subsp bovis AF2122/97
gcgguccagcgucgccgcc

SEQ ID NO: 3088939 - RNA, 15 nt, Mycobacterium bovis subsp bovis AF2122/97
gcgguccaggccggc

SEQ ID NO: 3088940 - RNA, 19 nt, Mycobacterium bovis subsp bovis AF2122/97
gcgguccaggccggcaccc

SEQ ID NO: 3088941 - RNA, 14 nt, Mycobacterium bovis subsp bovis AF2122/97
gcgguccaucagca

SEQ ID NO: 3088942 - RNA, 18 nt, Mycobacterium bovis subsp bovis AF2122/97
gcggucccacggccggcc

SEQ ID NO: 3088943 - RNA, 13 nt, Mycobacterium bovis subsp bovis AF2122/97
gcggucccgcaua

SEQ ID NO: 3088944 - RNA, 20 nt, Mycobacterium bovis subsp bovis AF2122/97
gcggucccugaucaaggacc

SEQ ID NO: 3088945 - RNA, 13 nt, Mycobacterium bovis subsp bovis AF2122/97
gcgguccgaugcg

SEQ ID NO: 3088946 - RNA, 21 nt, Mycobacterium bovis subsp bovis AF2122/97
gcgguccgaugcgcgcggcgc

SEQ ID NO: 3088947 - RNA, 13 nt, Mycobacterium bovis subsp bovis AF2122/97
gcgguccgccgcc

SEQ ID NO: 3088948 - RNA, 13 nt, Mycobacterium bovis subsp bovis AF2122/97
gcgguccgcugcc

SEQ ID NO: 3088949 - RNA, 14 nt, Mycobacterium bovis subsp bovis AF2122/97
gcgguccgcugcca

SEQ ID NO: 3088950 - RNA, 14 nt, Mycobacterium bovis subsp bovis AF2122/97
gcgguccggcuucg

SEQ ID NO: 3088951 - RNA, 19 nt, Mycobacterium bovis subsp bovis AF2122/97
gcgguccggcuucggcgaa

SEQ ID NO: 3088952 - RNA, 18 nt, Mycobacterium bovis subsp bovis AF2122/97
gcgguccucgaucggugg

SEQ ID NO: 3088953 - RNA, 19 nt, Mycobacterium bovis subsp bovis AF2122/97
gcggucgaagaccaagagc

SEQ ID NO: 3088954 - RNA, 12 nt, Mycobacterium bovis subsp bovis AF2122/97
gcggucgacguu

SEQ ID NO: 3088955 - RNA, 12 nt, Mycobacterium bovis subsp bovis AF2122/97
gcggucgagcag

SEQ ID NO: 3088956 - RNA, 20 nt, Mycobacterium bovis subsp bovis AF2122/97
gcggucgagccacccaccga

SEQ ID NO: 3088957 - RNA, 13 nt, Mycobacterium bovis subsp bovis AF2122/97
gcggucgagcucg

SEQ ID NO: 3088958 - RNA, 22 nt, Mycobacterium bovis subsp bovis AF2122/97
gcggucgaggguaccaggcgcc

SEQ ID NO: 3088959 - RNA, 18 nt, Mycobacterium bovis subsp bovis AF2122/97
gcggucgagguggcgggc

SEQ ID NO: 3088960 - RNA, 22 nt, Mycobacterium bovis subsp bovis AF2122/97
gcggucgagguggcgggcgaug

SEQ ID NO: 3088961 - RNA, 18 nt, Mycobacterium bovis subsp bovis AF2122/97
gcggucgaguccacagcg

SEQ ID NO: 3088962 - RNA, 20 nt, Mycobacterium bovis subsp bovis AF2122/97
gcggucgaucaacaccaacg

SEQ ID NO: 3088963 - RNA, 13 nt, Mycobacterium bovis subsp bovis AF2122/97
gcggucgaucaca

SEQ ID NO: 3088964 - RNA, 16 nt, Mycobacterium bovis subsp bovis AF2122/97
gcggucgaucacacgg

SEQ ID NO: 3088965 - RNA, 21 nt, Mycobacterium bovis subsp bovis AF2122/97
gcggucgaucaggccguguac

SEQ ID NO: 3088966 - RNA, 19 nt, Mycobacterium bovis subsp bovis AF2122/97
gcggucgauguccgcagca

SEQ ID NO: 3088967 - RNA, 22 nt, Mycobacterium bovis subsp bovis AF2122/97
gcggucgauguccgcagcaccg

SEQ ID NO: 3088968 - RNA, 17 nt, Mycobacterium bovis subsp bovis AF2122/97
gcggucgcagcagacca

SEQ ID NO: 3088969 - RNA, 16 nt, Mycobacterium bovis subsp bovis AF2122/97
gcggucgccaagaucg

SEQ ID NO: 3088970 - RNA, 22 nt, Mycobacterium bovis subsp bovis AF2122/97
gcggucgccaagaucggguggc

SEQ ID NO: 3088971 - RNA, 16 nt, Mycobacterium bovis subsp bovis AF2122/97
gcggucgccacacccg

SEQ ID NO: 3088972 - RNA, 20 nt, Mycobacterium bovis subsp bovis AF2122/97
gcggucgccagucgauucgg

SEQ ID NO: 3088973 - RNA, 12 nt, Mycobacterium bovis subsp bovis AF2122/97
gcggucgcccag

SEQ ID NO: 3088974 - RNA, 13 nt, Mycobacterium bovis subsp bovis AF2122/97
gcggucgccgcgc

SEQ ID NO: 3088975 - RNA, 21 nt, Mycobacterium bovis subsp bovis AF2122/97
gcggucgcgcccucagccgcg

SEQ ID NO: 3088976 - RNA, 11 nt, Mycobacterium bovis subsp bovis AF2122/97
gcggucgcgga

SEQ ID NO: 3088977 - RNA, 23 nt, Mycobacterium bovis subsp bovis AF2122/97
gcggucgcgguagcagccgcuga

SEQ ID NO: 3088978 - RNA, 19 nt, Mycobacterium bovis subsp bovis AF2122/97
gcggucgcuauccggcggc

SEQ ID NO: 3088979 - RNA, 22 nt, Mycobacterium bovis subsp bovis AF2122/97
gcggucggaaugccgucgccgg

SEQ ID NO: 3088980 - RNA, 16 nt, Mycobacterium bovis subsp bovis AF2122/97
gcggucggaccacccg

SEQ ID NO: 3088981 - RNA, 19 nt, Mycobacterium bovis subsp bovis AF2122/97
gcggucggagucgagcaca

SEQ ID NO: 3088982 - RNA, 13 nt, Mycobacterium bovis subsp bovis AF2122/97
gcggucggccaca

SEQ ID NO: 3088983 - RNA, 20 nt, Mycobacterium bovis subsp bovis AF2122/97
gcggucggccacauccagcg

SEQ ID NO: 3088984 - RNA, 21 nt, Mycobacterium bovis subsp bovis AF2122/97
gcggucggccacauccagcgc

SEQ ID NO: 3088985 - RNA, 14 nt, Mycobacterium bovis subsp bovis AF2122/97
gcggucggccacca

SEQ ID NO: 3088986 - RNA, 16 nt, Mycobacterium bovis subsp bovis AF2122/97
gcggucggccugcggc

SEQ ID NO: 3088987 - RNA, 17 nt, Mycobacterium bovis subsp bovis AF2122/97
gcggucggcgacguaga

SEQ ID NO: 3088988 - RNA, 13 nt, Mycobacterium bovis subsp bovis AF2122/97
gcggucggcggcc

SEQ ID NO: 3088989 - RNA, 14 nt, Mycobacterium bovis subsp bovis AF2122/97
gcggucggcggccg

SEQ ID NO: 3088990 - RNA, 15 nt, Mycobacterium bovis subsp bovis AF2122/97
gcggucggcggccgc

SEQ ID NO: 3088991 - RNA, 16 nt, Mycobacterium bovis subsp bovis AF2122/97
gcggucggcggccgcc

SEQ ID NO: 3088992 - RNA, 14 nt, Mycobacterium bovis subsp bovis AF2122/97
gcggucgggcccgg

SEQ ID NO: 3088993 - RNA, 15 nt, Mycobacterium bovis subsp bovis AF2122/97
gcggucgggcccggc

SEQ ID NO: 3088994 - RNA, 21 nt, Mycobacterium bovis subsp bovis AF2122/97
gcggucggucaccauggcgcc

SEQ ID NO: 3088995 - RNA, 21 nt, Mycobacterium bovis subsp bovis AF2122/97
gcggucguccccgucgcuggc

SEQ ID NO: 3088996 - RNA, 23 nt, Mycobacterium bovis subsp bovis AF2122/97
gcggucguugauuucggcggcga

SEQ ID NO: 3088997 - RNA, 19 nt, Mycobacterium bovis subsp bovis AF2122/97
gcggucguugccgaccgau

SEQ ID NO: 3088998 - RNA, 22 nt, Mycobacterium bovis subsp bovis AF2122/97
gcggucguuggauauggucacc

SEQ ID NO: 3088999 - RNA, 14 nt, Mycobacterium bovis subsp bovis AF2122/97
gcggucguuggcga

SEQ ID NO: 3089000 - RNA, 22 nt, Mycobacterium bovis subsp bovis AF2122/97
gcggucucacucaucggugugc

SEQ ID NO: 3089001 - RNA, 19 nt, Mycobacterium bovis subsp bovis AF2122/97
gcggucuccccagagcugg

SEQ ID NO: 3089002 - RNA, 16 nt, Mycobacterium bovis subsp bovis AF2122/97
gcggucuccgcccgcg

SEQ ID NO: 3089003 - RNA, 19 nt, Mycobacterium bovis subsp bovis AF2122/97
gcggucuccgcccgcgggc

SEQ ID NO: 3089004 - RNA, 14 nt, Mycobacterium bovis subsp bovis AF2122/97
gcggucucggugcc

SEQ ID NO: 3089005 - RNA, 17 nt, Mycobacterium bovis subsp bovis AF2122/97
gcggucugcagugcagc

SEQ ID NO: 3089006 - RNA, 18 nt, Mycobacterium bovis subsp bovis AF2122/97
gcggucugcgccuucgcc

SEQ ID NO: 3089007 - RNA, 19 nt, Mycobacterium bovis subsp bovis AF2122/97
gcggucugcgccuucgcca

SEQ ID NO: 3089008 - RNA, 13 nt, Mycobacterium bovis subsp bovis AF2122/97
gcggucugcgcgu

SEQ ID NO: 3089009 - RNA, 17 nt, Mycobacterium bovis subsp bovis AF2122/97
gcggucugcgcgucgcg

SEQ ID NO: 3089010 - RNA, 18 nt, Mycobacterium bovis subsp bovis AF2122/97
gcggucugcgcgucgcgu

SEQ ID NO: 3089011 - RNA, 12 nt, Mycobacterium bovis subsp bovis AF2122/97
gcggucugcucc

SEQ ID NO: 3089012 - RNA, 19 nt, Mycobacterium bovis subsp bovis AF2122/97
gcggucugcuccaggcgcg

SEQ ID NO: 3089013 - RNA, 14 nt, Mycobacterium bovis subsp bovis AF2122/97
gcggucugguuguc

SEQ ID NO: 3089014 - RNA, 18 nt, Mycobacterium bovis subsp bovis AF2122/97
gcggucugguugucgauc

SEQ ID NO: 3089015 - RNA, 20 nt, Mycobacterium bovis subsp bovis AF2122/97
gcggucuucuucaccgccuu

SEQ ID NO: 3089016 - RNA, 18 nt, Mycobacterium bovis subsp bovis AF2122/97
gcggucuugccgcaggcc

SEQ ID NO: 3089017 - RNA, 23 nt, Mycobacterium bovis subsp bovis AF2122/97
gcggucuuuuugggcuugcccca

SEQ ID NO: 3089018 - RNA, 20 nt, Mycobacterium bovis subsp bovis AF2122/97
gcggugaagugggcguuggc

SEQ ID NO: 3089019 - RNA, 17 nt, Mycobacterium bovis subsp bovis AF2122/97
gcggugaccaccccggc

SEQ ID NO: 3089020 - RNA, 21 nt, Mycobacterium bovis subsp bovis AF2122/97
gcggugacccggaagccgacc

SEQ ID NO: 3089021 - RNA, 21 nt, Mycobacterium bovis subsp bovis AF2122/97
gcggugacccguucagcgacg

SEQ ID NO: 3089022 - RNA, 15 nt, Mycobacterium bovis subsp bovis AF2122/97
gcggugaccggcucg

SEQ ID NO: 3089023 - RNA, 17 nt, Mycobacterium bovis subsp bovis AF2122/97
gcggugaccggcucggc

SEQ ID NO: 3089024 - RNA, 14 nt, Mycobacterium bovis subsp bovis AF2122/97
gcggugaccggguu

SEQ ID NO: 3089025 - RNA, 19 nt, Mycobacterium bovis subsp bovis AF2122/97
gcggugacgagccaccacc

SEQ ID NO: 3089026 - RNA, 17 nt, Mycobacterium bovis subsp bovis AF2122/97
gcggugacgcaacaucg

SEQ ID NO: 3089027 - RNA, 18 nt, Mycobacterium bovis subsp bovis AF2122/97
gcggugacgccagccugg

SEQ ID NO: 3089028 - RNA, 13 nt, Mycobacterium bovis subsp bovis AF2122/97
gcggugacggcgg

SEQ ID NO: 3089029 - RNA, 14 nt, Mycobacterium bovis subsp bovis AF2122/97
gcggugacggcggc

SEQ ID NO: 3089030 - RNA, 22 nt, Mycobacterium bovis subsp bovis AF2122/97
gcggugacucggccuccgccga

SEQ ID NO: 3089031 - RNA, 19 nt, Mycobacterium bovis subsp bovis AF2122/97
gcggugagauggcggugag

SEQ ID NO: 3089032 - RNA, 16 nt, Mycobacterium bovis subsp bovis AF2122/97
gcggugaggcagcgac

SEQ ID NO: 3089033 - RNA, 15 nt, Mycobacterium bovis subsp bovis AF2122/97
gcggugaggucggug

SEQ ID NO: 3089034 - RNA, 16 nt, Mycobacterium bovis subsp bovis AF2122/97
gcggugaggugaccaa

SEQ ID NO: 3089035 - RNA, 16 nt, Mycobacterium bovis subsp bovis AF2122/97
gcggugaguccgcuga

SEQ ID NO: 3089036 - RNA, 17 nt, Mycobacterium bovis subsp bovis AF2122/97
gcggugaucccacgagc

SEQ ID NO: 3089037 - RNA, 19 nt, Mycobacterium bovis subsp bovis AF2122/97
gcggugaucccacgagcgg

SEQ ID NO: 3089038 - RNA, 16 nt, Mycobacterium bovis subsp bovis AF2122/97
gcggugaucggggucg

SEQ ID NO: 3089039 - RNA, 19 nt, Mycobacterium bovis subsp bovis AF2122/97
gcggugauggacugaucgc

SEQ ID NO: 3089040 - RNA, 16 nt, Mycobacterium bovis subsp bovis AF2122/97
gcggugaugguggcaa

SEQ ID NO: 3089041 - RNA, 23 nt, Mycobacterium bovis subsp bovis AF2122/97
gcggugauugcaagcgggcaccg

SEQ ID NO: 3089042 - RNA, 16 nt, Mycobacterium bovis subsp bovis AF2122/97
gcggugcacacugacc

SEQ ID NO: 3089043 - RNA, 22 nt, Mycobacterium bovis subsp bovis AF2122/97
gcggugcaggauucggcggucg

SEQ ID NO: 3089044 - RNA, 22 nt, Mycobacterium bovis subsp bovis AF2122/97
gcggugcagugccucggcggcg

SEQ ID NO: 3089045 - RNA, 23 nt, Mycobacterium bovis subsp bovis AF2122/97
gcggugcagugccucggcggcgu

SEQ ID NO: 3089046 - RNA, 17 nt, Mycobacterium bovis subsp bovis AF2122/97
gcggugcaucgccacca

SEQ ID NO: 3089047 - RNA, 18 nt, Mycobacterium bovis subsp bovis AF2122/97
gcggugcaucgccaccac

SEQ ID NO: 3089048 - RNA, 22 nt, Mycobacterium bovis subsp bovis AF2122/97
gcggugccaccagugagcccgc

SEQ ID NO: 3089049 - RNA, 23 nt, Mycobacterium bovis subsp bovis AF2122/97
gcggugccacggugacccuggug

SEQ ID NO: 3089050 - RNA, 22 nt, Mycobacterium bovis subsp bovis AF2122/97
gcggugcccugccggcagcggc

SEQ ID NO: 3089051 - RNA, 12 nt, Mycobacterium bovis subsp bovis AF2122/97
gcggugccgcca

SEQ ID NO: 3089052 - RNA, 14 nt, Mycobacterium bovis subsp bovis AF2122/97
gcggugccgccacc

SEQ ID NO: 3089053 - RNA, 20 nt, Mycobacterium bovis subsp bovis AF2122/97
gcggugccgccaccggcguc

SEQ ID NO: 3089054 - RNA, 13 nt, Mycobacterium bovis subsp bovis AF2122/97
gcggugccgccgg

SEQ ID NO: 3089055 - RNA, 19 nt, Mycobacterium bovis subsp bovis AF2122/97
gcggugccgccggaaucga

SEQ ID NO: 3089056 - RNA, 13 nt, Mycobacterium bovis subsp bovis AF2122/97
gcggugccgcggc

SEQ ID NO: 3089057 - RNA, 16 nt, Mycobacterium bovis subsp bovis AF2122/97
gcggugccggcccugc

SEQ ID NO: 3089058 - RNA, 21 nt, Mycobacterium bovis subsp bovis AF2122/97
gcggugccggcccugcucggc

SEQ ID NO: 3089059 - RNA, 17 nt, Mycobacterium bovis subsp bovis AF2122/97
gcggugccggccguucg

SEQ ID NO: 3089060 - RNA, 18 nt, Mycobacterium bovis subsp bovis AF2122/97
gcggugccggcggaucug

SEQ ID NO: 3089061 - RNA, 15 nt, Mycobacterium bovis subsp bovis AF2122/97
gcggugccggcggcg

SEQ ID NO: 3089062 - RNA, 16 nt, Mycobacterium bovis subsp bovis AF2122/97
gcggugccggcggcgc

SEQ ID NO: 3089063 - RNA, 19 nt, Mycobacterium bovis subsp bovis AF2122/97
gcggugccgucagcggcgg

SEQ ID NO: 3089064 - RNA, 16 nt, Mycobacterium bovis subsp bovis AF2122/97
gcggugccgucgccgc

SEQ ID NO: 3089065 - RNA, 18 nt, Mycobacterium bovis subsp bovis AF2122/97
gcggugccgucgccgccc

SEQ ID NO: 3089066 - RNA, 22 nt, Mycobacterium bovis subsp bovis AF2122/97
gcggugccgugcucacggcagg

SEQ ID NO: 3089067 - RNA, 14 nt, Mycobacterium bovis subsp bovis AF2122/97
gcggugccguggug

SEQ ID NO: 3089068 - RNA, 16 nt, Mycobacterium bovis subsp bovis AF2122/97
gcggugccugcagcuu

SEQ ID NO: 3089069 - RNA, 12 nt, Mycobacterium bovis subsp bovis AF2122/97
gcggugcgcacc

SEQ ID NO: 3089070 - RNA, 21 nt, Mycobacterium bovis subsp bovis AF2122/97
gcggugcgcagcuuggccagc

SEQ ID NO: 3089071 - RNA, 22 nt, Mycobacterium bovis subsp bovis AF2122/97
gcggugcgcagcuuggccagcc

SEQ ID NO: 3089072 - RNA, 12 nt, Mycobacterium bovis subsp bovis AF2122/97
gcggugcgcggu

SEQ ID NO: 3089073 - RNA, 13 nt, Mycobacterium bovis subsp bovis AF2122/97
gcggugcggcaac

SEQ ID NO: 3089074 - RNA, 19 nt, Mycobacterium bovis subsp bovis AF2122/97
gcggugcggcaacagcgcc

SEQ ID NO: 3089075 - RNA, 23 nt, Mycobacterium bovis subsp bovis AF2122/97
gcggugcggcagauacucggcga

SEQ ID NO: 3089076 - RNA, 12 nt, Mycobacterium bovis subsp bovis AF2122/97
gcggugcggcca

SEQ ID NO: 3089077 - RNA, 16 nt, Mycobacterium bovis subsp bovis AF2122/97
gcggugcggguggugc

SEQ ID NO: 3089078 - RNA, 18 nt, Mycobacterium bovis subsp bovis AF2122/97
gcggugcggguggugccg

SEQ ID NO: 3089079 - RNA, 19 nt, Mycobacterium bovis subsp bovis AF2122/97
gcggugcugguggcggcac

SEQ ID NO: 3089080 - RNA, 16 nt, Mycobacterium bovis subsp bovis AF2122/97
gcgguggaaccuggcg

SEQ ID NO: 3089081 - RNA, 14 nt, Mycobacterium bovis subsp bovis AF2122/97
gcgguggaccaccg

SEQ ID NO: 3089082 - RNA, 13 nt, Mycobacterium bovis subsp bovis AF2122/97
gcgguggacgagc

SEQ ID NO: 3089083 - RNA, 23 nt, Mycobacterium bovis subsp bovis AF2122/97
gcgguggaugcgaugcgcgccga

SEQ ID NO: 3089084 - RNA, 20 nt, Mycobacterium bovis subsp bovis AF2122/97
gcgguggccacccggccgcg

SEQ ID NO: 3089085 - RNA, 12 nt, Mycobacterium bovis subsp bovis AF2122/97
gcgguggccaga

SEQ ID NO: 3089086 - RNA, 22 nt, Mycobacterium bovis subsp bovis AF2122/97
gcgguggccagaucgaacgcag

SEQ ID NO: 3089087 - RNA, 12 nt, Mycobacterium bovis subsp bovis AF2122/97
gcgguggccagc

SEQ ID NO: 3089088 - RNA, 18 nt, Mycobacterium bovis subsp bovis AF2122/97
gcgguggccagcgucgcg

SEQ ID NO: 3089089 - RNA, 13 nt, Mycobacterium bovis subsp bovis AF2122/97
gcgguggccgaca

SEQ ID NO: 3089090 - RNA, 21 nt, Mycobacterium bovis subsp bovis AF2122/97
gcgguggccgucgggugcagc

SEQ ID NO: 3089091 - RNA, 21 nt, Mycobacterium bovis subsp bovis AF2122/97
gcgguggccucccacggcgcg

SEQ ID NO: 3089092 - RNA, 18 nt, Mycobacterium bovis subsp bovis AF2122/97
gcgguggccugucgaaga

SEQ ID NO: 3089093 - RNA, 12 nt, Mycobacterium bovis subsp bovis AF2122/97
gcgguggcggcg

SEQ ID NO: 3089094 - RNA, 13 nt, Mycobacterium bovis subsp bovis AF2122/97
gcgguggcggcgg

SEQ ID NO: 3089095 - RNA, 14 nt, Mycobacterium bovis subsp bovis AF2122/97
gcgguggcggcggu

SEQ ID NO: 3089096 - RNA, 19 nt, Mycobacterium bovis subsp bovis AF2122/97
gcgguggcgucgucggcgg

SEQ ID NO: 3089097 - RNA, 21 nt, Mycobacterium bovis subsp bovis AF2122/97
gcgguggcgucgucggcgggc

SEQ ID NO: 3089098 - RNA, 23 nt, Mycobacterium bovis subsp bovis AF2122/97
gcgguggcgucgucggcgggcug

SEQ ID NO: 3089099 - RNA, 18 nt, Mycobacterium bovis subsp bovis AF2122/97
gcgguggcuugccccgcc

SEQ ID NO: 3089100 - RNA, 14 nt, Mycobacterium bovis subsp bovis AF2122/97
gcggugggcacagc

SEQ ID NO: 3089101 - RNA, 13 nt, Mycobacterium bovis subsp bovis AF2122/97
gcggugggcagca

SEQ ID NO: 3089102 - RNA, 14 nt, Mycobacterium bovis subsp bovis AF2122/97
gcggugggcagcag

SEQ ID NO: 3089103 - RNA, 22 nt, Mycobacterium bovis subsp bovis AF2122/97
gcggugggccagguuuugccgc

SEQ ID NO: 3089104 - RNA, 17 nt, Mycobacterium bovis subsp bovis AF2122/97
gcggugggcuuggcgcc

SEQ ID NO: 3089105 - RNA, 19 nt, Mycobacterium bovis subsp bovis AF2122/97
gcggugggcuuggcgccga

SEQ ID NO: 3089106 - RNA, 15 nt, Mycobacterium bovis subsp bovis AF2122/97
gcgguggggccggcg

SEQ ID NO: 3089107 - RNA, 18 nt, Mycobacterium bovis subsp bovis AF2122/97
gcgguggggccggcgucg

SEQ ID NO: 3089108 - RNA, 17 nt, Mycobacterium bovis subsp bovis AF2122/97
gcgguggggcgcgccgg

SEQ ID NO: 3089109 - RNA, 21 nt, Mycobacterium bovis subsp bovis AF2122/97
gcggugguaccggcgccaccg

SEQ ID NO: 3089110 - RNA, 19 nt, Mycobacterium bovis subsp bovis AF2122/97
gcggugguaggacgccagc

SEQ ID NO: 3089111 - RNA, 20 nt, Mycobacterium bovis subsp bovis AF2122/97
gcggugguaggacgccagca

SEQ ID NO: 3089112 - RNA, 20 nt, Mycobacterium bovis subsp bovis AF2122/97
gcgguggucagcaccggcgc

SEQ ID NO: 3089113 - RNA, 18 nt, Mycobacterium bovis subsp bovis AF2122/97
gcgguggucccgauggcg

SEQ ID NO: 3089114 - RNA, 16 nt, Mycobacterium bovis subsp bovis AF2122/97
gcgguggucgcgaccg

SEQ ID NO: 3089115 - RNA, 17 nt, Mycobacterium bovis subsp bovis AF2122/97
gcgguggugccgcggcc

SEQ ID NO: 3089116 - RNA, 23 nt, Mycobacterium bovis subsp bovis AF2122/97
gcgguggugccgcggccaccgcc

SEQ ID NO: 3089117 - RNA, 21 nt, Mycobacterium bovis subsp bovis AF2122/97
gcgguggugcgcaaucgacac

SEQ ID NO: 3089118 - RNA, 22 nt, Mycobacterium bovis subsp bovis AF2122/97
gcgguggugguguaggaguaca

SEQ ID NO: 3089119 - RNA, 17 nt, Mycobacterium bovis subsp bovis AF2122/97
gcgguguagccggcgcc

SEQ ID NO: 3089120 - RNA, 19 nt, Mycobacterium bovis subsp bovis AF2122/97
gcgguguagccggcgccgc

SEQ ID NO: 3089121 - RNA, 22 nt, Mycobacterium bovis subsp bovis AF2122/97
gcgguguagccggcgccgccgu

SEQ ID NO: 3089122 - RNA, 17 nt, Mycobacterium bovis subsp bovis AF2122/97
gcgguguagggcggcgu

SEQ ID NO: 3089123 - RNA, 19 nt, Mycobacterium bovis subsp bovis AF2122/97
gcggugucacaacgcguga

SEQ ID NO: 3089124 - RNA, 23 nt, Mycobacterium bovis subsp bovis AF2122/97
gcgguguccagaacgguggcgcg

SEQ ID NO: 3089125 - RNA, 13 nt, Mycobacterium bovis subsp bovis AF2122/97
gcggugucggcgc

SEQ ID NO: 3089126 - RNA, 14 nt, Mycobacterium bovis subsp bovis AF2122/97
gcggugucggcgcc

SEQ ID NO: 3089127 - RNA, 20 nt, Mycobacterium bovis subsp bovis AF2122/97
gcggugucggggcccccgcc

SEQ ID NO: 3089128 - RNA, 22 nt, Mycobacterium bovis subsp bovis AF2122/97
gcggugugcagggacccggcgc

SEQ ID NO: 3089129 - RNA, 23 nt, Mycobacterium bovis subsp bovis AF2122/97
gcggugugcagggacccggcgcc

SEQ ID NO: 3089130 - RNA, 13 nt, Mycobacterium bovis subsp bovis AF2122/97
gcggugugccgag

SEQ ID NO: 3089131 - RNA, 18 nt, Mycobacterium bovis subsp bovis AF2122/97
gcggugugcgcauggugg

SEQ ID NO: 3089132 - RNA, 18 nt, Mycobacterium bovis subsp bovis AF2122/97
gcggugugcggcagcccg

SEQ ID NO: 3089133 - RNA, 19 nt, Mycobacterium bovis subsp bovis AF2122/97
gcggugugcggcagcccgc

SEQ ID NO: 3089134 - RNA, 18 nt, Mycobacterium bovis subsp bovis AF2122/97
gcggugugcgugucaccc

SEQ ID NO: 3089135 - RNA, 22 nt, Mycobacterium bovis subsp bovis AF2122/97
gcgguguggcuugcgucgcgga

SEQ ID NO: 3089136 - RNA, 16 nt, Mycobacterium bovis subsp bovis AF2122/97
gcgguguggucgcagg

SEQ ID NO: 3089137 - RNA, 14 nt, Mycobacterium bovis subsp bovis AF2122/97
gcgguguugccgga

SEQ ID NO: 3089138 - RNA, 17 nt, Mycobacterium bovis subsp bovis AF2122/97
gcgguguugcucccggc

SEQ ID NO: 3089139 - RNA, 21 nt, Mycobacterium bovis subsp bovis AF2122/97
gcgguguugcucccggccgcc

SEQ ID NO: 3089140 - RNA, 21 nt, Mycobacterium bovis subsp bovis AF2122/97
gcgguguuggacgcgggccga

SEQ ID NO: 3089141 - RNA, 15 nt, Mycobacterium bovis subsp bovis AF2122/97
gcgguuagcagccgc

SEQ ID NO: 3089142 - RNA, 22 nt, Mycobacterium bovis subsp bovis AF2122/97
gcgguuauguauccgcgccgca

SEQ ID NO: 3089143 - RNA, 21 nt, Mycobacterium bovis subsp bovis AF2122/97
gcgguuccauacagccgccga

SEQ ID NO: 3089144 - RNA, 19 nt, Mycobacterium bovis subsp bovis AF2122/97
gcgguucgaacgcgaucga

SEQ ID NO: 3089145 - RNA, 22 nt, Mycobacterium bovis subsp bovis AF2122/97
gcgguucgaucccguccgcgcc

SEQ ID NO: 3089146 - RNA, 16 nt, Mycobacterium bovis subsp bovis AF2122/97
gcgguucgcauugggg

SEQ ID NO: 3089147 - RNA, 14 nt, Mycobacterium bovis subsp bovis AF2122/97
gcgguucgcugcgg

SEQ ID NO: 3089148 - RNA, 18 nt, Mycobacterium bovis subsp bovis AF2122/97
gcgguucgcugcggcggu

SEQ ID NO: 3089149 - RNA, 15 nt, Mycobacterium bovis subsp bovis AF2122/97
gcgguucucgagcuc

SEQ ID NO: 3089150 - RNA, 16 nt, Mycobacterium bovis subsp bovis AF2122/97
gcgguugaugcggccg

SEQ ID NO: 3089151 - RNA, 16 nt, Mycobacterium bovis subsp bovis AF2122/97
gcgguugauucgugcg

SEQ ID NO: 3089152 - RNA, 22 nt, Mycobacterium bovis subsp bovis AF2122/97
gcgguugcaaaccgcugcgcga

SEQ ID NO: 3089153 - RNA, 21 nt, Mycobacterium bovis subsp bovis AF2122/97
gcgguugcauaccgccgggcc

SEQ ID NO: 3089154 - RNA, 22 nt, Mycobacterium bovis subsp bovis AF2122/97
gcgguugcauccauccugccuu

SEQ ID NO: 3089155 - RNA, 17 nt, Mycobacterium bovis subsp bovis AF2122/97
gcgguugcccgagcggc

SEQ ID NO: 3089156 - RNA, 19 nt, Mycobacterium bovis subsp bovis AF2122/97
gcgguugcccgagcggcug

SEQ ID NO: 3089157 - RNA, 21 nt, Mycobacterium bovis subsp bovis AF2122/97
gcgguugccgucugcggucga

SEQ ID NO: 3089158 - RNA, 16 nt, Mycobacterium bovis subsp bovis AF2122/97
gcgguugccuucuugg

SEQ ID NO: 3089159 - RNA, 16 nt, Mycobacterium bovis subsp bovis AF2122/97
gcgguuggcggcgaug

SEQ ID NO: 3089160 - RNA, 13 nt, Mycobacterium bovis subsp bovis AF2122/97
gcgguuggugguu

SEQ ID NO: 3089161 - RNA, 17 nt, Mycobacterium bovis subsp bovis AF2122/97
gcgguuguccggucgcc

SEQ ID NO: 3089162 - RNA, 17 nt, Mycobacterium bovis subsp bovis AF2122/97
gcgguuguggcugaucc

SEQ ID NO: 3089163 - RNA, 17 nt, Mycobacterium bovis subsp bovis AF2122/97
gcgguuugccggugcgg

SEQ ID NO: 3089164 - RNA, 23 nt, Mycobacterium bovis subsp bovis AF2122/97
gcgguuuggaucacccgccgcgu

SEQ ID NO: 3089165 - RNA, 15 nt, Mycobacterium bovis subsp bovis AF2122/97
gcgguuuggcgacgu

SEQ ID NO: 3089166 - RNA, 14 nt, Mycobacterium bovis subsp bovis AF2122/97
gcgguuuucgccgg

SEQ ID NO: 3089167 - RNA, 17 nt, Mycobacterium bovis subsp bovis AF2122/97
gcgguuuucggcugccg

SEQ ID NO: 3089168 - RNA, 15 nt, Mycobacterium bovis subsp bovis AF2122/97
gcguaaaccggcuga

SEQ ID NO: 3089169 - RNA, 21 nt, Mycobacterium bovis subsp bovis AF2122/97
gcguaaaggccuugggcggca

SEQ ID NO: 3089170 - RNA, 23 nt, Mycobacterium bovis subsp bovis AF2122/97
gcguaaaggccuugggcggcacu

SEQ ID NO: 3089171 - RNA, 24 nt, Mycobacterium bovis subsp bovis AF2122/97
gcguaacuguggaaggugaucacg

SEQ ID NO: 3089172 - RNA, 20 nt, Mycobacterium bovis subsp bovis AF2122/97
gcguaauccgagcgcggcgg

SEQ ID NO: 3089173 - RNA, 15 nt, Mycobacterium bovis subsp bovis AF2122/97
gcguaaugcugcugc

SEQ ID NO: 3089174 - RNA, 22 nt, Mycobacterium bovis subsp bovis AF2122/97
gcguaauuuggcuugcgccgaa

SEQ ID NO: 3089175 - RNA, 17 nt, Mycobacterium bovis subsp bovis AF2122/97
gcguacaaaccgucggg

SEQ ID NO: 3089176 - RNA, 12 nt, Mycobacterium bovis subsp bovis AF2122/97
gcguacagcgcc

SEQ ID NO: 3089177 - RNA, 17 nt, Mycobacterium bovis subsp bovis AF2122/97
gcguacagcgccugggu

SEQ ID NO: 3089178 - RNA, 15 nt, Mycobacterium bovis subsp bovis AF2122/97
gcguacaggccggcc

SEQ ID NO: 3089179 - RNA, 18 nt, Mycobacterium bovis subsp bovis AF2122/97
gcguacaggccggccacc

SEQ ID NO: 3089180 - RNA, 22 nt, Mycobacterium bovis subsp bovis AF2122/97
gcguacauucgggcgugcucgc

SEQ ID NO: 3089181 - RNA, 13 nt, Mycobacterium bovis subsp bovis AF2122/97
gcguacccaacgg

SEQ ID NO: 3089182 - RNA, 18 nt, Mycobacterium bovis subsp bovis AF2122/97
gcguacccgaucagcgac

SEQ ID NO: 3089183 - RNA, 19 nt, Mycobacterium bovis subsp bovis AF2122/97
gcguacccgaucagcgacg

SEQ ID NO: 3089184 - RNA, 20 nt, Mycobacterium bovis subsp bovis AF2122/97
gcguacccguuaugcgccgc

SEQ ID NO: 3089185 - RNA, 22 nt, Mycobacterium bovis subsp bovis AF2122/97
gcguacgccggacccggucgcc

SEQ ID NO: 3089186 - RNA, 14 nt, Mycobacterium bovis subsp bovis AF2122/97
gcguacggaaccac

SEQ ID NO: 3089187 - RNA, 16 nt, Mycobacterium bovis subsp bovis AF2122/97
gcguacucggugaucg

SEQ ID NO: 3089188 - RNA, 18 nt, Mycobacterium bovis subsp bovis AF2122/97
gcguacucgugcaccguc

SEQ ID NO: 3089189 - RNA, 21 nt, Mycobacterium bovis subsp bovis AF2122/97
gcguagaagaaguacaucugc

SEQ ID NO: 3089190 - RNA, 23 nt, Mycobacterium bovis subsp bovis AF2122/97
gcguagaccccaaucgaccgccc

SEQ ID NO: 3089191 - RNA, 20 nt, Mycobacterium bovis subsp bovis AF2122/97
gcguagacguccgcggucgc

SEQ ID NO: 3089192 - RNA, 13 nt, Mycobacterium bovis subsp bovis AF2122/97
gcguagagcagca

SEQ ID NO: 3089193 - RNA, 15 nt, Mycobacterium bovis subsp bovis AF2122/97
gcguagagcagcagc

SEQ ID NO: 3089194 - RNA, 16 nt, Mycobacterium bovis subsp bovis AF2122/97
gcguagagcagcagcg

SEQ ID NO: 3089195 - RNA, 17 nt, Mycobacterium bovis subsp bovis AF2122/97
gcguagagcagcagcgg

SEQ ID NO: 3089196 - RNA, 18 nt, Mycobacterium bovis subsp bovis AF2122/97
gcguagaucaucagcgac

SEQ ID NO: 3089197 - RNA, 13 nt, Mycobacterium bovis subsp bovis AF2122/97
gcguagcaaccca

SEQ ID NO: 3089198 - RNA, 15 nt, Mycobacterium bovis subsp bovis AF2122/97
gcguagcaggucgac

SEQ ID NO: 3089199 - RNA, 19 nt, Mycobacterium bovis subsp bovis AF2122/97
gcguagcaggucgacggcc

SEQ ID NO: 3089200 - RNA, 21 nt, Mycobacterium bovis subsp bovis AF2122/97
gcguagcccacccgggugggc

SEQ ID NO: 3089201 - RNA, 17 nt, Mycobacterium bovis subsp bovis AF2122/97
gcguagcccaugccgau

SEQ ID NO: 3089202 - RNA, 20 nt, Mycobacterium bovis subsp bovis AF2122/97
gcguagcccaugccgaugcc

SEQ ID NO: 3089203 - RNA, 14 nt, Mycobacterium bovis subsp bovis AF2122/97
gcguagcggcgaua

SEQ ID NO: 3089204 - RNA, 13 nt, Mycobacterium bovis subsp bovis AF2122/97
gcguagcggggga

SEQ ID NO: 3089205 - RNA, 21 nt, Mycobacterium bovis subsp bovis AF2122/97
gcguagcgggggagcgaacgg

SEQ ID NO: 3089206 - RNA, 13 nt, Mycobacterium bovis subsp bovis AF2122/97
gcguaggccagcg

SEQ ID NO: 3089207 - RNA, 19 nt, Mycobacterium bovis subsp bovis AF2122/97
gcguaggcccaacgacggc

SEQ ID NO: 3089208 - RNA, 13 nt, Mycobacterium bovis subsp bovis AF2122/97
gcguaggcgaugg

SEQ ID NO: 3089209 - RNA, 18 nt, Mycobacterium bovis subsp bovis AF2122/97
gcguaggcgauggcggcg

SEQ ID NO: 3089210 - RNA, 15 nt, Mycobacterium bovis subsp bovis AF2122/97
gcguagggccagcgc

SEQ ID NO: 3089211 - RNA, 16 nt, Mycobacterium bovis subsp bovis AF2122/97
gcguagggccagcgcc

SEQ ID NO: 3089212 - RNA, 17 nt, Mycobacterium bovis subsp bovis AF2122/97
gcguaguaaugcucgac

SEQ ID NO: 3089213 - RNA, 18 nt, Mycobacterium bovis subsp bovis AF2122/97
gcguaguaaugcucgacg

SEQ ID NO: 3089214 - RNA, 20 nt, Mycobacterium bovis subsp bovis AF2122/97
gcguaguccgcauccgcgac

SEQ ID NO: 3089215 - RNA, 21 nt, Mycobacterium bovis subsp bovis AF2122/97
gcguagugcggcguggaucag

SEQ ID NO: 3089216 - RNA, 20 nt, Mycobacterium bovis subsp bovis AF2122/97
gcguauagcaugccgcggcg

SEQ ID NO: 3089217 - RNA, 21 nt, Mycobacterium bovis subsp bovis AF2122/97
gcguauagcaugccgcggcgg

SEQ ID NO: 3089218 - RNA, 22 nt, Mycobacterium bovis subsp bovis AF2122/97
gcguauagcaugccgcggcgga

SEQ ID NO: 3089219 - RNA, 23 nt, Mycobacterium bovis subsp bovis AF2122/97
gcguauagcaugccgcggcggaa

SEQ ID NO: 3089220 - RNA, 17 nt, Mycobacterium bovis subsp bovis AF2122/97
gcguaucccgugugcgg

SEQ ID NO: 3089221 - RNA, 20 nt, Mycobacterium bovis subsp bovis AF2122/97
gcguaucccgugugcggaca

SEQ ID NO: 3089222 - RNA, 22 nt, Mycobacterium bovis subsp bovis AF2122/97
gcguaucgggcccccuggaucg

SEQ ID NO: 3089223 - RNA, 17 nt, Mycobacterium bovis subsp bovis AF2122/97
gcguaugcccacgaacc

SEQ ID NO: 3089224 - RNA, 18 nt, Mycobacterium bovis subsp bovis AF2122/97
gcguauuggacgcugccg

SEQ ID NO: 3089225 - RNA, 19 nt, Mycobacterium bovis subsp bovis AF2122/97
gcgucaaacaccuccagga

SEQ ID NO: 3089226 - RNA, 18 nt, Mycobacterium bovis subsp bovis AF2122/97
gcgucaaccacggccgcc

SEQ ID NO: 3089227 - RNA, 17 nt, Mycobacterium bovis subsp bovis AF2122/97
gcgucaaccgaucgguc

SEQ ID NO: 3089228 - RNA, 21 nt, Mycobacterium bovis subsp bovis AF2122/97
gcgucaaccgaucggucgucc

SEQ ID NO: 3089229 - RNA, 23 nt, Mycobacterium bovis subsp bovis AF2122/97
gcgucaacgcuguugucguccaa

SEQ ID NO: 3089230 - RNA, 16 nt, Mycobacterium bovis subsp bovis AF2122/97
gcgucaagggcugggu

SEQ ID NO: 3089231 - RNA, 18 nt, Mycobacterium bovis subsp bovis AF2122/97
gcgucaagggcuggguca

SEQ ID NO: 3089232 - RNA, 14 nt, Mycobacterium bovis subsp bovis AF2122/97
gcgucacagccggg

SEQ ID NO: 3089233 - RNA, 13 nt, Mycobacterium bovis subsp bovis AF2122/97
gcgucacauccga

SEQ ID NO: 3089234 - RNA, 15 nt, Mycobacterium bovis subsp bovis AF2122/97
gcgucacccugucgc

SEQ ID NO: 3089235 - RNA, 19 nt, Mycobacterium bovis subsp bovis AF2122/97
gcgucacccugucgcgcac

SEQ ID NO: 3089236 - RNA, 15 nt, Mycobacterium bovis subsp bovis AF2122/97
gcgucaccgccggug

SEQ ID NO: 3089237 - RNA, 15 nt, Mycobacterium bovis subsp bovis AF2122/97
gcgucaccgcgggug

SEQ ID NO: 3089238 - RNA, 20 nt, Mycobacterium bovis subsp bovis AF2122/97
gcgucaccggaggccgccgc

SEQ ID NO: 3089239 - RNA, 22 nt, Mycobacterium bovis subsp bovis AF2122/97
gcgucaccggaggccgccgcgc

SEQ ID NO: 3089240 - RNA, 21 nt, Mycobacterium bovis subsp bovis AF2122/97
gcgucaccucaccgaacggca

SEQ ID NO: 3089241 - RNA, 20 nt, Mycobacterium bovis subsp bovis AF2122/97
gcgucacggugcguucgugc

SEQ ID NO: 3089242 - RNA, 19 nt, Mycobacterium bovis subsp bovis AF2122/97
gcgucagauccggccguug

SEQ ID NO: 3089243 - RNA, 14 nt, Mycobacterium bovis subsp bovis AF2122/97
gcgucagcagcaac

SEQ ID NO: 3089244 - RNA, 13 nt, Mycobacterium bovis subsp bovis AF2122/97
gcgucagcaguuc

SEQ ID NO: 3089245 - RNA, 19 nt, Mycobacterium bovis subsp bovis AF2122/97
gcgucagccgcaccccgcc

SEQ ID NO: 3089246 - RNA, 21 nt, Mycobacterium bovis subsp bovis AF2122/97
gcgucagccgcaccccgcccg

SEQ ID NO: 3089247 - RNA, 22 nt, Mycobacterium bovis subsp bovis AF2122/97
gcgucagccgcaccccgcccga

SEQ ID NO: 3089248 - RNA, 15 nt, Mycobacterium bovis subsp bovis AF2122/97
gcgucagcggcgagc

SEQ ID NO: 3089249 - RNA, 18 nt, Mycobacterium bovis subsp bovis AF2122/97
gcgucaggcacaacgcga

SEQ ID NO: 3089250 - RNA, 15 nt, Mycobacterium bovis subsp bovis AF2122/97
gcgucaggccagcgc

SEQ ID NO: 3089251 - RNA, 20 nt, Mycobacterium bovis subsp bovis AF2122/97
gcgucaggccagcgcucacc

SEQ ID NO: 3089252 - RNA, 22 nt, Mycobacterium bovis subsp bovis AF2122/97
gcgucaggcccucgggugucac

SEQ ID NO: 3089253 - RNA, 17 nt, Mycobacterium bovis subsp bovis AF2122/97
gcgucaggugcgcgacc

SEQ ID NO: 3089254 - RNA, 23 nt, Mycobacterium bovis subsp bovis AF2122/97
gcgucaguccucaucgagcgcgc

SEQ ID NO: 3089255 - RNA, 13 nt, Mycobacterium bovis subsp bovis AF2122/97
gcgucaucaccgg

SEQ ID NO: 3089256 - RNA, 21 nt, Mycobacterium bovis subsp bovis AF2122/97
gcgucaucaccgguacugcga

SEQ ID NO: 3089257 - RNA, 15 nt, Mycobacterium bovis subsp bovis AF2122/97
gcgucaucaggucgu

SEQ ID NO: 3089258 - RNA, 17 nt, Mycobacterium bovis subsp bovis AF2122/97
gcgucaucaggucgucg

SEQ ID NO: 3089259 - RNA, 16 nt, Mycobacterium bovis subsp bovis AF2122/97
gcgucaugaugucgac

SEQ ID NO: 3089260 - RNA, 20 nt, Mycobacterium bovis subsp bovis AF2122/97
gcgucaugaugucgacaucg

SEQ ID NO: 3089261 - RNA, 21 nt, Mycobacterium bovis subsp bovis AF2122/97
gcgucaugaugucgacaucga

SEQ ID NO: 3089262 - RNA, 21 nt, Mycobacterium bovis subsp bovis AF2122/97
gcgucauucaccgcguugaug

SEQ ID NO: 3089263 - RNA, 23 nt, Mycobacterium bovis subsp bovis AF2122/97
gcguccaaccaaggacgaacgcg

SEQ ID NO: 3089264 - RNA, 20 nt, Mycobacterium bovis subsp bovis AF2122/97
gcguccaacccaggguggcg

SEQ ID NO: 3089265 - RNA, 17 nt, Mycobacterium bovis subsp bovis AF2122/97
gcguccaaggcgcgcug

SEQ ID NO: 3089266 - RNA, 19 nt, Mycobacterium bovis subsp bovis AF2122/97
gcguccaaggcgcgcuggg

SEQ ID NO: 3089267 - RNA, 15 nt, Mycobacterium bovis subsp bovis AF2122/97
gcguccaaggcgcug

SEQ ID NO: 3089268 - RNA, 16 nt, Mycobacterium bovis subsp bovis AF2122/97
gcguccaccacgcaaa

SEQ ID NO: 3089269 - RNA, 21 nt, Mycobacterium bovis subsp bovis AF2122/97
gcguccacccacgaucagcag

SEQ ID NO: 3089270 - RNA, 19 nt, Mycobacterium bovis subsp bovis AF2122/97
gcguccaccugcuccgcug

SEQ ID NO: 3089271 - RNA, 21 nt, Mycobacterium bovis subsp bovis AF2122/97
gcguccaccugcuccgcuguc

SEQ ID NO: 3089272 - RNA, 19 nt, Mycobacterium bovis subsp bovis AF2122/97
gcguccacgcugaccaacg

SEQ ID NO: 3089273 - RNA, 15 nt, Mycobacterium bovis subsp bovis AF2122/97
gcguccacgggaucu

SEQ ID NO: 3089274 - RNA, 23 nt, Mycobacterium bovis subsp bovis AF2122/97
gcguccagaagaagaugaucgcg

SEQ ID NO: 3089275 - RNA, 18 nt, Mycobacterium bovis subsp bovis AF2122/97
gcguccagcaaaugcggc

SEQ ID NO: 3089276 - RNA, 20 nt, Mycobacterium bovis subsp bovis AF2122/97
gcguccagcaaaugcggcgc

SEQ ID NO: 3089277 - RNA, 13 nt, Mycobacterium bovis subsp bovis AF2122/97
gcguccagcagcg

SEQ ID NO: 3089278 - RNA, 13 nt, Mycobacterium bovis subsp bovis AF2122/97
gcguccagccgcc

SEQ ID NO: 3089279 - RNA, 17 nt, Mycobacterium bovis subsp bovis AF2122/97
gcguccagcgcggccuu

SEQ ID NO: 3089280 - RNA, 15 nt, Mycobacterium bovis subsp bovis AF2122/97
gcguccagcuggcau

SEQ ID NO: 3089281 - RNA, 23 nt, Mycobacterium bovis subsp bovis AF2122/97
gcguccaggcgagugaacucguc

SEQ ID NO: 3089282 - RNA, 18 nt, Mycobacterium bovis subsp bovis AF2122/97
gcguccaguccgaucacc

SEQ ID NO: 3089283 - RNA, 23 nt, Mycobacterium bovis subsp bovis AF2122/97
gcguccaucagagacagcagcgu

SEQ ID NO: 3089284 - RNA, 14 nt, Mycobacterium bovis subsp bovis AF2122/97
gcguccauccgcag

SEQ ID NO: 3089285 - RNA, 14 nt, Mycobacterium bovis subsp bovis AF2122/97
gcguccaucgccac

SEQ ID NO: 3089286 - RNA, 16 nt, Mycobacterium bovis subsp bovis AF2122/97
gcguccaucgccaccg

SEQ ID NO: 3089287 - RNA, 18 nt, Mycobacterium bovis subsp bovis AF2122/97
gcguccaucgccaccgcg

SEQ ID NO: 3089288 - RNA, 16 nt, Mycobacterium bovis subsp bovis AF2122/97
gcguccaucgcgcgcc

SEQ ID NO: 3089289 - RNA, 21 nt, Mycobacterium bovis subsp bovis AF2122/97
gcguccaucgcgcgccgaccg

SEQ ID NO: 3089290 - RNA, 19 nt, Mycobacterium bovis subsp bovis AF2122/97
gcguccauggucgcgccac

SEQ ID NO: 3089291 - RNA, 23 nt, Mycobacterium bovis subsp bovis AF2122/97
gcgucccaaucgggaucgcugcc

SEQ ID NO: 3089292 - RNA, 14 nt, Mycobacterium bovis subsp bovis AF2122/97
gcguccccagcgcc

SEQ ID NO: 3089293 - RNA, 18 nt, Mycobacterium bovis subsp bovis AF2122/97
gcguccccagcgccaccg

SEQ ID NO: 3089294 - RNA, 15 nt, Mycobacterium bovis subsp bovis AF2122/97
gcguccccaugcagc

SEQ ID NO: 3089295 - RNA, 15 nt, Mycobacterium bovis subsp bovis AF2122/97
gcgucccgccgcacc

SEQ ID NO: 3089296 - RNA, 13 nt, Mycobacterium bovis subsp bovis AF2122/97
gcgucccggcggu

SEQ ID NO: 3089297 - RNA, 17 nt, Mycobacterium bovis subsp bovis AF2122/97
gcgucccggcggucagc

SEQ ID NO: 3089298 - RNA, 15 nt, Mycobacterium bovis subsp bovis AF2122/97
gcguccgcccagcac

SEQ ID NO: 3089299 - RNA, 16 nt, Mycobacterium bovis subsp bovis AF2122/97
gcguccgcccagcacc

SEQ ID NO: 3089300 - RNA, 16 nt, Mycobacterium bovis subsp bovis AF2122/97
gcguccgcccagccgc

SEQ ID NO: 3089301 - RNA, 17 nt, Mycobacterium bovis subsp bovis AF2122/97
gcguccgcccagccgca

SEQ ID NO: 3089302 - RNA, 16 nt, Mycobacterium bovis subsp bovis AF2122/97
gcguccgccgaacacc

SEQ ID NO: 3089303 - RNA, 18 nt, Mycobacterium bovis subsp bovis AF2122/97
gcguccgcgaucugcagc

SEQ ID NO: 3089304 - RNA, 13 nt, Mycobacterium bovis subsp bovis AF2122/97
gcguccgcgcguu

SEQ ID NO: 3089305 - RNA, 20 nt, Mycobacterium bovis subsp bovis AF2122/97
gcguccggaaccaaccucgg

SEQ ID NO: 3089306 - RNA, 13 nt, Mycobacterium bovis subsp bovis AF2122/97
gcguccgggcagc

SEQ ID NO: 3089307 - RNA, 15 nt, Mycobacterium bovis subsp bovis AF2122/97
gcguccgggcagccg

SEQ ID NO: 3089308 - RNA, 13 nt, Mycobacterium bovis subsp bovis AF2122/97
gcguccggugcug

SEQ ID NO: 3089309 - RNA, 14 nt, Mycobacterium bovis subsp bovis AF2122/97
gcguccggugcugg

SEQ ID NO: 3089310 - RNA, 15 nt, Mycobacterium bovis subsp bovis AF2122/97
gcguccggugcuggu

SEQ ID NO: 3089311 - RNA, 19 nt, Mycobacterium bovis subsp bovis AF2122/97
gcguccguagcgauucugg

SEQ ID NO: 3089312 - RNA, 14 nt, Mycobacterium bovis subsp bovis AF2122/97
gcguccgucggcga

SEQ ID NO: 3089313 - RNA, 15 nt, Mycobacterium bovis subsp bovis AF2122/97
gcguccgucgucggc

SEQ ID NO: 3089314 - RNA, 17 nt, Mycobacterium bovis subsp bovis AF2122/97
gcguccgucgucggcgu

SEQ ID NO: 3089315 - RNA, 19 nt, Mycobacterium bovis subsp bovis AF2122/97
gcguccgucgucggcgucc

SEQ ID NO: 3089316 - RNA, 15 nt, Mycobacterium bovis subsp bovis AF2122/97
gcguccucgccgcac

SEQ ID NO: 3089317 - RNA, 21 nt, Mycobacterium bovis subsp bovis AF2122/97
gcguccucgccgcacgccggc

SEQ ID NO: 3089318 - RNA, 13 nt, Mycobacterium bovis subsp bovis AF2122/97
gcguccucgucga

SEQ ID NO: 3089319 - RNA, 15 nt, Mycobacterium bovis subsp bovis AF2122/97
gcguccucgucgaga

SEQ ID NO: 3089320 - RNA, 19 nt, Mycobacterium bovis subsp bovis AF2122/97
gcguccugguggcgggauc

SEQ ID NO: 3089321 - RNA, 23 nt, Mycobacterium bovis subsp bovis AF2122/97
gcguccugguggcgggaucacca

SEQ ID NO: 3089322 - RNA, 22 nt, Mycobacterium bovis subsp bovis AF2122/97
gcguccuucuuguuggucccga

SEQ ID NO: 3089323 - RNA, 13 nt, Mycobacterium bovis subsp bovis AF2122/97
gcgucgaacacgu

SEQ ID NO: 3089324 - RNA, 20 nt, Mycobacterium bovis subsp bovis AF2122/97
gcgucgaacacgucgggaug

SEQ ID NO: 3089325 - RNA, 20 nt, Mycobacterium bovis subsp bovis AF2122/97
gcgucgaacagugccucgcg

SEQ ID NO: 3089326 - RNA, 19 nt, Mycobacterium bovis subsp bovis AF2122/97
gcgucgaacugggcgcccg

SEQ ID NO: 3089327 - RNA, 18 nt, Mycobacterium bovis subsp bovis AF2122/97
gcgucgaagaccgccucc

SEQ ID NO: 3089328 - RNA, 15 nt, Mycobacterium bovis subsp bovis AF2122/97
gcgucgaagccgggg

SEQ ID NO: 3089329 - RNA, 23 nt, Mycobacterium bovis subsp bovis AF2122/97
gcgucgaauuccggcucaccgau

SEQ ID NO: 3089330 - RNA, 21 nt, Mycobacterium bovis subsp bovis AF2122/97
gcgucgacaacacgccgucga

SEQ ID NO: 3089331 - RNA, 14 nt, Mycobacterium bovis subsp bovis AF2122/97
gcgucgacacaccc

SEQ ID NO: 3089332 - RNA, 15 nt, Mycobacterium bovis subsp bovis AF2122/97
gcgucgaccacaggc

SEQ ID NO: 3089333 - RNA, 14 nt, Mycobacterium bovis subsp bovis AF2122/97
gcgucgaccacgca

SEQ ID NO: 3089334 - RNA, 16 nt, Mycobacterium bovis subsp bovis AF2122/97
gcgucgacccagaaca

SEQ ID NO: 3089335 - RNA, 14 nt, Mycobacterium bovis subsp bovis AF2122/97
gcgucgaccgcggc

SEQ ID NO: 3089336 - RNA, 18 nt, Mycobacterium bovis subsp bovis AF2122/97
gcgucgaccgcggcccgg

SEQ ID NO: 3089337 - RNA, 21 nt, Mycobacterium bovis subsp bovis AF2122/97
gcgucgaccgcggcccggacg

SEQ ID NO: 3089338 - RNA, 23 nt, Mycobacterium bovis subsp bovis AF2122/97
gcgucgaccucgcgggcgaucgg

SEQ ID NO: 3089339 - RNA, 19 nt, Mycobacterium bovis subsp bovis AF2122/97
gcgucgacgucagcaccau

SEQ ID NO: 3089340 - RNA, 14 nt, Mycobacterium bovis subsp bovis AF2122/97
gcgucgacgucgac

SEQ ID NO: 3089341 - RNA, 14 nt, Mycobacterium bovis subsp bovis AF2122/97
gcgucgacgucggc

SEQ ID NO: 3089342 - RNA, 20 nt, Mycobacterium bovis subsp bovis AF2122/97
gcgucgagcagcaccacccg

SEQ ID NO: 3089343 - RNA, 22 nt, Mycobacterium bovis subsp bovis AF2122/97
gcgucgagccggauucggcugc

SEQ ID NO: 3089344 - RNA, 14 nt, Mycobacterium bovis subsp bovis AF2122/97
gcgucgagcgaccc

SEQ ID NO: 3089345 - RNA, 21 nt, Mycobacterium bovis subsp bovis AF2122/97
gcgucgagcgacccccagcgc

SEQ ID NO: 3089346 - RNA, 15 nt, Mycobacterium bovis subsp bovis AF2122/97
gcgucgagcgccggc

SEQ ID NO: 3089347 - RNA, 17 nt, Mycobacterium bovis subsp bovis AF2122/97
gcgucgagcgccggccg

SEQ ID NO: 3089348 - RNA, 18 nt, Mycobacterium bovis subsp bovis AF2122/97
gcgucgagcgccggccgc

SEQ ID NO: 3089349 - RNA, 20 nt, Mycobacterium bovis subsp bovis AF2122/97
gcgucgagcucguccucguc

SEQ ID NO: 3089350 - RNA, 16 nt, Mycobacterium bovis subsp bovis AF2122/97
gcgucgagggagcgcc

SEQ ID NO: 3089351 - RNA, 18 nt, Mycobacterium bovis subsp bovis AF2122/97
gcgucgaguggccgugga

SEQ ID NO: 3089352 - RNA, 15 nt, Mycobacterium bovis subsp bovis AF2122/97
gcgucgauaucgcga

SEQ ID NO: 3089353 - RNA, 21 nt, Mycobacterium bovis subsp bovis AF2122/97
gcgucgaucaacaacagccgc

SEQ ID NO: 3089354 - RNA, 14 nt, Mycobacterium bovis subsp bovis AF2122/97
gcgucgaucaccug

SEQ ID NO: 3089355 - RNA, 20 nt, Mycobacterium bovis subsp bovis AF2122/97
gcgucgaucguuccgcugga

SEQ ID NO: 3089356 - RNA, 22 nt, Mycobacterium bovis subsp bovis AF2122/97
gcgucgaucguuccgcuggacg

SEQ ID NO: 3089357 - RNA, 22 nt, Mycobacterium bovis subsp bovis AF2122/97
gcgucgaugagguucaucgccg

SEQ ID NO: 3089358 - RNA, 23 nt, Mycobacterium bovis subsp bovis AF2122/97
gcgucgaugagguucaucgccgg

SEQ ID NO: 3089359 - RNA, 12 nt, Mycobacterium bovis subsp bovis AF2122/97
gcgucgaugccg

SEQ ID NO: 3089360 - RNA, 12 nt, Mycobacterium bovis subsp bovis AF2122/97
gcgucgaugcgc

SEQ ID NO: 3089361 - RNA, 23 nt, Mycobacterium bovis subsp bovis AF2122/97
gcgucgauggccacccgguggcg

SEQ ID NO: 3089362 - RNA, 16 nt, Mycobacterium bovis subsp bovis AF2122/97
gcgucgauggcgucgg

SEQ ID NO: 3089363 - RNA, 20 nt, Mycobacterium bovis subsp bovis AF2122/97
gcgucgcaacccggccugga

SEQ ID NO: 3089364 - RNA, 21 nt, Mycobacterium bovis subsp bovis AF2122/97
gcgucgcaacgcgaucaccuc

SEQ ID NO: 3089365 - RNA, 21 nt, Mycobacterium bovis subsp bovis AF2122/97
gcgucgcaaggcccgcaccgc

SEQ ID NO: 3089366 - RNA, 13 nt, Mycobacterium bovis subsp bovis AF2122/97
gcgucgcacgcgc

SEQ ID NO: 3089367 - RNA, 15 nt, Mycobacterium bovis subsp bovis AF2122/97
gcgucgcacgcgcgc

SEQ ID NO: 3089368 - RNA, 18 nt, Mycobacterium bovis subsp bovis AF2122/97
gcgucgcaggauucccag

SEQ ID NO: 3089369 - RNA, 14 nt, Mycobacterium bovis subsp bovis AF2122/97
gcgucgccgacgcc

SEQ ID NO: 3089370 - RNA, 12 nt, Mycobacterium bovis subsp bovis AF2122/97
gcgucgccgagg

SEQ ID NO: 3089371 - RNA, 16 nt, Mycobacterium bovis subsp bovis AF2122/97
gcgucgccgccgggca

SEQ ID NO: 3089372 - RNA, 17 nt, Mycobacterium bovis subsp bovis AF2122/97
gcgucgccgccguugcc

SEQ ID NO: 3089373 - RNA, 23 nt, Mycobacterium bovis subsp bovis AF2122/97
gcgucgccgccguugccgccggc

SEQ ID NO: 3089374 - RNA, 15 nt, Mycobacterium bovis subsp bovis AF2122/97
gcgucgccggcaccg

SEQ ID NO: 3089375 - RNA, 13 nt, Mycobacterium bovis subsp bovis AF2122/97
gcgucgccggccc

SEQ ID NO: 3089376 - RNA, 20 nt, Mycobacterium bovis subsp bovis AF2122/97
gcgucgccggccuugagcac

SEQ ID NO: 3089377 - RNA, 13 nt, Mycobacterium bovis subsp bovis AF2122/97
gcgucgcgcgcgg

SEQ ID NO: 3089378 - RNA, 21 nt, Mycobacterium bovis subsp bovis AF2122/97
gcgucgcgcgcggcaugggcc

SEQ ID NO: 3089379 - RNA, 13 nt, Mycobacterium bovis subsp bovis AF2122/97
gcgucgcggccac

SEQ ID NO: 3089380 - RNA, 17 nt, Mycobacterium bovis subsp bovis AF2122/97
gcgucgcgggauugcgc

SEQ ID NO: 3089381 - RNA, 23 nt, Mycobacterium bovis subsp bovis AF2122/97
gcgucgcgggucuuggcgaucuc

SEQ ID NO: 3089382 - RNA, 23 nt, Mycobacterium bovis subsp bovis AF2122/97
gcgucgcuaucgugcgccgacgg

SEQ ID NO: 3089383 - RNA, 14 nt, Mycobacterium bovis subsp bovis AF2122/97
gcgucgcucgucgu

SEQ ID NO: 3089384 - RNA, 19 nt, Mycobacterium bovis subsp bovis AF2122/97
gcgucggaauacaacagcu

SEQ ID NO: 3089385 - RNA, 16 nt, Mycobacterium bovis subsp bovis AF2122/97
gcgucggacaugccga

SEQ ID NO: 3089386 - RNA, 16 nt, Mycobacterium bovis subsp bovis AF2122/97
gcgucggacuccgaga

SEQ ID NO: 3089387 - RNA, 13 nt, Mycobacterium bovis subsp bovis AF2122/97
gcgucggccaccg

SEQ ID NO: 3089388 - RNA, 15 nt, Mycobacterium bovis subsp bovis AF2122/97
gcgucggccaccgcc

SEQ ID NO: 3089389 - RNA, 13 nt, Mycobacterium bovis subsp bovis AF2122/97
gcgucggccagga

SEQ ID NO: 3089390 - RNA, 12 nt, Mycobacterium bovis subsp bovis AF2122/97
gcgucggcccgg

SEQ ID NO: 3089391 - RNA, 11 nt, Mycobacterium bovis subsp bovis AF2122/97
gcgucggcgaa

SEQ ID NO: 3089392 - RNA, 21 nt, Mycobacterium bovis subsp bovis AF2122/97
gcgucggcgaacagacgcaaa

SEQ ID NO: 3089393 - RNA, 23 nt, Mycobacterium bovis subsp bovis AF2122/97
gcgucggcgaugaacagcgacgc

SEQ ID NO: 3089394 - RNA, 14 nt, Mycobacterium bovis subsp bovis AF2122/97
gcgucggcgcccag

SEQ ID NO: 3089395 - RNA, 17 nt, Mycobacterium bovis subsp bovis AF2122/97
gcgucggcggccaguac

SEQ ID NO: 3089396 - RNA, 14 nt, Mycobacterium bovis subsp bovis AF2122/97
gcgucggcggcgac

SEQ ID NO: 3089397 - RNA, 19 nt, Mycobacterium bovis subsp bovis AF2122/97
gcgucggcggcgaccgcca

SEQ ID NO: 3089398 - RNA, 22 nt, Mycobacterium bovis subsp bovis AF2122/97
gcgucggcggcgaccgccagcg

SEQ ID NO: 3089399 - RNA, 12 nt, Mycobacterium bovis subsp bovis AF2122/97
gcgucggcggcu

SEQ ID NO: 3089400 - RNA, 23 nt, Mycobacterium bovis subsp bovis AF2122/97
gcgucggcggcuuccucgagcga

SEQ ID NO: 3089401 - RNA, 19 nt, Mycobacterium bovis subsp bovis AF2122/97
gcgucggcgucauccaccg

SEQ ID NO: 3089402 - RNA, 14 nt, Mycobacterium bovis subsp bovis AF2122/97
gcgucggcugccgc

SEQ ID NO: 3089403 - RNA, 13 nt, Mycobacterium bovis subsp bovis AF2122/97
gcgucgggcucgg

SEQ ID NO: 3089404 - RNA, 18 nt, Mycobacterium bovis subsp bovis AF2122/97
gcgucgggguggcggucc

SEQ ID NO: 3089405 - RNA, 13 nt, Mycobacterium bovis subsp bovis AF2122/97
gcgucggucaccg

SEQ ID NO: 3089406 - RNA, 23 nt, Mycobacterium bovis subsp bovis AF2122/97
gcgucggucaccuggcgauaacc

SEQ ID NO: 3089407 - RNA, 19 nt, Mycobacterium bovis subsp bovis AF2122/97
gcgucggucggguggaucu

SEQ ID NO: 3089408 - RNA, 19 nt, Mycobacterium bovis subsp bovis AF2122/97
gcgucggugagcgcgucgc

SEQ ID NO: 3089409 - RNA, 14 nt, Mycobacterium bovis subsp bovis AF2122/97
gcgucgguggcaac

SEQ ID NO: 3089410 - RNA, 20 nt, Mycobacterium bovis subsp bovis AF2122/97
gcgucgguggcaacgggucg

SEQ ID NO: 3089411 - RNA, 15 nt, Mycobacterium bovis subsp bovis AF2122/97
gcgucggugucgaug

SEQ ID NO: 3089412 - RNA, 16 nt, Mycobacterium bovis subsp bovis AF2122/97
gcgucggugucgaugc

SEQ ID NO: 3089413 - RNA, 23 nt, Mycobacterium bovis subsp bovis AF2122/97
gcgucgguugauugugcccagua

SEQ ID NO: 3089414 - RNA, 20 nt, Mycobacterium bovis subsp bovis AF2122/97
gcgucguaaccgucgccugc

SEQ ID NO: 3089415 - RNA, 16 nt, Mycobacterium bovis subsp bovis AF2122/97
gcgucguagcgcucgu

SEQ ID NO: 3089416 - RNA, 18 nt, Mycobacterium bovis subsp bovis AF2122/97
gcgucguaggagccguca

SEQ ID NO: 3089417 - RNA, 18 nt, Mycobacterium bovis subsp bovis AF2122/97
gcgucguauucgaugccg

SEQ ID NO: 3089418 - RNA, 14 nt, Mycobacterium bovis subsp bovis AF2122/97
gcgucguccgcgcc

SEQ ID NO: 3089419 - RNA, 19 nt, Mycobacterium bovis subsp bovis AF2122/97
gcgucgucgaguuggccau

SEQ ID NO: 3089420 - RNA, 16 nt, Mycobacterium bovis subsp bovis AF2122/97
gcgucgucgcgcugaa

SEQ ID NO: 3089421 - RNA, 13 nt, Mycobacterium bovis subsp bovis AF2122/97
gcgucgucggcgg

SEQ ID NO: 3089422 - RNA, 15 nt, Mycobacterium bovis subsp bovis AF2122/97
gcgucgucggcggcg

SEQ ID NO: 3089423 - RNA, 17 nt, Mycobacterium bovis subsp bovis AF2122/97
gcgucgucggcggcgac

SEQ ID NO: 3089424 - RNA, 21 nt, Mycobacterium bovis subsp bovis AF2122/97
gcgucgucggcgggcugcagu

SEQ ID NO: 3089425 - RNA, 19 nt, Mycobacterium bovis subsp bovis AF2122/97
gcgucgucugcagaccugu

SEQ ID NO: 3089426 - RNA, 24 nt, Mycobacterium bovis subsp bovis AF2122/97
gcgucgugcgcggccggcacgacc

SEQ ID NO: 3089427 - RNA, 20 nt, Mycobacterium bovis subsp bovis AF2122/97
gcgucguggcuuccgguggu

SEQ ID NO: 3089428 - RNA, 23 nt, Mycobacterium bovis subsp bovis AF2122/97
gcgucguggcuuccggugguguc

SEQ ID NO: 3089429 - RNA, 15 nt, Mycobacterium bovis subsp bovis AF2122/97
gcgucguggggaccg

SEQ ID NO: 3089430 - RNA, 21 nt, Mycobacterium bovis subsp bovis AF2122/97
gcgucguggggaccggcaggc

SEQ ID NO: 3089431 - RNA, 16 nt, Mycobacterium bovis subsp bovis AF2122/97
gcgucguggucggcga

SEQ ID NO: 3089432 - RNA, 22 nt, Mycobacterium bovis subsp bovis AF2122/97
gcgucgugguggcuauuccgac

SEQ ID NO: 3089433 - RNA, 22 nt, Mycobacterium bovis subsp bovis AF2122/97
gcgucguucgagaccccgacga

SEQ ID NO: 3089434 - RNA, 17 nt, Mycobacterium bovis subsp bovis AF2122/97
gcgucguucggagcccu

SEQ ID NO: 3089435 - RNA, 19 nt, Mycobacterium bovis subsp bovis AF2122/97
gcgucguucggagcccuga

SEQ ID NO: 3089436 - RNA, 22 nt, Mycobacterium bovis subsp bovis AF2122/97
gcgucguucggagcccugaccg

SEQ ID NO: 3089437 - RNA, 14 nt, Mycobacterium bovis subsp bovis AF2122/97
gcgucguugaggaa

SEQ ID NO: 3089438 - RNA, 23 nt, Mycobacterium bovis subsp bovis AF2122/97
gcgucguugaggaagcccgaugc

SEQ ID NO: 3089439 - RNA, 20 nt, Mycobacterium bovis subsp bovis AF2122/97
gcgucguugcucggucucgu

SEQ ID NO: 3089440 - RNA, 19 nt, Mycobacterium bovis subsp bovis AF2122/97
gcgucguugucgucgccgg

SEQ ID NO: 3089441 - RNA, 17 nt, Mycobacterium bovis subsp bovis AF2122/97
gcgucguuugggugcgc

SEQ ID NO: 3089442 - RNA, 16 nt, Mycobacterium bovis subsp bovis AF2122/97
gcgucuaccaaccggu

SEQ ID NO: 3089443 - RNA, 17 nt, Mycobacterium bovis subsp bovis AF2122/97
gcgucuccacuuucugc

SEQ ID NO: 3089444 - RNA, 16 nt, Mycobacterium bovis subsp bovis AF2122/97
gcgucuccagcugggu

SEQ ID NO: 3089445 - RNA, 14 nt, Mycobacterium bovis subsp bovis AF2122/97
gcgucuccuugagc

SEQ ID NO: 3089446 - RNA, 13 nt, Mycobacterium bovis subsp bovis AF2122/97
gcgucucgagcgc

SEQ ID NO: 3089447 - RNA, 18 nt, Mycobacterium bovis subsp bovis AF2122/97
gcgucucgccgggaaaca

SEQ ID NO: 3089448 - RNA, 21 nt, Mycobacterium bovis subsp bovis AF2122/97
gcgucucgccgggaaacaccg

SEQ ID NO: 3089449 - RNA, 17 nt, Mycobacterium bovis subsp bovis AF2122/97
gcgucucgcgcagccgg

SEQ ID NO: 3089450 - RNA, 12 nt, Mycobacterium bovis subsp bovis AF2122/97
gcgucucggugg

SEQ ID NO: 3089451 - RNA, 16 nt, Mycobacterium bovis subsp bovis AF2122/97
gcgucugagcgccggc

SEQ ID NO: 3089452 - RNA, 20 nt, Mycobacterium bovis subsp bovis AF2122/97
gcgucugagcgccggcaucg

SEQ ID NO: 3089453 - RNA, 21 nt, Mycobacterium bovis subsp bovis AF2122/97
gcgucugagcgccggcaucgc

SEQ ID NO: 3089454 - RNA, 18 nt, Mycobacterium bovis subsp bovis AF2122/97
gcgucugcccgcccagcc

SEQ ID NO: 3089455 - RNA, 13 nt, Mycobacterium bovis subsp bovis AF2122/97
gcgucugcggcgg

SEQ ID NO: 3089456 - RNA, 16 nt, Mycobacterium bovis subsp bovis AF2122/97
gcgucugcgguggccu

SEQ ID NO: 3089457 - RNA, 17 nt, Mycobacterium bovis subsp bovis AF2122/97
gcgucugcucaccagcg

SEQ ID NO: 3089458 - RNA, 20 nt, Mycobacterium bovis subsp bovis AF2122/97
gcgucugcucaccagcgguc

SEQ ID NO: 3089459 - RNA, 12 nt, Mycobacterium bovis subsp bovis AF2122/97
gcgucugcucgc

SEQ ID NO: 3089460 - RNA, 14 nt, Mycobacterium bovis subsp bovis AF2122/97
gcgucugcucgcca

SEQ ID NO: 3089461 - RNA, 16 nt, Mycobacterium bovis subsp bovis AF2122/97
gcgucugcucgccagc

SEQ ID NO: 3089462 - RNA, 17 nt, Mycobacterium bovis subsp bovis AF2122/97
gcgucugcucgccagcg

SEQ ID NO: 3089463 - RNA, 15 nt, Mycobacterium bovis subsp bovis AF2122/97
gcgucugcucgccgg

SEQ ID NO: 3089464 - RNA, 22 nt, Mycobacterium bovis subsp bovis AF2122/97
gcgucugcucgcgcagggaucg

SEQ ID NO: 3089465 - RNA, 19 nt, Mycobacterium bovis subsp bovis AF2122/97
gcgucugcucgcgccggug

SEQ ID NO: 3089466 - RNA, 22 nt, Mycobacterium bovis subsp bovis AF2122/97
gcgucugcucgcgccggugagg

SEQ ID NO: 3089467 - RNA, 16 nt, Mycobacterium bovis subsp bovis AF2122/97
gcgucugcucggcauc

SEQ ID NO: 3089468 - RNA, 15 nt, Mycobacterium bovis subsp bovis AF2122/97
gcgucugcucggcgc

SEQ ID NO: 3089469 - RNA, 18 nt, Mycobacterium bovis subsp bovis AF2122/97
gcgucugcucggcgcagc

SEQ ID NO: 3089470 - RNA, 19 nt, Mycobacterium bovis subsp bovis AF2122/97
gcgucugcucggcgcagcu

SEQ ID NO: 3089471 - RNA, 17 nt, Mycobacterium bovis subsp bovis AF2122/97
gcgucugcucggcggcc

SEQ ID NO: 3089472 - RNA, 18 nt, Mycobacterium bovis subsp bovis AF2122/97
gcgucugcucggcggugc

SEQ ID NO: 3089473 - RNA, 15 nt, Mycobacterium bovis subsp bovis AF2122/97
gcgucugcucggcgu

SEQ ID NO: 3089474 - RNA, 14 nt, Mycobacterium bovis subsp bovis AF2122/97
gcgucugcugaccg

SEQ ID NO: 3089475 - RNA, 14 nt, Mycobacterium bovis subsp bovis AF2122/97
gcgucuggcgacau

SEQ ID NO: 3089476 - RNA, 20 nt, Mycobacterium bovis subsp bovis AF2122/97
gcgucuggucagccgcggcg

SEQ ID NO: 3089477 - RNA, 18 nt, Mycobacterium bovis subsp bovis AF2122/97
gcgucuuccucggccacc

SEQ ID NO: 3089478 - RNA, 14 nt, Mycobacterium bovis subsp bovis AF2122/97
gcgucuugcagccu

SEQ ID NO: 3089479 - RNA, 20 nt, Mycobacterium bovis subsp bovis AF2122/97
gcgucuuggaaggcgcgcgc

SEQ ID NO: 3089480 - RNA, 23 nt, Mycobacterium bovis subsp bovis AF2122/97
gcgugaaaaacgcccgcgcugcc

SEQ ID NO: 3089481 - RNA, 19 nt, Mycobacterium bovis subsp bovis AF2122/97
gcgugaaaugcacgaucgc

SEQ ID NO: 3089482 - RNA, 16 nt, Mycobacterium bovis subsp bovis AF2122/97
gcgugaaccuggcgac

SEQ ID NO: 3089483 - RNA, 18 nt, Mycobacterium bovis subsp bovis AF2122/97
gcgugaaccuggcgacgc

SEQ ID NO: 3089484 - RNA, 19 nt, Mycobacterium bovis subsp bovis AF2122/97
gcgugaagucacggcggcu

SEQ ID NO: 3089485 - RNA, 22 nt, Mycobacterium bovis subsp bovis AF2122/97
gcgugaccacugaaccguucga

SEQ ID NO: 3089486 - RNA, 14 nt, Mycobacterium bovis subsp bovis AF2122/97
gcgugaccagggcc

SEQ ID NO: 3089487 - RNA, 19 nt, Mycobacterium bovis subsp bovis AF2122/97
gcgugaccagggccugagu

SEQ ID NO: 3089488 - RNA, 23 nt, Mycobacterium bovis subsp bovis AF2122/97
gcgugaccagucgcggcguucgg

SEQ ID NO: 3089489 - RNA, 13 nt, Mycobacterium bovis subsp bovis AF2122/97
gcgugacccgccg

SEQ ID NO: 3089490 - RNA, 15 nt, Mycobacterium bovis subsp bovis AF2122/97
gcgugacccgccggc

SEQ ID NO: 3089491 - RNA, 16 nt, Mycobacterium bovis subsp bovis AF2122/97
gcgugacccgccggcg

SEQ ID NO: 3089492 - RNA, 17 nt, Mycobacterium bovis subsp bovis AF2122/97
gcgugacccgccggcga

SEQ ID NO: 3089493 - RNA, 18 nt, Mycobacterium bovis subsp bovis AF2122/97
gcgugacccgccggcgac

SEQ ID NO: 3089494 - RNA, 16 nt, Mycobacterium bovis subsp bovis AF2122/97
gcgugaccgacugcgg

SEQ ID NO: 3089495 - RNA, 18 nt, Mycobacterium bovis subsp bovis AF2122/97
gcgugaccgacugcgggu

SEQ ID NO: 3089496 - RNA, 18 nt, Mycobacterium bovis subsp bovis AF2122/97
gcgugaccgugccgucgg

SEQ ID NO: 3089497 - RNA, 19 nt, Mycobacterium bovis subsp bovis AF2122/97
gcgugaccgugccgucggc

SEQ ID NO: 3089498 - RNA, 20 nt, Mycobacterium bovis subsp bovis AF2122/97
gcgugaccuaccuccucggc

SEQ ID NO: 3089499 - RNA, 13 nt, Mycobacterium bovis subsp bovis AF2122/97
gcgugacgaccag

SEQ ID NO: 3089500 - RNA, 15 nt, Mycobacterium bovis subsp bovis AF2122/97
gcgugacgaccagcc

SEQ ID NO: 3089501 - RNA, 19 nt, Mycobacterium bovis subsp bovis AF2122/97
gcgugacgaccagccccgc

SEQ ID NO: 3089502 - RNA, 22 nt, Mycobacterium bovis subsp bovis AF2122/97
gcgugacgcuaacgucgaucuc

SEQ ID NO: 3089503 - RNA, 15 nt, Mycobacterium bovis subsp bovis AF2122/97
gcgugacgggcagga

SEQ ID NO: 3089504 - RNA, 17 nt, Mycobacterium bovis subsp bovis AF2122/97
gcgugacguaccacggc

SEQ ID NO: 3089505 - RNA, 23 nt, Mycobacterium bovis subsp bovis AF2122/97
gcgugacguaccacggcgauccg

SEQ ID NO: 3089506 - RNA, 18 nt, Mycobacterium bovis subsp bovis AF2122/97
gcgugacucggccgacga

SEQ ID NO: 3089507 - RNA, 19 nt, Mycobacterium bovis subsp bovis AF2122/97
gcgugacucggccgacgag

SEQ ID NO: 3089508 - RNA, 14 nt, Mycobacterium bovis subsp bovis AF2122/97
gcgugagcagacgc

SEQ ID NO: 3089509 - RNA, 16 nt, Mycobacterium bovis subsp bovis AF2122/97
gcgugagcagacgcaa

SEQ ID NO: 3089510 - RNA, 20 nt, Mycobacterium bovis subsp bovis AF2122/97
gcgugagccaugccgcucgg

SEQ ID NO: 3089511 - RNA, 18 nt, Mycobacterium bovis subsp bovis AF2122/97
gcgugagcgccgcggcga

SEQ ID NO: 3089512 - RNA, 21 nt, Mycobacterium bovis subsp bovis AF2122/97
gcgugagcuaugcuggcagcu

SEQ ID NO: 3089513 - RNA, 14 nt, Mycobacterium bovis subsp bovis AF2122/97
gcgugaucccgccc

SEQ ID NO: 3089514 - RNA, 16 nt, Mycobacterium bovis subsp bovis AF2122/97
gcgugaucuggccacg

SEQ ID NO: 3089515 - RNA, 18 nt, Mycobacterium bovis subsp bovis AF2122/97
gcgugaucuggccacggc

SEQ ID NO: 3089516 - RNA, 14 nt, Mycobacterium bovis subsp bovis AF2122/97
gcgugaucuggccg

SEQ ID NO: 3089517 - RNA, 16 nt, Mycobacterium bovis subsp bovis AF2122/97
gcgugaucuggccgaa

SEQ ID NO: 3089518 - RNA, 21 nt, Mycobacterium bovis subsp bovis AF2122/97
gcgugaucuggccgaagcccg

SEQ ID NO: 3089519 - RNA, 17 nt, Mycobacterium bovis subsp bovis AF2122/97
gcgugauggcggcgcac

SEQ ID NO: 3089520 - RNA, 15 nt, Mycobacterium bovis subsp bovis AF2122/97
gcgugaugguugcuc

SEQ ID NO: 3089521 - RNA, 16 nt, Mycobacterium bovis subsp bovis AF2122/97
gcgugcacacccgcaa

SEQ ID NO: 3089522 - RNA, 17 nt, Mycobacterium bovis subsp bovis AF2122/97
gcgugcacaggucagcg

SEQ ID NO: 3089523 - RNA, 14 nt, Mycobacterium bovis subsp bovis AF2122/97
gcgugcaccgcauc

SEQ ID NO: 3089524 - RNA, 16 nt, Mycobacterium bovis subsp bovis AF2122/97
gcgugcacugaccgcg

SEQ ID NO: 3089525 - RNA, 18 nt, Mycobacterium bovis subsp bovis AF2122/97
gcgugcacugaccgcggc

SEQ ID NO: 3089526 - RNA, 21 nt, Mycobacterium bovis subsp bovis AF2122/97
gcgugcacugaccgcggcugu

SEQ ID NO: 3089527 - RNA, 13 nt, Mycobacterium bovis subsp bovis AF2122/97
gcgugcagaaucc

SEQ ID NO: 3089528 - RNA, 19 nt, Mycobacterium bovis subsp bovis AF2122/97
gcgugcagaauccguucga

SEQ ID NO: 3089529 - RNA, 18 nt, Mycobacterium bovis subsp bovis AF2122/97
gcgugcagcggcgccgcc

SEQ ID NO: 3089530 - RNA, 19 nt, Mycobacterium bovis subsp bovis AF2122/97
gcgugcagcggcgccgcca

SEQ ID NO: 3089531 - RNA, 15 nt, Mycobacterium bovis subsp bovis AF2122/97
gcgugcagcggcggg

SEQ ID NO: 3089532 - RNA, 17 nt, Mycobacterium bovis subsp bovis AF2122/97
gcgugcagcggcgggcg

SEQ ID NO: 3089533 - RNA, 20 nt, Mycobacterium bovis subsp bovis AF2122/97
gcgugcaggcugucaauccg

SEQ ID NO: 3089534 - RNA, 19 nt, Mycobacterium bovis subsp bovis AF2122/97
gcgugcaguacaccccauc

SEQ ID NO: 3089535 - RNA, 17 nt, Mycobacterium bovis subsp bovis AF2122/97
gcgugcaucgccugcgc

SEQ ID NO: 3089536 - RNA, 12 nt, Mycobacterium bovis subsp bovis AF2122/97
gcgugcaucgcg

SEQ ID NO: 3089537 - RNA, 16 nt, Mycobacterium bovis subsp bovis AF2122/97
gcgugcaucgcgauuc

SEQ ID NO: 3089538 - RNA, 23 nt, Mycobacterium bovis subsp bovis AF2122/97
gcgugcaucgcgauuccggcggc

SEQ ID NO: 3089539 - RNA, 16 nt, Mycobacterium bovis subsp bovis AF2122/97
gcgugccagcacacgc

SEQ ID NO: 3089540 - RNA, 21 nt, Mycobacterium bovis subsp bovis AF2122/97
gcgugccagcacacgccuacc

SEQ ID NO: 3089541 - RNA, 24 nt, Mycobacterium bovis subsp bovis AF2122/97
gcgugccagcgccccgcgguccug

SEQ ID NO: 3089542 - RNA, 15 nt, Mycobacterium bovis subsp bovis AF2122/97
gcgugcccaguacgu

SEQ ID NO: 3089543 - RNA, 13 nt, Mycobacterium bovis subsp bovis AF2122/97
gcgugcccgccac

SEQ ID NO: 3089544 - RNA, 17 nt, Mycobacterium bovis subsp bovis AF2122/97
gcgugccgaacagggag

SEQ ID NO: 3089545 - RNA, 15 nt, Mycobacterium bovis subsp bovis AF2122/97
gcgugccgaccagca

SEQ ID NO: 3089546 - RNA, 18 nt, Mycobacterium bovis subsp bovis AF2122/97
gcgugccgaccagcaucu

SEQ ID NO: 3089547 - RNA, 13 nt, Mycobacterium bovis subsp bovis AF2122/97
gcgugccgcagcg

SEQ ID NO: 3089548 - RNA, 13 nt, Mycobacterium bovis subsp bovis AF2122/97
gcgugccgccgca

SEQ ID NO: 3089549 - RNA, 19 nt, Mycobacterium bovis subsp bovis AF2122/97
gcgugccggcagcgguggc

SEQ ID NO: 3089550 - RNA, 23 nt, Mycobacterium bovis subsp bovis AF2122/97
gcgugccggggauaucacgacgc

SEQ ID NO: 3089551 - RNA, 22 nt, Mycobacterium bovis subsp bovis AF2122/97
gcgugcgacgauaucgggagcg

SEQ ID NO: 3089552 - RNA, 13 nt, Mycobacterium bovis subsp bovis AF2122/97
gcgugcgaugcag

SEQ ID NO: 3089553 - RNA, 15 nt, Mycobacterium bovis subsp bovis AF2122/97
gcgugcgaugcagcg

SEQ ID NO: 3089554 - RNA, 18 nt, Mycobacterium bovis subsp bovis AF2122/97
gcgugcgaugcagcgcgc

SEQ ID NO: 3089555 - RNA, 19 nt, Mycobacterium bovis subsp bovis AF2122/97
gcgugcgaugcagcgcgcc

SEQ ID NO: 3089556 - RNA, 16 nt, Mycobacterium bovis subsp bovis AF2122/97
gcgugcgauucugcgu

SEQ ID NO: 3089557 - RNA, 21 nt, Mycobacterium bovis subsp bovis AF2122/97
gcgugcgauucugcgucugcu

SEQ ID NO: 3089558 - RNA, 12 nt, Mycobacterium bovis subsp bovis AF2122/97
gcgugcgcacgg

SEQ ID NO: 3089559 - RNA, 18 nt, Mycobacterium bovis subsp bovis AF2122/97
gcgugcgcacggcgccga

SEQ ID NO: 3089560 - RNA, 20 nt, Mycobacterium bovis subsp bovis AF2122/97
gcgugcgcacggcgccgacc

SEQ ID NO: 3089561 - RNA, 13 nt, Mycobacterium bovis subsp bovis AF2122/97
gcgugcgccgggg

SEQ ID NO: 3089562 - RNA, 12 nt, Mycobacterium bovis subsp bovis AF2122/97
gcgugcgcgucg

SEQ ID NO: 3089563 - RNA, 15 nt, Mycobacterium bovis subsp bovis AF2122/97
gcgugcgcgucggug

SEQ ID NO: 3089564 - RNA, 13 nt, Mycobacterium bovis subsp bovis AF2122/97
gcgugcgcuggcu

SEQ ID NO: 3089565 - RNA, 20 nt, Mycobacterium bovis subsp bovis AF2122/97
gcgugcggcgaggacgcgcc

SEQ ID NO: 3089566 - RNA, 13 nt, Mycobacterium bovis subsp bovis AF2122/97
gcgugcggcggcc

SEQ ID NO: 3089567 - RNA, 21 nt, Mycobacterium bovis subsp bovis AF2122/97
gcgugcggcguuaucgucggc

SEQ ID NO: 3089568 - RNA, 23 nt, Mycobacterium bovis subsp bovis AF2122/97
gcgugcggcguuaucgucggcuu

SEQ ID NO: 3089569 - RNA, 13 nt, Mycobacterium bovis subsp bovis AF2122/97
gcgugcggcugcc

SEQ ID NO: 3089570 - RNA, 15 nt, Mycobacterium bovis subsp bovis AF2122/97
gcgugcgggggacgg

SEQ ID NO: 3089571 - RNA, 19 nt, Mycobacterium bovis subsp bovis AF2122/97
gcgugcgggggacgggucg

SEQ ID NO: 3089572 - RNA, 17 nt, Mycobacterium bovis subsp bovis AF2122/97
gcgugcggucgauccgg

SEQ ID NO: 3089573 - RNA, 12 nt, Mycobacterium bovis subsp bovis AF2122/97
gcgugcggucgu

SEQ ID NO: 3089574 - RNA, 15 nt, Mycobacterium bovis subsp bovis AF2122/97
gcgugcgguggcgcg

SEQ ID NO: 3089575 - RNA, 16 nt, Mycobacterium bovis subsp bovis AF2122/97
gcgugcuccugcccga

SEQ ID NO: 3089576 - RNA, 15 nt, Mycobacterium bovis subsp bovis AF2122/97
gcgugcucgacgcgc

SEQ ID NO: 3089577 - RNA, 18 nt, Mycobacterium bovis subsp bovis AF2122/97
gcgugcucgacgcgcauc

SEQ ID NO: 3089578 - RNA, 15 nt, Mycobacterium bovis subsp bovis AF2122/97
gcgugcugccgccuu

SEQ ID NO: 3089579 - RNA, 16 nt, Mycobacterium bovis subsp bovis AF2122/97
gcgugcugcggcuggu

SEQ ID NO: 3089580 - RNA, 13 nt, Mycobacterium bovis subsp bovis AF2122/97
gcgugcugcuagc

SEQ ID NO: 3089581 - RNA, 13 nt, Mycobacterium bovis subsp bovis AF2122/97
gcgugcuggcgca

SEQ ID NO: 3089582 - RNA, 16 nt, Mycobacterium bovis subsp bovis AF2122/97
gcgugcugguaaccaa

SEQ ID NO: 3089583 - RNA, 14 nt, Mycobacterium bovis subsp bovis AF2122/97
gcgugcugugcuca

SEQ ID NO: 3089584 - RNA, 14 nt, Mycobacterium bovis subsp bovis AF2122/97
gcgugcuugaccgc

SEQ ID NO: 3089585 - RNA, 13 nt, Mycobacterium bovis subsp bovis AF2122/97
gcgugcuugagca

SEQ ID NO: 3089586 - RNA, 16 nt, Mycobacterium bovis subsp bovis AF2122/97
gcgugcuugagcacgu

SEQ ID NO: 3089587 - RNA, 15 nt, Mycobacterium bovis subsp bovis AF2122/97
gcgugcuuggcagcg

SEQ ID NO: 3089588 - RNA, 22 nt, Mycobacterium bovis subsp bovis AF2122/97
gcguggaaaccggugguagcga

SEQ ID NO: 3089589 - RNA, 14 nt, Mycobacterium bovis subsp bovis AF2122/97
gcguggacgcccgc

SEQ ID NO: 3089590 - RNA, 15 nt, Mycobacterium bovis subsp bovis AF2122/97
gcguggacgcccgcc

SEQ ID NO: 3089591 - RNA, 17 nt, Mycobacterium bovis subsp bovis AF2122/97
gcguggacgcccgcccg

SEQ ID NO: 3089592 - RNA, 22 nt, Mycobacterium bovis subsp bovis AF2122/97
gcguggacgcccgcccgcacga

SEQ ID NO: 3089593 - RNA, 13 nt, Mycobacterium bovis subsp bovis AF2122/97
gcguggaucgcgc

SEQ ID NO: 3089594 - RNA, 15 nt, Mycobacterium bovis subsp bovis AF2122/97
gcguggaucuuggcc

SEQ ID NO: 3089595 - RNA, 18 nt, Mycobacterium bovis subsp bovis AF2122/97
gcguggaucuuggccagc

SEQ ID NO: 3089596 - RNA, 23 nt, Mycobacterium bovis subsp bovis AF2122/97
gcguggaucuuggccagcagcgc

SEQ ID NO: 3089597 - RNA, 22 nt, Mycobacterium bovis subsp bovis AF2122/97
gcguggcagugcaggcggccgc

SEQ ID NO: 3089598 - RNA, 23 nt, Mycobacterium bovis subsp bovis AF2122/97
gcguggccaacucuucagcaagc

SEQ ID NO: 3089599 - RNA, 13 nt, Mycobacterium bovis subsp bovis AF2122/97
gcguggccccacc

SEQ ID NO: 3089600 - RNA, 16 nt, Mycobacterium bovis subsp bovis AF2122/97
gcguggcccucggcga

SEQ ID NO: 3089601 - RNA, 13 nt, Mycobacterium bovis subsp bovis AF2122/97
gcguggccgccgg

SEQ ID NO: 3089602 - RNA, 14 nt, Mycobacterium bovis subsp bovis AF2122/97
gcguggccgccggc

SEQ ID NO: 3089603 - RNA, 17 nt, Mycobacterium bovis subsp bovis AF2122/97
gcguggccgccggcgcu

SEQ ID NO: 3089604 - RNA, 21 nt, Mycobacterium bovis subsp bovis AF2122/97
gcguggcgaaccaggggucgc

SEQ ID NO: 3089605 - RNA, 14 nt, Mycobacterium bovis subsp bovis AF2122/97
gcguggcgacggga

SEQ ID NO: 3089606 - RNA, 15 nt, Mycobacterium bovis subsp bovis AF2122/97
gcguggcgcaccacc

SEQ ID NO: 3089607 - RNA, 22 nt, Mycobacterium bovis subsp bovis AF2122/97
gcguggcgcccgugccgcccgc

SEQ ID NO: 3089608 - RNA, 13 nt, Mycobacterium bovis subsp bovis AF2122/97
gcguggcgccggc

SEQ ID NO: 3089609 - RNA, 20 nt, Mycobacterium bovis subsp bovis AF2122/97
gcguggcggggccgcgccuu

SEQ ID NO: 3089610 - RNA, 16 nt, Mycobacterium bovis subsp bovis AF2122/97
gcguggcguugguggu

SEQ ID NO: 3089611 - RNA, 15 nt, Mycobacterium bovis subsp bovis AF2122/97
gcguggcugccuucg

SEQ ID NO: 3089612 - RNA, 23 nt, Mycobacterium bovis subsp bovis AF2122/97
gcguggcuggcaccucccgggcg

SEQ ID NO: 3089613 - RNA, 18 nt, Mycobacterium bovis subsp bovis AF2122/97
gcguggcuggcggcgacc

SEQ ID NO: 3089614 - RNA, 20 nt, Mycobacterium bovis subsp bovis AF2122/97
gcguggcuucacccaacccc

SEQ ID NO: 3089615 - RNA, 22 nt, Mycobacterium bovis subsp bovis AF2122/97
gcguggcuugguggucgccacc

SEQ ID NO: 3089616 - RNA, 24 nt, Mycobacterium bovis subsp bovis AF2122/97
gcgugggaagagccgggcucgucg

SEQ ID NO: 3089617 - RNA, 13 nt, Mycobacterium bovis subsp bovis AF2122/97
gcgugggcacuug

SEQ ID NO: 3089618 - RNA, 20 nt, Mycobacterium bovis subsp bovis AF2122/97
gcgugggcauucccgcucgc

SEQ ID NO: 3089619 - RNA, 13 nt, Mycobacterium bovis subsp bovis AF2122/97
gcgugggcgcggc

SEQ ID NO: 3089620 - RNA, 19 nt, Mycobacterium bovis subsp bovis AF2122/97
gcguggggccgccaccagc

SEQ ID NO: 3089621 - RNA, 15 nt, Mycobacterium bovis subsp bovis AF2122/97
gcgugggugucggcg

SEQ ID NO: 3089622 - RNA, 22 nt, Mycobacterium bovis subsp bovis AF2122/97
gcguggguucgaaucccaucgg

SEQ ID NO: 3089623 - RNA, 17 nt, Mycobacterium bovis subsp bovis AF2122/97
gcgugguaaccagggca

SEQ ID NO: 3089624 - RNA, 21 nt, Mycobacterium bovis subsp bovis AF2122/97
gcgugguacuuucacgcucgu

SEQ ID NO: 3089625 - RNA, 15 nt, Mycobacterium bovis subsp bovis AF2122/97
gcguggucgccccga

SEQ ID NO: 3089626 - RNA, 22 nt, Mycobacterium bovis subsp bovis AF2122/97
gcguggucggcaaagcgcucgu

SEQ ID NO: 3089627 - RNA, 23 nt, Mycobacterium bovis subsp bovis AF2122/97
gcguggucggcaaagcgcucgua

SEQ ID NO: 3089628 - RNA, 17 nt, Mycobacterium bovis subsp bovis AF2122/97
gcguggugaagucggug

SEQ ID NO: 3089629 - RNA, 18 nt, Mycobacterium bovis subsp bovis AF2122/97
gcguggugaagucggugc

SEQ ID NO: 3089630 - RNA, 19 nt, Mycobacterium bovis subsp bovis AF2122/97
gcguggugaagucggugcc

SEQ ID NO: 3089631 - RNA, 14 nt, Mycobacterium bovis subsp bovis AF2122/97
gcguggugagcagu

SEQ ID NO: 3089632 - RNA, 20 nt, Mycobacterium bovis subsp bovis AF2122/97
gcguggugauccggucuccg

SEQ ID NO: 3089633 - RNA, 20 nt, Mycobacterium bovis subsp bovis AF2122/97
gcgugguggacgcagaguca

SEQ ID NO: 3089634 - RNA, 15 nt, Mycobacterium bovis subsp bovis AF2122/97
gcgugguguccaccg

SEQ ID NO: 3089635 - RNA, 19 nt, Mycobacterium bovis subsp bovis AF2122/97
gcgugguguccaccgcauc

SEQ ID NO: 3089636 - RNA, 23 nt, Mycobacterium bovis subsp bovis AF2122/97
gcgugguuccggcgugcagcacc

SEQ ID NO: 3089637 - RNA, 15 nt, Mycobacterium bovis subsp bovis AF2122/97
gcguguaaccccagg

SEQ ID NO: 3089638 - RNA, 18 nt, Mycobacterium bovis subsp bovis AF2122/97
gcguguaaccccaggcgc

SEQ ID NO: 3089639 - RNA, 21 nt, Mycobacterium bovis subsp bovis AF2122/97
gcguguaaccccaggcgcugc

SEQ ID NO: 3089640 - RNA, 16 nt, Mycobacterium bovis subsp bovis AF2122/97
gcguguagccugcggc

SEQ ID NO: 3089641 - RNA, 22 nt, Mycobacterium bovis subsp bovis AF2122/97
gcgugucacccaauggagccgc

SEQ ID NO: 3089642 - RNA, 13 nt, Mycobacterium bovis subsp bovis AF2122/97
gcguguccgccga

SEQ ID NO: 3089643 - RNA, 17 nt, Mycobacterium bovis subsp bovis AF2122/97
gcguguccgccgaacug

SEQ ID NO: 3089644 - RNA, 17 nt, Mycobacterium bovis subsp bovis AF2122/97
gcguguccuuugccacc

SEQ ID NO: 3089645 - RNA, 14 nt, Mycobacterium bovis subsp bovis AF2122/97
gcgugucgccgcca

SEQ ID NO: 3089646 - RNA, 15 nt, Mycobacterium bovis subsp bovis AF2122/97
gcgugucggccggcc

SEQ ID NO: 3089647 - RNA, 22 nt, Mycobacterium bovis subsp bovis AF2122/97
gcgugucguugccagggcgggc

SEQ ID NO: 3089648 - RNA, 14 nt, Mycobacterium bovis subsp bovis AF2122/97
gcgugucuggcgaa

SEQ ID NO: 3089649 - RNA, 15 nt, Mycobacterium bovis subsp bovis AF2122/97
gcgugugcgcgugcu

SEQ ID NO: 3089650 - RNA, 16 nt, Mycobacterium bovis subsp bovis AF2122/97
gcguguggagcucgcg

SEQ ID NO: 3089651 - RNA, 14 nt, Mycobacterium bovis subsp bovis AF2122/97
gcguguggcagaug

SEQ ID NO: 3089652 - RNA, 12 nt, Mycobacterium bovis subsp bovis AF2122/97
gcguuacgccgc

SEQ ID NO: 3089653 - RNA, 17 nt, Mycobacterium bovis subsp bovis AF2122/97
gcguuagggccgccauc

SEQ ID NO: 3089654 - RNA, 16 nt, Mycobacterium bovis subsp bovis AF2122/97
gcguucaacaccgccg

SEQ ID NO: 3089655 - RNA, 19 nt, Mycobacterium bovis subsp bovis AF2122/97
gcguucaaggucuccagac

SEQ ID NO: 3089656 - RNA, 18 nt, Mycobacterium bovis subsp bovis AF2122/97
gcguucaccugcgucggc

SEQ ID NO: 3089657 - RNA, 16 nt, Mycobacterium bovis subsp bovis AF2122/97
gcguucagcggccagc

SEQ ID NO: 3089658 - RNA, 18 nt, Mycobacterium bovis subsp bovis AF2122/97
gcguuccaacucgguucg

SEQ ID NO: 3089659 - RNA, 16 nt, Mycobacterium bovis subsp bovis AF2122/97
gcguuccagcacaccc

SEQ ID NO: 3089660 - RNA, 17 nt, Mycobacterium bovis subsp bovis AF2122/97
gcguuccagcacaccca

SEQ ID NO: 3089661 - RNA, 16 nt, Mycobacterium bovis subsp bovis AF2122/97
gcguuccaucagggcc

SEQ ID NO: 3089662 - RNA, 14 nt, Mycobacterium bovis subsp bovis AF2122/97
gcguucccccacuc

SEQ ID NO: 3089663 - RNA, 14 nt, Mycobacterium bovis subsp bovis AF2122/97
gcguucccgccauu

SEQ ID NO: 3089664 - RNA, 23 nt, Mycobacterium bovis subsp bovis AF2122/97
gcguucccgccauugccgccguc

SEQ ID NO: 3089665 - RNA, 14 nt, Mycobacterium bovis subsp bovis AF2122/97
gcguucccgccggc

SEQ ID NO: 3089666 - RNA, 21 nt, Mycobacterium bovis subsp bovis AF2122/97
gcguucccgccggcuccgcca

SEQ ID NO: 3089667 - RNA, 14 nt, Mycobacterium bovis subsp bovis AF2122/97
gcguucccgcucgg

SEQ ID NO: 3089668 - RNA, 20 nt, Mycobacterium bovis subsp bovis AF2122/97
gcguuccgaucggcaaucga

SEQ ID NO: 3089669 - RNA, 15 nt, Mycobacterium bovis subsp bovis AF2122/97
gcguuccggacggga

SEQ ID NO: 3089670 - RNA, 20 nt, Mycobacterium bovis subsp bovis AF2122/97
gcguuccgggccgaucaccc

SEQ ID NO: 3089671 - RNA, 16 nt, Mycobacterium bovis subsp bovis AF2122/97
gcguuccuccagcagc

SEQ ID NO: 3089672 - RNA, 17 nt, Mycobacterium bovis subsp bovis AF2122/97
gcguuccuccagcagcg

SEQ ID NO: 3089673 - RNA, 21 nt, Mycobacterium bovis subsp bovis AF2122/97
gcguuccuccagcagcgacgg

SEQ ID NO: 3089674 - RNA, 23 nt, Mycobacterium bovis subsp bovis AF2122/97
gcguuccugaucgagcgccagcg

SEQ ID NO: 3089675 - RNA, 13 nt, Mycobacterium bovis subsp bovis AF2122/97
gcguucgaccucg

SEQ ID NO: 3089676 - RNA, 15 nt, Mycobacterium bovis subsp bovis AF2122/97
gcguucgaccucgac

SEQ ID NO: 3089677 - RNA, 20 nt, Mycobacterium bovis subsp bovis AF2122/97
gcguucgacucgaccgcgac

SEQ ID NO: 3089678 - RNA, 23 nt, Mycobacterium bovis subsp bovis AF2122/97
gcguucgagagccccgaccagca

SEQ ID NO: 3089679 - RNA, 18 nt, Mycobacterium bovis subsp bovis AF2122/97
gcguucgagugcggucga

SEQ ID NO: 3089680 - RNA, 14 nt, Mycobacterium bovis subsp bovis AF2122/97
gcguucgaugccac

SEQ ID NO: 3089681 - RNA, 13 nt, Mycobacterium bovis subsp bovis AF2122/97
gcguucgccgccc

SEQ ID NO: 3089682 - RNA, 23 nt, Mycobacterium bovis subsp bovis AF2122/97
gcguucgccggaauacaccagcg

SEQ ID NO: 3089683 - RNA, 22 nt, Mycobacterium bovis subsp bovis AF2122/97
gcguucggccgacucggucuca

SEQ ID NO: 3089684 - RNA, 15 nt, Mycobacterium bovis subsp bovis AF2122/97
gcguucggccgggcc

SEQ ID NO: 3089685 - RNA, 15 nt, Mycobacterium bovis subsp bovis AF2122/97
gcguucggcgagcag

SEQ ID NO: 3089686 - RNA, 17 nt, Mycobacterium bovis subsp bovis AF2122/97
gcguucggcgagcagcg

SEQ ID NO: 3089687 - RNA, 22 nt, Mycobacterium bovis subsp bovis AF2122/97
gcguucggcgagcaucucgaca

SEQ ID NO: 3089688 - RNA, 18 nt, Mycobacterium bovis subsp bovis AF2122/97
gcguucggucagugggac

SEQ ID NO: 3089689 - RNA, 17 nt, Mycobacterium bovis subsp bovis AF2122/97
gcguucuccggcaccgg

SEQ ID NO: 3089690 - RNA, 18 nt, Mycobacterium bovis subsp bovis AF2122/97
gcguucuccggcaccggu

SEQ ID NO: 3089691 - RNA, 21 nt, Mycobacterium bovis subsp bovis AF2122/97
gcguucucgauugucgccgcg

SEQ ID NO: 3089692 - RNA, 22 nt, Mycobacterium bovis subsp bovis AF2122/97
gcguucucgauugucgccgcgc

SEQ ID NO: 3089693 - RNA, 14 nt, Mycobacterium bovis subsp bovis AF2122/97
gcguucugcgcccg

SEQ ID NO: 3089694 - RNA, 16 nt, Mycobacterium bovis subsp bovis AF2122/97
gcguugaacugugcgg

SEQ ID NO: 3089695 - RNA, 13 nt, Mycobacterium bovis subsp bovis AF2122/97
gcguugaccgcau

SEQ ID NO: 3089696 - RNA, 14 nt, Mycobacterium bovis subsp bovis AF2122/97
gcguugaccgcggu

SEQ ID NO: 3089697 - RNA, 18 nt, Mycobacterium bovis subsp bovis AF2122/97
gcguugaccgcggucugc

SEQ ID NO: 3089698 - RNA, 18 nt, Mycobacterium bovis subsp bovis AF2122/97
gcguugacggcggggcgg

SEQ ID NO: 3089699 - RNA, 22 nt, Mycobacterium bovis subsp bovis AF2122/97
gcguugacggcuucggcagccg

SEQ ID NO: 3089700 - RNA, 16 nt, Mycobacterium bovis subsp bovis AF2122/97
gcguugacggucagcc

SEQ ID NO: 3089701 - RNA, 19 nt, Mycobacterium bovis subsp bovis AF2122/97
gcguugacgucgagcagcg

SEQ ID NO: 3089702 - RNA, 20 nt, Mycobacterium bovis subsp bovis AF2122/97
gcguugacgucgagcagcgc

SEQ ID NO: 3089703 - RNA, 15 nt, Mycobacterium bovis subsp bovis AF2122/97
gcguugacucugcgu

SEQ ID NO: 3089704 - RNA, 14 nt, Mycobacterium bovis subsp bovis AF2122/97
gcguugagcgcagc

SEQ ID NO: 3089705 - RNA, 15 nt, Mycobacterium bovis subsp bovis AF2122/97
gcguugaugaccagg

SEQ ID NO: 3089706 - RNA, 14 nt, Mycobacterium bovis subsp bovis AF2122/97
gcguugcacagcag

SEQ ID NO: 3089707 - RNA, 15 nt, Mycobacterium bovis subsp bovis AF2122/97
gcguugcacagcagc

SEQ ID NO: 3089708 - RNA, 21 nt, Mycobacterium bovis subsp bovis AF2122/97
gcguugcacagcagcgguuga

SEQ ID NO: 3089709 - RNA, 17 nt, Mycobacterium bovis subsp bovis AF2122/97
gcguugcaccauucgca

SEQ ID NO: 3089710 - RNA, 19 nt, Mycobacterium bovis subsp bovis AF2122/97
gcguugcagaccaccagug

SEQ ID NO: 3089711 - RNA, 21 nt, Mycobacterium bovis subsp bovis AF2122/97
gcguugcaggaaaguggccga

SEQ ID NO: 3089712 - RNA, 16 nt, Mycobacterium bovis subsp bovis AF2122/97
gcguugcaucagcacg

SEQ ID NO: 3089713 - RNA, 22 nt, Mycobacterium bovis subsp bovis AF2122/97
gcguugccaagauccuugauca

SEQ ID NO: 3089714 - RNA, 17 nt, Mycobacterium bovis subsp bovis AF2122/97
gcguugccgaaacccga

SEQ ID NO: 3089715 - RNA, 19 nt, Mycobacterium bovis subsp bovis AF2122/97
gcguugccgaaacccgagu

SEQ ID NO: 3089716 - RNA, 13 nt, Mycobacterium bovis subsp bovis AF2122/97
gcguugccgccgu

SEQ ID NO: 3089717 - RNA, 17 nt, Mycobacterium bovis subsp bovis AF2122/97
gcguugccgccguugcc

SEQ ID NO: 3089718 - RNA, 22 nt, Mycobacterium bovis subsp bovis AF2122/97
gcguugcggaaucagcacccca

SEQ ID NO: 3089719 - RNA, 17 nt, Mycobacterium bovis subsp bovis AF2122/97
gcguugcggcaacagcg

SEQ ID NO: 3089720 - RNA, 17 nt, Mycobacterium bovis subsp bovis AF2122/97
gcguugcugaugucgcc

SEQ ID NO: 3089721 - RNA, 17 nt, Mycobacterium bovis subsp bovis AF2122/97
gcguugcugcagcagcg

SEQ ID NO: 3089722 - RNA, 17 nt, Mycobacterium bovis subsp bovis AF2122/97
gcguugcuggucgccgu

SEQ ID NO: 3089723 - RNA, 20 nt, Mycobacterium bovis subsp bovis AF2122/97
gcguugcuggucgccgucga

SEQ ID NO: 3089724 - RNA, 19 nt, Mycobacterium bovis subsp bovis AF2122/97
gcguuggacaauucgacga

SEQ ID NO: 3089725 - RNA, 15 nt, Mycobacterium bovis subsp bovis AF2122/97
gcguuggaucccagc

SEQ ID NO: 3089726 - RNA, 18 nt, Mycobacterium bovis subsp bovis AF2122/97
gcguuggaucccagcccg

SEQ ID NO: 3089727 - RNA, 16 nt, Mycobacterium bovis subsp bovis AF2122/97
gcguuggcgacgaaga

SEQ ID NO: 3089728 - RNA, 17 nt, Mycobacterium bovis subsp bovis AF2122/97
gcguuggcgaucucgac

SEQ ID NO: 3089729 - RNA, 16 nt, Mycobacterium bovis subsp bovis AF2122/97
gcguuggcgccaccag

SEQ ID NO: 3089730 - RNA, 15 nt, Mycobacterium bovis subsp bovis AF2122/97
gcguuggcggcaagg

SEQ ID NO: 3089731 - RNA, 19 nt, Mycobacterium bovis subsp bovis AF2122/97
gcguuggcggcaagggugg

SEQ ID NO: 3089732 - RNA, 12 nt, Mycobacterium bovis subsp bovis AF2122/97
gcguuggcggcg

SEQ ID NO: 3089733 - RNA, 17 nt, Mycobacterium bovis subsp bovis AF2122/97
gcguuggcgggcugaaa

SEQ ID NO: 3089734 - RNA, 15 nt, Mycobacterium bovis subsp bovis AF2122/97
gcguugggaccagug

SEQ ID NO: 3089735 - RNA, 19 nt, Mycobacterium bovis subsp bovis AF2122/97
gcguugggaccagugcggu

SEQ ID NO: 3089736 - RNA, 16 nt, Mycobacterium bovis subsp bovis AF2122/97
gcguugggaucgcgca

SEQ ID NO: 3089737 - RNA, 19 nt, Mycobacterium bovis subsp bovis AF2122/97
gcguugggcagcuccacca

SEQ ID NO: 3089738 - RNA, 21 nt, Mycobacterium bovis subsp bovis AF2122/97
gcguugggcgggauggccgcc

SEQ ID NO: 3089739 - RNA, 22 nt, Mycobacterium bovis subsp bovis AF2122/97
gcguugggcgggauggccgccg

SEQ ID NO: 3089740 - RNA, 14 nt, Mycobacterium bovis subsp bovis AF2122/97
gcguuggggcucgu

SEQ ID NO: 3089741 - RNA, 22 nt, Mycobacterium bovis subsp bovis AF2122/97
gcguugggguuggcauguggac

SEQ ID NO: 3089742 - RNA, 16 nt, Mycobacterium bovis subsp bovis AF2122/97
gcguugguagccaggg

SEQ ID NO: 3089743 - RNA, 18 nt, Mycobacterium bovis subsp bovis AF2122/97
gcguugguggucugccaa

SEQ ID NO: 3089744 - RNA, 18 nt, Mycobacterium bovis subsp bovis AF2122/97
gcguuguagcgguccagc

SEQ ID NO: 3089745 - RNA, 22 nt, Mycobacterium bovis subsp bovis AF2122/97
gcguuguaguccugcgggccgu

SEQ ID NO: 3089746 - RNA, 12 nt, Mycobacterium bovis subsp bovis AF2122/97
gcguuguccacc

SEQ ID NO: 3089747 - RNA, 14 nt, Mycobacterium bovis subsp bovis AF2122/97
gcguuguccaccau

SEQ ID NO: 3089748 - RNA, 16 nt, Mycobacterium bovis subsp bovis AF2122/97
gcguugucgacgaagg

SEQ ID NO: 3089749 - RNA, 14 nt, Mycobacterium bovis subsp bovis AF2122/97
gcguugucgcccac

SEQ ID NO: 3089750 - RNA, 19 nt, Mycobacterium bovis subsp bovis AF2122/97
gcguugucggguggcugcu

SEQ ID NO: 3089751 - RNA, 16 nt, Mycobacterium bovis subsp bovis AF2122/97
gcguugugaccgccga

SEQ ID NO: 3089752 - RNA, 16 nt, Mycobacterium bovis subsp bovis AF2122/97
gcguugugcccgccgg

SEQ ID NO: 3089753 - RNA, 17 nt, Mycobacterium bovis subsp bovis AF2122/97
gcguugugcccgccggc

SEQ ID NO: 3089754 - RNA, 13 nt, Mycobacterium bovis subsp bovis AF2122/97
gcguuguggcuga

SEQ ID NO: 3089755 - RNA, 22 nt, Mycobacterium bovis subsp bovis AF2122/97
gcguuguguuccguugcgucgc

SEQ ID NO: 3089756 - RNA, 20 nt, Mycobacterium bovis subsp bovis AF2122/97
gcguuuauaccucgccgccc

SEQ ID NO: 3089757 - RNA, 22 nt, Mycobacterium bovis subsp bovis AF2122/97
gcguuuauaccucgccgcccug

SEQ ID NO: 3089758 - RNA, 16 nt, Mycobacterium bovis subsp bovis AF2122/97
gcguuucacgaaaccc

SEQ ID NO: 3089759 - RNA, 17 nt, Mycobacterium bovis subsp bovis AF2122/97
gcguuucgucgaccgcg

SEQ ID NO: 3089760 - RNA, 15 nt, Mycobacterium bovis subsp bovis AF2122/97
gcguuugaggcagcg

SEQ ID NO: 3089761 - RNA, 13 nt, Mycobacterium bovis subsp bovis AF2122/97
gcguuugaugcgg

SEQ ID NO: 3089762 - RNA, 22 nt, Mycobacterium bovis subsp bovis AF2122/97
gcguuugcacuguucgcgguga

SEQ ID NO: 3089763 - RNA, 15 nt, Mycobacterium bovis subsp bovis AF2122/97
gcguuuggacgggcg

SEQ ID NO: 3089764 - RNA, 15 nt, Mycobacterium bovis subsp bovis AF2122/97
gcguuuggcagagcc

SEQ ID NO: 3089765 - RNA, 21 nt, Mycobacterium bovis subsp bovis AF2122/97
gcguuuucaauuucacugcga

SEQ ID NO: 3089766 - RNA, 20 nt, Mycobacterium bovis subsp bovis AF2122/97
gcguuuuccgggcuguucgc

SEQ ID NO: 3089767 - RNA, 17 nt, Mycobacterium bovis subsp bovis AF2122/97
gcuaaaaaccgcugccg

SEQ ID NO: 3089768 - RNA, 20 nt, Mycobacterium bovis subsp bovis AF2122/97
gcuaaacuccgugccgagcg

SEQ ID NO: 3089769 - RNA, 12 nt, Mycobacterium bovis subsp bovis AF2122/97
gcuaacacccga

SEQ ID NO: 3089770 - RNA, 20 nt, Mycobacterium bovis subsp bovis AF2122/97
gcuaacacccgagcaacggc

SEQ ID NO: 3089771 - RNA, 15 nt, Mycobacterium bovis subsp bovis AF2122/97
gcuaacaccgcaggc

SEQ ID NO: 3089772 - RNA, 21 nt, Mycobacterium bovis subsp bovis AF2122/97
gcuaaccacggugugcuacca

SEQ ID NO: 3089773 - RNA, 17 nt, Mycobacterium bovis subsp bovis AF2122/97
gcuaaccgacgcugaag

SEQ ID NO: 3089774 - RNA, 22 nt, Mycobacterium bovis subsp bovis AF2122/97
gcuaacgaagccagaucagccg

SEQ ID NO: 3089775 - RNA, 14 nt, Mycobacterium bovis subsp bovis AF2122/97
gcuaacgcaccugc

SEQ ID NO: 3089776 - RNA, 16 nt, Mycobacterium bovis subsp bovis AF2122/97
gcuaacgucgaucucg

SEQ ID NO: 3089777 - RNA, 22 nt, Mycobacterium bovis subsp bovis AF2122/97
gcuaacuggacuggggcgccac

SEQ ID NO: 3089778 - RNA, 15 nt, Mycobacterium bovis subsp bovis AF2122/97
gcuaacuggcccgga

SEQ ID NO: 3089779 - RNA, 16 nt, Mycobacterium bovis subsp bovis AF2122/97
gcuaauaccugcggau

SEQ ID NO: 3089780 - RNA, 15 nt, Mycobacterium bovis subsp bovis AF2122/97
gcuaauagcucgccg

SEQ ID NO: 3089781 - RNA, 20 nt, Mycobacterium bovis subsp bovis AF2122/97
gcuaauccagcagcaccgac

SEQ ID NO: 3089782 - RNA, 17 nt, Mycobacterium bovis subsp bovis AF2122/97
gcuaauugcggccgccg

SEQ ID NO: 3089783 - RNA, 20 nt, Mycobacterium bovis subsp bovis AF2122/97
gcuacacccguagaccuucg

SEQ ID NO: 3089784 - RNA, 23 nt, Mycobacterium bovis subsp bovis AF2122/97
gcuacaucagaaucaggcucgcc

SEQ ID NO: 3089785 - RNA, 16 nt, Mycobacterium bovis subsp bovis AF2122/97
gcuacaucggcggcgu

SEQ ID NO: 3089786 - RNA, 18 nt, Mycobacterium bovis subsp bovis AF2122/97
gcuacaucggcggcgucg

SEQ ID NO: 3089787 - RNA, 23 nt, Mycobacterium bovis subsp bovis AF2122/97
gcuacaucggcggcgucgacguc

SEQ ID NO: 3089788 - RNA, 21 nt, Mycobacterium bovis subsp bovis AF2122/97
gcuaccaacgcaacacgggcg

SEQ ID NO: 3089789 - RNA, 16 nt, Mycobacterium bovis subsp bovis AF2122/97
gcuaccagagccgcga

SEQ ID NO: 3089790 - RNA, 15 nt, Mycobacterium bovis subsp bovis AF2122/97
gcuaccagcucacgg

SEQ ID NO: 3089791 - RNA, 17 nt, Mycobacterium bovis subsp bovis AF2122/97
gcuaccagcucacggcg

SEQ ID NO: 3089792 - RNA, 20 nt, Mycobacterium bovis subsp bovis AF2122/97
gcuacccaccggccggugcc

SEQ ID NO: 3089793 - RNA, 23 nt, Mycobacterium bovis subsp bovis AF2122/97
gcuacccauggcccguuggcagc

SEQ ID NO: 3089794 - RNA, 17 nt, Mycobacterium bovis subsp bovis AF2122/97
gcuacccauucggcggc

SEQ ID NO: 3089795 - RNA, 18 nt, Mycobacterium bovis subsp bovis AF2122/97
gcuacccauucggcggcg

SEQ ID NO: 3089796 - RNA, 23 nt, Mycobacterium bovis subsp bovis AF2122/97
gcuacccauucggcggcgguggc

SEQ ID NO: 3089797 - RNA, 20 nt, Mycobacterium bovis subsp bovis AF2122/97
gcuacccccgauggcgucgc

SEQ ID NO: 3089798 - RNA, 16 nt, Mycobacterium bovis subsp bovis AF2122/97
gcuaccccgacggcga

SEQ ID NO: 3089799 - RNA, 17 nt, Mycobacterium bovis subsp bovis AF2122/97
gcuaccccgcagaaucc

SEQ ID NO: 3089800 - RNA, 18 nt, Mycobacterium bovis subsp bovis AF2122/97
gcuacccgagccggcacg

SEQ ID NO: 3089801 - RNA, 22 nt, Mycobacterium bovis subsp bovis AF2122/97
gcuacccggacagggcggcgag

SEQ ID NO: 3089802 - RNA, 12 nt, Mycobacterium bovis subsp bovis AF2122/97
gcuacccgggcc

SEQ ID NO: 3089803 - RNA, 16 nt, Mycobacterium bovis subsp bovis AF2122/97
gcuacccgggccaggc

SEQ ID NO: 3089804 - RNA, 18 nt, Mycobacterium bovis subsp bovis AF2122/97
gcuaccgcaggugccacc

SEQ ID NO: 3089805 - RNA, 19 nt, Mycobacterium bovis subsp bovis AF2122/97
gcuaccgcaggugccaccu

SEQ ID NO: 3089806 - RNA, 15 nt, Mycobacterium bovis subsp bovis AF2122/97
gcuaccgcccgcgcc

SEQ ID NO: 3089807 - RNA, 16 nt, Mycobacterium bovis subsp bovis AF2122/97
gcuaccgcccgcgcca

SEQ ID NO: 3089808 - RNA, 18 nt, Mycobacterium bovis subsp bovis AF2122/97
gcuaccgcccgcgccacc

SEQ ID NO: 3089809 - RNA, 12 nt, Mycobacterium bovis subsp bovis AF2122/97
gcuaccgccgac

SEQ ID NO: 3089810 - RNA, 19 nt, Mycobacterium bovis subsp bovis AF2122/97
gcuaccgccgaccggaccg

SEQ ID NO: 3089811 - RNA, 13 nt, Mycobacterium bovis subsp bovis AF2122/97
gcuaccgccgggg

SEQ ID NO: 3089812 - RNA, 13 nt, Mycobacterium bovis subsp bovis AF2122/97
gcuaccgcgcucc

SEQ ID NO: 3089813 - RNA, 17 nt, Mycobacterium bovis subsp bovis AF2122/97
gcuaccgcgcucccggc

SEQ ID NO: 3089814 - RNA, 19 nt, Mycobacterium bovis subsp bovis AF2122/97
gcuaccgcgcucccggcgu

SEQ ID NO: 3089815 - RNA, 16 nt, Mycobacterium bovis subsp bovis AF2122/97
gcuaccggcagcugcu

SEQ ID NO: 3089816 - RNA, 13 nt, Mycobacterium bovis subsp bovis AF2122/97
gcuaccggcgccg

SEQ ID NO: 3089817 - RNA, 20 nt, Mycobacterium bovis subsp bovis AF2122/97
gcuaccggcgccgcgcggcu

SEQ ID NO: 3089818 - RNA, 23 nt, Mycobacterium bovis subsp bovis AF2122/97
gcuaccggcgugucacgucgcag

SEQ ID NO: 3089819 - RNA, 21 nt, Mycobacterium bovis subsp bovis AF2122/97
gcuaccggcuuggcgggaccg

SEQ ID NO: 3089820 - RNA, 17 nt, Mycobacterium bovis subsp bovis AF2122/97
gcuaccuaacccgcgcc

SEQ ID NO: 3089821 - RNA, 20 nt, Mycobacterium bovis subsp bovis AF2122/97
gcuaccuaacccgcgccggc

SEQ ID NO: 3089822 - RNA, 16 nt, Mycobacterium bovis subsp bovis AF2122/97
gcuaccuccgccacca

SEQ ID NO: 3089823 - RNA, 13 nt, Mycobacterium bovis subsp bovis AF2122/97
gcuaccuuggacu

SEQ ID NO: 3089824 - RNA, 22 nt, Mycobacterium bovis subsp bovis AF2122/97
gcuacgacgagugguccggcgg

SEQ ID NO: 3089825 - RNA, 14 nt, Mycobacterium bovis subsp bovis AF2122/97
gcuacgacggcgcc

SEQ ID NO: 3089826 - RNA, 13 nt, Mycobacterium bovis subsp bovis AF2122/97
gcuacgacggucc

SEQ ID NO: 3089827 - RNA, 21 nt, Mycobacterium bovis subsp bovis AF2122/97
gcuacgcaacgggucgggucc

SEQ ID NO: 3089828 - RNA, 13 nt, Mycobacterium bovis subsp bovis AF2122/97
gcuacgccccacu

SEQ ID NO: 3089829 - RNA, 15 nt, Mycobacterium bovis subsp bovis AF2122/97
gcuacgccuccuucg

SEQ ID NO: 3089830 - RNA, 13 nt, Mycobacterium bovis subsp bovis AF2122/97
gcuacgcgaucag

SEQ ID NO: 3089831 - RNA, 14 nt, Mycobacterium bovis subsp bovis AF2122/97
gcuacgcgcgcccg

SEQ ID NO: 3089832 - RNA, 15 nt, Mycobacterium bovis subsp bovis AF2122/97
gcuacgcgcgcccga

SEQ ID NO: 3089833 - RNA, 20 nt, Mycobacterium bovis subsp bovis AF2122/97
gcuacgcgcgcucgcucacc

SEQ ID NO: 3089834 - RNA, 21 nt, Mycobacterium bovis subsp bovis AF2122/97
gcuacgcgcgcucgcucaccg

SEQ ID NO: 3089835 - RNA, 16 nt, Mycobacterium bovis subsp bovis AF2122/97
gcuacggcgacacgcc

SEQ ID NO: 3089836 - RNA, 18 nt, Mycobacterium bovis subsp bovis AF2122/97
gcuacggcgacacgccag

SEQ ID NO: 3089837 - RNA, 21 nt, Mycobacterium bovis subsp bovis AF2122/97
gcuacggcgacacgccagccg

SEQ ID NO: 3089838 - RNA, 15 nt, Mycobacterium bovis subsp bovis AF2122/97
gcuacgggccgcggu

SEQ ID NO: 3089839 - RNA, 22 nt, Mycobacterium bovis subsp bovis AF2122/97
gcuacgggccgcgguacccacc

SEQ ID NO: 3089840 - RNA, 22 nt, Mycobacterium bovis subsp bovis AF2122/97
gcuacggggcggucgagccacc

SEQ ID NO: 3089841 - RNA, 17 nt, Mycobacterium bovis subsp bovis AF2122/97
gcuacgucaagccgugc

SEQ ID NO: 3089842 - RNA, 14 nt, Mycobacterium bovis subsp bovis AF2122/97
gcuacgucggcucg

SEQ ID NO: 3089843 - RNA, 18 nt, Mycobacterium bovis subsp bovis AF2122/97
gcuacgucggcucgucgc

SEQ ID NO: 3089844 - RNA, 22 nt, Mycobacterium bovis subsp bovis AF2122/97
gcuacgucggcucgucgcucga

SEQ ID NO: 3089845 - RNA, 13 nt, Mycobacterium bovis subsp bovis AF2122/97
gcuacuaugccaa

SEQ ID NO: 3089846 - RNA, 17 nt, Mycobacterium bovis subsp bovis AF2122/97
gcuacucacggugaucg

SEQ ID NO: 3089847 - RNA, 18 nt, Mycobacterium bovis subsp bovis AF2122/97
gcuacucgaaacccaugu

SEQ ID NO: 3089848 - RNA, 13 nt, Mycobacterium bovis subsp bovis AF2122/97
gcuacugcgacca

SEQ ID NO: 3089849 - RNA, 19 nt, Mycobacterium bovis subsp bovis AF2122/97
gcuagacccgucaccgccg

SEQ ID NO: 3089850 - RNA, 21 nt, Mycobacterium bovis subsp bovis AF2122/97
gcuagacccgucaccgccgac

SEQ ID NO: 3089851 - RNA, 19 nt, Mycobacterium bovis subsp bovis AF2122/97
gcuagccagggaucagccg

SEQ ID NO: 3089852 - RNA, 15 nt, Mycobacterium bovis subsp bovis AF2122/97
gcuagccagucggcc

SEQ ID NO: 3089853 - RNA, 20 nt, Mycobacterium bovis subsp bovis AF2122/97
gcuagccgggcgcgccggcc

SEQ ID NO: 3089854 - RNA, 21 nt, Mycobacterium bovis subsp bovis AF2122/97
gcuagccgggcgcgccggcca

SEQ ID NO: 3089855 - RNA, 18 nt, Mycobacterium bovis subsp bovis AF2122/97
gcuagccguucggcugcc

SEQ ID NO: 3089856 - RNA, 18 nt, Mycobacterium bovis subsp bovis AF2122/97
gcuagcgcccgcgagaga

SEQ ID NO: 3089857 - RNA, 18 nt, Mycobacterium bovis subsp bovis AF2122/97
gcuagcgcuugcgacccc

SEQ ID NO: 3089858 - RNA, 20 nt, Mycobacterium bovis subsp bovis AF2122/97
gcuagcgcuugcgaccccgg

SEQ ID NO: 3089859 - RNA, 21 nt, Mycobacterium bovis subsp bovis AF2122/97
gcuagcgcuugcgaccccggc

SEQ ID NO: 3089860 - RNA, 17 nt, Mycobacterium bovis subsp bovis AF2122/97
gcuagcuuggcggccag

SEQ ID NO: 3089861 - RNA, 19 nt, Mycobacterium bovis subsp bovis AF2122/97
gcuagcuuggcggccagcg

SEQ ID NO: 3089862 - RNA, 13 nt, Mycobacterium bovis subsp bovis AF2122/97
gcuaggaccacca

SEQ ID NO: 3089863 - RNA, 16 nt, Mycobacterium bovis subsp bovis AF2122/97
gcuaggaccaccagcg

SEQ ID NO: 3089864 - RNA, 15 nt, Mycobacterium bovis subsp bovis AF2122/97
gcuaggaccgcggug

SEQ ID NO: 3089865 - RNA, 21 nt, Mycobacterium bovis subsp bovis AF2122/97
gcuaggacggcugccgucagc

SEQ ID NO: 3089866 - RNA, 23 nt, Mycobacterium bovis subsp bovis AF2122/97
gcuaggacggcugccgucagccg

SEQ ID NO: 3089867 - RNA, 17 nt, Mycobacterium bovis subsp bovis AF2122/97
gcuaggagaucagcacc

SEQ ID NO: 3089868 - RNA, 17 nt, Mycobacterium bovis subsp bovis AF2122/97
gcuaggccaccggcgac

SEQ ID NO: 3089869 - RNA, 12 nt, Mycobacterium bovis subsp bovis AF2122/97
gcuagggcagca

SEQ ID NO: 3089870 - RNA, 17 nt, Mycobacterium bovis subsp bovis AF2122/97
gcuagggcagcagcccg

SEQ ID NO: 3089871 - RNA, 16 nt, Mycobacterium bovis subsp bovis AF2122/97
gcuagggcccuggcgg

SEQ ID NO: 3089872 - RNA, 17 nt, Mycobacterium bovis subsp bovis AF2122/97
gcuagguaccguucgau

SEQ ID NO: 3089873 - RNA, 18 nt, Mycobacterium bovis subsp bovis AF2122/97
gcuagguauugccgcaga

SEQ ID NO: 3089874 - RNA, 21 nt, Mycobacterium bovis subsp bovis AF2122/97
gcuaggucaguucccagacca

SEQ ID NO: 3089875 - RNA, 21 nt, Mycobacterium bovis subsp bovis AF2122/97
gcuagguccgaacuugacgaa

SEQ ID NO: 3089876 - RNA, 17 nt, Mycobacterium bovis subsp bovis AF2122/97
gcuaggugacgccgcca

SEQ ID NO: 3089877 - RNA, 22 nt, Mycobacterium bovis subsp bovis AF2122/97
gcuagugcaaaauugcuuggcc

SEQ ID NO: 3089878 - RNA, 19 nt, Mycobacterium bovis subsp bovis AF2122/97
gcuagugcgggccgugacc

SEQ ID NO: 3089879 - RNA, 19 nt, Mycobacterium bovis subsp bovis AF2122/97
gcuagugugaccgucagcc

SEQ ID NO: 3089880 - RNA, 14 nt, Mycobacterium bovis subsp bovis AF2122/97
gcuaucaugaccac

SEQ ID NO: 3089881 - RNA, 17 nt, Mycobacterium bovis subsp bovis AF2122/97
gcuaucaugaccaccga

SEQ ID NO: 3089882 - RNA, 16 nt, Mycobacterium bovis subsp bovis AF2122/97
gcuaucccaggggcac

SEQ ID NO: 3089883 - RNA, 19 nt, Mycobacterium bovis subsp bovis AF2122/97
gcuauccgcgggaaguucg

SEQ ID NO: 3089884 - RNA, 14 nt, Mycobacterium bovis subsp bovis AF2122/97
gcuaucgcagaacg

SEQ ID NO: 3089885 - RNA, 18 nt, Mycobacterium bovis subsp bovis AF2122/97
gcuaucgguucagcugcg

SEQ ID NO: 3089886 - RNA, 15 nt, Mycobacterium bovis subsp bovis AF2122/97
gcuaucgugcgccga

SEQ ID NO: 3089887 - RNA, 18 nt, Mycobacterium bovis subsp bovis AF2122/97
gcuaucguggcggcgucg

SEQ ID NO: 3089888 - RNA, 16 nt, Mycobacterium bovis subsp bovis AF2122/97
gcuaugaugccgccgg

SEQ ID NO: 3089889 - RNA, 23 nt, Mycobacterium bovis subsp bovis AF2122/97
gcuaugcgccgcaugccaccgag

SEQ ID NO: 3089890 - RNA, 20 nt, Mycobacterium bovis subsp bovis AF2122/97
gcuaugcuggcgcagcgcca

SEQ ID NO: 3089891 - RNA, 22 nt, Mycobacterium bovis subsp bovis AF2122/97
gcuauggcauuaccacuucggc

SEQ ID NO: 3089892 - RNA, 16 nt, Mycobacterium bovis subsp bovis AF2122/97
gcuauggcgccgcggc

SEQ ID NO: 3089893 - RNA, 20 nt, Mycobacterium bovis subsp bovis AF2122/97
gcuaugucauagcgcaccac

SEQ ID NO: 3089894 - RNA, 14 nt, Mycobacterium bovis subsp bovis AF2122/97
gcuauuccgcggca

SEQ ID NO: 3089895 - RNA, 21 nt, Mycobacterium bovis subsp bovis AF2122/97
gcuauuccuacagccucgacg

SEQ ID NO: 3089896 - RNA, 16 nt, Mycobacterium bovis subsp bovis AF2122/97
gcuauucgccagcgcc

SEQ ID NO: 3089897 - RNA, 15 nt, Mycobacterium bovis subsp bovis AF2122/97
gcuauucggcggcau

SEQ ID NO: 3089898 - RNA, 14 nt, Mycobacterium bovis subsp bovis AF2122/97
gcuauucggugucg

SEQ ID NO: 3089899 - RNA, 16 nt, Mycobacterium bovis subsp bovis AF2122/97
gcuauugggugcagug

SEQ ID NO: 3089900 - RNA, 12 nt, Mycobacterium bovis subsp bovis AF2122/97
gcucaaacccga

SEQ ID NO: 3089901 - RNA, 16 nt, Mycobacterium bovis subsp bovis AF2122/97
gcucaaaucaugcgau

SEQ ID NO: 3089902 - RNA, 22 nt, Mycobacterium bovis subsp bovis AF2122/97
gcucaacaccgaguuccucugc

SEQ ID NO: 3089903 - RNA, 15 nt, Mycobacterium bovis subsp bovis AF2122/97
gcucaaccagcagac

SEQ ID NO: 3089904 - RNA, 18 nt, Mycobacterium bovis subsp bovis AF2122/97
gcucaaccucuggcggcg

SEQ ID NO: 3089905 - RNA, 20 nt, Mycobacterium bovis subsp bovis AF2122/97
gcucaaccucuggcggcggg

SEQ ID NO: 3089906 - RNA, 22 nt, Mycobacterium bovis subsp bovis AF2122/97
gcucaacggaaccgauaccucg

SEQ ID NO: 3089907 - RNA, 14 nt, Mycobacterium bovis subsp bovis AF2122/97
gcucaacggcgaca

SEQ ID NO: 3089908 - RNA, 18 nt, Mycobacterium bovis subsp bovis AF2122/97
gcucaacggcgacaucgg

SEQ ID NO: 3089909 - RNA, 14 nt, Mycobacterium bovis subsp bovis AF2122/97
gcucaagcgcgucg

SEQ ID NO: 3089910 - RNA, 15 nt, Mycobacterium bovis subsp bovis AF2122/97
gcucaagcgcgucgu

SEQ ID NO: 3089911 - RNA, 18 nt, Mycobacterium bovis subsp bovis AF2122/97
gcucaagucucccggccg

SEQ ID NO: 3089912 - RNA, 23 nt, Mycobacterium bovis subsp bovis AF2122/97
gcucaagucucccggccgcaccc

SEQ ID NO: 3089913 - RNA, 22 nt, Mycobacterium bovis subsp bovis AF2122/97
gcucaaugaucgcggcggcgau

SEQ ID NO: 3089914 - RNA, 16 nt, Mycobacterium bovis subsp bovis AF2122/97
gcucaaugugccgccg

SEQ ID NO: 3089915 - RNA, 17 nt, Mycobacterium bovis subsp bovis AF2122/97
gcucaaugugccgccgg

SEQ ID NO: 3089916 - RNA, 13 nt, Mycobacterium bovis subsp bovis AF2122/97
gcucacacuggcu

SEQ ID NO: 3089917 - RNA, 17 nt, Mycobacterium bovis subsp bovis AF2122/97
gcucacagcacagcgca

SEQ ID NO: 3089918 - RNA, 17 nt, Mycobacterium bovis subsp bovis AF2122/97
gcucacauacagcaggc

SEQ ID NO: 3089919 - RNA, 17 nt, Mycobacterium bovis subsp bovis AF2122/97
gcucacauccggucaga

SEQ ID NO: 3089920 - RNA, 13 nt, Mycobacterium bovis subsp bovis AF2122/97
gcucacaugcccg

SEQ ID NO: 3089921 - RNA, 19 nt, Mycobacterium bovis subsp bovis AF2122/97
gcucaccaaggucggcgau

SEQ ID NO: 3089922 - RNA, 18 nt, Mycobacterium bovis subsp bovis AF2122/97
gcucaccaaucugcgggc

SEQ ID NO: 3089923 - RNA, 19 nt, Mycobacterium bovis subsp bovis AF2122/97
gcucaccaaucugcgggcc

SEQ ID NO: 3089924 - RNA, 19 nt, Mycobacterium bovis subsp bovis AF2122/97
gcucaccaccgaccucgac

SEQ ID NO: 3089925 - RNA, 22 nt, Mycobacterium bovis subsp bovis AF2122/97
gcucaccacgccggucgaggug

SEQ ID NO: 3089926 - RNA, 21 nt, Mycobacterium bovis subsp bovis AF2122/97
gcucaccagcggucagccggc

SEQ ID NO: 3089927 - RNA, 13 nt, Mycobacterium bovis subsp bovis AF2122/97
gcucaccaggcga

SEQ ID NO: 3089928 - RNA, 17 nt, Mycobacterium bovis subsp bovis AF2122/97
gcucaccaggcgagccg

SEQ ID NO: 3089929 - RNA, 18 nt, Mycobacterium bovis subsp bovis AF2122/97
gcucaccaggcgagccgg

SEQ ID NO: 3089930 - RNA, 21 nt, Mycobacterium bovis subsp bovis AF2122/97
gcucaccaggcgagccggcgc

SEQ ID NO: 3089931 - RNA, 15 nt, Mycobacterium bovis subsp bovis AF2122/97
gcucacccaggcgcc

SEQ ID NO: 3089932 - RNA, 16 nt, Mycobacterium bovis subsp bovis AF2122/97
gcucacccaggcgccg

SEQ ID NO: 3089933 - RNA, 20 nt, Mycobacterium bovis subsp bovis AF2122/97
gcucaccccggucgaggucg

SEQ ID NO: 3089934 - RNA, 16 nt, Mycobacterium bovis subsp bovis AF2122/97
gcucacccgccgcggu

SEQ ID NO: 3089935 - RNA, 16 nt, Mycobacterium bovis subsp bovis AF2122/97
gcucacccggagcacc

SEQ ID NO: 3089936 - RNA, 18 nt, Mycobacterium bovis subsp bovis AF2122/97
gcucacccggagcacccg

SEQ ID NO: 3089937 - RNA, 20 nt, Mycobacterium bovis subsp bovis AF2122/97
gcucacccuuggaauugaag

SEQ ID NO: 3089938 - RNA, 18 nt, Mycobacterium bovis subsp bovis AF2122/97
gcucaccgacggagaucg

SEQ ID NO: 3089939 - RNA, 16 nt, Mycobacterium bovis subsp bovis AF2122/97
gcucaccgcacaccug

SEQ ID NO: 3089940 - RNA, 12 nt, Mycobacterium bovis subsp bovis AF2122/97
gcucaccggcgc

SEQ ID NO: 3089941 - RNA, 13 nt, Mycobacterium bovis subsp bovis AF2122/97
gcucaccggcgcc

SEQ ID NO: 3089942 - RNA, 17 nt, Mycobacterium bovis subsp bovis AF2122/97
gcucaccggcgcccagc

SEQ ID NO: 3089943 - RNA, 18 nt, Mycobacterium bovis subsp bovis AF2122/97
gcucaccggcgucguagg

SEQ ID NO: 3089944 - RNA, 14 nt, Mycobacterium bovis subsp bovis AF2122/97
gcucaccggcuggu

SEQ ID NO: 3089945 - RNA, 12 nt, Mycobacterium bovis subsp bovis AF2122/97
gcucaccgucga

SEQ ID NO: 3089946 - RNA, 14 nt, Mycobacterium bovis subsp bovis AF2122/97
gcucaccgucgagg

SEQ ID NO: 3089947 - RNA, 16 nt, Mycobacterium bovis subsp bovis AF2122/97
gcucaccgucgaggua

SEQ ID NO: 3089948 - RNA, 16 nt, Mycobacterium bovis subsp bovis AF2122/97
gcucaccucaugaucu

SEQ ID NO: 3089949 - RNA, 21 nt, Mycobacterium bovis subsp bovis AF2122/97
gcucaccucaugaucucacca

SEQ ID NO: 3089950 - RNA, 19 nt, Mycobacterium bovis subsp bovis AF2122/97
gcucacgaagaccgcgucg

SEQ ID NO: 3089951 - RNA, 20 nt, Mycobacterium bovis subsp bovis AF2122/97
gcucacgaagaccgcgucgg

SEQ ID NO: 3089952 - RNA, 22 nt, Mycobacterium bovis subsp bovis AF2122/97
gcucacgaagaccgcgucggcg

SEQ ID NO: 3089953 - RNA, 15 nt, Mycobacterium bovis subsp bovis AF2122/97
gcucacgaccggcca

SEQ ID NO: 3089954 - RNA, 22 nt, Mycobacterium bovis subsp bovis AF2122/97
gcucacgaccggccaacgccgc

SEQ ID NO: 3089955 - RNA, 13 nt, Mycobacterium bovis subsp bovis AF2122/97
gcucacgcucacc

SEQ ID NO: 3089956 - RNA, 16 nt, Mycobacterium bovis subsp bovis AF2122/97
gcucacgcuccgccgg

SEQ ID NO: 3089957 - RNA, 21 nt, Mycobacterium bovis subsp bovis AF2122/97
gcucacgcugaagccgcugga

SEQ ID NO: 3089958 - RNA, 15 nt, Mycobacterium bovis subsp bovis AF2122/97
gcucacggacgcugg

SEQ ID NO: 3089959 - RNA, 22 nt, Mycobacterium bovis subsp bovis AF2122/97
gcucacggacgcugggcgguag

SEQ ID NO: 3089960 - RNA, 16 nt, Mycobacterium bovis subsp bovis AF2122/97
gcucacggcaggcggu

SEQ ID NO: 3089961 - RNA, 19 nt, Mycobacterium bovis subsp bovis AF2122/97
gcucacgggcgaucgugcg

SEQ ID NO: 3089962 - RNA, 13 nt, Mycobacterium bovis subsp bovis AF2122/97
gcucacgguggcc

SEQ ID NO: 3089963 - RNA, 15 nt, Mycobacterium bovis subsp bovis AF2122/97
gcucacgguggccgc

SEQ ID NO: 3089964 - RNA, 15 nt, Mycobacterium bovis subsp bovis AF2122/97
gcucacgguuagacg

SEQ ID NO: 3089965 - RNA, 20 nt, Mycobacterium bovis subsp bovis AF2122/97
gcucacgugcugccgauagc

SEQ ID NO: 3089966 - RNA, 17 nt, Mycobacterium bovis subsp bovis AF2122/97
gcucacuacccgcaacg

SEQ ID NO: 3089967 - RNA, 24 nt, Mycobacterium bovis subsp bovis AF2122/97
gcucacucgccgaaucgcugaccg

SEQ ID NO: 3089968 - RNA, 18 nt, Mycobacterium bovis subsp bovis AF2122/97
gcucacuucacgccgccc

SEQ ID NO: 3089969 - RNA, 19 nt, Mycobacterium bovis subsp bovis AF2122/97
gcucagaacccuccgcacc

SEQ ID NO: 3089970 - RNA, 13 nt, Mycobacterium bovis subsp bovis AF2122/97
gcucagaccaagg

SEQ ID NO: 3089971 - RNA, 14 nt, Mycobacterium bovis subsp bovis AF2122/97
gcucagaccggcgc

SEQ ID NO: 3089972 - RNA, 15 nt, Mycobacterium bovis subsp bovis AF2122/97
gcucagaccggcgcc

SEQ ID NO: 3089973 - RNA, 17 nt, Mycobacterium bovis subsp bovis AF2122/97
gcucagaccggcgccgu

SEQ ID NO: 3089974 - RNA, 23 nt, Mycobacterium bovis subsp bovis AF2122/97
gcucagaccggcgccguagccga

SEQ ID NO: 3089975 - RNA, 18 nt, Mycobacterium bovis subsp bovis AF2122/97
gcucagacgacgaucgcg

SEQ ID NO: 3089976 - RNA, 17 nt, Mycobacterium bovis subsp bovis AF2122/97
gcucagcaacgucacgu

SEQ ID NO: 3089977 - RNA, 22 nt, Mycobacterium bovis subsp bovis AF2122/97
gcucagcaacgucacgucgacg

SEQ ID NO: 3089978 - RNA, 17 nt, Mycobacterium bovis subsp bovis AF2122/97
gcucagcaaguucgucg

SEQ ID NO: 3089979 - RNA, 22 nt, Mycobacterium bovis subsp bovis AF2122/97
gcucagcaaguucgucgggauc

SEQ ID NO: 3089980 - RNA, 11 nt, Mycobacterium bovis subsp bovis AF2122/97
gcucagcagcg

SEQ ID NO: 3089981 - RNA, 19 nt, Mycobacterium bovis subsp bovis AF2122/97
gcucagcagcgccgcgcgg

SEQ ID NO: 3089982 - RNA, 12 nt, Mycobacterium bovis subsp bovis AF2122/97
gcucagcauuca

SEQ ID NO: 3089983 - RNA, 13 nt, Mycobacterium bovis subsp bovis AF2122/97
gcucagcauucac

SEQ ID NO: 3089984 - RNA, 20 nt, Mycobacterium bovis subsp bovis AF2122/97
gcucagccggcccugcggcc

SEQ ID NO: 3089985 - RNA, 15 nt, Mycobacterium bovis subsp bovis AF2122/97
gcucagccggguauc

SEQ ID NO: 3089986 - RNA, 20 nt, Mycobacterium bovis subsp bovis AF2122/97
gcucagccguccgggcggcc

SEQ ID NO: 3089987 - RNA, 21 nt, Mycobacterium bovis subsp bovis AF2122/97
gcucagccguccgggcggccu

SEQ ID NO: 3089988 - RNA, 15 nt, Mycobacterium bovis subsp bovis AF2122/97
gcucagcgcagcauc

SEQ ID NO: 3089989 - RNA, 12 nt, Mycobacterium bovis subsp bovis AF2122/97
gcucagcgcgcg

SEQ ID NO: 3089990 - RNA, 13 nt, Mycobacterium bovis subsp bovis AF2122/97
gcucagcgcgcgc

SEQ ID NO: 3089991 - RNA, 19 nt, Mycobacterium bovis subsp bovis AF2122/97
gcucagcgcgcgccgcugg

SEQ ID NO: 3089992 - RNA, 13 nt, Mycobacterium bovis subsp bovis AF2122/97
gcucagcgcggcc

SEQ ID NO: 3089993 - RNA, 14 nt, Mycobacterium bovis subsp bovis AF2122/97
gcucagcgcggcca

SEQ ID NO: 3089994 - RNA, 17 nt, Mycobacterium bovis subsp bovis AF2122/97
gcucagcgcggccccga

SEQ ID NO: 3089995 - RNA, 15 nt, Mycobacterium bovis subsp bovis AF2122/97
gcucagcggcgaccg

SEQ ID NO: 3089996 - RNA, 13 nt, Mycobacterium bovis subsp bovis AF2122/97
gcucagcgguggc

SEQ ID NO: 3089997 - RNA, 14 nt, Mycobacterium bovis subsp bovis AF2122/97
gcucagcgugcgcu

SEQ ID NO: 3089998 - RNA, 17 nt, Mycobacterium bovis subsp bovis AF2122/97
gcucagcgugcgcuggc

SEQ ID NO: 3089999 - RNA, 20 nt, Mycobacterium bovis subsp bovis AF2122/97
gcucagcgugcgcuggcuga

SEQ ID NO: 3090000 - RNA, 16 nt, Mycobacterium bovis subsp bovis AF2122/97
gcucagcuccggcgac

SEQ ID NO: 3090001 - RNA, 17 nt, Mycobacterium bovis subsp bovis AF2122/97
gcucagcuccggcgacu

SEQ ID NO: 3090002 - RNA, 15 nt, Mycobacterium bovis subsp bovis AF2122/97
gcucagcugcggauu

SEQ ID NO: 3090003 - RNA, 18 nt, Mycobacterium bovis subsp bovis AF2122/97
gcucagcugguggcggcg

SEQ ID NO: 3090004 - RNA, 20 nt, Mycobacterium bovis subsp bovis AF2122/97
gcucagcugguggcggcggu

SEQ ID NO: 3090005 - RNA, 14 nt, Mycobacterium bovis subsp bovis AF2122/97
gcucagggcaguag

SEQ ID NO: 3090006 - RNA, 23 nt, Mycobacterium bovis subsp bovis AF2122/97
gcucaggggcuacuaggcccagc

SEQ ID NO: 3090007 - RNA, 16 nt, Mycobacterium bovis subsp bovis AF2122/97
gcucagggugcgccgc

SEQ ID NO: 3090008 - RNA, 17 nt, Mycobacterium bovis subsp bovis AF2122/97
gcucagggugcgccgca

SEQ ID NO: 3090009 - RNA, 19 nt, Mycobacterium bovis subsp bovis AF2122/97
gcucagggugcgccgcagc

SEQ ID NO: 3090010 - RNA, 20 nt, Mycobacterium bovis subsp bovis AF2122/97
gcucaggguguucacguuca

SEQ ID NO: 3090011 - RNA, 22 nt, Mycobacterium bovis subsp bovis AF2122/97
gcucaggguguucacguucagc

SEQ ID NO: 3090012 - RNA, 19 nt, Mycobacterium bovis subsp bovis AF2122/97
gcucaggucaccggccgcc

SEQ ID NO: 3090013 - RNA, 19 nt, Mycobacterium bovis subsp bovis AF2122/97
gcucaggucaucggcggcg

SEQ ID NO: 3090014 - RNA, 12 nt, Mycobacterium bovis subsp bovis AF2122/97
gcucaggugcuc

SEQ ID NO: 3090015 - RNA, 14 nt, Mycobacterium bovis subsp bovis AF2122/97
gcucagguucagcu

SEQ ID NO: 3090016 - RNA, 14 nt, Mycobacterium bovis subsp bovis AF2122/97
gcucagucacgcac

SEQ ID NO: 3090017 - RNA, 14 nt, Mycobacterium bovis subsp bovis AF2122/97
gcucagugaccugu

SEQ ID NO: 3090018 - RNA, 19 nt, Mycobacterium bovis subsp bovis AF2122/97
gcucagugaugcgccccgg

SEQ ID NO: 3090019 - RNA, 20 nt, Mycobacterium bovis subsp bovis AF2122/97
gcucauaccgggaggacacc

SEQ ID NO: 3090020 - RNA, 21 nt, Mycobacterium bovis subsp bovis AF2122/97
gcucauaccgggaggacacca

SEQ ID NO: 3090021 - RNA, 14 nt, Mycobacterium bovis subsp bovis AF2122/97
gcucaucacccagc

SEQ ID NO: 3090022 - RNA, 17 nt, Mycobacterium bovis subsp bovis AF2122/97
gcucaucacccagcgcc

SEQ ID NO: 3090023 - RNA, 14 nt, Mycobacterium bovis subsp bovis AF2122/97
gcucaucaccggcg

SEQ ID NO: 3090024 - RNA, 13 nt, Mycobacterium bovis subsp bovis AF2122/97
gcucauccagcgc

SEQ ID NO: 3090025 - RNA, 19 nt, Mycobacterium bovis subsp bovis AF2122/97
gcucauccauucggcggcg

SEQ ID NO: 3090026 - RNA, 21 nt, Mycobacterium bovis subsp bovis AF2122/97
gcucauccauucggcggcggc

SEQ ID NO: 3090027 - RNA, 16 nt, Mycobacterium bovis subsp bovis AF2122/97
gcucauccgccgggcc

SEQ ID NO: 3090028 - RNA, 21 nt, Mycobacterium bovis subsp bovis AF2122/97
gcucauccgccgggccaggcc

SEQ ID NO: 3090029 - RNA, 18 nt, Mycobacterium bovis subsp bovis AF2122/97
gcucaucgaagcuucggc

SEQ ID NO: 3090030 - RNA, 14 nt, Mycobacterium bovis subsp bovis AF2122/97
gcucaucgaccgcg

SEQ ID NO: 3090031 - RNA, 17 nt, Mycobacterium bovis subsp bovis AF2122/97
gcucaucgaccgcggcc

SEQ ID NO: 3090032 - RNA, 21 nt, Mycobacterium bovis subsp bovis AF2122/97
gcucaucgaccggggcuuggg

SEQ ID NO: 3090033 - RNA, 22 nt, Mycobacterium bovis subsp bovis AF2122/97
gcucaucgacgagccgcggucg

SEQ ID NO: 3090034 - RNA, 23 nt, Mycobacterium bovis subsp bovis AF2122/97
gcucaucgauccucgcccgcacc

SEQ ID NO: 3090035 - RNA, 17 nt, Mycobacterium bovis subsp bovis AF2122/97
gcucaucgccgcuaccg

SEQ ID NO: 3090036 - RNA, 14 nt, Mycobacterium bovis subsp bovis AF2122/97
gcucaucgcgcacg

SEQ ID NO: 3090037 - RNA, 14 nt, Mycobacterium bovis subsp bovis AF2122/97
gcucaucgcgcccg

SEQ ID NO: 3090038 - RNA, 15 nt, Mycobacterium bovis subsp bovis AF2122/97
gcucaucgcggcgaa

SEQ ID NO: 3090039 - RNA, 16 nt, Mycobacterium bovis subsp bovis AF2122/97
gcucaucgcggcgaac

SEQ ID NO: 3090040 - RNA, 18 nt, Mycobacterium bovis subsp bovis AF2122/97
gcucaucugcgcgcggaa

SEQ ID NO: 3090041 - RNA, 20 nt, Mycobacterium bovis subsp bovis AF2122/97
gcucaucuguaaccuccucg

SEQ ID NO: 3090042 - RNA, 17 nt, Mycobacterium bovis subsp bovis AF2122/97
gcucaugaccgcucgga

SEQ ID NO: 3090043 - RNA, 17 nt, Mycobacterium bovis subsp bovis AF2122/97
gcucauggcauuuccug

SEQ ID NO: 3090044 - RNA, 17 nt, Mycobacterium bovis subsp bovis AF2122/97
gcucauguucucgaccg

SEQ ID NO: 3090045 - RNA, 15 nt, Mycobacterium bovis subsp bovis AF2122/97
gcucauuagcccccg

SEQ ID NO: 3090046 - RNA, 17 nt, Mycobacterium bovis subsp bovis AF2122/97
gcucauuagcccccgcg

SEQ ID NO: 3090047 - RNA, 18 nt, Mycobacterium bovis subsp bovis AF2122/97
gcucauuagcccccgcgg

SEQ ID NO: 3090048 - RNA, 17 nt, Mycobacterium bovis subsp bovis AF2122/97
gcucauucgugcccggg

SEQ ID NO: 3090049 - RNA, 24 nt, Mycobacterium bovis subsp bovis AF2122/97
gcucauucgugcccgggcggucga

SEQ ID NO: 3090050 - RNA, 14 nt, Mycobacterium bovis subsp bovis AF2122/97
gcucauugccgauu

SEQ ID NO: 3090051 - RNA, 23 nt, Mycobacterium bovis subsp bovis AF2122/97
gcuccaaauccuucggcguggcg

SEQ ID NO: 3090052 - RNA, 23 nt, Mycobacterium bovis subsp bovis AF2122/97
gcuccaaaucggcaucggcgacg

SEQ ID NO: 3090053 - RNA, 18 nt, Mycobacterium bovis subsp bovis AF2122/97
gcuccaacaacuccagca

SEQ ID NO: 3090054 - RNA, 20 nt, Mycobacterium bovis subsp bovis AF2122/97
gcuccaacaacuccagcagg

SEQ ID NO: 3090055 - RNA, 18 nt, Mycobacterium bovis subsp bovis AF2122/97
gcuccaacaaugccagcu

SEQ ID NO: 3090056 - RNA, 20 nt, Mycobacterium bovis subsp bovis AF2122/97
gcuccaacaaugccagcugu

SEQ ID NO: 3090057 - RNA, 21 nt, Mycobacterium bovis subsp bovis AF2122/97
gcuccaacgauggaacgggcg

SEQ ID NO: 3090058 - RNA, 18 nt, Mycobacterium bovis subsp bovis AF2122/97
gcuccaacgcacacaccg

SEQ ID NO: 3090059 - RNA, 22 nt, Mycobacterium bovis subsp bovis AF2122/97
gcuccaacuccaagaugccgcc

SEQ ID NO: 3090060 - RNA, 22 nt, Mycobacterium bovis subsp bovis AF2122/97
gcuccaauccuuugccagccac

SEQ ID NO: 3090061 - RNA, 17 nt, Mycobacterium bovis subsp bovis AF2122/97
gcuccaauugcggccgc

SEQ ID NO: 3090062 - RNA, 16 nt, Mycobacterium bovis subsp bovis AF2122/97
gcuccaccacgaccgc

SEQ ID NO: 3090063 - RNA, 13 nt, Mycobacterium bovis subsp bovis AF2122/97
gcuccaccaggac

SEQ ID NO: 3090064 - RNA, 14 nt, Mycobacterium bovis subsp bovis AF2122/97
gcuccaccaggacg

SEQ ID NO: 3090065 - RNA, 14 nt, Mycobacterium bovis subsp bovis AF2122/97
gcuccaccgggccc

SEQ ID NO: 3090066 - RNA, 20 nt, Mycobacterium bovis subsp bovis AF2122/97
gcuccaccgggcccgccggc

SEQ ID NO: 3090067 - RNA, 21 nt, Mycobacterium bovis subsp bovis AF2122/97
gcuccaccgggcccgccggcc

SEQ ID NO: 3090068 - RNA, 22 nt, Mycobacterium bovis subsp bovis AF2122/97
gcuccaccgggcccgccggccc

SEQ ID NO: 3090069 - RNA, 13 nt, Mycobacterium bovis subsp bovis AF2122/97
gcuccaccgucga

SEQ ID NO: 3090070 - RNA, 15 nt, Mycobacterium bovis subsp bovis AF2122/97
gcuccacguacgcgg

SEQ ID NO: 3090071 - RNA, 18 nt, Mycobacterium bovis subsp bovis AF2122/97
gcuccacguacgcggcug

SEQ ID NO: 3090072 - RNA, 19 nt, Mycobacterium bovis subsp bovis AF2122/97
gcuccacguacgcggcugc

SEQ ID NO: 3090073 - RNA, 21 nt, Mycobacterium bovis subsp bovis AF2122/97
gcuccagcaaaacccgcucca

SEQ ID NO: 3090074 - RNA, 11 nt, Mycobacterium bovis subsp bovis AF2122/97
gcuccagcacc

SEQ ID NO: 3090075 - RNA, 17 nt, Mycobacterium bovis subsp bovis AF2122/97
gcuccagcaccgugacc

SEQ ID NO: 3090076 - RNA, 22 nt, Mycobacterium bovis subsp bovis AF2122/97
gcuccagcaccgugacccugau

SEQ ID NO: 3090077 - RNA, 17 nt, Mycobacterium bovis subsp bovis AF2122/97
gcuccagcgcgcgccgc

SEQ ID NO: 3090078 - RNA, 20 nt, Mycobacterium bovis subsp bovis AF2122/97
gcuccagcgcgcgccgcagc

SEQ ID NO: 3090079 - RNA, 21 nt, Mycobacterium bovis subsp bovis AF2122/97
gcuccagcgcgcgccgcagcg

SEQ ID NO: 3090080 - RNA, 15 nt, Mycobacterium bovis subsp bovis AF2122/97
gcuccagcucggcca

SEQ ID NO: 3090081 - RNA, 17 nt, Mycobacterium bovis subsp bovis AF2122/97
gcuccagcucggccagu

SEQ ID NO: 3090082 - RNA, 14 nt, Mycobacterium bovis subsp bovis AF2122/97
gcuccagcucggcg

SEQ ID NO: 3090083 - RNA, 18 nt, Mycobacterium bovis subsp bovis AF2122/97
gcuccagcucggcgggcu

SEQ ID NO: 3090084 - RNA, 22 nt, Mycobacterium bovis subsp bovis AF2122/97
gcuccagcugagcggccggcau

SEQ ID NO: 3090085 - RNA, 16 nt, Mycobacterium bovis subsp bovis AF2122/97
gcuccaggcgcgccgc

SEQ ID NO: 3090086 - RNA, 17 nt, Mycobacterium bovis subsp bovis AF2122/97
gcuccaggcgcgccgca

SEQ ID NO: 3090087 - RNA, 17 nt, Mycobacterium bovis subsp bovis AF2122/97
gcuccagguagagucca

SEQ ID NO: 3090088 - RNA, 22 nt, Mycobacterium bovis subsp bovis AF2122/97
gcuccaggucgacauaggccac

SEQ ID NO: 3090089 - RNA, 16 nt, Mycobacterium bovis subsp bovis AF2122/97
gcuccaguagucggcc

SEQ ID NO: 3090090 - RNA, 15 nt, Mycobacterium bovis subsp bovis AF2122/97
gcuccaguggcgcca

SEQ ID NO: 3090091 - RNA, 17 nt, Mycobacterium bovis subsp bovis AF2122/97
gcuccaguggcgccagg

SEQ ID NO: 3090092 - RNA, 20 nt, Mycobacterium bovis subsp bovis AF2122/97
gcuccaguggcgccagggcc

SEQ ID NO: 3090093 - RNA, 12 nt, Mycobacterium bovis subsp bovis AF2122/97
gcuccauccccu

SEQ ID NO: 3090094 - RNA, 19 nt, Mycobacterium bovis subsp bovis AF2122/97
gcuccaugacaaaccugca

SEQ ID NO: 3090095 - RNA, 11 nt, Mycobacterium bovis subsp bovis AF2122/97
gcucccacggc

SEQ ID NO: 3090096 - RNA, 21 nt, Mycobacterium bovis subsp bovis AF2122/97
gcucccccgccaaccccaaca

SEQ ID NO: 3090097 - RNA, 20 nt, Mycobacterium bovis subsp bovis AF2122/97
gcuccccggauuccucguca

SEQ ID NO: 3090098 - RNA, 23 nt, Mycobacterium bovis subsp bovis AF2122/97
gcuccccggauuccucgucaccg

SEQ ID NO: 3090099 - RNA, 16 nt, Mycobacterium bovis subsp bovis AF2122/97
gcuccccgucggggaa

SEQ ID NO: 3090100 - RNA, 18 nt, Mycobacterium bovis subsp bovis AF2122/97
gcucccgcaauggggcgc

SEQ ID NO: 3090101 - RNA, 23 nt, Mycobacterium bovis subsp bovis AF2122/97
gcucccggagcacaauccagaca

SEQ ID NO: 3090102 - RNA, 23 nt, Mycobacterium bovis subsp bovis AF2122/97
gcucccggcgucuuaccugaagc

SEQ ID NO: 3090103 - RNA, 16 nt, Mycobacterium bovis subsp bovis AF2122/97
gcucccgggcggcggc

SEQ ID NO: 3090104 - RNA, 14 nt, Mycobacterium bovis subsp bovis AF2122/97
gcucccgggggcac

SEQ ID NO: 3090105 - RNA, 19 nt, Mycobacterium bovis subsp bovis AF2122/97
gcucccggggguuccacuc

SEQ ID NO: 3090106 - RNA, 14 nt, Mycobacterium bovis subsp bovis AF2122/97
gcucccguacgccg

SEQ ID NO: 3090107 - RNA, 16 nt, Mycobacterium bovis subsp bovis AF2122/97
gcucccguacgccggc

SEQ ID NO: 3090108 - RNA, 22 nt, Mycobacterium bovis subsp bovis AF2122/97
gcucccguacgccggcgguggc

SEQ ID NO: 3090109 - RNA, 16 nt, Mycobacterium bovis subsp bovis AF2122/97
gcucccgucucgacag

SEQ ID NO: 3090110 - RNA, 23 nt, Mycobacterium bovis subsp bovis AF2122/97
gcucccgucucgacaguggcgac

SEQ ID NO: 3090111 - RNA, 14 nt, Mycobacterium bovis subsp bovis AF2122/97
gcucccgugcuggc

SEQ ID NO: 3090112 - RNA, 19 nt, Mycobacterium bovis subsp bovis AF2122/97
gcucccgugcuggcgccga

SEQ ID NO: 3090113 - RNA, 20 nt, Mycobacterium bovis subsp bovis AF2122/97
gcucccuaaugucugaccgg

SEQ ID NO: 3090114 - RNA, 18 nt, Mycobacterium bovis subsp bovis AF2122/97
gcucccuacgagcccacg

SEQ ID NO: 3090115 - RNA, 22 nt, Mycobacterium bovis subsp bovis AF2122/97
gcucccuacgagcccacgcgcc

SEQ ID NO: 3090116 - RNA, 13 nt, Mycobacterium bovis subsp bovis AF2122/97
gcucccugcaccc

SEQ ID NO: 3090117 - RNA, 18 nt, Mycobacterium bovis subsp bovis AF2122/97
gcucccugggcgucgacc

SEQ ID NO: 3090118 - RNA, 20 nt, Mycobacterium bovis subsp bovis AF2122/97
gcucccugggcgucgaccac

SEQ ID NO: 3090119 - RNA, 17 nt, Mycobacterium bovis subsp bovis AF2122/97
gcucccuuuuccaaagg

SEQ ID NO: 3090120 - RNA, 21 nt, Mycobacterium bovis subsp bovis AF2122/97
gcuccgaacauggccagcauc

SEQ ID NO: 3090121 - RNA, 22 nt, Mycobacterium bovis subsp bovis AF2122/97
gcuccgaaguccacgcaccacg

SEQ ID NO: 3090122 - RNA, 15 nt, Mycobacterium bovis subsp bovis AF2122/97
gcuccgaccgguggc

SEQ ID NO: 3090123 - RNA, 20 nt, Mycobacterium bovis subsp bovis AF2122/97
gcuccgacgaaacucucccg

SEQ ID NO: 3090124 - RNA, 16 nt, Mycobacterium bovis subsp bovis AF2122/97
gcuccgaucucuggug

SEQ ID NO: 3090125 - RNA, 14 nt, Mycobacterium bovis subsp bovis AF2122/97
gcuccgaugccgac

SEQ ID NO: 3090126 - RNA, 18 nt, Mycobacterium bovis subsp bovis AF2122/97
gcuccgaugccgacggcg

SEQ ID NO: 3090127 - RNA, 21 nt, Mycobacterium bovis subsp bovis AF2122/97
gcuccgcagcgaagaccagcg

SEQ ID NO: 3090128 - RNA, 17 nt, Mycobacterium bovis subsp bovis AF2122/97
gcuccgccacuggcgcc

SEQ ID NO: 3090129 - RNA, 17 nt, Mycobacterium bovis subsp bovis AF2122/97
gcuccgcccauucccag

SEQ ID NO: 3090130 - RNA, 13 nt, Mycobacterium bovis subsp bovis AF2122/97
gcuccgccgccga

SEQ ID NO: 3090131 - RNA, 18 nt, Mycobacterium bovis subsp bovis AF2122/97
gcuccgccgccgacggau

SEQ ID NO: 3090132 - RNA, 17 nt, Mycobacterium bovis subsp bovis AF2122/97
gcuccgccggguuggcg

SEQ ID NO: 3090133 - RNA, 14 nt, Mycobacterium bovis subsp bovis AF2122/97
gcuccgccgucgcc

SEQ ID NO: 3090134 - RNA, 15 nt, Mycobacterium bovis subsp bovis AF2122/97
gcuccgccgucgccg

SEQ ID NO: 3090135 - RNA, 16 nt, Mycobacterium bovis subsp bovis AF2122/97
gcuccgccgucgccgc

SEQ ID NO: 3090136 - RNA, 19 nt, Mycobacterium bovis subsp bovis AF2122/97
gcuccgccguugacgccgu

SEQ ID NO: 3090137 - RNA, 15 nt, Mycobacterium bovis subsp bovis AF2122/97
gcuccgccugccgcu

SEQ ID NO: 3090138 - RNA, 23 nt, Mycobacterium bovis subsp bovis AF2122/97
gcuccgccugccgcuggucgucg

SEQ ID NO: 3090139 - RNA, 18 nt, Mycobacterium bovis subsp bovis AF2122/97
gcuccgcgcagccaggga

SEQ ID NO: 3090140 - RNA, 23 nt, Mycobacterium bovis subsp bovis AF2122/97
gcuccgcggcgagcuccgaugcc

SEQ ID NO: 3090141 - RNA, 20 nt, Mycobacterium bovis subsp bovis AF2122/97
gcuccgcggcgcagcacggc

SEQ ID NO: 3090142 - RNA, 21 nt, Mycobacterium bovis subsp bovis AF2122/97
gcuccggacaccccgcacgga

SEQ ID NO: 3090143 - RNA, 14 nt, Mycobacterium bovis subsp bovis AF2122/97
gcuccggauugcug

SEQ ID NO: 3090144 - RNA, 19 nt, Mycobacterium bovis subsp bovis AF2122/97
gcuccggcccugccgccgg

SEQ ID NO: 3090145 - RNA, 22 nt, Mycobacterium bovis subsp bovis AF2122/97
gcuccggcccugccgccggccc

SEQ ID NO: 3090146 - RNA, 17 nt, Mycobacterium bovis subsp bovis AF2122/97
gcuccggccgcacgccu

SEQ ID NO: 3090147 - RNA, 14 nt, Mycobacterium bovis subsp bovis AF2122/97
gcuccggccgcguu

SEQ ID NO: 3090148 - RNA, 16 nt, Mycobacterium bovis subsp bovis AF2122/97
gcuccggccgcguugg

SEQ ID NO: 3090149 - RNA, 14 nt, Mycobacterium bovis subsp bovis AF2122/97
gcuccggccggcca

SEQ ID NO: 3090150 - RNA, 16 nt, Mycobacterium bovis subsp bovis AF2122/97
gcuccggccggccagc

SEQ ID NO: 3090151 - RNA, 18 nt, Mycobacterium bovis subsp bovis AF2122/97
gcuccggccggccagcac

SEQ ID NO: 3090152 - RNA, 20 nt, Mycobacterium bovis subsp bovis AF2122/97
gcuccggccggccagcaccc

SEQ ID NO: 3090153 - RNA, 21 nt, Mycobacterium bovis subsp bovis AF2122/97
gcuccggccggccagcacccg

SEQ ID NO: 3090154 - RNA, 14 nt, Mycobacterium bovis subsp bovis AF2122/97
gcuccggcgcgacg

SEQ ID NO: 3090155 - RNA, 15 nt, Mycobacterium bovis subsp bovis AF2122/97
gcuccggcgcgacgc

SEQ ID NO: 3090156 - RNA, 17 nt, Mycobacterium bovis subsp bovis AF2122/97
gcuccggcggcagcggc

SEQ ID NO: 3090157 - RNA, 16 nt, Mycobacterium bovis subsp bovis AF2122/97
gcuccggcggugccgu

SEQ ID NO: 3090158 - RNA, 15 nt, Mycobacterium bovis subsp bovis AF2122/97
gcuccgggacgguga

SEQ ID NO: 3090159 - RNA, 13 nt, Mycobacterium bovis subsp bovis AF2122/97
gcuccggucgggu

SEQ ID NO: 3090160 - RNA, 13 nt, Mycobacterium bovis subsp bovis AF2122/97
gcuccgguuggcg

SEQ ID NO: 3090161 - RNA, 17 nt, Mycobacterium bovis subsp bovis AF2122/97
gcuccgguuggcgcggg

SEQ ID NO: 3090162 - RNA, 19 nt, Mycobacterium bovis subsp bovis AF2122/97
gcuccgguuggcgcgggcg

SEQ ID NO: 3090163 - RNA, 20 nt, Mycobacterium bovis subsp bovis AF2122/97
gcuccgguuggcgcgggcga

SEQ ID NO: 3090164 - RNA, 13 nt, Mycobacterium bovis subsp bovis AF2122/97
gcuccgucgccga

SEQ ID NO: 3090165 - RNA, 23 nt, Mycobacterium bovis subsp bovis AF2122/97
gcuccgucgccgaacagugcggu

SEQ ID NO: 3090166 - RNA, 14 nt, Mycobacterium bovis subsp bovis AF2122/97
gcuccgucgcggcc

SEQ ID NO: 3090167 - RNA, 15 nt, Mycobacterium bovis subsp bovis AF2122/97
gcuccgucgcggccg

SEQ ID NO: 3090168 - RNA, 20 nt, Mycobacterium bovis subsp bovis AF2122/97
gcuccgugguugccgaagcc

SEQ ID NO: 3090169 - RNA, 17 nt, Mycobacterium bovis subsp bovis AF2122/97
gcuccguuguccagcgc

SEQ ID NO: 3090170 - RNA, 21 nt, Mycobacterium bovis subsp bovis AF2122/97
gcuccguuguccagcgcgacg

SEQ ID NO: 3090171 - RNA, 21 nt, Mycobacterium bovis subsp bovis AF2122/97
gcuccucagccaccgcgguca

SEQ ID NO: 3090172 - RNA, 21 nt, Mycobacterium bovis subsp bovis AF2122/97
gcuccucauagagcggcacca

SEQ ID NO: 3090173 - RNA, 16 nt, Mycobacterium bovis subsp bovis AF2122/97
gcuccucaucgugggg

SEQ ID NO: 3090174 - RNA, 15 nt, Mycobacterium bovis subsp bovis AF2122/97
gcuccuccaccaacu

SEQ ID NO: 3090175 - RNA, 16 nt, Mycobacterium bovis subsp bovis AF2122/97
gcuccuccccggcccg

SEQ ID NO: 3090176 - RNA, 17 nt, Mycobacterium bovis subsp bovis AF2122/97
gcuccuccccggcccgc

SEQ ID NO: 3090177 - RNA, 12 nt, Mycobacterium bovis subsp bovis AF2122/97
gcuccuccggca

SEQ ID NO: 3090178 - RNA, 14 nt, Mycobacterium bovis subsp bovis AF2122/97
gcuccuccgguauc

SEQ ID NO: 3090179 - RNA, 14 nt, Mycobacterium bovis subsp bovis AF2122/97
gcuccucgcgcucg

SEQ ID NO: 3090180 - RNA, 14 nt, Mycobacterium bovis subsp bovis AF2122/97
gcuccucgcgguag

SEQ ID NO: 3090181 - RNA, 15 nt, Mycobacterium bovis subsp bovis AF2122/97
gcuccucggccagcg

SEQ ID NO: 3090182 - RNA, 16 nt, Mycobacterium bovis subsp bovis AF2122/97
gcuccucggccagcgu

SEQ ID NO: 3090183 - RNA, 19 nt, Mycobacterium bovis subsp bovis AF2122/97
gcuccucggucagcggggu

SEQ ID NO: 3090184 - RNA, 18 nt, Mycobacterium bovis subsp bovis AF2122/97
gcuccucgugcacgcaca

SEQ ID NO: 3090185 - RNA, 15 nt, Mycobacterium bovis subsp bovis AF2122/97
gcuccugcaugccgg

SEQ ID NO: 3090186 - RNA, 16 nt, Mycobacterium bovis subsp bovis AF2122/97
gcuccugcguccagau

SEQ ID NO: 3090187 - RNA, 23 nt, Mycobacterium bovis subsp bovis AF2122/97
gcuccuggaaguacacggcggcc

SEQ ID NO: 3090188 - RNA, 18 nt, Mycobacterium bovis subsp bovis AF2122/97
gcuccuucagggcgucga

SEQ ID NO: 3090189 - RNA, 23 nt, Mycobacterium bovis subsp bovis AF2122/97
gcucgaaacggauuggucgaccg

SEQ ID NO: 3090190 - RNA, 17 nt, Mycobacterium bovis subsp bovis AF2122/97
gcucgaaagcgucgauc

SEQ ID NO: 3090191 - RNA, 21 nt, Mycobacterium bovis subsp bovis AF2122/97
gcucgaaauccugguggcaga

SEQ ID NO: 3090192 - RNA, 22 nt, Mycobacterium bovis subsp bovis AF2122/97
gcucgaacuccccggucgccgc

SEQ ID NO: 3090193 - RNA, 14 nt, Mycobacterium bovis subsp bovis AF2122/97
gcucgaagcccgga

SEQ ID NO: 3090194 - RNA, 16 nt, Mycobacterium bovis subsp bovis AF2122/97
gcucgaauacaccuug

SEQ ID NO: 3090195 - RNA, 16 nt, Mycobacterium bovis subsp bovis AF2122/97
gcucgaaucgucacgg

SEQ ID NO: 3090196 - RNA, 15 nt, Mycobacterium bovis subsp bovis AF2122/97
gcucgacaaagccac

SEQ ID NO: 3090197 - RNA, 21 nt, Mycobacterium bovis subsp bovis AF2122/97
gcucgacaaagccacgcagaa

SEQ ID NO: 3090198 - RNA, 17 nt, Mycobacterium bovis subsp bovis AF2122/97
gcucgaccagacgcugc

SEQ ID NO: 3090199 - RNA, 21 nt, Mycobacterium bovis subsp bovis AF2122/97
gcucgaccagacgcugcccaa

SEQ ID NO: 3090200 - RNA, 12 nt, Mycobacterium bovis subsp bovis AF2122/97
gcucgaccagga

SEQ ID NO: 3090201 - RNA, 13 nt, Mycobacterium bovis subsp bovis AF2122/97
gcucgaccaggaa

SEQ ID NO: 3090202 - RNA, 22 nt, Mycobacterium bovis subsp bovis AF2122/97
gcucgaccaggaacggcucggc

SEQ ID NO: 3090203 - RNA, 23 nt, Mycobacterium bovis subsp bovis AF2122/97
gcucgaccaggaacggcucggcc

SEQ ID NO: 3090204 - RNA, 15 nt, Mycobacterium bovis subsp bovis AF2122/97
gcucgaccaugccgu

SEQ ID NO: 3090205 - RNA, 22 nt, Mycobacterium bovis subsp bovis AF2122/97
gcucgaccaugccgucgucggc

SEQ ID NO: 3090206 - RNA, 18 nt, Mycobacterium bovis subsp bovis AF2122/97
gcucgaccugaggcaccu

SEQ ID NO: 3090207 - RNA, 19 nt, Mycobacterium bovis subsp bovis AF2122/97
gcucgacgaagaucgcgug

SEQ ID NO: 3090208 - RNA, 21 nt, Mycobacterium bovis subsp bovis AF2122/97
gcucgacgaagaucgcgugcc

SEQ ID NO: 3090209 - RNA, 20 nt, Mycobacterium bovis subsp bovis AF2122/97
gcucgacgacgggcgccaac

SEQ ID NO: 3090210 - RNA, 17 nt, Mycobacterium bovis subsp bovis AF2122/97
gcucgacgagcacgccg

SEQ ID NO: 3090211 - RNA, 15 nt, Mycobacterium bovis subsp bovis AF2122/97
gcucgacgaggccac

SEQ ID NO: 3090212 - RNA, 17 nt, Mycobacterium bovis subsp bovis AF2122/97
gcucgacgaggccacgg

SEQ ID NO: 3090213 - RNA, 20 nt, Mycobacterium bovis subsp bovis AF2122/97
gcucgacggcuccgauuccg

SEQ ID NO: 3090214 - RNA, 20 nt, Mycobacterium bovis subsp bovis AF2122/97
gcucgacguacagcgcggcg

SEQ ID NO: 3090215 - RNA, 22 nt, Mycobacterium bovis subsp bovis AF2122/97
gcucgagagcaugguccagcac

SEQ ID NO: 3090216 - RNA, 21 nt, Mycobacterium bovis subsp bovis AF2122/97
gcucgagcaccucggccucgu

SEQ ID NO: 3090217 - RNA, 17 nt, Mycobacterium bovis subsp bovis AF2122/97
gcucgagcagcgcgccg

SEQ ID NO: 3090218 - RNA, 14 nt, Mycobacterium bovis subsp bovis AF2122/97
gcucgagcucggcg

SEQ ID NO: 3090219 - RNA, 16 nt, Mycobacterium bovis subsp bovis AF2122/97
gcucgagcucggcgau

SEQ ID NO: 3090220 - RNA, 14 nt, Mycobacterium bovis subsp bovis AF2122/97
gcucgaggaccacc

SEQ ID NO: 3090221 - RNA, 13 nt, Mycobacterium bovis subsp bovis AF2122/97
gcucgaggcccgg

SEQ ID NO: 3090222 - RNA, 15 nt, Mycobacterium bovis subsp bovis AF2122/97
gcucgagguggucuc

SEQ ID NO: 3090223 - RNA, 17 nt, Mycobacterium bovis subsp bovis AF2122/97
gcucgagguggucucgg

SEQ ID NO: 3090224 - RNA, 14 nt, Mycobacterium bovis subsp bovis AF2122/97
gcucgagucgcagc

SEQ ID NO: 3090225 - RNA, 18 nt, Mycobacterium bovis subsp bovis AF2122/97
gcucgagucgcagcacgg

SEQ ID NO: 3090226 - RNA, 21 nt, Mycobacterium bovis subsp bovis AF2122/97
gcucgaguguggccgaaagcc

SEQ ID NO: 3090227 - RNA, 14 nt, Mycobacterium bovis subsp bovis AF2122/97
gcucgauacccagg

SEQ ID NO: 3090228 - RNA, 23 nt, Mycobacterium bovis subsp bovis AF2122/97
gcucgauaucguuggcgaccacc

SEQ ID NO: 3090229 - RNA, 16 nt, Mycobacterium bovis subsp bovis AF2122/97
gcucgaucacgccggc

SEQ ID NO: 3090230 - RNA, 20 nt, Mycobacterium bovis subsp bovis AF2122/97
gcucgaucacgccggccucg

SEQ ID NO: 3090231 - RNA, 23 nt, Mycobacterium bovis subsp bovis AF2122/97
gcucgaucacgccggccucgccg

SEQ ID NO: 3090232 - RNA, 16 nt, Mycobacterium bovis subsp bovis AF2122/97
gcucgaucacuagcgc

SEQ ID NO: 3090233 - RNA, 20 nt, Mycobacterium bovis subsp bovis AF2122/97
gcucgaucaucgggagccgc

SEQ ID NO: 3090234 - RNA, 14 nt, Mycobacterium bovis subsp bovis AF2122/97
gcucgauccgcaac

SEQ ID NO: 3090235 - RNA, 18 nt, Mycobacterium bovis subsp bovis AF2122/97
gcucgaucggcagccagg

SEQ ID NO: 3090236 - RNA, 20 nt, Mycobacterium bovis subsp bovis AF2122/97
gcucgaucugcccggugauc

SEQ ID NO: 3090237 - RNA, 14 nt, Mycobacterium bovis subsp bovis AF2122/97
gcucgaucugucgc

SEQ ID NO: 3090238 - RNA, 20 nt, Mycobacterium bovis subsp bovis AF2122/97
gcucgaucugucgcgccggu

SEQ ID NO: 3090239 - RNA, 13 nt, Mycobacterium bovis subsp bovis AF2122/97
gcucgaugccgug

SEQ ID NO: 3090240 - RNA, 20 nt, Mycobacterium bovis subsp bovis AF2122/97
gcucgauggcggccaccagc

SEQ ID NO: 3090241 - RNA, 21 nt, Mycobacterium bovis subsp bovis AF2122/97
gcucgauggcggccaccagcg

SEQ ID NO: 3090242 - RNA, 16 nt, Mycobacterium bovis subsp bovis AF2122/97
gcucgcaaucguuggc

SEQ ID NO: 3090243 - RNA, 17 nt, Mycobacterium bovis subsp bovis AF2122/97
gcucgcaaucguuggcc

SEQ ID NO: 3090244 - RNA, 14 nt, Mycobacterium bovis subsp bovis AF2122/97
gcucgcacagcacc

SEQ ID NO: 3090245 - RNA, 17 nt, Mycobacterium bovis subsp bovis AF2122/97
gcucgcacagcaccacg

SEQ ID NO: 3090246 - RNA, 12 nt, Mycobacterium bovis subsp bovis AF2122/97
gcucgcacagcc

SEQ ID NO: 3090247 - RNA, 22 nt, Mycobacterium bovis subsp bovis AF2122/97
gcucgcacccgcucggcgcgcg

SEQ ID NO: 3090248 - RNA, 13 nt, Mycobacterium bovis subsp bovis AF2122/97
gcucgcaccgccc

SEQ ID NO: 3090249 - RNA, 17 nt, Mycobacterium bovis subsp bovis AF2122/97
gcucgcagccacgcaaa

SEQ ID NO: 3090250 - RNA, 18 nt, Mycobacterium bovis subsp bovis AF2122/97
gcucgcaggccggcggcg

SEQ ID NO: 3090251 - RNA, 13 nt, Mycobacterium bovis subsp bovis AF2122/97
gcucgcaucaucg

SEQ ID NO: 3090252 - RNA, 19 nt, Mycobacterium bovis subsp bovis AF2122/97
gcucgcauguucuccacgc

SEQ ID NO: 3090253 - RNA, 22 nt, Mycobacterium bovis subsp bovis AF2122/97
gcucgcauguucuccacgccga

SEQ ID NO: 3090254 - RNA, 17 nt, Mycobacterium bovis subsp bovis AF2122/97
gcucgcauucggcgagc

SEQ ID NO: 3090255 - RNA, 13 nt, Mycobacterium bovis subsp bovis AF2122/97
gcucgccaccucg

SEQ ID NO: 3090256 - RNA, 14 nt, Mycobacterium bovis subsp bovis AF2122/97
gcucgccagccggc

SEQ ID NO: 3090257 - RNA, 22 nt, Mycobacterium bovis subsp bovis AF2122/97
gcucgccaggcaagccagcacu

SEQ ID NO: 3090258 - RNA, 23 nt, Mycobacterium bovis subsp bovis AF2122/97
gcucgccaggcaagccagcacug

SEQ ID NO: 3090259 - RNA, 12 nt, Mycobacterium bovis subsp bovis AF2122/97
gcucgccaggcc

SEQ ID NO: 3090260 - RNA, 19 nt, Mycobacterium bovis subsp bovis AF2122/97
gcucgccaguucgcgccac

SEQ ID NO: 3090261 - RNA, 22 nt, Mycobacterium bovis subsp bovis AF2122/97
gcucgcccaggaagccgagacc

SEQ ID NO: 3090262 - RNA, 16 nt, Mycobacterium bovis subsp bovis AF2122/97
gcucgcccgccgccac

SEQ ID NO: 3090263 - RNA, 17 nt, Mycobacterium bovis subsp bovis AF2122/97
gcucgcccgccgccacc

SEQ ID NO: 3090264 - RNA, 15 nt, Mycobacterium bovis subsp bovis AF2122/97
gcucgcccgcggccg

SEQ ID NO: 3090265 - RNA, 18 nt, Mycobacterium bovis subsp bovis AF2122/97
gcucgcccuauacgcaac

SEQ ID NO: 3090266 - RNA, 15 nt, Mycobacterium bovis subsp bovis AF2122/97
gcucgccgaccagcu

SEQ ID NO: 3090267 - RNA, 23 nt, Mycobacterium bovis subsp bovis AF2122/97
gcucgccgagcagacacagaauc

SEQ ID NO: 3090268 - RNA, 14 nt, Mycobacterium bovis subsp bovis AF2122/97
gcucgccgagcucg

SEQ ID NO: 3090269 - RNA, 15 nt, Mycobacterium bovis subsp bovis AF2122/97
gcucgccgagcugug

SEQ ID NO: 3090270 - RNA, 11 nt, Mycobacterium bovis subsp bovis AF2122/97
gcucgccgagg

SEQ ID NO: 3090271 - RNA, 14 nt, Mycobacterium bovis subsp bovis AF2122/97
gcucgccggccaac

SEQ ID NO: 3090272 - RNA, 18 nt, Mycobacterium bovis subsp bovis AF2122/97
gcucgccggccaacuggg

SEQ ID NO: 3090273 - RNA, 13 nt, Mycobacterium bovis subsp bovis AF2122/97
gcucgccggccgg

SEQ ID NO: 3090274 - RNA, 13 nt, Mycobacterium bovis subsp bovis AF2122/97
gcucgccggcgaa

SEQ ID NO: 3090275 - RNA, 14 nt, Mycobacterium bovis subsp bovis AF2122/97
gcucgccggcgacc

SEQ ID NO: 3090276 - RNA, 15 nt, Mycobacterium bovis subsp bovis AF2122/97
gcucgccggcgaccg

SEQ ID NO: 3090277 - RNA, 17 nt, Mycobacterium bovis subsp bovis AF2122/97
gcucgccggcggcccgc

SEQ ID NO: 3090278 - RNA, 16 nt, Mycobacterium bovis subsp bovis AF2122/97
gcucgccggcucggcg

SEQ ID NO: 3090279 - RNA, 20 nt, Mycobacterium bovis subsp bovis AF2122/97
gcucgccggcucggcgguac

SEQ ID NO: 3090280 - RNA, 14 nt, Mycobacterium bovis subsp bovis AF2122/97
gcucgccgggcagc

SEQ ID NO: 3090281 - RNA, 16 nt, Mycobacterium bovis subsp bovis AF2122/97
gcucgccgggucagcc

SEQ ID NO: 3090282 - RNA, 22 nt, Mycobacterium bovis subsp bovis AF2122/97
gcucgccgggucagcccggcgc

SEQ ID NO: 3090283 - RNA, 18 nt, Mycobacterium bovis subsp bovis AF2122/97
gcucgccgguaggcggcc

SEQ ID NO: 3090284 - RNA, 20 nt, Mycobacterium bovis subsp bovis AF2122/97
gcucgccgguaggcggccag

SEQ ID NO: 3090285 - RNA, 21 nt, Mycobacterium bovis subsp bovis AF2122/97
gcucgccgguaggcggccagc

SEQ ID NO: 3090286 - RNA, 22 nt, Mycobacterium bovis subsp bovis AF2122/97
gcucgccgguaggcggccagcg

SEQ ID NO: 3090287 - RNA, 19 nt, Mycobacterium bovis subsp bovis AF2122/97
gcucgccgguguccuuggc

SEQ ID NO: 3090288 - RNA, 18 nt, Mycobacterium bovis subsp bovis AF2122/97
gcucgccguaagcaccag

SEQ ID NO: 3090289 - RNA, 21 nt, Mycobacterium bovis subsp bovis AF2122/97
gcucgccguaagcaccagcca

SEQ ID NO: 3090290 - RNA, 23 nt, Mycobacterium bovis subsp bovis AF2122/97
gcucgccguaagcaccagccagc

SEQ ID NO: 3090291 - RNA, 13 nt, Mycobacterium bovis subsp bovis AF2122/97
gcucgccgugacc

SEQ ID NO: 3090292 - RNA, 17 nt, Mycobacterium bovis subsp bovis AF2122/97
gcucgccgugaccaggu

SEQ ID NO: 3090293 - RNA, 19 nt, Mycobacterium bovis subsp bovis AF2122/97
gcucgccuaucgacucagu

SEQ ID NO: 3090294 - RNA, 21 nt, Mycobacterium bovis subsp bovis AF2122/97
gcucgccuaucgacucaguca

SEQ ID NO: 3090295 - RNA, 17 nt, Mycobacterium bovis subsp bovis AF2122/97
gcucgccucgauggcgu

SEQ ID NO: 3090296 - RNA, 19 nt, Mycobacterium bovis subsp bovis AF2122/97
gcucgccucgauggcguag

SEQ ID NO: 3090297 - RNA, 14 nt, Mycobacterium bovis subsp bovis AF2122/97
gcucgcgaagccgg

SEQ ID NO: 3090298 - RNA, 15 nt, Mycobacterium bovis subsp bovis AF2122/97
gcucgcgaucgcagu

SEQ ID NO: 3090299 - RNA, 20 nt, Mycobacterium bovis subsp bovis AF2122/97
gcucgcgcaagcggacccga

SEQ ID NO: 3090300 - RNA, 17 nt, Mycobacterium bovis subsp bovis AF2122/97
gcucgcgcaaggcgccg

SEQ ID NO: 3090301 - RNA, 18 nt, Mycobacterium bovis subsp bovis AF2122/97
gcucgcgcaaggcgccgc

SEQ ID NO: 3090302 - RNA, 21 nt, Mycobacterium bovis subsp bovis AF2122/97
gcucgcgcaaggcgccgcagg

SEQ ID NO: 3090303 - RNA, 19 nt, Mycobacterium bovis subsp bovis AF2122/97
gcucgcgcacccagcccag

SEQ ID NO: 3090304 - RNA, 14 nt, Mycobacterium bovis subsp bovis AF2122/97
gcucgcgcccgcua

SEQ ID NO: 3090305 - RNA, 14 nt, Mycobacterium bovis subsp bovis AF2122/97
gcucgcgccgguga

SEQ ID NO: 3090306 - RNA, 21 nt, Mycobacterium bovis subsp bovis AF2122/97
gcucgcgccggugaggcgacc

SEQ ID NO: 3090307 - RNA, 15 nt, Mycobacterium bovis subsp bovis AF2122/97
gcucgcgcgcugggc

SEQ ID NO: 3090308 - RNA, 16 nt, Mycobacterium bovis subsp bovis AF2122/97
gcucgcgcgcugggcg

SEQ ID NO: 3090309 - RNA, 15 nt, Mycobacterium bovis subsp bovis AF2122/97
gcucgcgcucgaugg

SEQ ID NO: 3090310 - RNA, 13 nt, Mycobacterium bovis subsp bovis AF2122/97
gcucgcgcucgcu

SEQ ID NO: 3090311 - RNA, 21 nt, Mycobacterium bovis subsp bovis AF2122/97
gcucgcgcucgcucacgccgu

SEQ ID NO: 3090312 - RNA, 20 nt, Mycobacterium bovis subsp bovis AF2122/97
gcucgcgcucguuagcggcg

SEQ ID NO: 3090313 - RNA, 14 nt, Mycobacterium bovis subsp bovis AF2122/97
gcucgcggcgcagg

SEQ ID NO: 3090314 - RNA, 17 nt, Mycobacterium bovis subsp bovis AF2122/97
gcucgcggcggcgcugg

SEQ ID NO: 3090315 - RNA, 21 nt, Mycobacterium bovis subsp bovis AF2122/97
gcucgcggcuucaguccggcc

SEQ ID NO: 3090316 - RNA, 13 nt, Mycobacterium bovis subsp bovis AF2122/97
gcucgcggucaug

SEQ ID NO: 3090317 - RNA, 21 nt, Mycobacterium bovis subsp bovis AF2122/97
gcucgcgguuuuggucgcgau

SEQ ID NO: 3090318 - RNA, 23 nt, Mycobacterium bovis subsp bovis AF2122/97
gcucgcgguuuuggucgcgauga

SEQ ID NO: 3090319 - RNA, 15 nt, Mycobacterium bovis subsp bovis AF2122/97
gcucgcguggccgcc

SEQ ID NO: 3090320 - RNA, 19 nt, Mycobacterium bovis subsp bovis AF2122/97
gcucgcguggccgccggcg

SEQ ID NO: 3090321 - RNA, 15 nt, Mycobacterium bovis subsp bovis AF2122/97
gcucgcucaccggcg

SEQ ID NO: 3090322 - RNA, 16 nt, Mycobacterium bovis subsp bovis AF2122/97
gcucgcucaccggcug

SEQ ID NO: 3090323 - RNA, 16 nt, Mycobacterium bovis subsp bovis AF2122/97
gcucgcucugcgcggc

SEQ ID NO: 3090324 - RNA, 14 nt, Mycobacterium bovis subsp bovis AF2122/97
gcucgcugacggca

SEQ ID NO: 3090325 - RNA, 22 nt, Mycobacterium bovis subsp bovis AF2122/97
gcucgcugauaguggcgcgcgg

SEQ ID NO: 3090326 - RNA, 20 nt, Mycobacterium bovis subsp bovis AF2122/97
gcucgcugaucuggggcacc

SEQ ID NO: 3090327 - RNA, 21 nt, Mycobacterium bovis subsp bovis AF2122/97
gcucgcugaucuggggcacca

SEQ ID NO: 3090328 - RNA, 15 nt, Mycobacterium bovis subsp bovis AF2122/97
gcucgcugcaccagc

SEQ ID NO: 3090329 - RNA, 18 nt, Mycobacterium bovis subsp bovis AF2122/97
gcucgcugcaccagcugc

SEQ ID NO: 3090330 - RNA, 14 nt, Mycobacterium bovis subsp bovis AF2122/97
gcucgcugcgcgcc

SEQ ID NO: 3090331 - RNA, 23 nt, Mycobacterium bovis subsp bovis AF2122/97
gcucgcugcgcgcccaccgggcg

SEQ ID NO: 3090332 - RNA, 21 nt, Mycobacterium bovis subsp bovis AF2122/97
gcucggaguugagcugucgca

SEQ ID NO: 3090333 - RNA, 14 nt, Mycobacterium bovis subsp bovis AF2122/97
gcucggauccggcc

SEQ ID NO: 3090334 - RNA, 13 nt, Mycobacterium bovis subsp bovis AF2122/97
gcucggaucggcu

SEQ ID NO: 3090335 - RNA, 16 nt, Mycobacterium bovis subsp bovis AF2122/97
gcucggcacccgccgg

SEQ ID NO: 3090336 - RNA, 22 nt, Mycobacterium bovis subsp bovis AF2122/97
gcucggcagcaucuccgucggc

SEQ ID NO: 3090337 - RNA, 18 nt, Mycobacterium bovis subsp bovis AF2122/97
gcucggcaugagucgaac

SEQ ID NO: 3090338 - RNA, 19 nt, Mycobacterium bovis subsp bovis AF2122/97
gcucggcaugagucgaacc

SEQ ID NO: 3090339 - RNA, 22 nt, Mycobacterium bovis subsp bovis AF2122/97
gcucggccagaaagaucgguug

SEQ ID NO: 3090340 - RNA, 13 nt, Mycobacterium bovis subsp bovis AF2122/97
gcucggccagcac

SEQ ID NO: 3090341 - RNA, 17 nt, Mycobacterium bovis subsp bovis AF2122/97
gcucggccagcacgccg

SEQ ID NO: 3090342 - RNA, 21 nt, Mycobacterium bovis subsp bovis AF2122/97
gcucggccagcacgccgccgg

SEQ ID NO: 3090343 - RNA, 17 nt, Mycobacterium bovis subsp bovis AF2122/97
gcucggccaggcuggcc

SEQ ID NO: 3090344 - RNA, 23 nt, Mycobacterium bovis subsp bovis AF2122/97
gcucggccaggcuggccaacuug

SEQ ID NO: 3090345 - RNA, 15 nt, Mycobacterium bovis subsp bovis AF2122/97
gcucggccauagcgc

SEQ ID NO: 3090346 - RNA, 21 nt, Mycobacterium bovis subsp bovis AF2122/97
gcucggccauagcgccgcgcc

SEQ ID NO: 3090347 - RNA, 21 nt, Mycobacterium bovis subsp bovis AF2122/97
gcucggccaucagaaccuccu

SEQ ID NO: 3090348 - RNA, 14 nt, Mycobacterium bovis subsp bovis AF2122/97
gcucggcccagcgc

SEQ ID NO: 3090349 - RNA, 17 nt, Mycobacterium bovis subsp bovis AF2122/97
gcucggcccagcgcgcc

SEQ ID NO: 3090350 - RNA, 15 nt, Mycobacterium bovis subsp bovis AF2122/97
gcucggcccccgaga

SEQ ID NO: 3090351 - RNA, 13 nt, Mycobacterium bovis subsp bovis AF2122/97
gcucggccccgcc

SEQ ID NO: 3090352 - RNA, 18 nt, Mycobacterium bovis subsp bovis AF2122/97
gcucggccccgccgccgg

SEQ ID NO: 3090353 - RNA, 21 nt, Mycobacterium bovis subsp bovis AF2122/97
gcucggccccgccgccggugc

SEQ ID NO: 3090354 - RNA, 23 nt, Mycobacterium bovis subsp bovis AF2122/97
gcucggccccgccgccggugcgg

SEQ ID NO: 3090355 - RNA, 18 nt, Mycobacterium bovis subsp bovis AF2122/97
gcucggcccuguucggcc

SEQ ID NO: 3090356 - RNA, 17 nt, Mycobacterium bovis subsp bovis AF2122/97
gcucggccgaggcgguc

SEQ ID NO: 3090357 - RNA, 14 nt, Mycobacterium bovis subsp bovis AF2122/97
gcucggccgaugcg

SEQ ID NO: 3090358 - RNA, 19 nt, Mycobacterium bovis subsp bovis AF2122/97
gcucggccgaugcgcagug

SEQ ID NO: 3090359 - RNA, 14 nt, Mycobacterium bovis subsp bovis AF2122/97
gcucggccgcagcc

SEQ ID NO: 3090360 - RNA, 22 nt, Mycobacterium bovis subsp bovis AF2122/97
gcucggccgcagccagcgguag

SEQ ID NO: 3090361 - RNA, 16 nt, Mycobacterium bovis subsp bovis AF2122/97
gcucggccgccggguc

SEQ ID NO: 3090362 - RNA, 21 nt, Mycobacterium bovis subsp bovis AF2122/97
gcucggccgucaggguguugc

SEQ ID NO: 3090363 - RNA, 16 nt, Mycobacterium bovis subsp bovis AF2122/97
gcucggccuguucggc

SEQ ID NO: 3090364 - RNA, 20 nt, Mycobacterium bovis subsp bovis AF2122/97
gcucggccuguucggcggcu

SEQ ID NO: 3090365 - RNA, 16 nt, Mycobacterium bovis subsp bovis AF2122/97
gcucggcgaaacccgg

SEQ ID NO: 3090366 - RNA, 18 nt, Mycobacterium bovis subsp bovis AF2122/97
gcucggcgaaacccggga

SEQ ID NO: 3090367 - RNA, 21 nt, Mycobacterium bovis subsp bovis AF2122/97
gcucggcgaaacccgggauca

SEQ ID NO: 3090368 - RNA, 19 nt, Mycobacterium bovis subsp bovis AF2122/97
gcucggcgaaggccgcgcg

SEQ ID NO: 3090369 - RNA, 12 nt, Mycobacterium bovis subsp bovis AF2122/97
gcucggcgagcg

SEQ ID NO: 3090370 - RNA, 20 nt, Mycobacterium bovis subsp bovis AF2122/97
gcucggcgagcucagugacc

SEQ ID NO: 3090371 - RNA, 16 nt, Mycobacterium bovis subsp bovis AF2122/97
gcucggcgaguucggc

SEQ ID NO: 3090372 - RNA, 10 nt, Mycobacterium bovis subsp bovis AF2122/97
gcucggcgau

SEQ ID NO: 3090373 - RNA, 18 nt, Mycobacterium bovis subsp bovis AF2122/97
gcucggcgaugcugagcc

SEQ ID NO: 3090374 - RNA, 18 nt, Mycobacterium bovis subsp bovis AF2122/97
gcucggcgcagcacaucc

SEQ ID NO: 3090375 - RNA, 17 nt, Mycobacterium bovis subsp bovis AF2122/97
gcucggcgccguuuggc

SEQ ID NO: 3090376 - RNA, 14 nt, Mycobacterium bovis subsp bovis AF2122/97
gcucggcgcgccgg

SEQ ID NO: 3090377 - RNA, 21 nt, Mycobacterium bovis subsp bovis AF2122/97
gcucggcgcgccggucgccga

SEQ ID NO: 3090378 - RNA, 22 nt, Mycobacterium bovis subsp bovis AF2122/97
gcucggcgcgguggggcgcgcc

SEQ ID NO: 3090379 - RNA, 14 nt, Mycobacterium bovis subsp bovis AF2122/97
gcucggcgcugacu

SEQ ID NO: 3090380 - RNA, 22 nt, Mycobacterium bovis subsp bovis AF2122/97
gcucggcggagaaaagcgcgcu

SEQ ID NO: 3090381 - RNA, 15 nt, Mycobacterium bovis subsp bovis AF2122/97
gcucggcggcagcgg

SEQ ID NO: 3090382 - RNA, 17 nt, Mycobacterium bovis subsp bovis AF2122/97
gcucggcggcagcggcg

SEQ ID NO: 3090383 - RNA, 14 nt, Mycobacterium bovis subsp bovis AF2122/97
gcucggcggcccgg

SEQ ID NO: 3090384 - RNA, 15 nt, Mycobacterium bovis subsp bovis AF2122/97
gcucggcggcccggc

SEQ ID NO: 3090385 - RNA, 17 nt, Mycobacterium bovis subsp bovis AF2122/97
gcucggcggcgcgugcg

SEQ ID NO: 3090386 - RNA, 21 nt, Mycobacterium bovis subsp bovis AF2122/97
gcucggcggguauauggugcg

SEQ ID NO: 3090387 - RNA, 15 nt, Mycobacterium bovis subsp bovis AF2122/97
gcucggcgguacaca

SEQ ID NO: 3090388 - RNA, 13 nt, Mycobacterium bovis subsp bovis AF2122/97
gcucggcggugca

SEQ ID NO: 3090389 - RNA, 16 nt, Mycobacterium bovis subsp bovis AF2122/97
gcucggcggugcagug

SEQ ID NO: 3090390 - RNA, 18 nt, Mycobacterium bovis subsp bovis AF2122/97
gcucggcggugccgcggc

SEQ ID NO: 3090391 - RNA, 19 nt, Mycobacterium bovis subsp bovis AF2122/97
gcucggcggugccgcggcu

SEQ ID NO: 3090392 - RNA, 14 nt, Mycobacterium bovis subsp bovis AF2122/97
gcucggcguccgcc

SEQ ID NO: 3090393 - RNA, 15 nt, Mycobacterium bovis subsp bovis AF2122/97
gcucggcgucgccgc

SEQ ID NO: 3090394 - RNA, 17 nt, Mycobacterium bovis subsp bovis AF2122/97
gcucggcgucgccgcca

SEQ ID NO: 3090395 - RNA, 17 nt, Mycobacterium bovis subsp bovis AF2122/97
gcucggcgugcucggcc

SEQ ID NO: 3090396 - RNA, 14 nt, Mycobacterium bovis subsp bovis AF2122/97
gcucggcgugucgg

SEQ ID NO: 3090397 - RNA, 15 nt, Mycobacterium bovis subsp bovis AF2122/97
gcucggcgugucggg

SEQ ID NO: 3090398 - RNA, 15 nt, Mycobacterium bovis subsp bovis AF2122/97
gcucggcugcucgac

SEQ ID NO: 3090399 - RNA, 17 nt, Mycobacterium bovis subsp bovis AF2122/97
gcucggcugcucgacgg

SEQ ID NO: 3090400 - RNA, 18 nt, Mycobacterium bovis subsp bovis AF2122/97
gcucgggaacuucgccga

SEQ ID NO: 3090401 - RNA, 21 nt, Mycobacterium bovis subsp bovis AF2122/97
gcucgggaacuucgccgaagc

SEQ ID NO: 3090402 - RNA, 16 nt, Mycobacterium bovis subsp bovis AF2122/97
gcucgggcaaggccac

SEQ ID NO: 3090403 - RNA, 22 nt, Mycobacterium bovis subsp bovis AF2122/97
gcucgggcaaggccaccggcgg

SEQ ID NO: 3090404 - RNA, 14 nt, Mycobacterium bovis subsp bovis AF2122/97
gcucgggcgcacgg

SEQ ID NO: 3090405 - RNA, 17 nt, Mycobacterium bovis subsp bovis AF2122/97
gcucgggcgcacggucc

SEQ ID NO: 3090406 - RNA, 16 nt, Mycobacterium bovis subsp bovis AF2122/97
gcucgggcgugauccc

SEQ ID NO: 3090407 - RNA, 14 nt, Mycobacterium bovis subsp bovis AF2122/97
gcucgggcugccgc

SEQ ID NO: 3090408 - RNA, 22 nt, Mycobacterium bovis subsp bovis AF2122/97
gcucggggcgaugagccugcag

SEQ ID NO: 3090409 - RNA, 13 nt, Mycobacterium bovis subsp bovis AF2122/97
gcucgggggccga

SEQ ID NO: 3090410 - RNA, 20 nt, Mycobacterium bovis subsp bovis AF2122/97
gcucgguaagugccucgcgg

SEQ ID NO: 3090411 - RNA, 21 nt, Mycobacterium bovis subsp bovis AF2122/97
gcucgguaccaaagcugucga

SEQ ID NO: 3090412 - RNA, 16 nt, Mycobacterium bovis subsp bovis AF2122/97
gcucggucaccacggc

SEQ ID NO: 3090413 - RNA, 18 nt, Mycobacterium bovis subsp bovis AF2122/97
gcucggucaccacggcgg

SEQ ID NO: 3090414 - RNA, 15 nt, Mycobacterium bovis subsp bovis AF2122/97
gcucggucaggcggc

SEQ ID NO: 3090415 - RNA, 16 nt, Mycobacterium bovis subsp bovis AF2122/97
gcucgguccagccggu

SEQ ID NO: 3090416 - RNA, 22 nt, Mycobacterium bovis subsp bovis AF2122/97
gcucgguccagccgguccagac

SEQ ID NO: 3090417 - RNA, 17 nt, Mycobacterium bovis subsp bovis AF2122/97
gcucgguccccgcagcu

SEQ ID NO: 3090418 - RNA, 16 nt, Mycobacterium bovis subsp bovis AF2122/97
gcucggucgccaccgc

SEQ ID NO: 3090419 - RNA, 18 nt, Mycobacterium bovis subsp bovis AF2122/97
gcucggucgccaccgccg

SEQ ID NO: 3090420 - RNA, 14 nt, Mycobacterium bovis subsp bovis AF2122/97
gcucggucuccacc

SEQ ID NO: 3090421 - RNA, 17 nt, Mycobacterium bovis subsp bovis AF2122/97
gcucggucuccaccacc

SEQ ID NO: 3090422 - RNA, 18 nt, Mycobacterium bovis subsp bovis AF2122/97
gcucggucuccaccaccg

SEQ ID NO: 3090423 - RNA, 14 nt, Mycobacterium bovis subsp bovis AF2122/97
gcucggugaccccc

SEQ ID NO: 3090424 - RNA, 14 nt, Mycobacterium bovis subsp bovis AF2122/97
gcucggugacguag

SEQ ID NO: 3090425 - RNA, 16 nt, Mycobacterium bovis subsp bovis AF2122/97
gcucggugagccucuu

SEQ ID NO: 3090426 - RNA, 21 nt, Mycobacterium bovis subsp bovis AF2122/97
gcucggugaucaccaugauca

SEQ ID NO: 3090427 - RNA, 19 nt, Mycobacterium bovis subsp bovis AF2122/97
gcucggugaugcccagcgc

SEQ ID NO: 3090428 - RNA, 20 nt, Mycobacterium bovis subsp bovis AF2122/97
gcucggugaugcccagcgcc

SEQ ID NO: 3090429 - RNA, 22 nt, Mycobacterium bovis subsp bovis AF2122/97
gcucggugaugcccagcgccga

SEQ ID NO: 3090430 - RNA, 15 nt, Mycobacterium bovis subsp bovis AF2122/97
gcucggugcacggcg

SEQ ID NO: 3090431 - RNA, 16 nt, Mycobacterium bovis subsp bovis AF2122/97
gcucggugcacggcgc

SEQ ID NO: 3090432 - RNA, 17 nt, Mycobacterium bovis subsp bovis AF2122/97
gcucggugcacggcgcu

SEQ ID NO: 3090433 - RNA, 11 nt, Mycobacterium bovis subsp bovis AF2122/97
gcucggugcgc

SEQ ID NO: 3090434 - RNA, 15 nt, Mycobacterium bovis subsp bovis AF2122/97
gcucggugcgccaga

SEQ ID NO: 3090435 - RNA, 19 nt, Mycobacterium bovis subsp bovis AF2122/97
gcucggugcugcgccgaua

SEQ ID NO: 3090436 - RNA, 20 nt, Mycobacterium bovis subsp bovis AF2122/97
gcucggugcugcgccgauac

SEQ ID NO: 3090437 - RNA, 21 nt, Mycobacterium bovis subsp bovis AF2122/97
gcucggugcuguugcgcgguc

SEQ ID NO: 3090438 - RNA, 22 nt, Mycobacterium bovis subsp bovis AF2122/97
gcucggugcuguugcgcggucg

SEQ ID NO: 3090439 - RNA, 19 nt, Mycobacterium bovis subsp bovis AF2122/97
gcucgguggcgccggggcg

SEQ ID NO: 3090440 - RNA, 18 nt, Mycobacterium bovis subsp bovis AF2122/97
gcucgguggcggacggcg

SEQ ID NO: 3090441 - RNA, 18 nt, Mycobacterium bovis subsp bovis AF2122/97
gcucgguuugcguccugg

SEQ ID NO: 3090442 - RNA, 20 nt, Mycobacterium bovis subsp bovis AF2122/97
gcucgguuugcguccuggug

SEQ ID NO: 3090443 - RNA, 17 nt, Mycobacterium bovis subsp bovis AF2122/97
gcucguagacuugcugc

SEQ ID NO: 3090444 - RNA, 14 nt, Mycobacterium bovis subsp bovis AF2122/97
gcucguagcccagg

SEQ ID NO: 3090445 - RNA, 17 nt, Mycobacterium bovis subsp bovis AF2122/97
gcucguagcggcggcgc

SEQ ID NO: 3090446 - RNA, 14 nt, Mycobacterium bovis subsp bovis AF2122/97
gcucguagcuggug

SEQ ID NO: 3090447 - RNA, 21 nt, Mycobacterium bovis subsp bovis AF2122/97
gcucgucacgugucccgcaug

SEQ ID NO: 3090448 - RNA, 17 nt, Mycobacterium bovis subsp bovis AF2122/97
gcucgucauccauccgg

SEQ ID NO: 3090449 - RNA, 20 nt, Mycobacterium bovis subsp bovis AF2122/97
gcucgucauccauccgggcc

SEQ ID NO: 3090450 - RNA, 19 nt, Mycobacterium bovis subsp bovis AF2122/97
gcucguccaccccgauccg

SEQ ID NO: 3090451 - RNA, 23 nt, Mycobacterium bovis subsp bovis AF2122/97
gcucguccaccccgauccgccac

SEQ ID NO: 3090452 - RNA, 12 nt, Mycobacterium bovis subsp bovis AF2122/97
gcucguccagca

SEQ ID NO: 3090453 - RNA, 14 nt, Mycobacterium bovis subsp bovis AF2122/97
gcucguccagcaac

SEQ ID NO: 3090454 - RNA, 20 nt, Mycobacterium bovis subsp bovis AF2122/97
gcucguccaggucggccgcc

SEQ ID NO: 3090455 - RNA, 23 nt, Mycobacterium bovis subsp bovis AF2122/97
gcucguccgggcagaugaugccg

SEQ ID NO: 3090456 - RNA, 23 nt, Mycobacterium bovis subsp bovis AF2122/97
gcucguccggguuuugcgcggcc

SEQ ID NO: 3090457 - RNA, 14 nt, Mycobacterium bovis subsp bovis AF2122/97
gcucguccucgucu

SEQ ID NO: 3090458 - RNA, 22 nt, Mycobacterium bovis subsp bovis AF2122/97
gcucguccucgucuucgucggu

SEQ ID NO: 3090459 - RNA, 18 nt, Mycobacterium bovis subsp bovis AF2122/97
gcucgucgaacauggcac

SEQ ID NO: 3090460 - RNA, 14 nt, Mycobacterium bovis subsp bovis AF2122/97
gcucgucgagcaug

SEQ ID NO: 3090461 - RNA, 18 nt, Mycobacterium bovis subsp bovis AF2122/97
gcucgucgagccgaccgc

SEQ ID NO: 3090462 - RNA, 15 nt, Mycobacterium bovis subsp bovis AF2122/97
gcucgucgagcgcgu

SEQ ID NO: 3090463 - RNA, 19 nt, Mycobacterium bovis subsp bovis AF2122/97
gcucgucgagcgcgucggu

SEQ ID NO: 3090464 - RNA, 22 nt, Mycobacterium bovis subsp bovis AF2122/97
gcucgucgagcgcgucggucac

SEQ ID NO: 3090465 - RNA, 13 nt, Mycobacterium bovis subsp bovis AF2122/97
gcucgucgagcug

SEQ ID NO: 3090466 - RNA, 18 nt, Mycobacterium bovis subsp bovis AF2122/97
gcucgucgaguggaucac

SEQ ID NO: 3090467 - RNA, 15 nt, Mycobacterium bovis subsp bovis AF2122/97
gcucgucgauccccg

SEQ ID NO: 3090468 - RNA, 23 nt, Mycobacterium bovis subsp bovis AF2122/97
gcucgucgaugucgacgucgcgu

SEQ ID NO: 3090469 - RNA, 14 nt, Mycobacterium bovis subsp bovis AF2122/97
gcucgucgccggug

SEQ ID NO: 3090470 - RNA, 14 nt, Mycobacterium bovis subsp bovis AF2122/97
gcucgucgcggccc

SEQ ID NO: 3090471 - RNA, 23 nt, Mycobacterium bovis subsp bovis AF2122/97
gcucgucgcugaacagacggcuc

SEQ ID NO: 3090472 - RNA, 15 nt, Mycobacterium bovis subsp bovis AF2122/97
gcucgucggccaccg

SEQ ID NO: 3090473 - RNA, 14 nt, Mycobacterium bovis subsp bovis AF2122/97
gcucgucggcgaug

SEQ ID NO: 3090474 - RNA, 21 nt, Mycobacterium bovis subsp bovis AF2122/97
gcucgucggcgauggccagca

SEQ ID NO: 3090475 - RNA, 13 nt, Mycobacterium bovis subsp bovis AF2122/97
gcucgucggcgcc

SEQ ID NO: 3090476 - RNA, 15 nt, Mycobacterium bovis subsp bovis AF2122/97
gcucgucggcgccgg

SEQ ID NO: 3090477 - RNA, 17 nt, Mycobacterium bovis subsp bovis AF2122/97
gcucgucggcgccggcg

SEQ ID NO: 3090478 - RNA, 19 nt, Mycobacterium bovis subsp bovis AF2122/97
gcucgucggcgccggcggc

SEQ ID NO: 3090479 - RNA, 20 nt, Mycobacterium bovis subsp bovis AF2122/97
gcucgucggcgccggcggcc

SEQ ID NO: 3090480 - RNA, 14 nt, Mycobacterium bovis subsp bovis AF2122/97
gcucgucggucacc

SEQ ID NO: 3090481 - RNA, 15 nt, Mycobacterium bovis subsp bovis AF2122/97
gcucgucggucaccg

SEQ ID NO: 3090482 - RNA, 14 nt, Mycobacterium bovis subsp bovis AF2122/97
gcucgucguccggc

SEQ ID NO: 3090483 - RNA, 19 nt, Mycobacterium bovis subsp bovis AF2122/97
gcucgucguccggccacgg

SEQ ID NO: 3090484 - RNA, 20 nt, Mycobacterium bovis subsp bovis AF2122/97
gcucgucgucgauccagccc

SEQ ID NO: 3090485 - RNA, 15 nt, Mycobacterium bovis subsp bovis AF2122/97
gcucgucgucggcgu

SEQ ID NO: 3090486 - RNA, 22 nt, Mycobacterium bovis subsp bovis AF2122/97
gcucgucuaccccgagccuuga

SEQ ID NO: 3090487 - RNA, 18 nt, Mycobacterium bovis subsp bovis AF2122/97
gcucgucuuggcggcggu

SEQ ID NO: 3090488 - RNA, 19 nt, Mycobacterium bovis subsp bovis AF2122/97
gcucgucuuggcggcggug

SEQ ID NO: 3090489 - RNA, 15 nt, Mycobacterium bovis subsp bovis AF2122/97
gcucgucuugggccg

SEQ ID NO: 3090490 - RNA, 20 nt, Mycobacterium bovis subsp bovis AF2122/97
gcucgucuugggccgggaug

SEQ ID NO: 3090491 - RNA, 16 nt, Mycobacterium bovis subsp bovis AF2122/97
gcucgugagccccagc

SEQ ID NO: 3090492 - RNA, 19 nt, Mycobacterium bovis subsp bovis AF2122/97
gcucgugagccccagcgac

SEQ ID NO: 3090493 - RNA, 20 nt, Mycobacterium bovis subsp bovis AF2122/97
gcucgugagccccagcgacg

SEQ ID NO: 3090494 - RNA, 22 nt, Mycobacterium bovis subsp bovis AF2122/97
gcucgugcgcuuggucgaccgc

SEQ ID NO: 3090495 - RNA, 15 nt, Mycobacterium bovis subsp bovis AF2122/97
gcucguggcgacggc

SEQ ID NO: 3090496 - RNA, 21 nt, Mycobacterium bovis subsp bovis AF2122/97
gcucguggcgacggcgucgau

SEQ ID NO: 3090497 - RNA, 21 nt, Mycobacterium bovis subsp bovis AF2122/97
gcucguggucgacgugaucgc

SEQ ID NO: 3090498 - RNA, 15 nt, Mycobacterium bovis subsp bovis AF2122/97
gcucguguccgccgu

SEQ ID NO: 3090499 - RNA, 21 nt, Mycobacterium bovis subsp bovis AF2122/97
gcucguguuguugaagcccga

SEQ ID NO: 3090500 - RNA, 19 nt, Mycobacterium bovis subsp bovis AF2122/97
gcucguugcgggcgggaac

SEQ ID NO: 3090501 - RNA, 12 nt, Mycobacterium bovis subsp bovis AF2122/97
gcucguugcguu

SEQ ID NO: 3090502 - RNA, 16 nt, Mycobacterium bovis subsp bovis AF2122/97
gcucguuugcgagcag

SEQ ID NO: 3090503 - RNA, 18 nt, Mycobacterium bovis subsp bovis AF2122/97
gcucguuugcgagcaggg

SEQ ID NO: 3090504 - RNA, 16 nt, Mycobacterium bovis subsp bovis AF2122/97
gcucuacucgcggccg

SEQ ID NO: 3090505 - RNA, 19 nt, Mycobacterium bovis subsp bovis AF2122/97
gcucuacucgcggccggcg

SEQ ID NO: 3090506 - RNA, 16 nt, Mycobacterium bovis subsp bovis AF2122/97
gcucucacgagcggcg

SEQ ID NO: 3090507 - RNA, 19 nt, Mycobacterium bovis subsp bovis AF2122/97
gcucucauagcgacggcgc

SEQ ID NO: 3090508 - RNA, 23 nt, Mycobacterium bovis subsp bovis AF2122/97
gcucucauagcgacggcgcucgg

SEQ ID NO: 3090509 - RNA, 15 nt, Mycobacterium bovis subsp bovis AF2122/97
gcucuccauggccga

SEQ ID NO: 3090510 - RNA, 20 nt, Mycobacterium bovis subsp bovis AF2122/97
gcucuccauggccgauuccg

SEQ ID NO: 3090511 - RNA, 13 nt, Mycobacterium bovis subsp bovis AF2122/97
gcucuccgucgcg

SEQ ID NO: 3090512 - RNA, 20 nt, Mycobacterium bovis subsp bovis AF2122/97
gcucucgaguccaggcagcu

SEQ ID NO: 3090513 - RNA, 22 nt, Mycobacterium bovis subsp bovis AF2122/97
gcucucgcagcauguccgcagc

SEQ ID NO: 3090514 - RNA, 11 nt, Mycobacterium bovis subsp bovis AF2122/97
gcucucggcgu

SEQ ID NO: 3090515 - RNA, 13 nt, Mycobacterium bovis subsp bovis AF2122/97
gcucucggcgucg

SEQ ID NO: 3090516 - RNA, 18 nt, Mycobacterium bovis subsp bovis AF2122/97
gcucucggucaguuccuc

SEQ ID NO: 3090517 - RNA, 18 nt, Mycobacterium bovis subsp bovis AF2122/97
gcucucggugguccagcg

SEQ ID NO: 3090518 - RNA, 22 nt, Mycobacterium bovis subsp bovis AF2122/97
gcucucguggauggccgccagg

SEQ ID NO: 3090519 - RNA, 21 nt, Mycobacterium bovis subsp bovis AF2122/97
gcucucguguaucgagcggca

SEQ ID NO: 3090520 - RNA, 17 nt, Mycobacterium bovis subsp bovis AF2122/97
gcucucuucgcgcgcug

SEQ ID NO: 3090521 - RNA, 19 nt, Mycobacterium bovis subsp bovis AF2122/97
gcucucuucgcgcgcuggg

SEQ ID NO: 3090522 - RNA, 20 nt, Mycobacterium bovis subsp bovis AF2122/97
gcucugagcuuggucgccgg

SEQ ID NO: 3090523 - RNA, 18 nt, Mycobacterium bovis subsp bovis AF2122/97
gcucugcgaccucgccgg

SEQ ID NO: 3090524 - RNA, 22 nt, Mycobacterium bovis subsp bovis AF2122/97
gcucugcgaccucgccggacgg

SEQ ID NO: 3090525 - RNA, 18 nt, Mycobacterium bovis subsp bovis AF2122/97
gcucugcgccacagcagc

SEQ ID NO: 3090526 - RNA, 18 nt, Mycobacterium bovis subsp bovis AF2122/97
gcucugcgcggcuucguc

SEQ ID NO: 3090527 - RNA, 15 nt, Mycobacterium bovis subsp bovis AF2122/97
gcucugcugccagcc

SEQ ID NO: 3090528 - RNA, 14 nt, Mycobacterium bovis subsp bovis AF2122/97
gcucuggacgguca

SEQ ID NO: 3090529 - RNA, 19 nt, Mycobacterium bovis subsp bovis AF2122/97
gcucuggucgucgaacggc

SEQ ID NO: 3090530 - RNA, 22 nt, Mycobacterium bovis subsp bovis AF2122/97
gcucuguagcgucgcacccagg

SEQ ID NO: 3090531 - RNA, 14 nt, Mycobacterium bovis subsp bovis AF2122/97
gcucugugucgccg

SEQ ID NO: 3090532 - RNA, 20 nt, Mycobacterium bovis subsp bovis AF2122/97
gcucuucgcagcgguggucg

SEQ ID NO: 3090533 - RNA, 22 nt, Mycobacterium bovis subsp bovis AF2122/97
gcucuucggcaccaccgcgacc

SEQ ID NO: 3090534 - RNA, 14 nt, Mycobacterium bovis subsp bovis AF2122/97
gcucuugcgggcag

SEQ ID NO: 3090535 - RNA, 14 nt, Mycobacterium bovis subsp bovis AF2122/97
gcucuuugagugcc

SEQ ID NO: 3090536 - RNA, 18 nt, Mycobacterium bovis subsp bovis AF2122/97
gcucuuugagugccgcgu

SEQ ID NO: 3090537 - RNA, 20 nt, Mycobacterium bovis subsp bovis AF2122/97
gcugaaaauaggccgggcag

SEQ ID NO: 3090538 - RNA, 15 nt, Mycobacterium bovis subsp bovis AF2122/97
gcugaacaccgguga

SEQ ID NO: 3090539 - RNA, 19 nt, Mycobacterium bovis subsp bovis AF2122/97
gcugaacaccgugggcgga

SEQ ID NO: 3090540 - RNA, 18 nt, Mycobacterium bovis subsp bovis AF2122/97
gcugaacagacggcucag

SEQ ID NO: 3090541 - RNA, 14 nt, Mycobacterium bovis subsp bovis AF2122/97
gcugaaccgcuggg

SEQ ID NO: 3090542 - RNA, 14 nt, Mycobacterium bovis subsp bovis AF2122/97
gcugaacgcgagca

SEQ ID NO: 3090543 - RNA, 16 nt, Mycobacterium bovis subsp bovis AF2122/97
gcugaacggcagccga

SEQ ID NO: 3090544 - RNA, 16 nt, Mycobacterium bovis subsp bovis AF2122/97
gcugaacuccgccgcg

SEQ ID NO: 3090545 - RNA, 23 nt, Mycobacterium bovis subsp bovis AF2122/97
gcugaacugguuggugacguaga

SEQ ID NO: 3090546 - RNA, 16 nt, Mycobacterium bovis subsp bovis AF2122/97
gcugaagaacgcgucg

SEQ ID NO: 3090547 - RNA, 20 nt, Mycobacterium bovis subsp bovis AF2122/97
gcugaagaucaacaggcguc

SEQ ID NO: 3090548 - RNA, 23 nt, Mycobacterium bovis subsp bovis AF2122/97
gcugaagccaaaugcgcugucgc

SEQ ID NO: 3090549 - RNA, 15 nt, Mycobacterium bovis subsp bovis AF2122/97
gcugaagcccauggc

SEQ ID NO: 3090550 - RNA, 16 nt, Mycobacterium bovis subsp bovis AF2122/97
gcugaagccgucguau

SEQ ID NO: 3090551 - RNA, 18 nt, Mycobacterium bovis subsp bovis AF2122/97
gcugaagcuguaggcgac

SEQ ID NO: 3090552 - RNA, 20 nt, Mycobacterium bovis subsp bovis AF2122/97
gcugaagcuguaggcgacca

SEQ ID NO: 3090553 - RNA, 22 nt, Mycobacterium bovis subsp bovis AF2122/97
gcugaagcuguaggcgaccaga

SEQ ID NO: 3090554 - RNA, 23 nt, Mycobacterium bovis subsp bovis AF2122/97
gcugaaggcccguugucgaccga

SEQ ID NO: 3090555 - RNA, 20 nt, Mycobacterium bovis subsp bovis AF2122/97
gcugaaucaccccggcggcc

SEQ ID NO: 3090556 - RNA, 22 nt, Mycobacterium bovis subsp bovis AF2122/97
gcugaauguugguuugccggcg

SEQ ID NO: 3090557 - RNA, 23 nt, Mycobacterium bovis subsp bovis AF2122/97
gcugaauguugguuugccggcgg

SEQ ID NO: 3090558 - RNA, 16 nt, Mycobacterium bovis subsp bovis AF2122/97
gcugaauucggcgagc

SEQ ID NO: 3090559 - RNA, 14 nt, Mycobacterium bovis subsp bovis AF2122/97
gcugaauuggcgcc

SEQ ID NO: 3090560 - RNA, 17 nt, Mycobacterium bovis subsp bovis AF2122/97
gcugaauuggcgccgau

SEQ ID NO: 3090561 - RNA, 18 nt, Mycobacterium bovis subsp bovis AF2122/97
gcugaauuggcgccgaug

SEQ ID NO: 3090562 - RNA, 22 nt, Mycobacterium bovis subsp bovis AF2122/97
gcugacacccgcagcuguggcc

SEQ ID NO: 3090563 - RNA, 14 nt, Mycobacterium bovis subsp bovis AF2122/97
gcugacacccgcca

SEQ ID NO: 3090564 - RNA, 16 nt, Mycobacterium bovis subsp bovis AF2122/97
gcugacaccgaaccgc

SEQ ID NO: 3090565 - RNA, 23 nt, Mycobacterium bovis subsp bovis AF2122/97
gcugacaccgauccggccgccga

SEQ ID NO: 3090566 - RNA, 14 nt, Mycobacterium bovis subsp bovis AF2122/97
gcugaccaacccaa

SEQ ID NO: 3090567 - RNA, 21 nt, Mycobacterium bovis subsp bovis AF2122/97
gcugaccagcguccagccgcc

SEQ ID NO: 3090568 - RNA, 22 nt, Mycobacterium bovis subsp bovis AF2122/97
gcugaccagcguccagccgccc

SEQ ID NO: 3090569 - RNA, 21 nt, Mycobacterium bovis subsp bovis AF2122/97
gcugaccaucacacccaucac

SEQ ID NO: 3090570 - RNA, 22 nt, Mycobacterium bovis subsp bovis AF2122/97
gcugaccaucacacccaucacc

SEQ ID NO: 3090571 - RNA, 15 nt, Mycobacterium bovis subsp bovis AF2122/97
gcugaccccgccggc

SEQ ID NO: 3090572 - RNA, 21 nt, Mycobacterium bovis subsp bovis AF2122/97
gcugaccccgccggcugcgga

SEQ ID NO: 3090573 - RNA, 18 nt, Mycobacterium bovis subsp bovis AF2122/97
gcugaccccggcagcgcc

SEQ ID NO: 3090574 - RNA, 13 nt, Mycobacterium bovis subsp bovis AF2122/97
gcugacccgcggu

SEQ ID NO: 3090575 - RNA, 16 nt, Mycobacterium bovis subsp bovis AF2122/97
gcugacccgcgguagc

SEQ ID NO: 3090576 - RNA, 18 nt, Mycobacterium bovis subsp bovis AF2122/97
gcugacccgggccgggcc

SEQ ID NO: 3090577 - RNA, 19 nt, Mycobacterium bovis subsp bovis AF2122/97
gcugacccgggccgggccg

SEQ ID NO: 3090578 - RNA, 15 nt, Mycobacterium bovis subsp bovis AF2122/97
gcugaccgaagagcu

SEQ ID NO: 3090579 - RNA, 20 nt, Mycobacterium bovis subsp bovis AF2122/97
gcugaccgaauggccgccgc

SEQ ID NO: 3090580 - RNA, 12 nt, Mycobacterium bovis subsp bovis AF2122/97
gcugaccgaccc

SEQ ID NO: 3090581 - RNA, 19 nt, Mycobacterium bovis subsp bovis AF2122/97
gcugaccgagcugauccgg

SEQ ID NO: 3090582 - RNA, 13 nt, Mycobacterium bovis subsp bovis AF2122/97
gcugaccgccacc

SEQ ID NO: 3090583 - RNA, 21 nt, Mycobacterium bovis subsp bovis AF2122/97
gcugaccgccagcggccgcuc

SEQ ID NO: 3090584 - RNA, 13 nt, Mycobacterium bovis subsp bovis AF2122/97
gcugaccgcgccg

SEQ ID NO: 3090585 - RNA, 14 nt, Mycobacterium bovis subsp bovis AF2122/97
gcugaccgcgccgg

SEQ ID NO: 3090586 - RNA, 17 nt, Mycobacterium bovis subsp bovis AF2122/97
gcugaccgcguagacca

SEQ ID NO: 3090587 - RNA, 24 nt, Mycobacterium bovis subsp bovis AF2122/97
gcugaccgcuaccagcugggcgac

SEQ ID NO: 3090588 - RNA, 22 nt, Mycobacterium bovis subsp bovis AF2122/97
gcugaccggaucugacggcgcc

SEQ ID NO: 3090589 - RNA, 23 nt, Mycobacterium bovis subsp bovis AF2122/97
gcugaccggcuauuagcggcuug

SEQ ID NO: 3090590 - RNA, 13 nt, Mycobacterium bovis subsp bovis AF2122/97
gcugaccgggcag

SEQ ID NO: 3090591 - RNA, 16 nt, Mycobacterium bovis subsp bovis AF2122/97
gcugaccggggcgccc

SEQ ID NO: 3090592 - RNA, 21 nt, Mycobacterium bovis subsp bovis AF2122/97
gcugaccggggucggccugcg

SEQ ID NO: 3090593 - RNA, 23 nt, Mycobacterium bovis subsp bovis AF2122/97
gcugaccggggucggccugcggc

SEQ ID NO: 3090594 - RNA, 16 nt, Mycobacterium bovis subsp bovis AF2122/97
gcugaccgguccccgg

SEQ ID NO: 3090595 - RNA, 16 nt, Mycobacterium bovis subsp bovis AF2122/97
gcugaccguggcgccg

SEQ ID NO: 3090596 - RNA, 17 nt, Mycobacterium bovis subsp bovis AF2122/97
gcugaccguggcgccgg

SEQ ID NO: 3090597 - RNA, 20 nt, Mycobacterium bovis subsp bovis AF2122/97
gcugaccguggcgccggucg

SEQ ID NO: 3090598 - RNA, 22 nt, Mycobacterium bovis subsp bovis AF2122/97
gcugaccguggcgccggucgcc

SEQ ID NO: 3090599 - RNA, 14 nt, Mycobacterium bovis subsp bovis AF2122/97
gcugaccucccacc

SEQ ID NO: 3090600 - RNA, 16 nt, Mycobacterium bovis subsp bovis AF2122/97
gcugaccuucaggccc

SEQ ID NO: 3090601 - RNA, 12 nt, Mycobacterium bovis subsp bovis AF2122/97
gcugacgaccaa

SEQ ID NO: 3090602 - RNA, 15 nt, Mycobacterium bovis subsp bovis AF2122/97
gcugacgagccggug

SEQ ID NO: 3090603 - RNA, 18 nt, Mycobacterium bovis subsp bovis AF2122/97
gcugacgagccgguggcg

SEQ ID NO: 3090604 - RNA, 15 nt, Mycobacterium bovis subsp bovis AF2122/97
gcugacgaguugaug

SEQ ID NO: 3090605 - RNA, 13 nt, Mycobacterium bovis subsp bovis AF2122/97
gcugacgaugcgg

SEQ ID NO: 3090606 - RNA, 19 nt, Mycobacterium bovis subsp bovis AF2122/97
gcugacgaugcggucgacg

SEQ ID NO: 3090607 - RNA, 20 nt, Mycobacterium bovis subsp bovis AF2122/97
gcugacgaugcggucgacgg

SEQ ID NO: 3090608 - RNA, 15 nt, Mycobacterium bovis subsp bovis AF2122/97
gcugacgauggccag

SEQ ID NO: 3090609 - RNA, 16 nt, Mycobacterium bovis subsp bovis AF2122/97
gcugacgauggccagg

SEQ ID NO: 3090610 - RNA, 22 nt, Mycobacterium bovis subsp bovis AF2122/97
gcugacgcccuccuggcgggug

SEQ ID NO: 3090611 - RNA, 20 nt, Mycobacterium bovis subsp bovis AF2122/97
gcugacgcugcucuggacgg

SEQ ID NO: 3090612 - RNA, 18 nt, Mycobacterium bovis subsp bovis AF2122/97
gcugacggccauggacgc

SEQ ID NO: 3090613 - RNA, 13 nt, Mycobacterium bovis subsp bovis AF2122/97
gcugacggcgcaa

SEQ ID NO: 3090614 - RNA, 17 nt, Mycobacterium bovis subsp bovis AF2122/97
gcugacgggccgcugug

SEQ ID NO: 3090615 - RNA, 14 nt, Mycobacterium bovis subsp bovis AF2122/97
gcugacggugggga

SEQ ID NO: 3090616 - RNA, 16 nt, Mycobacterium bovis subsp bovis AF2122/97
gcugacuagggucacc

SEQ ID NO: 3090617 - RNA, 17 nt, Mycobacterium bovis subsp bovis AF2122/97
gcugacuagggucaccg

SEQ ID NO: 3090618 - RNA, 15 nt, Mycobacterium bovis subsp bovis AF2122/97
gcugacuccugcggc

SEQ ID NO: 3090619 - RNA, 18 nt, Mycobacterium bovis subsp bovis AF2122/97
gcugacuccugcggcacc

SEQ ID NO: 3090620 - RNA, 23 nt, Mycobacterium bovis subsp bovis AF2122/97
gcugagacagaccgggcccggcg

SEQ ID NO: 3090621 - RNA, 21 nt, Mycobacterium bovis subsp bovis AF2122/97
gcugagacgguguugcucgcc

SEQ ID NO: 3090622 - RNA, 16 nt, Mycobacterium bovis subsp bovis AF2122/97
gcugagcaaguccugc

SEQ ID NO: 3090623 - RNA, 19 nt, Mycobacterium bovis subsp bovis AF2122/97
gcugagcaccugagccuca

SEQ ID NO: 3090624 - RNA, 18 nt, Mycobacterium bovis subsp bovis AF2122/97
gcugagcacggcgcggcg

SEQ ID NO: 3090625 - RNA, 16 nt, Mycobacterium bovis subsp bovis AF2122/97
gcugagcagcgccgcg

SEQ ID NO: 3090626 - RNA, 16 nt, Mycobacterium bovis subsp bovis AF2122/97
gcugagcccgccgcga

SEQ ID NO: 3090627 - RNA, 20 nt, Mycobacterium bovis subsp bovis AF2122/97
gcugagcccgccgcgaccac

SEQ ID NO: 3090628 - RNA, 20 nt, Mycobacterium bovis subsp bovis AF2122/97
gcugagcccguuuccucagc

SEQ ID NO: 3090629 - RNA, 22 nt, Mycobacterium bovis subsp bovis AF2122/97
gcugagcccugcgccucggcgg

SEQ ID NO: 3090630 - RNA, 18 nt, Mycobacterium bovis subsp bovis AF2122/97
gcugagccgcaucuggcc

SEQ ID NO: 3090631 - RNA, 20 nt, Mycobacterium bovis subsp bovis AF2122/97
gcugagccgcaucuggccgg

SEQ ID NO: 3090632 - RNA, 23 nt, Mycobacterium bovis subsp bovis AF2122/97
gcugagccgcaucuggccggcgg

SEQ ID NO: 3090633 - RNA, 21 nt, Mycobacterium bovis subsp bovis AF2122/97
gcugagccguagugucggcgu

SEQ ID NO: 3090634 - RNA, 20 nt, Mycobacterium bovis subsp bovis AF2122/97
gcugagcgacugcagcggcg

SEQ ID NO: 3090635 - RNA, 19 nt, Mycobacterium bovis subsp bovis AF2122/97
gcugagcgccaggccgcac

SEQ ID NO: 3090636 - RNA, 13 nt, Mycobacterium bovis subsp bovis AF2122/97
gcugagcggacuc

SEQ ID NO: 3090637 - RNA, 17 nt, Mycobacterium bovis subsp bovis AF2122/97
gcugagcggccagcauc

SEQ ID NO: 3090638 - RNA, 16 nt, Mycobacterium bovis subsp bovis AF2122/97
gcugagcggccggcau

SEQ ID NO: 3090639 - RNA, 19 nt, Mycobacterium bovis subsp bovis AF2122/97
gcugagcucgaugucagcg

SEQ ID NO: 3090640 - RNA, 15 nt, Mycobacterium bovis subsp bovis AF2122/97
gcugagcugcucgcc

SEQ ID NO: 3090641 - RNA, 16 nt, Mycobacterium bovis subsp bovis AF2122/97
gcugagcugcucgccg

SEQ ID NO: 3090642 - RNA, 22 nt, Mycobacterium bovis subsp bovis AF2122/97
gcugagcugcucgccggccaac

SEQ ID NO: 3090643 - RNA, 18 nt, Mycobacterium bovis subsp bovis AF2122/97
gcugagcuggcagcuccu

SEQ ID NO: 3090644 - RNA, 21 nt, Mycobacterium bovis subsp bovis AF2122/97
gcugagcuggcagcuccucgc

SEQ ID NO: 3090645 - RNA, 15 nt, Mycobacterium bovis subsp bovis AF2122/97
gcugaggaacgccgg

SEQ ID NO: 3090646 - RNA, 17 nt, Mycobacterium bovis subsp bovis AF2122/97
gcugaggaacgccggca

SEQ ID NO: 3090647 - RNA, 22 nt, Mycobacterium bovis subsp bovis AF2122/97
gcugaggaacgccggcaucgcg

SEQ ID NO: 3090648 - RNA, 18 nt, Mycobacterium bovis subsp bovis AF2122/97
gcugaggaagcggcggca

SEQ ID NO: 3090649 - RNA, 19 nt, Mycobacterium bovis subsp bovis AF2122/97
gcugaggaagcggcggcaa

SEQ ID NO: 3090650 - RNA, 12 nt, Mycobacterium bovis subsp bovis AF2122/97
gcugaggcggcg

SEQ ID NO: 3090651 - RNA, 13 nt, Mycobacterium bovis subsp bovis AF2122/97
gcugaggcggcga

SEQ ID NO: 3090652 - RNA, 15 nt, Mycobacterium bovis subsp bovis AF2122/97
gcugaggcggcgacg

SEQ ID NO: 3090653 - RNA, 17 nt, Mycobacterium bovis subsp bovis AF2122/97
gcugaguccccaggugg

SEQ ID NO: 3090654 - RNA, 19 nt, Mycobacterium bovis subsp bovis AF2122/97
gcugaguccccaggugggc

SEQ ID NO: 3090655 - RNA, 21 nt, Mycobacterium bovis subsp bovis AF2122/97
gcugaguccccaggugggcag

SEQ ID NO: 3090656 - RNA, 23 nt, Mycobacterium bovis subsp bovis AF2122/97
gcugaguccccaggugggcagca

SEQ ID NO: 3090657 - RNA, 14 nt, Mycobacterium bovis subsp bovis AF2122/97
gcugagucgugaca

SEQ ID NO: 3090658 - RNA, 19 nt, Mycobacterium bovis subsp bovis AF2122/97
gcugagucgugacaaccau

SEQ ID NO: 3090659 - RNA, 20 nt, Mycobacterium bovis subsp bovis AF2122/97
gcugauagcggucggucacc

SEQ ID NO: 3090660 - RNA, 15 nt, Mycobacterium bovis subsp bovis AF2122/97
gcugauaguggcgcg

SEQ ID NO: 3090661 - RNA, 19 nt, Mycobacterium bovis subsp bovis AF2122/97
gcugauaguggcgcgcggc

SEQ ID NO: 3090662 - RNA, 22 nt, Mycobacterium bovis subsp bovis AF2122/97
gcugauaguggcgcgcggcgcc

SEQ ID NO: 3090663 - RNA, 18 nt, Mycobacterium bovis subsp bovis AF2122/97
gcugaucaccgucguacu

SEQ ID NO: 3090664 - RNA, 22 nt, Mycobacterium bovis subsp bovis AF2122/97
gcugaucaccguugcguuggcg

SEQ ID NO: 3090665 - RNA, 14 nt, Mycobacterium bovis subsp bovis AF2122/97
gcugauccaaguac

SEQ ID NO: 3090666 - RNA, 22 nt, Mycobacterium bovis subsp bovis AF2122/97
gcugauccacgauaucgaugcg

SEQ ID NO: 3090667 - RNA, 17 nt, Mycobacterium bovis subsp bovis AF2122/97
gcugaucccggccaggc

SEQ ID NO: 3090668 - RNA, 19 nt, Mycobacterium bovis subsp bovis AF2122/97
gcugaucccggccaggccg

SEQ ID NO: 3090669 - RNA, 19 nt, Mycobacterium bovis subsp bovis AF2122/97
gcugauccggguggcguca

SEQ ID NO: 3090670 - RNA, 18 nt, Mycobacterium bovis subsp bovis AF2122/97
gcugaucgagcggguguc

SEQ ID NO: 3090671 - RNA, 15 nt, Mycobacterium bovis subsp bovis AF2122/97
gcugaucgcgcgcac

SEQ ID NO: 3090672 - RNA, 19 nt, Mycobacterium bovis subsp bovis AF2122/97
gcugaucgguccggcgaac

SEQ ID NO: 3090673 - RNA, 20 nt, Mycobacterium bovis subsp bovis AF2122/97
gcugaucgguccggcgaacu

SEQ ID NO: 3090674 - RNA, 15 nt, Mycobacterium bovis subsp bovis AF2122/97
gcugaucugccgccg

SEQ ID NO: 3090675 - RNA, 17 nt, Mycobacterium bovis subsp bovis AF2122/97
gcugaucugccgccgcg

SEQ ID NO: 3090676 - RNA, 19 nt, Mycobacterium bovis subsp bovis AF2122/97
gcugaugaaacgccgucgc

SEQ ID NO: 3090677 - RNA, 15 nt, Mycobacterium bovis subsp bovis AF2122/97
gcugaugccuggucg

SEQ ID NO: 3090678 - RNA, 14 nt, Mycobacterium bovis subsp bovis AF2122/97
gcugaugcgcuggg

SEQ ID NO: 3090679 - RNA, 20 nt, Mycobacterium bovis subsp bovis AF2122/97
gcugaugcgcugggccaggg

SEQ ID NO: 3090680 - RNA, 20 nt, Mycobacterium bovis subsp bovis AF2122/97
gcugauggacggugcgcagg

SEQ ID NO: 3090681 - RNA, 18 nt, Mycobacterium bovis subsp bovis AF2122/97
gcugaugggucaggccga

SEQ ID NO: 3090682 - RNA, 20 nt, Mycobacterium bovis subsp bovis AF2122/97
gcugaugggucaggccgacg

SEQ ID NO: 3090683 - RNA, 18 nt, Mycobacterium bovis subsp bovis AF2122/97
gcugauggugcugcggcg

SEQ ID NO: 3090684 - RNA, 21 nt, Mycobacterium bovis subsp bovis AF2122/97
gcugauggugcugcggcgucc

SEQ ID NO: 3090685 - RNA, 18 nt, Mycobacterium bovis subsp bovis AF2122/97
gcugauguacccggcgac

SEQ ID NO: 3090686 - RNA, 13 nt, Mycobacterium bovis subsp bovis AF2122/97
gcugaugucgccg

SEQ ID NO: 3090687 - RNA, 18 nt, Mycobacterium bovis subsp bovis AF2122/97
gcugaugucgccgguguc

SEQ ID NO: 3090688 - RNA, 22 nt, Mycobacterium bovis subsp bovis AF2122/97
gcugaugucgccggugucgacg

SEQ ID NO: 3090689 - RNA, 23 nt, Mycobacterium bovis subsp bovis AF2122/97
gcugaugucgccggugucgacgg

SEQ ID NO: 3090690 - RNA, 17 nt, Mycobacterium bovis subsp bovis AF2122/97
gcugauuaccgacaccg

SEQ ID NO: 3090691 - RNA, 14 nt, Mycobacterium bovis subsp bovis AF2122/97
gcugauugcgaccg

SEQ ID NO: 3090692 - RNA, 20 nt, Mycobacterium bovis subsp bovis AF2122/97
gcugauuguguuccaccagc

SEQ ID NO: 3090693 - RNA, 23 nt, Mycobacterium bovis subsp bovis AF2122/97
gcugauuguguuccaccagcgcc

SEQ ID NO: 3090694 - RNA, 15 nt, Mycobacterium bovis subsp bovis AF2122/97
gcugcaaccagcggc

SEQ ID NO: 3090695 - RNA, 16 nt, Mycobacterium bovis subsp bovis AF2122/97
gcugcaaccgacuucg

SEQ ID NO: 3090696 - RNA, 23 nt, Mycobacterium bovis subsp bovis AF2122/97
gcugcaacgauugaacucuggug

SEQ ID NO: 3090697 - RNA, 17 nt, Mycobacterium bovis subsp bovis AF2122/97
gcugcaacggagcgagc

SEQ ID NO: 3090698 - RNA, 20 nt, Mycobacterium bovis subsp bovis AF2122/97
gcugcaacggagcgagcuca

SEQ ID NO: 3090699 - RNA, 23 nt, Mycobacterium bovis subsp bovis AF2122/97
gcugcaauagccuuacgcgggug

SEQ ID NO: 3090700 - RNA, 17 nt, Mycobacterium bovis subsp bovis AF2122/97
gcugcaaugacuggacc

SEQ ID NO: 3090701 - RNA, 14 nt, Mycobacterium bovis subsp bovis AF2122/97
gcugcaccgauucg

SEQ ID NO: 3090702 - RNA, 13 nt, Mycobacterium bovis subsp bovis AF2122/97
gcugcaccggcuu

SEQ ID NO: 3090703 - RNA, 21 nt, Mycobacterium bovis subsp bovis AF2122/97
gcugcaccggcuugggccagg

SEQ ID NO: 3090704 - RNA, 15 nt, Mycobacterium bovis subsp bovis AF2122/97
gcugcaccguuuccg

SEQ ID NO: 3090705 - RNA, 19 nt, Mycobacterium bovis subsp bovis AF2122/97
gcugcaccguuuccggcgc

SEQ ID NO: 3090706 - RNA, 17 nt, Mycobacterium bovis subsp bovis AF2122/97
gcugcaccuccgacggc

SEQ ID NO: 3090707 - RNA, 19 nt, Mycobacterium bovis subsp bovis AF2122/97
gcugcacgacaucgucgcg

SEQ ID NO: 3090708 - RNA, 13 nt, Mycobacterium bovis subsp bovis AF2122/97
gcugcacgcucgu

SEQ ID NO: 3090709 - RNA, 15 nt, Mycobacterium bovis subsp bovis AF2122/97
gcugcacgcucugcg

SEQ ID NO: 3090710 - RNA, 17 nt, Mycobacterium bovis subsp bovis AF2122/97
gcugcacgcugcggguc

SEQ ID NO: 3090711 - RNA, 19 nt, Mycobacterium bovis subsp bovis AF2122/97
gcugcagaaaggccaacug

SEQ ID NO: 3090712 - RNA, 18 nt, Mycobacterium bovis subsp bovis AF2122/97
gcugcagacccguucgcc

SEQ ID NO: 3090713 - RNA, 19 nt, Mycobacterium bovis subsp bovis AF2122/97
gcugcagacccguucgccg

SEQ ID NO: 3090714 - RNA, 21 nt, Mycobacterium bovis subsp bovis AF2122/97
gcugcagacccguucgccguc

SEQ ID NO: 3090715 - RNA, 12 nt, Mycobacterium bovis subsp bovis AF2122/97
gcugcagaggcg

SEQ ID NO: 3090716 - RNA, 17 nt, Mycobacterium bovis subsp bovis AF2122/97
gcugcagcagcgcaguc

SEQ ID NO: 3090717 - RNA, 14 nt, Mycobacterium bovis subsp bovis AF2122/97
gcugcagcauggcu

SEQ ID NO: 3090718 - RNA, 15 nt, Mycobacterium bovis subsp bovis AF2122/97
gcugcagccugugga

SEQ ID NO: 3090719 - RNA, 12 nt, Mycobacterium bovis subsp bovis AF2122/97
gcugcagcgaga

SEQ ID NO: 3090720 - RNA, 18 nt, Mycobacterium bovis subsp bovis AF2122/97
gcugcagcgagaccucuc

SEQ ID NO: 3090721 - RNA, 15 nt, Mycobacterium bovis subsp bovis AF2122/97
gcugcagcgaugcgg

SEQ ID NO: 3090722 - RNA, 23 nt, Mycobacterium bovis subsp bovis AF2122/97
gcugcagcgucaagggcuggguc

SEQ ID NO: 3090723 - RNA, 18 nt, Mycobacterium bovis subsp bovis AF2122/97
gcugcagcugcucgucgu

SEQ ID NO: 3090724 - RNA, 13 nt, Mycobacterium bovis subsp bovis AF2122/97
gcugcagggccug

SEQ ID NO: 3090725 - RNA, 14 nt, Mycobacterium bovis subsp bovis AF2122/97
gcugcagguccagg

SEQ ID NO: 3090726 - RNA, 22 nt, Mycobacterium bovis subsp bovis AF2122/97
gcugcagucagcuccgcgcagc

SEQ ID NO: 3090727 - RNA, 15 nt, Mycobacterium bovis subsp bovis AF2122/97
gcugcagugacucga

SEQ ID NO: 3090728 - RNA, 16 nt, Mycobacterium bovis subsp bovis AF2122/97
gcugcagugacucgau

SEQ ID NO: 3090729 - RNA, 20 nt, Mycobacterium bovis subsp bovis AF2122/97
gcugcagugacucgaucacc

SEQ ID NO: 3090730 - RNA, 21 nt, Mycobacterium bovis subsp bovis AF2122/97
gcugcagugacucgaucacca

SEQ ID NO: 3090731 - RNA, 15 nt, Mycobacterium bovis subsp bovis AF2122/97
gcugcagugccgcac

SEQ ID NO: 3090732 - RNA, 16 nt, Mycobacterium bovis subsp bovis AF2122/97
gcugcagugccgcacc

SEQ ID NO: 3090733 - RNA, 17 nt, Mycobacterium bovis subsp bovis AF2122/97
gcugcagugccgcaccc

SEQ ID NO: 3090734 - RNA, 19 nt, Mycobacterium bovis subsp bovis AF2122/97
gcugcagugguaccggcgc

SEQ ID NO: 3090735 - RNA, 21 nt, Mycobacterium bovis subsp bovis AF2122/97
gcugcagugguaccggcgccg

SEQ ID NO: 3090736 - RNA, 21 nt, Mycobacterium bovis subsp bovis AF2122/97
gcugcauacaaccccgcgcug

SEQ ID NO: 3090737 - RNA, 15 nt, Mycobacterium bovis subsp bovis AF2122/97
gcugcauccgcagca

SEQ ID NO: 3090738 - RNA, 23 nt, Mycobacterium bovis subsp bovis AF2122/97
gcugccaaggccuucagcggucg

SEQ ID NO: 3090739 - RNA, 15 nt, Mycobacterium bovis subsp bovis AF2122/97
gcugccacccaucgc

SEQ ID NO: 3090740 - RNA, 21 nt, Mycobacterium bovis subsp bovis AF2122/97
gcugccacccaucgcacggau

SEQ ID NO: 3090741 - RNA, 10 nt, Mycobacterium bovis subsp bovis AF2122/97
gcugccaccg

SEQ ID NO: 3090742 - RNA, 13 nt, Mycobacterium bovis subsp bovis AF2122/97
gcugccaccgcgg

SEQ ID NO: 3090743 - RNA, 14 nt, Mycobacterium bovis subsp bovis AF2122/97
gcugccaccgcggu

SEQ ID NO: 3090744 - RNA, 15 nt, Mycobacterium bovis subsp bovis AF2122/97
gcugccaccggccgg

SEQ ID NO: 3090745 - RNA, 18 nt, Mycobacterium bovis subsp bovis AF2122/97
gcugccaccggccggcgc

SEQ ID NO: 3090746 - RNA, 14 nt, Mycobacterium bovis subsp bovis AF2122/97
gcugccacgaacgc

SEQ ID NO: 3090747 - RNA, 22 nt, Mycobacterium bovis subsp bovis AF2122/97
gcugccacuagcauugucgccg

SEQ ID NO: 3090748 - RNA, 16 nt, Mycobacterium bovis subsp bovis AF2122/97
gcugccacuuggacga

SEQ ID NO: 3090749 - RNA, 18 nt, Mycobacterium bovis subsp bovis AF2122/97
gcugccagaaugggcggc

SEQ ID NO: 3090750 - RNA, 18 nt, Mycobacterium bovis subsp bovis AF2122/97
gcugccagaucggucggc

SEQ ID NO: 3090751 - RNA, 16 nt, Mycobacterium bovis subsp bovis AF2122/97
gcugccagccauggcc

SEQ ID NO: 3090752 - RNA, 16 nt, Mycobacterium bovis subsp bovis AF2122/97
gcugccagccgaagcc

SEQ ID NO: 3090753 - RNA, 18 nt, Mycobacterium bovis subsp bovis AF2122/97
gcugccagcgccgccgcc

SEQ ID NO: 3090754 - RNA, 13 nt, Mycobacterium bovis subsp bovis AF2122/97
gcugccaggccgc

SEQ ID NO: 3090755 - RNA, 14 nt, Mycobacterium bovis subsp bovis AF2122/97
gcugccaggccgcu

SEQ ID NO: 3090756 - RNA, 22 nt, Mycobacterium bovis subsp bovis AF2122/97
gcugccaguucuuggcgaccuu

SEQ ID NO: 3090757 - RNA, 17 nt, Mycobacterium bovis subsp bovis AF2122/97
gcugccaucccgauccc

SEQ ID NO: 3090758 - RNA, 15 nt, Mycobacterium bovis subsp bovis AF2122/97
gcugccaucgccuug

SEQ ID NO: 3090759 - RNA, 20 nt, Mycobacterium bovis subsp bovis AF2122/97
gcugccaucggcaccagcgc

SEQ ID NO: 3090760 - RNA, 12 nt, Mycobacterium bovis subsp bovis AF2122/97
gcugccaugcgg

SEQ ID NO: 3090761 - RNA, 13 nt, Mycobacterium bovis subsp bovis AF2122/97
gcugccauugccg

SEQ ID NO: 3090762 - RNA, 22 nt, Mycobacterium bovis subsp bovis AF2122/97
gcugccauugccugggcgaccg

SEQ ID NO: 3090763 - RNA, 23 nt, Mycobacterium bovis subsp bovis AF2122/97
gcugccauugccugggcgaccgg

SEQ ID NO: 3090764 - RNA, 17 nt, Mycobacterium bovis subsp bovis AF2122/97
gcugcccaaccggucaa

SEQ ID NO: 3090765 - RNA, 15 nt, Mycobacterium bovis subsp bovis AF2122/97
gcugcccaacggaag

SEQ ID NO: 3090766 - RNA, 21 nt, Mycobacterium bovis subsp bovis AF2122/97
gcugcccacggagggcaggag

SEQ ID NO: 3090767 - RNA, 16 nt, Mycobacterium bovis subsp bovis AF2122/97
gcugcccaucacaccc

SEQ ID NO: 3090768 - RNA, 15 nt, Mycobacterium bovis subsp bovis AF2122/97
gcugcccaucccggc

SEQ ID NO: 3090769 - RNA, 18 nt, Mycobacterium bovis subsp bovis AF2122/97
gcugcccaucggugaucg

SEQ ID NO: 3090770 - RNA, 13 nt, Mycobacterium bovis subsp bovis AF2122/97
gcugcccaugcgg

SEQ ID NO: 3090771 - RNA, 16 nt, Mycobacterium bovis subsp bovis AF2122/97
gcugcccaugcggcag

SEQ ID NO: 3090772 - RNA, 17 nt, Mycobacterium bovis subsp bovis AF2122/97
gcugcccaugguggcga

SEQ ID NO: 3090773 - RNA, 22 nt, Mycobacterium bovis subsp bovis AF2122/97
gcugcccaugguggcgaucugg

SEQ ID NO: 3090774 - RNA, 14 nt, Mycobacterium bovis subsp bovis AF2122/97
gcugccccgccacc

SEQ ID NO: 3090775 - RNA, 22 nt, Mycobacterium bovis subsp bovis AF2122/97
gcugccccgccaccucgccggc

SEQ ID NO: 3090776 - RNA, 15 nt, Mycobacterium bovis subsp bovis AF2122/97
gcugccccgccgcca

SEQ ID NO: 3090777 - RNA, 16 nt, Mycobacterium bovis subsp bovis AF2122/97
gcugccccgccgccau

SEQ ID NO: 3090778 - RNA, 15 nt, Mycobacterium bovis subsp bovis AF2122/97
gcugccccuccgggc

SEQ ID NO: 3090779 - RNA, 15 nt, Mycobacterium bovis subsp bovis AF2122/97
gcugcccgacacccg

SEQ ID NO: 3090780 - RNA, 17 nt, Mycobacterium bovis subsp bovis AF2122/97
gcugcccgacacccgca

SEQ ID NO: 3090781 - RNA, 12 nt, Mycobacterium bovis subsp bovis AF2122/97
gcugcccgacgu

SEQ ID NO: 3090782 - RNA, 15 nt, Mycobacterium bovis subsp bovis AF2122/97
gcugcccgagaucgc

SEQ ID NO: 3090783 - RNA, 14 nt, Mycobacterium bovis subsp bovis AF2122/97
gcugcccgaguucg

SEQ ID NO: 3090784 - RNA, 13 nt, Mycobacterium bovis subsp bovis AF2122/97
gcugcccgccagc

SEQ ID NO: 3090785 - RNA, 15 nt, Mycobacterium bovis subsp bovis AF2122/97
gcugcccgccagcgc

SEQ ID NO: 3090786 - RNA, 16 nt, Mycobacterium bovis subsp bovis AF2122/97
gcugcccgccagcgcc

SEQ ID NO: 3090787 - RNA, 20 nt, Mycobacterium bovis subsp bovis AF2122/97
gcugcccgccagcgccgccg

SEQ ID NO: 3090788 - RNA, 12 nt, Mycobacterium bovis subsp bovis AF2122/97
gcugcccgccgc

SEQ ID NO: 3090789 - RNA, 18 nt, Mycobacterium bovis subsp bovis AF2122/97
gcugcccgcgcggccaau

SEQ ID NO: 3090790 - RNA, 21 nt, Mycobacterium bovis subsp bovis AF2122/97
gcugcccgcggacgugccggu

SEQ ID NO: 3090791 - RNA, 17 nt, Mycobacterium bovis subsp bovis AF2122/97
gcugcccgggcugccgc

SEQ ID NO: 3090792 - RNA, 19 nt, Mycobacterium bovis subsp bovis AF2122/97
gcugcccgggcugccgccc

SEQ ID NO: 3090793 - RNA, 20 nt, Mycobacterium bovis subsp bovis AF2122/97
gcugcccgggcugccgccca

SEQ ID NO: 3090794 - RNA, 21 nt, Mycobacterium bovis subsp bovis AF2122/97
gcugcccguucugcccaggca

SEQ ID NO: 3090795 - RNA, 15 nt, Mycobacterium bovis subsp bovis AF2122/97
gcugcccugguuggu

SEQ ID NO: 3090796 - RNA, 19 nt, Mycobacterium bovis subsp bovis AF2122/97
gcugcccugguuggugacg

SEQ ID NO: 3090797 - RNA, 23 nt, Mycobacterium bovis subsp bovis AF2122/97
gcugccgaacagcgaaccgccgg

SEQ ID NO: 3090798 - RNA, 23 nt, Mycobacterium bovis subsp bovis AF2122/97
gcugccgaacaguucggcgagca

SEQ ID NO: 3090799 - RNA, 22 nt, Mycobacterium bovis subsp bovis AF2122/97
gcugccgaagcggccaccgccg

SEQ ID NO: 3090800 - RNA, 13 nt, Mycobacterium bovis subsp bovis AF2122/97
gcugccgaaguug

SEQ ID NO: 3090801 - RNA, 23 nt, Mycobacterium bovis subsp bovis AF2122/97
gcugccgaccuuccguuggcggc

SEQ ID NO: 3090802 - RNA, 18 nt, Mycobacterium bovis subsp bovis AF2122/97
gcugccgagaucccagcg

SEQ ID NO: 3090803 - RNA, 18 nt, Mycobacterium bovis subsp bovis AF2122/97
gcugccgauagcgcggca

SEQ ID NO: 3090804 - RNA, 20 nt, Mycobacterium bovis subsp bovis AF2122/97
gcugccgauagcgcggcacc

SEQ ID NO: 3090805 - RNA, 20 nt, Mycobacterium bovis subsp bovis AF2122/97
gcugccgaucaauggcaacg

SEQ ID NO: 3090806 - RNA, 14 nt, Mycobacterium bovis subsp bovis AF2122/97
gcugccgaucaguc

SEQ ID NO: 3090807 - RNA, 22 nt, Mycobacterium bovis subsp bovis AF2122/97
gcugccgcaaacgcggcgucga

SEQ ID NO: 3090808 - RNA, 13 nt, Mycobacterium bovis subsp bovis AF2122/97
gcugccgcacacg

SEQ ID NO: 3090809 - RNA, 14 nt, Mycobacterium bovis subsp bovis AF2122/97
gcugccgcacacgc

SEQ ID NO: 3090810 - RNA, 21 nt, Mycobacterium bovis subsp bovis AF2122/97
gcugccgcacacgcgugcacc

SEQ ID NO: 3090811 - RNA, 15 nt, Mycobacterium bovis subsp bovis AF2122/97
gcugccgcacccccu

SEQ ID NO: 3090812 - RNA, 16 nt, Mycobacterium bovis subsp bovis AF2122/97
gcugccgcagcucagc

SEQ ID NO: 3090813 - RNA, 18 nt, Mycobacterium bovis subsp bovis AF2122/97
gcugccgcaugcgcuccg

SEQ ID NO: 3090814 - RNA, 22 nt, Mycobacterium bovis subsp bovis AF2122/97
gcugccgcaugcgcuccggcgc

SEQ ID NO: 3090815 - RNA, 15 nt, Mycobacterium bovis subsp bovis AF2122/97
gcugccgccaggcuc

SEQ ID NO: 3090816 - RNA, 16 nt, Mycobacterium bovis subsp bovis AF2122/97
gcugccgcccaugccg

SEQ ID NO: 3090817 - RNA, 17 nt, Mycobacterium bovis subsp bovis AF2122/97
gcugccgccgagcuggc

SEQ ID NO: 3090818 - RNA, 21 nt, Mycobacterium bovis subsp bovis AF2122/97
gcugccgccgaucgacacccg

SEQ ID NO: 3090819 - RNA, 14 nt, Mycobacterium bovis subsp bovis AF2122/97
gcugccgccgccgc

SEQ ID NO: 3090820 - RNA, 19 nt, Mycobacterium bovis subsp bovis AF2122/97
gcugccgccgccgccggcg

SEQ ID NO: 3090821 - RNA, 20 nt, Mycobacterium bovis subsp bovis AF2122/97
gcugccgccgccgccggcgc

SEQ ID NO: 3090822 - RNA, 15 nt, Mycobacterium bovis subsp bovis AF2122/97
gcugccgccgccggc

SEQ ID NO: 3090823 - RNA, 21 nt, Mycobacterium bovis subsp bovis AF2122/97
gcugccgccgccggcggucgc

SEQ ID NO: 3090824 - RNA, 12 nt, Mycobacterium bovis subsp bovis AF2122/97
gcugccgccggu

SEQ ID NO: 3090825 - RNA, 17 nt, Mycobacterium bovis subsp bovis AF2122/97
gcugccgccggugccgc

SEQ ID NO: 3090826 - RNA, 15 nt, Mycobacterium bovis subsp bovis AF2122/97
gcugccgccgucgcc

SEQ ID NO: 3090827 - RNA, 16 nt, Mycobacterium bovis subsp bovis AF2122/97
gcugccgccgucgccg

SEQ ID NO: 3090828 - RNA, 17 nt, Mycobacterium bovis subsp bovis AF2122/97
gcugccgccgucgccgc

SEQ ID NO: 3090829 - RNA, 19 nt, Mycobacterium bovis subsp bovis AF2122/97
gcugccgccgucgccgccg

SEQ ID NO: 3090830 - RNA, 20 nt, Mycobacterium bovis subsp bovis AF2122/97
gcugccgccgucgccgccgu

SEQ ID NO: 3090831 - RNA, 16 nt, Mycobacterium bovis subsp bovis AF2122/97
gcugccgccguugccg

SEQ ID NO: 3090832 - RNA, 23 nt, Mycobacterium bovis subsp bovis AF2122/97
gcugccgccguugccgucgucgc

SEQ ID NO: 3090833 - RNA, 14 nt, Mycobacterium bovis subsp bovis AF2122/97
gcugccgcgcggcg

SEQ ID NO: 3090834 - RNA, 20 nt, Mycobacterium bovis subsp bovis AF2122/97
gcugccgcgcggcgagagcc

SEQ ID NO: 3090835 - RNA, 14 nt, Mycobacterium bovis subsp bovis AF2122/97
gcugccgcggccgg

SEQ ID NO: 3090836 - RNA, 17 nt, Mycobacterium bovis subsp bovis AF2122/97
gcugccgcggccggcgu

SEQ ID NO: 3090837 - RNA, 23 nt, Mycobacterium bovis subsp bovis AF2122/97
gcugccgcggccggcgugccagc

SEQ ID NO: 3090838 - RNA, 13 nt, Mycobacterium bovis subsp bovis AF2122/97
gcugccgcggcug

SEQ ID NO: 3090839 - RNA, 16 nt, Mycobacterium bovis subsp bovis AF2122/97
gcugccgcggcugcca

SEQ ID NO: 3090840 - RNA, 18 nt, Mycobacterium bovis subsp bovis AF2122/97
gcugccgcugcgcguacu

SEQ ID NO: 3090841 - RNA, 19 nt, Mycobacterium bovis subsp bovis AF2122/97
gcugccggagacacccgcc

SEQ ID NO: 3090842 - RNA, 20 nt, Mycobacterium bovis subsp bovis AF2122/97
gcugccggagacacccgcca

SEQ ID NO: 3090843 - RNA, 21 nt, Mycobacterium bovis subsp bovis AF2122/97
gcugccggcaacagcucgccu

SEQ ID NO: 3090844 - RNA, 14 nt, Mycobacterium bovis subsp bovis AF2122/97
gcugccggcaccaa

SEQ ID NO: 3090845 - RNA, 22 nt, Mycobacterium bovis subsp bovis AF2122/97
gcugccggcaccaaccaccgac

SEQ ID NO: 3090846 - RNA, 13 nt, Mycobacterium bovis subsp bovis AF2122/97
gcugccggccaga

SEQ ID NO: 3090847 - RNA, 18 nt, Mycobacterium bovis subsp bovis AF2122/97
gcugccggccagacggug

SEQ ID NO: 3090848 - RNA, 16 nt, Mycobacterium bovis subsp bovis AF2122/97
gcugccggcccaccag

SEQ ID NO: 3090849 - RNA, 15 nt, Mycobacterium bovis subsp bovis AF2122/97
gcugccggcgccgcc

SEQ ID NO: 3090850 - RNA, 16 nt, Mycobacterium bovis subsp bovis AF2122/97
gcugccggcgccgcca

SEQ ID NO: 3090851 - RNA, 15 nt, Mycobacterium bovis subsp bovis AF2122/97
gcugccggcugacga

SEQ ID NO: 3090852 - RNA, 16 nt, Mycobacterium bovis subsp bovis AF2122/97
gcugccgguagcacag

SEQ ID NO: 3090853 - RNA, 20 nt, Mycobacterium bovis subsp bovis AF2122/97
gcugccgguagcacagcagc

SEQ ID NO: 3090854 - RNA, 12 nt, Mycobacterium bovis subsp bovis AF2122/97
gcugccgguguc

SEQ ID NO: 3090855 - RNA, 13 nt, Mycobacterium bovis subsp bovis AF2122/97
gcugccguaucca

SEQ ID NO: 3090856 - RNA, 14 nt, Mycobacterium bovis subsp bovis AF2122/97
gcugccgucagccg

SEQ ID NO: 3090857 - RNA, 16 nt, Mycobacterium bovis subsp bovis AF2122/97
gcugccgucgcugccc

SEQ ID NO: 3090858 - RNA, 14 nt, Mycobacterium bovis subsp bovis AF2122/97
gcugccgucggugc

SEQ ID NO: 3090859 - RNA, 15 nt, Mycobacterium bovis subsp bovis AF2122/97
gcugccgucuccugg

SEQ ID NO: 3090860 - RNA, 14 nt, Mycobacterium bovis subsp bovis AF2122/97
gcugccguugauuc

SEQ ID NO: 3090861 - RNA, 23 nt, Mycobacterium bovis subsp bovis AF2122/97
gcugccguugauucggccgccga

SEQ ID NO: 3090862 - RNA, 17 nt, Mycobacterium bovis subsp bovis AF2122/97
gcugccguugggcaccg

SEQ ID NO: 3090863 - RNA, 16 nt, Mycobacterium bovis subsp bovis AF2122/97
gcugccguuggggugg

SEQ ID NO: 3090864 - RNA, 19 nt, Mycobacterium bovis subsp bovis AF2122/97
gcugccuugauugccgcgu

SEQ ID NO: 3090865 - RNA, 21 nt, Mycobacterium bovis subsp bovis AF2122/97
gcugccuuggcgcggcacccg

SEQ ID NO: 3090866 - RNA, 18 nt, Mycobacterium bovis subsp bovis AF2122/97
gcugccuugggaccgcgc

SEQ ID NO: 3090867 - RNA, 17 nt, Mycobacterium bovis subsp bovis AF2122/97
gcugcgaaagccacucg

SEQ ID NO: 3090868 - RNA, 18 nt, Mycobacterium bovis subsp bovis AF2122/97
gcugcgaaagccacucgc

SEQ ID NO: 3090869 - RNA, 16 nt, Mycobacterium bovis subsp bovis AF2122/97
gcugcgaagccgagca

SEQ ID NO: 3090870 - RNA, 14 nt, Mycobacterium bovis subsp bovis AF2122/97
gcugcgacgaugcc

SEQ ID NO: 3090871 - RNA, 14 nt, Mycobacterium bovis subsp bovis AF2122/97
gcugcgacuggccg

SEQ ID NO: 3090872 - RNA, 17 nt, Mycobacterium bovis subsp bovis AF2122/97
gcugcgacuggugccug

SEQ ID NO: 3090873 - RNA, 14 nt, Mycobacterium bovis subsp bovis AF2122/97
gcugcgagagcacc

SEQ ID NO: 3090874 - RNA, 15 nt, Mycobacterium bovis subsp bovis AF2122/97
gcugcgagagcaccg

SEQ ID NO: 3090875 - RNA, 16 nt, Mycobacterium bovis subsp bovis AF2122/97
gcugcgagagcaccga

SEQ ID NO: 3090876 - RNA, 15 nt, Mycobacterium bovis subsp bovis AF2122/97
gcugcgaucgccgcg

SEQ ID NO: 3090877 - RNA, 22 nt, Mycobacterium bovis subsp bovis AF2122/97
gcugcgaucgccgcgcuggucg

SEQ ID NO: 3090878 - RNA, 16 nt, Mycobacterium bovis subsp bovis AF2122/97
gcugcgcaacaccauc

SEQ ID NO: 3090879 - RNA, 22 nt, Mycobacterium bovis subsp bovis AF2122/97
gcugcgcaauagcgacagcagc

SEQ ID NO: 3090880 - RNA, 20 nt, Mycobacterium bovis subsp bovis AF2122/97
gcugcgcaccaaggccguga

SEQ ID NO: 3090881 - RNA, 17 nt, Mycobacterium bovis subsp bovis AF2122/97
gcugcgcaccgccgcgc

SEQ ID NO: 3090882 - RNA, 19 nt, Mycobacterium bovis subsp bovis AF2122/97
gcugcgcacgucgggcccg

SEQ ID NO: 3090883 - RNA, 17 nt, Mycobacterium bovis subsp bovis AF2122/97
gcugcgcaucgccacca

SEQ ID NO: 3090884 - RNA, 19 nt, Mycobacterium bovis subsp bovis AF2122/97
gcugcgcaucgccaccauc

SEQ ID NO: 3090885 - RNA, 14 nt, Mycobacterium bovis subsp bovis AF2122/97
gcugcgccagguca

SEQ ID NO: 3090886 - RNA, 15 nt, Mycobacterium bovis subsp bovis AF2122/97
gcugcgccgaacacc

SEQ ID NO: 3090887 - RNA, 20 nt, Mycobacterium bovis subsp bovis AF2122/97
gcugcgccgaacaccacacc

SEQ ID NO: 3090888 - RNA, 14 nt, Mycobacterium bovis subsp bovis AF2122/97
gcugcgccgauacg

SEQ ID NO: 3090889 - RNA, 20 nt, Mycobacterium bovis subsp bovis AF2122/97
gcugcgccgucgcagccagc

SEQ ID NO: 3090890 - RNA, 17 nt, Mycobacterium bovis subsp bovis AF2122/97
gcugcgcgaagccacca

SEQ ID NO: 3090891 - RNA, 19 nt, Mycobacterium bovis subsp bovis AF2122/97
gcugcgcgaaucgcgucga

SEQ ID NO: 3090892 - RNA, 23 nt, Mycobacterium bovis subsp bovis AF2122/97
gcugcgcgacugauccucgauga

SEQ ID NO: 3090893 - RNA, 13 nt, Mycobacterium bovis subsp bovis AF2122/97
gcugcgcgauggc

SEQ ID NO: 3090894 - RNA, 14 nt, Mycobacterium bovis subsp bovis AF2122/97
gcugcgcgauggcc

SEQ ID NO: 3090895 - RNA, 20 nt, Mycobacterium bovis subsp bovis AF2122/97
gcugcgcgaugucguucgcg

SEQ ID NO: 3090896 - RNA, 14 nt, Mycobacterium bovis subsp bovis AF2122/97
gcugcgcgcccacc

SEQ ID NO: 3090897 - RNA, 20 nt, Mycobacterium bovis subsp bovis AF2122/97
gcugcgcgcccaccgggcgg

SEQ ID NO: 3090898 - RNA, 17 nt, Mycobacterium bovis subsp bovis AF2122/97
gcugcgcgccguucacc

SEQ ID NO: 3090899 - RNA, 12 nt, Mycobacterium bovis subsp bovis AF2122/97
gcugcgcgcucg

SEQ ID NO: 3090900 - RNA, 13 nt, Mycobacterium bovis subsp bovis AF2122/97
gcugcgcggugcc

SEQ ID NO: 3090901 - RNA, 17 nt, Mycobacterium bovis subsp bovis AF2122/97
gcugcgcuacccagcgc

SEQ ID NO: 3090902 - RNA, 11 nt, Mycobacterium bovis subsp bovis AF2122/97
gcugcgcuggu

SEQ ID NO: 3090903 - RNA, 12 nt, Mycobacterium bovis subsp bovis AF2122/97
gcugcgcuggua

SEQ ID NO: 3090904 - RNA, 15 nt, Mycobacterium bovis subsp bovis AF2122/97
gcugcgcuucgaccg

SEQ ID NO: 3090905 - RNA, 20 nt, Mycobacterium bovis subsp bovis AF2122/97
gcugcggacaagucggcacc

SEQ ID NO: 3090906 - RNA, 18 nt, Mycobacterium bovis subsp bovis AF2122/97
gcugcggauacagccgcc

SEQ ID NO: 3090907 - RNA, 19 nt, Mycobacterium bovis subsp bovis AF2122/97
gcugcggauacagccgccg

SEQ ID NO: 3090908 - RNA, 20 nt, Mycobacterium bovis subsp bovis AF2122/97
gcugcggauacagccgccgc

SEQ ID NO: 3090909 - RNA, 18 nt, Mycobacterium bovis subsp bovis AF2122/97
gcugcggaucacagugau

SEQ ID NO: 3090910 - RNA, 18 nt, Mycobacterium bovis subsp bovis AF2122/97
gcugcggauccaccacgc

SEQ ID NO: 3090911 - RNA, 22 nt, Mycobacterium bovis subsp bovis AF2122/97
gcugcggauccaccacgcuggc

SEQ ID NO: 3090912 - RNA, 22 nt, Mycobacterium bovis subsp bovis AF2122/97
gcugcggauuaagucggcggcc

SEQ ID NO: 3090913 - RNA, 17 nt, Mycobacterium bovis subsp bovis AF2122/97
gcugcggcaacgagguc

SEQ ID NO: 3090914 - RNA, 12 nt, Mycobacterium bovis subsp bovis AF2122/97
gcugcggcaccg

SEQ ID NO: 3090915 - RNA, 17 nt, Mycobacterium bovis subsp bovis AF2122/97
gcugcggcagcgcggcc

SEQ ID NO: 3090916 - RNA, 14 nt, Mycobacterium bovis subsp bovis AF2122/97
gcugcggccagcgc

SEQ ID NO: 3090917 - RNA, 16 nt, Mycobacterium bovis subsp bovis AF2122/97
gcugcggcccacacca

SEQ ID NO: 3090918 - RNA, 21 nt, Mycobacterium bovis subsp bovis AF2122/97
gcugcggcccacaccagcgca

SEQ ID NO: 3090919 - RNA, 18 nt, Mycobacterium bovis subsp bovis AF2122/97
gcugcggccgcgagguga

SEQ ID NO: 3090920 - RNA, 13 nt, Mycobacterium bovis subsp bovis AF2122/97
gcugcggcgcugg

SEQ ID NO: 3090921 - RNA, 18 nt, Mycobacterium bovis subsp bovis AF2122/97
gcugcggcgcuggccagc

SEQ ID NO: 3090922 - RNA, 13 nt, Mycobacterium bovis subsp bovis AF2122/97
gcugcggcggcuu

SEQ ID NO: 3090923 - RNA, 13 nt, Mycobacterium bovis subsp bovis AF2122/97
gcugcggcgguau

SEQ ID NO: 3090924 - RNA, 16 nt, Mycobacterium bovis subsp bovis AF2122/97
gcugcggcuuucagcg

SEQ ID NO: 3090925 - RNA, 23 nt, Mycobacterium bovis subsp bovis AF2122/97
gcugcggggcgauccccagcacc

SEQ ID NO: 3090926 - RNA, 14 nt, Mycobacterium bovis subsp bovis AF2122/97
gcugcggguagccg

SEQ ID NO: 3090927 - RNA, 15 nt, Mycobacterium bovis subsp bovis AF2122/97
gcugcggguagccgu

SEQ ID NO: 3090928 - RNA, 18 nt, Mycobacterium bovis subsp bovis AF2122/97
gcugcggguagccgucga

SEQ ID NO: 3090929 - RNA, 19 nt, Mycobacterium bovis subsp bovis AF2122/97
gcugcggguagccgucgau

SEQ ID NO: 3090930 - RNA, 23 nt, Mycobacterium bovis subsp bovis AF2122/97
gcugcggguagccgucgaucccg

SEQ ID NO: 3090931 - RNA, 21 nt, Mycobacterium bovis subsp bovis AF2122/97
gcugcgggucucgccgaccuu

SEQ ID NO: 3090932 - RNA, 19 nt, Mycobacterium bovis subsp bovis AF2122/97
gcugcgggugauugagcuc

SEQ ID NO: 3090933 - RNA, 23 nt, Mycobacterium bovis subsp bovis AF2122/97
gcugcgggugggaaacacgugga

SEQ ID NO: 3090934 - RNA, 23 nt, Mycobacterium bovis subsp bovis AF2122/97
gcugcggguucacuuccgggcag

SEQ ID NO: 3090935 - RNA, 20 nt, Mycobacterium bovis subsp bovis AF2122/97
gcugcgguaaucgccaccgc

SEQ ID NO: 3090936 - RNA, 20 nt, Mycobacterium bovis subsp bovis AF2122/97
gcugcggucgaacaucaucg

SEQ ID NO: 3090937 - RNA, 17 nt, Mycobacterium bovis subsp bovis AF2122/97
gcugcggugggccaggu

SEQ ID NO: 3090938 - RNA, 20 nt, Mycobacterium bovis subsp bovis AF2122/97
gcugcgucgucugcagaccu

SEQ ID NO: 3090939 - RNA, 16 nt, Mycobacterium bovis subsp bovis AF2122/97
gcugcguggcgaacca

SEQ ID NO: 3090940 - RNA, 19 nt, Mycobacterium bovis subsp bovis AF2122/97
gcugcguggcgaaccaggg

SEQ ID NO: 3090941 - RNA, 22 nt, Mycobacterium bovis subsp bovis AF2122/97
gcugcguggcgggcugcagccg

SEQ ID NO: 3090942 - RNA, 21 nt, Mycobacterium bovis subsp bovis AF2122/97
gcugcguugggaucccagcgc

SEQ ID NO: 3090943 - RNA, 14 nt, Mycobacterium bovis subsp bovis AF2122/97
gcugcuaugggucg

SEQ ID NO: 3090944 - RNA, 16 nt, Mycobacterium bovis subsp bovis AF2122/97
gcugcucacgcagcag

SEQ ID NO: 3090945 - RNA, 16 nt, Mycobacterium bovis subsp bovis AF2122/97
gcugcucagcaacggc

SEQ ID NO: 3090946 - RNA, 17 nt, Mycobacterium bovis subsp bovis AF2122/97
gcugcucaucgcgcccg

SEQ ID NO: 3090947 - RNA, 22 nt, Mycobacterium bovis subsp bovis AF2122/97
gcugcucaucgcgcccgccauc

SEQ ID NO: 3090948 - RNA, 23 nt, Mycobacterium bovis subsp bovis AF2122/97
gcugcucccgaaaagcgccucgg

SEQ ID NO: 3090949 - RNA, 13 nt, Mycobacterium bovis subsp bovis AF2122/97
gcugcuccucgcg

SEQ ID NO: 3090950 - RNA, 16 nt, Mycobacterium bovis subsp bovis AF2122/97
gcugcuccucgcggua

SEQ ID NO: 3090951 - RNA, 12 nt, Mycobacterium bovis subsp bovis AF2122/97
gcugcuccugga

SEQ ID NO: 3090952 - RNA, 20 nt, Mycobacterium bovis subsp bovis AF2122/97
gcugcucgagcagaucagca

SEQ ID NO: 3090953 - RNA, 15 nt, Mycobacterium bovis subsp bovis AF2122/97
gcugcucgaucaucg

SEQ ID NO: 3090954 - RNA, 15 nt, Mycobacterium bovis subsp bovis AF2122/97
gcugcucgccggcca

SEQ ID NO: 3090955 - RNA, 18 nt, Mycobacterium bovis subsp bovis AF2122/97
gcugcucggucaggcggc

SEQ ID NO: 3090956 - RNA, 23 nt, Mycobacterium bovis subsp bovis AF2122/97
gcugcucggucaggcggcuggcc

SEQ ID NO: 3090957 - RNA, 17 nt, Mycobacterium bovis subsp bovis AF2122/97
gcugcucgucggcgccg

SEQ ID NO: 3090958 - RNA, 18 nt, Mycobacterium bovis subsp bovis AF2122/97
gcugcucgucggcgccgg

SEQ ID NO: 3090959 - RNA, 21 nt, Mycobacterium bovis subsp bovis AF2122/97
gcugcucgucuuggcggcggu

SEQ ID NO: 3090960 - RNA, 21 nt, Mycobacterium bovis subsp bovis AF2122/97
gcugcucuccgucgcgcacgg

SEQ ID NO: 3090961 - RNA, 23 nt, Mycobacterium bovis subsp bovis AF2122/97
gcugcucugagcuuggucgccgg

SEQ ID NO: 3090962 - RNA, 17 nt, Mycobacterium bovis subsp bovis AF2122/97
gcugcucugcgaccucg

SEQ ID NO: 3090963 - RNA, 16 nt, Mycobacterium bovis subsp bovis AF2122/97
gcugcugaacaccggu

SEQ ID NO: 3090964 - RNA, 13 nt, Mycobacterium bovis subsp bovis AF2122/97
gcugcugcagcaa

SEQ ID NO: 3090965 - RNA, 17 nt, Mycobacterium bovis subsp bovis AF2122/97
gcugcugccgcaccggu

SEQ ID NO: 3090966 - RNA, 18 nt, Mycobacterium bovis subsp bovis AF2122/97
gcugcugccguggcggca

SEQ ID NO: 3090967 - RNA, 15 nt, Mycobacterium bovis subsp bovis AF2122/97
gcugcugcgaucgcc

SEQ ID NO: 3090968 - RNA, 14 nt, Mycobacterium bovis subsp bovis AF2122/97
gcugcugcgcggug

SEQ ID NO: 3090969 - RNA, 15 nt, Mycobacterium bovis subsp bovis AF2122/97
gcugcugcgcggugc

SEQ ID NO: 3090970 - RNA, 17 nt, Mycobacterium bovis subsp bovis AF2122/97
gcugcuggcaugcaggu

SEQ ID NO: 3090971 - RNA, 15 nt, Mycobacterium bovis subsp bovis AF2122/97
gcugcuggcgcgccu

SEQ ID NO: 3090972 - RNA, 13 nt, Mycobacterium bovis subsp bovis AF2122/97
gcugcuggugacg

SEQ ID NO: 3090973 - RNA, 23 nt, Mycobacterium bovis subsp bovis AF2122/97
gcugcuguugguauuagggccgg

SEQ ID NO: 3090974 - RNA, 16 nt, Mycobacterium bovis subsp bovis AF2122/97
gcugcuuauuggucuc

SEQ ID NO: 3090975 - RNA, 19 nt, Mycobacterium bovis subsp bovis AF2122/97
gcugcuugcgcccggccug

SEQ ID NO: 3090976 - RNA, 20 nt, Mycobacterium bovis subsp bovis AF2122/97
gcugcuuggcggucugcgcc

SEQ ID NO: 3090977 - RNA, 21 nt, Mycobacterium bovis subsp bovis AF2122/97
gcugcuuggucgcccagccac

SEQ ID NO: 3090978 - RNA, 17 nt, Mycobacterium bovis subsp bovis AF2122/97
gcugcuugucgaggcgc

SEQ ID NO: 3090979 - RNA, 23 nt, Mycobacterium bovis subsp bovis AF2122/97
gcugcuuuaaccgcgucaucacc

SEQ ID NO: 3090980 - RNA, 18 nt, Mycobacterium bovis subsp bovis AF2122/97
gcuggaaaaucgggucac

SEQ ID NO: 3090981 - RNA, 22 nt, Mycobacterium bovis subsp bovis AF2122/97
gcuggaaaccucuucgggugca

SEQ ID NO: 3090982 - RNA, 18 nt, Mycobacterium bovis subsp bovis AF2122/97
gcuggaacuuggcgucga

SEQ ID NO: 3090983 - RNA, 20 nt, Mycobacterium bovis subsp bovis AF2122/97
gcuggaacuuggcgucgaca

SEQ ID NO: 3090984 - RNA, 16 nt, Mycobacterium bovis subsp bovis AF2122/97
gcuggaagccgucucu

SEQ ID NO: 3090985 - RNA, 19 nt, Mycobacterium bovis subsp bovis AF2122/97
gcuggaagcggcgacuacc

SEQ ID NO: 3090986 - RNA, 14 nt, Mycobacterium bovis subsp bovis AF2122/97
gcuggaaugcgguc

SEQ ID NO: 3090987 - RNA, 20 nt, Mycobacterium bovis subsp bovis AF2122/97
gcuggacaguuacgcuggca

SEQ ID NO: 3090988 - RNA, 16 nt, Mycobacterium bovis subsp bovis AF2122/97
gcuggaccacucgccg

SEQ ID NO: 3090989 - RNA, 20 nt, Mycobacterium bovis subsp bovis AF2122/97
gcuggaccacucgccggcgg

SEQ ID NO: 3090990 - RNA, 19 nt, Mycobacterium bovis subsp bovis AF2122/97
gcuggacccgcauggcgcg

SEQ ID NO: 3090991 - RNA, 21 nt, Mycobacterium bovis subsp bovis AF2122/97
gcuggacccgcauggcgcggg

SEQ ID NO: 3090992 - RNA, 13 nt, Mycobacterium bovis subsp bovis AF2122/97
gcuggacggcggg

SEQ ID NO: 3090993 - RNA, 14 nt, Mycobacterium bovis subsp bovis AF2122/97
gcuggacggcgggc

SEQ ID NO: 3090994 - RNA, 15 nt, Mycobacterium bovis subsp bovis AF2122/97
gcuggacggcgggcc

SEQ ID NO: 3090995 - RNA, 22 nt, Mycobacterium bovis subsp bovis AF2122/97
gcuggacggcgggccgcgcggc

SEQ ID NO: 3090996 - RNA, 23 nt, Mycobacterium bovis subsp bovis AF2122/97
gcuggacggcgggccgcgcggcg

SEQ ID NO: 3090997 - RNA, 15 nt, Mycobacterium bovis subsp bovis AF2122/97
gcuggacuccgguca

SEQ ID NO: 3090998 - RNA, 22 nt, Mycobacterium bovis subsp bovis AF2122/97
gcuggacuccggucagcgcggc

SEQ ID NO: 3090999 - RNA, 23 nt, Mycobacterium bovis subsp bovis AF2122/97
gcuggacuccggucagcgcggcg

SEQ ID NO: 3091000 - RNA, 16 nt, Mycobacterium bovis subsp bovis AF2122/97
gcuggagaucacgccg

SEQ ID NO: 3091001 - RNA, 20 nt, Mycobacterium bovis subsp bovis AF2122/97
gcuggagaucacgccgacga

SEQ ID NO: 3091002 - RNA, 12 nt, Mycobacterium bovis subsp bovis AF2122/97
gcuggaggccac

SEQ ID NO: 3091003 - RNA, 14 nt, Mycobacterium bovis subsp bovis AF2122/97
gcuggaggcggcgc

SEQ ID NO: 3091004 - RNA, 15 nt, Mycobacterium bovis subsp bovis AF2122/97
gcuggaggcggcgcc

SEQ ID NO: 3091005 - RNA, 17 nt, Mycobacterium bovis subsp bovis AF2122/97
gcuggaggcggcgccug

SEQ ID NO: 3091006 - RNA, 19 nt, Mycobacterium bovis subsp bovis AF2122/97
gcuggaggcuccuggucgc

SEQ ID NO: 3091007 - RNA, 15 nt, Mycobacterium bovis subsp bovis AF2122/97
gcuggaucaacccgg

SEQ ID NO: 3091008 - RNA, 18 nt, Mycobacterium bovis subsp bovis AF2122/97
gcuggaugucgucgacga

SEQ ID NO: 3091009 - RNA, 20 nt, Mycobacterium bovis subsp bovis AF2122/97
gcuggaugugggcgcucgca

SEQ ID NO: 3091010 - RNA, 15 nt, Mycobacterium bovis subsp bovis AF2122/97
gcuggcaacgccgcg

SEQ ID NO: 3091011 - RNA, 17 nt, Mycobacterium bovis subsp bovis AF2122/97
gcuggcaacgccgcgcc

SEQ ID NO: 3091012 - RNA, 19 nt, Mycobacterium bovis subsp bovis AF2122/97
gcuggcaacgccgcgccgu

SEQ ID NO: 3091013 - RNA, 21 nt, Mycobacterium bovis subsp bovis AF2122/97
gcuggcaacgccgcgccguuc

SEQ ID NO: 3091014 - RNA, 20 nt, Mycobacterium bovis subsp bovis AF2122/97
gcuggcaaucccgcggucga

SEQ ID NO: 3091015 - RNA, 13 nt, Mycobacterium bovis subsp bovis AF2122/97
gcuggcacacucc

SEQ ID NO: 3091016 - RNA, 24 nt, Mycobacterium bovis subsp bovis AF2122/97
gcuggcacacuguuacuccgacgg

SEQ ID NO: 3091017 - RNA, 14 nt, Mycobacterium bovis subsp bovis AF2122/97
gcuggcaccagcac

SEQ ID NO: 3091018 - RNA, 18 nt, Mycobacterium bovis subsp bovis AF2122/97
gcuggcaccucccgggcg

SEQ ID NO: 3091019 - RNA, 12 nt, Mycobacterium bovis subsp bovis AF2122/97
gcuggcagacuc

SEQ ID NO: 3091020 - RNA, 16 nt, Mycobacterium bovis subsp bovis AF2122/97
gcuggcagacucgagg

SEQ ID NO: 3091021 - RNA, 13 nt, Mycobacterium bovis subsp bovis AF2122/97
gcuggcagcgacu

SEQ ID NO: 3091022 - RNA, 20 nt, Mycobacterium bovis subsp bovis AF2122/97
gcuggcagcgacuuaggcag

SEQ ID NO: 3091023 - RNA, 21 nt, Mycobacterium bovis subsp bovis AF2122/97
gcuggcagcgacuuaggcaga

SEQ ID NO: 3091024 - RNA, 16 nt, Mycobacterium bovis subsp bovis AF2122/97
gcuggcagcuccucgc

SEQ ID NO: 3091025 - RNA, 14 nt, Mycobacterium bovis subsp bovis AF2122/97
gcuggcaggauacc

SEQ ID NO: 3091026 - RNA, 16 nt, Mycobacterium bovis subsp bovis AF2122/97
gcuggcaggauaccga

SEQ ID NO: 3091027 - RNA, 13 nt, Mycobacterium bovis subsp bovis AF2122/97
gcuggcaggccgg

SEQ ID NO: 3091028 - RNA, 14 nt, Mycobacterium bovis subsp bovis AF2122/97
gcuggcaggccggg

SEQ ID NO: 3091029 - RNA, 15 nt, Mycobacterium bovis subsp bovis AF2122/97
gcuggcaggccgggc

SEQ ID NO: 3091030 - RNA, 17 nt, Mycobacterium bovis subsp bovis AF2122/97
gcuggcaggccgggcac

SEQ ID NO: 3091031 - RNA, 19 nt, Mycobacterium bovis subsp bovis AF2122/97
gcuggcaggccgggcacca

SEQ ID NO: 3091032 - RNA, 16 nt, Mycobacterium bovis subsp bovis AF2122/97
gcuggcauaggaucgc

SEQ ID NO: 3091033 - RNA, 19 nt, Mycobacterium bovis subsp bovis AF2122/97
gcuggcauaggaucgcgcc

SEQ ID NO: 3091034 - RNA, 24 nt, Mycobacterium bovis subsp bovis AF2122/97
gcuggcauaggaucgcgcccaccg

SEQ ID NO: 3091035 - RNA, 14 nt, Mycobacterium bovis subsp bovis AF2122/97
gcuggcaugccggc

SEQ ID NO: 3091036 - RNA, 15 nt, Mycobacterium bovis subsp bovis AF2122/97
gcuggcaugccggcg

SEQ ID NO: 3091037 - RNA, 15 nt, Mycobacterium bovis subsp bovis AF2122/97
gcuggccaacuugac

SEQ ID NO: 3091038 - RNA, 18 nt, Mycobacterium bovis subsp bovis AF2122/97
gcuggccaacuugacccg

SEQ ID NO: 3091039 - RNA, 20 nt, Mycobacterium bovis subsp bovis AF2122/97
gcuggccaacuugacccggg

SEQ ID NO: 3091040 - RNA, 12 nt, Mycobacterium bovis subsp bovis AF2122/97
gcuggccaccgc

SEQ ID NO: 3091041 - RNA, 22 nt, Mycobacterium bovis subsp bovis AF2122/97
gcuggccaccuuagcgcuugcc

SEQ ID NO: 3091042 - RNA, 14 nt, Mycobacterium bovis subsp bovis AF2122/97
gcuggccacgaucc

SEQ ID NO: 3091043 - RNA, 21 nt, Mycobacterium bovis subsp bovis AF2122/97
gcuggccacucacauuggcca

SEQ ID NO: 3091044 - RNA, 19 nt, Mycobacterium bovis subsp bovis AF2122/97
gcuggccagcacaccgucg

SEQ ID NO: 3091045 - RNA, 20 nt, Mycobacterium bovis subsp bovis AF2122/97
gcuggccagcacaccgucga

SEQ ID NO: 3091046 - RNA, 16 nt, Mycobacterium bovis subsp bovis AF2122/97
gcuggccagcacgccc

SEQ ID NO: 3091047 - RNA, 19 nt, Mycobacterium bovis subsp bovis AF2122/97
gcuggccagcacgcccgcg

SEQ ID NO: 3091048 - RNA, 20 nt, Mycobacterium bovis subsp bovis AF2122/97
gcuggccagcacgcccucga

SEQ ID NO: 3091049 - RNA, 12 nt, Mycobacterium bovis subsp bovis AF2122/97
gcuggccagccc

SEQ ID NO: 3091050 - RNA, 16 nt, Mycobacterium bovis subsp bovis AF2122/97
gcuggccaggccggca

SEQ ID NO: 3091051 - RNA, 19 nt, Mycobacterium bovis subsp bovis AF2122/97
gcuggccaugguggcgccg

SEQ ID NO: 3091052 - RNA, 21 nt, Mycobacterium bovis subsp bovis AF2122/97
gcuggcccaccuccucgccgg

SEQ ID NO: 3091053 - RNA, 14 nt, Mycobacterium bovis subsp bovis AF2122/97
gcuggcccagcgac

SEQ ID NO: 3091054 - RNA, 18 nt, Mycobacterium bovis subsp bovis AF2122/97
gcuggcccagcgaccagu

SEQ ID NO: 3091055 - RNA, 19 nt, Mycobacterium bovis subsp bovis AF2122/97
gcuggcccagcgaccagug

SEQ ID NO: 3091056 - RNA, 17 nt, Mycobacterium bovis subsp bovis AF2122/97
gcuggcccgcaugccgg

SEQ ID NO: 3091057 - RNA, 21 nt, Mycobacterium bovis subsp bovis AF2122/97
gcuggcccggcuacgacggcg

SEQ ID NO: 3091058 - RNA, 20 nt, Mycobacterium bovis subsp bovis AF2122/97
gcuggcccugcuccucgcgg

SEQ ID NO: 3091059 - RNA, 13 nt, Mycobacterium bovis subsp bovis AF2122/97
gcuggccgccacc

SEQ ID NO: 3091060 - RNA, 16 nt, Mycobacterium bovis subsp bovis AF2122/97
gcuggccgccaccgca

SEQ ID NO: 3091061 - RNA, 23 nt, Mycobacterium bovis subsp bovis AF2122/97
gcuggccgccaccgcacgcacgc

SEQ ID NO: 3091062 - RNA, 14 nt, Mycobacterium bovis subsp bovis AF2122/97
gcuggccgccuccg

SEQ ID NO: 3091063 - RNA, 15 nt, Mycobacterium bovis subsp bovis AF2122/97
gcuggccgcgaggua

SEQ ID NO: 3091064 - RNA, 14 nt, Mycobacterium bovis subsp bovis AF2122/97
gcuggccgcgaucg

SEQ ID NO: 3091065 - RNA, 14 nt, Mycobacterium bovis subsp bovis AF2122/97
gcuggccgcggcga

SEQ ID NO: 3091066 - RNA, 16 nt, Mycobacterium bovis subsp bovis AF2122/97
gcuggccgcggcuggu

SEQ ID NO: 3091067 - RNA, 23 nt, Mycobacterium bovis subsp bovis AF2122/97
gcuggccgcggcuggugucgggc

SEQ ID NO: 3091068 - RNA, 12 nt, Mycobacterium bovis subsp bovis AF2122/97
gcuggccggcac

SEQ ID NO: 3091069 - RNA, 15 nt, Mycobacterium bovis subsp bovis AF2122/97
gcuggccggcaccgu

SEQ ID NO: 3091070 - RNA, 17 nt, Mycobacterium bovis subsp bovis AF2122/97
gcuggccggcaccguga

SEQ ID NO: 3091071 - RNA, 21 nt, Mycobacterium bovis subsp bovis AF2122/97
gcuggccgggugcgugcgcgu

SEQ ID NO: 3091072 - RNA, 23 nt, Mycobacterium bovis subsp bovis AF2122/97
gcuggccguaacgcggaucgggc

SEQ ID NO: 3091073 - RNA, 18 nt, Mycobacterium bovis subsp bovis AF2122/97
gcuggccgucagcgucgg

SEQ ID NO: 3091074 - RNA, 22 nt, Mycobacterium bovis subsp bovis AF2122/97
gcuggccgucgaagacgaacgu

SEQ ID NO: 3091075 - RNA, 22 nt, Mycobacterium bovis subsp bovis AF2122/97
gcuggccuccuggaaggaggcc

SEQ ID NO: 3091076 - RNA, 21 nt, Mycobacterium bovis subsp bovis AF2122/97
gcuggcgaaggacaacagccg

SEQ ID NO: 3091077 - RNA, 17 nt, Mycobacterium bovis subsp bovis AF2122/97
gcuggcgaccuggucgc

SEQ ID NO: 3091078 - RNA, 16 nt, Mycobacterium bovis subsp bovis AF2122/97
gcuggcgauacagcga

SEQ ID NO: 3091079 - RNA, 20 nt, Mycobacterium bovis subsp bovis AF2122/97
gcuggcgaucuggucggcgg

SEQ ID NO: 3091080 - RNA, 18 nt, Mycobacterium bovis subsp bovis AF2122/97
gcuggcgcagccugccga

SEQ ID NO: 3091081 - RNA, 19 nt, Mycobacterium bovis subsp bovis AF2122/97
gcuggcgcagcgccaucga

SEQ ID NO: 3091082 - RNA, 15 nt, Mycobacterium bovis subsp bovis AF2122/97
gcuggcgccccaggu

SEQ ID NO: 3091083 - RNA, 21 nt, Mycobacterium bovis subsp bovis AF2122/97
gcuggcgccccaggugguuca

SEQ ID NO: 3091084 - RNA, 17 nt, Mycobacterium bovis subsp bovis AF2122/97
gcuggcgcccccgacga

SEQ ID NO: 3091085 - RNA, 12 nt, Mycobacterium bovis subsp bovis AF2122/97
gcuggcgcccgg

SEQ ID NO: 3091086 - RNA, 19 nt, Mycobacterium bovis subsp bovis AF2122/97
gcuggcgcccuugccggcg

SEQ ID NO: 3091087 - RNA, 20 nt, Mycobacterium bovis subsp bovis AF2122/97
gcuggcgcccuugccggcga

SEQ ID NO: 3091088 - RNA, 13 nt, Mycobacterium bovis subsp bovis AF2122/97
gcuggcgccgccg

SEQ ID NO: 3091089 - RNA, 14 nt, Mycobacterium bovis subsp bovis AF2122/97
gcuggcgccgccgg

SEQ ID NO: 3091090 - RNA, 18 nt, Mycobacterium bovis subsp bovis AF2122/97
gcuggcgccgccggugcc

SEQ ID NO: 3091091 - RNA, 13 nt, Mycobacterium bovis subsp bovis AF2122/97
gcuggcgccggcc

SEQ ID NO: 3091092 - RNA, 14 nt, Mycobacterium bovis subsp bovis AF2122/97
gcuggcgccggcca

SEQ ID NO: 3091093 - RNA, 16 nt, Mycobacterium bovis subsp bovis AF2122/97
gcuggcgccggccagc

SEQ ID NO: 3091094 - RNA, 18 nt, Mycobacterium bovis subsp bovis AF2122/97
gcuggcgccggccagcca

SEQ ID NO: 3091095 - RNA, 15 nt, Mycobacterium bovis subsp bovis AF2122/97
gcuggcgcgcggggu

SEQ ID NO: 3091096 - RNA, 22 nt, Mycobacterium bovis subsp bovis AF2122/97
gcuggcggccucgccggcgcgc

SEQ ID NO: 3091097 - RNA, 13 nt, Mycobacterium bovis subsp bovis AF2122/97
gcuggcggcgacc

SEQ ID NO: 3091098 - RNA, 14 nt, Mycobacterium bovis subsp bovis AF2122/97
gcuggcggcgcagc

SEQ ID NO: 3091099 - RNA, 12 nt, Mycobacterium bovis subsp bovis AF2122/97
gcuggcggcgcg

SEQ ID NO: 3091100 - RNA, 13 nt, Mycobacterium bovis subsp bovis AF2122/97
gcuggcggcgugc

SEQ ID NO: 3091101 - RNA, 15 nt, Mycobacterium bovis subsp bovis AF2122/97
gcuggcgggcggcgu

SEQ ID NO: 3091102 - RNA, 16 nt, Mycobacterium bovis subsp bovis AF2122/97
gcuggcgggcggcgug

SEQ ID NO: 3091103 - RNA, 14 nt, Mycobacterium bovis subsp bovis AF2122/97
gcuggcggguuggu

SEQ ID NO: 3091104 - RNA, 17 nt, Mycobacterium bovis subsp bovis AF2122/97
gcuggcggguugguccc

SEQ ID NO: 3091105 - RNA, 19 nt, Mycobacterium bovis subsp bovis AF2122/97
gcuggcggguuggucccga

SEQ ID NO: 3091106 - RNA, 16 nt, Mycobacterium bovis subsp bovis AF2122/97
gcuggcgguguagccg

SEQ ID NO: 3091107 - RNA, 14 nt, Mycobacterium bovis subsp bovis AF2122/97
gcuggcgucaccgc

SEQ ID NO: 3091108 - RNA, 15 nt, Mycobacterium bovis subsp bovis AF2122/97
gcuggcgucaccgcg

SEQ ID NO: 3091109 - RNA, 16 nt, Mycobacterium bovis subsp bovis AF2122/97
gcuggcgugcagcagg

SEQ ID NO: 3091110 - RNA, 23 nt, Mycobacterium bovis subsp bovis AF2122/97
gcuggcguucccgcucggcuagu

SEQ ID NO: 3091111 - RNA, 22 nt, Mycobacterium bovis subsp bovis AF2122/97
gcuggcguuguugacgaucacc

SEQ ID NO: 3091112 - RNA, 15 nt, Mycobacterium bovis subsp bovis AF2122/97
gcuggcuacccaccg

SEQ ID NO: 3091113 - RNA, 24 nt, Mycobacterium bovis subsp bovis AF2122/97
gcuggcuagcagguacucgcccca

SEQ ID NO: 3091114 - RNA, 20 nt, Mycobacterium bovis subsp bovis AF2122/97
gcuggcucaccgacaugacg

SEQ ID NO: 3091115 - RNA, 17 nt, Mycobacterium bovis subsp bovis AF2122/97
gcuggcugacaccgauc

SEQ ID NO: 3091116 - RNA, 21 nt, Mycobacterium bovis subsp bovis AF2122/97
gcuggcugaccgaauggccgc

SEQ ID NO: 3091117 - RNA, 23 nt, Mycobacterium bovis subsp bovis AF2122/97
gcuggcugaccgaauggccgccg

SEQ ID NO: 3091118 - RNA, 11 nt, Mycobacterium bovis subsp bovis AF2122/97
gcuggcugcgg

SEQ ID NO: 3091119 - RNA, 17 nt, Mycobacterium bovis subsp bovis AF2122/97
gcuggcugggaaagcau

SEQ ID NO: 3091120 - RNA, 13 nt, Mycobacterium bovis subsp bovis AF2122/97
gcuggcuguggcu

SEQ ID NO: 3091121 - RNA, 15 nt, Mycobacterium bovis subsp bovis AF2122/97
gcuggcuucucgcag

SEQ ID NO: 3091122 - RNA, 18 nt, Mycobacterium bovis subsp bovis AF2122/97
gcuggcuugggccagcgc

SEQ ID NO: 3091123 - RNA, 18 nt, Mycobacterium bovis subsp bovis AF2122/97
gcugggacccgagcagug

SEQ ID NO: 3091124 - RNA, 18 nt, Mycobacterium bovis subsp bovis AF2122/97
gcugggacgggcgcgucg

SEQ ID NO: 3091125 - RNA, 20 nt, Mycobacterium bovis subsp bovis AF2122/97
gcugggacgggcgcgucggc

SEQ ID NO: 3091126 - RNA, 22 nt, Mycobacterium bovis subsp bovis AF2122/97
gcugggacgggcgcgucggcgu

SEQ ID NO: 3091127 - RNA, 19 nt, Mycobacterium bovis subsp bovis AF2122/97
gcugggacggucgcucggc

SEQ ID NO: 3091128 - RNA, 17 nt, Mycobacterium bovis subsp bovis AF2122/97
gcugggaggcgcggucg

SEQ ID NO: 3091129 - RNA, 22 nt, Mycobacterium bovis subsp bovis AF2122/97
gcugggaucggauuuuccgccu

SEQ ID NO: 3091130 - RNA, 21 nt, Mycobacterium bovis subsp bovis AF2122/97
gcugggauguucgaucagcga

SEQ ID NO: 3091131 - RNA, 19 nt, Mycobacterium bovis subsp bovis AF2122/97
gcugggcaagaucguuucc

SEQ ID NO: 3091132 - RNA, 13 nt, Mycobacterium bovis subsp bovis AF2122/97
gcugggcaccccg

SEQ ID NO: 3091133 - RNA, 19 nt, Mycobacterium bovis subsp bovis AF2122/97
gcugggcagccagaucucc

SEQ ID NO: 3091134 - RNA, 15 nt, Mycobacterium bovis subsp bovis AF2122/97
gcugggcaucaccga

SEQ ID NO: 3091135 - RNA, 24 nt, Mycobacterium bovis subsp bovis AF2122/97
gcugggcaucaccgacgcgucggc

SEQ ID NO: 3091136 - RNA, 20 nt, Mycobacterium bovis subsp bovis AF2122/97
gcugggcaucaccgccgcgg

SEQ ID NO: 3091137 - RNA, 21 nt, Mycobacterium bovis subsp bovis AF2122/97
gcugggcaucaccgccgcggc

SEQ ID NO: 3091138 - RNA, 21 nt, Mycobacterium bovis subsp bovis AF2122/97
gcugggcaucaucagcggcgc

SEQ ID NO: 3091139 - RNA, 12 nt, Mycobacterium bovis subsp bovis AF2122/97
gcugggccaggg

SEQ ID NO: 3091140 - RNA, 18 nt, Mycobacterium bovis subsp bovis AF2122/97
gcugggcccaucgcgacu

SEQ ID NO: 3091141 - RNA, 21 nt, Mycobacterium bovis subsp bovis AF2122/97
gcugggcccgagcgcgcgcug

SEQ ID NO: 3091142 - RNA, 14 nt, Mycobacterium bovis subsp bovis AF2122/97
gcugggcccgccag

SEQ ID NO: 3091143 - RNA, 18 nt, Mycobacterium bovis subsp bovis AF2122/97
gcugggcccgccagccca

SEQ ID NO: 3091144 - RNA, 20 nt, Mycobacterium bovis subsp bovis AF2122/97
gcugggcccgccagcccagc

SEQ ID NO: 3091145 - RNA, 19 nt, Mycobacterium bovis subsp bovis AF2122/97
gcugggcccgccgucaccg

SEQ ID NO: 3091146 - RNA, 15 nt, Mycobacterium bovis subsp bovis AF2122/97
gcugggccgaccgcc

SEQ ID NO: 3091147 - RNA, 21 nt, Mycobacterium bovis subsp bovis AF2122/97
gcugggccggggaggcuaggc

SEQ ID NO: 3091148 - RNA, 13 nt, Mycobacterium bovis subsp bovis AF2122/97
gcugggcgaccac

SEQ ID NO: 3091149 - RNA, 14 nt, Mycobacterium bovis subsp bovis AF2122/97
gcugggcgccacca

SEQ ID NO: 3091150 - RNA, 20 nt, Mycobacterium bovis subsp bovis AF2122/97
gcugggcgccaugcgccaac

SEQ ID NO: 3091151 - RNA, 14 nt, Mycobacterium bovis subsp bovis AF2122/97
gcugggcgccgcgc

SEQ ID NO: 3091152 - RNA, 17 nt, Mycobacterium bovis subsp bovis AF2122/97
gcugggcgccgcgcucg

SEQ ID NO: 3091153 - RNA, 12 nt, Mycobacterium bovis subsp bovis AF2122/97
gcugggcgcgcu

SEQ ID NO: 3091154 - RNA, 13 nt, Mycobacterium bovis subsp bovis AF2122/97
gcugggcgcgcuc

SEQ ID NO: 3091155 - RNA, 14 nt, Mycobacterium bovis subsp bovis AF2122/97
gcugggcgcgcuca

SEQ ID NO: 3091156 - RNA, 17 nt, Mycobacterium bovis subsp bovis AF2122/97
gcugggcgcgcucaucg

SEQ ID NO: 3091157 - RNA, 19 nt, Mycobacterium bovis subsp bovis AF2122/97
gcugggcggucggaaugcc

SEQ ID NO: 3091158 - RNA, 18 nt, Mycobacterium bovis subsp bovis AF2122/97
gcugggcuugugggccgg

SEQ ID NO: 3091159 - RNA, 18 nt, Mycobacterium bovis subsp bovis AF2122/97
gcuggggaugcgauggcc

SEQ ID NO: 3091160 - RNA, 13 nt, Mycobacterium bovis subsp bovis AF2122/97
gcuggggccccgc

SEQ ID NO: 3091161 - RNA, 15 nt, Mycobacterium bovis subsp bovis AF2122/97
gcuggggccccgcgc

SEQ ID NO: 3091162 - RNA, 17 nt, Mycobacterium bovis subsp bovis AF2122/97
gcuggggccccgcgccg

SEQ ID NO: 3091163 - RNA, 21 nt, Mycobacterium bovis subsp bovis AF2122/97
gcuggggccccgcgccggccg

SEQ ID NO: 3091164 - RNA, 13 nt, Mycobacterium bovis subsp bovis AF2122/97
gcuggggcuguag

SEQ ID NO: 3091165 - RNA, 15 nt, Mycobacterium bovis subsp bovis AF2122/97
gcugggggcggucgc

SEQ ID NO: 3091166 - RNA, 16 nt, Mycobacterium bovis subsp bovis AF2122/97
gcuggggguaccuccc

SEQ ID NO: 3091167 - RNA, 15 nt, Mycobacterium bovis subsp bovis AF2122/97
gcugggggucaaucg

SEQ ID NO: 3091168 - RNA, 17 nt, Mycobacterium bovis subsp bovis AF2122/97
gcugggggucaaucggg

SEQ ID NO: 3091169 - RNA, 16 nt, Mycobacterium bovis subsp bovis AF2122/97
gcuggguaugcaccca

SEQ ID NO: 3091170 - RNA, 23 nt, Mycobacterium bovis subsp bovis AF2122/97
gcugggucagguugucggcgauc

SEQ ID NO: 3091171 - RNA, 22 nt, Mycobacterium bovis subsp bovis AF2122/97
gcuggguccccucccaccagcg

SEQ ID NO: 3091172 - RNA, 16 nt, Mycobacterium bovis subsp bovis AF2122/97
gcugggucccgcuggc

SEQ ID NO: 3091173 - RNA, 17 nt, Mycobacterium bovis subsp bovis AF2122/97
gcugggucccgcuggca

SEQ ID NO: 3091174 - RNA, 15 nt, Mycobacterium bovis subsp bovis AF2122/97
gcugggucgccguuu

SEQ ID NO: 3091175 - RNA, 12 nt, Mycobacterium bovis subsp bovis AF2122/97
gcugggugacca

SEQ ID NO: 3091176 - RNA, 14 nt, Mycobacterium bovis subsp bovis AF2122/97
gcugggugaccagg

SEQ ID NO: 3091177 - RNA, 15 nt, Mycobacterium bovis subsp bovis AF2122/97
gcugggugaccagga

SEQ ID NO: 3091178 - RNA, 15 nt, Mycobacterium bovis subsp bovis AF2122/97
gcugggugccgcagc

SEQ ID NO: 3091179 - RNA, 12 nt, Mycobacterium bovis subsp bovis AF2122/97
gcugguagcugc

SEQ ID NO: 3091180 - RNA, 15 nt, Mycobacterium bovis subsp bovis AF2122/97
gcugguaggucaccg

SEQ ID NO: 3091181 - RNA, 19 nt, Mycobacterium bovis subsp bovis AF2122/97
gcugguauagccggcgcag

SEQ ID NO: 3091182 - RNA, 22 nt, Mycobacterium bovis subsp bovis AF2122/97
gcugguauagcucacgguggcc

SEQ ID NO: 3091183 - RNA, 16 nt, Mycobacterium bovis subsp bovis AF2122/97
gcugguaucgagcacc

SEQ ID NO: 3091184 - RNA, 19 nt, Mycobacterium bovis subsp bovis AF2122/97
gcuggucaacagcggcaag

SEQ ID NO: 3091185 - RNA, 16 nt, Mycobacterium bovis subsp bovis AF2122/97
gcuggucaccaucacc

SEQ ID NO: 3091186 - RNA, 13 nt, Mycobacterium bovis subsp bovis AF2122/97
gcuggucagccgu

SEQ ID NO: 3091187 - RNA, 19 nt, Mycobacterium bovis subsp bovis AF2122/97
gcuggucagccgugccgug

SEQ ID NO: 3091188 - RNA, 22 nt, Mycobacterium bovis subsp bovis AF2122/97
gcuggucagccgugccguggug

SEQ ID NO: 3091189 - RNA, 14 nt, Mycobacterium bovis subsp bovis AF2122/97
gcuggucagcggcg

SEQ ID NO: 3091190 - RNA, 14 nt, Mycobacterium bovis subsp bovis AF2122/97
gcugguccagccgg

SEQ ID NO: 3091191 - RNA, 19 nt, Mycobacterium bovis subsp bovis AF2122/97
gcugguccuccuucggugg

SEQ ID NO: 3091192 - RNA, 23 nt, Mycobacterium bovis subsp bovis AF2122/97
gcugguccuccuucggugguggg

SEQ ID NO: 3091193 - RNA, 19 nt, Mycobacterium bovis subsp bovis AF2122/97
gcugguccuugucgacccc

SEQ ID NO: 3091194 - RNA, 15 nt, Mycobacterium bovis subsp bovis AF2122/97
gcuggucgagcagug

SEQ ID NO: 3091195 - RNA, 14 nt, Mycobacterium bovis subsp bovis AF2122/97
gcuggucgauggcg

SEQ ID NO: 3091196 - RNA, 21 nt, Mycobacterium bovis subsp bovis AF2122/97
gcuggucgauggcguacagca

SEQ ID NO: 3091197 - RNA, 23 nt, Mycobacterium bovis subsp bovis AF2122/97
gcuggucgauggcguacagcacc

SEQ ID NO: 3091198 - RNA, 19 nt, Mycobacterium bovis subsp bovis AF2122/97
gcuggucgcgguggcggcg

SEQ ID NO: 3091199 - RNA, 18 nt, Mycobacterium bovis subsp bovis AF2122/97
gcuggucgcugcugcgau

SEQ ID NO: 3091200 - RNA, 14 nt, Mycobacterium bovis subsp bovis AF2122/97
gcuggucggcggcu

SEQ ID NO: 3091201 - RNA, 21 nt, Mycobacterium bovis subsp bovis AF2122/97
gcuggucggcuaccgccgacc

SEQ ID NO: 3091202 - RNA, 22 nt, Mycobacterium bovis subsp bovis AF2122/97
gcuggucggcuaccgccgaccg

SEQ ID NO: 3091203 - RNA, 14 nt, Mycobacterium bovis subsp bovis AF2122/97
gcuggucggugggc

SEQ ID NO: 3091204 - RNA, 19 nt, Mycobacterium bovis subsp bovis AF2122/97
gcuggucgugggccaccac

SEQ ID NO: 3091205 - RNA, 20 nt, Mycobacterium bovis subsp bovis AF2122/97
gcuggucgugggccaccacc

SEQ ID NO: 3091206 - RNA, 17 nt, Mycobacterium bovis subsp bovis AF2122/97
gcuggucuacccgcggc

SEQ ID NO: 3091207 - RNA, 18 nt, Mycobacterium bovis subsp bovis AF2122/97
gcuggucugcaggcggcc

SEQ ID NO: 3091208 - RNA, 20 nt, Mycobacterium bovis subsp bovis AF2122/97
gcuggugaucagcucaguga

SEQ ID NO: 3091209 - RNA, 23 nt, Mycobacterium bovis subsp bovis AF2122/97
gcuggugaucugcugggcaagau

SEQ ID NO: 3091210 - RNA, 22 nt, Mycobacterium bovis subsp bovis AF2122/97
gcuggugauggccaucuggccg

SEQ ID NO: 3091211 - RNA, 13 nt, Mycobacterium bovis subsp bovis AF2122/97
gcuggugccaacu

SEQ ID NO: 3091212 - RNA, 19 nt, Mycobacterium bovis subsp bovis AF2122/97
gcuggugccaacugcgccg

SEQ ID NO: 3091213 - RNA, 20 nt, Mycobacterium bovis subsp bovis AF2122/97
gcuggugcgccacgccaccg

SEQ ID NO: 3091214 - RNA, 23 nt, Mycobacterium bovis subsp bovis AF2122/97
gcuggugcgccacgccaccgcgg

SEQ ID NO: 3091215 - RNA, 18 nt, Mycobacterium bovis subsp bovis AF2122/97
gcuggugcgggacgccga

SEQ ID NO: 3091216 - RNA, 22 nt, Mycobacterium bovis subsp bovis AF2122/97
gcuggugcguagcccacccggg

SEQ ID NO: 3091217 - RNA, 18 nt, Mycobacterium bovis subsp bovis AF2122/97
gcugguggcgccaucccc

SEQ ID NO: 3091218 - RNA, 15 nt, Mycobacterium bovis subsp bovis AF2122/97
gcugguggcggcgac

SEQ ID NO: 3091219 - RNA, 20 nt, Mycobacterium bovis subsp bovis AF2122/97
gcugguggcggucaccacgc

SEQ ID NO: 3091220 - RNA, 13 nt, Mycobacterium bovis subsp bovis AF2122/97
gcugguggcgugc

SEQ ID NO: 3091221 - RNA, 13 nt, Mycobacterium bovis subsp bovis AF2122/97
gcuggugggacgc

SEQ ID NO: 3091222 - RNA, 17 nt, Mycobacterium bovis subsp bovis AF2122/97
gcuggugggacgcggcc

SEQ ID NO: 3091223 - RNA, 17 nt, Mycobacterium bovis subsp bovis AF2122/97
gcuggugggaggggacc

SEQ ID NO: 3091224 - RNA, 22 nt, Mycobacterium bovis subsp bovis AF2122/97
gcuggugggaucgcagcgccau

SEQ ID NO: 3091225 - RNA, 15 nt, Mycobacterium bovis subsp bovis AF2122/97
gcuggugggccggac

SEQ ID NO: 3091226 - RNA, 23 nt, Mycobacterium bovis subsp bovis AF2122/97
gcuggugggggagcggccgccgc

SEQ ID NO: 3091227 - RNA, 14 nt, Mycobacterium bovis subsp bovis AF2122/97
gcugguggucagca

SEQ ID NO: 3091228 - RNA, 18 nt, Mycobacterium bovis subsp bovis AF2122/97
gcugguguccagccaggc

SEQ ID NO: 3091229 - RNA, 13 nt, Mycobacterium bovis subsp bovis AF2122/97
gcuggugugcggg

SEQ ID NO: 3091230 - RNA, 15 nt, Mycobacterium bovis subsp bovis AF2122/97
gcuggugugcgggug

SEQ ID NO: 3091231 - RNA, 17 nt, Mycobacterium bovis subsp bovis AF2122/97
gcuggugugcgggugug

SEQ ID NO: 3091232 - RNA, 17 nt, Mycobacterium bovis subsp bovis AF2122/97
gcugguugaacaugucc

SEQ ID NO: 3091233 - RNA, 20 nt, Mycobacterium bovis subsp bovis AF2122/97
gcugguugccuuugcggcgg

SEQ ID NO: 3091234 - RNA, 21 nt, Mycobacterium bovis subsp bovis AF2122/97
gcugguugccuuugcggcggg

SEQ ID NO: 3091235 - RNA, 23 nt, Mycobacterium bovis subsp bovis AF2122/97
gcugguugccuuugcggcgggca

SEQ ID NO: 3091236 - RNA, 15 nt, Mycobacterium bovis subsp bovis AF2122/97
gcugguuggcacgca

SEQ ID NO: 3091237 - RNA, 15 nt, Mycobacterium bovis subsp bovis AF2122/97
gcugguuggcgccga

SEQ ID NO: 3091238 - RNA, 14 nt, Mycobacterium bovis subsp bovis AF2122/97
gcugguugugcugg

SEQ ID NO: 3091239 - RNA, 16 nt, Mycobacterium bovis subsp bovis AF2122/97
gcugguuucggccgca

SEQ ID NO: 3091240 - RNA, 22 nt, Mycobacterium bovis subsp bovis AF2122/97
gcugguuucggccgcauccccg

SEQ ID NO: 3091241 - RNA, 16 nt, Mycobacterium bovis subsp bovis AF2122/97
gcugguuucggggacc

SEQ ID NO: 3091242 - RNA, 19 nt, Mycobacterium bovis subsp bovis AF2122/97
gcuguaacacccggccgcc

SEQ ID NO: 3091243 - RNA, 21 nt, Mycobacterium bovis subsp bovis AF2122/97
gcuguaacacccggccgccga

SEQ ID NO: 3091244 - RNA, 22 nt, Mycobacterium bovis subsp bovis AF2122/97
gcuguaagcaugccguugcgau

SEQ ID NO: 3091245 - RNA, 15 nt, Mycobacterium bovis subsp bovis AF2122/97
gcuguacaacgccgu

SEQ ID NO: 3091246 - RNA, 18 nt, Mycobacterium bovis subsp bovis AF2122/97
gcuguacauacucugcga

SEQ ID NO: 3091247 - RNA, 22 nt, Mycobacterium bovis subsp bovis AF2122/97
gcuguacauacucugcgacacc

SEQ ID NO: 3091248 - RNA, 16 nt, Mycobacterium bovis subsp bovis AF2122/97
gcuguacccgaccagc

SEQ ID NO: 3091249 - RNA, 17 nt, Mycobacterium bovis subsp bovis AF2122/97
gcuguacccgaccagca

SEQ ID NO: 3091250 - RNA, 16 nt, Mycobacterium bovis subsp bovis AF2122/97
gcuguacucgcggcgc

SEQ ID NO: 3091251 - RNA, 19 nt, Mycobacterium bovis subsp bovis AF2122/97
gcuguacucgcggcgcggc

SEQ ID NO: 3091252 - RNA, 20 nt, Mycobacterium bovis subsp bovis AF2122/97
gcuguacucgcggcgcggcc

SEQ ID NO: 3091253 - RNA, 21 nt, Mycobacterium bovis subsp bovis AF2122/97
gcuguacucgcggcgcggccg

SEQ ID NO: 3091254 - RNA, 15 nt, Mycobacterium bovis subsp bovis AF2122/97
gcuguacugcggugc

SEQ ID NO: 3091255 - RNA, 24 nt, Mycobacterium bovis subsp bovis AF2122/97
gcuguacuugggauugcgggccug

SEQ ID NO: 3091256 - RNA, 16 nt, Mycobacterium bovis subsp bovis AF2122/97
gcuguaggccagcccg

SEQ ID NO: 3091257 - RNA, 18 nt, Mycobacterium bovis subsp bovis AF2122/97
gcuguaggucagcgcguc

SEQ ID NO: 3091258 - RNA, 19 nt, Mycobacterium bovis subsp bovis AF2122/97
gcuguaggucagcgcgucg

SEQ ID NO: 3091259 - RNA, 16 nt, Mycobacterium bovis subsp bovis AF2122/97
gcuguagucgcgccuc

SEQ ID NO: 3091260 - RNA, 16 nt, Mycobacterium bovis subsp bovis AF2122/97
gcugucaagcgggcug

SEQ ID NO: 3091261 - RNA, 19 nt, Mycobacterium bovis subsp bovis AF2122/97
gcugucaagcgggcuggcg

SEQ ID NO: 3091262 - RNA, 16 nt, Mycobacterium bovis subsp bovis AF2122/97
gcugucacaagccugc

SEQ ID NO: 3091263 - RNA, 18 nt, Mycobacterium bovis subsp bovis AF2122/97
gcugucacaagccugccg

SEQ ID NO: 3091264 - RNA, 15 nt, Mycobacterium bovis subsp bovis AF2122/97
gcugucaccguacgg

SEQ ID NO: 3091265 - RNA, 19 nt, Mycobacterium bovis subsp bovis AF2122/97
gcugucaccguacggccac

SEQ ID NO: 3091266 - RNA, 16 nt, Mycobacterium bovis subsp bovis AF2122/97
gcugucacgccugcca

SEQ ID NO: 3091267 - RNA, 19 nt, Mycobacterium bovis subsp bovis AF2122/97
gcugucacgccugccaccg

SEQ ID NO: 3091268 - RNA, 14 nt, Mycobacterium bovis subsp bovis AF2122/97
gcugucagacggcg

SEQ ID NO: 3091269 - RNA, 18 nt, Mycobacterium bovis subsp bovis AF2122/97
gcugucauccccggccag

SEQ ID NO: 3091270 - RNA, 20 nt, Mycobacterium bovis subsp bovis AF2122/97
gcuguccaccgaggccugac

SEQ ID NO: 3091271 - RNA, 19 nt, Mycobacterium bovis subsp bovis AF2122/97
gcuguccacugccaccgcg

SEQ ID NO: 3091272 - RNA, 21 nt, Mycobacterium bovis subsp bovis AF2122/97
gcuguccacugccaccgcgag

SEQ ID NO: 3091273 - RNA, 14 nt, Mycobacterium bovis subsp bovis AF2122/97
gcugucccagcccg

SEQ ID NO: 3091274 - RNA, 16 nt, Mycobacterium bovis subsp bovis AF2122/97
gcuguccccgccgagg

SEQ ID NO: 3091275 - RNA, 15 nt, Mycobacterium bovis subsp bovis AF2122/97
gcugucccgcgggcc

SEQ ID NO: 3091276 - RNA, 18 nt, Mycobacterium bovis subsp bovis AF2122/97
gcugucccgcgggccagc

SEQ ID NO: 3091277 - RNA, 21 nt, Mycobacterium bovis subsp bovis AF2122/97
gcugucccgcgggccagcacc

SEQ ID NO: 3091278 - RNA, 22 nt, Mycobacterium bovis subsp bovis AF2122/97
gcugucccuauugaucuggcaa

SEQ ID NO: 3091279 - RNA, 17 nt, Mycobacterium bovis subsp bovis AF2122/97
gcuguccgaaccgacgu

SEQ ID NO: 3091280 - RNA, 19 nt, Mycobacterium bovis subsp bovis AF2122/97
gcuguccgaccucgccgcg

SEQ ID NO: 3091281 - RNA, 20 nt, Mycobacterium bovis subsp bovis AF2122/97
gcuguccgaccucgccgcgc

SEQ ID NO: 3091282 - RNA, 15 nt, Mycobacterium bovis subsp bovis AF2122/97
gcuguccgcgggccg

SEQ ID NO: 3091283 - RNA, 17 nt, Mycobacterium bovis subsp bovis AF2122/97
gcuguccgcgggccgcg

SEQ ID NO: 3091284 - RNA, 18 nt, Mycobacterium bovis subsp bovis AF2122/97
gcuguccgcgggccgcgc

SEQ ID NO: 3091285 - RNA, 23 nt, Mycobacterium bovis subsp bovis AF2122/97
gcugucgaaauaaaccgcgaucg

SEQ ID NO: 3091286 - RNA, 15 nt, Mycobacterium bovis subsp bovis AF2122/97
gcugucgaaguggua

SEQ ID NO: 3091287 - RNA, 15 nt, Mycobacterium bovis subsp bovis AF2122/97
gcugucgaaguuggu

SEQ ID NO: 3091288 - RNA, 15 nt, Mycobacterium bovis subsp bovis AF2122/97
gcugucgacgucggc

SEQ ID NO: 3091289 - RNA, 17 nt, Mycobacterium bovis subsp bovis AF2122/97
gcugucgagccggugcc

SEQ ID NO: 3091290 - RNA, 18 nt, Mycobacterium bovis subsp bovis AF2122/97
gcugucgaucagcgaccc

SEQ ID NO: 3091291 - RNA, 20 nt, Mycobacterium bovis subsp bovis AF2122/97
gcugucgauuucgccgucgc

SEQ ID NO: 3091292 - RNA, 17 nt, Mycobacterium bovis subsp bovis AF2122/97
gcugucgcaacgcaucg

SEQ ID NO: 3091293 - RNA, 23 nt, Mycobacterium bovis subsp bovis AF2122/97
gcugucgcaacgcaucgaugcgu

SEQ ID NO: 3091294 - RNA, 19 nt, Mycobacterium bovis subsp bovis AF2122/97
gcugucggauagccucggc

SEQ ID NO: 3091295 - RNA, 16 nt, Mycobacterium bovis subsp bovis AF2122/97
gcugucggcgaccgag

SEQ ID NO: 3091296 - RNA, 22 nt, Mycobacterium bovis subsp bovis AF2122/97
gcugucggcgaccgagacggcg

SEQ ID NO: 3091297 - RNA, 14 nt, Mycobacterium bovis subsp bovis AF2122/97
gcugucggugccgu

SEQ ID NO: 3091298 - RNA, 17 nt, Mycobacterium bovis subsp bovis AF2122/97
gcugucggugccgucga

SEQ ID NO: 3091299 - RNA, 17 nt, Mycobacterium bovis subsp bovis AF2122/97
gcugucguaccgcucgg

SEQ ID NO: 3091300 - RNA, 18 nt, Mycobacterium bovis subsp bovis AF2122/97
gcugucguaccgcucggc

SEQ ID NO: 3091301 - RNA, 17 nt, Mycobacterium bovis subsp bovis AF2122/97
gcugucgugcucucggc

SEQ ID NO: 3091302 - RNA, 20 nt, Mycobacterium bovis subsp bovis AF2122/97
gcugucguugaucggcacgc

SEQ ID NO: 3091303 - RNA, 16 nt, Mycobacterium bovis subsp bovis AF2122/97
gcugugaacaggccga

SEQ ID NO: 3091304 - RNA, 18 nt, Mycobacterium bovis subsp bovis AF2122/97
gcugugaucgagucgcga

SEQ ID NO: 3091305 - RNA, 12 nt, Mycobacterium bovis subsp bovis AF2122/97
gcugugcagcgg

SEQ ID NO: 3091306 - RNA, 17 nt, Mycobacterium bovis subsp bovis AF2122/97
gcugugccccagggcag

SEQ ID NO: 3091307 - RNA, 19 nt, Mycobacterium bovis subsp bovis AF2122/97
gcugugccccagggcagug

SEQ ID NO: 3091308 - RNA, 13 nt, Mycobacterium bovis subsp bovis AF2122/97
gcugugccggcca

SEQ ID NO: 3091309 - RNA, 14 nt, Mycobacterium bovis subsp bovis AF2122/97
gcugugcgacccgc

SEQ ID NO: 3091310 - RNA, 13 nt, Mycobacterium bovis subsp bovis AF2122/97
gcugugcgcuggu

SEQ ID NO: 3091311 - RNA, 14 nt, Mycobacterium bovis subsp bovis AF2122/97
gcugugcgcugguc

SEQ ID NO: 3091312 - RNA, 15 nt, Mycobacterium bovis subsp bovis AF2122/97
gcugugcgcuggucg

SEQ ID NO: 3091313 - RNA, 13 nt, Mycobacterium bovis subsp bovis AF2122/97
gcugugcucacga

SEQ ID NO: 3091314 - RNA, 18 nt, Mycobacterium bovis subsp bovis AF2122/97
gcugugcucacgagcaaa

SEQ ID NO: 3091315 - RNA, 14 nt, Mycobacterium bovis subsp bovis AF2122/97
gcugugcucgacga

SEQ ID NO: 3091316 - RNA, 18 nt, Mycobacterium bovis subsp bovis AF2122/97
gcuguggaucgacaccga

SEQ ID NO: 3091317 - RNA, 21 nt, Mycobacterium bovis subsp bovis AF2122/97
gcuguggaucgacaccgacgc

SEQ ID NO: 3091318 - RNA, 23 nt, Mycobacterium bovis subsp bovis AF2122/97
gcuguggaucgacaccgacgcgg

SEQ ID NO: 3091319 - RNA, 15 nt, Mycobacterium bovis subsp bovis AF2122/97
gcuguggaugccgac

SEQ ID NO: 3091320 - RNA, 19 nt, Mycobacterium bovis subsp bovis AF2122/97
gcuguggccagcaucauca

SEQ ID NO: 3091321 - RNA, 18 nt, Mycobacterium bovis subsp bovis AF2122/97
gcuguggcccgcggugac

SEQ ID NO: 3091322 - RNA, 19 nt, Mycobacterium bovis subsp bovis AF2122/97
gcuguggcccgucauacuc

SEQ ID NO: 3091323 - RNA, 20 nt, Mycobacterium bovis subsp bovis AF2122/97
gcuguggccgccguaacucu

SEQ ID NO: 3091324 - RNA, 13 nt, Mycobacterium bovis subsp bovis AF2122/97
gcuguggccgcgu

SEQ ID NO: 3091325 - RNA, 19 nt, Mycobacterium bovis subsp bovis AF2122/97
gcuguggcucgacgaugcg

SEQ ID NO: 3091326 - RNA, 15 nt, Mycobacterium bovis subsp bovis AF2122/97
gcugugggauucggg

SEQ ID NO: 3091327 - RNA, 18 nt, Mycobacterium bovis subsp bovis AF2122/97
gcugugguaggccggugc

SEQ ID NO: 3091328 - RNA, 20 nt, Mycobacterium bovis subsp bovis AF2122/97
gcuguggucggugccagcac

SEQ ID NO: 3091329 - RNA, 13 nt, Mycobacterium bovis subsp bovis AF2122/97
gcuguggugguga

SEQ ID NO: 3091330 - RNA, 13 nt, Mycobacterium bovis subsp bovis AF2122/97
gcugugucguacc

SEQ ID NO: 3091331 - RNA, 13 nt, Mycobacterium bovis subsp bovis AF2122/97
gcugugugggagc

SEQ ID NO: 3091332 - RNA, 16 nt, Mycobacterium bovis subsp bovis AF2122/97
gcuguguugcacccga

SEQ ID NO: 3091333 - RNA, 16 nt, Mycobacterium bovis subsp bovis AF2122/97
gcuguucgcgccauac

SEQ ID NO: 3091334 - RNA, 21 nt, Mycobacterium bovis subsp bovis AF2122/97
gcuguucggccaacccgggcc

SEQ ID NO: 3091335 - RNA, 17 nt, Mycobacterium bovis subsp bovis AF2122/97
gcuguucggccauggcg

SEQ ID NO: 3091336 - RNA, 20 nt, Mycobacterium bovis subsp bovis AF2122/97
gcuguucggccauggcggcg

SEQ ID NO: 3091337 - RNA, 21 nt, Mycobacterium bovis subsp bovis AF2122/97
gcuguucggccauggcggcgc

SEQ ID NO: 3091338 - RNA, 15 nt, Mycobacterium bovis subsp bovis AF2122/97
gcuguugaagccgcc

SEQ ID NO: 3091339 - RNA, 20 nt, Mycobacterium bovis subsp bovis AF2122/97
gcuguugaagccgcccgagu

SEQ ID NO: 3091340 - RNA, 22 nt, Mycobacterium bovis subsp bovis AF2122/97
gcuguugacccguacccacgac

SEQ ID NO: 3091341 - RNA, 15 nt, Mycobacterium bovis subsp bovis AF2122/97
gcuguugacgccacg

SEQ ID NO: 3091342 - RNA, 19 nt, Mycobacterium bovis subsp bovis AF2122/97
gcuguugacgccacgacgc

SEQ ID NO: 3091343 - RNA, 18 nt, Mycobacterium bovis subsp bovis AF2122/97
gcuguugaucgacaccga

SEQ ID NO: 3091344 - RNA, 18 nt, Mycobacterium bovis subsp bovis AF2122/97
gcuguugcaucgccgcga

SEQ ID NO: 3091345 - RNA, 20 nt, Mycobacterium bovis subsp bovis AF2122/97
gcuguugccagucgaucgcg

SEQ ID NO: 3091346 - RNA, 23 nt, Mycobacterium bovis subsp bovis AF2122/97
gcuguuggcguggaucuuggcca

SEQ ID NO: 3091347 - RNA, 19 nt, Mycobacterium bovis subsp bovis AF2122/97
gcuguuuggggucgcgcug

SEQ ID NO: 3091348 - RNA, 22 nt, Mycobacterium bovis subsp bovis AF2122/97
gcuuaaggcccuggccgcgccg

SEQ ID NO: 3091349 - RNA, 15 nt, Mycobacterium bovis subsp bovis AF2122/97
gcuuacaugcccugc

SEQ ID NO: 3091350 - RNA, 14 nt, Mycobacterium bovis subsp bovis AF2122/97
gcuuaccggcgggc

SEQ ID NO: 3091351 - RNA, 19 nt, Mycobacterium bovis subsp bovis AF2122/97
gcuuacuuaaccaggcgag

SEQ ID NO: 3091352 - RNA, 22 nt, Mycobacterium bovis subsp bovis AF2122/97
gcuuacuuaaccaggcgagccg

SEQ ID NO: 3091353 - RNA, 14 nt, Mycobacterium bovis subsp bovis AF2122/97
gcuuacuugaucuc

SEQ ID NO: 3091354 - RNA, 19 nt, Mycobacterium bovis subsp bovis AF2122/97
gcuuacuugaucucggcga

SEQ ID NO: 3091355 - RNA, 20 nt, Mycobacterium bovis subsp bovis AF2122/97
gcuuacuugaucucggcgag

SEQ ID NO: 3091356 - RNA, 14 nt, Mycobacterium bovis subsp bovis AF2122/97
gcuuagcgcgggcc

SEQ ID NO: 3091357 - RNA, 20 nt, Mycobacterium bovis subsp bovis AF2122/97
gcuuagcgcgggccuggccc

SEQ ID NO: 3091358 - RNA, 15 nt, Mycobacterium bovis subsp bovis AF2122/97
gcuuagcggcuuggc

SEQ ID NO: 3091359 - RNA, 16 nt, Mycobacterium bovis subsp bovis AF2122/97
gcuuagcggcuuggcc

SEQ ID NO: 3091360 - RNA, 23 nt, Mycobacterium bovis subsp bovis AF2122/97
gcuuagcugccgucggugccggg

SEQ ID NO: 3091361 - RNA, 17 nt, Mycobacterium bovis subsp bovis AF2122/97
gcuuagcuuccggguuc

SEQ ID NO: 3091362 - RNA, 18 nt, Mycobacterium bovis subsp bovis AF2122/97
gcuuagggcgcccgcccc

SEQ ID NO: 3091363 - RNA, 19 nt, Mycobacterium bovis subsp bovis AF2122/97
gcuuaugcgucugcucgcc

SEQ ID NO: 3091364 - RNA, 20 nt, Mycobacterium bovis subsp bovis AF2122/97
gcuuaugcgucugcucgccg

SEQ ID NO: 3091365 - RNA, 17 nt, Mycobacterium bovis subsp bovis AF2122/97
gcuuauguguccgcucg

SEQ ID NO: 3091366 - RNA, 20 nt, Mycobacterium bovis subsp bovis AF2122/97
gcuuauguguccgcucgccg

SEQ ID NO: 3091367 - RNA, 13 nt, Mycobacterium bovis subsp bovis AF2122/97
gcuucaacccggg

SEQ ID NO: 3091368 - RNA, 20 nt, Mycobacterium bovis subsp bovis AF2122/97
gcuucaagauuaccgaagcc

SEQ ID NO: 3091369 - RNA, 14 nt, Mycobacterium bovis subsp bovis AF2122/97
gcuucagcacggug

SEQ ID NO: 3091370 - RNA, 21 nt, Mycobacterium bovis subsp bovis AF2122/97
gcuucagcacgguguacgccc

SEQ ID NO: 3091371 - RNA, 18 nt, Mycobacterium bovis subsp bovis AF2122/97
gcuucaggcgccacugcu

SEQ ID NO: 3091372 - RNA, 20 nt, Mycobacterium bovis subsp bovis AF2122/97
gcuucauagguucgguaguc

SEQ ID NO: 3091373 - RNA, 18 nt, Mycobacterium bovis subsp bovis AF2122/97
gcuucaucccggagccgc

SEQ ID NO: 3091374 - RNA, 15 nt, Mycobacterium bovis subsp bovis AF2122/97
gcuucaugagccgcu

SEQ ID NO: 3091375 - RNA, 18 nt, Mycobacterium bovis subsp bovis AF2122/97
gcuuccaaacccgguguu

SEQ ID NO: 3091376 - RNA, 19 nt, Mycobacterium bovis subsp bovis AF2122/97
gcuuccaacucggcggcca

SEQ ID NO: 3091377 - RNA, 20 nt, Mycobacterium bovis subsp bovis AF2122/97
gcuuccaacucggcggccag

SEQ ID NO: 3091378 - RNA, 21 nt, Mycobacterium bovis subsp bovis AF2122/97
gcuuccaacucggcggccagc

SEQ ID NO: 3091379 - RNA, 20 nt, Mycobacterium bovis subsp bovis AF2122/97
gcuuccagccacagcccggc

SEQ ID NO: 3091380 - RNA, 16 nt, Mycobacterium bovis subsp bovis AF2122/97
gcuuccagggcgacgg

SEQ ID NO: 3091381 - RNA, 21 nt, Mycobacterium bovis subsp bovis AF2122/97
gcuucccggaagcgccggccc

SEQ ID NO: 3091382 - RNA, 23 nt, Mycobacterium bovis subsp bovis AF2122/97
gcuucccuccagauaccaccgcc

SEQ ID NO: 3091383 - RNA, 22 nt, Mycobacterium bovis subsp bovis AF2122/97
gcuuccgcgcgcagaugagcgc

SEQ ID NO: 3091384 - RNA, 17 nt, Mycobacterium bovis subsp bovis AF2122/97
gcuuccgcugaacaccg

SEQ ID NO: 3091385 - RNA, 20 nt, Mycobacterium bovis subsp bovis AF2122/97
gcuuccgcuggguggccgcu

SEQ ID NO: 3091386 - RNA, 18 nt, Mycobacterium bovis subsp bovis AF2122/97
gcuuccggaacaaaggcu

SEQ ID NO: 3091387 - RNA, 21 nt, Mycobacterium bovis subsp bovis AF2122/97
gcuuccggccauugcgggcuc

SEQ ID NO: 3091388 - RNA, 23 nt, Mycobacterium bovis subsp bovis AF2122/97
gcuuccgggacuaccacccgcag

SEQ ID NO: 3091389 - RNA, 18 nt, Mycobacterium bovis subsp bovis AF2122/97
gcuuccgguccagcggcc

SEQ ID NO: 3091390 - RNA, 19 nt, Mycobacterium bovis subsp bovis AF2122/97
gcuuccgguccagcggccg

SEQ ID NO: 3091391 - RNA, 22 nt, Mycobacterium bovis subsp bovis AF2122/97
gcuuccgguccagcggccgccg

SEQ ID NO: 3091392 - RNA, 16 nt, Mycobacterium bovis subsp bovis AF2122/97
gcuuccggugccggga

SEQ ID NO: 3091393 - RNA, 12 nt, Mycobacterium bovis subsp bovis AF2122/97
gcuuccguggcc

SEQ ID NO: 3091394 - RNA, 20 nt, Mycobacterium bovis subsp bovis AF2122/97
gcuuccguggcccaacccgg

SEQ ID NO: 3091395 - RNA, 17 nt, Mycobacterium bovis subsp bovis AF2122/97
gcuuccuccgacgcgau

SEQ ID NO: 3091396 - RNA, 23 nt, Mycobacterium bovis subsp bovis AF2122/97
gcuuccucgagcgaaccgaagcc

SEQ ID NO: 3091397 - RNA, 18 nt, Mycobacterium bovis subsp bovis AF2122/97
gcuuccucgcgagcuccc

SEQ ID NO: 3091398 - RNA, 20 nt, Mycobacterium bovis subsp bovis AF2122/97
gcuuccuggguuggcaucca

SEQ ID NO: 3091399 - RNA, 16 nt, Mycobacterium bovis subsp bovis AF2122/97
gcuucgaagcgaucgc

SEQ ID NO: 3091400 - RNA, 12 nt, Mycobacterium bovis subsp bovis AF2122/97
gcuucgaccgcc

SEQ ID NO: 3091401 - RNA, 17 nt, Mycobacterium bovis subsp bovis AF2122/97
gcuucgacggcggccaa

SEQ ID NO: 3091402 - RNA, 18 nt, Mycobacterium bovis subsp bovis AF2122/97
gcuucgacgucggcgacc

SEQ ID NO: 3091403 - RNA, 19 nt, Mycobacterium bovis subsp bovis AF2122/97
gcuucgagcaccgacaccg

SEQ ID NO: 3091404 - RNA, 18 nt, Mycobacterium bovis subsp bovis AF2122/97
gcuucgagugcgacggcg

SEQ ID NO: 3091405 - RNA, 21 nt, Mycobacterium bovis subsp bovis AF2122/97
gcuucgauugcgcugcaccgg

SEQ ID NO: 3091406 - RNA, 19 nt, Mycobacterium bovis subsp bovis AF2122/97
gcuucgccacaccaugauu

SEQ ID NO: 3091407 - RNA, 20 nt, Mycobacterium bovis subsp bovis AF2122/97
gcuucgccagguggccgcuc

SEQ ID NO: 3091408 - RNA, 20 nt, Mycobacterium bovis subsp bovis AF2122/97
gcuucgcccagagccgcugc

SEQ ID NO: 3091409 - RNA, 16 nt, Mycobacterium bovis subsp bovis AF2122/97
gcuucgccgcgcagcc

SEQ ID NO: 3091410 - RNA, 21 nt, Mycobacterium bovis subsp bovis AF2122/97
gcuucgccgcgcagccuucuc

SEQ ID NO: 3091411 - RNA, 14 nt, Mycobacterium bovis subsp bovis AF2122/97
gcuucgcgguuggc

SEQ ID NO: 3091412 - RNA, 19 nt, Mycobacterium bovis subsp bovis AF2122/97
gcuucgcuaauacaccucc

SEQ ID NO: 3091413 - RNA, 21 nt, Mycobacterium bovis subsp bovis AF2122/97
gcuucgcuuuugaaccggguc

SEQ ID NO: 3091414 - RNA, 18 nt, Mycobacterium bovis subsp bovis AF2122/97
gcuucggcaccgacugcu

SEQ ID NO: 3091415 - RNA, 20 nt, Mycobacterium bovis subsp bovis AF2122/97
gcuucggcagaccggcaucg

SEQ ID NO: 3091416 - RNA, 15 nt, Mycobacterium bovis subsp bovis AF2122/97
gcuucggcgaacccu

SEQ ID NO: 3091417 - RNA, 20 nt, Mycobacterium bovis subsp bovis AF2122/97
gcuucggcgaacccuccgca

SEQ ID NO: 3091418 - RNA, 11 nt, Mycobacterium bovis subsp bovis AF2122/97
gcuucggcgag

SEQ ID NO: 3091419 - RNA, 13 nt, Mycobacterium bovis subsp bovis AF2122/97
gcuucggcgagcg

SEQ ID NO: 3091420 - RNA, 20 nt, Mycobacterium bovis subsp bovis AF2122/97
gcuucggcggccgagcgcac

SEQ ID NO: 3091421 - RNA, 14 nt, Mycobacterium bovis subsp bovis AF2122/97
gcuucggcggucag

SEQ ID NO: 3091422 - RNA, 19 nt, Mycobacterium bovis subsp bovis AF2122/97
gcuucggcggucagcggcu

SEQ ID NO: 3091423 - RNA, 16 nt, Mycobacterium bovis subsp bovis AF2122/97
gcuucggcggucgccg

SEQ ID NO: 3091424 - RNA, 19 nt, Mycobacterium bovis subsp bovis AF2122/97
gcuucggcggucgccgcgc

SEQ ID NO: 3091425 - RNA, 14 nt, Mycobacterium bovis subsp bovis AF2122/97
gcuucggcuggcgu

SEQ ID NO: 3091426 - RNA, 19 nt, Mycobacterium bovis subsp bovis AF2122/97
gcuucgggguaaccggcgg

SEQ ID NO: 3091427 - RNA, 22 nt, Mycobacterium bovis subsp bovis AF2122/97
gcuucgggguaaccggcggauu

SEQ ID NO: 3091428 - RNA, 16 nt, Mycobacterium bovis subsp bovis AF2122/97
gcuucggugacccggg

SEQ ID NO: 3091429 - RNA, 19 nt, Mycobacterium bovis subsp bovis AF2122/97
gcuucggugacccgggcgg

SEQ ID NO: 3091430 - RNA, 18 nt, Mycobacterium bovis subsp bovis AF2122/97
gcuucgucgacaucgcca

SEQ ID NO: 3091431 - RNA, 18 nt, Mycobacterium bovis subsp bovis AF2122/97
gcuucgucggccagcagc

SEQ ID NO: 3091432 - RNA, 15 nt, Mycobacterium bovis subsp bovis AF2122/97
gcuucgucggccggc

SEQ ID NO: 3091433 - RNA, 21 nt, Mycobacterium bovis subsp bovis AF2122/97
gcuucgucggccggcacccca

SEQ ID NO: 3091434 - RNA, 15 nt, Mycobacterium bovis subsp bovis AF2122/97
gcuucgugcaccaca

SEQ ID NO: 3091435 - RNA, 21 nt, Mycobacterium bovis subsp bovis AF2122/97
gcuucguggcggcgcgcgcug

SEQ ID NO: 3091436 - RNA, 22 nt, Mycobacterium bovis subsp bovis AF2122/97
gcuucucagcaccaugcucgga

SEQ ID NO: 3091437 - RNA, 19 nt, Mycobacterium bovis subsp bovis AF2122/97
gcuucucccgccacugcug

SEQ ID NO: 3091438 - RNA, 20 nt, Mycobacterium bovis subsp bovis AF2122/97
gcuucucccgccacugcugg

SEQ ID NO: 3091439 - RNA, 16 nt, Mycobacterium bovis subsp bovis AF2122/97
gcuucuccuccagaga

SEQ ID NO: 3091440 - RNA, 21 nt, Mycobacterium bovis subsp bovis AF2122/97
gcuucugggguuggcucggcg

SEQ ID NO: 3091441 - RNA, 22 nt, Mycobacterium bovis subsp bovis AF2122/97
gcuucugggguuggcucggcgc

SEQ ID NO: 3091442 - RNA, 17 nt, Mycobacterium bovis subsp bovis AF2122/97
gcuucuuccgcgcgccg

SEQ ID NO: 3091443 - RNA, 20 nt, Mycobacterium bovis subsp bovis AF2122/97
gcuucuucggacagcagccg

SEQ ID NO: 3091444 - RNA, 22 nt, Mycobacterium bovis subsp bovis AF2122/97
gcuucuucggucaccucgaugc

SEQ ID NO: 3091445 - RNA, 19 nt, Mycobacterium bovis subsp bovis AF2122/97
gcuucuucuucuugaccgc

SEQ ID NO: 3091446 - RNA, 15 nt, Mycobacterium bovis subsp bovis AF2122/97
gcuugaccccgccga

SEQ ID NO: 3091447 - RNA, 22 nt, Mycobacterium bovis subsp bovis AF2122/97
gcuugaccccuggccgccggcg

SEQ ID NO: 3091448 - RNA, 14 nt, Mycobacterium bovis subsp bovis AF2122/97
gcuugacccgcgga

SEQ ID NO: 3091449 - RNA, 17 nt, Mycobacterium bovis subsp bovis AF2122/97
gcuugacccgcggaccg

SEQ ID NO: 3091450 - RNA, 18 nt, Mycobacterium bovis subsp bovis AF2122/97
gcuugaccgccuggaagg

SEQ ID NO: 3091451 - RNA, 21 nt, Mycobacterium bovis subsp bovis AF2122/97
gcuugacgcagcucgugaccg

SEQ ID NO: 3091452 - RNA, 14 nt, Mycobacterium bovis subsp bovis AF2122/97
gcuugacuccgcgc

SEQ ID NO: 3091453 - RNA, 18 nt, Mycobacterium bovis subsp bovis AF2122/97
gcuugacuccgcgcgcug

SEQ ID NO: 3091454 - RNA, 18 nt, Mycobacterium bovis subsp bovis AF2122/97
gcuugacugcacaccacc

SEQ ID NO: 3091455 - RNA, 22 nt, Mycobacterium bovis subsp bovis AF2122/97
gcuugagcacacguccggcgau

SEQ ID NO: 3091456 - RNA, 15 nt, Mycobacterium bovis subsp bovis AF2122/97
gcuugagcgccgaug

SEQ ID NO: 3091457 - RNA, 22 nt, Mycobacterium bovis subsp bovis AF2122/97
gcuugaggucccgugcgcgcgc

SEQ ID NO: 3091458 - RNA, 17 nt, Mycobacterium bovis subsp bovis AF2122/97
gcuugaguuucggcgca

SEQ ID NO: 3091459 - RNA, 18 nt, Mycobacterium bovis subsp bovis AF2122/97
gcuugauccacccgacga

SEQ ID NO: 3091460 - RNA, 13 nt, Mycobacterium bovis subsp bovis AF2122/97
gcuugaucgccga

SEQ ID NO: 3091461 - RNA, 21 nt, Mycobacterium bovis subsp bovis AF2122/97
gcuugaucugggcugcggccg

SEQ ID NO: 3091462 - RNA, 17 nt, Mycobacterium bovis subsp bovis AF2122/97
gcuugcaaggucgcugc

SEQ ID NO: 3091463 - RNA, 17 nt, Mycobacterium bovis subsp bovis AF2122/97
gcuugcaauugcgcggc

SEQ ID NO: 3091464 - RNA, 17 nt, Mycobacterium bovis subsp bovis AF2122/97
gcuugcaggcgaucugg

SEQ ID NO: 3091465 - RNA, 18 nt, Mycobacterium bovis subsp bovis AF2122/97
gcuugcagugccgccggc

SEQ ID NO: 3091466 - RNA, 17 nt, Mycobacterium bovis subsp bovis AF2122/97
gcuugcauugaggggcg

SEQ ID NO: 3091467 - RNA, 14 nt, Mycobacterium bovis subsp bovis AF2122/97
gcuugccaccgccg

SEQ ID NO: 3091468 - RNA, 18 nt, Mycobacterium bovis subsp bovis AF2122/97
gcuugccaccgccgccgg

SEQ ID NO: 3091469 - RNA, 13 nt, Mycobacterium bovis subsp bovis AF2122/97
gcuugccccgccu

SEQ ID NO: 3091470 - RNA, 14 nt, Mycobacterium bovis subsp bovis AF2122/97
gcuugccccgccuu

SEQ ID NO: 3091471 - RNA, 17 nt, Mycobacterium bovis subsp bovis AF2122/97
gcuugcccggcucggca

SEQ ID NO: 3091472 - RNA, 21 nt, Mycobacterium bovis subsp bovis AF2122/97
gcuugccgauagaacuagauc

SEQ ID NO: 3091473 - RNA, 21 nt, Mycobacterium bovis subsp bovis AF2122/97
gcuugcgaucggcacuuagcc

SEQ ID NO: 3091474 - RNA, 14 nt, Mycobacterium bovis subsp bovis AF2122/97
gcuugcgcagccgc

SEQ ID NO: 3091475 - RNA, 15 nt, Mycobacterium bovis subsp bovis AF2122/97
gcuugcgcagccgca

SEQ ID NO: 3091476 - RNA, 16 nt, Mycobacterium bovis subsp bovis AF2122/97
gcuugcgcagccgcag

SEQ ID NO: 3091477 - RNA, 18 nt, Mycobacterium bovis subsp bovis AF2122/97
gcuugcgcagccgcagcc

SEQ ID NO: 3091478 - RNA, 16 nt, Mycobacterium bovis subsp bovis AF2122/97
gcuugcgcaucgccga

SEQ ID NO: 3091479 - RNA, 22 nt, Mycobacterium bovis subsp bovis AF2122/97
gcuugcgccgcccaugccucca

SEQ ID NO: 3091480 - RNA, 21 nt, Mycobacterium bovis subsp bovis AF2122/97
gcuugcgccggaugacaccga

SEQ ID NO: 3091481 - RNA, 15 nt, Mycobacterium bovis subsp bovis AF2122/97
gcuugcgcguggcag

SEQ ID NO: 3091482 - RNA, 13 nt, Mycobacterium bovis subsp bovis AF2122/97
gcuugcggcacaa

SEQ ID NO: 3091483 - RNA, 14 nt, Mycobacterium bovis subsp bovis AF2122/97
gcuugcggccgcgc

SEQ ID NO: 3091484 - RNA, 18 nt, Mycobacterium bovis subsp bovis AF2122/97
gcuugcggggccgggcga

SEQ ID NO: 3091485 - RNA, 23 nt, Mycobacterium bovis subsp bovis AF2122/97
gcuugcgggggaguagugguggg

SEQ ID NO: 3091486 - RNA, 17 nt, Mycobacterium bovis subsp bovis AF2122/97
gcuugcucucgcagcau

SEQ ID NO: 3091487 - RNA, 16 nt, Mycobacterium bovis subsp bovis AF2122/97
gcuuggaccagcgugg

SEQ ID NO: 3091488 - RNA, 20 nt, Mycobacterium bovis subsp bovis AF2122/97
gcuuggacccugcgccgcca

SEQ ID NO: 3091489 - RNA, 17 nt, Mycobacterium bovis subsp bovis AF2122/97
gcuuggagaggcggugc

SEQ ID NO: 3091490 - RNA, 16 nt, Mycobacterium bovis subsp bovis AF2122/97
gcuuggagaucgccgc

SEQ ID NO: 3091491 - RNA, 21 nt, Mycobacterium bovis subsp bovis AF2122/97
gcuuggcaaccuguuccagcg

SEQ ID NO: 3091492 - RNA, 21 nt, Mycobacterium bovis subsp bovis AF2122/97
gcuuggcaaucaucucccgac

SEQ ID NO: 3091493 - RNA, 23 nt, Mycobacterium bovis subsp bovis AF2122/97
gcuuggccacuugcucggugagc

SEQ ID NO: 3091494 - RNA, 19 nt, Mycobacterium bovis subsp bovis AF2122/97
gcuuggccagccacuccuc

SEQ ID NO: 3091495 - RNA, 13 nt, Mycobacterium bovis subsp bovis AF2122/97
gcuuggcccagcg

SEQ ID NO: 3091496 - RNA, 12 nt, Mycobacterium bovis subsp bovis AF2122/97
gcuuggccgccg

SEQ ID NO: 3091497 - RNA, 13 nt, Mycobacterium bovis subsp bovis AF2122/97
gcuuggccgccgc

SEQ ID NO: 3091498 - RNA, 17 nt, Mycobacterium bovis subsp bovis AF2122/97
gcuuggccgccgccacc

SEQ ID NO: 3091499 - RNA, 14 nt, Mycobacterium bovis subsp bovis AF2122/97
gcuuggccgcgcag

SEQ ID NO: 3091500 - RNA, 17 nt, Mycobacterium bovis subsp bovis AF2122/97
gcuuggccgcgcaggcu

SEQ ID NO: 3091501 - RNA, 23 nt, Mycobacterium bovis subsp bovis AF2122/97
gcuuggccgcgcaggcuuccagc

SEQ ID NO: 3091502 - RNA, 14 nt, Mycobacterium bovis subsp bovis AF2122/97
gcuuggccgggagu

SEQ ID NO: 3091503 - RNA, 18 nt, Mycobacterium bovis subsp bovis AF2122/97
gcuuggccguaggcggcg

SEQ ID NO: 3091504 - RNA, 21 nt, Mycobacterium bovis subsp bovis AF2122/97
gcuuggccguaggcggcgacc

SEQ ID NO: 3091505 - RNA, 14 nt, Mycobacterium bovis subsp bovis AF2122/97
gcuuggccuaugcu

SEQ ID NO: 3091506 - RNA, 17 nt, Mycobacterium bovis subsp bovis AF2122/97
gcuuggccucagccacc

SEQ ID NO: 3091507 - RNA, 22 nt, Mycobacterium bovis subsp bovis AF2122/97
gcuuggccucagccaccgggcg

SEQ ID NO: 3091508 - RNA, 23 nt, Mycobacterium bovis subsp bovis AF2122/97
gcuuggcgacgaugcaggugaca

SEQ ID NO: 3091509 - RNA, 11 nt, Mycobacterium bovis subsp bovis AF2122/97
gcuuggcgccg

SEQ ID NO: 3091510 - RNA, 13 nt, Mycobacterium bovis subsp bovis AF2122/97
gcuuggcgccgau

SEQ ID NO: 3091511 - RNA, 15 nt, Mycobacterium bovis subsp bovis AF2122/97
gcuuggcggccagcg

SEQ ID NO: 3091512 - RNA, 12 nt, Mycobacterium bovis subsp bovis AF2122/97
gcuuggcggcga

SEQ ID NO: 3091513 - RNA, 22 nt, Mycobacterium bovis subsp bovis AF2122/97
gcuuggcggcgaucaacucggg

SEQ ID NO: 3091514 - RNA, 16 nt, Mycobacterium bovis subsp bovis AF2122/97
gcuuggcgggaccgug

SEQ ID NO: 3091515 - RNA, 23 nt, Mycobacterium bovis subsp bovis AF2122/97
gcuuggcggucugcgccaaaauc

SEQ ID NO: 3091516 - RNA, 16 nt, Mycobacterium bovis subsp bovis AF2122/97
gcuuggcgucgacguc

SEQ ID NO: 3091517 - RNA, 13 nt, Mycobacterium bovis subsp bovis AF2122/97
gcuuggcgucggc

SEQ ID NO: 3091518 - RNA, 15 nt, Mycobacterium bovis subsp bovis AF2122/97
gcuuggcgugaccua

SEQ ID NO: 3091519 - RNA, 21 nt, Mycobacterium bovis subsp bovis AF2122/97
gcuuggcgugaccuaccuccu

SEQ ID NO: 3091520 - RNA, 18 nt, Mycobacterium bovis subsp bovis AF2122/97
gcuuggcuccacaauccu

SEQ ID NO: 3091521 - RNA, 15 nt, Mycobacterium bovis subsp bovis AF2122/97
gcuuggcuuggccgu

SEQ ID NO: 3091522 - RNA, 20 nt, Mycobacterium bovis subsp bovis AF2122/97
gcuugggcacuucggcgaag

SEQ ID NO: 3091523 - RNA, 18 nt, Mycobacterium bovis subsp bovis AF2122/97
gcuugggccaggcccagc

SEQ ID NO: 3091524 - RNA, 22 nt, Mycobacterium bovis subsp bovis AF2122/97
gcuuggggccggaugucgacga

SEQ ID NO: 3091525 - RNA, 15 nt, Mycobacterium bovis subsp bovis AF2122/97
gcuugggguugggcg

SEQ ID NO: 3091526 - RNA, 15 nt, Mycobacterium bovis subsp bovis AF2122/97
gcuuggucgaccgcc

SEQ ID NO: 3091527 - RNA, 18 nt, Mycobacterium bovis subsp bovis AF2122/97
gcuuggugaaccgcgcgg

SEQ ID NO: 3091528 - RNA, 23 nt, Mycobacterium bovis subsp bovis AF2122/97
gcuuggugcccagcguggcuggc

SEQ ID NO: 3091529 - RNA, 18 nt, Mycobacterium bovis subsp bovis AF2122/97
gcuugguggucgccaccc

SEQ ID NO: 3091530 - RNA, 20 nt, Mycobacterium bovis subsp bovis AF2122/97
gcuugguggucgccacccga

SEQ ID NO: 3091531 - RNA, 22 nt, Mycobacterium bovis subsp bovis AF2122/97
gcuugguggucuuggccggugc

SEQ ID NO: 3091532 - RNA, 17 nt, Mycobacterium bovis subsp bovis AF2122/97
gcuugguguggcccaac

SEQ ID NO: 3091533 - RNA, 18 nt, Mycobacterium bovis subsp bovis AF2122/97
gcuuguagcgcaucgcca

SEQ ID NO: 3091534 - RNA, 14 nt, Mycobacterium bovis subsp bovis AF2122/97
gcuuguagcgcucg

SEQ ID NO: 3091535 - RNA, 16 nt, Mycobacterium bovis subsp bovis AF2122/97
gcuugucagccgcgac

SEQ ID NO: 3091536 - RNA, 17 nt, Mycobacterium bovis subsp bovis AF2122/97
gcuuguccaccgugcgg

SEQ ID NO: 3091537 - RNA, 13 nt, Mycobacterium bovis subsp bovis AF2122/97
gcuugucgaccac

SEQ ID NO: 3091538 - RNA, 14 nt, Mycobacterium bovis subsp bovis AF2122/97
gcuugucgagcagg

SEQ ID NO: 3091539 - RNA, 14 nt, Mycobacterium bovis subsp bovis AF2122/97
gcuugucgccggca

SEQ ID NO: 3091540 - RNA, 13 nt, Mycobacterium bovis subsp bovis AF2122/97
gcuugucgcggug

SEQ ID NO: 3091541 - RNA, 18 nt, Mycobacterium bovis subsp bovis AF2122/97
gcuugucgguagguguca

SEQ ID NO: 3091542 - RNA, 17 nt, Mycobacterium bovis subsp bovis AF2122/97
gcuugugggccggugug

SEQ ID NO: 3091543 - RNA, 14 nt, Mycobacterium bovis subsp bovis AF2122/97
gcuugugggcgacg

SEQ ID NO: 3091544 - RNA, 15 nt, Mycobacterium bovis subsp bovis AF2122/97
gcuugugggcgacgg

SEQ ID NO: 3091545 - RNA, 20 nt, Mycobacterium bovis subsp bovis AF2122/97
gcuuguugaccucacgggcg

SEQ ID NO: 3091546 - RNA, 21 nt, Mycobacterium bovis subsp bovis AF2122/97
gcuuguuuuccaccagcgagc

SEQ ID NO: 3091547 - RNA, 18 nt, Mycobacterium bovis subsp bovis AF2122/97
gcuuuagugucugcucgc

SEQ ID NO: 3091548 - RNA, 12 nt, Mycobacterium bovis subsp bovis AF2122/97
gcuuucagcacc

SEQ ID NO: 3091549 - RNA, 18 nt, Mycobacterium bovis subsp bovis AF2122/97
gcuuucagcaccggaucg

SEQ ID NO: 3091550 - RNA, 16 nt, Mycobacterium bovis subsp bovis AF2122/97
gcuuucccgucggcgg

SEQ ID NO: 3091551 - RNA, 15 nt, Mycobacterium bovis subsp bovis AF2122/97
gcuuuccggcggugg

SEQ ID NO: 3091552 - RNA, 16 nt, Mycobacterium bovis subsp bovis AF2122/97
gcuuuccggcgguggu

SEQ ID NO: 3091553 - RNA, 20 nt, Mycobacterium bovis subsp bovis AF2122/97
gcuuucgauauagccgccgg

SEQ ID NO: 3091554 - RNA, 18 nt, Mycobacterium bovis subsp bovis AF2122/97
gcuuucgcgugcggcugc

SEQ ID NO: 3091555 - RNA, 20 nt, Mycobacterium bovis subsp bovis AF2122/97
gcuuucggaaaaccgcaccg

SEQ ID NO: 3091556 - RNA, 19 nt, Mycobacterium bovis subsp bovis AF2122/97
gcuuucugcacccgccagg

SEQ ID NO: 3091557 - RNA, 15 nt, Mycobacterium bovis subsp bovis AF2122/97
gcuuugacgcccucg

SEQ ID NO: 3091558 - RNA, 14 nt, Mycobacterium bovis subsp bovis AF2122/97
gcuuugcacugugg

SEQ ID NO: 3091559 - RNA, 16 nt, Mycobacterium bovis subsp bovis AF2122/97
gcuuugcgcggucagc

SEQ ID NO: 3091560 - RNA, 17 nt, Mycobacterium bovis subsp bovis AF2122/97
gcuuuggcccgcgagcg

SEQ ID NO: 3091561 - RNA, 13 nt, Mycobacterium bovis subsp bovis AF2122/97
gcuuuggccgccg

SEQ ID NO: 3091562 - RNA, 14 nt, Mycobacterium bovis subsp bovis AF2122/97
gcuuuggccgccgu

SEQ ID NO: 3091563 - RNA, 15 nt, Mycobacterium bovis subsp bovis AF2122/97
gcuuuggccgccgug

SEQ ID NO: 3091564 - RNA, 17 nt, Mycobacterium bovis subsp bovis AF2122/97
gcuuuggccgccguggc

SEQ ID NO: 3091565 - RNA, 14 nt, Mycobacterium bovis subsp bovis AF2122/97
gcuuugggcugccg

SEQ ID NO: 3091566 - RNA, 16 nt, Mycobacterium bovis subsp bovis AF2122/97
gcuuugguuagaggau

SEQ ID NO: 3091567 - RNA, 22 nt, Mycobacterium bovis subsp bovis AF2122/97
gcuuugucaccggcuucggcca

SEQ ID NO: 3091568 - RNA, 17 nt, Mycobacterium bovis subsp bovis AF2122/97
gcuuuuacgucugcucg

SEQ ID NO: 3091569 - RNA, 19 nt, Mycobacterium bovis subsp bovis AF2122/97
gcuuuuacgucugcucgcg

SEQ ID NO: 3091570 - RNA, 21 nt, Mycobacterium bovis subsp bovis AF2122/97
gcuuuuccggcauugccgccg

SEQ ID NO: 3091571 - RNA, 23 nt, Mycobacterium bovis subsp bovis AF2122/97
gcuuuuccggcguucccccacuc

SEQ ID NO: 3091572 - RNA, 15 nt, Mycobacterium bovis subsp bovis AF2122/97
gcuuuugcaccggac

SEQ ID NO: 3091573 - RNA, 17 nt, Mycobacterium bovis subsp bovis AF2122/97
gcuuuugcgucugcucg

SEQ ID NO: 3091574 - RNA, 20 nt, Mycobacterium bovis subsp bovis AF2122/97
gcuuuugcgucugcucgcgc

SEQ ID NO: 3091575 - RNA, 22 nt, Mycobacterium bovis subsp bovis AF2122/97
gcuuuugcgucugcucgcgccg

SEQ ID NO: 3091576 - RNA, 16 nt, Mycobacterium bovis subsp bovis AF2122/97
gcuuuuucccggcggc

SEQ ID NO: 3091577 - RNA, 19 nt, Mycobacterium bovis subsp bovis AF2122/97
ggaaaaauuucuucgccga

SEQ ID NO: 3091578 - RNA, 19 nt, Mycobacterium bovis subsp bovis AF2122/97
ggaaaaccccggccaccag

SEQ ID NO: 3091579 - RNA, 13 nt, Mycobacterium bovis subsp bovis AF2122/97
ggaaaagcccgga

SEQ ID NO: 3091580 - RNA, 18 nt, Mycobacterium bovis subsp bovis AF2122/97
ggaaacaaccccgcgguu

SEQ ID NO: 3091581 - RNA, 22 nt, Mycobacterium bovis subsp bovis AF2122/97
ggaaacaucguucugacggcuu

SEQ ID NO: 3091582 - RNA, 17 nt, Mycobacterium bovis subsp bovis AF2122/97
ggaaaccacagcgccau

SEQ ID NO: 3091583 - RNA, 12 nt, Mycobacterium bovis subsp bovis AF2122/97
ggaaacccgccg

SEQ ID NO: 3091584 - RNA, 14 nt, Mycobacterium bovis subsp bovis AF2122/97
ggaaacccgccgaa

SEQ ID NO: 3091585 - RNA, 19 nt, Mycobacterium bovis subsp bovis AF2122/97
ggaaacccggccagcugcg

SEQ ID NO: 3091586 - RNA, 17 nt, Mycobacterium bovis subsp bovis AF2122/97
ggaaacccggccgccga

SEQ ID NO: 3091587 - RNA, 13 nt, Mycobacterium bovis subsp bovis AF2122/97
ggaaaccgccccg

SEQ ID NO: 3091588 - RNA, 22 nt, Mycobacterium bovis subsp bovis AF2122/97
ggaaaccgccccgugggccucg

SEQ ID NO: 3091589 - RNA, 15 nt, Mycobacterium bovis subsp bovis AF2122/97
ggaaaccggccagcc

SEQ ID NO: 3091590 - RNA, 22 nt, Mycobacterium bovis subsp bovis AF2122/97
ggaaaccucuucgggugcagcc

SEQ ID NO: 3091591 - RNA, 12 nt, Mycobacterium bovis subsp bovis AF2122/97
ggaaacgccagg

SEQ ID NO: 3091592 - RNA, 17 nt, Mycobacterium bovis subsp bovis AF2122/97
ggaaacggagccgagcc

SEQ ID NO: 3091593 - RNA, 21 nt, Mycobacterium bovis subsp bovis AF2122/97
ggaaacggagccgagccgaua

SEQ ID NO: 3091594 - RNA, 18 nt, Mycobacterium bovis subsp bovis AF2122/97
ggaaagcagcagcggcgg

SEQ ID NO: 3091595 - RNA, 17 nt, Mycobacterium bovis subsp bovis AF2122/97
ggaaagcccgcucggau

SEQ ID NO: 3091596 - RNA, 15 nt, Mycobacterium bovis subsp bovis AF2122/97
ggaaagccgcagccg

SEQ ID NO: 3091597 - RNA, 19 nt, Mycobacterium bovis subsp bovis AF2122/97
ggaaagcucuugcacucgg

SEQ ID NO: 3091598 - RNA, 17 nt, Mycobacterium bovis subsp bovis AF2122/97
ggaaaggcgccggucgc

SEQ ID NO: 3091599 - RNA, 15 nt, Mycobacterium bovis subsp bovis AF2122/97
ggaaagggccgccgc

SEQ ID NO: 3091600 - RNA, 17 nt, Mycobacterium bovis subsp bovis AF2122/97
ggaaaucggacgacucg

SEQ ID NO: 3091601 - RNA, 14 nt, Mycobacterium bovis subsp bovis AF2122/97
ggaaaugaaguggc

SEQ ID NO: 3091602 - RNA, 22 nt, Mycobacterium bovis subsp bovis AF2122/97
ggaaauggcgucgccggcaccg

SEQ ID NO: 3091603 - RNA, 13 nt, Mycobacterium bovis subsp bovis AF2122/97
ggaaaugucgcac

SEQ ID NO: 3091604 - RNA, 13 nt, Mycobacterium bovis subsp bovis AF2122/97
ggaaaugucuccu

SEQ ID NO: 3091605 - RNA, 14 nt, Mycobacterium bovis subsp bovis AF2122/97
ggaaauuccaagcg

SEQ ID NO: 3091606 - RNA, 19 nt, Mycobacterium bovis subsp bovis AF2122/97
ggaaauuccggcgcggccg

SEQ ID NO: 3091607 - RNA, 17 nt, Mycobacterium bovis subsp bovis AF2122/97
ggaaauugcgcaaauag

SEQ ID NO: 3091608 - RNA, 17 nt, Mycobacterium bovis subsp bovis AF2122/97
ggaacaaaggcuugcgg

SEQ ID NO: 3091609 - RNA, 18 nt, Mycobacterium bovis subsp bovis AF2122/97
ggaacaacgcgcaaccag

SEQ ID NO: 3091610 - RNA, 20 nt, Mycobacterium bovis subsp bovis AF2122/97
ggaacaacgcgcaaccagcc

SEQ ID NO: 3091611 - RNA, 21 nt, Mycobacterium bovis subsp bovis AF2122/97
ggaacaacggcguaaucggga

SEQ ID NO: 3091612 - RNA, 21 nt, Mycobacterium bovis subsp bovis AF2122/97
ggaacaccaccaggcugucgu

SEQ ID NO: 3091613 - RNA, 12 nt, Mycobacterium bovis subsp bovis AF2122/97
ggaacaccagca

SEQ ID NO: 3091614 - RNA, 15 nt, Mycobacterium bovis subsp bovis AF2122/97
ggaacaccagcaggc

SEQ ID NO: 3091615 - RNA, 17 nt, Mycobacterium bovis subsp bovis AF2122/97
ggaacaccagcaggcgg

SEQ ID NO: 3091616 - RNA, 18 nt, Mycobacterium bovis subsp bovis AF2122/97
ggaacaccagcaggcggc

SEQ ID NO: 3091617 - RNA, 22 nt, Mycobacterium bovis subsp bovis AF2122/97
ggaacacccauaccuucggcga

SEQ ID NO: 3091618 - RNA, 14 nt, Mycobacterium bovis subsp bovis AF2122/97
ggaacaccgaggcg

SEQ ID NO: 3091619 - RNA, 16 nt, Mycobacterium bovis subsp bovis AF2122/97
ggaacaccgcccggcc

SEQ ID NO: 3091620 - RNA, 19 nt, Mycobacterium bovis subsp bovis AF2122/97
ggaacaccgcccggcccgg

SEQ ID NO: 3091621 - RNA, 19 nt, Mycobacterium bovis subsp bovis AF2122/97
ggaacacgaagucgaacgg

SEQ ID NO: 3091622 - RNA, 13 nt, Mycobacterium bovis subsp bovis AF2122/97
ggaacagcagcgc

SEQ ID NO: 3091623 - RNA, 19 nt, Mycobacterium bovis subsp bovis AF2122/97
ggaacaucgucaucgacga

SEQ ID NO: 3091624 - RNA, 19 nt, Mycobacterium bovis subsp bovis AF2122/97
ggaaccaccaguaccaccg

SEQ ID NO: 3091625 - RNA, 21 nt, Mycobacterium bovis subsp bovis AF2122/97
ggaaccacccaccggccacca

SEQ ID NO: 3091626 - RNA, 18 nt, Mycobacterium bovis subsp bovis AF2122/97
ggaaccacucgcucagga

SEQ ID NO: 3091627 - RNA, 16 nt, Mycobacterium bovis subsp bovis AF2122/97
ggaaccagcggucggc

SEQ ID NO: 3091628 - RNA, 17 nt, Mycobacterium bovis subsp bovis AF2122/97
ggaaccagcggucggcg

SEQ ID NO: 3091629 - RNA, 18 nt, Mycobacterium bovis subsp bovis AF2122/97
ggaaccagcggucggcga

SEQ ID NO: 3091630 - RNA, 22 nt, Mycobacterium bovis subsp bovis AF2122/97
ggaaccagcguaucggccggca

SEQ ID NO: 3091631 - RNA, 23 nt, Mycobacterium bovis subsp bovis AF2122/97
ggaaccagcguaucggccggcag

SEQ ID NO: 3091632 - RNA, 17 nt, Mycobacterium bovis subsp bovis AF2122/97
ggaaccaguugacgaag

SEQ ID NO: 3091633 - RNA, 21 nt, Mycobacterium bovis subsp bovis AF2122/97
ggaacccacaguggcucgcgg

SEQ ID NO: 3091634 - RNA, 18 nt, Mycobacterium bovis subsp bovis AF2122/97
ggaacccccagcugcagg

SEQ ID NO: 3091635 - RNA, 21 nt, Mycobacterium bovis subsp bovis AF2122/97
ggaacccccagcugcagggcg

SEQ ID NO: 3091636 - RNA, 17 nt, Mycobacterium bovis subsp bovis AF2122/97
ggaaccccgagcugcca

SEQ ID NO: 3091637 - RNA, 21 nt, Mycobacterium bovis subsp bovis AF2122/97
ggaaccccgagcugccaacgc

SEQ ID NO: 3091638 - RNA, 16 nt, Mycobacterium bovis subsp bovis AF2122/97
ggaaccccggccacug

SEQ ID NO: 3091639 - RNA, 22 nt, Mycobacterium bovis subsp bovis AF2122/97
ggaaccccucgauucccggcgc

SEQ ID NO: 3091640 - RNA, 19 nt, Mycobacterium bovis subsp bovis AF2122/97
ggaacccgaaucccacagc

SEQ ID NO: 3091641 - RNA, 14 nt, Mycobacterium bovis subsp bovis AF2122/97
ggaacccgagccgg

SEQ ID NO: 3091642 - RNA, 19 nt, Mycobacterium bovis subsp bovis AF2122/97
ggaacccgagcuugggccg

SEQ ID NO: 3091643 - RNA, 20 nt, Mycobacterium bovis subsp bovis AF2122/97
ggaacccgagcuugggccgg

SEQ ID NO: 3091644 - RNA, 23 nt, Mycobacterium bovis subsp bovis AF2122/97
ggaaccgacaucccaacccauga

SEQ ID NO: 3091645 - RNA, 19 nt, Mycobacterium bovis subsp bovis AF2122/97
ggaaccgauaccucgccau

SEQ ID NO: 3091646 - RNA, 13 nt, Mycobacterium bovis subsp bovis AF2122/97
ggaaccgaucggu

SEQ ID NO: 3091647 - RNA, 17 nt, Mycobacterium bovis subsp bovis AF2122/97
ggaaccgaucggucgau

SEQ ID NO: 3091648 - RNA, 20 nt, Mycobacterium bovis subsp bovis AF2122/97
ggaaccgaucggucgaucga

SEQ ID NO: 3091649 - RNA, 14 nt, Mycobacterium bovis subsp bovis AF2122/97
ggaaccgggcaaau

SEQ ID NO: 3091650 - RNA, 16 nt, Mycobacterium bovis subsp bovis AF2122/97
ggaaccgggcaaauca

SEQ ID NO: 3091651 - RNA, 17 nt, Mycobacterium bovis subsp bovis AF2122/97
ggaaccgguaucgccaa

SEQ ID NO: 3091652 - RNA, 20 nt, Mycobacterium bovis subsp bovis AF2122/97
ggaaccuugaccgaccagcu

SEQ ID NO: 3091653 - RNA, 17 nt, Mycobacterium bovis subsp bovis AF2122/97
ggaacgagccacgccag

SEQ ID NO: 3091654 - RNA, 17 nt, Mycobacterium bovis subsp bovis AF2122/97
ggaacgagguagcgcgc

SEQ ID NO: 3091655 - RNA, 23 nt, Mycobacterium bovis subsp bovis AF2122/97
ggaacgauagaacguagcgccca

SEQ ID NO: 3091656 - RNA, 21 nt, Mycobacterium bovis subsp bovis AF2122/97
ggaacgaugccgccggcgggc

SEQ ID NO: 3091657 - RNA, 15 nt, Mycobacterium bovis subsp bovis AF2122/97
ggaacgaugccggca

SEQ ID NO: 3091658 - RNA, 16 nt, Mycobacterium bovis subsp bovis AF2122/97
ggaacgccgagcacgc

SEQ ID NO: 3091659 - RNA, 21 nt, Mycobacterium bovis subsp bovis AF2122/97
ggaacgccgagcacgccgagc

SEQ ID NO: 3091660 - RNA, 22 nt, Mycobacterium bovis subsp bovis AF2122/97
ggaacgccgagcacgccgagcc

SEQ ID NO: 3091661 - RNA, 12 nt, Mycobacterium bovis subsp bovis AF2122/97
ggaacgccggca

SEQ ID NO: 3091662 - RNA, 12 nt, Mycobacterium bovis subsp bovis AF2122/97
ggaacgccgggg

SEQ ID NO: 3091663 - RNA, 14 nt, Mycobacterium bovis subsp bovis AF2122/97
ggaacgccucaggg

SEQ ID NO: 3091664 - RNA, 21 nt, Mycobacterium bovis subsp bovis AF2122/97
ggaacgcuaggcgauccagac

SEQ ID NO: 3091665 - RNA, 22 nt, Mycobacterium bovis subsp bovis AF2122/97
ggaacgggcaaaccauugcgcc

SEQ ID NO: 3091666 - RNA, 19 nt, Mycobacterium bovis subsp bovis AF2122/97
ggaacguccagccguggcg

SEQ ID NO: 3091667 - RNA, 23 nt, Mycobacterium bovis subsp bovis AF2122/97
ggaacguccagccguggcggcgg

SEQ ID NO: 3091668 - RNA, 16 nt, Mycobacterium bovis subsp bovis AF2122/97
ggaacgugaccgacgc

SEQ ID NO: 3091669 - RNA, 17 nt, Mycobacterium bovis subsp bovis AF2122/97
ggaacguuucgcugucc

SEQ ID NO: 3091670 - RNA, 21 nt, Mycobacterium bovis subsp bovis AF2122/97
ggaacuacccgccagcaaacc

SEQ ID NO: 3091671 - RNA, 16 nt, Mycobacterium bovis subsp bovis AF2122/97
ggaacuccgcgauccg

SEQ ID NO: 3091672 - RNA, 19 nt, Mycobacterium bovis subsp bovis AF2122/97
ggaacugaugaaccacggc

SEQ ID NO: 3091673 - RNA, 17 nt, Mycobacterium bovis subsp bovis AF2122/97
ggaacugcaugguggcg

SEQ ID NO: 3091674 - RNA, 19 nt, Mycobacterium bovis subsp bovis AF2122/97
ggaacuggacaccguggau

SEQ ID NO: 3091675 - RNA, 16 nt, Mycobacterium bovis subsp bovis AF2122/97
ggaacuggaccacagc

SEQ ID NO: 3091676 - RNA, 16 nt, Mycobacterium bovis subsp bovis AF2122/97
ggaacuggaccggugc

SEQ ID NO: 3091677 - RNA, 21 nt, Mycobacterium bovis subsp bovis AF2122/97
ggaacuggaccggugccagca

SEQ ID NO: 3091678 - RNA, 22 nt, Mycobacterium bovis subsp bovis AF2122/97
ggaacuguaggucacagcugcg

SEQ ID NO: 3091679 - RNA, 16 nt, Mycobacterium bovis subsp bovis AF2122/97
ggaacuugccggugcg

SEQ ID NO: 3091680 - RNA, 20 nt, Mycobacterium bovis subsp bovis AF2122/97
ggaacuugccggugcgcacc

SEQ ID NO: 3091681 - RNA, 17 nt, Mycobacterium bovis subsp bovis AF2122/97
ggaacuugugccgggcg

SEQ ID NO: 3091682 - RNA, 18 nt, Mycobacterium bovis subsp bovis AF2122/97
ggaagaaaccgcagucgc

SEQ ID NO: 3091683 - RNA, 17 nt, Mycobacterium bovis subsp bovis AF2122/97
ggaagaagagguuggcg

SEQ ID NO: 3091684 - RNA, 19 nt, Mycobacterium bovis subsp bovis AF2122/97
ggaagacuuagcgggugcc

SEQ ID NO: 3091685 - RNA, 23 nt, Mycobacterium bovis subsp bovis AF2122/97
ggaagaucacgcgucgugccacu

SEQ ID NO: 3091686 - RNA, 14 nt, Mycobacterium bovis subsp bovis AF2122/97
ggaagaucucggcc

SEQ ID NO: 3091687 - RNA, 18 nt, Mycobacterium bovis subsp bovis AF2122/97
ggaagaucucggccagga

SEQ ID NO: 3091688 - RNA, 17 nt, Mycobacterium bovis subsp bovis AF2122/97
ggaagauguugccgccg

SEQ ID NO: 3091689 - RNA, 22 nt, Mycobacterium bovis subsp bovis AF2122/97
ggaagauuucugggccgcucca

SEQ ID NO: 3091690 - RNA, 21 nt, Mycobacterium bovis subsp bovis AF2122/97
ggaagcagaaguccucggcgg

SEQ ID NO: 3091691 - RNA, 15 nt, Mycobacterium bovis subsp bovis AF2122/97
ggaagcagacuccgg

SEQ ID NO: 3091692 - RNA, 14 nt, Mycobacterium bovis subsp bovis AF2122/97
ggaagcccgaugcg

SEQ ID NO: 3091693 - RNA, 19 nt, Mycobacterium bovis subsp bovis AF2122/97
ggaagcccggcagaugcag

SEQ ID NO: 3091694 - RNA, 15 nt, Mycobacterium bovis subsp bovis AF2122/97
ggaagcccgucgcgg

SEQ ID NO: 3091695 - RNA, 21 nt, Mycobacterium bovis subsp bovis AF2122/97
ggaagccgaccuucucggcgu

SEQ ID NO: 3091696 - RNA, 23 nt, Mycobacterium bovis subsp bovis AF2122/97
ggaagccgaccuucucggcguac

SEQ ID NO: 3091697 - RNA, 12 nt, Mycobacterium bovis subsp bovis AF2122/97
ggaagccgccgg

SEQ ID NO: 3091698 - RNA, 21 nt, Mycobacterium bovis subsp bovis AF2122/97
ggaagccgcgccuugaugguc

SEQ ID NO: 3091699 - RNA, 20 nt, Mycobacterium bovis subsp bovis AF2122/97
ggaagccugcgggccggcau

SEQ ID NO: 3091700 - RNA, 14 nt, Mycobacterium bovis subsp bovis AF2122/97
ggaagcgccggccg

SEQ ID NO: 3091701 - RNA, 17 nt, Mycobacterium bovis subsp bovis AF2122/97
ggaagcgccggccgauc

SEQ ID NO: 3091702 - RNA, 19 nt, Mycobacterium bovis subsp bovis AF2122/97
ggaagcggcggcaaccccg

SEQ ID NO: 3091703 - RNA, 18 nt, Mycobacterium bovis subsp bovis AF2122/97
ggaagcgggauugccgag

SEQ ID NO: 3091704 - RNA, 17 nt, Mycobacterium bovis subsp bovis AF2122/97
ggaagcgggcgaugccg

SEQ ID NO: 3091705 - RNA, 14 nt, Mycobacterium bovis subsp bovis AF2122/97
ggaagcgguggccu

SEQ ID NO: 3091706 - RNA, 21 nt, Mycobacterium bovis subsp bovis AF2122/97
ggaagcgguugacccacagca

SEQ ID NO: 3091707 - RNA, 15 nt, Mycobacterium bovis subsp bovis AF2122/97
ggaaggaaccgggca

SEQ ID NO: 3091708 - RNA, 19 nt, Mycobacterium bovis subsp bovis AF2122/97
ggaaggcccaccauggcug

SEQ ID NO: 3091709 - RNA, 19 nt, Mycobacterium bovis subsp bovis AF2122/97
ggaaggcccggcgcggccg

SEQ ID NO: 3091710 - RNA, 16 nt, Mycobacterium bovis subsp bovis AF2122/97
ggaaggcgcgcgcccg

SEQ ID NO: 3091711 - RNA, 14 nt, Mycobacterium bovis subsp bovis AF2122/97
ggaaggcggccagg

SEQ ID NO: 3091712 - RNA, 17 nt, Mycobacterium bovis subsp bovis AF2122/97
ggaaggcucaccacggu

SEQ ID NO: 3091713 - RNA, 23 nt, Mycobacterium bovis subsp bovis AF2122/97
ggaaggggcgucugcagcgggcg

SEQ ID NO: 3091714 - RNA, 22 nt, Mycobacterium bovis subsp bovis AF2122/97
ggaaggugugcgucuccagcug

SEQ ID NO: 3091715 - RNA, 18 nt, Mycobacterium bovis subsp bovis AF2122/97
ggaaguacacggcggccc

SEQ ID NO: 3091716 - RNA, 19 nt, Mycobacterium bovis subsp bovis AF2122/97
ggaaguacuccacccaggc

SEQ ID NO: 3091717 - RNA, 17 nt, Mycobacterium bovis subsp bovis AF2122/97
ggaaguacuucgcggcg

SEQ ID NO: 3091718 - RNA, 19 nt, Mycobacterium bovis subsp bovis AF2122/97
ggaaguacuuuuggguucg

SEQ ID NO: 3091719 - RNA, 15 nt, Mycobacterium bovis subsp bovis AF2122/97
ggaaguagccgagcc

SEQ ID NO: 3091720 - RNA, 23 nt, Mycobacterium bovis subsp bovis AF2122/97
ggaaguaucgccggccgcgggcg

SEQ ID NO: 3091721 - RNA, 13 nt, Mycobacterium bovis subsp bovis AF2122/97
ggaagucccgagu

SEQ ID NO: 3091722 - RNA, 13 nt, Mycobacterium bovis subsp bovis AF2122/97
ggaagucgagcag

SEQ ID NO: 3091723 - RNA, 15 nt, Mycobacterium bovis subsp bovis AF2122/97
ggaagugcaccugga

SEQ ID NO: 3091724 - RNA, 12 nt, Mycobacterium bovis subsp bovis AF2122/97
ggaagugcggug

SEQ ID NO: 3091725 - RNA, 20 nt, Mycobacterium bovis subsp bovis AF2122/97
ggaagugcggugagauggcg

SEQ ID NO: 3091726 - RNA, 14 nt, Mycobacterium bovis subsp bovis AF2122/97
ggaaguucgucggu

SEQ ID NO: 3091727 - RNA, 23 nt, Mycobacterium bovis subsp bovis AF2122/97
ggaaguugaucuugccgcccuug

SEQ ID NO: 3091728 - RNA, 17 nt, Mycobacterium bovis subsp bovis AF2122/97
ggaaguugcccagguga

SEQ ID NO: 3091729 - RNA, 13 nt, Mycobacterium bovis subsp bovis AF2122/97
ggaauacaacagc

SEQ ID NO: 3091730 - RNA, 17 nt, Mycobacterium bovis subsp bovis AF2122/97
ggaauacaacagcuggg

SEQ ID NO: 3091731 - RNA, 13 nt, Mycobacterium bovis subsp bovis AF2122/97
ggaauacagcuug

SEQ ID NO: 3091732 - RNA, 18 nt, Mycobacterium bovis subsp bovis AF2122/97
ggaauacgcgccgccggc

SEQ ID NO: 3091733 - RNA, 16 nt, Mycobacterium bovis subsp bovis AF2122/97
ggaauauggcggccgg

SEQ ID NO: 3091734 - RNA, 22 nt, Mycobacterium bovis subsp bovis AF2122/97
ggaaucagggucugcgccgccg

SEQ ID NO: 3091735 - RNA, 20 nt, Mycobacterium bovis subsp bovis AF2122/97
ggaauccaccagccgguagc

SEQ ID NO: 3091736 - RNA, 17 nt, Mycobacterium bovis subsp bovis AF2122/97
ggaauccccccugucgc

SEQ ID NO: 3091737 - RNA, 16 nt, Mycobacterium bovis subsp bovis AF2122/97
ggaaucccgagucugc

SEQ ID NO: 3091738 - RNA, 19 nt, Mycobacterium bovis subsp bovis AF2122/97
ggaaucccucggccgcagg

SEQ ID NO: 3091739 - RNA, 20 nt, Mycobacterium bovis subsp bovis AF2122/97
ggaaucccucggccgcaggc

SEQ ID NO: 3091740 - RNA, 19 nt, Mycobacterium bovis subsp bovis AF2122/97
ggaauccgaacgcgauccg

SEQ ID NO: 3091741 - RNA, 14 nt, Mycobacterium bovis subsp bovis AF2122/97
ggaauccgaacucg

SEQ ID NO: 3091742 - RNA, 14 nt, Mycobacterium bovis subsp bovis AF2122/97
ggaauccggccaga

SEQ ID NO: 3091743 - RNA, 18 nt, Mycobacterium bovis subsp bovis AF2122/97
ggaauccggugaugaccg

SEQ ID NO: 3091744 - RNA, 15 nt, Mycobacterium bovis subsp bovis AF2122/97
ggaauccuggccgcc

SEQ ID NO: 3091745 - RNA, 17 nt, Mycobacterium bovis subsp bovis AF2122/97
ggaauccuggccgccgc

SEQ ID NO: 3091746 - RNA, 16 nt, Mycobacterium bovis subsp bovis AF2122/97
ggaaucgcaucggcgg

SEQ ID NO: 3091747 - RNA, 23 nt, Mycobacterium bovis subsp bovis AF2122/97
ggaaucgcgagcuuggccggcag

SEQ ID NO: 3091748 - RNA, 21 nt, Mycobacterium bovis subsp bovis AF2122/97
ggaaucggcggcggauucggu

SEQ ID NO: 3091749 - RNA, 15 nt, Mycobacterium bovis subsp bovis AF2122/97
ggaaucgguuucgac

SEQ ID NO: 3091750 - RNA, 16 nt, Mycobacterium bovis subsp bovis AF2122/97
ggaaucgucgcggccg

SEQ ID NO: 3091751 - RNA, 23 nt, Mycobacterium bovis subsp bovis AF2122/97
ggaaucgucggcgcggcugucgu

SEQ ID NO: 3091752 - RNA, 13 nt, Mycobacterium bovis subsp bovis AF2122/97
ggaaucguucggg

SEQ ID NO: 3091753 - RNA, 14 nt, Mycobacterium bovis subsp bovis AF2122/97
ggaaucuccggcug

SEQ ID NO: 3091754 - RNA, 12 nt, Mycobacterium bovis subsp bovis AF2122/97
ggaaugccgcgg

SEQ ID NO: 3091755 - RNA, 22 nt, Mycobacterium bovis subsp bovis AF2122/97
ggaauggacaggucgggcagca

SEQ ID NO: 3091756 - RNA, 14 nt, Mycobacterium bovis subsp bovis AF2122/97
ggaauggaccagcg

SEQ ID NO: 3091757 - RNA, 17 nt, Mycobacterium bovis subsp bovis AF2122/97
ggaauggaccagcgccc

SEQ ID NO: 3091758 - RNA, 13 nt, Mycobacterium bovis subsp bovis AF2122/97
ggaauggcgccgg

SEQ ID NO: 3091759 - RNA, 16 nt, Mycobacterium bovis subsp bovis AF2122/97
ggaauggcgccggccg

SEQ ID NO: 3091760 - RNA, 22 nt, Mycobacterium bovis subsp bovis AF2122/97
ggaauggcgccggccggcgcgg

SEQ ID NO: 3091761 - RNA, 22 nt, Mycobacterium bovis subsp bovis AF2122/97
ggaauggcucacgcuccgccgg

SEQ ID NO: 3091762 - RNA, 15 nt, Mycobacterium bovis subsp bovis AF2122/97
ggaaugggaccgggc

SEQ ID NO: 3091763 - RNA, 17 nt, Mycobacterium bovis subsp bovis AF2122/97
ggaaugggcgccacagc

SEQ ID NO: 3091764 - RNA, 19 nt, Mycobacterium bovis subsp bovis AF2122/97
ggaaugucgaaacccacgu

SEQ ID NO: 3091765 - RNA, 18 nt, Mycobacterium bovis subsp bovis AF2122/97
ggaauuccccaccgucgu

SEQ ID NO: 3091766 - RNA, 23 nt, Mycobacterium bovis subsp bovis AF2122/97
ggaauuccgcuaccgcacaggca

SEQ ID NO: 3091767 - RNA, 17 nt, Mycobacterium bovis subsp bovis AF2122/97
ggaauucgaucuggcgg

SEQ ID NO: 3091768 - RNA, 19 nt, Mycobacterium bovis subsp bovis AF2122/97
ggacaaacaucgcacccac

SEQ ID NO: 3091769 - RNA, 22 nt, Mycobacterium bovis subsp bovis AF2122/97
ggacaaacaucgcacccaccac

SEQ ID NO: 3091770 - RNA, 24 nt, Mycobacterium bovis subsp bovis AF2122/97
ggacaaagacgccgucggcgccgg

SEQ ID NO: 3091771 - RNA, 16 nt, Mycobacterium bovis subsp bovis AF2122/97
ggacaaagccgucgcg

SEQ ID NO: 3091772 - RNA, 18 nt, Mycobacterium bovis subsp bovis AF2122/97
ggacaaagccgucgcgac

SEQ ID NO: 3091773 - RNA, 22 nt, Mycobacterium bovis subsp bovis AF2122/97
ggacaaagcugcucgucggcgc

SEQ ID NO: 3091774 - RNA, 22 nt, Mycobacterium bovis subsp bovis AF2122/97
ggacaacaagaugccugacacg

SEQ ID NO: 3091775 - RNA, 14 nt, Mycobacterium bovis subsp bovis AF2122/97
ggacaacacggcga

SEQ ID NO: 3091776 - RNA, 14 nt, Mycobacterium bovis subsp bovis AF2122/97
ggacaacagcuugg

SEQ ID NO: 3091777 - RNA, 16 nt, Mycobacterium bovis subsp bovis AF2122/97
ggacaaccccuugccu

SEQ ID NO: 3091778 - RNA, 19 nt, Mycobacterium bovis subsp bovis AF2122/97
ggacaaccuggggccacca

SEQ ID NO: 3091779 - RNA, 13 nt, Mycobacterium bovis subsp bovis AF2122/97
ggacaagcuccuc

SEQ ID NO: 3091780 - RNA, 15 nt, Mycobacterium bovis subsp bovis AF2122/97
ggacaagcuccucgc

SEQ ID NO: 3091781 - RNA, 20 nt, Mycobacterium bovis subsp bovis AF2122/97
ggacaaggucaucggcaucc

SEQ ID NO: 3091782 - RNA, 20 nt, Mycobacterium bovis subsp bovis AF2122/97
ggacaagucggcaccggugc

SEQ ID NO: 3091783 - RNA, 18 nt, Mycobacterium bovis subsp bovis AF2122/97
ggacaagugccggcgcgg

SEQ ID NO: 3091784 - RNA, 18 nt, Mycobacterium bovis subsp bovis AF2122/97
ggacaauggacaccaacc

SEQ ID NO: 3091785 - RNA, 14 nt, Mycobacterium bovis subsp bovis AF2122/97
ggacacacaggcgg

SEQ ID NO: 3091786 - RNA, 22 nt, Mycobacterium bovis subsp bovis AF2122/97
ggacacagcccacaggcggcgc

SEQ ID NO: 3091787 - RNA, 14 nt, Mycobacterium bovis subsp bovis AF2122/97
ggacacagcguccg

SEQ ID NO: 3091788 - RNA, 17 nt, Mycobacterium bovis subsp bovis AF2122/97
ggacacauugaccaggu

SEQ ID NO: 3091789 - RNA, 20 nt, Mycobacterium bovis subsp bovis AF2122/97
ggacaccaacccacccccca

SEQ ID NO: 3091790 - RNA, 16 nt, Mycobacterium bovis subsp bovis AF2122/97
ggacaccaccguggcc

SEQ ID NO: 3091791 - RNA, 11 nt, Mycobacterium bovis subsp bovis AF2122/97
ggacaccaucu

SEQ ID NO: 3091792 - RNA, 14 nt, Mycobacterium bovis subsp bovis AF2122/97
ggacaccgcggcga

SEQ ID NO: 3091793 - RNA, 16 nt, Mycobacterium bovis subsp bovis AF2122/97
ggacaccgcggcgauc

SEQ ID NO: 3091794 - RNA, 16 nt, Mycobacterium bovis subsp bovis AF2122/97
ggacaccggcaccacg

SEQ ID NO: 3091795 - RNA, 16 nt, Mycobacterium bovis subsp bovis AF2122/97
ggacaccgucaugccg

SEQ ID NO: 3091796 - RNA, 19 nt, Mycobacterium bovis subsp bovis AF2122/97
ggacaccguggaucggcag

SEQ ID NO: 3091797 - RNA, 22 nt, Mycobacterium bovis subsp bovis AF2122/97
ggacaccuaccgagaucaccgc

SEQ ID NO: 3091798 - RNA, 23 nt, Mycobacterium bovis subsp bovis AF2122/97
ggacaccuaccgagaucaccgcc

SEQ ID NO: 3091799 - RNA, 15 nt, Mycobacterium bovis subsp bovis AF2122/97
ggacaccucgggcgc

SEQ ID NO: 3091800 - RNA, 14 nt, Mycobacterium bovis subsp bovis AF2122/97
ggacaccugcugca

SEQ ID NO: 3091801 - RNA, 20 nt, Mycobacterium bovis subsp bovis AF2122/97
ggacaccuuccccaaacuau

SEQ ID NO: 3091802 - RNA, 16 nt, Mycobacterium bovis subsp bovis AF2122/97
ggacaccuuucuccac

SEQ ID NO: 3091803 - RNA, 15 nt, Mycobacterium bovis subsp bovis AF2122/97
ggacacgucgugagg

SEQ ID NO: 3091804 - RNA, 13 nt, Mycobacterium bovis subsp bovis AF2122/97
ggacacguggcgu

SEQ ID NO: 3091805 - RNA, 18 nt, Mycobacterium bovis subsp bovis AF2122/97
ggacacguuguucaccga

SEQ ID NO: 3091806 - RNA, 20 nt, Mycobacterium bovis subsp bovis AF2122/97
ggacacguuguucaccgacg

SEQ ID NO: 3091807 - RNA, 21 nt, Mycobacterium bovis subsp bovis AF2122/97
ggacacguuguucaccgacgc

SEQ ID NO: 3091808 - RNA, 24 nt, Mycobacterium bovis subsp bovis AF2122/97
ggacacguuguucaccgacgcgaa

SEQ ID NO: 3091809 - RNA, 21 nt, Mycobacterium bovis subsp bovis AF2122/97
ggacacucccgggugcgacgc

SEQ ID NO: 3091810 - RNA, 21 nt, Mycobacterium bovis subsp bovis AF2122/97
ggacacuccugcacacaggac

SEQ ID NO: 3091811 - RNA, 22 nt, Mycobacterium bovis subsp bovis AF2122/97
ggacacuccugcacacaggacu

SEQ ID NO: 3091812 - RNA, 14 nt, Mycobacterium bovis subsp bovis AF2122/97
ggacagcagccgcc

SEQ ID NO: 3091813 - RNA, 19 nt, Mycobacterium bovis subsp bovis AF2122/97
ggacagcagccgccggccg

SEQ ID NO: 3091814 - RNA, 13 nt, Mycobacterium bovis subsp bovis AF2122/97
ggacagcagccgg

SEQ ID NO: 3091815 - RNA, 24 nt, Mycobacterium bovis subsp bovis AF2122/97
ggacagcccggacgcgcggauggc

SEQ ID NO: 3091816 - RNA, 11 nt, Mycobacterium bovis subsp bovis AF2122/97
ggacagcgccu

SEQ ID NO: 3091817 - RNA, 16 nt, Mycobacterium bovis subsp bovis AF2122/97
ggacaggcccgguggc

SEQ ID NO: 3091818 - RNA, 18 nt, Mycobacterium bovis subsp bovis AF2122/97
ggacaggcuugacugcac

SEQ ID NO: 3091819 - RNA, 22 nt, Mycobacterium bovis subsp bovis AF2122/97
ggacagggcggcaacggcggca

SEQ ID NO: 3091820 - RNA, 15 nt, Mycobacterium bovis subsp bovis AF2122/97
ggacagggcggcgag

SEQ ID NO: 3091821 - RNA, 22 nt, Mycobacterium bovis subsp bovis AF2122/97
ggacagggugggggcaucaggg

SEQ ID NO: 3091822 - RNA, 16 nt, Mycobacterium bovis subsp bovis AF2122/97
ggacagguagucgccg

SEQ ID NO: 3091823 - RNA, 15 nt, Mycobacterium bovis subsp bovis AF2122/97
ggacaggucgggcag

SEQ ID NO: 3091824 - RNA, 17 nt, Mycobacterium bovis subsp bovis AF2122/97
ggacaggucgggcagca

SEQ ID NO: 3091825 - RNA, 15 nt, Mycobacterium bovis subsp bovis AF2122/97
ggacaguuccccggg

SEQ ID NO: 3091826 - RNA, 20 nt, Mycobacterium bovis subsp bovis AF2122/97
ggacaguucgcgccguggcg

SEQ ID NO: 3091827 - RNA, 14 nt, Mycobacterium bovis subsp bovis AF2122/97
ggacaucaccggca

SEQ ID NO: 3091828 - RNA, 16 nt, Mycobacterium bovis subsp bovis AF2122/97
ggacauccagugcggu

SEQ ID NO: 3091829 - RNA, 21 nt, Mycobacterium bovis subsp bovis AF2122/97
ggacauccgcuuacggguguc

SEQ ID NO: 3091830 - RNA, 20 nt, Mycobacterium bovis subsp bovis AF2122/97
ggacauccgggccgagcgca

SEQ ID NO: 3091831 - RNA, 13 nt, Mycobacterium bovis subsp bovis AF2122/97
ggacaucggccgg

SEQ ID NO: 3091832 - RNA, 17 nt, Mycobacterium bovis subsp bovis AF2122/97
ggacaucggccggcguc

SEQ ID NO: 3091833 - RNA, 19 nt, Mycobacterium bovis subsp bovis AF2122/97
ggacaucggccggcgucag

SEQ ID NO: 3091834 - RNA, 15 nt, Mycobacterium bovis subsp bovis AF2122/97
ggacaucgggcggca

SEQ ID NO: 3091835 - RNA, 23 nt, Mycobacterium bovis subsp bovis AF2122/97
ggacaucugacgcuuggccaggu

SEQ ID NO: 3091836 - RNA, 17 nt, Mycobacterium bovis subsp bovis AF2122/97
ggacaugacagccccgc

SEQ ID NO: 3091837 - RNA, 17 nt, Mycobacterium bovis subsp bovis AF2122/97
ggacaugcgggcagcac

SEQ ID NO: 3091838 - RNA, 23 nt, Mycobacterium bovis subsp bovis AF2122/97
ggaccaacgccaacgccacggca

SEQ ID NO: 3091839 - RNA, 14 nt, Mycobacterium bovis subsp bovis AF2122/97
ggaccacagccgcg

SEQ ID NO: 3091840 - RNA, 15 nt, Mycobacterium bovis subsp bovis AF2122/97
ggaccacagccgcgc

SEQ ID NO: 3091841 - RNA, 16 nt, Mycobacterium bovis subsp bovis AF2122/97
ggaccacagccgcgcc

SEQ ID NO: 3091842 - RNA, 18 nt, Mycobacterium bovis subsp bovis AF2122/97
ggaccacaucuggucacg

SEQ ID NO: 3091843 - RNA, 17 nt, Mycobacterium bovis subsp bovis AF2122/97
ggaccaccagcgcucca

SEQ ID NO: 3091844 - RNA, 14 nt, Mycobacterium bovis subsp bovis AF2122/97
ggaccacccggcgc

SEQ ID NO: 3091845 - RNA, 20 nt, Mycobacterium bovis subsp bovis AF2122/97
ggaccaccgcauaacgccag

SEQ ID NO: 3091846 - RNA, 15 nt, Mycobacterium bovis subsp bovis AF2122/97
ggaccaccgcucgcc

SEQ ID NO: 3091847 - RNA, 17 nt, Mycobacterium bovis subsp bovis AF2122/97
ggaccaccgcucgccac

SEQ ID NO: 3091848 - RNA, 15 nt, Mycobacterium bovis subsp bovis AF2122/97
ggaccacgccgacgu

SEQ ID NO: 3091849 - RNA, 17 nt, Mycobacterium bovis subsp bovis AF2122/97
ggaccacgugaucgacg

SEQ ID NO: 3091850 - RNA, 23 nt, Mycobacterium bovis subsp bovis AF2122/97
ggaccacuaguucgagcugccag

SEQ ID NO: 3091851 - RNA, 15 nt, Mycobacterium bovis subsp bovis AF2122/97
ggaccacucgccggc

SEQ ID NO: 3091852 - RNA, 17 nt, Mycobacterium bovis subsp bovis AF2122/97
ggaccacucgccggcgg

SEQ ID NO: 3091853 - RNA, 14 nt, Mycobacterium bovis subsp bovis AF2122/97
ggaccagaggcgcu

SEQ ID NO: 3091854 - RNA, 21 nt, Mycobacterium bovis subsp bovis AF2122/97
ggaccagaggcgcuucgccac

SEQ ID NO: 3091855 - RNA, 12 nt, Mycobacterium bovis subsp bovis AF2122/97
ggaccagcaccg

SEQ ID NO: 3091856 - RNA, 15 nt, Mycobacterium bovis subsp bovis AF2122/97
ggaccagcaccgccg

SEQ ID NO: 3091857 - RNA, 17 nt, Mycobacterium bovis subsp bovis AF2122/97
ggaccagcaccgccgcg

SEQ ID NO: 3091858 - RNA, 11 nt, Mycobacterium bovis subsp bovis AF2122/97
ggaccagcgcc

SEQ ID NO: 3091859 - RNA, 18 nt, Mycobacterium bovis subsp bovis AF2122/97
ggaccagcgccccggcgc

SEQ ID NO: 3091860 - RNA, 20 nt, Mycobacterium bovis subsp bovis AF2122/97
ggaccagcgccggaccgucu

SEQ ID NO: 3091861 - RNA, 21 nt, Mycobacterium bovis subsp bovis AF2122/97
ggaccagcguggggccgccac

SEQ ID NO: 3091862 - RNA, 12 nt, Mycobacterium bovis subsp bovis AF2122/97
ggaccagcuccu

SEQ ID NO: 3091863 - RNA, 15 nt, Mycobacterium bovis subsp bovis AF2122/97
ggaccagcugccggc

SEQ ID NO: 3091864 - RNA, 22 nt, Mycobacterium bovis subsp bovis AF2122/97
ggaccagugcgguggcagguga

SEQ ID NO: 3091865 - RNA, 19 nt, Mycobacterium bovis subsp bovis AF2122/97
ggaccauagucgccgucgu

SEQ ID NO: 3091866 - RNA, 18 nt, Mycobacterium bovis subsp bovis AF2122/97
ggaccaucagcgucgacg

SEQ ID NO: 3091867 - RNA, 17 nt, Mycobacterium bovis subsp bovis AF2122/97
ggaccaucgacaacgcc

SEQ ID NO: 3091868 - RNA, 16 nt, Mycobacterium bovis subsp bovis AF2122/97
ggaccaucgccaggcc

SEQ ID NO: 3091869 - RNA, 13 nt, Mycobacterium bovis subsp bovis AF2122/97
ggaccaucgccug

SEQ ID NO: 3091870 - RNA, 15 nt, Mycobacterium bovis subsp bovis AF2122/97
ggacccacccgcacc

SEQ ID NO: 3091871 - RNA, 22 nt, Mycobacterium bovis subsp bovis AF2122/97
ggacccacccgcaccgccggca

SEQ ID NO: 3091872 - RNA, 12 nt, Mycobacterium bovis subsp bovis AF2122/97
ggacccagcacc

SEQ ID NO: 3091873 - RNA, 14 nt, Mycobacterium bovis subsp bovis AF2122/97
ggacccagccagcu

SEQ ID NO: 3091874 - RNA, 17 nt, Mycobacterium bovis subsp bovis AF2122/97
ggacccagccagcugga

SEQ ID NO: 3091875 - RNA, 14 nt, Mycobacterium bovis subsp bovis AF2122/97
ggacccaucgccag

SEQ ID NO: 3091876 - RNA, 12 nt, Mycobacterium bovis subsp bovis AF2122/97
ggacccgcagcu

SEQ ID NO: 3091877 - RNA, 15 nt, Mycobacterium bovis subsp bovis AF2122/97
ggacccgcagcugcg

SEQ ID NO: 3091878 - RNA, 19 nt, Mycobacterium bovis subsp bovis AF2122/97
ggacccgcagcugcggauc

SEQ ID NO: 3091879 - RNA, 12 nt, Mycobacterium bovis subsp bovis AF2122/97
ggacccgccagg

SEQ ID NO: 3091880 - RNA, 16 nt, Mycobacterium bovis subsp bovis AF2122/97
ggacccgcgcgucgcc

SEQ ID NO: 3091881 - RNA, 19 nt, Mycobacterium bovis subsp bovis AF2122/97
ggacccgcgcgucgcccag

SEQ ID NO: 3091882 - RNA, 13 nt, Mycobacterium bovis subsp bovis AF2122/97
ggacccggccggc

SEQ ID NO: 3091883 - RNA, 17 nt, Mycobacterium bovis subsp bovis AF2122/97
ggacccggcgccgucga

SEQ ID NO: 3091884 - RNA, 20 nt, Mycobacterium bovis subsp bovis AF2122/97
ggacccggugacccgcuggg

SEQ ID NO: 3091885 - RNA, 12 nt, Mycobacterium bovis subsp bovis AF2122/97
ggacccgucggc

SEQ ID NO: 3091886 - RNA, 19 nt, Mycobacterium bovis subsp bovis AF2122/97
ggacccgugagcucgucga

SEQ ID NO: 3091887 - RNA, 20 nt, Mycobacterium bovis subsp bovis AF2122/97
ggacccgugagcucgucgag

SEQ ID NO: 3091888 - RNA, 19 nt, Mycobacterium bovis subsp bovis AF2122/97
ggacccugcgccgccacag

SEQ ID NO: 3091889 - RNA, 16 nt, Mycobacterium bovis subsp bovis AF2122/97
ggacccuuccgccgcc

SEQ ID NO: 3091890 - RNA, 13 nt, Mycobacterium bovis subsp bovis AF2122/97
ggaccgaccaccg

SEQ ID NO: 3091891 - RNA, 14 nt, Mycobacterium bovis subsp bovis AF2122/97
ggaccgaccggcuc

SEQ ID NO: 3091892 - RNA, 23 nt, Mycobacterium bovis subsp bovis AF2122/97
ggaccgagccgaucugcugucgg

SEQ ID NO: 3091893 - RNA, 18 nt, Mycobacterium bovis subsp bovis AF2122/97
ggaccgaucuuggccacc

SEQ ID NO: 3091894 - RNA, 22 nt, Mycobacterium bovis subsp bovis AF2122/97
ggaccgaugacgaucggcggcg

SEQ ID NO: 3091895 - RNA, 22 nt, Mycobacterium bovis subsp bovis AF2122/97
ggaccgcagcgacgggaaagcc

SEQ ID NO: 3091896 - RNA, 14 nt, Mycobacterium bovis subsp bovis AF2122/97
ggaccgcagcguga

SEQ ID NO: 3091897 - RNA, 23 nt, Mycobacterium bovis subsp bovis AF2122/97
ggaccgcagcgugaucuggccac

SEQ ID NO: 3091898 - RNA, 21 nt, Mycobacterium bovis subsp bovis AF2122/97
ggaccgcccgagucucgucgg

SEQ ID NO: 3091899 - RNA, 20 nt, Mycobacterium bovis subsp bovis AF2122/97
ggaccgcccgugccgucgcc

SEQ ID NO: 3091900 - RNA, 15 nt, Mycobacterium bovis subsp bovis AF2122/97
ggaccgccgaucggc

SEQ ID NO: 3091901 - RNA, 17 nt, Mycobacterium bovis subsp bovis AF2122/97
ggaccgccgaucggcca

SEQ ID NO: 3091902 - RNA, 13 nt, Mycobacterium bovis subsp bovis AF2122/97
ggaccgccgccga

SEQ ID NO: 3091903 - RNA, 14 nt, Mycobacterium bovis subsp bovis AF2122/97
ggaccgccgccgac

SEQ ID NO: 3091904 - RNA, 20 nt, Mycobacterium bovis subsp bovis AF2122/97
ggaccgcgacggcgccggca

SEQ ID NO: 3091905 - RNA, 21 nt, Mycobacterium bovis subsp bovis AF2122/97
ggaccgcgacggcgccggcau

SEQ ID NO: 3091906 - RNA, 14 nt, Mycobacterium bovis subsp bovis AF2122/97
ggaccgcgcccaga

SEQ ID NO: 3091907 - RNA, 20 nt, Mycobacterium bovis subsp bovis AF2122/97
ggaccgcggauuccagcgcg

SEQ ID NO: 3091908 - RNA, 21 nt, Mycobacterium bovis subsp bovis AF2122/97
ggaccgcggauuccagcgcgu

SEQ ID NO: 3091909 - RNA, 22 nt, Mycobacterium bovis subsp bovis AF2122/97
ggaccgcggcgcguccgggcuc

SEQ ID NO: 3091910 - RNA, 17 nt, Mycobacterium bovis subsp bovis AF2122/97
ggaccgcggucauggcg

SEQ ID NO: 3091911 - RNA, 21 nt, Mycobacterium bovis subsp bovis AF2122/97
ggaccgcggugacccggaagc

SEQ ID NO: 3091912 - RNA, 14 nt, Mycobacterium bovis subsp bovis AF2122/97
ggaccgcucgucgc

SEQ ID NO: 3091913 - RNA, 20 nt, Mycobacterium bovis subsp bovis AF2122/97
ggaccggcaauuuucugcug

SEQ ID NO: 3091914 - RNA, 12 nt, Mycobacterium bovis subsp bovis AF2122/97
ggaccggcaggc

SEQ ID NO: 3091915 - RNA, 14 nt, Mycobacterium bovis subsp bovis AF2122/97
ggaccggcuccggu

SEQ ID NO: 3091916 - RNA, 20 nt, Mycobacterium bovis subsp bovis AF2122/97
ggaccgggaucgucaggccc

SEQ ID NO: 3091917 - RNA, 19 nt, Mycobacterium bovis subsp bovis AF2122/97
ggaccgggucgggcaccgc

SEQ ID NO: 3091918 - RNA, 20 nt, Mycobacterium bovis subsp bovis AF2122/97
ggaccgggucgggcaccgcg

SEQ ID NO: 3091919 - RNA, 16 nt, Mycobacterium bovis subsp bovis AF2122/97
ggaccguccgacggcg

SEQ ID NO: 3091920 - RNA, 12 nt, Mycobacterium bovis subsp bovis AF2122/97
ggaccgucgugg

SEQ ID NO: 3091921 - RNA, 14 nt, Mycobacterium bovis subsp bovis AF2122/97
ggaccgucguggcg

SEQ ID NO: 3091922 - RNA, 20 nt, Mycobacterium bovis subsp bovis AF2122/97
ggaccgucuuuggugccgag

SEQ ID NO: 3091923 - RNA, 22 nt, Mycobacterium bovis subsp bovis AF2122/97
ggaccgucuuuggugccgagca

SEQ ID NO: 3091924 - RNA, 19 nt, Mycobacterium bovis subsp bovis AF2122/97
ggaccgugacguaucgccg

SEQ ID NO: 3091925 - RNA, 14 nt, Mycobacterium bovis subsp bovis AF2122/97
ggaccguggcagcu

SEQ ID NO: 3091926 - RNA, 21 nt, Mycobacterium bovis subsp bovis AF2122/97
ggaccuccggauaacccagcg

SEQ ID NO: 3091927 - RNA, 13 nt, Mycobacterium bovis subsp bovis AF2122/97
ggaccuccucgcc

SEQ ID NO: 3091928 - RNA, 20 nt, Mycobacterium bovis subsp bovis AF2122/97
ggaccucgaagcccagcacc

SEQ ID NO: 3091929 - RNA, 13 nt, Mycobacterium bovis subsp bovis AF2122/97
ggaccucgcccau

SEQ ID NO: 3091930 - RNA, 20 nt, Mycobacterium bovis subsp bovis AF2122/97
ggaccucggcgaccugcucg

SEQ ID NO: 3091931 - RNA, 21 nt, Mycobacterium bovis subsp bovis AF2122/97
ggaccucguugcugccggcgu

SEQ ID NO: 3091932 - RNA, 12 nt, Mycobacterium bovis subsp bovis AF2122/97
ggaccugaccgg

SEQ ID NO: 3091933 - RNA, 19 nt, Mycobacterium bovis subsp bovis AF2122/97
ggaccugcgagaucggaug

SEQ ID NO: 3091934 - RNA, 22 nt, Mycobacterium bovis subsp bovis AF2122/97
ggaccugcgucaucgcggguga

SEQ ID NO: 3091935 - RNA, 20 nt, Mycobacterium bovis subsp bovis AF2122/97
ggaccugggcgacuaccggc

SEQ ID NO: 3091936 - RNA, 19 nt, Mycobacterium bovis subsp bovis AF2122/97
ggaccugugcggccgacgg

SEQ ID NO: 3091937 - RNA, 20 nt, Mycobacterium bovis subsp bovis AF2122/97
ggaccuucugucccugcagu

SEQ ID NO: 3091938 - RNA, 22 nt, Mycobacterium bovis subsp bovis AF2122/97
ggaccuuggcgaccaugcuccu

SEQ ID NO: 3091939 - RNA, 15 nt, Mycobacterium bovis subsp bovis AF2122/97
ggacgaaaucggcgg

SEQ ID NO: 3091940 - RNA, 23 nt, Mycobacterium bovis subsp bovis AF2122/97
ggacgaacaacgcgacgaagcag

SEQ ID NO: 3091941 - RNA, 19 nt, Mycobacterium bovis subsp bovis AF2122/97
ggacgaacacaccgguguc

SEQ ID NO: 3091942 - RNA, 18 nt, Mycobacterium bovis subsp bovis AF2122/97
ggacgaaccggccgacgc

SEQ ID NO: 3091943 - RNA, 21 nt, Mycobacterium bovis subsp bovis AF2122/97
ggacgaacgcuggcggcgugc

SEQ ID NO: 3091944 - RNA, 17 nt, Mycobacterium bovis subsp bovis AF2122/97
ggacgaacugcugauga

SEQ ID NO: 3091945 - RNA, 23 nt, Mycobacterium bovis subsp bovis AF2122/97
ggacgaaucccgcgcccggccgg

SEQ ID NO: 3091946 - RNA, 24 nt, Mycobacterium bovis subsp bovis AF2122/97
ggacgaaucccgcgcccggccggu

SEQ ID NO: 3091947 - RNA, 15 nt, Mycobacterium bovis subsp bovis AF2122/97
ggacgacaacaggcc

SEQ ID NO: 3091948 - RNA, 20 nt, Mycobacterium bovis subsp bovis AF2122/97
ggacgacaacaggccgucga

SEQ ID NO: 3091949 - RNA, 12 nt, Mycobacterium bovis subsp bovis AF2122/97
ggacgacaccgc

SEQ ID NO: 3091950 - RNA, 19 nt, Mycobacterium bovis subsp bovis AF2122/97
ggacgaccgcgcggcacuu

SEQ ID NO: 3091951 - RNA, 16 nt, Mycobacterium bovis subsp bovis AF2122/97
ggacgacgaucaagcc

SEQ ID NO: 3091952 - RNA, 18 nt, Mycobacterium bovis subsp bovis AF2122/97
ggacgacgccaccugacg

SEQ ID NO: 3091953 - RNA, 15 nt, Mycobacterium bovis subsp bovis AF2122/97
ggacgacgccgacga

SEQ ID NO: 3091954 - RNA, 20 nt, Mycobacterium bovis subsp bovis AF2122/97
ggacgacgccgacgaugacg

SEQ ID NO: 3091955 - RNA, 15 nt, Mycobacterium bovis subsp bovis AF2122/97
ggacgacggcaagaa

SEQ ID NO: 3091956 - RNA, 19 nt, Mycobacterium bovis subsp bovis AF2122/97
ggacgagguucugccgcga

SEQ ID NO: 3091957 - RNA, 16 nt, Mycobacterium bovis subsp bovis AF2122/97
ggacgauaccgggcua

SEQ ID NO: 3091958 - RNA, 16 nt, Mycobacterium bovis subsp bovis AF2122/97
ggacgauacgcgcacc

SEQ ID NO: 3091959 - RNA, 23 nt, Mycobacterium bovis subsp bovis AF2122/97
ggacgaucagggugucgaagagc

SEQ ID NO: 3091960 - RNA, 21 nt, Mycobacterium bovis subsp bovis AF2122/97
ggacgaugcccuccucgaccg

SEQ ID NO: 3091961 - RNA, 20 nt, Mycobacterium bovis subsp bovis AF2122/97
ggacgauggcgucggccagg

SEQ ID NO: 3091962 - RNA, 23 nt, Mycobacterium bovis subsp bovis AF2122/97
ggacgauggcgucggccaggauc

SEQ ID NO: 3091963 - RNA, 15 nt, Mycobacterium bovis subsp bovis AF2122/97
ggacgcacgauccgc

SEQ ID NO: 3091964 - RNA, 18 nt, Mycobacterium bovis subsp bovis AF2122/97
ggacgcacgauccgcacc

SEQ ID NO: 3091965 - RNA, 19 nt, Mycobacterium bovis subsp bovis AF2122/97
ggacgccagcucaaccaca

SEQ ID NO: 3091966 - RNA, 21 nt, Mycobacterium bovis subsp bovis AF2122/97
ggacgccagcucaaccacaug

SEQ ID NO: 3091967 - RNA, 15 nt, Mycobacterium bovis subsp bovis AF2122/97
ggacgcccgaguuga

SEQ ID NO: 3091968 - RNA, 14 nt, Mycobacterium bovis subsp bovis AF2122/97
ggacgcccggcgca

SEQ ID NO: 3091969 - RNA, 20 nt, Mycobacterium bovis subsp bovis AF2122/97
ggacgcccggcgcaccaucg

SEQ ID NO: 3091970 - RNA, 15 nt, Mycobacterium bovis subsp bovis AF2122/97
ggacgcccgugcggc

SEQ ID NO: 3091971 - RNA, 15 nt, Mycobacterium bovis subsp bovis AF2122/97
ggacgcccucggggu

SEQ ID NO: 3091972 - RNA, 23 nt, Mycobacterium bovis subsp bovis AF2122/97
ggacgccgcccucucacggcggu

SEQ ID NO: 3091973 - RNA, 15 nt, Mycobacterium bovis subsp bovis AF2122/97
ggacgccgccggaga

SEQ ID NO: 3091974 - RNA, 16 nt, Mycobacterium bovis subsp bovis AF2122/97
ggacgccgccggagau

SEQ ID NO: 3091975 - RNA, 17 nt, Mycobacterium bovis subsp bovis AF2122/97
ggacgccgcgccgcaga

SEQ ID NO: 3091976 - RNA, 16 nt, Mycobacterium bovis subsp bovis AF2122/97
ggacgccgcgccggcg

SEQ ID NO: 3091977 - RNA, 12 nt, Mycobacterium bovis subsp bovis AF2122/97
ggacgccggcgc

SEQ ID NO: 3091978 - RNA, 13 nt, Mycobacterium bovis subsp bovis AF2122/97
ggacgccggcgcc

SEQ ID NO: 3091979 - RNA, 17 nt, Mycobacterium bovis subsp bovis AF2122/97
ggacgccggcgccgcca

SEQ ID NO: 3091980 - RNA, 19 nt, Mycobacterium bovis subsp bovis AF2122/97
ggacgccuugaucggcgag

SEQ ID NO: 3091981 - RNA, 21 nt, Mycobacterium bovis subsp bovis AF2122/97
ggacgccuugcacaagcugaa

SEQ ID NO: 3091982 - RNA, 17 nt, Mycobacterium bovis subsp bovis AF2122/97
ggacgcgaaauccccug

SEQ ID NO: 3091983 - RNA, 16 nt, Mycobacterium bovis subsp bovis AF2122/97
ggacgcgacucggcgg

SEQ ID NO: 3091984 - RNA, 18 nt, Mycobacterium bovis subsp bovis AF2122/97
ggacgcgacucggcgguc

SEQ ID NO: 3091985 - RNA, 14 nt, Mycobacterium bovis subsp bovis AF2122/97
ggacgcgaucggcg

SEQ ID NO: 3091986 - RNA, 16 nt, Mycobacterium bovis subsp bovis AF2122/97
ggacgcgaucggcguc

SEQ ID NO: 3091987 - RNA, 16 nt, Mycobacterium bovis subsp bovis AF2122/97
ggacgcgcagcaucgg

SEQ ID NO: 3091988 - RNA, 18 nt, Mycobacterium bovis subsp bovis AF2122/97
ggacgcgcagcaucggcg

SEQ ID NO: 3091989 - RNA, 21 nt, Mycobacterium bovis subsp bovis AF2122/97
ggacgcgcagcaucggcgaca

SEQ ID NO: 3091990 - RNA, 17 nt, Mycobacterium bovis subsp bovis AF2122/97
ggacgcgcaugccccga

SEQ ID NO: 3091991 - RNA, 18 nt, Mycobacterium bovis subsp bovis AF2122/97
ggacgcgcauuucaccgg

SEQ ID NO: 3091992 - RNA, 21 nt, Mycobacterium bovis subsp bovis AF2122/97
ggacgcgcauuucaccggggc

SEQ ID NO: 3091993 - RNA, 12 nt, Mycobacterium bovis subsp bovis AF2122/97
ggacgcuccggg

SEQ ID NO: 3091994 - RNA, 22 nt, Mycobacterium bovis subsp bovis AF2122/97
ggacgcugauugcgaccgcgcc

SEQ ID NO: 3091995 - RNA, 12 nt, Mycobacterium bovis subsp bovis AF2122/97
ggacgcugccgc

SEQ ID NO: 3091996 - RNA, 15 nt, Mycobacterium bovis subsp bovis AF2122/97
ggacgcugccggugu

SEQ ID NO: 3091997 - RNA, 17 nt, Mycobacterium bovis subsp bovis AF2122/97
ggacgcuuggguagccu

SEQ ID NO: 3091998 - RNA, 19 nt, Mycobacterium bovis subsp bovis AF2122/97
ggacggauaguucaccaca

SEQ ID NO: 3091999 - RNA, 13 nt, Mycobacterium bovis subsp bovis AF2122/97
ggacggcaccggc

SEQ ID NO: 3092000 - RNA, 21 nt, Mycobacterium bovis subsp bovis AF2122/97
ggacggcagccaccagcgacg

SEQ ID NO: 3092001 - RNA, 13 nt, Mycobacterium bovis subsp bovis AF2122/97
ggacggcaggcgg

SEQ ID NO: 3092002 - RNA, 23 nt, Mycobacterium bovis subsp bovis AF2122/97
ggacggcauagcagccagcgucc

SEQ ID NO: 3092003 - RNA, 16 nt, Mycobacterium bovis subsp bovis AF2122/97
ggacggccaacagggc

SEQ ID NO: 3092004 - RNA, 21 nt, Mycobacterium bovis subsp bovis AF2122/97
ggacggccaacagggcgccga

SEQ ID NO: 3092005 - RNA, 12 nt, Mycobacterium bovis subsp bovis AF2122/97
ggacggccucca

SEQ ID NO: 3092006 - RNA, 18 nt, Mycobacterium bovis subsp bovis AF2122/97
ggacggcgcgagccgcac

SEQ ID NO: 3092007 - RNA, 20 nt, Mycobacterium bovis subsp bovis AF2122/97
ggacggcguugagcaggugc

SEQ ID NO: 3092008 - RNA, 18 nt, Mycobacterium bovis subsp bovis AF2122/97
ggacggcuaccaccgcac

SEQ ID NO: 3092009 - RNA, 21 nt, Mycobacterium bovis subsp bovis AF2122/97
ggacggcuaccaccgcaccug

SEQ ID NO: 3092010 - RNA, 16 nt, Mycobacterium bovis subsp bovis AF2122/97
ggacggcuugagccgc

SEQ ID NO: 3092011 - RNA, 22 nt, Mycobacterium bovis subsp bovis AF2122/97
ggacgggaguugaucuccacgg

SEQ ID NO: 3092012 - RNA, 18 nt, Mycobacterium bovis subsp bovis AF2122/97
ggacgggaucgcccaggc

SEQ ID NO: 3092013 - RNA, 20 nt, Mycobacterium bovis subsp bovis AF2122/97
ggacgggaugcuuggucucg

SEQ ID NO: 3092014 - RNA, 20 nt, Mycobacterium bovis subsp bovis AF2122/97
ggacgggggcuguccaccga

SEQ ID NO: 3092015 - RNA, 20 nt, Mycobacterium bovis subsp bovis AF2122/97
ggacgggguacugcggcucg

SEQ ID NO: 3092016 - RNA, 14 nt, Mycobacterium bovis subsp bovis AF2122/97
ggacgggucgccgc

SEQ ID NO: 3092017 - RNA, 16 nt, Mycobacterium bovis subsp bovis AF2122/97
ggacgggucucgcgag

SEQ ID NO: 3092018 - RNA, 15 nt, Mycobacterium bovis subsp bovis AF2122/97
ggacgggugcagcgc

SEQ ID NO: 3092019 - RNA, 14 nt, Mycobacterium bovis subsp bovis AF2122/97
ggacggucgccagg

SEQ ID NO: 3092020 - RNA, 16 nt, Mycobacterium bovis subsp bovis AF2122/97
ggacggugcggucaga

SEQ ID NO: 3092021 - RNA, 16 nt, Mycobacterium bovis subsp bovis AF2122/97
ggacggugggucucga

SEQ ID NO: 3092022 - RNA, 20 nt, Mycobacterium bovis subsp bovis AF2122/97
ggacguacugucgucgcccu

SEQ ID NO: 3092023 - RNA, 20 nt, Mycobacterium bovis subsp bovis AF2122/97
ggacgucaccgucaguucgg

SEQ ID NO: 3092024 - RNA, 18 nt, Mycobacterium bovis subsp bovis AF2122/97
ggacgucgugaccggcgg

SEQ ID NO: 3092025 - RNA, 19 nt, Mycobacterium bovis subsp bovis AF2122/97
ggacgucgugaccggcggg

SEQ ID NO: 3092026 - RNA, 22 nt, Mycobacterium bovis subsp bovis AF2122/97
ggacgugacgucguggcgcucg

SEQ ID NO: 3092027 - RNA, 11 nt, Mycobacterium bovis subsp bovis AF2122/97
ggacgugcagc

SEQ ID NO: 3092028 - RNA, 21 nt, Mycobacterium bovis subsp bovis AF2122/97
ggacgugcagccgcagguggg

SEQ ID NO: 3092029 - RNA, 22 nt, Mycobacterium bovis subsp bovis AF2122/97
ggacgugcccgguguucaucac

SEQ ID NO: 3092030 - RNA, 17 nt, Mycobacterium bovis subsp bovis AF2122/97
ggacgugcccugacgcc

SEQ ID NO: 3092031 - RNA, 14 nt, Mycobacterium bovis subsp bovis AF2122/97
ggacguucuggauc

SEQ ID NO: 3092032 - RNA, 19 nt, Mycobacterium bovis subsp bovis AF2122/97
ggacguuguccaccgccac

SEQ ID NO: 3092033 - RNA, 16 nt, Mycobacterium bovis subsp bovis AF2122/97
ggacguuucagccggg

SEQ ID NO: 3092034 - RNA, 19 nt, Mycobacterium bovis subsp bovis AF2122/97
ggacguuugagaccccaac

SEQ ID NO: 3092035 - RNA, 14 nt, Mycobacterium bovis subsp bovis AF2122/97
ggacuaccacccgc

SEQ ID NO: 3092036 - RNA, 14 nt, Mycobacterium bovis subsp bovis AF2122/97
ggacuaccgccggc

SEQ ID NO: 3092037 - RNA, 18 nt, Mycobacterium bovis subsp bovis AF2122/97
ggacuaccgccggcggcg

SEQ ID NO: 3092038 - RNA, 21 nt, Mycobacterium bovis subsp bovis AF2122/97
ggacuacuaggccccuggccg

SEQ ID NO: 3092039 - RNA, 18 nt, Mycobacterium bovis subsp bovis AF2122/97
ggacuccggccgcacgcc

SEQ ID NO: 3092040 - RNA, 17 nt, Mycobacterium bovis subsp bovis AF2122/97
ggacuccggucagcgcg

SEQ ID NO: 3092041 - RNA, 16 nt, Mycobacterium bovis subsp bovis AF2122/97
ggacucgcguccucgg

SEQ ID NO: 3092042 - RNA, 19 nt, Mycobacterium bovis subsp bovis AF2122/97
ggacucggaauucggcguc

SEQ ID NO: 3092043 - RNA, 21 nt, Mycobacterium bovis subsp bovis AF2122/97
ggacucggaauucggcgucgu

SEQ ID NO: 3092044 - RNA, 18 nt, Mycobacterium bovis subsp bovis AF2122/97
ggacucgggcgcugaugc

SEQ ID NO: 3092045 - RNA, 17 nt, Mycobacterium bovis subsp bovis AF2122/97
ggacucuucagcuaccu

SEQ ID NO: 3092046 - RNA, 22 nt, Mycobacterium bovis subsp bovis AF2122/97
ggacucuucagcuaccuccgcc

SEQ ID NO: 3092047 - RNA, 18 nt, Mycobacterium bovis subsp bovis AF2122/97
ggacugaacaguugcaca

SEQ ID NO: 3092048 - RNA, 13 nt, Mycobacterium bovis subsp bovis AF2122/97
ggacugaagagca

SEQ ID NO: 3092049 - RNA, 15 nt, Mycobacterium bovis subsp bovis AF2122/97
ggacugaccucguca

SEQ ID NO: 3092050 - RNA, 23 nt, Mycobacterium bovis subsp bovis AF2122/97
ggacugaucgcgauccacccggc

SEQ ID NO: 3092051 - RNA, 11 nt, Mycobacterium bovis subsp bovis AF2122/97
ggacugcagcg

SEQ ID NO: 3092052 - RNA, 14 nt, Mycobacterium bovis subsp bovis AF2122/97
ggacugcagcgcgg

SEQ ID NO: 3092053 - RNA, 16 nt, Mycobacterium bovis subsp bovis AF2122/97
ggacugcagcgcggug

SEQ ID NO: 3092054 - RNA, 20 nt, Mycobacterium bovis subsp bovis AF2122/97
ggacugcgaagaguccuuaa

SEQ ID NO: 3092055 - RNA, 12 nt, Mycobacterium bovis subsp bovis AF2122/97
ggacugcgccac

SEQ ID NO: 3092056 - RNA, 15 nt, Mycobacterium bovis subsp bovis AF2122/97
ggacugcgccaccgg

SEQ ID NO: 3092057 - RNA, 14 nt, Mycobacterium bovis subsp bovis AF2122/97
ggacugcgccgggu

SEQ ID NO: 3092058 - RNA, 23 nt, Mycobacterium bovis subsp bovis AF2122/97
ggacugcggaacaccagcaggcg

SEQ ID NO: 3092059 - RNA, 18 nt, Mycobacterium bovis subsp bovis AF2122/97
ggacugcggacacguugc

SEQ ID NO: 3092060 - RNA, 21 nt, Mycobacterium bovis subsp bovis AF2122/97
ggacugcggucuggacaucgg

SEQ ID NO: 3092061 - RNA, 17 nt, Mycobacterium bovis subsp bovis AF2122/97
ggacuggcaccgccagc

SEQ ID NO: 3092062 - RNA, 18 nt, Mycobacterium bovis subsp bovis AF2122/97
ggacuggcaccgccagcc

SEQ ID NO: 3092063 - RNA, 16 nt, Mycobacterium bovis subsp bovis AF2122/97
ggacugucccaccagg

SEQ ID NO: 3092064 - RNA, 19 nt, Mycobacterium bovis subsp bovis AF2122/97
ggacuucagcaggcccagc

SEQ ID NO: 3092065 - RNA, 21 nt, Mycobacterium bovis subsp bovis AF2122/97
ggacuuccggggagcagagaa

SEQ ID NO: 3092066 - RNA, 14 nt, Mycobacterium bovis subsp bovis AF2122/97
ggacuucgggggcc

SEQ ID NO: 3092067 - RNA, 23 nt, Mycobacterium bovis subsp bovis AF2122/97
ggacuucggugagcagggcggcg

SEQ ID NO: 3092068 - RNA, 17 nt, Mycobacterium bovis subsp bovis AF2122/97
ggacuugauaucggcgg

SEQ ID NO: 3092069 - RNA, 21 nt, Mycobacterium bovis subsp bovis AF2122/97
ggacuugguuucgaugaagac

SEQ ID NO: 3092070 - RNA, 14 nt, Mycobacterium bovis subsp bovis AF2122/97
ggacuuuccggcgc

SEQ ID NO: 3092071 - RNA, 19 nt, Mycobacterium bovis subsp bovis AF2122/97
ggagaaaacggcggcgccg

SEQ ID NO: 3092072 - RNA, 20 nt, Mycobacterium bovis subsp bovis AF2122/97
ggagaaaacggcggcgccgg

SEQ ID NO: 3092073 - RNA, 21 nt, Mycobacterium bovis subsp bovis AF2122/97
ggagaacaucccccggcuggu

SEQ ID NO: 3092074 - RNA, 17 nt, Mycobacterium bovis subsp bovis AF2122/97
ggagaacgcccgcagga

SEQ ID NO: 3092075 - RNA, 23 nt, Mycobacterium bovis subsp bovis AF2122/97
ggagaacgucaaacccagcgacg

SEQ ID NO: 3092076 - RNA, 16 nt, Mycobacterium bovis subsp bovis AF2122/97
ggagaaggcgaccaag

SEQ ID NO: 3092077 - RNA, 24 nt, Mycobacterium bovis subsp bovis AF2122/97
ggagaaguucgugagcgaacgggc

SEQ ID NO: 3092078 - RNA, 19 nt, Mycobacterium bovis subsp bovis AF2122/97
ggagacaccgcaacgcgug

SEQ ID NO: 3092079 - RNA, 16 nt, Mycobacterium bovis subsp bovis AF2122/97
ggagaccccgcgcgcu

SEQ ID NO: 3092080 - RNA, 14 nt, Mycobacterium bovis subsp bovis AF2122/97
ggagaccgcggccg

SEQ ID NO: 3092081 - RNA, 19 nt, Mycobacterium bovis subsp bovis AF2122/97
ggagaccgcggccggccgu

SEQ ID NO: 3092082 - RNA, 21 nt, Mycobacterium bovis subsp bovis AF2122/97
ggagaccggccgggugaacca

SEQ ID NO: 3092083 - RNA, 22 nt, Mycobacterium bovis subsp bovis AF2122/97
ggagaccugucgguaccgccca

SEQ ID NO: 3092084 - RNA, 20 nt, Mycobacterium bovis subsp bovis AF2122/97
ggagacgaucgccaggccga

SEQ ID NO: 3092085 - RNA, 20 nt, Mycobacterium bovis subsp bovis AF2122/97
ggagacgguacgccagucgc

SEQ ID NO: 3092086 - RNA, 13 nt, Mycobacterium bovis subsp bovis AF2122/97
ggagacgucgccg

SEQ ID NO: 3092087 - RNA, 13 nt, Mycobacterium bovis subsp bovis AF2122/97
ggagagccgacgu

SEQ ID NO: 3092088 - RNA, 20 nt, Mycobacterium bovis subsp bovis AF2122/97
ggagaggcggugcagcuccg

SEQ ID NO: 3092089 - RNA, 17 nt, Mycobacterium bovis subsp bovis AF2122/97
ggagauaccgaccaucg

SEQ ID NO: 3092090 - RNA, 13 nt, Mycobacterium bovis subsp bovis AF2122/97
ggagauacgggcc

SEQ ID NO: 3092091 - RNA, 23 nt, Mycobacterium bovis subsp bovis AF2122/97
ggagaucaccucggugccggccg

SEQ ID NO: 3092092 - RNA, 18 nt, Mycobacterium bovis subsp bovis AF2122/97
ggagauccaccgguccag

SEQ ID NO: 3092093 - RNA, 21 nt, Mycobacterium bovis subsp bovis AF2122/97
ggagauccaccgguccagggc

SEQ ID NO: 3092094 - RNA, 16 nt, Mycobacterium bovis subsp bovis AF2122/97
ggagauccagggccuu

SEQ ID NO: 3092095 - RNA, 22 nt, Mycobacterium bovis subsp bovis AF2122/97
ggagauccagggccuucgggcc

SEQ ID NO: 3092096 - RNA, 14 nt, Mycobacterium bovis subsp bovis AF2122/97
ggagaucgccgccg

SEQ ID NO: 3092097 - RNA, 17 nt, Mycobacterium bovis subsp bovis AF2122/97
ggagaucgccgccggcg

SEQ ID NO: 3092098 - RNA, 20 nt, Mycobacterium bovis subsp bovis AF2122/97
ggagaucucugagcgggcgg

SEQ ID NO: 3092099 - RNA, 15 nt, Mycobacterium bovis subsp bovis AF2122/97
ggagaugucgaucag

SEQ ID NO: 3092100 - RNA, 16 nt, Mycobacterium bovis subsp bovis AF2122/97
ggagcaccgaccaggg

SEQ ID NO: 3092101 - RNA, 22 nt, Mycobacterium bovis subsp bovis AF2122/97
ggagcaccgaccagggccgccg

SEQ ID NO: 3092102 - RNA, 23 nt, Mycobacterium bovis subsp bovis AF2122/97
ggagcaccgaccagggccgccgc

SEQ ID NO: 3092103 - RNA, 16 nt, Mycobacterium bovis subsp bovis AF2122/97
ggagcagagaaaccgc

SEQ ID NO: 3092104 - RNA, 15 nt, Mycobacterium bovis subsp bovis AF2122/97
ggagcagcacgucga

SEQ ID NO: 3092105 - RNA, 12 nt, Mycobacterium bovis subsp bovis AF2122/97
ggagccaacggc

SEQ ID NO: 3092106 - RNA, 16 nt, Mycobacterium bovis subsp bovis AF2122/97
ggagccaacggccaag

SEQ ID NO: 3092107 - RNA, 16 nt, Mycobacterium bovis subsp bovis AF2122/97
ggagccaccggcgucg

SEQ ID NO: 3092108 - RNA, 21 nt, Mycobacterium bovis subsp bovis AF2122/97
ggagccacugcggcauggcag

SEQ ID NO: 3092109 - RNA, 15 nt, Mycobacterium bovis subsp bovis AF2122/97
ggagccaggacgacg

SEQ ID NO: 3092110 - RNA, 18 nt, Mycobacterium bovis subsp bovis AF2122/97
ggagccaggacgacgccg

SEQ ID NO: 3092111 - RNA, 16 nt, Mycobacterium bovis subsp bovis AF2122/97
ggagcccacacgcuca

SEQ ID NO: 3092112 - RNA, 22 nt, Mycobacterium bovis subsp bovis AF2122/97
ggagccccugucaacgccgcgg

SEQ ID NO: 3092113 - RNA, 21 nt, Mycobacterium bovis subsp bovis AF2122/97
ggagcccgagcucaccgcaca

SEQ ID NO: 3092114 - RNA, 19 nt, Mycobacterium bovis subsp bovis AF2122/97
ggagcccgagcucgccgca

SEQ ID NO: 3092115 - RNA, 22 nt, Mycobacterium bovis subsp bovis AF2122/97
ggagcccggcauuaggccgggg

SEQ ID NO: 3092116 - RNA, 18 nt, Mycobacterium bovis subsp bovis AF2122/97
ggagcccguccaggcccg

SEQ ID NO: 3092117 - RNA, 16 nt, Mycobacterium bovis subsp bovis AF2122/97
ggagcccugaccgggg

SEQ ID NO: 3092118 - RNA, 13 nt, Mycobacterium bovis subsp bovis AF2122/97
ggagccgacaacg

SEQ ID NO: 3092119 - RNA, 14 nt, Mycobacterium bovis subsp bovis AF2122/97
ggagccgcacccga

SEQ ID NO: 3092120 - RNA, 22 nt, Mycobacterium bovis subsp bovis AF2122/97
ggagccgccaggugcucgucga

SEQ ID NO: 3092121 - RNA, 12 nt, Mycobacterium bovis subsp bovis AF2122/97
ggagccgcccaa

SEQ ID NO: 3092122 - RNA, 13 nt, Mycobacterium bovis subsp bovis AF2122/97
ggagccgcccaag

SEQ ID NO: 3092123 - RNA, 15 nt, Mycobacterium bovis subsp bovis AF2122/97
ggagccgcccaagcc

SEQ ID NO: 3092124 - RNA, 19 nt, Mycobacterium bovis subsp bovis AF2122/97
ggagccgcccaagccgccg

SEQ ID NO: 3092125 - RNA, 12 nt, Mycobacterium bovis subsp bovis AF2122/97
ggagccgccgac

SEQ ID NO: 3092126 - RNA, 11 nt, Mycobacterium bovis subsp bovis AF2122/97
ggagccgccgg

SEQ ID NO: 3092127 - RNA, 18 nt, Mycobacterium bovis subsp bovis AF2122/97
ggagccgccggccccgcc

SEQ ID NO: 3092128 - RNA, 19 nt, Mycobacterium bovis subsp bovis AF2122/97
ggagccgccggccccgcca

SEQ ID NO: 3092129 - RNA, 14 nt, Mycobacterium bovis subsp bovis AF2122/97
ggagccgccggcgg

SEQ ID NO: 3092130 - RNA, 15 nt, Mycobacterium bovis subsp bovis AF2122/97
ggagccgccggcggu

SEQ ID NO: 3092131 - RNA, 13 nt, Mycobacterium bovis subsp bovis AF2122/97
ggagccggccacc

SEQ ID NO: 3092132 - RNA, 13 nt, Mycobacterium bovis subsp bovis AF2122/97
ggagccgggccgu

SEQ ID NO: 3092133 - RNA, 12 nt, Mycobacterium bovis subsp bovis AF2122/97
ggagccggugac

SEQ ID NO: 3092134 - RNA, 13 nt, Mycobacterium bovis subsp bovis AF2122/97
ggagccggugacg

SEQ ID NO: 3092135 - RNA, 14 nt, Mycobacterium bovis subsp bovis AF2122/97
ggagccggugacgg

SEQ ID NO: 3092136 - RNA, 17 nt, Mycobacterium bovis subsp bovis AF2122/97
ggagccggugccgacgg

SEQ ID NO: 3092137 - RNA, 15 nt, Mycobacterium bovis subsp bovis AF2122/97
ggagccgucacgccg

SEQ ID NO: 3092138 - RNA, 16 nt, Mycobacterium bovis subsp bovis AF2122/97
ggagccgucgagcagc

SEQ ID NO: 3092139 - RNA, 13 nt, Mycobacterium bovis subsp bovis AF2122/97
ggagccgugcggu

SEQ ID NO: 3092140 - RNA, 20 nt, Mycobacterium bovis subsp bovis AF2122/97
ggagccgugcggucgcgccc

SEQ ID NO: 3092141 - RNA, 22 nt, Mycobacterium bovis subsp bovis AF2122/97
ggagccgugcggucgcgcccuc

SEQ ID NO: 3092142 - RNA, 19 nt, Mycobacterium bovis subsp bovis AF2122/97
ggagccuccagcgcaccgg

SEQ ID NO: 3092143 - RNA, 16 nt, Mycobacterium bovis subsp bovis AF2122/97
ggagccuugguagccg

SEQ ID NO: 3092144 - RNA, 14 nt, Mycobacterium bovis subsp bovis AF2122/97
ggagcgaacggcgc

SEQ ID NO: 3092145 - RNA, 16 nt, Mycobacterium bovis subsp bovis AF2122/97
ggagcgacgucgguga

SEQ ID NO: 3092146 - RNA, 23 nt, Mycobacterium bovis subsp bovis AF2122/97
ggagcgcaaguugagcagcuugg

SEQ ID NO: 3092147 - RNA, 23 nt, Mycobacterium bovis subsp bovis AF2122/97
ggagcgcaccugaaggcggcgau

SEQ ID NO: 3092148 - RNA, 18 nt, Mycobacterium bovis subsp bovis AF2122/97
ggagcgcaggaccugacg

SEQ ID NO: 3092149 - RNA, 24 nt, Mycobacterium bovis subsp bovis AF2122/97
ggagcgcauuuguugcugcugccg

SEQ ID NO: 3092150 - RNA, 19 nt, Mycobacterium bovis subsp bovis AF2122/97
ggagcgccgagcucggcgc

SEQ ID NO: 3092151 - RNA, 13 nt, Mycobacterium bovis subsp bovis AF2122/97
ggagcgccgcagg

SEQ ID NO: 3092152 - RNA, 18 nt, Mycobacterium bovis subsp bovis AF2122/97
ggagcgcgccucgcccag

SEQ ID NO: 3092153 - RNA, 15 nt, Mycobacterium bovis subsp bovis AF2122/97
ggagcggaauggcgc

SEQ ID NO: 3092154 - RNA, 21 nt, Mycobacterium bovis subsp bovis AF2122/97
ggagcggaauggcgccggccg

SEQ ID NO: 3092155 - RNA, 14 nt, Mycobacterium bovis subsp bovis AF2122/97
ggagcggauagcgg

SEQ ID NO: 3092156 - RNA, 20 nt, Mycobacterium bovis subsp bovis AF2122/97
ggagcggauagcggcaaagc

SEQ ID NO: 3092157 - RNA, 15 nt, Mycobacterium bovis subsp bovis AF2122/97
ggagcggcgcggggg

SEQ ID NO: 3092158 - RNA, 18 nt, Mycobacterium bovis subsp bovis AF2122/97
ggagcggcgcgggggugg

SEQ ID NO: 3092159 - RNA, 15 nt, Mycobacterium bovis subsp bovis AF2122/97
ggagcggcugcggca

SEQ ID NO: 3092160 - RNA, 17 nt, Mycobacterium bovis subsp bovis AF2122/97
ggagcggcugcggcaac

SEQ ID NO: 3092161 - RNA, 13 nt, Mycobacterium bovis subsp bovis AF2122/97
ggagcgggccagc

SEQ ID NO: 3092162 - RNA, 14 nt, Mycobacterium bovis subsp bovis AF2122/97
ggagcgggccagca

SEQ ID NO: 3092163 - RNA, 16 nt, Mycobacterium bovis subsp bovis AF2122/97
ggagcgggugcgggcg

SEQ ID NO: 3092164 - RNA, 16 nt, Mycobacterium bovis subsp bovis AF2122/97
ggagcggguggccggg

SEQ ID NO: 3092165 - RNA, 21 nt, Mycobacterium bovis subsp bovis AF2122/97
ggagcgugucggccggccagg

SEQ ID NO: 3092166 - RNA, 22 nt, Mycobacterium bovis subsp bovis AF2122/97
ggagcgugucggccggccaggu

SEQ ID NO: 3092167 - RNA, 16 nt, Mycobacterium bovis subsp bovis AF2122/97
ggagcuauucgguguc

SEQ ID NO: 3092168 - RNA, 20 nt, Mycobacterium bovis subsp bovis AF2122/97
ggagcucacgccgggugugg

SEQ ID NO: 3092169 - RNA, 18 nt, Mycobacterium bovis subsp bovis AF2122/97
ggagcucacgugcugccg

SEQ ID NO: 3092170 - RNA, 15 nt, Mycobacterium bovis subsp bovis AF2122/97
ggagcucaucgacga

SEQ ID NO: 3092171 - RNA, 14 nt, Mycobacterium bovis subsp bovis AF2122/97
ggagcucgcggcgc

SEQ ID NO: 3092172 - RNA, 16 nt, Mycobacterium bovis subsp bovis AF2122/97
ggagcucuugcgggca

SEQ ID NO: 3092173 - RNA, 21 nt, Mycobacterium bovis subsp bovis AF2122/97
ggagcucuugcgggcagccgc

SEQ ID NO: 3092174 - RNA, 13 nt, Mycobacterium bovis subsp bovis AF2122/97
ggagcugcggcgg

SEQ ID NO: 3092175 - RNA, 14 nt, Mycobacterium bovis subsp bovis AF2122/97
ggagcugcggcggc

SEQ ID NO: 3092176 - RNA, 15 nt, Mycobacterium bovis subsp bovis AF2122/97
ggagcuuggcccagc

SEQ ID NO: 3092177 - RNA, 21 nt, Mycobacterium bovis subsp bovis AF2122/97
ggagcuuuuugcgucuguucg

SEQ ID NO: 3092178 - RNA, 15 nt, Mycobacterium bovis subsp bovis AF2122/97
ggaggaaccccgcgc

SEQ ID NO: 3092179 - RNA, 19 nt, Mycobacterium bovis subsp bovis AF2122/97
ggaggaaucguucggggug

SEQ ID NO: 3092180 - RNA, 14 nt, Mycobacterium bovis subsp bovis AF2122/97
ggaggacaccagcu

SEQ ID NO: 3092181 - RNA, 17 nt, Mycobacterium bovis subsp bovis AF2122/97
ggaggacaccagcugga

SEQ ID NO: 3092182 - RNA, 19 nt, Mycobacterium bovis subsp bovis AF2122/97
ggaggacuacuaggccccu

SEQ ID NO: 3092183 - RNA, 12 nt, Mycobacterium bovis subsp bovis AF2122/97
ggaggcaagcaa

SEQ ID NO: 3092184 - RNA, 14 nt, Mycobacterium bovis subsp bovis AF2122/97
ggaggcaagcaacc

SEQ ID NO: 3092185 - RNA, 22 nt, Mycobacterium bovis subsp bovis AF2122/97
ggaggcaagcaaccggugcgca

SEQ ID NO: 3092186 - RNA, 19 nt, Mycobacterium bovis subsp bovis AF2122/97
ggaggccaacccugcggcg

SEQ ID NO: 3092187 - RNA, 20 nt, Mycobacterium bovis subsp bovis AF2122/97
ggaggccaacccugcggcgu

SEQ ID NO: 3092188 - RNA, 14 nt, Mycobacterium bovis subsp bovis AF2122/97
ggaggccgccgcgc

SEQ ID NO: 3092189 - RNA, 20 nt, Mycobacterium bovis subsp bovis AF2122/97
ggaggcggaccaggccgcgc

SEQ ID NO: 3092190 - RNA, 14 nt, Mycobacterium bovis subsp bovis AF2122/97
ggaggcggcgccgc

SEQ ID NO: 3092191 - RNA, 22 nt, Mycobacterium bovis subsp bovis AF2122/97
ggaggcuaggcguuugguguga

SEQ ID NO: 3092192 - RNA, 18 nt, Mycobacterium bovis subsp bovis AF2122/97
ggaggcuccuggucgccg

SEQ ID NO: 3092193 - RNA, 21 nt, Mycobacterium bovis subsp bovis AF2122/97
ggaggucaaaaucagggugcc

SEQ ID NO: 3092194 - RNA, 13 nt, Mycobacterium bovis subsp bovis AF2122/97
ggaggucaaauca

SEQ ID NO: 3092195 - RNA, 20 nt, Mycobacterium bovis subsp bovis AF2122/97
ggaggugaaccccgccggca

SEQ ID NO: 3092196 - RNA, 13 nt, Mycobacterium bovis subsp bovis AF2122/97
ggaggugccggcg

SEQ ID NO: 3092197 - RNA, 14 nt, Mycobacterium bovis subsp bovis AF2122/97
ggaggugccggcgc

SEQ ID NO: 3092198 - RNA, 14 nt, Mycobacterium bovis subsp bovis AF2122/97
ggagguggcgcggg

SEQ ID NO: 3092199 - RNA, 20 nt, Mycobacterium bovis subsp bovis AF2122/97
ggaguacuccagccgcaaca

SEQ ID NO: 3092200 - RNA, 21 nt, Mycobacterium bovis subsp bovis AF2122/97
ggagucaacuucgacaacgca

SEQ ID NO: 3092201 - RNA, 18 nt, Mycobacterium bovis subsp bovis AF2122/97
ggagucaccagcaacagc

SEQ ID NO: 3092202 - RNA, 17 nt, Mycobacterium bovis subsp bovis AF2122/97
ggagucacgcagccgcg

SEQ ID NO: 3092203 - RNA, 18 nt, Mycobacterium bovis subsp bovis AF2122/97
ggagucacgcagccgcgc

SEQ ID NO: 3092204 - RNA, 17 nt, Mycobacterium bovis subsp bovis AF2122/97
ggaguccggccgacccg

SEQ ID NO: 3092205 - RNA, 15 nt, Mycobacterium bovis subsp bovis AF2122/97
ggagucgaacaucac

SEQ ID NO: 3092206 - RNA, 20 nt, Mycobacterium bovis subsp bovis AF2122/97
ggagucgacccugcccagca

SEQ ID NO: 3092207 - RNA, 17 nt, Mycobacterium bovis subsp bovis AF2122/97
ggagucgacggugccgu

SEQ ID NO: 3092208 - RNA, 20 nt, Mycobacterium bovis subsp bovis AF2122/97
ggagucgacggugccgucgg

SEQ ID NO: 3092209 - RNA, 15 nt, Mycobacterium bovis subsp bovis AF2122/97
ggagucgucgagcug

SEQ ID NO: 3092210 - RNA, 22 nt, Mycobacterium bovis subsp bovis AF2122/97
ggagucgucgagcugaccacgg

SEQ ID NO: 3092211 - RNA, 23 nt, Mycobacterium bovis subsp bovis AF2122/97
ggagucgucggcaugggccggcg

SEQ ID NO: 3092212 - RNA, 22 nt, Mycobacterium bovis subsp bovis AF2122/97
ggagucuucaacgucgagaucc

SEQ ID NO: 3092213 - RNA, 15 nt, Mycobacterium bovis subsp bovis AF2122/97
ggagugaggcugugc

SEQ ID NO: 3092214 - RNA, 15 nt, Mycobacterium bovis subsp bovis AF2122/97
ggagugcgccggcug

SEQ ID NO: 3092215 - RNA, 22 nt, Mycobacterium bovis subsp bovis AF2122/97
ggagugcgccggcuggcggccu

SEQ ID NO: 3092216 - RNA, 12 nt, Mycobacterium bovis subsp bovis AF2122/97
ggaguggccagu

SEQ ID NO: 3092217 - RNA, 13 nt, Mycobacterium bovis subsp bovis AF2122/97
ggaguggccgggc

SEQ ID NO: 3092218 - RNA, 18 nt, Mycobacterium bovis subsp bovis AF2122/97
ggaguggccgggcgguag

SEQ ID NO: 3092219 - RNA, 19 nt, Mycobacterium bovis subsp bovis AF2122/97
ggagugucgaugcgcgccg

SEQ ID NO: 3092220 - RNA, 22 nt, Mycobacterium bovis subsp bovis AF2122/97
ggaguuccucgaucgucgacgc

SEQ ID NO: 3092221 - RNA, 15 nt, Mycobacterium bovis subsp bovis AF2122/97
ggaguugaagaagcc

SEQ ID NO: 3092222 - RNA, 18 nt, Mycobacterium bovis subsp bovis AF2122/97
ggaguugaagaagcccga

SEQ ID NO: 3092223 - RNA, 16 nt, Mycobacterium bovis subsp bovis AF2122/97
ggaguugagcugucgc

SEQ ID NO: 3092224 - RNA, 20 nt, Mycobacterium bovis subsp bovis AF2122/97
ggaguugagcugucgcaacg

SEQ ID NO: 3092225 - RNA, 19 nt, Mycobacterium bovis subsp bovis AF2122/97
ggaguuuaagacgcccgag

SEQ ID NO: 3092226 - RNA, 13 nt, Mycobacterium bovis subsp bovis AF2122/97
ggaguuuccgaag

SEQ ID NO: 3092227 - RNA, 17 nt, Mycobacterium bovis subsp bovis AF2122/97
ggaguuuccgaagcccg

SEQ ID NO: 3092228 - RNA, 12 nt, Mycobacterium bovis subsp bovis AF2122/97
ggauaacccagc

SEQ ID NO: 3092229 - RNA, 17 nt, Mycobacterium bovis subsp bovis AF2122/97
ggauaacccagcggcgc

SEQ ID NO: 3092230 - RNA, 23 nt, Mycobacterium bovis subsp bovis AF2122/97
ggauaacccagcggcgccacgug

SEQ ID NO: 3092231 - RNA, 13 nt, Mycobacterium bovis subsp bovis AF2122/97
ggauacagccgcc

SEQ ID NO: 3092232 - RNA, 14 nt, Mycobacterium bovis subsp bovis AF2122/97
ggauacccagcgcc

SEQ ID NO: 3092233 - RNA, 15 nt, Mycobacterium bovis subsp bovis AF2122/97
ggauacccagcgccc

SEQ ID NO: 3092234 - RNA, 16 nt, Mycobacterium bovis subsp bovis AF2122/97
ggauacccagcgcccg

SEQ ID NO: 3092235 - RNA, 19 nt, Mycobacterium bovis subsp bovis AF2122/97
ggauacccagcgcccggcc

SEQ ID NO: 3092236 - RNA, 22 nt, Mycobacterium bovis subsp bovis AF2122/97
ggauacccagcgcccggccacu

SEQ ID NO: 3092237 - RNA, 18 nt, Mycobacterium bovis subsp bovis AF2122/97
ggauaccgaaaucaccuc

SEQ ID NO: 3092238 - RNA, 23 nt, Mycobacterium bovis subsp bovis AF2122/97
ggauaccgcucagggugcgccgc

SEQ ID NO: 3092239 - RNA, 21 nt, Mycobacterium bovis subsp bovis AF2122/97
ggauaccgcugggucgccguu

SEQ ID NO: 3092240 - RNA, 12 nt, Mycobacterium bovis subsp bovis AF2122/97
ggauaccggggu

SEQ ID NO: 3092241 - RNA, 18 nt, Mycobacterium bovis subsp bovis AF2122/97
ggauaccggucagcaccu

SEQ ID NO: 3092242 - RNA, 20 nt, Mycobacterium bovis subsp bovis AF2122/97
ggauaccgucaugggcggcu

SEQ ID NO: 3092243 - RNA, 19 nt, Mycobacterium bovis subsp bovis AF2122/97
ggauacgccccugguccac

SEQ ID NO: 3092244 - RNA, 22 nt, Mycobacterium bovis subsp bovis AF2122/97
ggauacuguucugcuggcugug

SEQ ID NO: 3092245 - RNA, 14 nt, Mycobacterium bovis subsp bovis AF2122/97
ggauagacggcgac

SEQ ID NO: 3092246 - RNA, 23 nt, Mycobacterium bovis subsp bovis AF2122/97
ggauagcaccggcacccgcacgg

SEQ ID NO: 3092247 - RNA, 14 nt, Mycobacterium bovis subsp bovis AF2122/97
ggauagcagugcag

SEQ ID NO: 3092248 - RNA, 15 nt, Mycobacterium bovis subsp bovis AF2122/97
ggauagcagugcagc

SEQ ID NO: 3092249 - RNA, 17 nt, Mycobacterium bovis subsp bovis AF2122/97
ggauagccucggcggcg

SEQ ID NO: 3092250 - RNA, 18 nt, Mycobacterium bovis subsp bovis AF2122/97
ggauagccucggcggcgc

SEQ ID NO: 3092251 - RNA, 18 nt, Mycobacterium bovis subsp bovis AF2122/97
ggauagcgucgucccagc

SEQ ID NO: 3092252 - RNA, 21 nt, Mycobacterium bovis subsp bovis AF2122/97
ggauagcgucgucccagcgcg

SEQ ID NO: 3092253 - RNA, 23 nt, Mycobacterium bovis subsp bovis AF2122/97
ggauagguggucuuggcgguggc

SEQ ID NO: 3092254 - RNA, 21 nt, Mycobacterium bovis subsp bovis AF2122/97
ggaucaaaaaccacgcgucgc

SEQ ID NO: 3092255 - RNA, 14 nt, Mycobacterium bovis subsp bovis AF2122/97
ggaucaacaggccg

SEQ ID NO: 3092256 - RNA, 14 nt, Mycobacterium bovis subsp bovis AF2122/97
ggaucaacgcacgg

SEQ ID NO: 3092257 - RNA, 15 nt, Mycobacterium bovis subsp bovis AF2122/97
ggaucaacgcacggc

SEQ ID NO: 3092258 - RNA, 12 nt, Mycobacterium bovis subsp bovis AF2122/97
ggaucacacauu

SEQ ID NO: 3092259 - RNA, 18 nt, Mycobacterium bovis subsp bovis AF2122/97
ggaucacacccacgucga

SEQ ID NO: 3092260 - RNA, 18 nt, Mycobacterium bovis subsp bovis AF2122/97
ggaucacaccccaggcac

SEQ ID NO: 3092261 - RNA, 19 nt, Mycobacterium bovis subsp bovis AF2122/97
ggaucacaccccaggcacc

SEQ ID NO: 3092262 - RNA, 19 nt, Mycobacterium bovis subsp bovis AF2122/97
ggaucacacuggccugcuc

SEQ ID NO: 3092263 - RNA, 15 nt, Mycobacterium bovis subsp bovis AF2122/97
ggaucacaucggcca

SEQ ID NO: 3092264 - RNA, 13 nt, Mycobacterium bovis subsp bovis AF2122/97
ggaucaccaucgc

SEQ ID NO: 3092265 - RNA, 18 nt, Mycobacterium bovis subsp bovis AF2122/97
ggaucacccacucgacgu

SEQ ID NO: 3092266 - RNA, 15 nt, Mycobacterium bovis subsp bovis AF2122/97
ggaucaccccggccg

SEQ ID NO: 3092267 - RNA, 13 nt, Mycobacterium bovis subsp bovis AF2122/97
ggaucaccgcgcc

SEQ ID NO: 3092268 - RNA, 20 nt, Mycobacterium bovis subsp bovis AF2122/97
ggaucaccgcgcccgccgcg

SEQ ID NO: 3092269 - RNA, 14 nt, Mycobacterium bovis subsp bovis AF2122/97
ggaucacgaccgcg

SEQ ID NO: 3092270 - RNA, 14 nt, Mycobacterium bovis subsp bovis AF2122/97
ggaucagaacgcgg

SEQ ID NO: 3092271 - RNA, 21 nt, Mycobacterium bovis subsp bovis AF2122/97
ggaucagaggacccgugcacg

SEQ ID NO: 3092272 - RNA, 22 nt, Mycobacterium bovis subsp bovis AF2122/97
ggaucagcccgcgcagcagugc

SEQ ID NO: 3092273 - RNA, 14 nt, Mycobacterium bovis subsp bovis AF2122/97
ggaucagcgcacug

SEQ ID NO: 3092274 - RNA, 15 nt, Mycobacterium bovis subsp bovis AF2122/97
ggaucagcgugucgc

SEQ ID NO: 3092275 - RNA, 20 nt, Mycobacterium bovis subsp bovis AF2122/97
ggaucaggcccgggcggaug

SEQ ID NO: 3092276 - RNA, 16 nt, Mycobacterium bovis subsp bovis AF2122/97
ggaucagggcuuucgc

SEQ ID NO: 3092277 - RNA, 20 nt, Mycobacterium bovis subsp bovis AF2122/97
ggaucaguuugccaucggga

SEQ ID NO: 3092278 - RNA, 17 nt, Mycobacterium bovis subsp bovis AF2122/97
ggaucauccuucgccgg

SEQ ID NO: 3092279 - RNA, 21 nt, Mycobacterium bovis subsp bovis AF2122/97
ggaucauccuucgccggcgcc

SEQ ID NO: 3092280 - RNA, 13 nt, Mycobacterium bovis subsp bovis AF2122/97
ggaucaucgccgc

SEQ ID NO: 3092281 - RNA, 17 nt, Mycobacterium bovis subsp bovis AF2122/97
ggaucaucgccgcggcc

SEQ ID NO: 3092282 - RNA, 13 nt, Mycobacterium bovis subsp bovis AF2122/97
ggaucauguucgg

SEQ ID NO: 3092283 - RNA, 13 nt, Mycobacterium bovis subsp bovis AF2122/97
ggauccaccacgc

SEQ ID NO: 3092284 - RNA, 19 nt, Mycobacterium bovis subsp bovis AF2122/97
ggauccaccacgcuggccu

SEQ ID NO: 3092285 - RNA, 16 nt, Mycobacterium bovis subsp bovis AF2122/97
ggauccacccagugcc

SEQ ID NO: 3092286 - RNA, 15 nt, Mycobacterium bovis subsp bovis AF2122/97
ggauccagcaggccg

SEQ ID NO: 3092287 - RNA, 15 nt, Mycobacterium bovis subsp bovis AF2122/97
ggauccaugcgggug

SEQ ID NO: 3092288 - RNA, 13 nt, Mycobacterium bovis subsp bovis AF2122/97
ggaucccacggcg

SEQ ID NO: 3092289 - RNA, 12 nt, Mycobacterium bovis subsp bovis AF2122/97
ggaucccagccc

SEQ ID NO: 3092290 - RNA, 13 nt, Mycobacterium bovis subsp bovis AF2122/97
ggaucccagcgca

SEQ ID NO: 3092291 - RNA, 15 nt, Mycobacterium bovis subsp bovis AF2122/97
ggaucccccgcgcga

SEQ ID NO: 3092292 - RNA, 14 nt, Mycobacterium bovis subsp bovis AF2122/97
ggaucccgaggcgc

SEQ ID NO: 3092293 - RNA, 12 nt, Mycobacterium bovis subsp bovis AF2122/97
ggaucccgccgc

SEQ ID NO: 3092294 - RNA, 18 nt, Mycobacterium bovis subsp bovis AF2122/97
ggaucccgccgcugccgc

SEQ ID NO: 3092295 - RNA, 20 nt, Mycobacterium bovis subsp bovis AF2122/97
ggaucccgccgcugccgccg

SEQ ID NO: 3092296 - RNA, 15 nt, Mycobacterium bovis subsp bovis AF2122/97
ggaucccggccgggu

SEQ ID NO: 3092297 - RNA, 11 nt, Mycobacterium bovis subsp bovis AF2122/97
ggaucccggug

SEQ ID NO: 3092298 - RNA, 22 nt, Mycobacterium bovis subsp bovis AF2122/97
ggaucccugugccagcagcagc

SEQ ID NO: 3092299 - RNA, 19 nt, Mycobacterium bovis subsp bovis AF2122/97
ggauccgaagagccagcaa

SEQ ID NO: 3092300 - RNA, 22 nt, Mycobacterium bovis subsp bovis AF2122/97
ggauccgaccccgcgccgacac

SEQ ID NO: 3092301 - RNA, 14 nt, Mycobacterium bovis subsp bovis AF2122/97
ggauccgauccgca

SEQ ID NO: 3092302 - RNA, 16 nt, Mycobacterium bovis subsp bovis AF2122/97
ggauccgauccgcaca

SEQ ID NO: 3092303 - RNA, 21 nt, Mycobacterium bovis subsp bovis AF2122/97
ggauccgaugacauaugacgg

SEQ ID NO: 3092304 - RNA, 16 nt, Mycobacterium bovis subsp bovis AF2122/97
ggauccgcaccacgcc

SEQ ID NO: 3092305 - RNA, 20 nt, Mycobacterium bovis subsp bovis AF2122/97
ggauccgccagaccgcggcg

SEQ ID NO: 3092306 - RNA, 15 nt, Mycobacterium bovis subsp bovis AF2122/97
ggauccgcugcggcc

SEQ ID NO: 3092307 - RNA, 13 nt, Mycobacterium bovis subsp bovis AF2122/97
ggauccggcagca

SEQ ID NO: 3092308 - RNA, 16 nt, Mycobacterium bovis subsp bovis AF2122/97
ggauccggcagcagcc

SEQ ID NO: 3092309 - RNA, 17 nt, Mycobacterium bovis subsp bovis AF2122/97
ggauccggcagcagccg

SEQ ID NO: 3092310 - RNA, 15 nt, Mycobacterium bovis subsp bovis AF2122/97
ggauccgggagucga

SEQ ID NO: 3092311 - RNA, 18 nt, Mycobacterium bovis subsp bovis AF2122/97
ggauccuccggguuggcg

SEQ ID NO: 3092312 - RNA, 16 nt, Mycobacterium bovis subsp bovis AF2122/97
ggaucgacaccgacgc

SEQ ID NO: 3092313 - RNA, 22 nt, Mycobacterium bovis subsp bovis AF2122/97
ggaucgacaccgacgcggucgg

SEQ ID NO: 3092314 - RNA, 20 nt, Mycobacterium bovis subsp bovis AF2122/97
ggaucgacaguugcgccagc

SEQ ID NO: 3092315 - RNA, 21 nt, Mycobacterium bovis subsp bovis AF2122/97
ggaucgaccaauucgaccgcg

SEQ ID NO: 3092316 - RNA, 23 nt, Mycobacterium bovis subsp bovis AF2122/97
ggaucgaccaauucgaccgcgcg

SEQ ID NO: 3092317 - RNA, 15 nt, Mycobacterium bovis subsp bovis AF2122/97
ggaucgaccaugguc

SEQ ID NO: 3092318 - RNA, 12 nt, Mycobacterium bovis subsp bovis AF2122/97
ggaucgaccgcc

SEQ ID NO: 3092319 - RNA, 17 nt, Mycobacterium bovis subsp bovis AF2122/97
ggaucgaccgccagcgc

SEQ ID NO: 3092320 - RNA, 16 nt, Mycobacterium bovis subsp bovis AF2122/97
ggaucgagagccgacc

SEQ ID NO: 3092321 - RNA, 19 nt, Mycobacterium bovis subsp bovis AF2122/97
ggaucgauucgucgcggau

SEQ ID NO: 3092322 - RNA, 14 nt, Mycobacterium bovis subsp bovis AF2122/97
ggaucgcagcgcca

SEQ ID NO: 3092323 - RNA, 17 nt, Mycobacterium bovis subsp bovis AF2122/97
ggaucgccaccggcgcc

SEQ ID NO: 3092324 - RNA, 12 nt, Mycobacterium bovis subsp bovis AF2122/97
ggaucgccacgg

SEQ ID NO: 3092325 - RNA, 14 nt, Mycobacterium bovis subsp bovis AF2122/97
ggaucgccacggug

SEQ ID NO: 3092326 - RNA, 17 nt, Mycobacterium bovis subsp bovis AF2122/97
ggaucgccgaaucggca

SEQ ID NO: 3092327 - RNA, 17 nt, Mycobacterium bovis subsp bovis AF2122/97
ggaucgccgagaccgcg

SEQ ID NO: 3092328 - RNA, 21 nt, Mycobacterium bovis subsp bovis AF2122/97
ggaucgccggggacgccgcgg

SEQ ID NO: 3092329 - RNA, 13 nt, Mycobacterium bovis subsp bovis AF2122/97
ggaucgccgucgc

SEQ ID NO: 3092330 - RNA, 14 nt, Mycobacterium bovis subsp bovis AF2122/97
ggaucgcgauggcc

SEQ ID NO: 3092331 - RNA, 16 nt, Mycobacterium bovis subsp bovis AF2122/97
ggaucgcgcagcgccg

SEQ ID NO: 3092332 - RNA, 13 nt, Mycobacterium bovis subsp bovis AF2122/97
ggaucgcgcugau

SEQ ID NO: 3092333 - RNA, 14 nt, Mycobacterium bovis subsp bovis AF2122/97
ggaucgcgcugcgg

SEQ ID NO: 3092334 - RNA, 22 nt, Mycobacterium bovis subsp bovis AF2122/97
ggaucgcggcgccgucgucagc

SEQ ID NO: 3092335 - RNA, 12 nt, Mycobacterium bovis subsp bovis AF2122/97
ggaucgcggcgg

SEQ ID NO: 3092336 - RNA, 15 nt, Mycobacterium bovis subsp bovis AF2122/97
ggaucgcggcggcgu

SEQ ID NO: 3092337 - RNA, 17 nt, Mycobacterium bovis subsp bovis AF2122/97
ggaucgcggucagcggg

SEQ ID NO: 3092338 - RNA, 18 nt, Mycobacterium bovis subsp bovis AF2122/97
ggaucgcggugggccccg

SEQ ID NO: 3092339 - RNA, 18 nt, Mycobacterium bovis subsp bovis AF2122/97
ggaucgcguccgccucgg

SEQ ID NO: 3092340 - RNA, 22 nt, Mycobacterium bovis subsp bovis AF2122/97
ggaucgcuacgucgaccgacgg

SEQ ID NO: 3092341 - RNA, 14 nt, Mycobacterium bovis subsp bovis AF2122/97
ggaucgcugccagc

SEQ ID NO: 3092342 - RNA, 19 nt, Mycobacterium bovis subsp bovis AF2122/97
ggaucgcugccagcggccg

SEQ ID NO: 3092343 - RNA, 16 nt, Mycobacterium bovis subsp bovis AF2122/97
ggaucgcuggccgcga

SEQ ID NO: 3092344 - RNA, 18 nt, Mycobacterium bovis subsp bovis AF2122/97
ggaucggacaacacggcg

SEQ ID NO: 3092345 - RNA, 16 nt, Mycobacterium bovis subsp bovis AF2122/97
ggaucggauggcggcc

SEQ ID NO: 3092346 - RNA, 23 nt, Mycobacterium bovis subsp bovis AF2122/97
ggaucggauuuuccgccuguacg

SEQ ID NO: 3092347 - RNA, 15 nt, Mycobacterium bovis subsp bovis AF2122/97
ggaucggcaccccac

SEQ ID NO: 3092348 - RNA, 18 nt, Mycobacterium bovis subsp bovis AF2122/97
ggaucggcggaccgcagc

SEQ ID NO: 3092349 - RNA, 13 nt, Mycobacterium bovis subsp bovis AF2122/97
ggaucggcggccg

SEQ ID NO: 3092350 - RNA, 23 nt, Mycobacterium bovis subsp bovis AF2122/97
ggaucggcggccgcgaccagcgc

SEQ ID NO: 3092351 - RNA, 14 nt, Mycobacterium bovis subsp bovis AF2122/97
ggaucggcggccgg

SEQ ID NO: 3092352 - RNA, 15 nt, Mycobacterium bovis subsp bovis AF2122/97
ggaucggcggccggc

SEQ ID NO: 3092353 - RNA, 16 nt, Mycobacterium bovis subsp bovis AF2122/97
ggaucggcggccggca

SEQ ID NO: 3092354 - RNA, 16 nt, Mycobacterium bovis subsp bovis AF2122/97
ggaucggcuaccuaac

SEQ ID NO: 3092355 - RNA, 16 nt, Mycobacterium bovis subsp bovis AF2122/97
ggaucggcuccgccgc

SEQ ID NO: 3092356 - RNA, 17 nt, Mycobacterium bovis subsp bovis AF2122/97
ggaucggcuccgccgcg

SEQ ID NO: 3092357 - RNA, 18 nt, Mycobacterium bovis subsp bovis AF2122/97
ggaucggcuccgccgcgg

SEQ ID NO: 3092358 - RNA, 20 nt, Mycobacterium bovis subsp bovis AF2122/97
ggaucggcuccgccgcgggc

SEQ ID NO: 3092359 - RNA, 14 nt, Mycobacterium bovis subsp bovis AF2122/97
ggaucggcucgcca

SEQ ID NO: 3092360 - RNA, 24 nt, Mycobacterium bovis subsp bovis AF2122/97
ggaucggcugcgcgcucggccagc

SEQ ID NO: 3092361 - RNA, 22 nt, Mycobacterium bovis subsp bovis AF2122/97
ggaucggugguacgugcgagcc

SEQ ID NO: 3092362 - RNA, 18 nt, Mycobacterium bovis subsp bovis AF2122/97
ggaucgguuccggccccg

SEQ ID NO: 3092363 - RNA, 21 nt, Mycobacterium bovis subsp bovis AF2122/97
ggaucgguuucugcggccccg

SEQ ID NO: 3092364 - RNA, 14 nt, Mycobacterium bovis subsp bovis AF2122/97
ggaucguccggccg

SEQ ID NO: 3092365 - RNA, 21 nt, Mycobacterium bovis subsp bovis AF2122/97
ggaucgucgggagcacacaag

SEQ ID NO: 3092366 - RNA, 15 nt, Mycobacterium bovis subsp bovis AF2122/97
ggaucgucgugcacg

SEQ ID NO: 3092367 - RNA, 19 nt, Mycobacterium bovis subsp bovis AF2122/97
ggaucgucgugcacggcgg

SEQ ID NO: 3092368 - RNA, 14 nt, Mycobacterium bovis subsp bovis AF2122/97
ggaucgugccggcg

SEQ ID NO: 3092369 - RNA, 23 nt, Mycobacterium bovis subsp bovis AF2122/97
ggaucguggcgcccgucuccagc

SEQ ID NO: 3092370 - RNA, 20 nt, Mycobacterium bovis subsp bovis AF2122/97
ggaucguucgcgugccagcg

SEQ ID NO: 3092371 - RNA, 22 nt, Mycobacterium bovis subsp bovis AF2122/97
ggaucguucgcgugccagcgcc

SEQ ID NO: 3092372 - RNA, 16 nt, Mycobacterium bovis subsp bovis AF2122/97
ggaucucauccauguu

SEQ ID NO: 3092373 - RNA, 17 nt, Mycobacterium bovis subsp bovis AF2122/97
ggaucucgaaggccgcc

SEQ ID NO: 3092374 - RNA, 21 nt, Mycobacterium bovis subsp bovis AF2122/97
ggaucucggugguaauacguc

SEQ ID NO: 3092375 - RNA, 16 nt, Mycobacterium bovis subsp bovis AF2122/97
ggaucucuuucggaug

SEQ ID NO: 3092376 - RNA, 20 nt, Mycobacterium bovis subsp bovis AF2122/97
ggaucugacggcgccgucga

SEQ ID NO: 3092377 - RNA, 22 nt, Mycobacterium bovis subsp bovis AF2122/97
ggaucugagcuagccguucggc

SEQ ID NO: 3092378 - RNA, 15 nt, Mycobacterium bovis subsp bovis AF2122/97
ggaucugcagcacgc

SEQ ID NO: 3092379 - RNA, 21 nt, Mycobacterium bovis subsp bovis AF2122/97
ggaucugcggaggcgaccccg

SEQ ID NO: 3092380 - RNA, 18 nt, Mycobacterium bovis subsp bovis AF2122/97
ggaucuggccuuggcagu

SEQ ID NO: 3092381 - RNA, 18 nt, Mycobacterium bovis subsp bovis AF2122/97
ggaucugguccaguggga

SEQ ID NO: 3092382 - RNA, 20 nt, Mycobacterium bovis subsp bovis AF2122/97
ggaucuugccgcugguggug

SEQ ID NO: 3092383 - RNA, 14 nt, Mycobacterium bovis subsp bovis AF2122/97
ggaucuuggccagc

SEQ ID NO: 3092384 - RNA, 14 nt, Mycobacterium bovis subsp bovis AF2122/97
ggaugaaaugacgg

SEQ ID NO: 3092385 - RNA, 19 nt, Mycobacterium bovis subsp bovis AF2122/97
ggaugaagaacgcgagcgc

SEQ ID NO: 3092386 - RNA, 22 nt, Mycobacterium bovis subsp bovis AF2122/97
ggaugaauucauguggcgcggg

SEQ ID NO: 3092387 - RNA, 16 nt, Mycobacterium bovis subsp bovis AF2122/97
ggaugacaccgaccgg

SEQ ID NO: 3092388 - RNA, 15 nt, Mycobacterium bovis subsp bovis AF2122/97
ggaugaccaccgguu

SEQ ID NO: 3092389 - RNA, 16 nt, Mycobacterium bovis subsp bovis AF2122/97
ggaugaccaccgguuc

SEQ ID NO: 3092390 - RNA, 20 nt, Mycobacterium bovis subsp bovis AF2122/97
ggaugaccagugaucagcgc

SEQ ID NO: 3092391 - RNA, 22 nt, Mycobacterium bovis subsp bovis AF2122/97
ggaugaccuucccgucgacgag

SEQ ID NO: 3092392 - RNA, 16 nt, Mycobacterium bovis subsp bovis AF2122/97
ggaugaccuuggccgu

SEQ ID NO: 3092393 - RNA, 18 nt, Mycobacterium bovis subsp bovis AF2122/97
ggaugaccuuggccgugc

SEQ ID NO: 3092394 - RNA, 15 nt, Mycobacterium bovis subsp bovis AF2122/97
ggaugacgacgguga

SEQ ID NO: 3092395 - RNA, 15 nt, Mycobacterium bovis subsp bovis AF2122/97
ggaugacgcccaggg

SEQ ID NO: 3092396 - RNA, 21 nt, Mycobacterium bovis subsp bovis AF2122/97
ggaugacgcccagggcgucgg

SEQ ID NO: 3092397 - RNA, 20 nt, Mycobacterium bovis subsp bovis AF2122/97
ggaugacgguuugcagcggg

SEQ ID NO: 3092398 - RNA, 15 nt, Mycobacterium bovis subsp bovis AF2122/97
ggaugaugccggugu

SEQ ID NO: 3092399 - RNA, 20 nt, Mycobacterium bovis subsp bovis AF2122/97
ggaugcagcugcccggcgug

SEQ ID NO: 3092400 - RNA, 22 nt, Mycobacterium bovis subsp bovis AF2122/97
ggaugcaugucaaguucgccag

SEQ ID NO: 3092401 - RNA, 22 nt, Mycobacterium bovis subsp bovis AF2122/97
ggaugccccuucaaagcggccu

SEQ ID NO: 3092402 - RNA, 17 nt, Mycobacterium bovis subsp bovis AF2122/97
ggaugccgaaccgcgcg

SEQ ID NO: 3092403 - RNA, 15 nt, Mycobacterium bovis subsp bovis AF2122/97
ggaugccgaaccgcu

SEQ ID NO: 3092404 - RNA, 19 nt, Mycobacterium bovis subsp bovis AF2122/97
ggaugccgaaccgcugcgg

SEQ ID NO: 3092405 - RNA, 13 nt, Mycobacterium bovis subsp bovis AF2122/97
ggaugccgacggc

SEQ ID NO: 3092406 - RNA, 14 nt, Mycobacterium bovis subsp bovis AF2122/97
ggaugccgacggcg

SEQ ID NO: 3092407 - RNA, 12 nt, Mycobacterium bovis subsp bovis AF2122/97
ggaugccgccgc

SEQ ID NO: 3092408 - RNA, 13 nt, Mycobacterium bovis subsp bovis AF2122/97
ggaugccggucgg

SEQ ID NO: 3092409 - RNA, 19 nt, Mycobacterium bovis subsp bovis AF2122/97
ggaugccggucggcgucga

SEQ ID NO: 3092410 - RNA, 12 nt, Mycobacterium bovis subsp bovis AF2122/97
ggaugcgacccg

SEQ ID NO: 3092411 - RNA, 14 nt, Mycobacterium bovis subsp bovis AF2122/97
ggaugcgaggcgua

SEQ ID NO: 3092412 - RNA, 13 nt, Mycobacterium bovis subsp bovis AF2122/97
ggaugcgauggcc

SEQ ID NO: 3092413 - RNA, 18 nt, Mycobacterium bovis subsp bovis AF2122/97
ggaugcgauggccgacgc

SEQ ID NO: 3092414 - RNA, 23 nt, Mycobacterium bovis subsp bovis AF2122/97
ggaugcgauggccgacgcugcug

SEQ ID NO: 3092415 - RNA, 15 nt, Mycobacterium bovis subsp bovis AF2122/97
ggaugcgcaaccgcg

SEQ ID NO: 3092416 - RNA, 17 nt, Mycobacterium bovis subsp bovis AF2122/97
ggaugcgccgcacggcg

SEQ ID NO: 3092417 - RNA, 12 nt, Mycobacterium bovis subsp bovis AF2122/97
ggaugcgcggcg

SEQ ID NO: 3092418 - RNA, 21 nt, Mycobacterium bovis subsp bovis AF2122/97
ggaugcgcguuacccaucgcc

SEQ ID NO: 3092419 - RNA, 19 nt, Mycobacterium bovis subsp bovis AF2122/97
ggaugcggccccaugcgcc

SEQ ID NO: 3092420 - RNA, 15 nt, Mycobacterium bovis subsp bovis AF2122/97
ggaugcucaggucac

SEQ ID NO: 3092421 - RNA, 22 nt, Mycobacterium bovis subsp bovis AF2122/97
ggaugcucgauccacugccgcg

SEQ ID NO: 3092422 - RNA, 23 nt, Mycobacterium bovis subsp bovis AF2122/97
ggauggaaguaaggcacgggugu

SEQ ID NO: 3092423 - RNA, 21 nt, Mycobacterium bovis subsp bovis AF2122/97
ggauggagccggugacggugu

SEQ ID NO: 3092424 - RNA, 14 nt, Mycobacterium bovis subsp bovis AF2122/97
ggauggcaccaccc

SEQ ID NO: 3092425 - RNA, 19 nt, Mycobacterium bovis subsp bovis AF2122/97
ggauggccccgccaaaccu

SEQ ID NO: 3092426 - RNA, 18 nt, Mycobacterium bovis subsp bovis AF2122/97
ggauggccgccaggcgcu

SEQ ID NO: 3092427 - RNA, 13 nt, Mycobacterium bovis subsp bovis AF2122/97
ggauggcgcccag

SEQ ID NO: 3092428 - RNA, 13 nt, Mycobacterium bovis subsp bovis AF2122/97
ggauggcggccac

SEQ ID NO: 3092429 - RNA, 21 nt, Mycobacterium bovis subsp bovis AF2122/97
ggauggcucacccaggcgccg

SEQ ID NO: 3092430 - RNA, 13 nt, Mycobacterium bovis subsp bovis AF2122/97
ggauggcucgccg

SEQ ID NO: 3092431 - RNA, 15 nt, Mycobacterium bovis subsp bovis AF2122/97
ggauggcucgccgaa

SEQ ID NO: 3092432 - RNA, 16 nt, Mycobacterium bovis subsp bovis AF2122/97
ggauggugcggccgcg

SEQ ID NO: 3092433 - RNA, 17 nt, Mycobacterium bovis subsp bovis AF2122/97
ggaugguugcgacggcg

SEQ ID NO: 3092434 - RNA, 14 nt, Mycobacterium bovis subsp bovis AF2122/97
ggauguaccccggc

SEQ ID NO: 3092435 - RNA, 15 nt, Mycobacterium bovis subsp bovis AF2122/97
ggauguccgcggcca

SEQ ID NO: 3092436 - RNA, 22 nt, Mycobacterium bovis subsp bovis AF2122/97
ggauguccuugaaccagcgcgu

SEQ ID NO: 3092437 - RNA, 22 nt, Mycobacterium bovis subsp bovis AF2122/97
ggaugucgacgagcaccgcgcc

SEQ ID NO: 3092438 - RNA, 20 nt, Mycobacterium bovis subsp bovis AF2122/97
ggaugucgagcccgucgagu

SEQ ID NO: 3092439 - RNA, 14 nt, Mycobacterium bovis subsp bovis AF2122/97
ggaugucgcggucg

SEQ ID NO: 3092440 - RNA, 16 nt, Mycobacterium bovis subsp bovis AF2122/97
ggaugucggggcgaag

SEQ ID NO: 3092441 - RNA, 17 nt, Mycobacterium bovis subsp bovis AF2122/97
ggaugucgucgacgauc

SEQ ID NO: 3092442 - RNA, 13 nt, Mycobacterium bovis subsp bovis AF2122/97
ggaugucgugcgg

SEQ ID NO: 3092443 - RNA, 15 nt, Mycobacterium bovis subsp bovis AF2122/97
ggaugucgugcgggc

SEQ ID NO: 3092444 - RNA, 16 nt, Mycobacterium bovis subsp bovis AF2122/97
ggaugugggcgcucgc

SEQ ID NO: 3092445 - RNA, 18 nt, Mycobacterium bovis subsp bovis AF2122/97
ggauguugugccgaucgg

SEQ ID NO: 3092446 - RNA, 15 nt, Mycobacterium bovis subsp bovis AF2122/97
ggauguuugcucggc

SEQ ID NO: 3092447 - RNA, 21 nt, Mycobacterium bovis subsp bovis AF2122/97
ggauguuuuccgguccggcgu

SEQ ID NO: 3092448 - RNA, 15 nt, Mycobacterium bovis subsp bovis AF2122/97
ggauuccagcagccu

SEQ ID NO: 3092449 - RNA, 17 nt, Mycobacterium bovis subsp bovis AF2122/97
ggauuccagcagccugc

SEQ ID NO: 3092450 - RNA, 22 nt, Mycobacterium bovis subsp bovis AF2122/97
ggauuccagcagccugcgccgc

SEQ ID NO: 3092451 - RNA, 18 nt, Mycobacterium bovis subsp bovis AF2122/97
ggauucccagucgcggcg

SEQ ID NO: 3092452 - RNA, 19 nt, Mycobacterium bovis subsp bovis AF2122/97
ggauucccagucgcggcgc

SEQ ID NO: 3092453 - RNA, 20 nt, Mycobacterium bovis subsp bovis AF2122/97
ggauucccgcccagcagcac

SEQ ID NO: 3092454 - RNA, 16 nt, Mycobacterium bovis subsp bovis AF2122/97
ggauucggcagcggcg

SEQ ID NO: 3092455 - RNA, 18 nt, Mycobacterium bovis subsp bovis AF2122/97
ggauucggcagcggcgcg

SEQ ID NO: 3092456 - RNA, 16 nt, Mycobacterium bovis subsp bovis AF2122/97
ggauucggccagacgc

SEQ ID NO: 3092457 - RNA, 18 nt, Mycobacterium bovis subsp bovis AF2122/97
ggauucggcgcugcggcg

SEQ ID NO: 3092458 - RNA, 15 nt, Mycobacterium bovis subsp bovis AF2122/97
ggauucggcugccac

SEQ ID NO: 3092459 - RNA, 17 nt, Mycobacterium bovis subsp bovis AF2122/97
ggauucggcugccaccg

SEQ ID NO: 3092460 - RNA, 15 nt, Mycobacterium bovis subsp bovis AF2122/97
ggauucgggcgccgc

SEQ ID NO: 3092461 - RNA, 15 nt, Mycobacterium bovis subsp bovis AF2122/97
ggauucugcugacca

SEQ ID NO: 3092462 - RNA, 15 nt, Mycobacterium bovis subsp bovis AF2122/97
ggauucuggcgcagc

SEQ ID NO: 3092463 - RNA, 12 nt, Mycobacterium bovis subsp bovis AF2122/97
ggauucuucagc

SEQ ID NO: 3092464 - RNA, 15 nt, Mycobacterium bovis subsp bovis AF2122/97
ggauucuucagcgcg

SEQ ID NO: 3092465 - RNA, 18 nt, Mycobacterium bovis subsp bovis AF2122/97
ggauucuucagcgcggca

SEQ ID NO: 3092466 - RNA, 18 nt, Mycobacterium bovis subsp bovis AF2122/97
ggauugaagcuggccacc

SEQ ID NO: 3092467 - RNA, 19 nt, Mycobacterium bovis subsp bovis AF2122/97
ggauugcuguacugcggug

SEQ ID NO: 3092468 - RNA, 19 nt, Mycobacterium bovis subsp bovis AF2122/97
ggauuuccagcagugcggg

SEQ ID NO: 3092469 - RNA, 19 nt, Mycobacterium bovis subsp bovis AF2122/97
ggauuucgcgucugcucgc

SEQ ID NO: 3092470 - RNA, 23 nt, Mycobacterium bovis subsp bovis AF2122/97
ggauuugccccguugagcagcac

SEQ ID NO: 3092471 - RNA, 18 nt, Mycobacterium bovis subsp bovis AF2122/97
ggauuugggcugcggaug

SEQ ID NO: 3092472 - RNA, 19 nt, Mycobacterium bovis subsp bovis AF2122/97
ggcaaaauaaccguugacc

SEQ ID NO: 3092473 - RNA, 20 nt, Mycobacterium bovis subsp bovis AF2122/97
ggcaaacaccagcccggcgg

SEQ ID NO: 3092474 - RNA, 16 nt, Mycobacterium bovis subsp bovis AF2122/97
ggcaaaccaagcgcgc

SEQ ID NO: 3092475 - RNA, 23 nt, Mycobacterium bovis subsp bovis AF2122/97
ggcaaaccgaucaauccgcccuu

SEQ ID NO: 3092476 - RNA, 15 nt, Mycobacterium bovis subsp bovis AF2122/97
ggcaaacuccugcag

SEQ ID NO: 3092477 - RNA, 13 nt, Mycobacterium bovis subsp bovis AF2122/97
ggcaaacugggca

SEQ ID NO: 3092478 - RNA, 19 nt, Mycobacterium bovis subsp bovis AF2122/97
ggcaaacugggcaccggcg

SEQ ID NO: 3092479 - RNA, 20 nt, Mycobacterium bovis subsp bovis AF2122/97
ggcaaacugggcaccggcgg

SEQ ID NO: 3092480 - RNA, 21 nt, Mycobacterium bovis subsp bovis AF2122/97
ggcaaacugggcaccggcggu

SEQ ID NO: 3092481 - RNA, 16 nt, Mycobacterium bovis subsp bovis AF2122/97
ggcaaagacgcuggcc

SEQ ID NO: 3092482 - RNA, 20 nt, Mycobacterium bovis subsp bovis AF2122/97
ggcaaaggaugaugaacaga

SEQ ID NO: 3092483 - RNA, 17 nt, Mycobacterium bovis subsp bovis AF2122/97
ggcaaaguuggccgccc

SEQ ID NO: 3092484 - RNA, 19 nt, Mycobacterium bovis subsp bovis AF2122/97
ggcaaaguuggccgcccga

SEQ ID NO: 3092485 - RNA, 17 nt, Mycobacterium bovis subsp bovis AF2122/97
ggcaaaucaagcacagc

SEQ ID NO: 3092486 - RNA, 18 nt, Mycobacterium bovis subsp bovis AF2122/97
ggcaaaucaagcacagcc

SEQ ID NO: 3092487 - RNA, 20 nt, Mycobacterium bovis subsp bovis AF2122/97
ggcaaaucggugcgauccug

SEQ ID NO: 3092488 - RNA, 19 nt, Mycobacterium bovis subsp bovis AF2122/97
ggcaacaacguucggcaca

SEQ ID NO: 3092489 - RNA, 14 nt, Mycobacterium bovis subsp bovis AF2122/97
ggcaacacagcuga

SEQ ID NO: 3092490 - RNA, 19 nt, Mycobacterium bovis subsp bovis AF2122/97
ggcaacaccaccucgacga

SEQ ID NO: 3092491 - RNA, 13 nt, Mycobacterium bovis subsp bovis AF2122/97
ggcaacagcgcca

SEQ ID NO: 3092492 - RNA, 21 nt, Mycobacterium bovis subsp bovis AF2122/97
ggcaacagcggggugugcggu

SEQ ID NO: 3092493 - RNA, 12 nt, Mycobacterium bovis subsp bovis AF2122/97
ggcaacagggga

SEQ ID NO: 3092494 - RNA, 22 nt, Mycobacterium bovis subsp bovis AF2122/97
ggcaacaucagcaggaccaacg

SEQ ID NO: 3092495 - RNA, 22 nt, Mycobacterium bovis subsp bovis AF2122/97
ggcaaccaaccgcgcgagccuc

SEQ ID NO: 3092496 - RNA, 14 nt, Mycobacterium bovis subsp bovis AF2122/97
ggcaaccaccggcc

SEQ ID NO: 3092497 - RNA, 16 nt, Mycobacterium bovis subsp bovis AF2122/97
ggcaaccaccggccgc

SEQ ID NO: 3092498 - RNA, 20 nt, Mycobacterium bovis subsp bovis AF2122/97
ggcaaccagcgagcccagcu

SEQ ID NO: 3092499 - RNA, 13 nt, Mycobacterium bovis subsp bovis AF2122/97
ggcaaccagcuuc

SEQ ID NO: 3092500 - RNA, 22 nt, Mycobacterium bovis subsp bovis AF2122/97
ggcaaccaggaugguugcgacg

SEQ ID NO: 3092501 - RNA, 17 nt, Mycobacterium bovis subsp bovis AF2122/97
ggcaacccacacgcccu

SEQ ID NO: 3092502 - RNA, 20 nt, Mycobacterium bovis subsp bovis AF2122/97
ggcaacccccgccggcgccc

SEQ ID NO: 3092503 - RNA, 17 nt, Mycobacterium bovis subsp bovis AF2122/97
ggcaaccgacacuggga

SEQ ID NO: 3092504 - RNA, 15 nt, Mycobacterium bovis subsp bovis AF2122/97
ggcaaccgcaccgca

SEQ ID NO: 3092505 - RNA, 12 nt, Mycobacterium bovis subsp bovis AF2122/97
ggcaaccgccgc

SEQ ID NO: 3092506 - RNA, 21 nt, Mycobacterium bovis subsp bovis AF2122/97
ggcaaccgccgccaccagggc

SEQ ID NO: 3092507 - RNA, 19 nt, Mycobacterium bovis subsp bovis AF2122/97
ggcaaccgccgugugccac

SEQ ID NO: 3092508 - RNA, 21 nt, Mycobacterium bovis subsp bovis AF2122/97
ggcaaccggagaucccggucc

SEQ ID NO: 3092509 - RNA, 21 nt, Mycobacterium bovis subsp bovis AF2122/97
ggcaaccgggaggccaccgcg

SEQ ID NO: 3092510 - RNA, 16 nt, Mycobacterium bovis subsp bovis AF2122/97
ggcaaccucaugcacg

SEQ ID NO: 3092511 - RNA, 24 nt, Mycobacterium bovis subsp bovis AF2122/97
ggcaaccugaauccagaccaugcg

SEQ ID NO: 3092512 - RNA, 14 nt, Mycobacterium bovis subsp bovis AF2122/97
ggcaaccugccggg

SEQ ID NO: 3092513 - RNA, 23 nt, Mycobacterium bovis subsp bovis AF2122/97
ggcaaccuggacugggucgccuc

SEQ ID NO: 3092514 - RNA, 17 nt, Mycobacterium bovis subsp bovis AF2122/97
ggcaaccuuuggccgcu

SEQ ID NO: 3092515 - RNA, 21 nt, Mycobacterium bovis subsp bovis AF2122/97
ggcaaccuuuggccgcugugg

SEQ ID NO: 3092516 - RNA, 16 nt, Mycobacterium bovis subsp bovis AF2122/97
ggcaacgaggucugcg

SEQ ID NO: 3092517 - RNA, 20 nt, Mycobacterium bovis subsp bovis AF2122/97
ggcaacgaggucugcggccg

SEQ ID NO: 3092518 - RNA, 14 nt, Mycobacterium bovis subsp bovis AF2122/97
ggcaacgaucaggu

SEQ ID NO: 3092519 - RNA, 15 nt, Mycobacterium bovis subsp bovis AF2122/97
ggcaacgaucgacac

SEQ ID NO: 3092520 - RNA, 18 nt, Mycobacterium bovis subsp bovis AF2122/97
ggcaacgaucgacaccag

SEQ ID NO: 3092521 - RNA, 14 nt, Mycobacterium bovis subsp bovis AF2122/97
ggcaacgccgcgcc

SEQ ID NO: 3092522 - RNA, 15 nt, Mycobacterium bovis subsp bovis AF2122/97
ggcaacgccgcgccg

SEQ ID NO: 3092523 - RNA, 19 nt, Mycobacterium bovis subsp bovis AF2122/97
ggcaacgcgaaccggccau

SEQ ID NO: 3092524 - RNA, 13 nt, Mycobacterium bovis subsp bovis AF2122/97
ggcaacgcggccu

SEQ ID NO: 3092525 - RNA, 14 nt, Mycobacterium bovis subsp bovis AF2122/97
ggcaacgcggcucg

SEQ ID NO: 3092526 - RNA, 21 nt, Mycobacterium bovis subsp bovis AF2122/97
ggcaacggacgggaucgccca

SEQ ID NO: 3092527 - RNA, 18 nt, Mycobacterium bovis subsp bovis AF2122/97
ggcaacggaggugccggc

SEQ ID NO: 3092528 - RNA, 19 nt, Mycobacterium bovis subsp bovis AF2122/97
ggcaacggaggugccggcg

SEQ ID NO: 3092529 - RNA, 20 nt, Mycobacterium bovis subsp bovis AF2122/97
ggcaacggaggugccggcgc

SEQ ID NO: 3092530 - RNA, 22 nt, Mycobacterium bovis subsp bovis AF2122/97
ggcaacggcggaucggcggccg

SEQ ID NO: 3092531 - RNA, 20 nt, Mycobacterium bovis subsp bovis AF2122/97
ggcaacggcggcaacggcgg

SEQ ID NO: 3092532 - RNA, 19 nt, Mycobacterium bovis subsp bovis AF2122/97
ggcaacggcggcgacggcg

SEQ ID NO: 3092533 - RNA, 12 nt, Mycobacterium bovis subsp bovis AF2122/97
ggcaacggcggg

SEQ ID NO: 3092534 - RNA, 16 nt, Mycobacterium bovis subsp bovis AF2122/97
ggcaacggcggggccg

SEQ ID NO: 3092535 - RNA, 19 nt, Mycobacterium bovis subsp bovis AF2122/97
ggcaacggcggggccggcg

SEQ ID NO: 3092536 - RNA, 20 nt, Mycobacterium bovis subsp bovis AF2122/97
ggcaacggcggggccggcgg

SEQ ID NO: 3092537 - RNA, 21 nt, Mycobacterium bovis subsp bovis AF2122/97
ggcaacggcgguaacggcggu

SEQ ID NO: 3092538 - RNA, 16 nt, Mycobacterium bovis subsp bovis AF2122/97
ggcaacgggggcgccg

SEQ ID NO: 3092539 - RNA, 18 nt, Mycobacterium bovis subsp bovis AF2122/97
ggcaacgguacgcgcuga

SEQ ID NO: 3092540 - RNA, 23 nt, Mycobacterium bovis subsp bovis AF2122/97
ggcaacuccggucaacacccgcc

SEQ ID NO: 3092541 - RNA, 16 nt, Mycobacterium bovis subsp bovis AF2122/97
ggcaacuucagcaacg

SEQ ID NO: 3092542 - RNA, 13 nt, Mycobacterium bovis subsp bovis AF2122/97
ggcaagaacccga

SEQ ID NO: 3092543 - RNA, 14 nt, Mycobacterium bovis subsp bovis AF2122/97
ggcaagaacccggu

SEQ ID NO: 3092544 - RNA, 20 nt, Mycobacterium bovis subsp bovis AF2122/97
ggcaagaccgaacagcggca

SEQ ID NO: 3092545 - RNA, 15 nt, Mycobacterium bovis subsp bovis AF2122/97
ggcaagacgcggucg

SEQ ID NO: 3092546 - RNA, 18 nt, Mycobacterium bovis subsp bovis AF2122/97
ggcaagcaaccggugcgc

SEQ ID NO: 3092547 - RNA, 14 nt, Mycobacterium bovis subsp bovis AF2122/97
ggcaagcacaccgc

SEQ ID NO: 3092548 - RNA, 15 nt, Mycobacterium bovis subsp bovis AF2122/97
ggcaagcacaccgcc

SEQ ID NO: 3092549 - RNA, 18 nt, Mycobacterium bovis subsp bovis AF2122/97
ggcaagcacaccgccagc

SEQ ID NO: 3092550 - RNA, 14 nt, Mycobacterium bovis subsp bovis AF2122/97
ggcaagcacggcgu

SEQ ID NO: 3092551 - RNA, 18 nt, Mycobacterium bovis subsp bovis AF2122/97
ggcaagccgauugcuucu

SEQ ID NO: 3092552 - RNA, 12 nt, Mycobacterium bovis subsp bovis AF2122/97
ggcaagccgggg

SEQ ID NO: 3092553 - RNA, 14 nt, Mycobacterium bovis subsp bovis AF2122/97
ggcaagccguucug

SEQ ID NO: 3092554 - RNA, 21 nt, Mycobacterium bovis subsp bovis AF2122/97
ggcaagcgcagacacgacccc

SEQ ID NO: 3092555 - RNA, 15 nt, Mycobacterium bovis subsp bovis AF2122/97
ggcaagcggccgcgg

SEQ ID NO: 3092556 - RNA, 23 nt, Mycobacterium bovis subsp bovis AF2122/97
ggcaagcgugacccgccggcgac

SEQ ID NO: 3092557 - RNA, 13 nt, Mycobacterium bovis subsp bovis AF2122/97
ggcaagcuccagu

SEQ ID NO: 3092558 - RNA, 18 nt, Mycobacterium bovis subsp bovis AF2122/97
ggcaagcugaccgccagc

SEQ ID NO: 3092559 - RNA, 16 nt, Mycobacterium bovis subsp bovis AF2122/97
ggcaagcugccccgcc

SEQ ID NO: 3092560 - RNA, 18 nt, Mycobacterium bovis subsp bovis AF2122/97
ggcaagcugucgucgccc

SEQ ID NO: 3092561 - RNA, 22 nt, Mycobacterium bovis subsp bovis AF2122/97
ggcaaggacggagcccaaaacc

SEQ ID NO: 3092562 - RNA, 14 nt, Mycobacterium bovis subsp bovis AF2122/97
ggcaaggccaccgg

SEQ ID NO: 3092563 - RNA, 17 nt, Mycobacterium bovis subsp bovis AF2122/97
ggcaaggccaccggcgg

SEQ ID NO: 3092564 - RNA, 18 nt, Mycobacterium bovis subsp bovis AF2122/97
ggcaaggccaccggcggu

SEQ ID NO: 3092565 - RNA, 14 nt, Mycobacterium bovis subsp bovis AF2122/97
ggcaaggcggcggc

SEQ ID NO: 3092566 - RNA, 21 nt, Mycobacterium bovis subsp bovis AF2122/97
ggcaaggcggcggccagccgu

SEQ ID NO: 3092567 - RNA, 15 nt, Mycobacterium bovis subsp bovis AF2122/97
ggcaagggcggcaac

SEQ ID NO: 3092568 - RNA, 17 nt, Mycobacterium bovis subsp bovis AF2122/97
ggcaaggguggggccgg

SEQ ID NO: 3092569 - RNA, 20 nt, Mycobacterium bovis subsp bovis AF2122/97
ggcaaggguggggccggcgg

SEQ ID NO: 3092570 - RNA, 21 nt, Mycobacterium bovis subsp bovis AF2122/97
ggcaaggguggggccggcggu

SEQ ID NO: 3092571 - RNA, 21 nt, Mycobacterium bovis subsp bovis AF2122/97
ggcaagucaacaccgcggccg

SEQ ID NO: 3092572 - RNA, 14 nt, Mycobacterium bovis subsp bovis AF2122/97
ggcaagucgacgcc

SEQ ID NO: 3092573 - RNA, 24 nt, Mycobacterium bovis subsp bovis AF2122/97
ggcaagucgcccagccgagcgugg

SEQ ID NO: 3092574 - RNA, 23 nt, Mycobacterium bovis subsp bovis AF2122/97
ggcaauaccgaaccgguguagca

SEQ ID NO: 3092575 - RNA, 19 nt, Mycobacterium bovis subsp bovis AF2122/97
ggcaauaccgccagcgcca

SEQ ID NO: 3092576 - RNA, 19 nt, Mycobacterium bovis subsp bovis AF2122/97
ggcaauacguagucgccga

SEQ ID NO: 3092577 - RNA, 18 nt, Mycobacterium bovis subsp bovis AF2122/97
ggcaaucaacgcaaugcc

SEQ ID NO: 3092578 - RNA, 20 nt, Mycobacterium bovis subsp bovis AF2122/97
ggcaaucaccgccggcggcg

SEQ ID NO: 3092579 - RNA, 22 nt, Mycobacterium bovis subsp bovis AF2122/97
ggcaaucaccgccggcggcggg

SEQ ID NO: 3092580 - RNA, 19 nt, Mycobacterium bovis subsp bovis AF2122/97
ggcaaucaucucccgaccg

SEQ ID NO: 3092581 - RNA, 22 nt, Mycobacterium bovis subsp bovis AF2122/97
ggcaaucgaggaaggugugcgu

SEQ ID NO: 3092582 - RNA, 19 nt, Mycobacterium bovis subsp bovis AF2122/97
ggcaaucgcucugugucgc

SEQ ID NO: 3092583 - RNA, 21 nt, Mycobacterium bovis subsp bovis AF2122/97
ggcaaucucccgaaucgugcg

SEQ ID NO: 3092584 - RNA, 22 nt, Mycobacterium bovis subsp bovis AF2122/97
ggcaaucucccgaaucgugcgg

SEQ ID NO: 3092585 - RNA, 15 nt, Mycobacterium bovis subsp bovis AF2122/97
ggcaaugaccccggc

SEQ ID NO: 3092586 - RNA, 17 nt, Mycobacterium bovis subsp bovis AF2122/97
ggcaaugaccccggcgu

SEQ ID NO: 3092587 - RNA, 21 nt, Mycobacterium bovis subsp bovis AF2122/97
ggcaaugaccccggcguugcc

SEQ ID NO: 3092588 - RNA, 22 nt, Mycobacterium bovis subsp bovis AF2122/97
ggcaaugaucaucccggcgcgu

SEQ ID NO: 3092589 - RNA, 17 nt, Mycobacterium bovis subsp bovis AF2122/97
ggcaaugcccgaccggu

SEQ ID NO: 3092590 - RNA, 19 nt, Mycobacterium bovis subsp bovis AF2122/97
ggcaaugcccgaccggucu

SEQ ID NO: 3092591 - RNA, 18 nt, Mycobacterium bovis subsp bovis AF2122/97
ggcaaugcgagcacccgu

SEQ ID NO: 3092592 - RNA, 20 nt, Mycobacterium bovis subsp bovis AF2122/97
ggcaaugcuccuaucugccg

SEQ ID NO: 3092593 - RNA, 13 nt, Mycobacterium bovis subsp bovis AF2122/97
ggcaauggccagc

SEQ ID NO: 3092594 - RNA, 17 nt, Mycobacterium bovis subsp bovis AF2122/97
ggcaaugucgacaccgg

SEQ ID NO: 3092595 - RNA, 20 nt, Mycobacterium bovis subsp bovis AF2122/97
ggcaaugucgacaccggcgc

SEQ ID NO: 3092596 - RNA, 22 nt, Mycobacterium bovis subsp bovis AF2122/97
ggcaauuacccgacuucaagac

SEQ ID NO: 3092597 - RNA, 18 nt, Mycobacterium bovis subsp bovis AF2122/97
ggcaauuaggucgaccac

SEQ ID NO: 3092598 - RNA, 14 nt, Mycobacterium bovis subsp bovis AF2122/97
ggcaauuccgccga

SEQ ID NO: 3092599 - RNA, 18 nt, Mycobacterium bovis subsp bovis AF2122/97
ggcaauucgggcaugguc

SEQ ID NO: 3092600 - RNA, 21 nt, Mycobacterium bovis subsp bovis AF2122/97
ggcaauugcgguucgaacgcg

SEQ ID NO: 3092601 - RNA, 19 nt, Mycobacterium bovis subsp bovis AF2122/97
ggcacaaccaacgacaggu

SEQ ID NO: 3092602 - RNA, 22 nt, Mycobacterium bovis subsp bovis AF2122/97
ggcacaauaggcuccagcgcgc

SEQ ID NO: 3092603 - RNA, 18 nt, Mycobacterium bovis subsp bovis AF2122/97
ggcacaaucaccgccgcg

SEQ ID NO: 3092604 - RNA, 14 nt, Mycobacterium bovis subsp bovis AF2122/97
ggcacaaucggcgc

SEQ ID NO: 3092605 - RNA, 17 nt, Mycobacterium bovis subsp bovis AF2122/97
ggcacacccaucaccgc

SEQ ID NO: 3092606 - RNA, 14 nt, Mycobacterium bovis subsp bovis AF2122/97
ggcacacccgcacc

SEQ ID NO: 3092607 - RNA, 17 nt, Mycobacterium bovis subsp bovis AF2122/97
ggcacacccgcaccgga

SEQ ID NO: 3092608 - RNA, 14 nt, Mycobacterium bovis subsp bovis AF2122/97
ggcacaccgacgcc

SEQ ID NO: 3092609 - RNA, 19 nt, Mycobacterium bovis subsp bovis AF2122/97
ggcacaccgacgccgccag

SEQ ID NO: 3092610 - RNA, 15 nt, Mycobacterium bovis subsp bovis AF2122/97
ggcacaccgguggcg

SEQ ID NO: 3092611 - RNA, 23 nt, Mycobacterium bovis subsp bovis AF2122/97
ggcacacgaguacagaucgaggg

SEQ ID NO: 3092612 - RNA, 18 nt, Mycobacterium bovis subsp bovis AF2122/97
ggcacacggucaccggca

SEQ ID NO: 3092613 - RNA, 12 nt, Mycobacterium bovis subsp bovis AF2122/97
ggcacagccagu

SEQ ID NO: 3092614 - RNA, 17 nt, Mycobacterium bovis subsp bovis AF2122/97
ggcacaugcgcguccag

SEQ ID NO: 3092615 - RNA, 19 nt, Mycobacterium bovis subsp bovis AF2122/97
ggcacauugaucgacggcc

SEQ ID NO: 3092616 - RNA, 20 nt, Mycobacterium bovis subsp bovis AF2122/97
ggcacauugaucgacggcca

SEQ ID NO: 3092617 - RNA, 22 nt, Mycobacterium bovis subsp bovis AF2122/97
ggcacauugaucgacggccagc

SEQ ID NO: 3092618 - RNA, 23 nt, Mycobacterium bovis subsp bovis AF2122/97
ggcacauugaucgacggccagcc

SEQ ID NO: 3092619 - RNA, 20 nt, Mycobacterium bovis subsp bovis AF2122/97
ggcaccaacgccaccgucgc

SEQ ID NO: 3092620 - RNA, 17 nt, Mycobacterium bovis subsp bovis AF2122/97
ggcaccaauaccgcacc

SEQ ID NO: 3092621 - RNA, 21 nt, Mycobacterium bovis subsp bovis AF2122/97
ggcaccaauaccgcacccgcu

SEQ ID NO: 3092622 - RNA, 19 nt, Mycobacterium bovis subsp bovis AF2122/97
ggcaccacccgauuggcca

SEQ ID NO: 3092623 - RNA, 16 nt, Mycobacterium bovis subsp bovis AF2122/97
ggcaccacccggcgaa

SEQ ID NO: 3092624 - RNA, 16 nt, Mycobacterium bovis subsp bovis AF2122/97
ggcaccacccuugccg

SEQ ID NO: 3092625 - RNA, 22 nt, Mycobacterium bovis subsp bovis AF2122/97
ggcaccacccuugccgaugacg

SEQ ID NO: 3092626 - RNA, 14 nt, Mycobacterium bovis subsp bovis AF2122/97
ggcaccacgccagc

SEQ ID NO: 3092627 - RNA, 15 nt, Mycobacterium bovis subsp bovis AF2122/97
ggcaccacgcugugc

SEQ ID NO: 3092628 - RNA, 20 nt, Mycobacterium bovis subsp bovis AF2122/97
ggcaccacuacaucgaucag

SEQ ID NO: 3092629 - RNA, 20 nt, Mycobacterium bovis subsp bovis AF2122/97
ggcaccagaucuucgagcgc

SEQ ID NO: 3092630 - RNA, 22 nt, Mycobacterium bovis subsp bovis AF2122/97
ggcaccagcacacucucgucgu

SEQ ID NO: 3092631 - RNA, 21 nt, Mycobacterium bovis subsp bovis AF2122/97
ggcaccagccggugagcgagc

SEQ ID NO: 3092632 - RNA, 23 nt, Mycobacterium bovis subsp bovis AF2122/97
ggcaccagccggugagcgagcgc

SEQ ID NO: 3092633 - RNA, 12 nt, Mycobacterium bovis subsp bovis AF2122/97
ggcaccagcgaa

SEQ ID NO: 3092634 - RNA, 17 nt, Mycobacterium bovis subsp bovis AF2122/97
ggcaccagcgcgcgccg

SEQ ID NO: 3092635 - RNA, 19 nt, Mycobacterium bovis subsp bovis AF2122/97
ggcaccagcgcgcgccgag

SEQ ID NO: 3092636 - RNA, 22 nt, Mycobacterium bovis subsp bovis AF2122/97
ggcaccagcgcgcgccgagccc

SEQ ID NO: 3092637 - RNA, 17 nt, Mycobacterium bovis subsp bovis AF2122/97
ggcaccagcggcaccgc

SEQ ID NO: 3092638 - RNA, 21 nt, Mycobacterium bovis subsp bovis AF2122/97
ggcaccagcggcaccgcggcc

SEQ ID NO: 3092639 - RNA, 19 nt, Mycobacterium bovis subsp bovis AF2122/97
ggcaccagcgggucggcgg

SEQ ID NO: 3092640 - RNA, 11 nt, Mycobacterium bovis subsp bovis AF2122/97
ggcaccagguu

SEQ ID NO: 3092641 - RNA, 21 nt, Mycobacterium bovis subsp bovis AF2122/97
ggcaccauguacaggcugucc

SEQ ID NO: 3092642 - RNA, 21 nt, Mycobacterium bovis subsp bovis AF2122/97
ggcacccacuuuucgguggcg

SEQ ID NO: 3092643 - RNA, 19 nt, Mycobacterium bovis subsp bovis AF2122/97
ggcacccagucggcgccgc

SEQ ID NO: 3092644 - RNA, 22 nt, Mycobacterium bovis subsp bovis AF2122/97
ggcacccaguuccacccggugc

SEQ ID NO: 3092645 - RNA, 24 nt, Mycobacterium bovis subsp bovis AF2122/97
ggcacccaucccguucagcgacca

SEQ ID NO: 3092646 - RNA, 19 nt, Mycobacterium bovis subsp bovis AF2122/97
ggcaccccacgccugccga

SEQ ID NO: 3092647 - RNA, 16 nt, Mycobacterium bovis subsp bovis AF2122/97
ggcaccccacggccag

SEQ ID NO: 3092648 - RNA, 17 nt, Mycobacterium bovis subsp bovis AF2122/97
ggcaccccacggccagu

SEQ ID NO: 3092649 - RNA, 16 nt, Mycobacterium bovis subsp bovis AF2122/97
ggcacccccgacgaga

SEQ ID NO: 3092650 - RNA, 14 nt, Mycobacterium bovis subsp bovis AF2122/97
ggcacccccgucgc

SEQ ID NO: 3092651 - RNA, 14 nt, Mycobacterium bovis subsp bovis AF2122/97
ggcaccccgaccac

SEQ ID NO: 3092652 - RNA, 20 nt, Mycobacterium bovis subsp bovis AF2122/97
ggcaccccgaccaccagagc

SEQ ID NO: 3092653 - RNA, 19 nt, Mycobacterium bovis subsp bovis AF2122/97
ggcaccccgaucacccgca

SEQ ID NO: 3092654 - RNA, 14 nt, Mycobacterium bovis subsp bovis AF2122/97
ggcaccccggccac

SEQ ID NO: 3092655 - RNA, 19 nt, Mycobacterium bovis subsp bovis AF2122/97
ggcaccccggugcccgcgg

SEQ ID NO: 3092656 - RNA, 16 nt, Mycobacterium bovis subsp bovis AF2122/97
ggcaccccuuugacgc

SEQ ID NO: 3092657 - RNA, 19 nt, Mycobacterium bovis subsp bovis AF2122/97
ggcaccccuuugacgccga

SEQ ID NO: 3092658 - RNA, 18 nt, Mycobacterium bovis subsp bovis AF2122/97
ggcacccgacucgucggc

SEQ ID NO: 3092659 - RNA, 19 nt, Mycobacterium bovis subsp bovis AF2122/97
ggcacccgagccgcacagc

SEQ ID NO: 3092660 - RNA, 17 nt, Mycobacterium bovis subsp bovis AF2122/97
ggcacccgcacggccuc

SEQ ID NO: 3092661 - RNA, 22 nt, Mycobacterium bovis subsp bovis AF2122/97
ggcacccgccggauucgcccgg

SEQ ID NO: 3092662 - RNA, 13 nt, Mycobacterium bovis subsp bovis AF2122/97
ggcacccgccgug

SEQ ID NO: 3092663 - RNA, 15 nt, Mycobacterium bovis subsp bovis AF2122/97
ggcacccgccgugcc

SEQ ID NO: 3092664 - RNA, 23 nt, Mycobacterium bovis subsp bovis AF2122/97
ggcacccgccgugcccccggcuu

SEQ ID NO: 3092665 - RNA, 14 nt, Mycobacterium bovis subsp bovis AF2122/97
ggcacccgcggcga

SEQ ID NO: 3092666 - RNA, 22 nt, Mycobacterium bovis subsp bovis AF2122/97
ggcacccgcggcgaaccgucuc

SEQ ID NO: 3092667 - RNA, 14 nt, Mycobacterium bovis subsp bovis AF2122/97
ggcacccgcgucga

SEQ ID NO: 3092668 - RNA, 14 nt, Mycobacterium bovis subsp bovis AF2122/97
ggcacccgcuggcg

SEQ ID NO: 3092669 - RNA, 20 nt, Mycobacterium bovis subsp bovis AF2122/97
ggcacccgcuggcgguaagc

SEQ ID NO: 3092670 - RNA, 11 nt, Mycobacterium bovis subsp bovis AF2122/97
ggcacccggcu

SEQ ID NO: 3092671 - RNA, 19 nt, Mycobacterium bovis subsp bovis AF2122/97
ggcacccggggugcccggc

SEQ ID NO: 3092672 - RNA, 20 nt, Mycobacterium bovis subsp bovis AF2122/97
ggcacccggggugcccggcc

SEQ ID NO: 3092673 - RNA, 22 nt, Mycobacterium bovis subsp bovis AF2122/97
ggcacccggggugcccggccgc

SEQ ID NO: 3092674 - RNA, 23 nt, Mycobacterium bovis subsp bovis AF2122/97
ggcacccggggugcccggccgcc

SEQ ID NO: 3092675 - RNA, 14 nt, Mycobacterium bovis subsp bovis AF2122/97
ggcacccggucggc

SEQ ID NO: 3092676 - RNA, 19 nt, Mycobacterium bovis subsp bovis AF2122/97
ggcacccggucggccaucc

SEQ ID NO: 3092677 - RNA, 22 nt, Mycobacterium bovis subsp bovis AF2122/97
ggcacccggugagaagaagccc

SEQ ID NO: 3092678 - RNA, 21 nt, Mycobacterium bovis subsp bovis AF2122/97
ggcacccgucgggugcugaug

SEQ ID NO: 3092679 - RNA, 13 nt, Mycobacterium bovis subsp bovis AF2122/97
ggcacccuccgcc

SEQ ID NO: 3092680 - RNA, 15 nt, Mycobacterium bovis subsp bovis AF2122/97
ggcacccuccgccgg

SEQ ID NO: 3092681 - RNA, 14 nt, Mycobacterium bovis subsp bovis AF2122/97
ggcacccucggcgu

SEQ ID NO: 3092682 - RNA, 13 nt, Mycobacterium bovis subsp bovis AF2122/97
ggcacccuugccg

SEQ ID NO: 3092683 - RNA, 19 nt, Mycobacterium bovis subsp bovis AF2122/97
ggcacccuugccgauuccg

SEQ ID NO: 3092684 - RNA, 20 nt, Mycobacterium bovis subsp bovis AF2122/97
ggcacccuugccgauuccgg

SEQ ID NO: 3092685 - RNA, 22 nt, Mycobacterium bovis subsp bovis AF2122/97
ggcaccgaaaaacaccagcgag

SEQ ID NO: 3092686 - RNA, 18 nt, Mycobacterium bovis subsp bovis AF2122/97
ggcaccgaagucgaugau

SEQ ID NO: 3092687 - RNA, 22 nt, Mycobacterium bovis subsp bovis AF2122/97
ggcaccgagcugagcggccagc

SEQ ID NO: 3092688 - RNA, 17 nt, Mycobacterium bovis subsp bovis AF2122/97
ggcaccgagucuaagga

SEQ ID NO: 3092689 - RNA, 15 nt, Mycobacterium bovis subsp bovis AF2122/97
ggcaccgauccugga

SEQ ID NO: 3092690 - RNA, 21 nt, Mycobacterium bovis subsp bovis AF2122/97
ggcaccgaucggugccggccu

SEQ ID NO: 3092691 - RNA, 18 nt, Mycobacterium bovis subsp bovis AF2122/97
ggcaccgauggcgcaccg

SEQ ID NO: 3092692 - RNA, 21 nt, Mycobacterium bovis subsp bovis AF2122/97
ggcaccgauggcgcaccggcg

SEQ ID NO: 3092693 - RNA, 14 nt, Mycobacterium bovis subsp bovis AF2122/97
ggcaccgcagcgga

SEQ ID NO: 3092694 - RNA, 17 nt, Mycobacterium bovis subsp bovis AF2122/97
ggcaccgccagccacca

SEQ ID NO: 3092695 - RNA, 14 nt, Mycobacterium bovis subsp bovis AF2122/97
ggcaccgccgagca

SEQ ID NO: 3092696 - RNA, 13 nt, Mycobacterium bovis subsp bovis AF2122/97
ggcaccgccgccc

SEQ ID NO: 3092697 - RNA, 14 nt, Mycobacterium bovis subsp bovis AF2122/97
ggcaccgccgcccc

SEQ ID NO: 3092698 - RNA, 17 nt, Mycobacterium bovis subsp bovis AF2122/97
ggcaccgccgcccccgc

SEQ ID NO: 3092699 - RNA, 18 nt, Mycobacterium bovis subsp bovis AF2122/97
ggcaccgccgcccccgcc

SEQ ID NO: 3092700 - RNA, 20 nt, Mycobacterium bovis subsp bovis AF2122/97
ggcaccgccgcccccgccgg

SEQ ID NO: 3092701 - RNA, 23 nt, Mycobacterium bovis subsp bovis AF2122/97
ggcaccgccgcccccgccggccg

SEQ ID NO: 3092702 - RNA, 22 nt, Mycobacterium bovis subsp bovis AF2122/97
ggcaccgccggcaccgccggcg

SEQ ID NO: 3092703 - RNA, 23 nt, Mycobacterium bovis subsp bovis AF2122/97
ggcaccgccggcaccgccggcgc

SEQ ID NO: 3092704 - RNA, 14 nt, Mycobacterium bovis subsp bovis AF2122/97
ggcaccgccggcgc

SEQ ID NO: 3092705 - RNA, 16 nt, Mycobacterium bovis subsp bovis AF2122/97
ggcaccgccggcgcca

SEQ ID NO: 3092706 - RNA, 17 nt, Mycobacterium bovis subsp bovis AF2122/97
ggcaccgccggcgccac

SEQ ID NO: 3092707 - RNA, 22 nt, Mycobacterium bovis subsp bovis AF2122/97
ggcaccgccggcgccaccgucg

SEQ ID NO: 3092708 - RNA, 18 nt, Mycobacterium bovis subsp bovis AF2122/97
ggcaccgccggcgcccag

SEQ ID NO: 3092709 - RNA, 20 nt, Mycobacterium bovis subsp bovis AF2122/97
ggcaccgccggcgcccaggc

SEQ ID NO: 3092710 - RNA, 19 nt, Mycobacterium bovis subsp bovis AF2122/97
ggcaccgccggcuccgccg

SEQ ID NO: 3092711 - RNA, 16 nt, Mycobacterium bovis subsp bovis AF2122/97
ggcaccgccgguggcg

SEQ ID NO: 3092712 - RNA, 14 nt, Mycobacterium bovis subsp bovis AF2122/97
ggcaccgccugcgc

SEQ ID NO: 3092713 - RNA, 15 nt, Mycobacterium bovis subsp bovis AF2122/97
ggcaccgccugcgcc

SEQ ID NO: 3092714 - RNA, 22 nt, Mycobacterium bovis subsp bovis AF2122/97
ggcaccgccugcgccgcccgcg

SEQ ID NO: 3092715 - RNA, 15 nt, Mycobacterium bovis subsp bovis AF2122/97
ggcaccgcgccggcg

SEQ ID NO: 3092716 - RNA, 16 nt, Mycobacterium bovis subsp bovis AF2122/97
ggcaccgcgccggcgg

SEQ ID NO: 3092717 - RNA, 13 nt, Mycobacterium bovis subsp bovis AF2122/97
ggcaccgcggcca

SEQ ID NO: 3092718 - RNA, 17 nt, Mycobacterium bovis subsp bovis AF2122/97
ggcaccgcggccagcgg

SEQ ID NO: 3092719 - RNA, 18 nt, Mycobacterium bovis subsp bovis AF2122/97
ggcaccgcggccagcggg

SEQ ID NO: 3092720 - RNA, 14 nt, Mycobacterium bovis subsp bovis AF2122/97
ggcaccgcugccgc

SEQ ID NO: 3092721 - RNA, 18 nt, Mycobacterium bovis subsp bovis AF2122/97
ggcaccgcugccgcugcc

SEQ ID NO: 3092722 - RNA, 19 nt, Mycobacterium bovis subsp bovis AF2122/97
ggcaccgcugccgcugccg

SEQ ID NO: 3092723 - RNA, 15 nt, Mycobacterium bovis subsp bovis AF2122/97
ggcaccgcuucaggc

SEQ ID NO: 3092724 - RNA, 16 nt, Mycobacterium bovis subsp bovis AF2122/97
ggcaccggccgugccg

SEQ ID NO: 3092725 - RNA, 21 nt, Mycobacterium bovis subsp bovis AF2122/97
ggcaccggccgugccgccgac

SEQ ID NO: 3092726 - RNA, 23 nt, Mycobacterium bovis subsp bovis AF2122/97
ggcaccggcgaucguguccaccg

SEQ ID NO: 3092727 - RNA, 14 nt, Mycobacterium bovis subsp bovis AF2122/97
ggcaccggcggcga

SEQ ID NO: 3092728 - RNA, 20 nt, Mycobacterium bovis subsp bovis AF2122/97
ggcaccggggcugcccgcgg

SEQ ID NO: 3092729 - RNA, 22 nt, Mycobacterium bovis subsp bovis AF2122/97
ggcaccgggguuacucgcagcg

SEQ ID NO: 3092730 - RNA, 17 nt, Mycobacterium bovis subsp bovis AF2122/97
ggcaccggugcccacca

SEQ ID NO: 3092731 - RNA, 18 nt, Mycobacterium bovis subsp bovis AF2122/97
ggcaccgguuuucgccgg

SEQ ID NO: 3092732 - RNA, 23 nt, Mycobacterium bovis subsp bovis AF2122/97
ggcaccgguuuucgccggcuccg

SEQ ID NO: 3092733 - RNA, 22 nt, Mycobacterium bovis subsp bovis AF2122/97
ggcaccguagagcaugccgccc

SEQ ID NO: 3092734 - RNA, 21 nt, Mycobacterium bovis subsp bovis AF2122/97
ggcaccgucucgcaccgcguu

SEQ ID NO: 3092735 - RNA, 21 nt, Mycobacterium bovis subsp bovis AF2122/97
ggcaccgugcggaucgcgcug

SEQ ID NO: 3092736 - RNA, 22 nt, Mycobacterium bovis subsp bovis AF2122/97
ggcaccgugcggaucgcgcugc

SEQ ID NO: 3092737 - RNA, 19 nt, Mycobacterium bovis subsp bovis AF2122/97
ggcaccguggaucugaaga

SEQ ID NO: 3092738 - RNA, 12 nt, Mycobacterium bovis subsp bovis AF2122/97
ggcaccgugucg

SEQ ID NO: 3092739 - RNA, 18 nt, Mycobacterium bovis subsp bovis AF2122/97
ggcaccguuaccgccguc

SEQ ID NO: 3092740 - RNA, 20 nt, Mycobacterium bovis subsp bovis AF2122/97
ggcaccguuaccgccgucgc

SEQ ID NO: 3092741 - RNA, 21 nt, Mycobacterium bovis subsp bovis AF2122/97
ggcaccguuaccgccgucgcc

SEQ ID NO: 3092742 - RNA, 23 nt, Mycobacterium bovis subsp bovis AF2122/97
ggcaccuccaauugcgaaccggc

SEQ ID NO: 3092743 - RNA, 13 nt, Mycobacterium bovis subsp bovis AF2122/97
ggcaccuccagca

SEQ ID NO: 3092744 - RNA, 15 nt, Mycobacterium bovis subsp bovis AF2122/97
ggcaccuccagcacc

SEQ ID NO: 3092745 - RNA, 19 nt, Mycobacterium bovis subsp bovis AF2122/97
ggcaccuccagcaccaccg

SEQ ID NO: 3092746 - RNA, 15 nt, Mycobacterium bovis subsp bovis AF2122/97
ggcaccucgcccucc

SEQ ID NO: 3092747 - RNA, 13 nt, Mycobacterium bovis subsp bovis AF2122/97
ggcaccucggccu

SEQ ID NO: 3092748 - RNA, 20 nt, Mycobacterium bovis subsp bovis AF2122/97
ggcaccuucggcccaugcag

SEQ ID NO: 3092749 - RNA, 16 nt, Mycobacterium bovis subsp bovis AF2122/97
ggcacgaaauugggcg

SEQ ID NO: 3092750 - RNA, 22 nt, Mycobacterium bovis subsp bovis AF2122/97
ggcacgaacaucagaucgccga

SEQ ID NO: 3092751 - RNA, 22 nt, Mycobacterium bovis subsp bovis AF2122/97
ggcacgaaucccccggacggca

SEQ ID NO: 3092752 - RNA, 14 nt, Mycobacterium bovis subsp bovis AF2122/97
ggcacgacccggga

SEQ ID NO: 3092753 - RNA, 19 nt, Mycobacterium bovis subsp bovis AF2122/97
ggcacgacccgggaaggaa

SEQ ID NO: 3092754 - RNA, 12 nt, Mycobacterium bovis subsp bovis AF2122/97
ggcacgaccgcu

SEQ ID NO: 3092755 - RNA, 16 nt, Mycobacterium bovis subsp bovis AF2122/97
ggcacgaccgcucccg

SEQ ID NO: 3092756 - RNA, 20 nt, Mycobacterium bovis subsp bovis AF2122/97
ggcacgaccgcucccggugu

SEQ ID NO: 3092757 - RNA, 18 nt, Mycobacterium bovis subsp bovis AF2122/97
ggcacgacgccggccugg

SEQ ID NO: 3092758 - RNA, 19 nt, Mycobacterium bovis subsp bovis AF2122/97
ggcacgaucaucggggugg

SEQ ID NO: 3092759 - RNA, 16 nt, Mycobacterium bovis subsp bovis AF2122/97
ggcacgaucgccaacg

SEQ ID NO: 3092760 - RNA, 14 nt, Mycobacterium bovis subsp bovis AF2122/97
ggcacgaucgucgc

SEQ ID NO: 3092761 - RNA, 18 nt, Mycobacterium bovis subsp bovis AF2122/97
ggcacgaucgucgcggcc

SEQ ID NO: 3092762 - RNA, 18 nt, Mycobacterium bovis subsp bovis AF2122/97
ggcacgcaacaccgccaa

SEQ ID NO: 3092763 - RNA, 17 nt, Mycobacterium bovis subsp bovis AF2122/97
ggcacgcacaaguucuu

SEQ ID NO: 3092764 - RNA, 20 nt, Mycobacterium bovis subsp bovis AF2122/97
ggcacgcacguagacggugu

SEQ ID NO: 3092765 - RNA, 18 nt, Mycobacterium bovis subsp bovis AF2122/97
ggcacgcaugccggugau

SEQ ID NO: 3092766 - RNA, 16 nt, Mycobacterium bovis subsp bovis AF2122/97
ggcacgcccacagcug

SEQ ID NO: 3092767 - RNA, 15 nt, Mycobacterium bovis subsp bovis AF2122/97
ggcacgccgaccggu

SEQ ID NO: 3092768 - RNA, 16 nt, Mycobacterium bovis subsp bovis AF2122/97
ggcacgccgaccggug

SEQ ID NO: 3092769 - RNA, 17 nt, Mycobacterium bovis subsp bovis AF2122/97
ggcacgccgaccggugg

SEQ ID NO: 3092770 - RNA, 20 nt, Mycobacterium bovis subsp bovis AF2122/97
ggcacgccgaccgguggcac

SEQ ID NO: 3092771 - RNA, 21 nt, Mycobacterium bovis subsp bovis AF2122/97
ggcacgccgaccgguggcacc

SEQ ID NO: 3092772 - RNA, 13 nt, Mycobacterium bovis subsp bovis AF2122/97
ggcacgccgccga

SEQ ID NO: 3092773 - RNA, 14 nt, Mycobacterium bovis subsp bovis AF2122/97
ggcacgccgccgac

SEQ ID NO: 3092774 - RNA, 16 nt, Mycobacterium bovis subsp bovis AF2122/97
ggcacgccgccgacgu

SEQ ID NO: 3092775 - RNA, 14 nt, Mycobacterium bovis subsp bovis AF2122/97
ggcacgccggcggc

SEQ ID NO: 3092776 - RNA, 19 nt, Mycobacterium bovis subsp bovis AF2122/97
ggcacgccgggcaucggcg

SEQ ID NO: 3092777 - RNA, 21 nt, Mycobacterium bovis subsp bovis AF2122/97
ggcacgccgggcaucggcggu

SEQ ID NO: 3092778 - RNA, 13 nt, Mycobacterium bovis subsp bovis AF2122/97
ggcacgcgcgcuu

SEQ ID NO: 3092779 - RNA, 22 nt, Mycobacterium bovis subsp bovis AF2122/97
ggcacgcggcgaugauggcgcg

SEQ ID NO: 3092780 - RNA, 22 nt, Mycobacterium bovis subsp bovis AF2122/97
ggcacgcgggaagugcacccgg

SEQ ID NO: 3092781 - RNA, 18 nt, Mycobacterium bovis subsp bovis AF2122/97
ggcacgcuccagcucggc

SEQ ID NO: 3092782 - RNA, 22 nt, Mycobacterium bovis subsp bovis AF2122/97
ggcacgcuccagcucggccagu

SEQ ID NO: 3092783 - RNA, 13 nt, Mycobacterium bovis subsp bovis AF2122/97
ggcacgcucgcgc

SEQ ID NO: 3092784 - RNA, 13 nt, Mycobacterium bovis subsp bovis AF2122/97
ggcacgcugucga

SEQ ID NO: 3092785 - RNA, 15 nt, Mycobacterium bovis subsp bovis AF2122/97
ggcacggaccgcguc

SEQ ID NO: 3092786 - RNA, 17 nt, Mycobacterium bovis subsp bovis AF2122/97
ggcacggaccgcgucgc

SEQ ID NO: 3092787 - RNA, 19 nt, Mycobacterium bovis subsp bovis AF2122/97
ggcacggccccugccacga

SEQ ID NO: 3092788 - RNA, 19 nt, Mycobacterium bovis subsp bovis AF2122/97
ggcacgggaaucgcucgcg

SEQ ID NO: 3092789 - RNA, 12 nt, Mycobacterium bovis subsp bovis AF2122/97
ggcacgggcggg

SEQ ID NO: 3092790 - RNA, 23 nt, Mycobacterium bovis subsp bovis AF2122/97
ggcacggguaaucaccgaauacc

SEQ ID NO: 3092791 - RNA, 18 nt, Mycobacterium bovis subsp bovis AF2122/97
ggcacgggugacgauguc

SEQ ID NO: 3092792 - RNA, 18 nt, Mycobacterium bovis subsp bovis AF2122/97
ggcacggucacacgccag

SEQ ID NO: 3092793 - RNA, 22 nt, Mycobacterium bovis subsp bovis AF2122/97
ggcacggucacacgccagccgg

SEQ ID NO: 3092794 - RNA, 16 nt, Mycobacterium bovis subsp bovis AF2122/97
ggcacggucgcccgau

SEQ ID NO: 3092795 - RNA, 22 nt, Mycobacterium bovis subsp bovis AF2122/97
ggcacggucgcccgaucggcgg

SEQ ID NO: 3092796 - RNA, 18 nt, Mycobacterium bovis subsp bovis AF2122/97
ggcacguccgaucggcgc

SEQ ID NO: 3092797 - RNA, 20 nt, Mycobacterium bovis subsp bovis AF2122/97
ggcacguccgaucggcgcgc

SEQ ID NO: 3092798 - RNA, 21 nt, Mycobacterium bovis subsp bovis AF2122/97
ggcacgucgcccccggccaug

SEQ ID NO: 3092799 - RNA, 16 nt, Mycobacterium bovis subsp bovis AF2122/97
ggcacgucgucguccc

SEQ ID NO: 3092800 - RNA, 18 nt, Mycobacterium bovis subsp bovis AF2122/97
ggcacguggcgaccggcg

SEQ ID NO: 3092801 - RNA, 21 nt, Mycobacterium bovis subsp bovis AF2122/97
ggcacguggcgaccggcgacc

SEQ ID NO: 3092802 - RNA, 17 nt, Mycobacterium bovis subsp bovis AF2122/97
ggcacguucagccaggc

SEQ ID NO: 3092803 - RNA, 18 nt, Mycobacterium bovis subsp bovis AF2122/97
ggcacguucagccaggcg

SEQ ID NO: 3092804 - RNA, 15 nt, Mycobacterium bovis subsp bovis AF2122/97
ggcacguucggcgca

SEQ ID NO: 3092805 - RNA, 20 nt, Mycobacterium bovis subsp bovis AF2122/97
ggcacuacgcagccguagcu

SEQ ID NO: 3092806 - RNA, 17 nt, Mycobacterium bovis subsp bovis AF2122/97
ggcacuagcgagccggc

SEQ ID NO: 3092807 - RNA, 20 nt, Mycobacterium bovis subsp bovis AF2122/97
ggcacuagcgagccggcgcc

SEQ ID NO: 3092808 - RNA, 14 nt, Mycobacterium bovis subsp bovis AF2122/97
ggcacuccaccggg

SEQ ID NO: 3092809 - RNA, 20 nt, Mycobacterium bovis subsp bovis AF2122/97
ggcacuccagcggcgggggc

SEQ ID NO: 3092810 - RNA, 17 nt, Mycobacterium bovis subsp bovis AF2122/97
ggcacuccgggcucggc

SEQ ID NO: 3092811 - RNA, 23 nt, Mycobacterium bovis subsp bovis AF2122/97
ggcacuccgggcucggcgucgcc

SEQ ID NO: 3092812 - RNA, 15 nt, Mycobacterium bovis subsp bovis AF2122/97
ggcacugaccgcgau

SEQ ID NO: 3092813 - RNA, 15 nt, Mycobacterium bovis subsp bovis AF2122/97
ggcacugacgcgccc

SEQ ID NO: 3092814 - RNA, 13 nt, Mycobacterium bovis subsp bovis AF2122/97
ggcacugcccagc

SEQ ID NO: 3092815 - RNA, 22 nt, Mycobacterium bovis subsp bovis AF2122/97
ggcacugcccagcagaccaagu

SEQ ID NO: 3092816 - RNA, 14 nt, Mycobacterium bovis subsp bovis AF2122/97
ggcacugccgagca

SEQ ID NO: 3092817 - RNA, 18 nt, Mycobacterium bovis subsp bovis AF2122/97
ggcacugccggcacgccg

SEQ ID NO: 3092818 - RNA, 16 nt, Mycobacterium bovis subsp bovis AF2122/97
ggcacugcgaucgcga

SEQ ID NO: 3092819 - RNA, 14 nt, Mycobacterium bovis subsp bovis AF2122/97
ggcacugcggccag

SEQ ID NO: 3092820 - RNA, 15 nt, Mycobacterium bovis subsp bovis AF2122/97
ggcacugcggccagu

SEQ ID NO: 3092821 - RNA, 20 nt, Mycobacterium bovis subsp bovis AF2122/97
ggcacuggggucugauggcg

SEQ ID NO: 3092822 - RNA, 16 nt, Mycobacterium bovis subsp bovis AF2122/97
ggcacuggguccacgc

SEQ ID NO: 3092823 - RNA, 14 nt, Mycobacterium bovis subsp bovis AF2122/97
ggcacugguggcga

SEQ ID NO: 3092824 - RNA, 22 nt, Mycobacterium bovis subsp bovis AF2122/97
ggcacugugaggucauuggcga

SEQ ID NO: 3092825 - RNA, 18 nt, Mycobacterium bovis subsp bovis AF2122/97
ggcacugugcguccgcaa

SEQ ID NO: 3092826 - RNA, 19 nt, Mycobacterium bovis subsp bovis AF2122/97
ggcacugugcguccgcaac

SEQ ID NO: 3092827 - RNA, 23 nt, Mycobacterium bovis subsp bovis AF2122/97
ggcacuuaccgagccgucagcgu

SEQ ID NO: 3092828 - RNA, 19 nt, Mycobacterium bovis subsp bovis AF2122/97
ggcacuuagcccgauggug

SEQ ID NO: 3092829 - RNA, 17 nt, Mycobacterium bovis subsp bovis AF2122/97
ggcacuuccagcccggc

SEQ ID NO: 3092830 - RNA, 20 nt, Mycobacterium bovis subsp bovis AF2122/97
ggcacuuccagcccggcaau

SEQ ID NO: 3092831 - RNA, 21 nt, Mycobacterium bovis subsp bovis AF2122/97
ggcagaacuggacaagcuccu

SEQ ID NO: 3092832 - RNA, 12 nt, Mycobacterium bovis subsp bovis AF2122/97
ggcagacacgcu

SEQ ID NO: 3092833 - RNA, 13 nt, Mycobacterium bovis subsp bovis AF2122/97
ggcagacacgcug

SEQ ID NO: 3092834 - RNA, 18 nt, Mycobacterium bovis subsp bovis AF2122/97
ggcagacacgcugcaggc

SEQ ID NO: 3092835 - RNA, 22 nt, Mycobacterium bovis subsp bovis AF2122/97
ggcagacacgcugcaggcggcc

SEQ ID NO: 3092836 - RNA, 19 nt, Mycobacterium bovis subsp bovis AF2122/97
ggcagacaucugggugaac

SEQ ID NO: 3092837 - RNA, 15 nt, Mycobacterium bovis subsp bovis AF2122/97
ggcagaccaacgcuc

SEQ ID NO: 3092838 - RNA, 14 nt, Mycobacterium bovis subsp bovis AF2122/97
ggcagacccgagcg

SEQ ID NO: 3092839 - RNA, 20 nt, Mycobacterium bovis subsp bovis AF2122/97
ggcagaccgaucggcaggcc

SEQ ID NO: 3092840 - RNA, 13 nt, Mycobacterium bovis subsp bovis AF2122/97
ggcagaccggugc

SEQ ID NO: 3092841 - RNA, 18 nt, Mycobacterium bovis subsp bovis AF2122/97
ggcagagcacgcgcggcg

SEQ ID NO: 3092842 - RNA, 12 nt, Mycobacterium bovis subsp bovis AF2122/97
ggcagagccgcc

SEQ ID NO: 3092843 - RNA, 19 nt, Mycobacterium bovis subsp bovis AF2122/97
ggcagagccgccguugccg

SEQ ID NO: 3092844 - RNA, 16 nt, Mycobacterium bovis subsp bovis AF2122/97
ggcagaggcuggcgca

SEQ ID NO: 3092845 - RNA, 18 nt, Mycobacterium bovis subsp bovis AF2122/97
ggcagaggcuggcgcaga

SEQ ID NO: 3092846 - RNA, 22 nt, Mycobacterium bovis subsp bovis AF2122/97
ggcagauacucggcgacugcgu

SEQ ID NO: 3092847 - RNA, 14 nt, Mycobacterium bovis subsp bovis AF2122/97
ggcagaucgauacc

SEQ ID NO: 3092848 - RNA, 16 nt, Mycobacterium bovis subsp bovis AF2122/97
ggcagaucgauaccgu

SEQ ID NO: 3092849 - RNA, 14 nt, Mycobacterium bovis subsp bovis AF2122/97
ggcagauggucucg

SEQ ID NO: 3092850 - RNA, 20 nt, Mycobacterium bovis subsp bovis AF2122/97
ggcagauggugaaguugccg

SEQ ID NO: 3092851 - RNA, 17 nt, Mycobacterium bovis subsp bovis AF2122/97
ggcagauguguccggca

SEQ ID NO: 3092852 - RNA, 15 nt, Mycobacterium bovis subsp bovis AF2122/97
ggcagauucuucacc

SEQ ID NO: 3092853 - RNA, 21 nt, Mycobacterium bovis subsp bovis AF2122/97
ggcagauugacggaacgauag

SEQ ID NO: 3092854 - RNA, 19 nt, Mycobacterium bovis subsp bovis AF2122/97
ggcagcaaaaaccagcguc

SEQ ID NO: 3092855 - RNA, 21 nt, Mycobacterium bovis subsp bovis AF2122/97
ggcagcaaaaaccagcgucca

SEQ ID NO: 3092856 - RNA, 13 nt, Mycobacterium bovis subsp bovis AF2122/97
ggcagcaacaggc

SEQ ID NO: 3092857 - RNA, 15 nt, Mycobacterium bovis subsp bovis AF2122/97
ggcagcacaggcugg

SEQ ID NO: 3092858 - RNA, 12 nt, Mycobacterium bovis subsp bovis AF2122/97
ggcagcacccgc

SEQ ID NO: 3092859 - RNA, 19 nt, Mycobacterium bovis subsp bovis AF2122/97
ggcagcacccgcacggugu

SEQ ID NO: 3092860 - RNA, 21 nt, Mycobacterium bovis subsp bovis AF2122/97
ggcagcacccgcacgguguau

SEQ ID NO: 3092861 - RNA, 15 nt, Mycobacterium bovis subsp bovis AF2122/97
ggcagcacccgcgcc

SEQ ID NO: 3092862 - RNA, 17 nt, Mycobacterium bovis subsp bovis AF2122/97
ggcagcacgccagcccc

SEQ ID NO: 3092863 - RNA, 11 nt, Mycobacterium bovis subsp bovis AF2122/97
ggcagcacguc

SEQ ID NO: 3092864 - RNA, 22 nt, Mycobacterium bovis subsp bovis AF2122/97
ggcagcacgucacgcaaccggc

SEQ ID NO: 3092865 - RNA, 15 nt, Mycobacterium bovis subsp bovis AF2122/97
ggcagcacuuggacc

SEQ ID NO: 3092866 - RNA, 21 nt, Mycobacterium bovis subsp bovis AF2122/97
ggcagcacuuggacccggccg

SEQ ID NO: 3092867 - RNA, 15 nt, Mycobacterium bovis subsp bovis AF2122/97
ggcagcagccggcgg

SEQ ID NO: 3092868 - RNA, 21 nt, Mycobacterium bovis subsp bovis AF2122/97
ggcagcagcgcaacggccagc

SEQ ID NO: 3092869 - RNA, 22 nt, Mycobacterium bovis subsp bovis AF2122/97
ggcagcagcgcgcggguuaccc

SEQ ID NO: 3092870 - RNA, 21 nt, Mycobacterium bovis subsp bovis AF2122/97
ggcagcagcggugcagcccgc

SEQ ID NO: 3092871 - RNA, 23 nt, Mycobacterium bovis subsp bovis AF2122/97
ggcagcagcggugcagcccgccg

SEQ ID NO: 3092872 - RNA, 18 nt, Mycobacterium bovis subsp bovis AF2122/97
ggcagcaggacaccuacc

SEQ ID NO: 3092873 - RNA, 16 nt, Mycobacterium bovis subsp bovis AF2122/97
ggcagcaggcgaugcg

SEQ ID NO: 3092874 - RNA, 13 nt, Mycobacterium bovis subsp bovis AF2122/97
ggcagcauauccg

SEQ ID NO: 3092875 - RNA, 20 nt, Mycobacterium bovis subsp bovis AF2122/97
ggcagcauauccgccggcga

SEQ ID NO: 3092876 - RNA, 18 nt, Mycobacterium bovis subsp bovis AF2122/97
ggcagcaucaacaccggc

SEQ ID NO: 3092877 - RNA, 19 nt, Mycobacterium bovis subsp bovis AF2122/97
ggcagcaucaacaccggcu

SEQ ID NO: 3092878 - RNA, 16 nt, Mycobacterium bovis subsp bovis AF2122/97
ggcagcauccucgacu

SEQ ID NO: 3092879 - RNA, 17 nt, Mycobacterium bovis subsp bovis AF2122/97
ggcagcaucggcacccc

SEQ ID NO: 3092880 - RNA, 20 nt, Mycobacterium bovis subsp bovis AF2122/97
ggcagcaucggcaccccggc

SEQ ID NO: 3092881 - RNA, 16 nt, Mycobacterium bovis subsp bovis AF2122/97
ggcagcaucggucaca

SEQ ID NO: 3092882 - RNA, 13 nt, Mycobacterium bovis subsp bovis AF2122/97
ggcagcauggcca

SEQ ID NO: 3092883 - RNA, 12 nt, Mycobacterium bovis subsp bovis AF2122/97
ggcagccaccag

SEQ ID NO: 3092884 - RNA, 16 nt, Mycobacterium bovis subsp bovis AF2122/97
ggcagccaccagcgac

SEQ ID NO: 3092885 - RNA, 18 nt, Mycobacterium bovis subsp bovis AF2122/97
ggcagccaccagcgacga

SEQ ID NO: 3092886 - RNA, 22 nt, Mycobacterium bovis subsp bovis AF2122/97
ggcagccaccgucaugccgacg

SEQ ID NO: 3092887 - RNA, 21 nt, Mycobacterium bovis subsp bovis AF2122/97
ggcagccacggguagcugccg

SEQ ID NO: 3092888 - RNA, 22 nt, Mycobacterium bovis subsp bovis AF2122/97
ggcagccacggguagcugccgc

SEQ ID NO: 3092889 - RNA, 16 nt, Mycobacterium bovis subsp bovis AF2122/97
ggcagccagccaccgg

SEQ ID NO: 3092890 - RNA, 17 nt, Mycobacterium bovis subsp bovis AF2122/97
ggcagccagccaccggg

SEQ ID NO: 3092891 - RNA, 15 nt, Mycobacterium bovis subsp bovis AF2122/97
ggcagccagcggcga

SEQ ID NO: 3092892 - RNA, 20 nt, Mycobacterium bovis subsp bovis AF2122/97
ggcagcccaaagcgccagca

SEQ ID NO: 3092893 - RNA, 23 nt, Mycobacterium bovis subsp bovis AF2122/97
ggcagcccaaagcgccagcagcc

SEQ ID NO: 3092894 - RNA, 14 nt, Mycobacterium bovis subsp bovis AF2122/97
ggcagccccuccgc

SEQ ID NO: 3092895 - RNA, 16 nt, Mycobacterium bovis subsp bovis AF2122/97
ggcagccccuccgcgc

SEQ ID NO: 3092896 - RNA, 18 nt, Mycobacterium bovis subsp bovis AF2122/97
ggcagccccuccgcgccg

SEQ ID NO: 3092897 - RNA, 21 nt, Mycobacterium bovis subsp bovis AF2122/97
ggcagcccgcuggccuccugg

SEQ ID NO: 3092898 - RNA, 14 nt, Mycobacterium bovis subsp bovis AF2122/97
ggcagcccggcgau

SEQ ID NO: 3092899 - RNA, 14 nt, Mycobacterium bovis subsp bovis AF2122/97
ggcagcccggcggc

SEQ ID NO: 3092900 - RNA, 16 nt, Mycobacterium bovis subsp bovis AF2122/97
ggcagcccggcggccg

SEQ ID NO: 3092901 - RNA, 13 nt, Mycobacterium bovis subsp bovis AF2122/97
ggcagcccguucg

SEQ ID NO: 3092902 - RNA, 18 nt, Mycobacterium bovis subsp bovis AF2122/97
ggcagcccguucgugccg

SEQ ID NO: 3092903 - RNA, 14 nt, Mycobacterium bovis subsp bovis AF2122/97
ggcagccgaagcgc

SEQ ID NO: 3092904 - RNA, 19 nt, Mycobacterium bovis subsp bovis AF2122/97
ggcagccgaagcgcccguu

SEQ ID NO: 3092905 - RNA, 19 nt, Mycobacterium bovis subsp bovis AF2122/97
ggcagccgcauaggccccg

SEQ ID NO: 3092906 - RNA, 24 nt, Mycobacterium bovis subsp bovis AF2122/97
ggcagccgcauaggccccgccagc

SEQ ID NO: 3092907 - RNA, 16 nt, Mycobacterium bovis subsp bovis AF2122/97
ggcagccgcccgccca

SEQ ID NO: 3092908 - RNA, 19 nt, Mycobacterium bovis subsp bovis AF2122/97
ggcagccgcccgcccaccu

SEQ ID NO: 3092909 - RNA, 14 nt, Mycobacterium bovis subsp bovis AF2122/97
ggcagccgcgccgc

SEQ ID NO: 3092910 - RNA, 16 nt, Mycobacterium bovis subsp bovis AF2122/97
ggcagccgcgccgcgg

SEQ ID NO: 3092911 - RNA, 21 nt, Mycobacterium bovis subsp bovis AF2122/97
ggcagccggcggagaaggcga

SEQ ID NO: 3092912 - RNA, 17 nt, Mycobacterium bovis subsp bovis AF2122/97
ggcagccgggcggcagc

SEQ ID NO: 3092913 - RNA, 19 nt, Mycobacterium bovis subsp bovis AF2122/97
ggcagccggguugguaccc

SEQ ID NO: 3092914 - RNA, 16 nt, Mycobacterium bovis subsp bovis AF2122/97
ggcagccugcugcaca

SEQ ID NO: 3092915 - RNA, 20 nt, Mycobacterium bovis subsp bovis AF2122/97
ggcagccugcugcacaucgc

SEQ ID NO: 3092916 - RNA, 18 nt, Mycobacterium bovis subsp bovis AF2122/97
ggcagcgaccgucgucca

SEQ ID NO: 3092917 - RNA, 23 nt, Mycobacterium bovis subsp bovis AF2122/97
ggcagcgacgccggcccgacggg

SEQ ID NO: 3092918 - RNA, 19 nt, Mycobacterium bovis subsp bovis AF2122/97
ggcagcgagacuucgacgc

SEQ ID NO: 3092919 - RNA, 15 nt, Mycobacterium bovis subsp bovis AF2122/97
ggcagcgaggcucgc

SEQ ID NO: 3092920 - RNA, 20 nt, Mycobacterium bovis subsp bovis AF2122/97
ggcagcgaugcggugucggg

SEQ ID NO: 3092921 - RNA, 14 nt, Mycobacterium bovis subsp bovis AF2122/97
ggcagcgcacccgg

SEQ ID NO: 3092922 - RNA, 21 nt, Mycobacterium bovis subsp bovis AF2122/97
ggcagcgcacccggucggcgg

SEQ ID NO: 3092923 - RNA, 22 nt, Mycobacterium bovis subsp bovis AF2122/97
ggcagcgcacccggucggcggc

SEQ ID NO: 3092924 - RNA, 16 nt, Mycobacterium bovis subsp bovis AF2122/97
ggcagcgccaggccgu

SEQ ID NO: 3092925 - RNA, 19 nt, Mycobacterium bovis subsp bovis AF2122/97
ggcagcgcccagaucgccg

SEQ ID NO: 3092926 - RNA, 15 nt, Mycobacterium bovis subsp bovis AF2122/97
ggcagcgccggucgg

SEQ ID NO: 3092927 - RNA, 13 nt, Mycobacterium bovis subsp bovis AF2122/97
ggcagcgcgauca

SEQ ID NO: 3092928 - RNA, 14 nt, Mycobacterium bovis subsp bovis AF2122/97
ggcagcgcgaucga

SEQ ID NO: 3092929 - RNA, 15 nt, Mycobacterium bovis subsp bovis AF2122/97
ggcagcgcgcccgac

SEQ ID NO: 3092930 - RNA, 12 nt, Mycobacterium bovis subsp bovis AF2122/97
ggcagcgcggca

SEQ ID NO: 3092931 - RNA, 14 nt, Mycobacterium bovis subsp bovis AF2122/97
ggcagcgcggcacc

SEQ ID NO: 3092932 - RNA, 13 nt, Mycobacterium bovis subsp bovis AF2122/97
ggcagcgcggcca

SEQ ID NO: 3092933 - RNA, 15 nt, Mycobacterium bovis subsp bovis AF2122/97
ggcagcgcggccaau

SEQ ID NO: 3092934 - RNA, 18 nt, Mycobacterium bovis subsp bovis AF2122/97
ggcagcgcggccacccgc

SEQ ID NO: 3092935 - RNA, 17 nt, Mycobacterium bovis subsp bovis AF2122/97
ggcagcgcggccgggcg

SEQ ID NO: 3092936 - RNA, 12 nt, Mycobacterium bovis subsp bovis AF2122/97
ggcagcgcuggc

SEQ ID NO: 3092937 - RNA, 20 nt, Mycobacterium bovis subsp bovis AF2122/97
ggcagcggaccgcugccugc

SEQ ID NO: 3092938 - RNA, 21 nt, Mycobacterium bovis subsp bovis AF2122/97
ggcagcggcaucggccagccg

SEQ ID NO: 3092939 - RNA, 13 nt, Mycobacterium bovis subsp bovis AF2122/97
ggcagcggcgagu

SEQ ID NO: 3092940 - RNA, 12 nt, Mycobacterium bovis subsp bovis AF2122/97
ggcagcggcgau

SEQ ID NO: 3092941 - RNA, 13 nt, Mycobacterium bovis subsp bovis AF2122/97
ggcagcggcgauc

SEQ ID NO: 3092942 - RNA, 21 nt, Mycobacterium bovis subsp bovis AF2122/97
ggcagcggcgaucaggcggac

SEQ ID NO: 3092943 - RNA, 20 nt, Mycobacterium bovis subsp bovis AF2122/97
ggcagcggcgcgcugcacgg

SEQ ID NO: 3092944 - RNA, 13 nt, Mycobacterium bovis subsp bovis AF2122/97
ggcagcggcgcgg

SEQ ID NO: 3092945 - RNA, 16 nt, Mycobacterium bovis subsp bovis AF2122/97
ggcagcggcgcgguuu

SEQ ID NO: 3092946 - RNA, 21 nt, Mycobacterium bovis subsp bovis AF2122/97
ggcagcggcgguaugcucgcu

SEQ ID NO: 3092947 - RNA, 22 nt, Mycobacterium bovis subsp bovis AF2122/97
ggcagcggcggucucggcgucg

SEQ ID NO: 3092948 - RNA, 17 nt, Mycobacterium bovis subsp bovis AF2122/97
ggcagcggcgucgucgu

SEQ ID NO: 3092949 - RNA, 15 nt, Mycobacterium bovis subsp bovis AF2122/97
ggcagcgggccgccc

SEQ ID NO: 3092950 - RNA, 16 nt, Mycobacterium bovis subsp bovis AF2122/97
ggcagcgggcuccccg

SEQ ID NO: 3092951 - RNA, 16 nt, Mycobacterium bovis subsp bovis AF2122/97
ggcagcgguggcuugc

SEQ ID NO: 3092952 - RNA, 20 nt, Mycobacterium bovis subsp bovis AF2122/97
ggcagcgguguagccggcgc

SEQ ID NO: 3092953 - RNA, 21 nt, Mycobacterium bovis subsp bovis AF2122/97
ggcagcgguguagccggcgcc

SEQ ID NO: 3092954 - RNA, 22 nt, Mycobacterium bovis subsp bovis AF2122/97
ggcagcgguguagccggcgccg

SEQ ID NO: 3092955 - RNA, 22 nt, Mycobacterium bovis subsp bovis AF2122/97
ggcagcgguuuuaggcagccca

SEQ ID NO: 3092956 - RNA, 18 nt, Mycobacterium bovis subsp bovis AF2122/97
ggcagcguagugcugcgc

SEQ ID NO: 3092957 - RNA, 15 nt, Mycobacterium bovis subsp bovis AF2122/97
ggcagcguccgaacc

SEQ ID NO: 3092958 - RNA, 14 nt, Mycobacterium bovis subsp bovis AF2122/97
ggcagcgucgucga

SEQ ID NO: 3092959 - RNA, 14 nt, Mycobacterium bovis subsp bovis AF2122/97
ggcagcguguaacc

SEQ ID NO: 3092960 - RNA, 13 nt, Mycobacterium bovis subsp bovis AF2122/97
ggcagcuccacca

SEQ ID NO: 3092961 - RNA, 18 nt, Mycobacterium bovis subsp bovis AF2122/97
ggcagcuccaccaggacg

SEQ ID NO: 3092962 - RNA, 15 nt, Mycobacterium bovis subsp bovis AF2122/97
ggcagcuccagcaaa

SEQ ID NO: 3092963 - RNA, 21 nt, Mycobacterium bovis subsp bovis AF2122/97
ggcagcucccgccacgucgcc

SEQ ID NO: 3092964 - RNA, 14 nt, Mycobacterium bovis subsp bovis AF2122/97
ggcagcuccgccgc

SEQ ID NO: 3092965 - RNA, 15 nt, Mycobacterium bovis subsp bovis AF2122/97
ggcagcuccgccgcc

SEQ ID NO: 3092966 - RNA, 14 nt, Mycobacterium bovis subsp bovis AF2122/97
ggcagcugggcagg

SEQ ID NO: 3092967 - RNA, 15 nt, Mycobacterium bovis subsp bovis AF2122/97
ggcagcuucaacacc

SEQ ID NO: 3092968 - RNA, 17 nt, Mycobacterium bovis subsp bovis AF2122/97
ggcagcuucaacaccgg

SEQ ID NO: 3092969 - RNA, 18 nt, Mycobacterium bovis subsp bovis AF2122/97
ggcagcuucaacaccggc

SEQ ID NO: 3092970 - RNA, 20 nt, Mycobacterium bovis subsp bovis AF2122/97
ggcagcuucaacaccggcau

SEQ ID NO: 3092971 - RNA, 21 nt, Mycobacterium bovis subsp bovis AF2122/97
ggcagcuucaacaccggcauc

SEQ ID NO: 3092972 - RNA, 15 nt, Mycobacterium bovis subsp bovis AF2122/97
ggcagcuucucgccg

SEQ ID NO: 3092973 - RNA, 18 nt, Mycobacterium bovis subsp bovis AF2122/97
ggcagcuucucgccgacg

SEQ ID NO: 3092974 - RNA, 16 nt, Mycobacterium bovis subsp bovis AF2122/97
ggcagcuuggacucau

SEQ ID NO: 3092975 - RNA, 21 nt, Mycobacterium bovis subsp bovis AF2122/97
ggcagcuuugacgcccucggc

SEQ ID NO: 3092976 - RNA, 23 nt, Mycobacterium bovis subsp bovis AF2122/97
ggcagcuuugacgcccucggcga

SEQ ID NO: 3092977 - RNA, 17 nt, Mycobacterium bovis subsp bovis AF2122/97
ggcaggaaugccgcggg

SEQ ID NO: 3092978 - RNA, 12 nt, Mycobacterium bovis subsp bovis AF2122/97
ggcaggacuugg

SEQ ID NO: 3092979 - RNA, 16 nt, Mycobacterium bovis subsp bovis AF2122/97
ggcaggagcagcacgu

SEQ ID NO: 3092980 - RNA, 13 nt, Mycobacterium bovis subsp bovis AF2122/97
ggcaggaucgccu

SEQ ID NO: 3092981 - RNA, 20 nt, Mycobacterium bovis subsp bovis AF2122/97
ggcaggaucgccugagcgcc

SEQ ID NO: 3092982 - RNA, 22 nt, Mycobacterium bovis subsp bovis AF2122/97
ggcaggaucuccgggucgaugu

SEQ ID NO: 3092983 - RNA, 21 nt, Mycobacterium bovis subsp bovis AF2122/97
ggcaggcagcucggcaacgug

SEQ ID NO: 3092984 - RNA, 14 nt, Mycobacterium bovis subsp bovis AF2122/97
ggcaggcagggcag

SEQ ID NO: 3092985 - RNA, 14 nt, Mycobacterium bovis subsp bovis AF2122/97
ggcaggcagguugg

SEQ ID NO: 3092986 - RNA, 13 nt, Mycobacterium bovis subsp bovis AF2122/97
ggcaggcauggcg

SEQ ID NO: 3092987 - RNA, 22 nt, Mycobacterium bovis subsp bovis AF2122/97
ggcaggcauggcgccguugccg

SEQ ID NO: 3092988 - RNA, 14 nt, Mycobacterium bovis subsp bovis AF2122/97
ggcaggccagcaug

SEQ ID NO: 3092989 - RNA, 17 nt, Mycobacterium bovis subsp bovis AF2122/97
ggcaggccauccgggcu

SEQ ID NO: 3092990 - RNA, 18 nt, Mycobacterium bovis subsp bovis AF2122/97
ggcaggccccacuggugc

SEQ ID NO: 3092991 - RNA, 16 nt, Mycobacterium bovis subsp bovis AF2122/97
ggcaggcccgacggcg

SEQ ID NO: 3092992 - RNA, 19 nt, Mycobacterium bovis subsp bovis AF2122/97
ggcaggcccgacggcgccc

SEQ ID NO: 3092993 - RNA, 14 nt, Mycobacterium bovis subsp bovis AF2122/97
ggcaggccgcuggg

SEQ ID NO: 3092994 - RNA, 15 nt, Mycobacterium bovis subsp bovis AF2122/97
ggcaggccgcugggc

SEQ ID NO: 3092995 - RNA, 21 nt, Mycobacterium bovis subsp bovis AF2122/97
ggcaggccgcugggccgaccg

SEQ ID NO: 3092996 - RNA, 14 nt, Mycobacterium bovis subsp bovis AF2122/97
ggcaggccggccac

SEQ ID NO: 3092997 - RNA, 19 nt, Mycobacterium bovis subsp bovis AF2122/97
ggcaggccggcgucgauca

SEQ ID NO: 3092998 - RNA, 12 nt, Mycobacterium bovis subsp bovis AF2122/97
ggcaggccggcu

SEQ ID NO: 3092999 - RNA, 16 nt, Mycobacterium bovis subsp bovis AF2122/97
ggcaggccggcucgcc

SEQ ID NO: 3093000 - RNA, 23 nt, Mycobacterium bovis subsp bovis AF2122/97
ggcaggccggcucgccgacccgc

SEQ ID NO: 3093001 - RNA, 13 nt, Mycobacterium bovis subsp bovis AF2122/97
ggcaggccgggca

SEQ ID NO: 3093002 - RNA, 15 nt, Mycobacterium bovis subsp bovis AF2122/97
ggcaggccgggcacc

SEQ ID NO: 3093003 - RNA, 17 nt, Mycobacterium bovis subsp bovis AF2122/97
ggcaggccucggcgccg

SEQ ID NO: 3093004 - RNA, 20 nt, Mycobacterium bovis subsp bovis AF2122/97
ggcaggccucggcgccgccc

SEQ ID NO: 3093005 - RNA, 18 nt, Mycobacterium bovis subsp bovis AF2122/97
ggcaggccuggcgagcca

SEQ ID NO: 3093006 - RNA, 13 nt, Mycobacterium bovis subsp bovis AF2122/97
ggcaggcgaaggc

SEQ ID NO: 3093007 - RNA, 14 nt, Mycobacterium bovis subsp bovis AF2122/97
ggcaggcgaaggcg

SEQ ID NO: 3093008 - RNA, 16 nt, Mycobacterium bovis subsp bovis AF2122/97
ggcaggcgaaggcggc

SEQ ID NO: 3093009 - RNA, 18 nt, Mycobacterium bovis subsp bovis AF2122/97
ggcaggcgaaggcggcuu

SEQ ID NO: 3093010 - RNA, 14 nt, Mycobacterium bovis subsp bovis AF2122/97
ggcaggcggccagc

SEQ ID NO: 3093011 - RNA, 15 nt, Mycobacterium bovis subsp bovis AF2122/97
ggcaggcggccagcg

SEQ ID NO: 3093012 - RNA, 15 nt, Mycobacterium bovis subsp bovis AF2122/97
ggcaggcggccgccg

SEQ ID NO: 3093013 - RNA, 18 nt, Mycobacterium bovis subsp bovis AF2122/97
ggcaggcgggggaucggu

SEQ ID NO: 3093014 - RNA, 17 nt, Mycobacterium bovis subsp bovis AF2122/97
ggcaggcggugaacacc

SEQ ID NO: 3093015 - RNA, 14 nt, Mycobacterium bovis subsp bovis AF2122/97
ggcaggcucgggca

SEQ ID NO: 3093016 - RNA, 13 nt, Mycobacterium bovis subsp bovis AF2122/97
ggcaggcuggcga

SEQ ID NO: 3093017 - RNA, 14 nt, Mycobacterium bovis subsp bovis AF2122/97
ggcagggcagcccg

SEQ ID NO: 3093018 - RNA, 13 nt, Mycobacterium bovis subsp bovis AF2122/97
ggcagggccagcg

SEQ ID NO: 3093019 - RNA, 14 nt, Mycobacterium bovis subsp bovis AF2122/97
ggcagggccagcgg

SEQ ID NO: 3093020 - RNA, 18 nt, Mycobacterium bovis subsp bovis AF2122/97
ggcagggccagcggcagc

SEQ ID NO: 3093021 - RNA, 17 nt, Mycobacterium bovis subsp bovis AF2122/97
ggcaggguggccagcag

SEQ ID NO: 3093022 - RNA, 18 nt, Mycobacterium bovis subsp bovis AF2122/97
ggcaggguggccagcagg

SEQ ID NO: 3093023 - RNA, 17 nt, Mycobacterium bovis subsp bovis AF2122/97
ggcaggucgaugcugcc

SEQ ID NO: 3093024 - RNA, 15 nt, Mycobacterium bovis subsp bovis AF2122/97
ggcaggugaucccga

SEQ ID NO: 3093025 - RNA, 14 nt, Mycobacterium bovis subsp bovis AF2122/97
ggcaggugcggcgg

SEQ ID NO: 3093026 - RNA, 22 nt, Mycobacterium bovis subsp bovis AF2122/97
ggcagguguuggugcgggguug

SEQ ID NO: 3093027 - RNA, 20 nt, Mycobacterium bovis subsp bovis AF2122/97
ggcagguuggccaccgccca

SEQ ID NO: 3093028 - RNA, 16 nt, Mycobacterium bovis subsp bovis AF2122/97
ggcaguacaccggcgu

SEQ ID NO: 3093029 - RNA, 22 nt, Mycobacterium bovis subsp bovis AF2122/97
ggcaguagcuguggcccgcggu

SEQ ID NO: 3093030 - RNA, 19 nt, Mycobacterium bovis subsp bovis AF2122/97
ggcaguagugaucgaucgc

SEQ ID NO: 3093031 - RNA, 20 nt, Mycobacterium bovis subsp bovis AF2122/97
ggcaguaucaucggcgcugg

SEQ ID NO: 3093032 - RNA, 17 nt, Mycobacterium bovis subsp bovis AF2122/97
ggcagucaggccuagcg

SEQ ID NO: 3093033 - RNA, 14 nt, Mycobacterium bovis subsp bovis AF2122/97
ggcaguccaccgcg

SEQ ID NO: 3093034 - RNA, 19 nt, Mycobacterium bovis subsp bovis AF2122/97
ggcaguccaccgcgcggcg

SEQ ID NO: 3093035 - RNA, 15 nt, Mycobacterium bovis subsp bovis AF2122/97
ggcaguccagccggg

SEQ ID NO: 3093036 - RNA, 15 nt, Mycobacterium bovis subsp bovis AF2122/97
ggcagucccagcgcc

SEQ ID NO: 3093037 - RNA, 16 nt, Mycobacterium bovis subsp bovis AF2122/97
ggcagucccagcgccg

SEQ ID NO: 3093038 - RNA, 23 nt, Mycobacterium bovis subsp bovis AF2122/97
ggcagucgcgguaccaucaccgc

SEQ ID NO: 3093039 - RNA, 19 nt, Mycobacterium bovis subsp bovis AF2122/97
ggcagugaaauugccgccg

SEQ ID NO: 3093040 - RNA, 23 nt, Mycobacterium bovis subsp bovis AF2122/97
ggcagugaaauugccgccgccgg

SEQ ID NO: 3093041 - RNA, 23 nt, Mycobacterium bovis subsp bovis AF2122/97
ggcagugagggucccacggcggu

SEQ ID NO: 3093042 - RNA, 12 nt, Mycobacterium bovis subsp bovis AF2122/97
ggcagugcgcgg

SEQ ID NO: 3093043 - RNA, 14 nt, Mycobacterium bovis subsp bovis AF2122/97
ggcagugcgcggcg

SEQ ID NO: 3093044 - RNA, 21 nt, Mycobacterium bovis subsp bovis AF2122/97
ggcagugcgcggcgucgucga

SEQ ID NO: 3093045 - RNA, 20 nt, Mycobacterium bovis subsp bovis AF2122/97
ggcagugguuacagaugaag

SEQ ID NO: 3093046 - RNA, 17 nt, Mycobacterium bovis subsp bovis AF2122/97
ggcaguucgcggccauc

SEQ ID NO: 3093047 - RNA, 18 nt, Mycobacterium bovis subsp bovis AF2122/97
ggcaguugaacucgacca

SEQ ID NO: 3093048 - RNA, 20 nt, Mycobacterium bovis subsp bovis AF2122/97
ggcaguugaacucgaccacc

SEQ ID NO: 3093049 - RNA, 18 nt, Mycobacterium bovis subsp bovis AF2122/97
ggcaguuguugacagaca

SEQ ID NO: 3093050 - RNA, 14 nt, Mycobacterium bovis subsp bovis AF2122/97
ggcaguuuggcggc

SEQ ID NO: 3093051 - RNA, 16 nt, Mycobacterium bovis subsp bovis AF2122/97
ggcaguuuggcggcag

SEQ ID NO: 3093052 - RNA, 17 nt, Mycobacterium bovis subsp bovis AF2122/97
ggcaguuuggcggcagg

SEQ ID NO: 3093053 - RNA, 19 nt, Mycobacterium bovis subsp bovis AF2122/97
ggcauaaacaucgguggcg

SEQ ID NO: 3093054 - RNA, 20 nt, Mycobacterium bovis subsp bovis AF2122/97
ggcauaacccgcaccggggu

SEQ ID NO: 3093055 - RNA, 14 nt, Mycobacterium bovis subsp bovis AF2122/97
ggcauacaacuggu

SEQ ID NO: 3093056 - RNA, 13 nt, Mycobacterium bovis subsp bovis AF2122/97
ggcauacauccag

SEQ ID NO: 3093057 - RNA, 16 nt, Mycobacterium bovis subsp bovis AF2122/97
ggcauacauccaggcu

SEQ ID NO: 3093058 - RNA, 13 nt, Mycobacterium bovis subsp bovis AF2122/97
ggcauacccauca

SEQ ID NO: 3093059 - RNA, 17 nt, Mycobacterium bovis subsp bovis AF2122/97
ggcauacccaucaacau

SEQ ID NO: 3093060 - RNA, 22 nt, Mycobacterium bovis subsp bovis AF2122/97
ggcauagaucgggucguuggcg

SEQ ID NO: 3093061 - RNA, 16 nt, Mycobacterium bovis subsp bovis AF2122/97
ggcauagcagccagcg

SEQ ID NO: 3093062 - RNA, 19 nt, Mycobacterium bovis subsp bovis AF2122/97
ggcauagcucagaccggcg

SEQ ID NO: 3093063 - RNA, 20 nt, Mycobacterium bovis subsp bovis AF2122/97
ggcauagcucagaccggcgc

SEQ ID NO: 3093064 - RNA, 19 nt, Mycobacterium bovis subsp bovis AF2122/97
ggcauaggaucgcgcccac

SEQ ID NO: 3093065 - RNA, 22 nt, Mycobacterium bovis subsp bovis AF2122/97
ggcauaggaucgcgcccaccga

SEQ ID NO: 3093066 - RNA, 22 nt, Mycobacterium bovis subsp bovis AF2122/97
ggcaucaagaaacguggugacg

SEQ ID NO: 3093067 - RNA, 15 nt, Mycobacterium bovis subsp bovis AF2122/97
ggcaucaccgacgcg

SEQ ID NO: 3093068 - RNA, 14 nt, Mycobacterium bovis subsp bovis AF2122/97
ggcaucaccgccgc

SEQ ID NO: 3093069 - RNA, 15 nt, Mycobacterium bovis subsp bovis AF2122/97
ggcaucaccgccgcg

SEQ ID NO: 3093070 - RNA, 19 nt, Mycobacterium bovis subsp bovis AF2122/97
ggcaucaccgccgcggccg

SEQ ID NO: 3093071 - RNA, 19 nt, Mycobacterium bovis subsp bovis AF2122/97
ggcaucaccuggcgugucg

SEQ ID NO: 3093072 - RNA, 23 nt, Mycobacterium bovis subsp bovis AF2122/97
ggcaucaccuggcgugucgccgc

SEQ ID NO: 3093073 - RNA, 14 nt, Mycobacterium bovis subsp bovis AF2122/97
ggcaucagcagagc

SEQ ID NO: 3093074 - RNA, 18 nt, Mycobacterium bovis subsp bovis AF2122/97
ggcaucagcagagccccg

SEQ ID NO: 3093075 - RNA, 16 nt, Mycobacterium bovis subsp bovis AF2122/97
ggcaucaucagcggcg

SEQ ID NO: 3093076 - RNA, 18 nt, Mycobacterium bovis subsp bovis AF2122/97
ggcaucaucagcggcgcc

SEQ ID NO: 3093077 - RNA, 18 nt, Mycobacterium bovis subsp bovis AF2122/97
ggcaucaucgcugugcgc

SEQ ID NO: 3093078 - RNA, 21 nt, Mycobacterium bovis subsp bovis AF2122/97
ggcaucaucgcugugcgcugg

SEQ ID NO: 3093079 - RNA, 17 nt, Mycobacterium bovis subsp bovis AF2122/97
ggcauccaacgcggcgc

SEQ ID NO: 3093080 - RNA, 15 nt, Mycobacterium bovis subsp bovis AF2122/97
ggcauccagcuucgc

SEQ ID NO: 3093081 - RNA, 17 nt, Mycobacterium bovis subsp bovis AF2122/97
ggcauccaggcugucgc

SEQ ID NO: 3093082 - RNA, 20 nt, Mycobacterium bovis subsp bovis AF2122/97
ggcauccccaguugugcggc

SEQ ID NO: 3093083 - RNA, 18 nt, Mycobacterium bovis subsp bovis AF2122/97
ggcauccgagcgggaacg

SEQ ID NO: 3093084 - RNA, 14 nt, Mycobacterium bovis subsp bovis AF2122/97
ggcauccgccccgc

SEQ ID NO: 3093085 - RNA, 22 nt, Mycobacterium bovis subsp bovis AF2122/97
ggcauccucugaaccagcugag

SEQ ID NO: 3093086 - RNA, 13 nt, Mycobacterium bovis subsp bovis AF2122/97
ggcauccugcacg

SEQ ID NO: 3093087 - RNA, 17 nt, Mycobacterium bovis subsp bovis AF2122/97
ggcauccuucaccagcu

SEQ ID NO: 3093088 - RNA, 20 nt, Mycobacterium bovis subsp bovis AF2122/97
ggcaucgaauuccagccagc

SEQ ID NO: 3093089 - RNA, 13 nt, Mycobacterium bovis subsp bovis AF2122/97
ggcaucgacgcgg

SEQ ID NO: 3093090 - RNA, 14 nt, Mycobacterium bovis subsp bovis AF2122/97
ggcaucgacugcca

SEQ ID NO: 3093091 - RNA, 16 nt, Mycobacterium bovis subsp bovis AF2122/97
ggcaucgacugccagc

SEQ ID NO: 3093092 - RNA, 17 nt, Mycobacterium bovis subsp bovis AF2122/97
ggcaucgacugccagcg

SEQ ID NO: 3093093 - RNA, 16 nt, Mycobacterium bovis subsp bovis AF2122/97
ggcaucgagacgagcc

SEQ ID NO: 3093094 - RNA, 18 nt, Mycobacterium bovis subsp bovis AF2122/97
ggcaucgagacgagccac

SEQ ID NO: 3093095 - RNA, 15 nt, Mycobacterium bovis subsp bovis AF2122/97
ggcaucgaguucggc

SEQ ID NO: 3093096 - RNA, 20 nt, Mycobacterium bovis subsp bovis AF2122/97
ggcaucgauaauggccgagu

SEQ ID NO: 3093097 - RNA, 14 nt, Mycobacterium bovis subsp bovis AF2122/97
ggcaucgaucaaca

SEQ ID NO: 3093098 - RNA, 12 nt, Mycobacterium bovis subsp bovis AF2122/97
ggcaucgccgcg

SEQ ID NO: 3093099 - RNA, 19 nt, Mycobacterium bovis subsp bovis AF2122/97
ggcaucgccgcgggugauc

SEQ ID NO: 3093100 - RNA, 23 nt, Mycobacterium bovis subsp bovis AF2122/97
ggcaucgcgaauauagcggcguu

SEQ ID NO: 3093101 - RNA, 17 nt, Mycobacterium bovis subsp bovis AF2122/97
ggcaucgcgcgcggcuc

SEQ ID NO: 3093102 - RNA, 21 nt, Mycobacterium bovis subsp bovis AF2122/97
ggcaucgcgcgcggcuccguu

SEQ ID NO: 3093103 - RNA, 21 nt, Mycobacterium bovis subsp bovis AF2122/97
ggcaucgcggaagcgggcgau

SEQ ID NO: 3093104 - RNA, 14 nt, Mycobacterium bovis subsp bovis AF2122/97
ggcaucgcgggcgg

SEQ ID NO: 3093105 - RNA, 23 nt, Mycobacterium bovis subsp bovis AF2122/97
ggcaucggaggaaccccgcgcgg

SEQ ID NO: 3093106 - RNA, 14 nt, Mycobacterium bovis subsp bovis AF2122/97
ggcaucggccagcc

SEQ ID NO: 3093107 - RNA, 13 nt, Mycobacterium bovis subsp bovis AF2122/97
ggcaucggcggca

SEQ ID NO: 3093108 - RNA, 14 nt, Mycobacterium bovis subsp bovis AF2122/97
ggcaucggcggcaa

SEQ ID NO: 3093109 - RNA, 20 nt, Mycobacterium bovis subsp bovis AF2122/97
ggcaucggcggcaagggugg

SEQ ID NO: 3093110 - RNA, 15 nt, Mycobacterium bovis subsp bovis AF2122/97
ggcaucggcggcguc

SEQ ID NO: 3093111 - RNA, 16 nt, Mycobacterium bovis subsp bovis AF2122/97
ggcaucggucaccgcg

SEQ ID NO: 3093112 - RNA, 22 nt, Mycobacterium bovis subsp bovis AF2122/97
ggcaucggucagcgcggcaagc

SEQ ID NO: 3093113 - RNA, 22 nt, Mycobacterium bovis subsp bovis AF2122/97
ggcaucggugaucaaaccggcg

SEQ ID NO: 3093114 - RNA, 23 nt, Mycobacterium bovis subsp bovis AF2122/97
ggcaucggugaucaaaccggcgg

SEQ ID NO: 3093115 - RNA, 21 nt, Mycobacterium bovis subsp bovis AF2122/97
ggcaucggugccacggcaccg

SEQ ID NO: 3093116 - RNA, 12 nt, Mycobacterium bovis subsp bovis AF2122/97
ggcaucguccac

SEQ ID NO: 3093117 - RNA, 14 nt, Mycobacterium bovis subsp bovis AF2122/97
ggcaucguccacgc

SEQ ID NO: 3093118 - RNA, 14 nt, Mycobacterium bovis subsp bovis AF2122/97
ggcaucgucgacgc

SEQ ID NO: 3093119 - RNA, 14 nt, Mycobacterium bovis subsp bovis AF2122/97
ggcaucgucgccga

SEQ ID NO: 3093120 - RNA, 15 nt, Mycobacterium bovis subsp bovis AF2122/97
ggcaucgucgccgag

SEQ ID NO: 3093121 - RNA, 18 nt, Mycobacterium bovis subsp bovis AF2122/97
ggcaucgucgccgagcgg

SEQ ID NO: 3093122 - RNA, 20 nt, Mycobacterium bovis subsp bovis AF2122/97
ggcaucgucgucgcugccgc

SEQ ID NO: 3093123 - RNA, 20 nt, Mycobacterium bovis subsp bovis AF2122/97
ggcaucuccaccgucgccgc

SEQ ID NO: 3093124 - RNA, 15 nt, Mycobacterium bovis subsp bovis AF2122/97
ggcaucucgcaccgc

SEQ ID NO: 3093125 - RNA, 20 nt, Mycobacterium bovis subsp bovis AF2122/97
ggcaucucgcaccgcgccgu

SEQ ID NO: 3093126 - RNA, 22 nt, Mycobacterium bovis subsp bovis AF2122/97
ggcaucucgcaccgcgccgugg

SEQ ID NO: 3093127 - RNA, 21 nt, Mycobacterium bovis subsp bovis AF2122/97
ggcaucucggcuacgccucgg

SEQ ID NO: 3093128 - RNA, 21 nt, Mycobacterium bovis subsp bovis AF2122/97
ggcaugaagcaguuggccgag

SEQ ID NO: 3093129 - RNA, 15 nt, Mycobacterium bovis subsp bovis AF2122/97
ggcaugacauacagc

SEQ ID NO: 3093130 - RNA, 19 nt, Mycobacterium bovis subsp bovis AF2122/97
ggcaugacauacagcgggc

SEQ ID NO: 3093131 - RNA, 16 nt, Mycobacterium bovis subsp bovis AF2122/97
ggcaugacgaauuggu

SEQ ID NO: 3093132 - RNA, 22 nt, Mycobacterium bovis subsp bovis AF2122/97
ggcaugauuuuucgcagugacg

SEQ ID NO: 3093133 - RNA, 18 nt, Mycobacterium bovis subsp bovis AF2122/97
ggcaugcaaugcuggcgg

SEQ ID NO: 3093134 - RNA, 21 nt, Mycobacterium bovis subsp bovis AF2122/97
ggcaugcaaugcuggcggcgc

SEQ ID NO: 3093135 - RNA, 14 nt, Mycobacterium bovis subsp bovis AF2122/97
ggcaugccacacac

SEQ ID NO: 3093136 - RNA, 19 nt, Mycobacterium bovis subsp bovis AF2122/97
ggcaugccagccacgaacu

SEQ ID NO: 3093137 - RNA, 22 nt, Mycobacterium bovis subsp bovis AF2122/97
ggcaugcccgcggugaccaccc

SEQ ID NO: 3093138 - RNA, 14 nt, Mycobacterium bovis subsp bovis AF2122/97
ggcaugccgcccgc

SEQ ID NO: 3093139 - RNA, 13 nt, Mycobacterium bovis subsp bovis AF2122/97
ggcaugccggcga

SEQ ID NO: 3093140 - RNA, 13 nt, Mycobacterium bovis subsp bovis AF2122/97
ggcaugccggcgu

SEQ ID NO: 3093141 - RNA, 20 nt, Mycobacterium bovis subsp bovis AF2122/97
ggcaugccggcgugcggcga

SEQ ID NO: 3093142 - RNA, 14 nt, Mycobacterium bovis subsp bovis AF2122/97
ggcaugccggucuu

SEQ ID NO: 3093143 - RNA, 16 nt, Mycobacterium bovis subsp bovis AF2122/97
ggcaugcggaucggcg

SEQ ID NO: 3093144 - RNA, 17 nt, Mycobacterium bovis subsp bovis AF2122/97
ggcaugcggaucggcgg

SEQ ID NO: 3093145 - RNA, 15 nt, Mycobacterium bovis subsp bovis AF2122/97
ggcaugcggauucgc

SEQ ID NO: 3093146 - RNA, 17 nt, Mycobacterium bovis subsp bovis AF2122/97
ggcaugcgugccggcag

SEQ ID NO: 3093147 - RNA, 12 nt, Mycobacterium bovis subsp bovis AF2122/97
ggcaugcucugg

SEQ ID NO: 3093148 - RNA, 16 nt, Mycobacterium bovis subsp bovis AF2122/97
ggcaugcucuggcaau

SEQ ID NO: 3093149 - RNA, 17 nt, Mycobacterium bovis subsp bovis AF2122/97
ggcaugcuggcgaucgc

SEQ ID NO: 3093150 - RNA, 13 nt, Mycobacterium bovis subsp bovis AF2122/97
ggcauggcgccgu

SEQ ID NO: 3093151 - RNA, 15 nt, Mycobacterium bovis subsp bovis AF2122/97
ggcauggcgccguug

SEQ ID NO: 3093152 - RNA, 22 nt, Mycobacterium bovis subsp bovis AF2122/97
ggcauggcgccguugccggcgu

SEQ ID NO: 3093153 - RNA, 13 nt, Mycobacterium bovis subsp bovis AF2122/97
ggcauggcggcgu

SEQ ID NO: 3093154 - RNA, 17 nt, Mycobacterium bovis subsp bovis AF2122/97
ggcaugggcccugcaca

SEQ ID NO: 3093155 - RNA, 17 nt, Mycobacterium bovis subsp bovis AF2122/97
ggcaugggccggcgccg

SEQ ID NO: 3093156 - RNA, 18 nt, Mycobacterium bovis subsp bovis AF2122/97
ggcaugggccggcgccgc

SEQ ID NO: 3093157 - RNA, 13 nt, Mycobacterium bovis subsp bovis AF2122/97
ggcauggucaggc

SEQ ID NO: 3093158 - RNA, 17 nt, Mycobacterium bovis subsp bovis AF2122/97
ggcauggucaggcggcc

SEQ ID NO: 3093159 - RNA, 20 nt, Mycobacterium bovis subsp bovis AF2122/97
ggcauguaccgaccgcguug

SEQ ID NO: 3093160 - RNA, 22 nt, Mycobacterium bovis subsp bovis AF2122/97
ggcauguuccuugcggccgcug

SEQ ID NO: 3093161 - RNA, 15 nt, Mycobacterium bovis subsp bovis AF2122/97
ggcauuaggccgggg

SEQ ID NO: 3093162 - RNA, 23 nt, Mycobacterium bovis subsp bovis AF2122/97
ggcauuaggccggggucgaacgc

SEQ ID NO: 3093163 - RNA, 13 nt, Mycobacterium bovis subsp bovis AF2122/97
ggcauucaccgcg

SEQ ID NO: 3093164 - RNA, 13 nt, Mycobacterium bovis subsp bovis AF2122/97
ggcauucccgcgg

SEQ ID NO: 3093165 - RNA, 16 nt, Mycobacterium bovis subsp bovis AF2122/97
ggcauucccgcggcaa

SEQ ID NO: 3093166 - RNA, 14 nt, Mycobacterium bovis subsp bovis AF2122/97
ggcauucccgcucg

SEQ ID NO: 3093167 - RNA, 15 nt, Mycobacterium bovis subsp bovis AF2122/97
ggcauuccggugugc

SEQ ID NO: 3093168 - RNA, 22 nt, Mycobacterium bovis subsp bovis AF2122/97
ggcauuccuugauaacgacccu

SEQ ID NO: 3093169 - RNA, 14 nt, Mycobacterium bovis subsp bovis AF2122/97
ggcauucgucgagu

SEQ ID NO: 3093170 - RNA, 19 nt, Mycobacterium bovis subsp bovis AF2122/97
ggcauucucgagcacccgc

SEQ ID NO: 3093171 - RNA, 15 nt, Mycobacterium bovis subsp bovis AF2122/97
ggcauugaccaccga

SEQ ID NO: 3093172 - RNA, 14 nt, Mycobacterium bovis subsp bovis AF2122/97
ggcauugccgccag

SEQ ID NO: 3093173 - RNA, 15 nt, Mycobacterium bovis subsp bovis AF2122/97
ggcauugccgccagc

SEQ ID NO: 3093174 - RNA, 14 nt, Mycobacterium bovis subsp bovis AF2122/97
ggcauugccgccgu

SEQ ID NO: 3093175 - RNA, 13 nt, Mycobacterium bovis subsp bovis AF2122/97
ggcauugcggccc

SEQ ID NO: 3093176 - RNA, 15 nt, Mycobacterium bovis subsp bovis AF2122/97
ggcauugcggcccgc

SEQ ID NO: 3093177 - RNA, 18 nt, Mycobacterium bovis subsp bovis AF2122/97
ggcauugcggcgcgggug

SEQ ID NO: 3093178 - RNA, 18 nt, Mycobacterium bovis subsp bovis AF2122/97
ggcauugcuccgguuggc

SEQ ID NO: 3093179 - RNA, 17 nt, Mycobacterium bovis subsp bovis AF2122/97
ggcauugguaccggcuu

SEQ ID NO: 3093180 - RNA, 15 nt, Mycobacterium bovis subsp bovis AF2122/97
ggcauuucagcgcgc

SEQ ID NO: 3093181 - RNA, 17 nt, Mycobacterium bovis subsp bovis AF2122/97
ggcauuucagcgcgccg

SEQ ID NO: 3093182 - RNA, 22 nt, Mycobacterium bovis subsp bovis AF2122/97
ggccaaagccgucagcucacca

SEQ ID NO: 3093183 - RNA, 15 nt, Mycobacterium bovis subsp bovis AF2122/97
ggccaacaccgccag

SEQ ID NO: 3093184 - RNA, 18 nt, Mycobacterium bovis subsp bovis AF2122/97
ggccaacaccgccagcau

SEQ ID NO: 3093185 - RNA, 15 nt, Mycobacterium bovis subsp bovis AF2122/97
ggccaacagguccac

SEQ ID NO: 3093186 - RNA, 15 nt, Mycobacterium bovis subsp bovis AF2122/97
ggccaaccaccaacu

SEQ ID NO: 3093187 - RNA, 14 nt, Mycobacterium bovis subsp bovis AF2122/97
ggccaaccccaugg

SEQ ID NO: 3093188 - RNA, 20 nt, Mycobacterium bovis subsp bovis AF2122/97
ggccaaccccauggccagcg

SEQ ID NO: 3093189 - RNA, 22 nt, Mycobacterium bovis subsp bovis AF2122/97
ggccaaccccauggccagcgcu

SEQ ID NO: 3093190 - RNA, 18 nt, Mycobacterium bovis subsp bovis AF2122/97
ggccaacccgggccgcca

SEQ ID NO: 3093191 - RNA, 18 nt, Mycobacterium bovis subsp bovis AF2122/97
ggccaacccugcggcguc

SEQ ID NO: 3093192 - RNA, 18 nt, Mycobacterium bovis subsp bovis AF2122/97
ggccaacgaacgugcccc

SEQ ID NO: 3093193 - RNA, 14 nt, Mycobacterium bovis subsp bovis AF2122/97
ggccaacgacggcc

SEQ ID NO: 3093194 - RNA, 11 nt, Mycobacterium bovis subsp bovis AF2122/97
ggccaacggca

SEQ ID NO: 3093195 - RNA, 12 nt, Mycobacterium bovis subsp bovis AF2122/97
ggccaacggcgc

SEQ ID NO: 3093196 - RNA, 15 nt, Mycobacterium bovis subsp bovis AF2122/97
ggccaacucggcgau

SEQ ID NO: 3093197 - RNA, 16 nt, Mycobacterium bovis subsp bovis AF2122/97
ggccaacucggcgaug

SEQ ID NO: 3093198 - RNA, 17 nt, Mycobacterium bovis subsp bovis AF2122/97
ggccaacugggccgagc

SEQ ID NO: 3093199 - RNA, 19 nt, Mycobacterium bovis subsp bovis AF2122/97
ggccaacugggccgagcgc

SEQ ID NO: 3093200 - RNA, 21 nt, Mycobacterium bovis subsp bovis AF2122/97
ggccaacugggccgagcgcgc

SEQ ID NO: 3093201 - RNA, 14 nt, Mycobacterium bovis subsp bovis AF2122/97
ggccaacugggcgg

SEQ ID NO: 3093202 - RNA, 16 nt, Mycobacterium bovis subsp bovis AF2122/97
ggccaacuucugcacg

SEQ ID NO: 3093203 - RNA, 16 nt, Mycobacterium bovis subsp bovis AF2122/97
ggccaacuuggcggcc

SEQ ID NO: 3093204 - RNA, 19 nt, Mycobacterium bovis subsp bovis AF2122/97
ggccaacuuggcggccagc

SEQ ID NO: 3093205 - RNA, 22 nt, Mycobacterium bovis subsp bovis AF2122/97
ggccaacuuggcggccagccgc

SEQ ID NO: 3093206 - RNA, 23 nt, Mycobacterium bovis subsp bovis AF2122/97
ggccaacuuggcggccagccgcu

SEQ ID NO: 3093207 - RNA, 22 nt, Mycobacterium bovis subsp bovis AF2122/97
ggccaagaaugugggcgacggc

SEQ ID NO: 3093208 - RNA, 23 nt, Mycobacterium bovis subsp bovis AF2122/97
ggccaagaaugugggcgacggcc

SEQ ID NO: 3093209 - RNA, 22 nt, Mycobacterium bovis subsp bovis AF2122/97
ggccaagacuucuccgcguccg

SEQ ID NO: 3093210 - RNA, 14 nt, Mycobacterium bovis subsp bovis AF2122/97
ggccaagaucggcg

SEQ ID NO: 3093211 - RNA, 15 nt, Mycobacterium bovis subsp bovis AF2122/97
ggccaagccggcgag

SEQ ID NO: 3093212 - RNA, 21 nt, Mycobacterium bovis subsp bovis AF2122/97
ggccaagggugcuugucgccg

SEQ ID NO: 3093213 - RNA, 16 nt, Mycobacterium bovis subsp bovis AF2122/97
ggccaagguggccacc

SEQ ID NO: 3093214 - RNA, 20 nt, Mycobacterium bovis subsp bovis AF2122/97
ggccaauagaagcacgucgu

SEQ ID NO: 3093215 - RNA, 15 nt, Mycobacterium bovis subsp bovis AF2122/97
ggccaauccggcggc

SEQ ID NO: 3093216 - RNA, 21 nt, Mycobacterium bovis subsp bovis AF2122/97
ggccaauccggcggcgacgug

SEQ ID NO: 3093217 - RNA, 15 nt, Mycobacterium bovis subsp bovis AF2122/97
ggccaauccggggcc

SEQ ID NO: 3093218 - RNA, 18 nt, Mycobacterium bovis subsp bovis AF2122/97
ggccaaugccguugaucg

SEQ ID NO: 3093219 - RNA, 17 nt, Mycobacterium bovis subsp bovis AF2122/97
ggccaauggccugcagc

SEQ ID NO: 3093220 - RNA, 14 nt, Mycobacterium bovis subsp bovis AF2122/97
ggccacaaccucgu

SEQ ID NO: 3093221 - RNA, 14 nt, Mycobacterium bovis subsp bovis AF2122/97
ggccacaaucgcgg

SEQ ID NO: 3093222 - RNA, 18 nt, Mycobacterium bovis subsp bovis AF2122/97
ggccacacagucacggac

SEQ ID NO: 3093223 - RNA, 19 nt, Mycobacterium bovis subsp bovis AF2122/97
ggccacaccuuggccgccg

SEQ ID NO: 3093224 - RNA, 21 nt, Mycobacterium bovis subsp bovis AF2122/97
ggccacaccuuggccgccggc

SEQ ID NO: 3093225 - RNA, 17 nt, Mycobacterium bovis subsp bovis AF2122/97
ggccacacucagcaccc

SEQ ID NO: 3093226 - RNA, 22 nt, Mycobacterium bovis subsp bovis AF2122/97
ggccacacucagcacccaauac

SEQ ID NO: 3093227 - RNA, 13 nt, Mycobacterium bovis subsp bovis AF2122/97
ggccacagcccgg

SEQ ID NO: 3093228 - RNA, 12 nt, Mycobacterium bovis subsp bovis AF2122/97
ggccacauccag

SEQ ID NO: 3093229 - RNA, 16 nt, Mycobacterium bovis subsp bovis AF2122/97
ggccacauccagcgcu

SEQ ID NO: 3093230 - RNA, 18 nt, Mycobacterium bovis subsp bovis AF2122/97
ggccacaucgccagcagc

SEQ ID NO: 3093231 - RNA, 18 nt, Mycobacterium bovis subsp bovis AF2122/97
ggccacaugaucgagcag

SEQ ID NO: 3093232 - RNA, 14 nt, Mycobacterium bovis subsp bovis AF2122/97
ggccacaugccaca

SEQ ID NO: 3093233 - RNA, 20 nt, Mycobacterium bovis subsp bovis AF2122/97
ggccacaugccacagcggcg

SEQ ID NO: 3093234 - RNA, 18 nt, Mycobacterium bovis subsp bovis AF2122/97
ggccaccaaacgcugcug

SEQ ID NO: 3093235 - RNA, 20 nt, Mycobacterium bovis subsp bovis AF2122/97
ggccaccaaccucaucgcgg

SEQ ID NO: 3093236 - RNA, 18 nt, Mycobacterium bovis subsp bovis AF2122/97
ggccaccaacucggcgac

SEQ ID NO: 3093237 - RNA, 13 nt, Mycobacterium bovis subsp bovis AF2122/97
ggccaccaccacg

SEQ ID NO: 3093238 - RNA, 15 nt, Mycobacterium bovis subsp bovis AF2122/97
ggccaccaccacggc

SEQ ID NO: 3093239 - RNA, 11 nt, Mycobacterium bovis subsp bovis AF2122/97
ggccaccaccg

SEQ ID NO: 3093240 - RNA, 16 nt, Mycobacterium bovis subsp bovis AF2122/97
ggccaccaccgccgcc

SEQ ID NO: 3093241 - RNA, 18 nt, Mycobacterium bovis subsp bovis AF2122/97
ggccaccaccgccgccgg

SEQ ID NO: 3093242 - RNA, 15 nt, Mycobacterium bovis subsp bovis AF2122/97
ggccaccaccgcgcc

SEQ ID NO: 3093243 - RNA, 21 nt, Mycobacterium bovis subsp bovis AF2122/97
ggccaccaccgcgccgucguc

SEQ ID NO: 3093244 - RNA, 14 nt, Mycobacterium bovis subsp bovis AF2122/97
ggccaccaccguga

SEQ ID NO: 3093245 - RNA, 23 nt, Mycobacterium bovis subsp bovis AF2122/97
ggccaccaccgugaagcccuggc

SEQ ID NO: 3093246 - RNA, 17 nt, Mycobacterium bovis subsp bovis AF2122/97
ggccaccagaaccacuu

SEQ ID NO: 3093247 - RNA, 14 nt, Mycobacterium bovis subsp bovis AF2122/97
ggccaccagccugg

SEQ ID NO: 3093248 - RNA, 19 nt, Mycobacterium bovis subsp bovis AF2122/97
ggccaccagccuggcugcg

SEQ ID NO: 3093249 - RNA, 14 nt, Mycobacterium bovis subsp bovis AF2122/97
ggccaccagcgccc

SEQ ID NO: 3093250 - RNA, 23 nt, Mycobacterium bovis subsp bovis AF2122/97
ggccaccagcgcccggcccgcca

SEQ ID NO: 3093251 - RNA, 14 nt, Mycobacterium bovis subsp bovis AF2122/97
ggccaccagcggca

SEQ ID NO: 3093252 - RNA, 14 nt, Mycobacterium bovis subsp bovis AF2122/97
ggccaccagcuggc

SEQ ID NO: 3093253 - RNA, 19 nt, Mycobacterium bovis subsp bovis AF2122/97
ggccaccaggggaccgcgg

SEQ ID NO: 3093254 - RNA, 12 nt, Mycobacterium bovis subsp bovis AF2122/97
ggccaccagucc

SEQ ID NO: 3093255 - RNA, 19 nt, Mycobacterium bovis subsp bovis AF2122/97
ggccaccaguuguccggcu

SEQ ID NO: 3093256 - RNA, 11 nt, Mycobacterium bovis subsp bovis AF2122/97
ggccaccaucg

SEQ ID NO: 3093257 - RNA, 15 nt, Mycobacterium bovis subsp bovis AF2122/97
ggccaccaucgcccc

SEQ ID NO: 3093258 - RNA, 18 nt, Mycobacterium bovis subsp bovis AF2122/97
ggccaccaucgccgccgu

SEQ ID NO: 3093259 - RNA, 14 nt, Mycobacterium bovis subsp bovis AF2122/97
ggccaccccgaccu

SEQ ID NO: 3093260 - RNA, 13 nt, Mycobacterium bovis subsp bovis AF2122/97
ggccaccccgagc

SEQ ID NO: 3093261 - RNA, 21 nt, Mycobacterium bovis subsp bovis AF2122/97
ggccaccccgagcucaccaag

SEQ ID NO: 3093262 - RNA, 14 nt, Mycobacterium bovis subsp bovis AF2122/97
ggccacccgcagac

SEQ ID NO: 3093263 - RNA, 13 nt, Mycobacterium bovis subsp bovis AF2122/97
ggccacccgcagg

SEQ ID NO: 3093264 - RNA, 24 nt, Mycobacterium bovis subsp bovis AF2122/97
ggccacccgcaggucgcaccacag

SEQ ID NO: 3093265 - RNA, 15 nt, Mycobacterium bovis subsp bovis AF2122/97
ggccacccgcgcgau

SEQ ID NO: 3093266 - RNA, 20 nt, Mycobacterium bovis subsp bovis AF2122/97
ggccacccgcgcgaugcugg

SEQ ID NO: 3093267 - RNA, 22 nt, Mycobacterium bovis subsp bovis AF2122/97
ggccacccggacauagccgcgc

SEQ ID NO: 3093268 - RNA, 13 nt, Mycobacterium bovis subsp bovis AF2122/97
ggccaccgcagac

SEQ ID NO: 3093269 - RNA, 16 nt, Mycobacterium bovis subsp bovis AF2122/97
ggccaccgcccagugc

SEQ ID NO: 3093270 - RNA, 22 nt, Mycobacterium bovis subsp bovis AF2122/97
ggccaccgcccagugccagaac

SEQ ID NO: 3093271 - RNA, 13 nt, Mycobacterium bovis subsp bovis AF2122/97
ggccaccgccgaa

SEQ ID NO: 3093272 - RNA, 14 nt, Mycobacterium bovis subsp bovis AF2122/97
ggccaccgccgccg

SEQ ID NO: 3093273 - RNA, 15 nt, Mycobacterium bovis subsp bovis AF2122/97
ggccaccgccgccgc

SEQ ID NO: 3093274 - RNA, 16 nt, Mycobacterium bovis subsp bovis AF2122/97
ggccaccgccgccgcc

SEQ ID NO: 3093275 - RNA, 19 nt, Mycobacterium bovis subsp bovis AF2122/97
ggccaccgccgccgccgac

SEQ ID NO: 3093276 - RNA, 22 nt, Mycobacterium bovis subsp bovis AF2122/97
ggccaccgccgccugcccggcc

SEQ ID NO: 3093277 - RNA, 12 nt, Mycobacterium bovis subsp bovis AF2122/97
ggccaccgcgca

SEQ ID NO: 3093278 - RNA, 20 nt, Mycobacterium bovis subsp bovis AF2122/97
ggccaccgcugucagccgac

SEQ ID NO: 3093279 - RNA, 22 nt, Mycobacterium bovis subsp bovis AF2122/97
ggccaccggaauccuggccgcc

SEQ ID NO: 3093280 - RNA, 11 nt, Mycobacterium bovis subsp bovis AF2122/97
ggccaccggcg

SEQ ID NO: 3093281 - RNA, 14 nt, Mycobacterium bovis subsp bovis AF2122/97
ggccaccggcgacc

SEQ ID NO: 3093282 - RNA, 16 nt, Mycobacterium bovis subsp bovis AF2122/97
ggccaccggcgccgug

SEQ ID NO: 3093283 - RNA, 13 nt, Mycobacterium bovis subsp bovis AF2122/97
ggccaccggcggu

SEQ ID NO: 3093284 - RNA, 14 nt, Mycobacterium bovis subsp bovis AF2122/97
ggccaccggcgguc

SEQ ID NO: 3093285 - RNA, 17 nt, Mycobacterium bovis subsp bovis AF2122/97
ggccaccggcggugccg

SEQ ID NO: 3093286 - RNA, 21 nt, Mycobacterium bovis subsp bovis AF2122/97
ggccaccggcgucugcccgcc

SEQ ID NO: 3093287 - RNA, 21 nt, Mycobacterium bovis subsp bovis AF2122/97
ggccaccggcugcaaccagcg

SEQ ID NO: 3093288 - RNA, 16 nt, Mycobacterium bovis subsp bovis AF2122/97
ggccaccggggucacc

SEQ ID NO: 3093289 - RNA, 17 nt, Mycobacterium bovis subsp bovis AF2122/97
ggccaccggggucaccu

SEQ ID NO: 3093290 - RNA, 19 nt, Mycobacterium bovis subsp bovis AF2122/97
ggccaccguaaacagcgcg

SEQ ID NO: 3093291 - RNA, 22 nt, Mycobacterium bovis subsp bovis AF2122/97
ggccaccguaaacagcgcgccg

SEQ ID NO: 3093292 - RNA, 16 nt, Mycobacterium bovis subsp bovis AF2122/97
ggccaccguagccagc

SEQ ID NO: 3093293 - RNA, 19 nt, Mycobacterium bovis subsp bovis AF2122/97
ggccaccguagccagcagg

SEQ ID NO: 3093294 - RNA, 17 nt, Mycobacterium bovis subsp bovis AF2122/97
ggccaccgucagcgcga

SEQ ID NO: 3093295 - RNA, 22 nt, Mycobacterium bovis subsp bovis AF2122/97
ggccaccgucccugugucgccg

SEQ ID NO: 3093296 - RNA, 23 nt, Mycobacterium bovis subsp bovis AF2122/97
ggccaccgucccugugucgccgu

SEQ ID NO: 3093297 - RNA, 12 nt, Mycobacterium bovis subsp bovis AF2122/97
ggccaccgucgc

SEQ ID NO: 3093298 - RNA, 13 nt, Mycobacterium bovis subsp bovis AF2122/97
ggccaccgucgcg

SEQ ID NO: 3093299 - RNA, 20 nt, Mycobacterium bovis subsp bovis AF2122/97
ggccaccuccgaggccgcca

SEQ ID NO: 3093300 - RNA, 14 nt, Mycobacterium bovis subsp bovis AF2122/97
ggccaccucgggug

SEQ ID NO: 3093301 - RNA, 21 nt, Mycobacterium bovis subsp bovis AF2122/97
ggccaccucggugcggaacac

SEQ ID NO: 3093302 - RNA, 19 nt, Mycobacterium bovis subsp bovis AF2122/97
ggccaccugaaaccacugc

SEQ ID NO: 3093303 - RNA, 20 nt, Mycobacterium bovis subsp bovis AF2122/97
ggccaccuguuggcaugccg

SEQ ID NO: 3093304 - RNA, 20 nt, Mycobacterium bovis subsp bovis AF2122/97
ggccaccuuagcgcuugccg

SEQ ID NO: 3093305 - RNA, 18 nt, Mycobacterium bovis subsp bovis AF2122/97
ggccacgaccucgggauc

SEQ ID NO: 3093306 - RNA, 13 nt, Mycobacterium bovis subsp bovis AF2122/97
ggccacgauccgc

SEQ ID NO: 3093307 - RNA, 17 nt, Mycobacterium bovis subsp bovis AF2122/97
ggccacgauccgcggua

SEQ ID NO: 3093308 - RNA, 17 nt, Mycobacterium bovis subsp bovis AF2122/97
ggccacgaugaucccaa

SEQ ID NO: 3093309 - RNA, 18 nt, Mycobacterium bovis subsp bovis AF2122/97
ggccacgccagcucgccg

SEQ ID NO: 3093310 - RNA, 20 nt, Mycobacterium bovis subsp bovis AF2122/97
ggccacgccagcucgccggc

SEQ ID NO: 3093311 - RNA, 22 nt, Mycobacterium bovis subsp bovis AF2122/97
ggccacgccagcucgccggccg

SEQ ID NO: 3093312 - RNA, 15 nt, Mycobacterium bovis subsp bovis AF2122/97
ggccacggcgucggc

SEQ ID NO: 3093313 - RNA, 19 nt, Mycobacterium bovis subsp bovis AF2122/97
ggccacggcuuugcggcgc

SEQ ID NO: 3093314 - RNA, 23 nt, Mycobacterium bovis subsp bovis AF2122/97
ggccacgggaguacgggagccgg

SEQ ID NO: 3093315 - RNA, 16 nt, Mycobacterium bovis subsp bovis AF2122/97
ggccacggggcugccg

SEQ ID NO: 3093316 - RNA, 17 nt, Mycobacterium bovis subsp bovis AF2122/97
ggccacggucagccagg

SEQ ID NO: 3093317 - RNA, 19 nt, Mycobacterium bovis subsp bovis AF2122/97
ggccacgguccggcccacc

SEQ ID NO: 3093318 - RNA, 22 nt, Mycobacterium bovis subsp bovis AF2122/97
ggccacgguccggcccaccagc

SEQ ID NO: 3093319 - RNA, 15 nt, Mycobacterium bovis subsp bovis AF2122/97
ggccacguagcagca

SEQ ID NO: 3093320 - RNA, 18 nt, Mycobacterium bovis subsp bovis AF2122/97
ggccacguccucagccgu

SEQ ID NO: 3093321 - RNA, 21 nt, Mycobacterium bovis subsp bovis AF2122/97
ggccacguccucagccgugcc

SEQ ID NO: 3093322 - RNA, 21 nt, Mycobacterium bovis subsp bovis AF2122/97
ggccacguuguccgcgacgua

SEQ ID NO: 3093323 - RNA, 22 nt, Mycobacterium bovis subsp bovis AF2122/97
ggccacuacggccuggccaccu

SEQ ID NO: 3093324 - RNA, 16 nt, Mycobacterium bovis subsp bovis AF2122/97
ggccacuccgguggcc

SEQ ID NO: 3093325 - RNA, 18 nt, Mycobacterium bovis subsp bovis AF2122/97
ggccacugauucgcaggc

SEQ ID NO: 3093326 - RNA, 21 nt, Mycobacterium bovis subsp bovis AF2122/97
ggccacugccgaccagcgcgc

SEQ ID NO: 3093327 - RNA, 22 nt, Mycobacterium bovis subsp bovis AF2122/97
ggccacugcguuccaucgccga

SEQ ID NO: 3093328 - RNA, 13 nt, Mycobacterium bovis subsp bovis AF2122/97
ggccacuggccgg

SEQ ID NO: 3093329 - RNA, 23 nt, Mycobacterium bovis subsp bovis AF2122/97
ggccacuggccgguucgcccgag

SEQ ID NO: 3093330 - RNA, 16 nt, Mycobacterium bovis subsp bovis AF2122/97
ggccacuugaugcucg

SEQ ID NO: 3093331 - RNA, 17 nt, Mycobacterium bovis subsp bovis AF2122/97
ggccacuugaugcucga

SEQ ID NO: 3093332 - RNA, 14 nt, Mycobacterium bovis subsp bovis AF2122/97
ggccagaaacccgg

SEQ ID NO: 3093333 - RNA, 15 nt, Mycobacterium bovis subsp bovis AF2122/97
ggccagacccaccac

SEQ ID NO: 3093334 - RNA, 20 nt, Mycobacterium bovis subsp bovis AF2122/97
ggccagacccgaauccacca

SEQ ID NO: 3093335 - RNA, 22 nt, Mycobacterium bovis subsp bovis AF2122/97
ggccagacccgaauccaccagc

SEQ ID NO: 3093336 - RNA, 23 nt, Mycobacterium bovis subsp bovis AF2122/97
ggccagacccgaauccaccagcu

SEQ ID NO: 3093337 - RNA, 20 nt, Mycobacterium bovis subsp bovis AF2122/97
ggccagacggugcagcuccc

SEQ ID NO: 3093338 - RNA, 17 nt, Mycobacterium bovis subsp bovis AF2122/97
ggccagacucgcggucg

SEQ ID NO: 3093339 - RNA, 15 nt, Mycobacterium bovis subsp bovis AF2122/97
ggccagagccgcgcg

SEQ ID NO: 3093340 - RNA, 16 nt, Mycobacterium bovis subsp bovis AF2122/97
ggccagagccgcgcgc

SEQ ID NO: 3093341 - RNA, 18 nt, Mycobacterium bovis subsp bovis AF2122/97
ggccagagccgcgcgccg

SEQ ID NO: 3093342 - RNA, 21 nt, Mycobacterium bovis subsp bovis AF2122/97
ggccagagccgcgcgccgguu

SEQ ID NO: 3093343 - RNA, 20 nt, Mycobacterium bovis subsp bovis AF2122/97
ggccagagucgcccgcacac

SEQ ID NO: 3093344 - RNA, 20 nt, Mycobacterium bovis subsp bovis AF2122/97
ggccagaucacgcacucgcg

SEQ ID NO: 3093345 - RNA, 15 nt, Mycobacterium bovis subsp bovis AF2122/97
ggccagaucgaacgc

SEQ ID NO: 3093346 - RNA, 23 nt, Mycobacterium bovis subsp bovis AF2122/97
ggccagaucgaagcgcagcaccu

SEQ ID NO: 3093347 - RNA, 13 nt, Mycobacterium bovis subsp bovis AF2122/97
ggccagaucgccg

SEQ ID NO: 3093348 - RNA, 16 nt, Mycobacterium bovis subsp bovis AF2122/97
ggccagcaacugccgc

SEQ ID NO: 3093349 - RNA, 19 nt, Mycobacterium bovis subsp bovis AF2122/97
ggccagcaacugccgcacc

SEQ ID NO: 3093350 - RNA, 16 nt, Mycobacterium bovis subsp bovis AF2122/97
ggccagcaagacgaug

SEQ ID NO: 3093351 - RNA, 21 nt, Mycobacterium bovis subsp bovis AF2122/97
ggccagcaaguacgcgucggu

SEQ ID NO: 3093352 - RNA, 14 nt, Mycobacterium bovis subsp bovis AF2122/97
ggccagcacaccgu

SEQ ID NO: 3093353 - RNA, 18 nt, Mycobacterium bovis subsp bovis AF2122/97
ggccagcacaccgucgac

SEQ ID NO: 3093354 - RNA, 20 nt, Mycobacterium bovis subsp bovis AF2122/97
ggccagcacaccgucgacga

SEQ ID NO: 3093355 - RNA, 15 nt, Mycobacterium bovis subsp bovis AF2122/97
ggccagcaccacggc

SEQ ID NO: 3093356 - RNA, 21 nt, Mycobacterium bovis subsp bovis AF2122/97
ggccagcaccacggccagcgg

SEQ ID NO: 3093357 - RNA, 23 nt, Mycobacterium bovis subsp bovis AF2122/97
ggccagcaccacggccagcgggu

SEQ ID NO: 3093358 - RNA, 13 nt, Mycobacterium bovis subsp bovis AF2122/97
ggccagcacccgc

SEQ ID NO: 3093359 - RNA, 15 nt, Mycobacterium bovis subsp bovis AF2122/97
ggccagcacccgcuc

SEQ ID NO: 3093360 - RNA, 23 nt, Mycobacterium bovis subsp bovis AF2122/97
ggccagcacccgcuccagcucgg

SEQ ID NO: 3093361 - RNA, 12 nt, Mycobacterium bovis subsp bovis AF2122/97
ggccagcaccgg

SEQ ID NO: 3093362 - RNA, 23 nt, Mycobacterium bovis subsp bovis AF2122/97
ggccagcaccggggacagcccgg

SEQ ID NO: 3093363 - RNA, 20 nt, Mycobacterium bovis subsp bovis AF2122/97
ggccagcacgcccgcgcuga

SEQ ID NO: 3093364 - RNA, 20 nt, Mycobacterium bovis subsp bovis AF2122/97
ggccagcacgcccucgacgc

SEQ ID NO: 3093365 - RNA, 18 nt, Mycobacterium bovis subsp bovis AF2122/97
ggccagcacgccgccggc

SEQ ID NO: 3093366 - RNA, 22 nt, Mycobacterium bovis subsp bovis AF2122/97
ggccagcacgccgccggccgcc

SEQ ID NO: 3093367 - RNA, 23 nt, Mycobacterium bovis subsp bovis AF2122/97
ggccagcacgccgccggccgcca

SEQ ID NO: 3093368 - RNA, 14 nt, Mycobacterium bovis subsp bovis AF2122/97
ggccagcacggcga

SEQ ID NO: 3093369 - RNA, 16 nt, Mycobacterium bovis subsp bovis AF2122/97
ggccagcacggcuugg

SEQ ID NO: 3093370 - RNA, 18 nt, Mycobacterium bovis subsp bovis AF2122/97
ggccagcagaaacaucga

SEQ ID NO: 3093371 - RNA, 19 nt, Mycobacterium bovis subsp bovis AF2122/97
ggccagcagaaacaucgac

SEQ ID NO: 3093372 - RNA, 22 nt, Mycobacterium bovis subsp bovis AF2122/97
ggccagcagaaacaucgacagc

SEQ ID NO: 3093373 - RNA, 16 nt, Mycobacterium bovis subsp bovis AF2122/97
ggccagcagagcggca

SEQ ID NO: 3093374 - RNA, 17 nt, Mycobacterium bovis subsp bovis AF2122/97
ggccagcagagcggcac

SEQ ID NO: 3093375 - RNA, 19 nt, Mycobacterium bovis subsp bovis AF2122/97
ggccagcagagcggcacgc

SEQ ID NO: 3093376 - RNA, 16 nt, Mycobacterium bovis subsp bovis AF2122/97
ggccagcagaucaggu

SEQ ID NO: 3093377 - RNA, 15 nt, Mycobacterium bovis subsp bovis AF2122/97
ggccagcagcaacga

SEQ ID NO: 3093378 - RNA, 21 nt, Mycobacterium bovis subsp bovis AF2122/97
ggccagcagcaaugcgguacc

SEQ ID NO: 3093379 - RNA, 13 nt, Mycobacterium bovis subsp bovis AF2122/97
ggccagcagccgc

SEQ ID NO: 3093380 - RNA, 14 nt, Mycobacterium bovis subsp bovis AF2122/97
ggccagcagccgcg

SEQ ID NO: 3093381 - RNA, 22 nt, Mycobacterium bovis subsp bovis AF2122/97
ggccagcagcgacuccagcgcc

SEQ ID NO: 3093382 - RNA, 23 nt, Mycobacterium bovis subsp bovis AF2122/97
ggccagcagcgacuccagcgccc

SEQ ID NO: 3093383 - RNA, 15 nt, Mycobacterium bovis subsp bovis AF2122/97
ggccagcagcgcggg

SEQ ID NO: 3093384 - RNA, 18 nt, Mycobacterium bovis subsp bovis AF2122/97
ggccagcagcgcgggauc

SEQ ID NO: 3093385 - RNA, 16 nt, Mycobacterium bovis subsp bovis AF2122/97
ggccagcaggaugaug

SEQ ID NO: 3093386 - RNA, 23 nt, Mycobacterium bovis subsp bovis AF2122/97
ggccagcaggaugaugaccgcca

SEQ ID NO: 3093387 - RNA, 14 nt, Mycobacterium bovis subsp bovis AF2122/97
ggccagcaggcggc

SEQ ID NO: 3093388 - RNA, 12 nt, Mycobacterium bovis subsp bovis AF2122/97
ggccagcagggc

SEQ ID NO: 3093389 - RNA, 17 nt, Mycobacterium bovis subsp bovis AF2122/97
ggccagcagggccacca

SEQ ID NO: 3093390 - RNA, 15 nt, Mycobacterium bovis subsp bovis AF2122/97
ggccagcaucagcgc

SEQ ID NO: 3093391 - RNA, 16 nt, Mycobacterium bovis subsp bovis AF2122/97
ggccagcaucagcgcc

SEQ ID NO: 3093392 - RNA, 16 nt, Mycobacterium bovis subsp bovis AF2122/97
ggccagcaucgggugg

SEQ ID NO: 3093393 - RNA, 13 nt, Mycobacterium bovis subsp bovis AF2122/97
ggccagccacagc

SEQ ID NO: 3093394 - RNA, 17 nt, Mycobacterium bovis subsp bovis AF2122/97
ggccagccacagccgac

SEQ ID NO: 3093395 - RNA, 18 nt, Mycobacterium bovis subsp bovis AF2122/97
ggccagccacuccucggu

SEQ ID NO: 3093396 - RNA, 15 nt, Mycobacterium bovis subsp bovis AF2122/97
ggccagccagcgauc

SEQ ID NO: 3093397 - RNA, 14 nt, Mycobacterium bovis subsp bovis AF2122/97
ggccagccagcggg

SEQ ID NO: 3093398 - RNA, 17 nt, Mycobacterium bovis subsp bovis AF2122/97
ggccagccagcgggcga

SEQ ID NO: 3093399 - RNA, 14 nt, Mycobacterium bovis subsp bovis AF2122/97
ggccagcccacucg

SEQ ID NO: 3093400 - RNA, 18 nt, Mycobacterium bovis subsp bovis AF2122/97
ggccagcccacucgucga

SEQ ID NO: 3093401 - RNA, 16 nt, Mycobacterium bovis subsp bovis AF2122/97
ggccagcccagccggg

SEQ ID NO: 3093402 - RNA, 15 nt, Mycobacterium bovis subsp bovis AF2122/97
ggccagcccgcccag

SEQ ID NO: 3093403 - RNA, 13 nt, Mycobacterium bovis subsp bovis AF2122/97
ggccagccgcggc

SEQ ID NO: 3093404 - RNA, 14 nt, Mycobacterium bovis subsp bovis AF2122/97
ggccagccgcggcc

SEQ ID NO: 3093405 - RNA, 15 nt, Mycobacterium bovis subsp bovis AF2122/97
ggccagccgcggccc

SEQ ID NO: 3093406 - RNA, 15 nt, Mycobacterium bovis subsp bovis AF2122/97
ggccagccgcucacc

SEQ ID NO: 3093407 - RNA, 20 nt, Mycobacterium bovis subsp bovis AF2122/97
ggccagccgcucacccgguc

SEQ ID NO: 3093408 - RNA, 17 nt, Mycobacterium bovis subsp bovis AF2122/97
ggccagcgagaucagca

SEQ ID NO: 3093409 - RNA, 19 nt, Mycobacterium bovis subsp bovis AF2122/97
ggccagcgaugugaaccgg

SEQ ID NO: 3093410 - RNA, 14 nt, Mycobacterium bovis subsp bovis AF2122/97
ggccagcgcaccgc

SEQ ID NO: 3093411 - RNA, 11 nt, Mycobacterium bovis subsp bovis AF2122/97
ggccagcgcau

SEQ ID NO: 3093412 - RNA, 23 nt, Mycobacterium bovis subsp bovis AF2122/97
ggccagcgcaucuuugaacgcca

SEQ ID NO: 3093413 - RNA, 16 nt, Mycobacterium bovis subsp bovis AF2122/97
ggccagcgcccgcagg

SEQ ID NO: 3093414 - RNA, 12 nt, Mycobacterium bovis subsp bovis AF2122/97
ggccagcgcgcc

SEQ ID NO: 3093415 - RNA, 18 nt, Mycobacterium bovis subsp bovis AF2122/97
ggccagcgcgccacgagc

SEQ ID NO: 3093416 - RNA, 15 nt, Mycobacterium bovis subsp bovis AF2122/97
ggccagcgcgcccgc

SEQ ID NO: 3093417 - RNA, 18 nt, Mycobacterium bovis subsp bovis AF2122/97
ggccagcgcgcccgcggc

SEQ ID NO: 3093418 - RNA, 15 nt, Mycobacterium bovis subsp bovis AF2122/97
ggccagcgcgcgcgg

SEQ ID NO: 3093419 - RNA, 18 nt, Mycobacterium bovis subsp bovis AF2122/97
ggccagcgcggcgagggc

SEQ ID NO: 3093420 - RNA, 19 nt, Mycobacterium bovis subsp bovis AF2122/97
ggccagcgcggcgagggcg

SEQ ID NO: 3093421 - RNA, 21 nt, Mycobacterium bovis subsp bovis AF2122/97
ggccagcgcggcgcgcggggc

SEQ ID NO: 3093422 - RNA, 15 nt, Mycobacterium bovis subsp bovis AF2122/97
ggccagcgcggcguc

SEQ ID NO: 3093423 - RNA, 23 nt, Mycobacterium bovis subsp bovis AF2122/97
ggccagcgcgucgggaugcgcgu

SEQ ID NO: 3093424 - RNA, 15 nt, Mycobacterium bovis subsp bovis AF2122/97
ggccagcgcucaccg

SEQ ID NO: 3093425 - RNA, 18 nt, Mycobacterium bovis subsp bovis AF2122/97
ggccagcgcucaccggcg

SEQ ID NO: 3093426 - RNA, 14 nt, Mycobacterium bovis subsp bovis AF2122/97
ggccagcgcugcug

SEQ ID NO: 3093427 - RNA, 19 nt, Mycobacterium bovis subsp bovis AF2122/97
ggccagcgcuucgucggcc

SEQ ID NO: 3093428 - RNA, 23 nt, Mycobacterium bovis subsp bovis AF2122/97
ggccagcgcuucgucggccggca

SEQ ID NO: 3093429 - RNA, 13 nt, Mycobacterium bovis subsp bovis AF2122/97
ggccagcggcagc

SEQ ID NO: 3093430 - RNA, 14 nt, Mycobacterium bovis subsp bovis AF2122/97
ggccagcggcagcc

SEQ ID NO: 3093431 - RNA, 22 nt, Mycobacterium bovis subsp bovis AF2122/97
ggccagcggcagccuggccucg

SEQ ID NO: 3093432 - RNA, 21 nt, Mycobacterium bovis subsp bovis AF2122/97
ggccagcggccauccggcggc

SEQ ID NO: 3093433 - RNA, 18 nt, Mycobacterium bovis subsp bovis AF2122/97
ggccagcggcccgucacc

SEQ ID NO: 3093434 - RNA, 20 nt, Mycobacterium bovis subsp bovis AF2122/97
ggccagcgggugaaucgaca

SEQ ID NO: 3093435 - RNA, 22 nt, Mycobacterium bovis subsp bovis AF2122/97
ggccagcgguaaugccagcggc

SEQ ID NO: 3093436 - RNA, 18 nt, Mycobacterium bovis subsp bovis AF2122/97
ggccagcgugucccaacg

SEQ ID NO: 3093437 - RNA, 22 nt, Mycobacterium bovis subsp bovis AF2122/97
ggccagcucccgggcggcggcc

SEQ ID NO: 3093438 - RNA, 22 nt, Mycobacterium bovis subsp bovis AF2122/97
ggccagcuccgccugccgcugg

SEQ ID NO: 3093439 - RNA, 19 nt, Mycobacterium bovis subsp bovis AF2122/97
ggccagcuccgugacaccg

SEQ ID NO: 3093440 - RNA, 17 nt, Mycobacterium bovis subsp bovis AF2122/97
ggccagcuccucagcca

SEQ ID NO: 3093441 - RNA, 23 nt, Mycobacterium bovis subsp bovis AF2122/97
ggccagcuccucagccaccgcgg

SEQ ID NO: 3093442 - RNA, 12 nt, Mycobacterium bovis subsp bovis AF2122/97
ggccagcucgcg

SEQ ID NO: 3093443 - RNA, 17 nt, Mycobacterium bovis subsp bovis AF2122/97
ggccagcucggccagcu

SEQ ID NO: 3093444 - RNA, 21 nt, Mycobacterium bovis subsp bovis AF2122/97
ggccagcugcggcuccggcgg

SEQ ID NO: 3093445 - RNA, 15 nt, Mycobacterium bovis subsp bovis AF2122/97
ggccagcuugcggag

SEQ ID NO: 3093446 - RNA, 20 nt, Mycobacterium bovis subsp bovis AF2122/97
ggccagcuugcggagccgcc

SEQ ID NO: 3093447 - RNA, 21 nt, Mycobacterium bovis subsp bovis AF2122/97
ggccagcuugcggagccgccg

SEQ ID NO: 3093448 - RNA, 21 nt, Mycobacterium bovis subsp bovis AF2122/97
ggccaggaagucccgggcacc

SEQ ID NO: 3093449 - RNA, 20 nt, Mycobacterium bovis subsp bovis AF2122/97
ggccaggauaaguccggaca

SEQ ID NO: 3093450 - RNA, 24 nt, Mycobacterium bovis subsp bovis AF2122/97
ggccaggaucgcuacgucgaccga

SEQ ID NO: 3093451 - RNA, 20 nt, Mycobacterium bovis subsp bovis AF2122/97
ggccaggaugaagacgcggg

SEQ ID NO: 3093452 - RNA, 14 nt, Mycobacterium bovis subsp bovis AF2122/97
ggccaggcccaagc

SEQ ID NO: 3093453 - RNA, 22 nt, Mycobacterium bovis subsp bovis AF2122/97
ggccaggcccucgacggcgucg

SEQ ID NO: 3093454 - RNA, 14 nt, Mycobacterium bovis subsp bovis AF2122/97
ggccaggccggcgg

SEQ ID NO: 3093455 - RNA, 11 nt, Mycobacterium bovis subsp bovis AF2122/97
ggccaggccgu

SEQ ID NO: 3093456 - RNA, 22 nt, Mycobacterium bovis subsp bovis AF2122/97
ggccaggccguaguggccggcu

SEQ ID NO: 3093457 - RNA, 14 nt, Mycobacterium bovis subsp bovis AF2122/97
ggccaggccgucgg

SEQ ID NO: 3093458 - RNA, 16 nt, Mycobacterium bovis subsp bovis AF2122/97
ggccaggccgucggcg

SEQ ID NO: 3093459 - RNA, 23 nt, Mycobacterium bovis subsp bovis AF2122/97
ggccaggcgguacgggucgccgg

SEQ ID NO: 3093460 - RNA, 23 nt, Mycobacterium bovis subsp bovis AF2122/97
ggccaggcuauggugccggugau

SEQ ID NO: 3093461 - RNA, 17 nt, Mycobacterium bovis subsp bovis AF2122/97
ggccaggcuggccaacu

SEQ ID NO: 3093462 - RNA, 19 nt, Mycobacterium bovis subsp bovis AF2122/97
ggccagggcgguggccacc

SEQ ID NO: 3093463 - RNA, 19 nt, Mycobacterium bovis subsp bovis AF2122/97
ggccaggggcgcagcgcgg

SEQ ID NO: 3093464 - RNA, 17 nt, Mycobacterium bovis subsp bovis AF2122/97
ggccagggucagcucgg

SEQ ID NO: 3093465 - RNA, 23 nt, Mycobacterium bovis subsp bovis AF2122/97
ggccagggucagcucggugaugu

SEQ ID NO: 3093466 - RNA, 20 nt, Mycobacterium bovis subsp bovis AF2122/97
ggccagggugcccucggccg

SEQ ID NO: 3093467 - RNA, 22 nt, Mycobacterium bovis subsp bovis AF2122/97
ggccagggugcccucggccgcc

SEQ ID NO: 3093468 - RNA, 17 nt, Mycobacterium bovis subsp bovis AF2122/97
ggccaggucgacaccgc

SEQ ID NO: 3093469 - RNA, 13 nt, Mycobacterium bovis subsp bovis AF2122/97
ggccaggucgacg

SEQ ID NO: 3093470 - RNA, 16 nt, Mycobacterium bovis subsp bovis AF2122/97
ggccaggucgacgggc

SEQ ID NO: 3093471 - RNA, 15 nt, Mycobacterium bovis subsp bovis AF2122/97
ggccaggucgagcac

SEQ ID NO: 3093472 - RNA, 16 nt, Mycobacterium bovis subsp bovis AF2122/97
ggccaggucgagcacc

SEQ ID NO: 3093473 - RNA, 18 nt, Mycobacterium bovis subsp bovis AF2122/97
ggccaggucgagcaccgg

SEQ ID NO: 3093474 - RNA, 19 nt, Mycobacterium bovis subsp bovis AF2122/97
ggccaggucgagcaccggc

SEQ ID NO: 3093475 - RNA, 14 nt, Mycobacterium bovis subsp bovis AF2122/97
ggccaggucggcca

SEQ ID NO: 3093476 - RNA, 17 nt, Mycobacterium bovis subsp bovis AF2122/97
ggccaggucggccaccg

SEQ ID NO: 3093477 - RNA, 15 nt, Mycobacterium bovis subsp bovis AF2122/97
ggccaggucggcgau

SEQ ID NO: 3093478 - RNA, 14 nt, Mycobacterium bovis subsp bovis AF2122/97
ggccaggugcaggc

SEQ ID NO: 3093479 - RNA, 15 nt, Mycobacterium bovis subsp bovis AF2122/97
ggccaggugcagggu

SEQ ID NO: 3093480 - RNA, 16 nt, Mycobacterium bovis subsp bovis AF2122/97
ggccagguggcgagcg

SEQ ID NO: 3093481 - RNA, 17 nt, Mycobacterium bovis subsp bovis AF2122/97
ggccagguguugacgau

SEQ ID NO: 3093482 - RNA, 14 nt, Mycobacterium bovis subsp bovis AF2122/97
ggccagguugaucg

SEQ ID NO: 3093483 - RNA, 17 nt, Mycobacterium bovis subsp bovis AF2122/97
ggccagguugccgucgg

SEQ ID NO: 3093484 - RNA, 18 nt, Mycobacterium bovis subsp bovis AF2122/97
ggccagguugccgucggc

SEQ ID NO: 3093485 - RNA, 20 nt, Mycobacterium bovis subsp bovis AF2122/97
ggccagguuguagacggcac

SEQ ID NO: 3093486 - RNA, 21 nt, Mycobacterium bovis subsp bovis AF2122/97
ggccagguuguagacggcacc

SEQ ID NO: 3093487 - RNA, 22 nt, Mycobacterium bovis subsp bovis AF2122/97
ggccagguuguagacggcaccc

SEQ ID NO: 3093488 - RNA, 14 nt, Mycobacterium bovis subsp bovis AF2122/97
ggccaguacgucga

SEQ ID NO: 3093489 - RNA, 16 nt, Mycobacterium bovis subsp bovis AF2122/97
ggccaguacgucgauc

SEQ ID NO: 3093490 - RNA, 22 nt, Mycobacterium bovis subsp bovis AF2122/97
ggccaguaugcggugcccgccc

SEQ ID NO: 3093491 - RNA, 21 nt, Mycobacterium bovis subsp bovis AF2122/97
ggccagucaggaaaccggcgc

SEQ ID NO: 3093492 - RNA, 22 nt, Mycobacterium bovis subsp bovis AF2122/97
ggccaguccgaaagccgccgag

SEQ ID NO: 3093493 - RNA, 17 nt, Mycobacterium bovis subsp bovis AF2122/97
ggccagucgaaucguca

SEQ ID NO: 3093494 - RNA, 14 nt, Mycobacterium bovis subsp bovis AF2122/97
ggccagucgugcuu

SEQ ID NO: 3093495 - RNA, 18 nt, Mycobacterium bovis subsp bovis AF2122/97
ggccagucgugcuugccc

SEQ ID NO: 3093496 - RNA, 19 nt, Mycobacterium bovis subsp bovis AF2122/97
ggccagugaaaccaccggc

SEQ ID NO: 3093497 - RNA, 24 nt, Mycobacterium bovis subsp bovis AF2122/97
ggccagugaaaccaccggccgucc

SEQ ID NO: 3093498 - RNA, 13 nt, Mycobacterium bovis subsp bovis AF2122/97
ggccagugccacc

SEQ ID NO: 3093499 - RNA, 19 nt, Mycobacterium bovis subsp bovis AF2122/97
ggccagugccaucgccaug

SEQ ID NO: 3093500 - RNA, 17 nt, Mycobacterium bovis subsp bovis AF2122/97
ggccagugucagcacga

SEQ ID NO: 3093501 - RNA, 21 nt, Mycobacterium bovis subsp bovis AF2122/97
ggccagugucagcacgacgac

SEQ ID NO: 3093502 - RNA, 22 nt, Mycobacterium bovis subsp bovis AF2122/97
ggccagugucagcacgacgaca

SEQ ID NO: 3093503 - RNA, 17 nt, Mycobacterium bovis subsp bovis AF2122/97
ggccaguucggcggccg

SEQ ID NO: 3093504 - RNA, 21 nt, Mycobacterium bovis subsp bovis AF2122/97
ggccaguucggcggccgccgc

SEQ ID NO: 3093505 - RNA, 16 nt, Mycobacterium bovis subsp bovis AF2122/97
ggccaguucggugagc

SEQ ID NO: 3093506 - RNA, 22 nt, Mycobacterium bovis subsp bovis AF2122/97
ggccaguugcacaucggugguu

SEQ ID NO: 3093507 - RNA, 18 nt, Mycobacterium bovis subsp bovis AF2122/97
ggccaguuggccggccag

SEQ ID NO: 3093508 - RNA, 20 nt, Mycobacterium bovis subsp bovis AF2122/97
ggccaguugguagccgcccu

SEQ ID NO: 3093509 - RNA, 14 nt, Mycobacterium bovis subsp bovis AF2122/97
ggccauacgcgcgc

SEQ ID NO: 3093510 - RNA, 22 nt, Mycobacterium bovis subsp bovis AF2122/97
ggccauagugaggccgaccagc

SEQ ID NO: 3093511 - RNA, 23 nt, Mycobacterium bovis subsp bovis AF2122/97
ggccauagugaggccgaccagca

SEQ ID NO: 3093512 - RNA, 20 nt, Mycobacterium bovis subsp bovis AF2122/97
ggccauauugggaguccggc

SEQ ID NO: 3093513 - RNA, 19 nt, Mycobacterium bovis subsp bovis AF2122/97
ggccaucacggcggggauc

SEQ ID NO: 3093514 - RNA, 16 nt, Mycobacterium bovis subsp bovis AF2122/97
ggccaucacggucagc

SEQ ID NO: 3093515 - RNA, 17 nt, Mycobacterium bovis subsp bovis AF2122/97
ggccaucacggucagcu

SEQ ID NO: 3093516 - RNA, 20 nt, Mycobacterium bovis subsp bovis AF2122/97
ggccaucaucgacggugauc

SEQ ID NO: 3093517 - RNA, 15 nt, Mycobacterium bovis subsp bovis AF2122/97
ggccauccaccgcag

SEQ ID NO: 3093518 - RNA, 18 nt, Mycobacterium bovis subsp bovis AF2122/97
ggccaucccgcguucgag

SEQ ID NO: 3093519 - RNA, 13 nt, Mycobacterium bovis subsp bovis AF2122/97
ggccaucccggcc

SEQ ID NO: 3093520 - RNA, 17 nt, Mycobacterium bovis subsp bovis AF2122/97
ggccaucccggccucca

SEQ ID NO: 3093521 - RNA, 23 nt, Mycobacterium bovis subsp bovis AF2122/97
ggccauccgaucacgacguugcc

SEQ ID NO: 3093522 - RNA, 16 nt, Mycobacterium bovis subsp bovis AF2122/97
ggccaucgagggcauc

SEQ ID NO: 3093523 - RNA, 17 nt, Mycobacterium bovis subsp bovis AF2122/97
ggccaucgcauccccag

SEQ ID NO: 3093524 - RNA, 20 nt, Mycobacterium bovis subsp bovis AF2122/97
ggccaucgcauccccagcac

SEQ ID NO: 3093525 - RNA, 20 nt, Mycobacterium bovis subsp bovis AF2122/97
ggccaucgcccggaugaucc

SEQ ID NO: 3093526 - RNA, 22 nt, Mycobacterium bovis subsp bovis AF2122/97
ggccaucgccgacacccucggg

SEQ ID NO: 3093527 - RNA, 18 nt, Mycobacterium bovis subsp bovis AF2122/97
ggccaucgggauggacac

SEQ ID NO: 3093528 - RNA, 14 nt, Mycobacterium bovis subsp bovis AF2122/97
ggccaucgucagga

SEQ ID NO: 3093529 - RNA, 13 nt, Mycobacterium bovis subsp bovis AF2122/97
ggccaucguccag

SEQ ID NO: 3093530 - RNA, 18 nt, Mycobacterium bovis subsp bovis AF2122/97
ggccaucgugcggcacuc

SEQ ID NO: 3093531 - RNA, 19 nt, Mycobacterium bovis subsp bovis AF2122/97
ggccaucgugcggcacucc

SEQ ID NO: 3093532 - RNA, 19 nt, Mycobacterium bovis subsp bovis AF2122/97
ggccaucucgucgaugucg

SEQ ID NO: 3093533 - RNA, 22 nt, Mycobacterium bovis subsp bovis AF2122/97
ggccaucugauccggugccgcg

SEQ ID NO: 3093534 - RNA, 23 nt, Mycobacterium bovis subsp bovis AF2122/97
ggccaugaucacaccgcugcuag

SEQ ID NO: 3093535 - RNA, 12 nt, Mycobacterium bovis subsp bovis AF2122/97
ggccaugaugau

SEQ ID NO: 3093536 - RNA, 13 nt, Mycobacterium bovis subsp bovis AF2122/97
ggccaugaugaug

SEQ ID NO: 3093537 - RNA, 20 nt, Mycobacterium bovis subsp bovis AF2122/97
ggccaugcuaggaccaccag

SEQ ID NO: 3093538 - RNA, 21 nt, Mycobacterium bovis subsp bovis AF2122/97
ggccaugcuaggaccaccagc

SEQ ID NO: 3093539 - RNA, 14 nt, Mycobacterium bovis subsp bovis AF2122/97
ggccaugcucgcca

SEQ ID NO: 3093540 - RNA, 20 nt, Mycobacterium bovis subsp bovis AF2122/97
ggccaugcuggucagcggcg

SEQ ID NO: 3093541 - RNA, 21 nt, Mycobacterium bovis subsp bovis AF2122/97
ggccauggacgccauggugaa

SEQ ID NO: 3093542 - RNA, 15 nt, Mycobacterium bovis subsp bovis AF2122/97
ggccauggcgcgcaa

SEQ ID NO: 3093543 - RNA, 14 nt, Mycobacterium bovis subsp bovis AF2122/97
ggccauggcggcgc

SEQ ID NO: 3093544 - RNA, 15 nt, Mycobacterium bovis subsp bovis AF2122/97
ggccauggcggcgcc

SEQ ID NO: 3093545 - RNA, 22 nt, Mycobacterium bovis subsp bovis AF2122/97
ggccaugguguucggcagcgcg

SEQ ID NO: 3093546 - RNA, 17 nt, Mycobacterium bovis subsp bovis AF2122/97
ggccaugucagcggccu

SEQ ID NO: 3093547 - RNA, 16 nt, Mycobacterium bovis subsp bovis AF2122/97
ggccauguccaccagc

SEQ ID NO: 3093548 - RNA, 16 nt, Mycobacterium bovis subsp bovis AF2122/97
ggccauguggacggca

SEQ ID NO: 3093549 - RNA, 17 nt, Mycobacterium bovis subsp bovis AF2122/97
ggccauguggacggcau

SEQ ID NO: 3093550 - RNA, 15 nt, Mycobacterium bovis subsp bovis AF2122/97
ggccauguugccgug

SEQ ID NO: 3093551 - RNA, 19 nt, Mycobacterium bovis subsp bovis AF2122/97
ggccauuagcagcacccgg

SEQ ID NO: 3093552 - RNA, 18 nt, Mycobacterium bovis subsp bovis AF2122/97
ggccauucuuggugaucg

SEQ ID NO: 3093553 - RNA, 22 nt, Mycobacterium bovis subsp bovis AF2122/97
ggccauucuuggugaucgcgaa

SEQ ID NO: 3093554 - RNA, 16 nt, Mycobacterium bovis subsp bovis AF2122/97
ggcccaacaccgccag

SEQ ID NO: 3093555 - RNA, 17 nt, Mycobacterium bovis subsp bovis AF2122/97
ggcccaacaccgccaga

SEQ ID NO: 3093556 - RNA, 15 nt, Mycobacterium bovis subsp bovis AF2122/97
ggcccaaccggucgu

SEQ ID NO: 3093557 - RNA, 17 nt, Mycobacterium bovis subsp bovis AF2122/97
ggcccaacgacggcaac

SEQ ID NO: 3093558 - RNA, 16 nt, Mycobacterium bovis subsp bovis AF2122/97
ggcccacaccagcgca

SEQ ID NO: 3093559 - RNA, 18 nt, Mycobacterium bovis subsp bovis AF2122/97
ggcccacaccagcgcagc

SEQ ID NO: 3093560 - RNA, 22 nt, Mycobacterium bovis subsp bovis AF2122/97
ggcccacacggucgucgcgagc

SEQ ID NO: 3093561 - RNA, 21 nt, Mycobacterium bovis subsp bovis AF2122/97
ggcccacacggugcgauuccg

SEQ ID NO: 3093562 - RNA, 14 nt, Mycobacterium bovis subsp bovis AF2122/97
ggcccaccagcgca

SEQ ID NO: 3093563 - RNA, 17 nt, Mycobacterium bovis subsp bovis AF2122/97
ggcccaccagcgcagcc

SEQ ID NO: 3093564 - RNA, 19 nt, Mycobacterium bovis subsp bovis AF2122/97
ggcccaccagcgcagccga

SEQ ID NO: 3093565 - RNA, 14 nt, Mycobacterium bovis subsp bovis AF2122/97
ggcccaccaggccc

SEQ ID NO: 3093566 - RNA, 20 nt, Mycobacterium bovis subsp bovis AF2122/97
ggcccaccgccguugggccg

SEQ ID NO: 3093567 - RNA, 21 nt, Mycobacterium bovis subsp bovis AF2122/97
ggcccaccgccguugggccgc

SEQ ID NO: 3093568 - RNA, 18 nt, Mycobacterium bovis subsp bovis AF2122/97
ggcccaccgcugcggcac

SEQ ID NO: 3093569 - RNA, 19 nt, Mycobacterium bovis subsp bovis AF2122/97
ggcccaccggucgcgcauu

SEQ ID NO: 3093570 - RNA, 23 nt, Mycobacterium bovis subsp bovis AF2122/97
ggcccacgcgcacucgaccagga

SEQ ID NO: 3093571 - RNA, 12 nt, Mycobacterium bovis subsp bovis AF2122/97
ggcccacggcag

SEQ ID NO: 3093572 - RNA, 16 nt, Mycobacterium bovis subsp bovis AF2122/97
ggcccacggcagcgcc

SEQ ID NO: 3093573 - RNA, 18 nt, Mycobacterium bovis subsp bovis AF2122/97
ggcccacggcgaccagga

SEQ ID NO: 3093574 - RNA, 19 nt, Mycobacterium bovis subsp bovis AF2122/97
ggcccacucucgccacgcc

SEQ ID NO: 3093575 - RNA, 22 nt, Mycobacterium bovis subsp bovis AF2122/97
ggcccacucucgccacgccgug

SEQ ID NO: 3093576 - RNA, 18 nt, Mycobacterium bovis subsp bovis AF2122/97
ggcccagcaaccgcucgg

SEQ ID NO: 3093577 - RNA, 19 nt, Mycobacterium bovis subsp bovis AF2122/97
ggcccagcaaccgcucggc

SEQ ID NO: 3093578 - RNA, 20 nt, Mycobacterium bovis subsp bovis AF2122/97
ggcccagcaaccgcucggcg

SEQ ID NO: 3093579 - RNA, 23 nt, Mycobacterium bovis subsp bovis AF2122/97
ggcccagcaaccgcucggcgaug

SEQ ID NO: 3093580 - RNA, 20 nt, Mycobacterium bovis subsp bovis AF2122/97
ggcccagcaggucgucggcg

SEQ ID NO: 3093581 - RNA, 14 nt, Mycobacterium bovis subsp bovis AF2122/97
ggcccagccgagcg

SEQ ID NO: 3093582 - RNA, 17 nt, Mycobacterium bovis subsp bovis AF2122/97
ggcccagccgagcggcg

SEQ ID NO: 3093583 - RNA, 19 nt, Mycobacterium bovis subsp bovis AF2122/97
ggcccagccgagcggcggc

SEQ ID NO: 3093584 - RNA, 20 nt, Mycobacterium bovis subsp bovis AF2122/97
ggcccagccgagcggcggca

SEQ ID NO: 3093585 - RNA, 21 nt, Mycobacterium bovis subsp bovis AF2122/97
ggcccagcgcccccagcagcu

SEQ ID NO: 3093586 - RNA, 11 nt, Mycobacterium bovis subsp bovis AF2122/97
ggcccagcgcg

SEQ ID NO: 3093587 - RNA, 12 nt, Mycobacterium bovis subsp bovis AF2122/97
ggcccagcgcgc

SEQ ID NO: 3093588 - RNA, 13 nt, Mycobacterium bovis subsp bovis AF2122/97
ggcccagcggccg

SEQ ID NO: 3093589 - RNA, 15 nt, Mycobacterium bovis subsp bovis AF2122/97
ggcccagcggccgcg

SEQ ID NO: 3093590 - RNA, 22 nt, Mycobacterium bovis subsp bovis AF2122/97
ggcccaggacagcagccgccgg

SEQ ID NO: 3093591 - RNA, 21 nt, Mycobacterium bovis subsp bovis AF2122/97
ggcccaggagauccaccgguc

SEQ ID NO: 3093592 - RNA, 22 nt, Mycobacterium bovis subsp bovis AF2122/97
ggcccaggagauccaccggucc

SEQ ID NO: 3093593 - RNA, 22 nt, Mycobacterium bovis subsp bovis AF2122/97
ggcccagguccgcgugcugccg

SEQ ID NO: 3093594 - RNA, 16 nt, Mycobacterium bovis subsp bovis AF2122/97
ggcccagguugccuug

SEQ ID NO: 3093595 - RNA, 22 nt, Mycobacterium bovis subsp bovis AF2122/97
ggcccagguugccuuggcggcc

SEQ ID NO: 3093596 - RNA, 22 nt, Mycobacterium bovis subsp bovis AF2122/97
ggcccagugggacaggucggca

SEQ ID NO: 3093597 - RNA, 20 nt, Mycobacterium bovis subsp bovis AF2122/97
ggcccagugggacuggcgug

SEQ ID NO: 3093598 - RNA, 17 nt, Mycobacterium bovis subsp bovis AF2122/97
ggcccauaacagcuggc

SEQ ID NO: 3093599 - RNA, 18 nt, Mycobacterium bovis subsp bovis AF2122/97
ggcccauaacagcuggcg

SEQ ID NO: 3093600 - RNA, 15 nt, Mycobacterium bovis subsp bovis AF2122/97
ggcccauacgugccg

SEQ ID NO: 3093601 - RNA, 23 nt, Mycobacterium bovis subsp bovis AF2122/97
ggcccaucgcgacuagacgccgc

SEQ ID NO: 3093602 - RNA, 17 nt, Mycobacterium bovis subsp bovis AF2122/97
ggcccaugcagcggcga

SEQ ID NO: 3093603 - RNA, 22 nt, Mycobacterium bovis subsp bovis AF2122/97
ggccccaagcgugcugccgccu

SEQ ID NO: 3093604 - RNA, 23 nt, Mycobacterium bovis subsp bovis AF2122/97
ggccccaagcgugcugccgccuu

SEQ ID NO: 3093605 - RNA, 16 nt, Mycobacterium bovis subsp bovis AF2122/97
ggccccaccgacagcc

SEQ ID NO: 3093606 - RNA, 13 nt, Mycobacterium bovis subsp bovis AF2122/97
ggccccaccggca

SEQ ID NO: 3093607 - RNA, 13 nt, Mycobacterium bovis subsp bovis AF2122/97
ggccccaccggua

SEQ ID NO: 3093608 - RNA, 13 nt, Mycobacterium bovis subsp bovis AF2122/97
ggccccaccggug

SEQ ID NO: 3093609 - RNA, 14 nt, Mycobacterium bovis subsp bovis AF2122/97
ggccccaccggugc

SEQ ID NO: 3093610 - RNA, 13 nt, Mycobacterium bovis subsp bovis AF2122/97
ggccccacggcgg

SEQ ID NO: 3093611 - RNA, 20 nt, Mycobacterium bovis subsp bovis AF2122/97
ggccccacuggugcagcgcc

SEQ ID NO: 3093612 - RNA, 13 nt, Mycobacterium bovis subsp bovis AF2122/97
ggccccaggggca

SEQ ID NO: 3093613 - RNA, 13 nt, Mycobacterium bovis subsp bovis AF2122/97
ggccccaugcgcc

SEQ ID NO: 3093614 - RNA, 17 nt, Mycobacterium bovis subsp bovis AF2122/97
ggcccccaagaccaagu

SEQ ID NO: 3093615 - RNA, 11 nt, Mycobacterium bovis subsp bovis AF2122/97
ggccccccgcg

SEQ ID NO: 3093616 - RNA, 17 nt, Mycobacterium bovis subsp bovis AF2122/97
ggccccccgcgccugcc

SEQ ID NO: 3093617 - RNA, 19 nt, Mycobacterium bovis subsp bovis AF2122/97
ggccccccgcgccugccuc

SEQ ID NO: 3093618 - RNA, 20 nt, Mycobacterium bovis subsp bovis AF2122/97
ggccccccgcgccugccuca

SEQ ID NO: 3093619 - RNA, 16 nt, Mycobacterium bovis subsp bovis AF2122/97
ggccccccggggccgc

SEQ ID NO: 3093620 - RNA, 17 nt, Mycobacterium bovis subsp bovis AF2122/97
ggccccccggggccgca

SEQ ID NO: 3093621 - RNA, 20 nt, Mycobacterium bovis subsp bovis AF2122/97
ggccccccggggccgcaacc

SEQ ID NO: 3093622 - RNA, 18 nt, Mycobacterium bovis subsp bovis AF2122/97
ggcccccgaggcuggcau

SEQ ID NO: 3093623 - RNA, 13 nt, Mycobacterium bovis subsp bovis AF2122/97
ggcccccggcagc

SEQ ID NO: 3093624 - RNA, 16 nt, Mycobacterium bovis subsp bovis AF2122/97
ggcccccucggcguga

SEQ ID NO: 3093625 - RNA, 19 nt, Mycobacterium bovis subsp bovis AF2122/97
ggccccgaaacgauggccg

SEQ ID NO: 3093626 - RNA, 20 nt, Mycobacterium bovis subsp bovis AF2122/97
ggccccgaaacgauggccgg

SEQ ID NO: 3093627 - RNA, 20 nt, Mycobacterium bovis subsp bovis AF2122/97
ggccccgacacagcggcggg

SEQ ID NO: 3093628 - RNA, 23 nt, Mycobacterium bovis subsp bovis AF2122/97
ggccccgacauacgucggggccg

SEQ ID NO: 3093629 - RNA, 21 nt, Mycobacterium bovis subsp bovis AF2122/97
ggccccgacggucaacgacau

SEQ ID NO: 3093630 - RNA, 14 nt, Mycobacterium bovis subsp bovis AF2122/97
ggccccgacugccg

SEQ ID NO: 3093631 - RNA, 20 nt, Mycobacterium bovis subsp bovis AF2122/97
ggccccgccaaaccuggguu

SEQ ID NO: 3093632 - RNA, 16 nt, Mycobacterium bovis subsp bovis AF2122/97
ggccccgccagcgccg

SEQ ID NO: 3093633 - RNA, 21 nt, Mycobacterium bovis subsp bovis AF2122/97
ggccccgccagcgccgccgag

SEQ ID NO: 3093634 - RNA, 16 nt, Mycobacterium bovis subsp bovis AF2122/97
ggccccgccagcggca

SEQ ID NO: 3093635 - RNA, 19 nt, Mycobacterium bovis subsp bovis AF2122/97
ggccccgccagcggcagcg

SEQ ID NO: 3093636 - RNA, 19 nt, Mycobacterium bovis subsp bovis AF2122/97
ggccccgcccgcgcggugg

SEQ ID NO: 3093637 - RNA, 21 nt, Mycobacterium bovis subsp bovis AF2122/97
ggccccgcccgcgcgguggcg

SEQ ID NO: 3093638 - RNA, 12 nt, Mycobacterium bovis subsp bovis AF2122/97
ggccccgccgau

SEQ ID NO: 3093639 - RNA, 16 nt, Mycobacterium bovis subsp bovis AF2122/97
ggccccgccgaugccg

SEQ ID NO: 3093640 - RNA, 18 nt, Mycobacterium bovis subsp bovis AF2122/97
ggccccgccgaugccgcc

SEQ ID NO: 3093641 - RNA, 19 nt, Mycobacterium bovis subsp bovis AF2122/97
ggccccgccgaugccgccg

SEQ ID NO: 3093642 - RNA, 15 nt, Mycobacterium bovis subsp bovis AF2122/97
ggccccgccgaugcg

SEQ ID NO: 3093643 - RNA, 16 nt, Mycobacterium bovis subsp bovis AF2122/97
ggccccgccgauggag

SEQ ID NO: 3093644 - RNA, 17 nt, Mycobacterium bovis subsp bovis AF2122/97
ggccccgccggccccgc

SEQ ID NO: 3093645 - RNA, 15 nt, Mycobacterium bovis subsp bovis AF2122/97
ggccccgccggcgcc

SEQ ID NO: 3093646 - RNA, 17 nt, Mycobacterium bovis subsp bovis AF2122/97
ggccccgccggcgccgc

SEQ ID NO: 3093647 - RNA, 19 nt, Mycobacterium bovis subsp bovis AF2122/97
ggccccgccgguggccgcg

SEQ ID NO: 3093648 - RNA, 15 nt, Mycobacterium bovis subsp bovis AF2122/97
ggccccgccgucacc

SEQ ID NO: 3093649 - RNA, 22 nt, Mycobacterium bovis subsp bovis AF2122/97
ggccccgccgucacccccgaua

SEQ ID NO: 3093650 - RNA, 15 nt, Mycobacterium bovis subsp bovis AF2122/97
ggccccgccgucgcc

SEQ ID NO: 3093651 - RNA, 16 nt, Mycobacterium bovis subsp bovis AF2122/97
ggccccgccgucgccg

SEQ ID NO: 3093652 - RNA, 20 nt, Mycobacterium bovis subsp bovis AF2122/97
ggccccgccgucgccgccgg

SEQ ID NO: 3093653 - RNA, 23 nt, Mycobacterium bovis subsp bovis AF2122/97
ggccccgccgucgccgccggcuc

SEQ ID NO: 3093654 - RNA, 15 nt, Mycobacterium bovis subsp bovis AF2122/97
ggccccgccguugcc

SEQ ID NO: 3093655 - RNA, 18 nt, Mycobacterium bovis subsp bovis AF2122/97
ggccccgccguugccgcc

SEQ ID NO: 3093656 - RNA, 19 nt, Mycobacterium bovis subsp bovis AF2122/97
ggccccgccguugccgccg

SEQ ID NO: 3093657 - RNA, 20 nt, Mycobacterium bovis subsp bovis AF2122/97
ggccccgccguugccgccga

SEQ ID NO: 3093658 - RNA, 23 nt, Mycobacterium bovis subsp bovis AF2122/97
ggccccgccguuuccgccgccgc

SEQ ID NO: 3093659 - RNA, 12 nt, Mycobacterium bovis subsp bovis AF2122/97
ggccccgcgcca

SEQ ID NO: 3093660 - RNA, 13 nt, Mycobacterium bovis subsp bovis AF2122/97
ggccccgcggagc

SEQ ID NO: 3093661 - RNA, 15 nt, Mycobacterium bovis subsp bovis AF2122/97
ggccccgcggccagc

SEQ ID NO: 3093662 - RNA, 22 nt, Mycobacterium bovis subsp bovis AF2122/97
ggccccgcggccagcaccgggg

SEQ ID NO: 3093663 - RNA, 14 nt, Mycobacterium bovis subsp bovis AF2122/97
ggccccgcggcgcc

SEQ ID NO: 3093664 - RNA, 15 nt, Mycobacterium bovis subsp bovis AF2122/97
ggccccgcggcgccg

SEQ ID NO: 3093665 - RNA, 20 nt, Mycobacterium bovis subsp bovis AF2122/97
ggccccgcggcgccgccacg

SEQ ID NO: 3093666 - RNA, 20 nt, Mycobacterium bovis subsp bovis AF2122/97
ggccccggcauugcccgagc

SEQ ID NO: 3093667 - RNA, 14 nt, Mycobacterium bovis subsp bovis AF2122/97
ggccccggcucucu

SEQ ID NO: 3093668 - RNA, 19 nt, Mycobacterium bovis subsp bovis AF2122/97
ggccccgggggaagcgcca

SEQ ID NO: 3093669 - RNA, 20 nt, Mycobacterium bovis subsp bovis AF2122/97
ggccccguccgauuucccag

SEQ ID NO: 3093670 - RNA, 12 nt, Mycobacterium bovis subsp bovis AF2122/97
ggccccgucgcc

SEQ ID NO: 3093671 - RNA, 15 nt, Mycobacterium bovis subsp bovis AF2122/97
ggccccgucgccgau

SEQ ID NO: 3093672 - RNA, 16 nt, Mycobacterium bovis subsp bovis AF2122/97
ggccccgucgccgauc

SEQ ID NO: 3093673 - RNA, 17 nt, Mycobacterium bovis subsp bovis AF2122/97
ggccccguucgccaggc

SEQ ID NO: 3093674 - RNA, 18 nt, Mycobacterium bovis subsp bovis AF2122/97
ggccccguucgccaggcc

SEQ ID NO: 3093675 - RNA, 17 nt, Mycobacterium bovis subsp bovis AF2122/97
ggccccugccacgacga

SEQ ID NO: 3093676 - RNA, 18 nt, Mycobacterium bovis subsp bovis AF2122/97
ggccccuugaccgcugcc

SEQ ID NO: 3093677 - RNA, 21 nt, Mycobacterium bovis subsp bovis AF2122/97
ggcccgaaaugccgggcccga

SEQ ID NO: 3093678 - RNA, 12 nt, Mycobacterium bovis subsp bovis AF2122/97
ggcccgacacgg

SEQ ID NO: 3093679 - RNA, 14 nt, Mycobacterium bovis subsp bovis AF2122/97
ggcccgacacggcg

SEQ ID NO: 3093680 - RNA, 16 nt, Mycobacterium bovis subsp bovis AF2122/97
ggcccgacacggcggc

SEQ ID NO: 3093681 - RNA, 21 nt, Mycobacterium bovis subsp bovis AF2122/97
ggcccgacccggccgauggug

SEQ ID NO: 3093682 - RNA, 19 nt, Mycobacterium bovis subsp bovis AF2122/97
ggcccgaccgggaaccacg

SEQ ID NO: 3093683 - RNA, 13 nt, Mycobacterium bovis subsp bovis AF2122/97
ggcccgacgacga

SEQ ID NO: 3093684 - RNA, 17 nt, Mycobacterium bovis subsp bovis AF2122/97
ggcccgacgacgacguu

SEQ ID NO: 3093685 - RNA, 15 nt, Mycobacterium bovis subsp bovis AF2122/97
ggcccgacggcgccc

SEQ ID NO: 3093686 - RNA, 18 nt, Mycobacterium bovis subsp bovis AF2122/97
ggcccgacggcgcccagc

SEQ ID NO: 3093687 - RNA, 22 nt, Mycobacterium bovis subsp bovis AF2122/97
ggcccgacggguaucccguccc

SEQ ID NO: 3093688 - RNA, 15 nt, Mycobacterium bovis subsp bovis AF2122/97
ggcccgagaagcguu

SEQ ID NO: 3093689 - RNA, 17 nt, Mycobacterium bovis subsp bovis AF2122/97
ggcccgagcgcgcgcug

SEQ ID NO: 3093690 - RNA, 19 nt, Mycobacterium bovis subsp bovis AF2122/97
ggcccgaggugccggggcc

SEQ ID NO: 3093691 - RNA, 22 nt, Mycobacterium bovis subsp bovis AF2122/97
ggcccgaggugccggggcccca

SEQ ID NO: 3093692 - RNA, 17 nt, Mycobacterium bovis subsp bovis AF2122/97
ggcccgaguuaccggug

SEQ ID NO: 3093693 - RNA, 18 nt, Mycobacterium bovis subsp bovis AF2122/97
ggcccgaguuaccgguga

SEQ ID NO: 3093694 - RNA, 21 nt, Mycobacterium bovis subsp bovis AF2122/97
ggcccgaguuggcgaagcccg

SEQ ID NO: 3093695 - RNA, 23 nt, Mycobacterium bovis subsp bovis AF2122/97
ggcccgauaaaugccgcgugggc

SEQ ID NO: 3093696 - RNA, 16 nt, Mycobacterium bovis subsp bovis AF2122/97
ggcccgaucaccagcc

SEQ ID NO: 3093697 - RNA, 15 nt, Mycobacterium bovis subsp bovis AF2122/97
ggcccgaucaccauc

SEQ ID NO: 3093698 - RNA, 12 nt, Mycobacterium bovis subsp bovis AF2122/97
ggcccgauccag

SEQ ID NO: 3093699 - RNA, 22 nt, Mycobacterium bovis subsp bovis AF2122/97
ggcccgauccagugguaggccg

SEQ ID NO: 3093700 - RNA, 15 nt, Mycobacterium bovis subsp bovis AF2122/97
ggcccgaucggcaac

SEQ ID NO: 3093701 - RNA, 21 nt, Mycobacterium bovis subsp bovis AF2122/97
ggcccgaucggcaacccgcac

SEQ ID NO: 3093702 - RNA, 15 nt, Mycobacterium bovis subsp bovis AF2122/97
ggcccgaugaccggu

SEQ ID NO: 3093703 - RNA, 22 nt, Mycobacterium bovis subsp bovis AF2122/97
ggcccgaugccgaggaucgcgc

SEQ ID NO: 3093704 - RNA, 14 nt, Mycobacterium bovis subsp bovis AF2122/97
ggcccgcaacgcgu

SEQ ID NO: 3093705 - RNA, 21 nt, Mycobacterium bovis subsp bovis AF2122/97
ggcccgcaacgcgucggucgc

SEQ ID NO: 3093706 - RNA, 18 nt, Mycobacterium bovis subsp bovis AF2122/97
ggcccgcacccguccggc

SEQ ID NO: 3093707 - RNA, 22 nt, Mycobacterium bovis subsp bovis AF2122/97
ggcccgcaccgcugaccccggc

SEQ ID NO: 3093708 - RNA, 16 nt, Mycobacterium bovis subsp bovis AF2122/97
ggcccgcacguuggcg

SEQ ID NO: 3093709 - RNA, 19 nt, Mycobacterium bovis subsp bovis AF2122/97
ggcccgcacguuggcggcc

SEQ ID NO: 3093710 - RNA, 13 nt, Mycobacterium bovis subsp bovis AF2122/97
ggcccgcagcagc

SEQ ID NO: 3093711 - RNA, 14 nt, Mycobacterium bovis subsp bovis AF2122/97
ggcccgcagcagca

SEQ ID NO: 3093712 - RNA, 14 nt, Mycobacterium bovis subsp bovis AF2122/97
ggcccgcagcccgc

SEQ ID NO: 3093713 - RNA, 18 nt, Mycobacterium bovis subsp bovis AF2122/97
ggcccgcagcccgccggg

SEQ ID NO: 3093714 - RNA, 22 nt, Mycobacterium bovis subsp bovis AF2122/97
ggcccgcauccgcaccgaaacc

SEQ ID NO: 3093715 - RNA, 20 nt, Mycobacterium bovis subsp bovis AF2122/97
ggcccgcaugccggcgcacc

SEQ ID NO: 3093716 - RNA, 22 nt, Mycobacterium bovis subsp bovis AF2122/97
ggcccgccaaaaacgccccggc

SEQ ID NO: 3093717 - RNA, 22 nt, Mycobacterium bovis subsp bovis AF2122/97
ggcccgccacaacggcggcgca

SEQ ID NO: 3093718 - RNA, 11 nt, Mycobacterium bovis subsp bovis AF2122/97
ggcccgccacg

SEQ ID NO: 3093719 - RNA, 20 nt, Mycobacterium bovis subsp bovis AF2122/97
ggcccgccagaacggcgucg

SEQ ID NO: 3093720 - RNA, 18 nt, Mycobacterium bovis subsp bovis AF2122/97
ggcccgccagcagggcca

SEQ ID NO: 3093721 - RNA, 13 nt, Mycobacterium bovis subsp bovis AF2122/97
ggcccgccagccc

SEQ ID NO: 3093722 - RNA, 16 nt, Mycobacterium bovis subsp bovis AF2122/97
ggcccgccagcccagc

SEQ ID NO: 3093723 - RNA, 20 nt, Mycobacterium bovis subsp bovis AF2122/97
ggcccgccaucauggcggcc

SEQ ID NO: 3093724 - RNA, 21 nt, Mycobacterium bovis subsp bovis AF2122/97
ggcccgccaucauggcggccc

SEQ ID NO: 3093725 - RNA, 19 nt, Mycobacterium bovis subsp bovis AF2122/97
ggcccgcccguagacccac

SEQ ID NO: 3093726 - RNA, 21 nt, Mycobacterium bovis subsp bovis AF2122/97
ggcccgcccguagacccacag

SEQ ID NO: 3093727 - RNA, 19 nt, Mycobacterium bovis subsp bovis AF2122/97
ggcccgccgaguucugcug

SEQ ID NO: 3093728 - RNA, 20 nt, Mycobacterium bovis subsp bovis AF2122/97
ggcccgccggccccgccggc

SEQ ID NO: 3093729 - RNA, 21 nt, Mycobacterium bovis subsp bovis AF2122/97
ggcccgccggccccgccggcc

SEQ ID NO: 3093730 - RNA, 14 nt, Mycobacterium bovis subsp bovis AF2122/97
ggcccgccgucacc

SEQ ID NO: 3093731 - RNA, 17 nt, Mycobacterium bovis subsp bovis AF2122/97
ggcccgccugaccgcca

SEQ ID NO: 3093732 - RNA, 20 nt, Mycobacterium bovis subsp bovis AF2122/97
ggcccgcgagauagcaccag

SEQ ID NO: 3093733 - RNA, 23 nt, Mycobacterium bovis subsp bovis AF2122/97
ggcccgcgcgagagccuccaugg

SEQ ID NO: 3093734 - RNA, 12 nt, Mycobacterium bovis subsp bovis AF2122/97
ggcccgcgcggc

SEQ ID NO: 3093735 - RNA, 13 nt, Mycobacterium bovis subsp bovis AF2122/97
ggcccgcgcggcg

SEQ ID NO: 3093736 - RNA, 13 nt, Mycobacterium bovis subsp bovis AF2122/97
ggcccgcgggauc

SEQ ID NO: 3093737 - RNA, 15 nt, Mycobacterium bovis subsp bovis AF2122/97
ggcccgcggucgcga

SEQ ID NO: 3093738 - RNA, 13 nt, Mycobacterium bovis subsp bovis AF2122/97
ggcccgcucaccu

SEQ ID NO: 3093739 - RNA, 21 nt, Mycobacterium bovis subsp bovis AF2122/97
ggcccgcucccugcacccagc

SEQ ID NO: 3093740 - RNA, 22 nt, Mycobacterium bovis subsp bovis AF2122/97
ggcccgcucccugcacccagcc

SEQ ID NO: 3093741 - RNA, 19 nt, Mycobacterium bovis subsp bovis AF2122/97
ggcccgcucgaucggcagc

SEQ ID NO: 3093742 - RNA, 12 nt, Mycobacterium bovis subsp bovis AF2122/97
ggcccgcucggg

SEQ ID NO: 3093743 - RNA, 22 nt, Mycobacterium bovis subsp bovis AF2122/97
ggcccgcugggcuuggggccgg

SEQ ID NO: 3093744 - RNA, 16 nt, Mycobacterium bovis subsp bovis AF2122/97
ggcccgcuguggucuu

SEQ ID NO: 3093745 - RNA, 23 nt, Mycobacterium bovis subsp bovis AF2122/97
ggcccggacaugcgggcagcacu

SEQ ID NO: 3093746 - RNA, 18 nt, Mycobacterium bovis subsp bovis AF2122/97
ggcccggacgucggcggc

SEQ ID NO: 3093747 - RNA, 18 nt, Mycobacterium bovis subsp bovis AF2122/97
ggcccggaggccgcugcc

SEQ ID NO: 3093748 - RNA, 14 nt, Mycobacterium bovis subsp bovis AF2122/97
ggcccggcacccgg

SEQ ID NO: 3093749 - RNA, 15 nt, Mycobacterium bovis subsp bovis AF2122/97
ggcccggcaccgcgu

SEQ ID NO: 3093750 - RNA, 15 nt, Mycobacterium bovis subsp bovis AF2122/97
ggcccggccgaacgc

SEQ ID NO: 3093751 - RNA, 18 nt, Mycobacterium bovis subsp bovis AF2122/97
ggcccggcgaacaggcga

SEQ ID NO: 3093752 - RNA, 13 nt, Mycobacterium bovis subsp bovis AF2122/97
ggcccggcgcggc

SEQ ID NO: 3093753 - RNA, 14 nt, Mycobacterium bovis subsp bovis AF2122/97
ggcccggcgcggcc

SEQ ID NO: 3093754 - RNA, 11 nt, Mycobacterium bovis subsp bovis AF2122/97
ggcccggcggu

SEQ ID NO: 3093755 - RNA, 14 nt, Mycobacterium bovis subsp bovis AF2122/97
ggcccggcucacag

SEQ ID NO: 3093756 - RNA, 15 nt, Mycobacterium bovis subsp bovis AF2122/97
ggcccgggaacccgc

SEQ ID NO: 3093757 - RNA, 12 nt, Mycobacterium bovis subsp bovis AF2122/97
ggcccgggcccg

SEQ ID NO: 3093758 - RNA, 15 nt, Mycobacterium bovis subsp bovis AF2122/97
ggcccgggcccgcgg

SEQ ID NO: 3093759 - RNA, 17 nt, Mycobacterium bovis subsp bovis AF2122/97
ggcccgggcccgcggga

SEQ ID NO: 3093760 - RNA, 12 nt, Mycobacterium bovis subsp bovis AF2122/97
ggcccgggcggc

SEQ ID NO: 3093761 - RNA, 14 nt, Mycobacterium bovis subsp bovis AF2122/97
ggcccgggcggcca

SEQ ID NO: 3093762 - RNA, 17 nt, Mycobacterium bovis subsp bovis AF2122/97
ggcccgggcggccagcu

SEQ ID NO: 3093763 - RNA, 18 nt, Mycobacterium bovis subsp bovis AF2122/97
ggcccgggcggccagcug

SEQ ID NO: 3093764 - RNA, 20 nt, Mycobacterium bovis subsp bovis AF2122/97
ggcccgggcggccagcugca

SEQ ID NO: 3093765 - RNA, 16 nt, Mycobacterium bovis subsp bovis AF2122/97
ggcccgggcucggcga

SEQ ID NO: 3093766 - RNA, 19 nt, Mycobacterium bovis subsp bovis AF2122/97
ggcccggggacgcccucgg

SEQ ID NO: 3093767 - RNA, 20 nt, Mycobacterium bovis subsp bovis AF2122/97
ggcccggggacgcccucggg

SEQ ID NO: 3093768 - RNA, 16 nt, Mycobacterium bovis subsp bovis AF2122/97
ggcccgggucuccggc

SEQ ID NO: 3093769 - RNA, 19 nt, Mycobacterium bovis subsp bovis AF2122/97
ggcccgggucuccggcgca

SEQ ID NO: 3093770 - RNA, 21 nt, Mycobacterium bovis subsp bovis AF2122/97
ggcccgggucuccggcgcacc

SEQ ID NO: 3093771 - RNA, 23 nt, Mycobacterium bovis subsp bovis AF2122/97
ggcccgggucuccggcgcaccug

SEQ ID NO: 3093772 - RNA, 14 nt, Mycobacterium bovis subsp bovis AF2122/97
ggcccgguccgcca

SEQ ID NO: 3093773 - RNA, 17 nt, Mycobacterium bovis subsp bovis AF2122/97
ggcccgguccgccauug

SEQ ID NO: 3093774 - RNA, 24 nt, Mycobacterium bovis subsp bovis AF2122/97
ggcccggucuacgccaccgagauc

SEQ ID NO: 3093775 - RNA, 22 nt, Mycobacterium bovis subsp bovis AF2122/97
ggcccggugaugaagcgcgguu

SEQ ID NO: 3093776 - RNA, 11 nt, Mycobacterium bovis subsp bovis AF2122/97
ggcccgguggu

SEQ ID NO: 3093777 - RNA, 21 nt, Mycobacterium bovis subsp bovis AF2122/97
ggcccgguguguauucgccga

SEQ ID NO: 3093778 - RNA, 23 nt, Mycobacterium bovis subsp bovis AF2122/97
ggcccgguguguauucgccgacg

SEQ ID NO: 3093779 - RNA, 14 nt, Mycobacterium bovis subsp bovis AF2122/97
ggcccgguucgagg

SEQ ID NO: 3093780 - RNA, 12 nt, Mycobacterium bovis subsp bovis AF2122/97
ggcccguagccg

SEQ ID NO: 3093781 - RNA, 16 nt, Mycobacterium bovis subsp bovis AF2122/97
ggcccguagccgagcu

SEQ ID NO: 3093782 - RNA, 20 nt, Mycobacterium bovis subsp bovis AF2122/97
ggcccguagcguccgcgccc

SEQ ID NO: 3093783 - RNA, 21 nt, Mycobacterium bovis subsp bovis AF2122/97
ggcccgucacaaugcccaggc

SEQ ID NO: 3093784 - RNA, 17 nt, Mycobacterium bovis subsp bovis AF2122/97
ggcccgucaccgcgggc

SEQ ID NO: 3093785 - RNA, 17 nt, Mycobacterium bovis subsp bovis AF2122/97
ggcccgucacgcccgcg

SEQ ID NO: 3093786 - RNA, 20 nt, Mycobacterium bovis subsp bovis AF2122/97
ggcccgucauacucgacacc

SEQ ID NO: 3093787 - RNA, 13 nt, Mycobacterium bovis subsp bovis AF2122/97
ggcccguccugcg

SEQ ID NO: 3093788 - RNA, 20 nt, Mycobacterium bovis subsp bovis AF2122/97
ggcccgucgcgucgaccgga

SEQ ID NO: 3093789 - RNA, 16 nt, Mycobacterium bovis subsp bovis AF2122/97
ggcccgucgucgucga

SEQ ID NO: 3093790 - RNA, 20 nt, Mycobacterium bovis subsp bovis AF2122/97
ggcccgucgugaccgaccgc

SEQ ID NO: 3093791 - RNA, 22 nt, Mycobacterium bovis subsp bovis AF2122/97
ggcccgugccacagcucgccgu

SEQ ID NO: 3093792 - RNA, 19 nt, Mycobacterium bovis subsp bovis AF2122/97
ggcccguuggcagcacagg

SEQ ID NO: 3093793 - RNA, 21 nt, Mycobacterium bovis subsp bovis AF2122/97
ggcccguuggcagcacaggcu

SEQ ID NO: 3093794 - RNA, 18 nt, Mycobacterium bovis subsp bovis AF2122/97
ggcccuacgcagcgcggc

SEQ ID NO: 3093795 - RNA, 15 nt, Mycobacterium bovis subsp bovis AF2122/97
ggcccuagccggcgc

SEQ ID NO: 3093796 - RNA, 17 nt, Mycobacterium bovis subsp bovis AF2122/97
ggcccuagccggcgcgc

SEQ ID NO: 3093797 - RNA, 18 nt, Mycobacterium bovis subsp bovis AF2122/97
ggcccuagccggcgcgcc

SEQ ID NO: 3093798 - RNA, 19 nt, Mycobacterium bovis subsp bovis AF2122/97
ggcccuagccggcgcgccc

SEQ ID NO: 3093799 - RNA, 18 nt, Mycobacterium bovis subsp bovis AF2122/97
ggcccuccacugcgagcg

SEQ ID NO: 3093800 - RNA, 13 nt, Mycobacterium bovis subsp bovis AF2122/97
ggcccuccggcgc

SEQ ID NO: 3093801 - RNA, 20 nt, Mycobacterium bovis subsp bovis AF2122/97
ggcccucgaauucggccggc

SEQ ID NO: 3093802 - RNA, 13 nt, Mycobacterium bovis subsp bovis AF2122/97
ggcccucgacggc

SEQ ID NO: 3093803 - RNA, 16 nt, Mycobacterium bovis subsp bovis AF2122/97
ggcccucgacggcguc

SEQ ID NO: 3093804 - RNA, 20 nt, Mycobacterium bovis subsp bovis AF2122/97
ggcccucgagcagugccgug

SEQ ID NO: 3093805 - RNA, 23 nt, Mycobacterium bovis subsp bovis AF2122/97
ggcccucuaugcgggcagcgauc

SEQ ID NO: 3093806 - RNA, 19 nt, Mycobacterium bovis subsp bovis AF2122/97
ggcccugagcugccgagcg

SEQ ID NO: 3093807 - RNA, 12 nt, Mycobacterium bovis subsp bovis AF2122/97
ggcccugccgac

SEQ ID NO: 3093808 - RNA, 20 nt, Mycobacterium bovis subsp bovis AF2122/97
ggcccugccgccggccccgc

SEQ ID NO: 3093809 - RNA, 22 nt, Mycobacterium bovis subsp bovis AF2122/97
ggcccugcuccucgcgggcggc

SEQ ID NO: 3093810 - RNA, 23 nt, Mycobacterium bovis subsp bovis AF2122/97
ggcccugcuccucgcgggcggcg

SEQ ID NO: 3093811 - RNA, 11 nt, Mycobacterium bovis subsp bovis AF2122/97
ggcccugcugg

SEQ ID NO: 3093812 - RNA, 16 nt, Mycobacterium bovis subsp bovis AF2122/97
ggcccugcuggcccaa

SEQ ID NO: 3093813 - RNA, 18 nt, Mycobacterium bovis subsp bovis AF2122/97
ggcccugcuugcaggcga

SEQ ID NO: 3093814 - RNA, 14 nt, Mycobacterium bovis subsp bovis AF2122/97
ggcccuggccagcc

SEQ ID NO: 3093815 - RNA, 21 nt, Mycobacterium bovis subsp bovis AF2122/97
ggcccuggccagcccgagcuc

SEQ ID NO: 3093816 - RNA, 18 nt, Mycobacterium bovis subsp bovis AF2122/97
ggcccuggccgcgccggg

SEQ ID NO: 3093817 - RNA, 15 nt, Mycobacterium bovis subsp bovis AF2122/97
ggcccuggcggcccg

SEQ ID NO: 3093818 - RNA, 14 nt, Mycobacterium bovis subsp bovis AF2122/97
ggcccugggcccuu

SEQ ID NO: 3093819 - RNA, 23 nt, Mycobacterium bovis subsp bovis AF2122/97
ggcccugggugguuccgcgcggc

SEQ ID NO: 3093820 - RNA, 15 nt, Mycobacterium bovis subsp bovis AF2122/97
ggcccuucaccagcc

SEQ ID NO: 3093821 - RNA, 17 nt, Mycobacterium bovis subsp bovis AF2122/97
ggcccuucaccagccac

SEQ ID NO: 3093822 - RNA, 21 nt, Mycobacterium bovis subsp bovis AF2122/97
ggcccuucaguucgacggugc

SEQ ID NO: 3093823 - RNA, 20 nt, Mycobacterium bovis subsp bovis AF2122/97
ggccgaaacuucgcccgggc

SEQ ID NO: 3093824 - RNA, 22 nt, Mycobacterium bovis subsp bovis AF2122/97
ggccgaaagccaggcggcaagg

SEQ ID NO: 3093825 - RNA, 16 nt, Mycobacterium bovis subsp bovis AF2122/97
ggccgaacacaccggg

SEQ ID NO: 3093826 - RNA, 15 nt, Mycobacterium bovis subsp bovis AF2122/97
ggccgaacagcaggc

SEQ ID NO: 3093827 - RNA, 18 nt, Mycobacterium bovis subsp bovis AF2122/97
ggccgaaccguucggcga

SEQ ID NO: 3093828 - RNA, 15 nt, Mycobacterium bovis subsp bovis AF2122/97
ggccgaacgccucgc

SEQ ID NO: 3093829 - RNA, 17 nt, Mycobacterium bovis subsp bovis AF2122/97
ggccgaacgccucgccg

SEQ ID NO: 3093830 - RNA, 20 nt, Mycobacterium bovis subsp bovis AF2122/97
ggccgaacgggucggcgacc

SEQ ID NO: 3093831 - RNA, 21 nt, Mycobacterium bovis subsp bovis AF2122/97
ggccgaacgggucggcgacca

SEQ ID NO: 3093832 - RNA, 18 nt, Mycobacterium bovis subsp bovis AF2122/97
ggccgaacuaccgacgca

SEQ ID NO: 3093833 - RNA, 19 nt, Mycobacterium bovis subsp bovis AF2122/97
ggccgaacuaccgacgcac

SEQ ID NO: 3093834 - RNA, 14 nt, Mycobacterium bovis subsp bovis AF2122/97
ggccgaagccccga

SEQ ID NO: 3093835 - RNA, 21 nt, Mycobacterium bovis subsp bovis AF2122/97
ggccgaagcccgaucggcggg

SEQ ID NO: 3093836 - RNA, 23 nt, Mycobacterium bovis subsp bovis AF2122/97
ggccgaauaccacaccgugacca

SEQ ID NO: 3093837 - RNA, 17 nt, Mycobacterium bovis subsp bovis AF2122/97
ggccgacaacccggccg

SEQ ID NO: 3093838 - RNA, 19 nt, Mycobacterium bovis subsp bovis AF2122/97
ggccgacaacccggccggg

SEQ ID NO: 3093839 - RNA, 18 nt, Mycobacterium bovis subsp bovis AF2122/97
ggccgacaaugucggcga

SEQ ID NO: 3093840 - RNA, 20 nt, Mycobacterium bovis subsp bovis AF2122/97
ggccgacaaugucggcgaug

SEQ ID NO: 3093841 - RNA, 22 nt, Mycobacterium bovis subsp bovis AF2122/97
ggccgacaaugucggcgaugcg

SEQ ID NO: 3093842 - RNA, 17 nt, Mycobacterium bovis subsp bovis AF2122/97
ggccgacaccgccacca

SEQ ID NO: 3093843 - RNA, 19 nt, Mycobacterium bovis subsp bovis AF2122/97
ggccgacaccgccaccacg

SEQ ID NO: 3093844 - RNA, 18 nt, Mycobacterium bovis subsp bovis AF2122/97
ggccgacacgccgaugcc

SEQ ID NO: 3093845 - RNA, 19 nt, Mycobacterium bovis subsp bovis AF2122/97
ggccgacacgccgaugccg

SEQ ID NO: 3093846 - RNA, 23 nt, Mycobacterium bovis subsp bovis AF2122/97
ggccgacacgccgaugccgaacu

SEQ ID NO: 3093847 - RNA, 13 nt, Mycobacterium bovis subsp bovis AF2122/97
ggccgacagccac

SEQ ID NO: 3093848 - RNA, 18 nt, Mycobacterium bovis subsp bovis AF2122/97
ggccgaccagcacaccgg

SEQ ID NO: 3093849 - RNA, 20 nt, Mycobacterium bovis subsp bovis AF2122/97
ggccgaccagcacaccgguu

SEQ ID NO: 3093850 - RNA, 12 nt, Mycobacterium bovis subsp bovis AF2122/97
ggccgaccagcc

SEQ ID NO: 3093851 - RNA, 11 nt, Mycobacterium bovis subsp bovis AF2122/97
ggccgaccgcg

SEQ ID NO: 3093852 - RNA, 22 nt, Mycobacterium bovis subsp bovis AF2122/97
ggccgaccgggcucuggccagu

SEQ ID NO: 3093853 - RNA, 16 nt, Mycobacterium bovis subsp bovis AF2122/97
ggccgaccucggcaac

SEQ ID NO: 3093854 - RNA, 17 nt, Mycobacterium bovis subsp bovis AF2122/97
ggccgaccucguucguc

SEQ ID NO: 3093855 - RNA, 21 nt, Mycobacterium bovis subsp bovis AF2122/97
ggccgaccuguaugccgcggu

SEQ ID NO: 3093856 - RNA, 21 nt, Mycobacterium bovis subsp bovis AF2122/97
ggccgacgaaagguugccgau

SEQ ID NO: 3093857 - RNA, 14 nt, Mycobacterium bovis subsp bovis AF2122/97
ggccgacgagaucg

SEQ ID NO: 3093858 - RNA, 14 nt, Mycobacterium bovis subsp bovis AF2122/97
ggccgacgauagcg

SEQ ID NO: 3093859 - RNA, 18 nt, Mycobacterium bovis subsp bovis AF2122/97
ggccgacgauagcggccc

SEQ ID NO: 3093860 - RNA, 15 nt, Mycobacterium bovis subsp bovis AF2122/97
ggccgacgcagguga

SEQ ID NO: 3093861 - RNA, 21 nt, Mycobacterium bovis subsp bovis AF2122/97
ggccgacgcaggugaacgccg

SEQ ID NO: 3093862 - RNA, 12 nt, Mycobacterium bovis subsp bovis AF2122/97
ggccgacgcugc

SEQ ID NO: 3093863 - RNA, 14 nt, Mycobacterium bovis subsp bovis AF2122/97
ggccgacgcugcug

SEQ ID NO: 3093864 - RNA, 23 nt, Mycobacterium bovis subsp bovis AF2122/97
ggccgacggcaaaccaguuggcg

SEQ ID NO: 3093865 - RNA, 19 nt, Mycobacterium bovis subsp bovis AF2122/97
ggccgacgggacaacccgu

SEQ ID NO: 3093866 - RNA, 17 nt, Mycobacterium bovis subsp bovis AF2122/97
ggccgacgugacaacug

SEQ ID NO: 3093867 - RNA, 14 nt, Mycobacterium bovis subsp bovis AF2122/97
ggccgacgugacca

SEQ ID NO: 3093868 - RNA, 19 nt, Mycobacterium bovis subsp bovis AF2122/97
ggccgacgugaccagcuuc

SEQ ID NO: 3093869 - RNA, 15 nt, Mycobacterium bovis subsp bovis AF2122/97
ggccgacucggucuc

SEQ ID NO: 3093870 - RNA, 16 nt, Mycobacterium bovis subsp bovis AF2122/97
ggccgacugggcgcga

SEQ ID NO: 3093871 - RNA, 20 nt, Mycobacterium bovis subsp bovis AF2122/97
ggccgacuuguacgcaucgc

SEQ ID NO: 3093872 - RNA, 18 nt, Mycobacterium bovis subsp bovis AF2122/97
ggccgagagcagccagcc

SEQ ID NO: 3093873 - RNA, 20 nt, Mycobacterium bovis subsp bovis AF2122/97
ggccgagagcagccagccac

SEQ ID NO: 3093874 - RNA, 14 nt, Mycobacterium bovis subsp bovis AF2122/97
ggccgagaucacgc

SEQ ID NO: 3093875 - RNA, 15 nt, Mycobacterium bovis subsp bovis AF2122/97
ggccgagcagggccg

SEQ ID NO: 3093876 - RNA, 20 nt, Mycobacterium bovis subsp bovis AF2122/97
ggccgagcagggccggcacc

SEQ ID NO: 3093877 - RNA, 22 nt, Mycobacterium bovis subsp bovis AF2122/97
ggccgagcagggccggcaccgc

SEQ ID NO: 3093878 - RNA, 13 nt, Mycobacterium bovis subsp bovis AF2122/97
ggccgagcccggu

SEQ ID NO: 3093879 - RNA, 15 nt, Mycobacterium bovis subsp bovis AF2122/97
ggccgagcccggugc

SEQ ID NO: 3093880 - RNA, 15 nt, Mycobacterium bovis subsp bovis AF2122/97
ggccgagccgcccgc

SEQ ID NO: 3093881 - RNA, 18 nt, Mycobacterium bovis subsp bovis AF2122/97
ggccgagccgcggucacc

SEQ ID NO: 3093882 - RNA, 13 nt, Mycobacterium bovis subsp bovis AF2122/97
ggccgagcgcacc

SEQ ID NO: 3093883 - RNA, 22 nt, Mycobacterium bovis subsp bovis AF2122/97
ggccgagcgcaccacggcgguc

SEQ ID NO: 3093884 - RNA, 12 nt, Mycobacterium bovis subsp bovis AF2122/97
ggccgagcgcga

SEQ ID NO: 3093885 - RNA, 21 nt, Mycobacterium bovis subsp bovis AF2122/97
ggccgagcgcgaugaugaucg

SEQ ID NO: 3093886 - RNA, 21 nt, Mycobacterium bovis subsp bovis AF2122/97
ggccgagcggagacuccagca

SEQ ID NO: 3093887 - RNA, 13 nt, Mycobacterium bovis subsp bovis AF2122/97
ggccgagcugguu

SEQ ID NO: 3093888 - RNA, 18 nt, Mycobacterium bovis subsp bovis AF2122/97
ggccgaggaccagaggcg

SEQ ID NO: 3093889 - RNA, 13 nt, Mycobacterium bovis subsp bovis AF2122/97
ggccgaggccgcu

SEQ ID NO: 3093890 - RNA, 17 nt, Mycobacterium bovis subsp bovis AF2122/97
ggccgaggccgucgcga

SEQ ID NO: 3093891 - RNA, 15 nt, Mycobacterium bovis subsp bovis AF2122/97
ggccgaguaccagcc

SEQ ID NO: 3093892 - RNA, 17 nt, Mycobacterium bovis subsp bovis AF2122/97
ggccgagucgauugcca

SEQ ID NO: 3093893 - RNA, 23 nt, Mycobacterium bovis subsp bovis AF2122/97
ggccgagucgauugccaccgaga

SEQ ID NO: 3093894 - RNA, 14 nt, Mycobacterium bovis subsp bovis AF2122/97
ggccgagugcccag

SEQ ID NO: 3093895 - RNA, 20 nt, Mycobacterium bovis subsp bovis AF2122/97
ggccgaguucgucagcggcc

SEQ ID NO: 3093896 - RNA, 19 nt, Mycobacterium bovis subsp bovis AF2122/97
ggccgauacgaagccgccg

SEQ ID NO: 3093897 - RNA, 13 nt, Mycobacterium bovis subsp bovis AF2122/97
ggccgaucacccc

SEQ ID NO: 3093898 - RNA, 16 nt, Mycobacterium bovis subsp bovis AF2122/97
ggccgaucaccccggu

SEQ ID NO: 3093899 - RNA, 17 nt, Mycobacterium bovis subsp bovis AF2122/97
ggccgaucaccccggug

SEQ ID NO: 3093900 - RNA, 19 nt, Mycobacterium bovis subsp bovis AF2122/97
ggccgaucagcgcggcgcc

SEQ ID NO: 3093901 - RNA, 21 nt, Mycobacterium bovis subsp bovis AF2122/97
ggccgaucagcgcggcgcccu

SEQ ID NO: 3093902 - RNA, 17 nt, Mycobacterium bovis subsp bovis AF2122/97
ggccgaucagcguggcg

SEQ ID NO: 3093903 - RNA, 15 nt, Mycobacterium bovis subsp bovis AF2122/97
ggccgaucccaccgg

SEQ ID NO: 3093904 - RNA, 18 nt, Mycobacterium bovis subsp bovis AF2122/97
ggccgaucucuccggcgg

SEQ ID NO: 3093905 - RNA, 19 nt, Mycobacterium bovis subsp bovis AF2122/97
ggccgaucucuccggcggc

SEQ ID NO: 3093906 - RNA, 21 nt, Mycobacterium bovis subsp bovis AF2122/97
ggccgaucucuccggcggcga

SEQ ID NO: 3093907 - RNA, 14 nt, Mycobacterium bovis subsp bovis AF2122/97
ggccgaugacgaug

SEQ ID NO: 3093908 - RNA, 19 nt, Mycobacterium bovis subsp bovis AF2122/97
ggccgaugacgaugccgcc

SEQ ID NO: 3093909 - RNA, 15 nt, Mycobacterium bovis subsp bovis AF2122/97
ggccgaugagcccag

SEQ ID NO: 3093910 - RNA, 19 nt, Mycobacterium bovis subsp bovis AF2122/97
ggccgaugagcccagccgc

SEQ ID NO: 3093911 - RNA, 16 nt, Mycobacterium bovis subsp bovis AF2122/97
ggccgaugccgaccuu

SEQ ID NO: 3093912 - RNA, 20 nt, Mycobacterium bovis subsp bovis AF2122/97
ggccgaugcgcagugcaccg

SEQ ID NO: 3093913 - RNA, 11 nt, Mycobacterium bovis subsp bovis AF2122/97
ggccgauggcg

SEQ ID NO: 3093914 - RNA, 19 nt, Mycobacterium bovis subsp bovis AF2122/97
ggccgauggugugcacggc

SEQ ID NO: 3093915 - RNA, 21 nt, Mycobacterium bovis subsp bovis AF2122/97
ggccgauguacugugccgccc

SEQ ID NO: 3093916 - RNA, 23 nt, Mycobacterium bovis subsp bovis AF2122/97
ggccgauguacugugccgccccc

SEQ ID NO: 3093917 - RNA, 17 nt, Mycobacterium bovis subsp bovis AF2122/97
ggccgauguaguccggc

SEQ ID NO: 3093918 - RNA, 16 nt, Mycobacterium bovis subsp bovis AF2122/97
ggccgauuccgcgcgu

SEQ ID NO: 3093919 - RNA, 14 nt, Mycobacterium bovis subsp bovis AF2122/97
ggccgauugcucgg

SEQ ID NO: 3093920 - RNA, 15 nt, Mycobacterium bovis subsp bovis AF2122/97
ggccgauugcucggg

SEQ ID NO: 3093921 - RNA, 16 nt, Mycobacterium bovis subsp bovis AF2122/97
ggccgauuuagugggc

SEQ ID NO: 3093922 - RNA, 15 nt, Mycobacterium bovis subsp bovis AF2122/97
ggccgcaagccgcga

SEQ ID NO: 3093923 - RNA, 20 nt, Mycobacterium bovis subsp bovis AF2122/97
ggccgcaagccgcgagucgc

SEQ ID NO: 3093924 - RNA, 16 nt, Mycobacterium bovis subsp bovis AF2122/97
ggccgcaaggcgccga

SEQ ID NO: 3093925 - RNA, 18 nt, Mycobacterium bovis subsp bovis AF2122/97
ggccgcaaggcgccgaua

SEQ ID NO: 3093926 - RNA, 16 nt, Mycobacterium bovis subsp bovis AF2122/97
ggccgcaauccagcug

SEQ ID NO: 3093927 - RNA, 14 nt, Mycobacterium bovis subsp bovis AF2122/97
ggccgcacgccgac

SEQ ID NO: 3093928 - RNA, 18 nt, Mycobacterium bovis subsp bovis AF2122/97
ggccgcacgccgaccagc

SEQ ID NO: 3093929 - RNA, 16 nt, Mycobacterium bovis subsp bovis AF2122/97
ggccgcacgccggcca

SEQ ID NO: 3093930 - RNA, 19 nt, Mycobacterium bovis subsp bovis AF2122/97
ggccgcacgucgaccucgg

SEQ ID NO: 3093931 - RNA, 20 nt, Mycobacterium bovis subsp bovis AF2122/97
ggccgcacuuucuuccucgg

SEQ ID NO: 3093932 - RNA, 21 nt, Mycobacterium bovis subsp bovis AF2122/97
ggccgcacuuucuuccucggg

SEQ ID NO: 3093933 - RNA, 14 nt, Mycobacterium bovis subsp bovis AF2122/97
ggccgcagccagca

SEQ ID NO: 3093934 - RNA, 16 nt, Mycobacterium bovis subsp bovis AF2122/97
ggccgcagccagcaag

SEQ ID NO: 3093935 - RNA, 15 nt, Mycobacterium bovis subsp bovis AF2122/97
ggccgcagccagcgg

SEQ ID NO: 3093936 - RNA, 14 nt, Mycobacterium bovis subsp bovis AF2122/97
ggccgcagcggcca

SEQ ID NO: 3093937 - RNA, 15 nt, Mycobacterium bovis subsp bovis AF2122/97
ggccgcagcggccag

SEQ ID NO: 3093938 - RNA, 17 nt, Mycobacterium bovis subsp bovis AF2122/97
ggccgcagcggccagcc

SEQ ID NO: 3093939 - RNA, 18 nt, Mycobacterium bovis subsp bovis AF2122/97
ggccgcaggcuugccgau

SEQ ID NO: 3093940 - RNA, 23 nt, Mycobacterium bovis subsp bovis AF2122/97
ggccgcaggcuugccgauggcgg

SEQ ID NO: 3093941 - RNA, 23 nt, Mycobacterium bovis subsp bovis AF2122/97
ggccgcauauugcggcgccguga

SEQ ID NO: 3093942 - RNA, 17 nt, Mycobacterium bovis subsp bovis AF2122/97
ggccgcaucgccucacc

SEQ ID NO: 3093943 - RNA, 15 nt, Mycobacterium bovis subsp bovis AF2122/97
ggccgcaucgucgcc

SEQ ID NO: 3093944 - RNA, 18 nt, Mycobacterium bovis subsp bovis AF2122/97
ggccgcaucgucgccgcg

SEQ ID NO: 3093945 - RNA, 16 nt, Mycobacterium bovis subsp bovis AF2122/97
ggccgcaugccacggc

SEQ ID NO: 3093946 - RNA, 19 nt, Mycobacterium bovis subsp bovis AF2122/97
ggccgcaugccacggcaag

SEQ ID NO: 3093947 - RNA, 18 nt, Mycobacterium bovis subsp bovis AF2122/97
ggccgcauuagccugcgu

SEQ ID NO: 3093948 - RNA, 17 nt, Mycobacterium bovis subsp bovis AF2122/97
ggccgccaacuccagca

SEQ ID NO: 3093949 - RNA, 20 nt, Mycobacterium bovis subsp bovis AF2122/97
ggccgccaacuccagcaccc

SEQ ID NO: 3093950 - RNA, 18 nt, Mycobacterium bovis subsp bovis AF2122/97
ggccgccacaccgccgcc

SEQ ID NO: 3093951 - RNA, 13 nt, Mycobacterium bovis subsp bovis AF2122/97
ggccgccaccagc

SEQ ID NO: 3093952 - RNA, 14 nt, Mycobacterium bovis subsp bovis AF2122/97
ggccgccaccagcg

SEQ ID NO: 3093953 - RNA, 11 nt, Mycobacterium bovis subsp bovis AF2122/97
ggccgccaccg

SEQ ID NO: 3093954 - RNA, 13 nt, Mycobacterium bovis subsp bovis AF2122/97
ggccgccaccgca

SEQ ID NO: 3093955 - RNA, 14 nt, Mycobacterium bovis subsp bovis AF2122/97
ggccgccaccgcac

SEQ ID NO: 3093956 - RNA, 13 nt, Mycobacterium bovis subsp bovis AF2122/97
ggccgccaccgcg

SEQ ID NO: 3093957 - RNA, 22 nt, Mycobacterium bovis subsp bovis AF2122/97
ggccgccaccgcgacgagcggc

SEQ ID NO: 3093958 - RNA, 12 nt, Mycobacterium bovis subsp bovis AF2122/97
ggccgccaccgu

SEQ ID NO: 3093959 - RNA, 15 nt, Mycobacterium bovis subsp bovis AF2122/97
ggccgccaccgucac

SEQ ID NO: 3093960 - RNA, 22 nt, Mycobacterium bovis subsp bovis AF2122/97
ggccgccaccgucaccgccguc

SEQ ID NO: 3093961 - RNA, 14 nt, Mycobacterium bovis subsp bovis AF2122/97
ggccgccaccuccc

SEQ ID NO: 3093962 - RNA, 15 nt, Mycobacterium bovis subsp bovis AF2122/97
ggccgccaccuccca

SEQ ID NO: 3093963 - RNA, 18 nt, Mycobacterium bovis subsp bovis AF2122/97
ggccgccacucgcccgcu

SEQ ID NO: 3093964 - RNA, 13 nt, Mycobacterium bovis subsp bovis AF2122/97
ggccgccagcagc

SEQ ID NO: 3093965 - RNA, 17 nt, Mycobacterium bovis subsp bovis AF2122/97
ggccgccagccccaccc

SEQ ID NO: 3093966 - RNA, 20 nt, Mycobacterium bovis subsp bovis AF2122/97
ggccgccagccccacccgca

SEQ ID NO: 3093967 - RNA, 13 nt, Mycobacterium bovis subsp bovis AF2122/97
ggccgccagccgg

SEQ ID NO: 3093968 - RNA, 15 nt, Mycobacterium bovis subsp bovis AF2122/97
ggccgccagccggcg

SEQ ID NO: 3093969 - RNA, 16 nt, Mycobacterium bovis subsp bovis AF2122/97
ggccgccagccggcgc

SEQ ID NO: 3093970 - RNA, 17 nt, Mycobacterium bovis subsp bovis AF2122/97
ggccgccagccggcgca

SEQ ID NO: 3093971 - RNA, 13 nt, Mycobacterium bovis subsp bovis AF2122/97
ggccgccagcgcg

SEQ ID NO: 3093972 - RNA, 13 nt, Mycobacterium bovis subsp bovis AF2122/97
ggccgccagcggc

SEQ ID NO: 3093973 - RNA, 14 nt, Mycobacterium bovis subsp bovis AF2122/97
ggccgccagcggcg

SEQ ID NO: 3093974 - RNA, 14 nt, Mycobacterium bovis subsp bovis AF2122/97
ggccgccagcugcg

SEQ ID NO: 3093975 - RNA, 15 nt, Mycobacterium bovis subsp bovis AF2122/97
ggccgccagcugcgc

SEQ ID NO: 3093976 - RNA, 21 nt, Mycobacterium bovis subsp bovis AF2122/97
ggccgccagcugcgcagcgca

SEQ ID NO: 3093977 - RNA, 13 nt, Mycobacterium bovis subsp bovis AF2122/97
ggccgccaggcgc

SEQ ID NO: 3093978 - RNA, 15 nt, Mycobacterium bovis subsp bovis AF2122/97
ggccgccaggcggcc

SEQ ID NO: 3093979 - RNA, 15 nt, Mycobacterium bovis subsp bovis AF2122/97
ggccgccaguccgau

SEQ ID NO: 3093980 - RNA, 22 nt, Mycobacterium bovis subsp bovis AF2122/97
ggccgccaguccgaucgccgag

SEQ ID NO: 3093981 - RNA, 15 nt, Mycobacterium bovis subsp bovis AF2122/97
ggccgccaguucggc

SEQ ID NO: 3093982 - RNA, 18 nt, Mycobacterium bovis subsp bovis AF2122/97
ggccgccaguucggcguc

SEQ ID NO: 3093983 - RNA, 13 nt, Mycobacterium bovis subsp bovis AF2122/97
ggccgccaucccc

SEQ ID NO: 3093984 - RNA, 21 nt, Mycobacterium bovis subsp bovis AF2122/97
ggccgccauccccuggccagc

SEQ ID NO: 3093985 - RNA, 21 nt, Mycobacterium bovis subsp bovis AF2122/97
ggccgccaugaaaucacccau

SEQ ID NO: 3093986 - RNA, 21 nt, Mycobacterium bovis subsp bovis AF2122/97
ggccgcccagaccgccgacgc

SEQ ID NO: 3093987 - RNA, 23 nt, Mycobacterium bovis subsp bovis AF2122/97
ggccgcccagaccgccgacgccg

SEQ ID NO: 3093988 - RNA, 14 nt, Mycobacterium bovis subsp bovis AF2122/97
ggccgcccagaugu

SEQ ID NO: 3093989 - RNA, 15 nt, Mycobacterium bovis subsp bovis AF2122/97
ggccgccccaggcug

SEQ ID NO: 3093990 - RNA, 16 nt, Mycobacterium bovis subsp bovis AF2122/97
ggccgccccaggcugg

SEQ ID NO: 3093991 - RNA, 12 nt, Mycobacterium bovis subsp bovis AF2122/97
ggccgccccggc

SEQ ID NO: 3093992 - RNA, 16 nt, Mycobacterium bovis subsp bovis AF2122/97
ggccgccccggccgcu

SEQ ID NO: 3093993 - RNA, 21 nt, Mycobacterium bovis subsp bovis AF2122/97
ggccgccccggccgcuggcgu

SEQ ID NO: 3093994 - RNA, 20 nt, Mycobacterium bovis subsp bovis AF2122/97
ggccgcccgcuccaacaccc

SEQ ID NO: 3093995 - RNA, 14 nt, Mycobacterium bovis subsp bovis AF2122/97
ggccgcccgcucga

SEQ ID NO: 3093996 - RNA, 16 nt, Mycobacterium bovis subsp bovis AF2122/97
ggccgcccgcucgaug

SEQ ID NO: 3093997 - RNA, 17 nt, Mycobacterium bovis subsp bovis AF2122/97
ggccgcccgcucgaugu

SEQ ID NO: 3093998 - RNA, 19 nt, Mycobacterium bovis subsp bovis AF2122/97
ggccgcccgcucgaugucg

SEQ ID NO: 3093999 - RNA, 15 nt, Mycobacterium bovis subsp bovis AF2122/97
ggccgcccgcugcgg

SEQ ID NO: 3094000 - RNA, 13 nt, Mycobacterium bovis subsp bovis AF2122/97
ggccgcccggcga

SEQ ID NO: 3094001 - RNA, 14 nt, Mycobacterium bovis subsp bovis AF2122/97
ggccgcccggcgag

SEQ ID NO: 3094002 - RNA, 19 nt, Mycobacterium bovis subsp bovis AF2122/97
ggccgcccuggccgcccag

SEQ ID NO: 3094003 - RNA, 20 nt, Mycobacterium bovis subsp bovis AF2122/97
ggccgcccuggccgcccaga

SEQ ID NO: 3094004 - RNA, 21 nt, Mycobacterium bovis subsp bovis AF2122/97
ggccgccgaaacucaccagca

SEQ ID NO: 3094005 - RNA, 23 nt, Mycobacterium bovis subsp bovis AF2122/97
ggccgccgaaacucaccagcacc

SEQ ID NO: 3094006 - RNA, 16 nt, Mycobacterium bovis subsp bovis AF2122/97
ggccgccgagcucggu

SEQ ID NO: 3094007 - RNA, 13 nt, Mycobacterium bovis subsp bovis AF2122/97
ggccgccgaugcc

SEQ ID NO: 3094008 - RNA, 12 nt, Mycobacterium bovis subsp bovis AF2122/97
ggccgccgcaag

SEQ ID NO: 3094009 - RNA, 12 nt, Mycobacterium bovis subsp bovis AF2122/97
ggccgccgcagc

SEQ ID NO: 3094010 - RNA, 23 nt, Mycobacterium bovis subsp bovis AF2122/97
ggccgccgcagcuccccgaccga

SEQ ID NO: 3094011 - RNA, 17 nt, Mycobacterium bovis subsp bovis AF2122/97
ggccgccgccagaugag

SEQ ID NO: 3094012 - RNA, 12 nt, Mycobacterium bovis subsp bovis AF2122/97
ggccgccgcccc

SEQ ID NO: 3094013 - RNA, 18 nt, Mycobacterium bovis subsp bovis AF2122/97
ggccgccgccccggcgcu

SEQ ID NO: 3094014 - RNA, 21 nt, Mycobacterium bovis subsp bovis AF2122/97
ggccgccgccguaacggucgc

SEQ ID NO: 3094015 - RNA, 22 nt, Mycobacterium bovis subsp bovis AF2122/97
ggccgccgccguaacggucgcu

SEQ ID NO: 3094016 - RNA, 15 nt, Mycobacterium bovis subsp bovis AF2122/97
ggccgccgccgucgg

SEQ ID NO: 3094017 - RNA, 18 nt, Mycobacterium bovis subsp bovis AF2122/97
ggccgccgccgucggcga

SEQ ID NO: 3094018 - RNA, 20 nt, Mycobacterium bovis subsp bovis AF2122/97
ggccgccgccgucggcgagc

SEQ ID NO: 3094019 - RNA, 14 nt, Mycobacterium bovis subsp bovis AF2122/97
ggccgccgcggccg

SEQ ID NO: 3094020 - RNA, 13 nt, Mycobacterium bovis subsp bovis AF2122/97
ggccgccgcggcg

SEQ ID NO: 3094021 - RNA, 14 nt, Mycobacterium bovis subsp bovis AF2122/97
ggccgccgcggcga

SEQ ID NO: 3094022 - RNA, 17 nt, Mycobacterium bovis subsp bovis AF2122/97
ggccgccgcggcuuguc

SEQ ID NO: 3094023 - RNA, 20 nt, Mycobacterium bovis subsp bovis AF2122/97
ggccgccgcgggacaccacc

SEQ ID NO: 3094024 - RNA, 14 nt, Mycobacterium bovis subsp bovis AF2122/97
ggccgccgcugccg

SEQ ID NO: 3094025 - RNA, 21 nt, Mycobacterium bovis subsp bovis AF2122/97
ggccgccgcugccgccugcag

SEQ ID NO: 3094026 - RNA, 15 nt, Mycobacterium bovis subsp bovis AF2122/97
ggccgccgcuggugg

SEQ ID NO: 3094027 - RNA, 15 nt, Mycobacterium bovis subsp bovis AF2122/97
ggccgccggacccgu

SEQ ID NO: 3094028 - RNA, 14 nt, Mycobacterium bovis subsp bovis AF2122/97
ggccgccggccagc

SEQ ID NO: 3094029 - RNA, 13 nt, Mycobacterium bovis subsp bovis AF2122/97
ggccgccggcccc

SEQ ID NO: 3094030 - RNA, 17 nt, Mycobacterium bovis subsp bovis AF2122/97
ggccgccggccccgccg

SEQ ID NO: 3094031 - RNA, 13 nt, Mycobacterium bovis subsp bovis AF2122/97
ggccgccggccgc

SEQ ID NO: 3094032 - RNA, 14 nt, Mycobacterium bovis subsp bovis AF2122/97
ggccgccggccgcg

SEQ ID NO: 3094033 - RNA, 14 nt, Mycobacterium bovis subsp bovis AF2122/97
ggccgccggcgccg

SEQ ID NO: 3094034 - RNA, 15 nt, Mycobacterium bovis subsp bovis AF2122/97
ggccgccggcgccgc

SEQ ID NO: 3094035 - RNA, 17 nt, Mycobacterium bovis subsp bovis AF2122/97
ggccgccggcgcuggcg

SEQ ID NO: 3094036 - RNA, 14 nt, Mycobacterium bovis subsp bovis AF2122/97
ggccgccgggcagu

SEQ ID NO: 3094037 - RNA, 16 nt, Mycobacterium bovis subsp bovis AF2122/97
ggccgccggguccgga

SEQ ID NO: 3094038 - RNA, 18 nt, Mycobacterium bovis subsp bovis AF2122/97
ggccgccguccccgccgu

SEQ ID NO: 3094039 - RNA, 19 nt, Mycobacterium bovis subsp bovis AF2122/97
ggccgccguccccgccguc

SEQ ID NO: 3094040 - RNA, 21 nt, Mycobacterium bovis subsp bovis AF2122/97
ggccgccguccccgccgucgc

SEQ ID NO: 3094041 - RNA, 15 nt, Mycobacterium bovis subsp bovis AF2122/97
ggccgccuccgcggc

SEQ ID NO: 3094042 - RNA, 15 nt, Mycobacterium bovis subsp bovis AF2122/97
ggccgccucgaucga

SEQ ID NO: 3094043 - RNA, 22 nt, Mycobacterium bovis subsp bovis AF2122/97
ggccgccucguacggaccgucg

SEQ ID NO: 3094044 - RNA, 16 nt, Mycobacterium bovis subsp bovis AF2122/97
ggccgccugccucgcc

SEQ ID NO: 3094045 - RNA, 18 nt, Mycobacterium bovis subsp bovis AF2122/97
ggccgccuucuccggcgu

SEQ ID NO: 3094046 - RNA, 16 nt, Mycobacterium bovis subsp bovis AF2122/97
ggccgccuugaggccc

SEQ ID NO: 3094047 - RNA, 20 nt, Mycobacterium bovis subsp bovis AF2122/97
ggccgccuuggcuucgacgc

SEQ ID NO: 3094048 - RNA, 21 nt, Mycobacterium bovis subsp bovis AF2122/97
ggccgcgaaugcugugccgag

SEQ ID NO: 3094049 - RNA, 20 nt, Mycobacterium bovis subsp bovis AF2122/97
ggccgcgacaauggugccca

SEQ ID NO: 3094050 - RNA, 15 nt, Mycobacterium bovis subsp bovis AF2122/97
ggccgcgaccagcgc

SEQ ID NO: 3094051 - RNA, 19 nt, Mycobacterium bovis subsp bovis AF2122/97
ggccgcgaccagcgccgca

SEQ ID NO: 3094052 - RNA, 20 nt, Mycobacterium bovis subsp bovis AF2122/97
ggccgcgaccagcgccgcac

SEQ ID NO: 3094053 - RNA, 16 nt, Mycobacterium bovis subsp bovis AF2122/97
ggccgcgacgacacgc

SEQ ID NO: 3094054 - RNA, 14 nt, Mycobacterium bovis subsp bovis AF2122/97
ggccgcgagacgca

SEQ ID NO: 3094055 - RNA, 22 nt, Mycobacterium bovis subsp bovis AF2122/97
ggccgcgagacgcaugucgggc

SEQ ID NO: 3094056 - RNA, 13 nt, Mycobacterium bovis subsp bovis AF2122/97
ggccgcgagguga

SEQ ID NO: 3094057 - RNA, 14 nt, Mycobacterium bovis subsp bovis AF2122/97
ggccgcgauccagc

SEQ ID NO: 3094058 - RNA, 16 nt, Mycobacterium bovis subsp bovis AF2122/97
ggccgcgauccagcgc

SEQ ID NO: 3094059 - RNA, 19 nt, Mycobacterium bovis subsp bovis AF2122/97
ggccgcgaucgacgguguc

SEQ ID NO: 3094060 - RNA, 20 nt, Mycobacterium bovis subsp bovis AF2122/97
ggccgcgauggugcgccggg

SEQ ID NO: 3094061 - RNA, 22 nt, Mycobacterium bovis subsp bovis AF2122/97
ggccgcgauggugcgccgggcg

SEQ ID NO: 3094062 - RNA, 19 nt, Mycobacterium bovis subsp bovis AF2122/97
ggccgcgcacccguccgcc

SEQ ID NO: 3094063 - RNA, 15 nt, Mycobacterium bovis subsp bovis AF2122/97
ggccgcgcagauucc

SEQ ID NO: 3094064 - RNA, 11 nt, Mycobacterium bovis subsp bovis AF2122/97
ggccgcgcagg

SEQ ID NO: 3094065 - RNA, 12 nt, Mycobacterium bovis subsp bovis AF2122/97
ggccgcgcaggc

SEQ ID NO: 3094066 - RNA, 13 nt, Mycobacterium bovis subsp bovis AF2122/97
ggccgcgcaggcu

SEQ ID NO: 3094067 - RNA, 13 nt, Mycobacterium bovis subsp bovis AF2122/97
ggccgcgcagggg

SEQ ID NO: 3094068 - RNA, 11 nt, Mycobacterium bovis subsp bovis AF2122/97
ggccgcgcaug

SEQ ID NO: 3094069 - RNA, 15 nt, Mycobacterium bovis subsp bovis AF2122/97
ggccgcgcccgccuc

SEQ ID NO: 3094070 - RNA, 21 nt, Mycobacterium bovis subsp bovis AF2122/97
ggccgcgcccgccucgaccgc

SEQ ID NO: 3094071 - RNA, 22 nt, Mycobacterium bovis subsp bovis AF2122/97
ggccgcgcccgccucgaccgcc

SEQ ID NO: 3094072 - RNA, 15 nt, Mycobacterium bovis subsp bovis AF2122/97
ggccgcgccggcccc

SEQ ID NO: 3094073 - RNA, 18 nt, Mycobacterium bovis subsp bovis AF2122/97
ggccgcgccggccccggg

SEQ ID NO: 3094074 - RNA, 15 nt, Mycobacterium bovis subsp bovis AF2122/97
ggccgcgcgacaacc

SEQ ID NO: 3094075 - RNA, 18 nt, Mycobacterium bovis subsp bovis AF2122/97
ggccgcgcgacaacccgg

SEQ ID NO: 3094076 - RNA, 22 nt, Mycobacterium bovis subsp bovis AF2122/97
ggccgcgcgcacuugcguggcg

SEQ ID NO: 3094077 - RNA, 18 nt, Mycobacterium bovis subsp bovis AF2122/97
ggccgcgcgcagggcguc

SEQ ID NO: 3094078 - RNA, 22 nt, Mycobacterium bovis subsp bovis AF2122/97
ggccgcgcgcucgagcaggcug

SEQ ID NO: 3094079 - RNA, 24 nt, Mycobacterium bovis subsp bovis AF2122/97
ggccgcgcgcucgagcaggcuggc

SEQ ID NO: 3094080 - RNA, 13 nt, Mycobacterium bovis subsp bovis AF2122/97
ggccgcgcggacc

SEQ ID NO: 3094081 - RNA, 17 nt, Mycobacterium bovis subsp bovis AF2122/97
ggccgcgcggacccagc

SEQ ID NO: 3094082 - RNA, 14 nt, Mycobacterium bovis subsp bovis AF2122/97
ggccgcgcggcgac

SEQ ID NO: 3094083 - RNA, 20 nt, Mycobacterium bovis subsp bovis AF2122/97
ggccgcgcggcggcgccggc

SEQ ID NO: 3094084 - RNA, 16 nt, Mycobacterium bovis subsp bovis AF2122/97
ggccgcgcggggugcg

SEQ ID NO: 3094085 - RNA, 13 nt, Mycobacterium bovis subsp bovis AF2122/97
ggccgcgcggucg

SEQ ID NO: 3094086 - RNA, 18 nt, Mycobacterium bovis subsp bovis AF2122/97
ggccgcgcggucguacgc

SEQ ID NO: 3094087 - RNA, 24 nt, Mycobacterium bovis subsp bovis AF2122/97
ggccgcgcggucguacgcauggcg

SEQ ID NO: 3094088 - RNA, 19 nt, Mycobacterium bovis subsp bovis AF2122/97
ggccgcgcucaucgcggcg

SEQ ID NO: 3094089 - RNA, 14 nt, Mycobacterium bovis subsp bovis AF2122/97
ggccgcgcucgucg

SEQ ID NO: 3094090 - RNA, 18 nt, Mycobacterium bovis subsp bovis AF2122/97
ggccgcgcugcagcacgg

SEQ ID NO: 3094091 - RNA, 13 nt, Mycobacterium bovis subsp bovis AF2122/97
ggccgcggagaag

SEQ ID NO: 3094092 - RNA, 22 nt, Mycobacterium bovis subsp bovis AF2122/97
ggccgcggagaaggcgcgggcg

SEQ ID NO: 3094093 - RNA, 12 nt, Mycobacterium bovis subsp bovis AF2122/97
ggccgcggcagc

SEQ ID NO: 3094094 - RNA, 20 nt, Mycobacterium bovis subsp bovis AF2122/97
ggccgcggccacaucgccag

SEQ ID NO: 3094095 - RNA, 22 nt, Mycobacterium bovis subsp bovis AF2122/97
ggccgcggccacaucgccagca

SEQ ID NO: 3094096 - RNA, 12 nt, Mycobacterium bovis subsp bovis AF2122/97
ggccgcggccuc

SEQ ID NO: 3094097 - RNA, 16 nt, Mycobacterium bovis subsp bovis AF2122/97
ggccgcggccucccgc

SEQ ID NO: 3094098 - RNA, 13 nt, Mycobacterium bovis subsp bovis AF2122/97
ggccgcggccucg

SEQ ID NO: 3094099 - RNA, 17 nt, Mycobacterium bovis subsp bovis AF2122/97
ggccgcggcgcgacggc

SEQ ID NO: 3094100 - RNA, 13 nt, Mycobacterium bovis subsp bovis AF2122/97
ggccgcggcggcc

SEQ ID NO: 3094101 - RNA, 16 nt, Mycobacterium bovis subsp bovis AF2122/97
ggccgcggcggccagc

SEQ ID NO: 3094102 - RNA, 19 nt, Mycobacterium bovis subsp bovis AF2122/97
ggccgcggcggccagcgca

SEQ ID NO: 3094103 - RNA, 20 nt, Mycobacterium bovis subsp bovis AF2122/97
ggccgcggcggccagcgcau

SEQ ID NO: 3094104 - RNA, 14 nt, Mycobacterium bovis subsp bovis AF2122/97
ggccgcggcggccc

SEQ ID NO: 3094105 - RNA, 16 nt, Mycobacterium bovis subsp bovis AF2122/97
ggccgcggcggccccg

SEQ ID NO: 3094106 - RNA, 19 nt, Mycobacterium bovis subsp bovis AF2122/97
ggccgcggcggccccgcgc

SEQ ID NO: 3094107 - RNA, 12 nt, Mycobacterium bovis subsp bovis AF2122/97
ggccgcggcggu

SEQ ID NO: 3094108 - RNA, 13 nt, Mycobacterium bovis subsp bovis AF2122/97
ggccgcggcgguc

SEQ ID NO: 3094109 - RNA, 13 nt, Mycobacterium bovis subsp bovis AF2122/97
ggccgcggcgucg

SEQ ID NO: 3094110 - RNA, 20 nt, Mycobacterium bovis subsp bovis AF2122/97
ggccgcgguacccaccuccc

SEQ ID NO: 3094111 - RNA, 22 nt, Mycobacterium bovis subsp bovis AF2122/97
ggccgcggucgauguccgcagc

SEQ ID NO: 3094112 - RNA, 13 nt, Mycobacterium bovis subsp bovis AF2122/97
ggccgcggucggc

SEQ ID NO: 3094113 - RNA, 14 nt, Mycobacterium bovis subsp bovis AF2122/97
ggccgcggucggcc

SEQ ID NO: 3094114 - RNA, 16 nt, Mycobacterium bovis subsp bovis AF2122/97
ggccgcggucggccac

SEQ ID NO: 3094115 - RNA, 18 nt, Mycobacterium bovis subsp bovis AF2122/97
ggccgcggucggccacca

SEQ ID NO: 3094116 - RNA, 16 nt, Mycobacterium bovis subsp bovis AF2122/97
ggccgcggugacggcg

SEQ ID NO: 3094117 - RNA, 17 nt, Mycobacterium bovis subsp bovis AF2122/97
ggccgcggugacggcgg

SEQ ID NO: 3094118 - RNA, 17 nt, Mycobacterium bovis subsp bovis AF2122/97
ggccgcgguuuggcgac

SEQ ID NO: 3094119 - RNA, 21 nt, Mycobacterium bovis subsp bovis AF2122/97
ggccgcguaaaccggcugacc

SEQ ID NO: 3094120 - RNA, 20 nt, Mycobacterium bovis subsp bovis AF2122/97
ggccgcgucacggaccugga

SEQ ID NO: 3094121 - RNA, 14 nt, Mycobacterium bovis subsp bovis AF2122/97
ggccgcguccagac

SEQ ID NO: 3094122 - RNA, 16 nt, Mycobacterium bovis subsp bovis AF2122/97
ggccgcguccagaccg

SEQ ID NO: 3094123 - RNA, 15 nt, Mycobacterium bovis subsp bovis AF2122/97
ggccgcgucgucgag

SEQ ID NO: 3094124 - RNA, 19 nt, Mycobacterium bovis subsp bovis AF2122/97
ggccgcgucucggugcagc

SEQ ID NO: 3094125 - RNA, 23 nt, Mycobacterium bovis subsp bovis AF2122/97
ggccgcgucucggugcagcagcg

SEQ ID NO: 3094126 - RNA, 17 nt, Mycobacterium bovis subsp bovis AF2122/97
ggccgcgucuuggugcg

SEQ ID NO: 3094127 - RNA, 20 nt, Mycobacterium bovis subsp bovis AF2122/97
ggccgcgucuuggugcgcgu

SEQ ID NO: 3094128 - RNA, 21 nt, Mycobacterium bovis subsp bovis AF2122/97
ggccgcgugacguaccacggc

SEQ ID NO: 3094129 - RNA, 22 nt, Mycobacterium bovis subsp bovis AF2122/97
ggccgcgugacguaccacggcg

SEQ ID NO: 3094130 - RNA, 20 nt, Mycobacterium bovis subsp bovis AF2122/97
ggccgcuauggcccgggccg

SEQ ID NO: 3094131 - RNA, 15 nt, Mycobacterium bovis subsp bovis AF2122/97
ggccgcucaccccgc

SEQ ID NO: 3094132 - RNA, 16 nt, Mycobacterium bovis subsp bovis AF2122/97
ggccgcucaccccgcg

SEQ ID NO: 3094133 - RNA, 14 nt, Mycobacterium bovis subsp bovis AF2122/97
ggccgcuccaccac

SEQ ID NO: 3094134 - RNA, 20 nt, Mycobacterium bovis subsp bovis AF2122/97
ggccgcuccaccacgaccgc

SEQ ID NO: 3094135 - RNA, 21 nt, Mycobacterium bovis subsp bovis AF2122/97
ggccgcuccaccacgaccgcg

SEQ ID NO: 3094136 - RNA, 12 nt, Mycobacterium bovis subsp bovis AF2122/97
ggccgcucgccu

SEQ ID NO: 3094137 - RNA, 17 nt, Mycobacterium bovis subsp bovis AF2122/97
ggccgcucgggccagcg

SEQ ID NO: 3094138 - RNA, 17 nt, Mycobacterium bovis subsp bovis AF2122/97
ggccgcucguuacgccg

SEQ ID NO: 3094139 - RNA, 12 nt, Mycobacterium bovis subsp bovis AF2122/97
ggccgcuggcgg

SEQ ID NO: 3094140 - RNA, 13 nt, Mycobacterium bovis subsp bovis AF2122/97
ggccgcugggccg

SEQ ID NO: 3094141 - RNA, 16 nt, Mycobacterium bovis subsp bovis AF2122/97
ggccgcuggggcgccc

SEQ ID NO: 3094142 - RNA, 18 nt, Mycobacterium bovis subsp bovis AF2122/97
ggccgcuggggcgcccga

SEQ ID NO: 3094143 - RNA, 18 nt, Mycobacterium bovis subsp bovis AF2122/97
ggccgcugucguaccgcu

SEQ ID NO: 3094144 - RNA, 22 nt, Mycobacterium bovis subsp bovis AF2122/97
ggccgcugugggucgauccggu

SEQ ID NO: 3094145 - RNA, 22 nt, Mycobacterium bovis subsp bovis AF2122/97
ggccgcuuagauagggguggcc

SEQ ID NO: 3094146 - RNA, 19 nt, Mycobacterium bovis subsp bovis AF2122/97
ggccgcuucggcggucagc

SEQ ID NO: 3094147 - RNA, 22 nt, Mycobacterium bovis subsp bovis AF2122/97
ggccgcuucggcggucagcggc

SEQ ID NO: 3094148 - RNA, 23 nt, Mycobacterium bovis subsp bovis AF2122/97
ggccgcuucggcggucagcggcu

SEQ ID NO: 3094149 - RNA, 21 nt, Mycobacterium bovis subsp bovis AF2122/97
ggccgcuugccccgccuuggc

SEQ ID NO: 3094150 - RNA, 15 nt, Mycobacterium bovis subsp bovis AF2122/97
ggccgcuuggccgcu

SEQ ID NO: 3094151 - RNA, 20 nt, Mycobacterium bovis subsp bovis AF2122/97
ggccgcuuuucgaugguguc

SEQ ID NO: 3094152 - RNA, 21 nt, Mycobacterium bovis subsp bovis AF2122/97
ggccgcuuuucgauggugucg

SEQ ID NO: 3094153 - RNA, 20 nt, Mycobacterium bovis subsp bovis AF2122/97
ggccgcuuuugauugaccaa

SEQ ID NO: 3094154 - RNA, 14 nt, Mycobacterium bovis subsp bovis AF2122/97
ggccggaacgcccg

SEQ ID NO: 3094155 - RNA, 16 nt, Mycobacterium bovis subsp bovis AF2122/97
ggccggaacgcccggc

SEQ ID NO: 3094156 - RNA, 19 nt, Mycobacterium bovis subsp bovis AF2122/97
ggccggaauacccgcuggc

SEQ ID NO: 3094157 - RNA, 15 nt, Mycobacterium bovis subsp bovis AF2122/97
ggccggaccaucagc

SEQ ID NO: 3094158 - RNA, 16 nt, Mycobacterium bovis subsp bovis AF2122/97
ggccggaccaucagcg

SEQ ID NO: 3094159 - RNA, 20 nt, Mycobacterium bovis subsp bovis AF2122/97
ggccggacccauuggaccga

SEQ ID NO: 3094160 - RNA, 20 nt, Mycobacterium bovis subsp bovis AF2122/97
ggccggaccuuguuggccau

SEQ ID NO: 3094161 - RNA, 14 nt, Mycobacterium bovis subsp bovis AF2122/97
ggccggacgggugc

SEQ ID NO: 3094162 - RNA, 14 nt, Mycobacterium bovis subsp bovis AF2122/97
ggccggagccgccg

SEQ ID NO: 3094163 - RNA, 15 nt, Mycobacterium bovis subsp bovis AF2122/97
ggccggagccgccgg

SEQ ID NO: 3094164 - RNA, 19 nt, Mycobacterium bovis subsp bovis AF2122/97
ggccggagccggugccgac

SEQ ID NO: 3094165 - RNA, 18 nt, Mycobacterium bovis subsp bovis AF2122/97
ggccggagggguuagguu

SEQ ID NO: 3094166 - RNA, 17 nt, Mycobacterium bovis subsp bovis AF2122/97
ggccggaguccgucggg

SEQ ID NO: 3094167 - RNA, 16 nt, Mycobacterium bovis subsp bovis AF2122/97
ggccggagucgacgac

SEQ ID NO: 3094168 - RNA, 19 nt, Mycobacterium bovis subsp bovis AF2122/97
ggccggagucgacgacguc

SEQ ID NO: 3094169 - RNA, 16 nt, Mycobacterium bovis subsp bovis AF2122/97
ggccggauacggcgac

SEQ ID NO: 3094170 - RNA, 17 nt, Mycobacterium bovis subsp bovis AF2122/97
ggccggauccucgauau

SEQ ID NO: 3094171 - RNA, 22 nt, Mycobacterium bovis subsp bovis AF2122/97
ggccggaucgaagaccagcaac

SEQ ID NO: 3094172 - RNA, 18 nt, Mycobacterium bovis subsp bovis AF2122/97
ggccggaugagcgaacgc

SEQ ID NO: 3094173 - RNA, 20 nt, Mycobacterium bovis subsp bovis AF2122/97
ggccggaugagcgaacgcca

SEQ ID NO: 3094174 - RNA, 16 nt, Mycobacterium bovis subsp bovis AF2122/97
ggccggaugucgacga

SEQ ID NO: 3094175 - RNA, 20 nt, Mycobacterium bovis subsp bovis AF2122/97
ggccggaugucgacgagcac

SEQ ID NO: 3094176 - RNA, 14 nt, Mycobacterium bovis subsp bovis AF2122/97
ggccggcaacggcg

SEQ ID NO: 3094177 - RNA, 23 nt, Mycobacterium bovis subsp bovis AF2122/97
ggccggcaagaccgaacagcggc

SEQ ID NO: 3094178 - RNA, 22 nt, Mycobacterium bovis subsp bovis AF2122/97
ggccggcaaugccgcggccagu

SEQ ID NO: 3094179 - RNA, 15 nt, Mycobacterium bovis subsp bovis AF2122/97
ggccggcacccacca

SEQ ID NO: 3094180 - RNA, 18 nt, Mycobacterium bovis subsp bovis AF2122/97
ggccggcacccaccagug

SEQ ID NO: 3094181 - RNA, 17 nt, Mycobacterium bovis subsp bovis AF2122/97
ggccggcaccccacggc

SEQ ID NO: 3094182 - RNA, 14 nt, Mycobacterium bovis subsp bovis AF2122/97
ggccggcaccgcag

SEQ ID NO: 3094183 - RNA, 15 nt, Mycobacterium bovis subsp bovis AF2122/97
ggccggcaccgcagc

SEQ ID NO: 3094184 - RNA, 16 nt, Mycobacterium bovis subsp bovis AF2122/97
ggccggcacugccgag

SEQ ID NO: 3094185 - RNA, 18 nt, Mycobacterium bovis subsp bovis AF2122/97
ggccggcacugccgagca

SEQ ID NO: 3094186 - RNA, 13 nt, Mycobacterium bovis subsp bovis AF2122/97
ggccggcauccgg

SEQ ID NO: 3094187 - RNA, 13 nt, Mycobacterium bovis subsp bovis AF2122/97
ggccggcaucguc

SEQ ID NO: 3094188 - RNA, 17 nt, Mycobacterium bovis subsp bovis AF2122/97
ggccggcaucgucgggu

SEQ ID NO: 3094189 - RNA, 21 nt, Mycobacterium bovis subsp bovis AF2122/97
ggccggcaugcuggcgaucgc

SEQ ID NO: 3094190 - RNA, 15 nt, Mycobacterium bovis subsp bovis AF2122/97
ggccggccaccaccg

SEQ ID NO: 3094191 - RNA, 16 nt, Mycobacterium bovis subsp bovis AF2122/97
ggccggccaccaccgc

SEQ ID NO: 3094192 - RNA, 13 nt, Mycobacterium bovis subsp bovis AF2122/97
ggccggccaccag

SEQ ID NO: 3094193 - RNA, 20 nt, Mycobacterium bovis subsp bovis AF2122/97
ggccggccagcacccgaacc

SEQ ID NO: 3094194 - RNA, 13 nt, Mycobacterium bovis subsp bovis AF2122/97
ggccggccaucgc

SEQ ID NO: 3094195 - RNA, 16 nt, Mycobacterium bovis subsp bovis AF2122/97
ggccggccaucgcccg

SEQ ID NO: 3094196 - RNA, 16 nt, Mycobacterium bovis subsp bovis AF2122/97
ggccggccccgcccgc

SEQ ID NO: 3094197 - RNA, 22 nt, Mycobacterium bovis subsp bovis AF2122/97
ggccggccccgcccgcgcggug

SEQ ID NO: 3094198 - RNA, 13 nt, Mycobacterium bovis subsp bovis AF2122/97
ggccggccgagcg

SEQ ID NO: 3094199 - RNA, 16 nt, Mycobacterium bovis subsp bovis AF2122/97
ggccggccgagcgcac

SEQ ID NO: 3094200 - RNA, 20 nt, Mycobacterium bovis subsp bovis AF2122/97
ggccggccgagcgcacuggg

SEQ ID NO: 3094201 - RNA, 12 nt, Mycobacterium bovis subsp bovis AF2122/97
ggccggccgcga

SEQ ID NO: 3094202 - RNA, 18 nt, Mycobacterium bovis subsp bovis AF2122/97
ggccggccggcaaugccg

SEQ ID NO: 3094203 - RNA, 14 nt, Mycobacterium bovis subsp bovis AF2122/97
ggccggcgauggcc

SEQ ID NO: 3094204 - RNA, 12 nt, Mycobacterium bovis subsp bovis AF2122/97
ggccggcgcagu

SEQ ID NO: 3094205 - RNA, 15 nt, Mycobacterium bovis subsp bovis AF2122/97
ggccggcgcaguggu

SEQ ID NO: 3094206 - RNA, 12 nt, Mycobacterium bovis subsp bovis AF2122/97
ggccggcgccgc

SEQ ID NO: 3094207 - RNA, 14 nt, Mycobacterium bovis subsp bovis AF2122/97
ggccggcgccggcg

SEQ ID NO: 3094208 - RNA, 14 nt, Mycobacterium bovis subsp bovis AF2122/97
ggccggcgcggucg

SEQ ID NO: 3094209 - RNA, 13 nt, Mycobacterium bovis subsp bovis AF2122/97
ggccggcgcucgc

SEQ ID NO: 3094210 - RNA, 14 nt, Mycobacterium bovis subsp bovis AF2122/97
ggccggcggcggcg

SEQ ID NO: 3094211 - RNA, 13 nt, Mycobacterium bovis subsp bovis AF2122/97
ggccggcggcggu

SEQ ID NO: 3094212 - RNA, 15 nt, Mycobacterium bovis subsp bovis AF2122/97
ggccggcggcggugg

SEQ ID NO: 3094213 - RNA, 16 nt, Mycobacterium bovis subsp bovis AF2122/97
ggccggcggcucgggu

SEQ ID NO: 3094214 - RNA, 22 nt, Mycobacterium bovis subsp bovis AF2122/97
ggccggcggcucgggugcgccc

SEQ ID NO: 3094215 - RNA, 16 nt, Mycobacterium bovis subsp bovis AF2122/97
ggccggcgggccugcc

SEQ ID NO: 3094216 - RNA, 16 nt, Mycobacterium bovis subsp bovis AF2122/97
ggccggcgggcucgcc

SEQ ID NO: 3094217 - RNA, 13 nt, Mycobacterium bovis subsp bovis AF2122/97
ggccggcgguagc

SEQ ID NO: 3094218 - RNA, 17 nt, Mycobacterium bovis subsp bovis AF2122/97
ggccggcggucagcagc

SEQ ID NO: 3094219 - RNA, 20 nt, Mycobacterium bovis subsp bovis AF2122/97
ggccggcggucagcagcgcc

SEQ ID NO: 3094220 - RNA, 13 nt, Mycobacterium bovis subsp bovis AF2122/97
ggccggcggucgc

SEQ ID NO: 3094221 - RNA, 16 nt, Mycobacterium bovis subsp bovis AF2122/97
ggccggcguagcggcg

SEQ ID NO: 3094222 - RNA, 19 nt, Mycobacterium bovis subsp bovis AF2122/97
ggccggcguagcggcgaua

SEQ ID NO: 3094223 - RNA, 22 nt, Mycobacterium bovis subsp bovis AF2122/97
ggccggcguagcggcgauaccg

SEQ ID NO: 3094224 - RNA, 16 nt, Mycobacterium bovis subsp bovis AF2122/97
ggccggcgucagcccc

SEQ ID NO: 3094225 - RNA, 17 nt, Mycobacterium bovis subsp bovis AF2122/97
ggccggcgucgaugacg

SEQ ID NO: 3094226 - RNA, 21 nt, Mycobacterium bovis subsp bovis AF2122/97
ggccggcgucgaugacgacgc

SEQ ID NO: 3094227 - RNA, 16 nt, Mycobacterium bovis subsp bovis AF2122/97
ggccggcgucggcguc

SEQ ID NO: 3094228 - RNA, 16 nt, Mycobacterium bovis subsp bovis AF2122/97
ggccggcgugccagca

SEQ ID NO: 3094229 - RNA, 22 nt, Mycobacterium bovis subsp bovis AF2122/97
ggccggcguguucugaucggug

SEQ ID NO: 3094230 - RNA, 13 nt, Mycobacterium bovis subsp bovis AF2122/97
ggccggcuagcgg

SEQ ID NO: 3094231 - RNA, 23 nt, Mycobacterium bovis subsp bovis AF2122/97
ggccggcucgccgacccgccgcg

SEQ ID NO: 3094232 - RNA, 11 nt, Mycobacterium bovis subsp bovis AF2122/97
ggccgggaacc

SEQ ID NO: 3094233 - RNA, 15 nt, Mycobacterium bovis subsp bovis AF2122/97
ggccgggacagcgcc

SEQ ID NO: 3094234 - RNA, 14 nt, Mycobacterium bovis subsp bovis AF2122/97
ggccgggaccacuc

SEQ ID NO: 3094235 - RNA, 14 nt, Mycobacterium bovis subsp bovis AF2122/97
ggccgggaccgccc

SEQ ID NO: 3094236 - RNA, 18 nt, Mycobacterium bovis subsp bovis AF2122/97
ggccgggaccgccccggc

SEQ ID NO: 3094237 - RNA, 16 nt, Mycobacterium bovis subsp bovis AF2122/97
ggccgggacggcgaua

SEQ ID NO: 3094238 - RNA, 11 nt, Mycobacterium bovis subsp bovis AF2122/97
ggccgggaucu

SEQ ID NO: 3094239 - RNA, 22 nt, Mycobacterium bovis subsp bovis AF2122/97
ggccgggaucucgaaggccgcc

SEQ ID NO: 3094240 - RNA, 19 nt, Mycobacterium bovis subsp bovis AF2122/97
ggccgggcagugcgcggcg

SEQ ID NO: 3094241 - RNA, 17 nt, Mycobacterium bovis subsp bovis AF2122/97
ggccgggcaguucacgg

SEQ ID NO: 3094242 - RNA, 14 nt, Mycobacterium bovis subsp bovis AF2122/97
ggccgggccgagug

SEQ ID NO: 3094243 - RNA, 12 nt, Mycobacterium bovis subsp bovis AF2122/97
ggccgggccgcu

SEQ ID NO: 3094244 - RNA, 13 nt, Mycobacterium bovis subsp bovis AF2122/97
ggccgggccugca

SEQ ID NO: 3094245 - RNA, 21 nt, Mycobacterium bovis subsp bovis AF2122/97
ggccgggccugcaccacggcg

SEQ ID NO: 3094246 - RNA, 17 nt, Mycobacterium bovis subsp bovis AF2122/97
ggccgggcgaucgccug

SEQ ID NO: 3094247 - RNA, 17 nt, Mycobacterium bovis subsp bovis AF2122/97
ggccgggcgcaagcagc

SEQ ID NO: 3094248 - RNA, 16 nt, Mycobacterium bovis subsp bovis AF2122/97
ggccgggcuccucugg

SEQ ID NO: 3094249 - RNA, 17 nt, Mycobacterium bovis subsp bovis AF2122/97
ggccgggggaacgggau

SEQ ID NO: 3094250 - RNA, 19 nt, Mycobacterium bovis subsp bovis AF2122/97
ggccggggugccggcgaug

SEQ ID NO: 3094251 - RNA, 20 nt, Mycobacterium bovis subsp bovis AF2122/97
ggccgggucgaucaccgaca

SEQ ID NO: 3094252 - RNA, 21 nt, Mycobacterium bovis subsp bovis AF2122/97
ggccgggucgaucaccgacac

SEQ ID NO: 3094253 - RNA, 18 nt, Mycobacterium bovis subsp bovis AF2122/97
ggccgggucgcgcuggcg

SEQ ID NO: 3094254 - RNA, 23 nt, Mycobacterium bovis subsp bovis AF2122/97
ggccgggucuuccggugcgccga

SEQ ID NO: 3094255 - RNA, 18 nt, Mycobacterium bovis subsp bovis AF2122/97
ggccgggugcgugcgcgu

SEQ ID NO: 3094256 - RNA, 16 nt, Mycobacterium bovis subsp bovis AF2122/97
ggccggguggcccggc

SEQ ID NO: 3094257 - RNA, 22 nt, Mycobacterium bovis subsp bovis AF2122/97
ggccggguuaucggcagcagga

SEQ ID NO: 3094258 - RNA, 18 nt, Mycobacterium bovis subsp bovis AF2122/97
ggccggguuccagcggca

SEQ ID NO: 3094259 - RNA, 18 nt, Mycobacterium bovis subsp bovis AF2122/97
ggccggguuggccggcgc

SEQ ID NO: 3094260 - RNA, 20 nt, Mycobacterium bovis subsp bovis AF2122/97
ggccgguaccgggacgaauc

SEQ ID NO: 3094261 - RNA, 23 nt, Mycobacterium bovis subsp bovis AF2122/97
ggccgguagaucuucggccgcac

SEQ ID NO: 3094262 - RNA, 18 nt, Mycobacterium bovis subsp bovis AF2122/97
ggccgguagcgcgggugg

SEQ ID NO: 3094263 - RNA, 14 nt, Mycobacterium bovis subsp bovis AF2122/97
ggccgguaguagcu

SEQ ID NO: 3094264 - RNA, 18 nt, Mycobacterium bovis subsp bovis AF2122/97
ggccgguauuucggcgac

SEQ ID NO: 3094265 - RNA, 19 nt, Mycobacterium bovis subsp bovis AF2122/97
ggccggucacguccgcggg

SEQ ID NO: 3094266 - RNA, 15 nt, Mycobacterium bovis subsp bovis AF2122/97
ggccgguccacggug

SEQ ID NO: 3094267 - RNA, 14 nt, Mycobacterium bovis subsp bovis AF2122/97
ggccgguccgggaa

SEQ ID NO: 3094268 - RNA, 13 nt, Mycobacterium bovis subsp bovis AF2122/97
ggccggucgagac

SEQ ID NO: 3094269 - RNA, 15 nt, Mycobacterium bovis subsp bovis AF2122/97
ggccggucggugagc

SEQ ID NO: 3094270 - RNA, 17 nt, Mycobacterium bovis subsp bovis AF2122/97
ggccggucgugccgggg

SEQ ID NO: 3094271 - RNA, 23 nt, Mycobacterium bovis subsp bovis AF2122/97
ggccggugaacggcagcacgguc

SEQ ID NO: 3094272 - RNA, 15 nt, Mycobacterium bovis subsp bovis AF2122/97
ggccggugcccgggc

SEQ ID NO: 3094273 - RNA, 17 nt, Mycobacterium bovis subsp bovis AF2122/97
ggccggugcgcaccaga

SEQ ID NO: 3094274 - RNA, 18 nt, Mycobacterium bovis subsp bovis AF2122/97
ggccggugcgcaccagag

SEQ ID NO: 3094275 - RNA, 13 nt, Mycobacterium bovis subsp bovis AF2122/97
ggccggugcgcau

SEQ ID NO: 3094276 - RNA, 21 nt, Mycobacterium bovis subsp bovis AF2122/97
ggccggugcgucacagccggg

SEQ ID NO: 3094277 - RNA, 21 nt, Mycobacterium bovis subsp bovis AF2122/97
ggccgguggaaaagccacggc

SEQ ID NO: 3094278 - RNA, 19 nt, Mycobacterium bovis subsp bovis AF2122/97
ggccgguggaaaccgggcg

SEQ ID NO: 3094279 - RNA, 13 nt, Mycobacterium bovis subsp bovis AF2122/97
ggccggugggccg

SEQ ID NO: 3094280 - RNA, 15 nt, Mycobacterium bovis subsp bovis AF2122/97
ggccggugggccgcc

SEQ ID NO: 3094281 - RNA, 21 nt, Mycobacterium bovis subsp bovis AF2122/97
ggccgguggguagccagcgcg

SEQ ID NO: 3094282 - RNA, 20 nt, Mycobacterium bovis subsp bovis AF2122/97
ggccgguuagcaccaguucc

SEQ ID NO: 3094283 - RNA, 23 nt, Mycobacterium bovis subsp bovis AF2122/97
ggccgguucagguugagugucgg

SEQ ID NO: 3094284 - RNA, 21 nt, Mycobacterium bovis subsp bovis AF2122/97
ggccgguucccuuguucccga

SEQ ID NO: 3094285 - RNA, 14 nt, Mycobacterium bovis subsp bovis AF2122/97
ggccgguucgcccg

SEQ ID NO: 3094286 - RNA, 16 nt, Mycobacterium bovis subsp bovis AF2122/97
ggccgguucgcccgag

SEQ ID NO: 3094287 - RNA, 12 nt, Mycobacterium bovis subsp bovis AF2122/97
ggccgguuggcc

SEQ ID NO: 3094288 - RNA, 15 nt, Mycobacterium bovis subsp bovis AF2122/97
ggccgguuggccagc

SEQ ID NO: 3094289 - RNA, 16 nt, Mycobacterium bovis subsp bovis AF2122/97
ggccgguuggccagcc

SEQ ID NO: 3094290 - RNA, 14 nt, Mycobacterium bovis subsp bovis AF2122/97
ggccguaccgguga

SEQ ID NO: 3094291 - RNA, 14 nt, Mycobacterium bovis subsp bovis AF2122/97
ggccguacgacggc

SEQ ID NO: 3094292 - RNA, 15 nt, Mycobacterium bovis subsp bovis AF2122/97
ggccguacucgucgu

SEQ ID NO: 3094293 - RNA, 16 nt, Mycobacterium bovis subsp bovis AF2122/97
ggccguagcccacgac

SEQ ID NO: 3094294 - RNA, 13 nt, Mycobacterium bovis subsp bovis AF2122/97
ggccguaggcggc

SEQ ID NO: 3094295 - RNA, 16 nt, Mycobacterium bovis subsp bovis AF2122/97
ggccguaggcggcgac

SEQ ID NO: 3094296 - RNA, 15 nt, Mycobacterium bovis subsp bovis AF2122/97
ggccguagucggcga

SEQ ID NO: 3094297 - RNA, 17 nt, Mycobacterium bovis subsp bovis AF2122/97
ggccguagucggcgaug

SEQ ID NO: 3094298 - RNA, 18 nt, Mycobacterium bovis subsp bovis AF2122/97
ggccguagucggcgaugc

SEQ ID NO: 3094299 - RNA, 20 nt, Mycobacterium bovis subsp bovis AF2122/97
ggccguagugcacgucggcg

SEQ ID NO: 3094300 - RNA, 17 nt, Mycobacterium bovis subsp bovis AF2122/97
ggccguaguggccggcu

SEQ ID NO: 3094301 - RNA, 18 nt, Mycobacterium bovis subsp bovis AF2122/97
ggccguaguggccggcuu

SEQ ID NO: 3094302 - RNA, 22 nt, Mycobacterium bovis subsp bovis AF2122/97
ggccgucaaccagggugccggc

SEQ ID NO: 3094303 - RNA, 19 nt, Mycobacterium bovis subsp bovis AF2122/97
ggccgucaccgacgcacag

SEQ ID NO: 3094304 - RNA, 18 nt, Mycobacterium bovis subsp bovis AF2122/97
ggccgucaccggucggcc

SEQ ID NO: 3094305 - RNA, 12 nt, Mycobacterium bovis subsp bovis AF2122/97
ggccgucagcca

SEQ ID NO: 3094306 - RNA, 18 nt, Mycobacterium bovis subsp bovis AF2122/97
ggccgucagccaggugcc

SEQ ID NO: 3094307 - RNA, 20 nt, Mycobacterium bovis subsp bovis AF2122/97
ggccgucagcgucggcgcau

SEQ ID NO: 3094308 - RNA, 14 nt, Mycobacterium bovis subsp bovis AF2122/97
ggccgucagggugu

SEQ ID NO: 3094309 - RNA, 15 nt, Mycobacterium bovis subsp bovis AF2122/97
ggccgucaucgccgg

SEQ ID NO: 3094310 - RNA, 16 nt, Mycobacterium bovis subsp bovis AF2122/97
ggccgucauggcccga

SEQ ID NO: 3094311 - RNA, 15 nt, Mycobacterium bovis subsp bovis AF2122/97
ggccgucccaccagc

SEQ ID NO: 3094312 - RNA, 22 nt, Mycobacterium bovis subsp bovis AF2122/97
ggccgucccgcgagcagcccgg

SEQ ID NO: 3094313 - RNA, 23 nt, Mycobacterium bovis subsp bovis AF2122/97
ggccguccgaccgauaacacccg

SEQ ID NO: 3094314 - RNA, 13 nt, Mycobacterium bovis subsp bovis AF2122/97
ggccguccucggu

SEQ ID NO: 3094315 - RNA, 18 nt, Mycobacterium bovis subsp bovis AF2122/97
ggccguccucggucagcu

SEQ ID NO: 3094316 - RNA, 18 nt, Mycobacterium bovis subsp bovis AF2122/97
ggccgucgaacgguagca

SEQ ID NO: 3094317 - RNA, 22 nt, Mycobacterium bovis subsp bovis AF2122/97
ggccgucgaacgguagcacggu

SEQ ID NO: 3094318 - RNA, 14 nt, Mycobacterium bovis subsp bovis AF2122/97
ggccgucgacgauc

SEQ ID NO: 3094319 - RNA, 17 nt, Mycobacterium bovis subsp bovis AF2122/97
ggccgucgacgaucagc

SEQ ID NO: 3094320 - RNA, 21 nt, Mycobacterium bovis subsp bovis AF2122/97
ggccgucgacgaucagcgagu

SEQ ID NO: 3094321 - RNA, 23 nt, Mycobacterium bovis subsp bovis AF2122/97
ggccgucgacgcaugggucaugg

SEQ ID NO: 3094322 - RNA, 14 nt, Mycobacterium bovis subsp bovis AF2122/97
ggccgucgaucaag

SEQ ID NO: 3094323 - RNA, 20 nt, Mycobacterium bovis subsp bovis AF2122/97
ggccgucgaucaagugcggu

SEQ ID NO: 3094324 - RNA, 20 nt, Mycobacterium bovis subsp bovis AF2122/97
ggccgucgaucuucuccucg

SEQ ID NO: 3094325 - RNA, 13 nt, Mycobacterium bovis subsp bovis AF2122/97
ggccgucgauggu

SEQ ID NO: 3094326 - RNA, 12 nt, Mycobacterium bovis subsp bovis AF2122/97
ggccgucgccga

SEQ ID NO: 3094327 - RNA, 12 nt, Mycobacterium bovis subsp bovis AF2122/97
ggccgucgccgg

SEQ ID NO: 3094328 - RNA, 21 nt, Mycobacterium bovis subsp bovis AF2122/97
ggccgucgccggagucgauca

SEQ ID NO: 3094329 - RNA, 21 nt, Mycobacterium bovis subsp bovis AF2122/97
ggccgucgcgggacaacagca

SEQ ID NO: 3094330 - RNA, 15 nt, Mycobacterium bovis subsp bovis AF2122/97
ggccgucgcuggugu

SEQ ID NO: 3094331 - RNA, 12 nt, Mycobacterium bovis subsp bovis AF2122/97
ggccgucggcgu

SEQ ID NO: 3094332 - RNA, 15 nt, Mycobacterium bovis subsp bovis AF2122/97
ggccgucggcgucga

SEQ ID NO: 3094333 - RNA, 18 nt, Mycobacterium bovis subsp bovis AF2122/97
ggccgucgggacggccaa

SEQ ID NO: 3094334 - RNA, 15 nt, Mycobacterium bovis subsp bovis AF2122/97
ggccgucgggcagca

SEQ ID NO: 3094335 - RNA, 16 nt, Mycobacterium bovis subsp bovis AF2122/97
ggccgucgggcagcag

SEQ ID NO: 3094336 - RNA, 20 nt, Mycobacterium bovis subsp bovis AF2122/97
ggccgucggggaguucgcgc

SEQ ID NO: 3094337 - RNA, 15 nt, Mycobacterium bovis subsp bovis AF2122/97
ggccgucgggugugc

SEQ ID NO: 3094338 - RNA, 16 nt, Mycobacterium bovis subsp bovis AF2122/97
ggccgucgucggucac

SEQ ID NO: 3094339 - RNA, 18 nt, Mycobacterium bovis subsp bovis AF2122/97
ggccgucguugccggcga

SEQ ID NO: 3094340 - RNA, 14 nt, Mycobacterium bovis subsp bovis AF2122/97
ggccgucucgacac

SEQ ID NO: 3094341 - RNA, 16 nt, Mycobacterium bovis subsp bovis AF2122/97
ggccgucucgacacug

SEQ ID NO: 3094342 - RNA, 15 nt, Mycobacterium bovis subsp bovis AF2122/97
ggccgucucgccgug

SEQ ID NO: 3094343 - RNA, 16 nt, Mycobacterium bovis subsp bovis AF2122/97
ggccgucuucggugau

SEQ ID NO: 3094344 - RNA, 17 nt, Mycobacterium bovis subsp bovis AF2122/97
ggccgucuucggugauc

SEQ ID NO: 3094345 - RNA, 14 nt, Mycobacterium bovis subsp bovis AF2122/97
ggccgugaacggcg

SEQ ID NO: 3094346 - RNA, 18 nt, Mycobacterium bovis subsp bovis AF2122/97
ggccgugaauucgccgaa

SEQ ID NO: 3094347 - RNA, 22 nt, Mycobacterium bovis subsp bovis AF2122/97
ggccgugacccucagcaccgcu

SEQ ID NO: 3094348 - RNA, 12 nt, Mycobacterium bovis subsp bovis AF2122/97
ggccgugaccga

SEQ ID NO: 3094349 - RNA, 16 nt, Mycobacterium bovis subsp bovis AF2122/97
ggccgugaccgagccg

SEQ ID NO: 3094350 - RNA, 16 nt, Mycobacterium bovis subsp bovis AF2122/97
ggccgugaugccacgg

SEQ ID NO: 3094351 - RNA, 17 nt, Mycobacterium bovis subsp bovis AF2122/97
ggccgugaugccacggc

SEQ ID NO: 3094352 - RNA, 12 nt, Mycobacterium bovis subsp bovis AF2122/97
ggccgugccgcc

SEQ ID NO: 3094353 - RNA, 13 nt, Mycobacterium bovis subsp bovis AF2122/97
ggccgugccgccg

SEQ ID NO: 3094354 - RNA, 15 nt, Mycobacterium bovis subsp bovis AF2122/97
ggccgugccgccgac

SEQ ID NO: 3094355 - RNA, 19 nt, Mycobacterium bovis subsp bovis AF2122/97
ggccguggaaagccggcgu

SEQ ID NO: 3094356 - RNA, 14 nt, Mycobacterium bovis subsp bovis AF2122/97
ggccguggaugucg

SEQ ID NO: 3094357 - RNA, 15 nt, Mycobacterium bovis subsp bovis AF2122/97
ggccguggcacccgc

SEQ ID NO: 3094358 - RNA, 18 nt, Mycobacterium bovis subsp bovis AF2122/97
ggccguggcacccgcagu

SEQ ID NO: 3094359 - RNA, 20 nt, Mycobacterium bovis subsp bovis AF2122/97
ggccguggcacccgcagugg

SEQ ID NO: 3094360 - RNA, 13 nt, Mycobacterium bovis subsp bovis AF2122/97
ggccguggcgaau

SEQ ID NO: 3094361 - RNA, 20 nt, Mycobacterium bovis subsp bovis AF2122/97
ggccgugggugucgguggcc

SEQ ID NO: 3094362 - RNA, 17 nt, Mycobacterium bovis subsp bovis AF2122/97
ggccguggucgagggcg

SEQ ID NO: 3094363 - RNA, 22 nt, Mycobacterium bovis subsp bovis AF2122/97
ggccguggucgagggcggcguc

SEQ ID NO: 3094364 - RNA, 17 nt, Mycobacterium bovis subsp bovis AF2122/97
ggccguggucgaggugg

SEQ ID NO: 3094365 - RNA, 17 nt, Mycobacterium bovis subsp bovis AF2122/97
ggccgugucgggcgcga

SEQ ID NO: 3094366 - RNA, 22 nt, Mycobacterium bovis subsp bovis AF2122/97
ggccguucggcgcccgcucggc

SEQ ID NO: 3094367 - RNA, 22 nt, Mycobacterium bovis subsp bovis AF2122/97
ggccguucgugggcauugcggc

SEQ ID NO: 3094368 - RNA, 22 nt, Mycobacterium bovis subsp bovis AF2122/97
ggccguugacggugucuugcca

SEQ ID NO: 3094369 - RNA, 23 nt, Mycobacterium bovis subsp bovis AF2122/97
ggccguugcuauucgccagcgcc

SEQ ID NO: 3094370 - RNA, 18 nt, Mycobacterium bovis subsp bovis AF2122/97
ggccguuggcggcggugg

SEQ ID NO: 3094371 - RNA, 20 nt, Mycobacterium bovis subsp bovis AF2122/97
ggccguuggcggcgguggcc

SEQ ID NO: 3094372 - RNA, 18 nt, Mycobacterium bovis subsp bovis AF2122/97
ggccguugggccaccggc

SEQ ID NO: 3094373 - RNA, 23 nt, Mycobacterium bovis subsp bovis AF2122/97
ggccguuggugaggccccccgcg

SEQ ID NO: 3094374 - RNA, 19 nt, Mycobacterium bovis subsp bovis AF2122/97
ggccuaccaggcgcggccc

SEQ ID NO: 3094375 - RNA, 15 nt, Mycobacterium bovis subsp bovis AF2122/97
ggccuaccgagcuac

SEQ ID NO: 3094376 - RNA, 13 nt, Mycobacterium bovis subsp bovis AF2122/97
ggccuagccgcgg

SEQ ID NO: 3094377 - RNA, 23 nt, Mycobacterium bovis subsp bovis AF2122/97
ggccuagccgcggcaccgccgag

SEQ ID NO: 3094378 - RNA, 14 nt, Mycobacterium bovis subsp bovis AF2122/97
ggccuagcgcggcg

SEQ ID NO: 3094379 - RNA, 12 nt, Mycobacterium bovis subsp bovis AF2122/97
ggccuagggcgg

SEQ ID NO: 3094380 - RNA, 15 nt, Mycobacterium bovis subsp bovis AF2122/97
ggccuagggcggcgg

SEQ ID NO: 3094381 - RNA, 19 nt, Mycobacterium bovis subsp bovis AF2122/97
ggccuaguccggcacugcg

SEQ ID NO: 3094382 - RNA, 16 nt, Mycobacterium bovis subsp bovis AF2122/97
ggccucacccggucaa

SEQ ID NO: 3094383 - RNA, 15 nt, Mycobacterium bovis subsp bovis AF2122/97
ggccucagacaacgg

SEQ ID NO: 3094384 - RNA, 19 nt, Mycobacterium bovis subsp bovis AF2122/97
ggccucagacaacggguug

SEQ ID NO: 3094385 - RNA, 15 nt, Mycobacterium bovis subsp bovis AF2122/97
ggccucagccaccgg

SEQ ID NO: 3094386 - RNA, 16 nt, Mycobacterium bovis subsp bovis AF2122/97
ggccucagccaccggg

SEQ ID NO: 3094387 - RNA, 18 nt, Mycobacterium bovis subsp bovis AF2122/97
ggccucagccaccgggcg

SEQ ID NO: 3094388 - RNA, 16 nt, Mycobacterium bovis subsp bovis AF2122/97
ggccucagcccggcca

SEQ ID NO: 3094389 - RNA, 22 nt, Mycobacterium bovis subsp bovis AF2122/97
ggccucagcccggccagccgca

SEQ ID NO: 3094390 - RNA, 21 nt, Mycobacterium bovis subsp bovis AF2122/97
ggccucagcuaccccggcggu

SEQ ID NO: 3094391 - RNA, 20 nt, Mycobacterium bovis subsp bovis AF2122/97
ggccucaguacagcgcguug

SEQ ID NO: 3094392 - RNA, 17 nt, Mycobacterium bovis subsp bovis AF2122/97
ggccucauccaccgaug

SEQ ID NO: 3094393 - RNA, 23 nt, Mycobacterium bovis subsp bovis AF2122/97
ggccucaugcuaggccaccggcg

SEQ ID NO: 3094394 - RNA, 21 nt, Mycobacterium bovis subsp bovis AF2122/97
ggccuccaaaaucgcggccac

SEQ ID NO: 3094395 - RNA, 21 nt, Mycobacterium bovis subsp bovis AF2122/97
ggccuccacccgccacgguuc

SEQ ID NO: 3094396 - RNA, 13 nt, Mycobacterium bovis subsp bovis AF2122/97
ggccucccacggc

SEQ ID NO: 3094397 - RNA, 17 nt, Mycobacterium bovis subsp bovis AF2122/97
ggccucccacggcgcgu

SEQ ID NO: 3094398 - RNA, 17 nt, Mycobacterium bovis subsp bovis AF2122/97
ggccucccacucaccca

SEQ ID NO: 3094399 - RNA, 21 nt, Mycobacterium bovis subsp bovis AF2122/97
ggccucccgcaaugcgagcgc

SEQ ID NO: 3094400 - RNA, 15 nt, Mycobacterium bovis subsp bovis AF2122/97
ggccucccgggccgc

SEQ ID NO: 3094401 - RNA, 17 nt, Mycobacterium bovis subsp bovis AF2122/97
ggccucccgggccgccg

SEQ ID NO: 3094402 - RNA, 12 nt, Mycobacterium bovis subsp bovis AF2122/97
ggccuccgccga

SEQ ID NO: 3094403 - RNA, 16 nt, Mycobacterium bovis subsp bovis AF2122/97
ggccuccgcugccgcc

SEQ ID NO: 3094404 - RNA, 18 nt, Mycobacterium bovis subsp bovis AF2122/97
ggccuccgcugccgcccg

SEQ ID NO: 3094405 - RNA, 22 nt, Mycobacterium bovis subsp bovis AF2122/97
ggccuccgcugccgcccgcgcc

SEQ ID NO: 3094406 - RNA, 18 nt, Mycobacterium bovis subsp bovis AF2122/97
ggccuccuccccgaccgc

SEQ ID NO: 3094407 - RNA, 23 nt, Mycobacterium bovis subsp bovis AF2122/97
ggccuccucgucgcucccgguug

SEQ ID NO: 3094408 - RNA, 20 nt, Mycobacterium bovis subsp bovis AF2122/97
ggccuccugcuggcccugcu

SEQ ID NO: 3094409 - RNA, 21 nt, Mycobacterium bovis subsp bovis AF2122/97
ggccuccugcuggcccugcuc

SEQ ID NO: 3094410 - RNA, 20 nt, Mycobacterium bovis subsp bovis AF2122/97
ggccucgaagggcuugucgc

SEQ ID NO: 3094411 - RNA, 13 nt, Mycobacterium bovis subsp bovis AF2122/97
ggccucgaccgcg

SEQ ID NO: 3094412 - RNA, 17 nt, Mycobacterium bovis subsp bovis AF2122/97
ggccucgaccucuucgg

SEQ ID NO: 3094413 - RNA, 16 nt, Mycobacterium bovis subsp bovis AF2122/97
ggccucgccggcgcgc

SEQ ID NO: 3094414 - RNA, 13 nt, Mycobacterium bovis subsp bovis AF2122/97
ggccucgccgggg

SEQ ID NO: 3094415 - RNA, 13 nt, Mycobacterium bovis subsp bovis AF2122/97
ggccucgcugcuc

SEQ ID NO: 3094416 - RNA, 15 nt, Mycobacterium bovis subsp bovis AF2122/97
ggccucgcugcucag

SEQ ID NO: 3094417 - RNA, 13 nt, Mycobacterium bovis subsp bovis AF2122/97
ggccucggcagca

SEQ ID NO: 3094418 - RNA, 15 nt, Mycobacterium bovis subsp bovis AF2122/97
ggccucggccagcgu

SEQ ID NO: 3094419 - RNA, 15 nt, Mycobacterium bovis subsp bovis AF2122/97
ggccucggcggccgu

SEQ ID NO: 3094420 - RNA, 19 nt, Mycobacterium bovis subsp bovis AF2122/97
ggccucggcggccguggcc

SEQ ID NO: 3094421 - RNA, 22 nt, Mycobacterium bovis subsp bovis AF2122/97
ggccucggcggccguggccucg

SEQ ID NO: 3094422 - RNA, 20 nt, Mycobacterium bovis subsp bovis AF2122/97
ggccucgggacucccgcgcg

SEQ ID NO: 3094423 - RNA, 13 nt, Mycobacterium bovis subsp bovis AF2122/97
ggccucggggauc

SEQ ID NO: 3094424 - RNA, 19 nt, Mycobacterium bovis subsp bovis AF2122/97
ggccucggggaucgcaagc

SEQ ID NO: 3094425 - RNA, 14 nt, Mycobacterium bovis subsp bovis AF2122/97
ggccucggucgcca

SEQ ID NO: 3094426 - RNA, 21 nt, Mycobacterium bovis subsp bovis AF2122/97
ggccucggugagcagcucggu

SEQ ID NO: 3094427 - RNA, 23 nt, Mycobacterium bovis subsp bovis AF2122/97
ggccucggugagcagcucgguga

SEQ ID NO: 3094428 - RNA, 12 nt, Mycobacterium bovis subsp bovis AF2122/97
ggccucguccag

SEQ ID NO: 3094429 - RNA, 14 nt, Mycobacterium bovis subsp bovis AF2122/97
ggccucguccagcu

SEQ ID NO: 3094430 - RNA, 14 nt, Mycobacterium bovis subsp bovis AF2122/97
ggccucgucgaugu

SEQ ID NO: 3094431 - RNA, 21 nt, Mycobacterium bovis subsp bovis AF2122/97
ggccucugaccagccggucuu

SEQ ID NO: 3094432 - RNA, 14 nt, Mycobacterium bovis subsp bovis AF2122/97
ggccugaaccacgc

SEQ ID NO: 3094433 - RNA, 19 nt, Mycobacterium bovis subsp bovis AF2122/97
ggccugaccggcucgccgg

SEQ ID NO: 3094434 - RNA, 20 nt, Mycobacterium bovis subsp bovis AF2122/97
ggccugaccggcucgccggc

SEQ ID NO: 3094435 - RNA, 15 nt, Mycobacterium bovis subsp bovis AF2122/97
ggccugaccggucac

SEQ ID NO: 3094436 - RNA, 14 nt, Mycobacterium bovis subsp bovis AF2122/97
ggccugagcggcca

SEQ ID NO: 3094437 - RNA, 18 nt, Mycobacterium bovis subsp bovis AF2122/97
ggccugagcgugucuggc

SEQ ID NO: 3094438 - RNA, 15 nt, Mycobacterium bovis subsp bovis AF2122/97
ggccugaugcagggc

SEQ ID NO: 3094439 - RNA, 17 nt, Mycobacterium bovis subsp bovis AF2122/97
ggccugcaccacggcgg

SEQ ID NO: 3094440 - RNA, 19 nt, Mycobacterium bovis subsp bovis AF2122/97
ggccugcaccacggcggcc

SEQ ID NO: 3094441 - RNA, 16 nt, Mycobacterium bovis subsp bovis AF2122/97
ggccugcacgccggcg

SEQ ID NO: 3094442 - RNA, 17 nt, Mycobacterium bovis subsp bovis AF2122/97
ggccugcacgccggcgc

SEQ ID NO: 3094443 - RNA, 13 nt, Mycobacterium bovis subsp bovis AF2122/97
ggccugcagccga

SEQ ID NO: 3094444 - RNA, 18 nt, Mycobacterium bovis subsp bovis AF2122/97
ggccugcagccgaugcuc

SEQ ID NO: 3094445 - RNA, 20 nt, Mycobacterium bovis subsp bovis AF2122/97
ggccugcagcgaugacgacc

SEQ ID NO: 3094446 - RNA, 13 nt, Mycobacterium bovis subsp bovis AF2122/97
ggccugcccagca

SEQ ID NO: 3094447 - RNA, 14 nt, Mycobacterium bovis subsp bovis AF2122/97
ggccugcccagcac

SEQ ID NO: 3094448 - RNA, 16 nt, Mycobacterium bovis subsp bovis AF2122/97
ggccugcccccggcgc

SEQ ID NO: 3094449 - RNA, 23 nt, Mycobacterium bovis subsp bovis AF2122/97
ggccugcccccggcgcggcggac

SEQ ID NO: 3094450 - RNA, 12 nt, Mycobacterium bovis subsp bovis AF2122/97
ggccugcccggc

SEQ ID NO: 3094451 - RNA, 15 nt, Mycobacterium bovis subsp bovis AF2122/97
ggccugcccggcgcc

SEQ ID NO: 3094452 - RNA, 17 nt, Mycobacterium bovis subsp bovis AF2122/97
ggccugcccggcgccgu

SEQ ID NO: 3094453 - RNA, 14 nt, Mycobacterium bovis subsp bovis AF2122/97
ggccugccggcagc

SEQ ID NO: 3094454 - RNA, 17 nt, Mycobacterium bovis subsp bovis AF2122/97
ggccugcgacgagccca

SEQ ID NO: 3094455 - RNA, 14 nt, Mycobacterium bovis subsp bovis AF2122/97
ggccugcgcagacu

SEQ ID NO: 3094456 - RNA, 15 nt, Mycobacterium bovis subsp bovis AF2122/97
ggccugcgccggcgc

SEQ ID NO: 3094457 - RNA, 16 nt, Mycobacterium bovis subsp bovis AF2122/97
ggccugcgccggcgcu

SEQ ID NO: 3094458 - RNA, 18 nt, Mycobacterium bovis subsp bovis AF2122/97
ggccugcgcgaccgacca

SEQ ID NO: 3094459 - RNA, 19 nt, Mycobacterium bovis subsp bovis AF2122/97
ggccugcgcgaccgaccag

SEQ ID NO: 3094460 - RNA, 18 nt, Mycobacterium bovis subsp bovis AF2122/97
ggccugcgcuucguccag

SEQ ID NO: 3094461 - RNA, 23 nt, Mycobacterium bovis subsp bovis AF2122/97
ggccugcgcuucguccagcgauc

SEQ ID NO: 3094462 - RNA, 20 nt, Mycobacterium bovis subsp bovis AF2122/97
ggccugcggcaacggcucgu

SEQ ID NO: 3094463 - RNA, 16 nt, Mycobacterium bovis subsp bovis AF2122/97
ggccugcggcaccggc

SEQ ID NO: 3094464 - RNA, 21 nt, Mycobacterium bovis subsp bovis AF2122/97
ggccugcggcaccggcucagg

SEQ ID NO: 3094465 - RNA, 14 nt, Mycobacterium bovis subsp bovis AF2122/97
ggccugcggucagg

SEQ ID NO: 3094466 - RNA, 15 nt, Mycobacterium bovis subsp bovis AF2122/97
ggccugcggucaggg

SEQ ID NO: 3094467 - RNA, 18 nt, Mycobacterium bovis subsp bovis AF2122/97
ggccugcggucagggcuu

SEQ ID NO: 3094468 - RNA, 19 nt, Mycobacterium bovis subsp bovis AF2122/97
ggccugcguccgacgccug

SEQ ID NO: 3094469 - RNA, 19 nt, Mycobacterium bovis subsp bovis AF2122/97
ggccugcuaaccacggugu

SEQ ID NO: 3094470 - RNA, 14 nt, Mycobacterium bovis subsp bovis AF2122/97
ggccugcucggcga

SEQ ID NO: 3094471 - RNA, 21 nt, Mycobacterium bovis subsp bovis AF2122/97
ggccuggaagacggugcgggc

SEQ ID NO: 3094472 - RNA, 17 nt, Mycobacterium bovis subsp bovis AF2122/97
ggccuggaucgugccga

SEQ ID NO: 3094473 - RNA, 18 nt, Mycobacterium bovis subsp bovis AF2122/97
ggccuggaucgugccgaa

SEQ ID NO: 3094474 - RNA, 14 nt, Mycobacterium bovis subsp bovis AF2122/97
ggccuggcacccgg

SEQ ID NO: 3094475 - RNA, 17 nt, Mycobacterium bovis subsp bovis AF2122/97
ggccuggcacccggggu

SEQ ID NO: 3094476 - RNA, 13 nt, Mycobacterium bovis subsp bovis AF2122/97
ggccuggcagggu

SEQ ID NO: 3094477 - RNA, 16 nt, Mycobacterium bovis subsp bovis AF2122/97
ggccuggccaccuggu

SEQ ID NO: 3094478 - RNA, 14 nt, Mycobacterium bovis subsp bovis AF2122/97
ggccuggccccggc

SEQ ID NO: 3094479 - RNA, 20 nt, Mycobacterium bovis subsp bovis AF2122/97
ggccuggccccggcugucgg

SEQ ID NO: 3094480 - RNA, 13 nt, Mycobacterium bovis subsp bovis AF2122/97
ggccuggccgcca

SEQ ID NO: 3094481 - RNA, 18 nt, Mycobacterium bovis subsp bovis AF2122/97
ggccuggccugcccagca

SEQ ID NO: 3094482 - RNA, 17 nt, Mycobacterium bovis subsp bovis AF2122/97
ggccugggacggcggca

SEQ ID NO: 3094483 - RNA, 24 nt, Mycobacterium bovis subsp bovis AF2122/97
ggccuggggcagccgggcgucgcu

SEQ ID NO: 3094484 - RNA, 23 nt, Mycobacterium bovis subsp bovis AF2122/97
ggccugguacucccgcgaucgcg

SEQ ID NO: 3094485 - RNA, 16 nt, Mycobacterium bovis subsp bovis AF2122/97
ggccuggucccaccgc

SEQ ID NO: 3094486 - RNA, 14 nt, Mycobacterium bovis subsp bovis AF2122/97
ggccuggucggcca

SEQ ID NO: 3094487 - RNA, 21 nt, Mycobacterium bovis subsp bovis AF2122/97
ggccuggugcucaacggcgac

SEQ ID NO: 3094488 - RNA, 22 nt, Mycobacterium bovis subsp bovis AF2122/97
ggccugguuguccguaucgggc

SEQ ID NO: 3094489 - RNA, 17 nt, Mycobacterium bovis subsp bovis AF2122/97
ggccugucaggcggcgg

SEQ ID NO: 3094490 - RNA, 18 nt, Mycobacterium bovis subsp bovis AF2122/97
ggccugucccgcacccgg

SEQ ID NO: 3094491 - RNA, 22 nt, Mycobacterium bovis subsp bovis AF2122/97
ggccugucgaagauccagcgca

SEQ ID NO: 3094492 - RNA, 16 nt, Mycobacterium bovis subsp bovis AF2122/97
ggccuguucaacuccg

SEQ ID NO: 3094493 - RNA, 15 nt, Mycobacterium bovis subsp bovis AF2122/97
ggccuguucgccguc

SEQ ID NO: 3094494 - RNA, 17 nt, Mycobacterium bovis subsp bovis AF2122/97
ggccuguucgccgucgc

SEQ ID NO: 3094495 - RNA, 15 nt, Mycobacterium bovis subsp bovis AF2122/97
ggccuguucggcggc

SEQ ID NO: 3094496 - RNA, 21 nt, Mycobacterium bovis subsp bovis AF2122/97
ggccuguugcugcccgacacc

SEQ ID NO: 3094497 - RNA, 22 nt, Mycobacterium bovis subsp bovis AF2122/97
ggccuucaaggaagccgcggcc

SEQ ID NO: 3094498 - RNA, 12 nt, Mycobacterium bovis subsp bovis AF2122/97
ggccuucgccga

SEQ ID NO: 3094499 - RNA, 23 nt, Mycobacterium bovis subsp bovis AF2122/97
ggccuucuccccgaucagcaccg

SEQ ID NO: 3094500 - RNA, 12 nt, Mycobacterium bovis subsp bovis AF2122/97
ggccuugacagc

SEQ ID NO: 3094501 - RNA, 18 nt, Mycobacterium bovis subsp bovis AF2122/97
ggccuugaucgugcuggc

SEQ ID NO: 3094502 - RNA, 19 nt, Mycobacterium bovis subsp bovis AF2122/97
ggccuugaucgugcuggcg

SEQ ID NO: 3094503 - RNA, 22 nt, Mycobacterium bovis subsp bovis AF2122/97
ggccuugccgaucagcuggcuc

SEQ ID NO: 3094504 - RNA, 17 nt, Mycobacterium bovis subsp bovis AF2122/97
ggccuugccgccggcgc

SEQ ID NO: 3094505 - RNA, 22 nt, Mycobacterium bovis subsp bovis AF2122/97
ggccuugcucagcacgccgggu

SEQ ID NO: 3094506 - RNA, 23 nt, Mycobacterium bovis subsp bovis AF2122/97
ggccuugcucagccggcccugcg

SEQ ID NO: 3094507 - RNA, 15 nt, Mycobacterium bovis subsp bovis AF2122/97
ggccuugcugcgcga

SEQ ID NO: 3094508 - RNA, 20 nt, Mycobacterium bovis subsp bovis AF2122/97
ggccuugcugcgcgauggcc

SEQ ID NO: 3094509 - RNA, 18 nt, Mycobacterium bovis subsp bovis AF2122/97
ggccuuggcaguccagcc

SEQ ID NO: 3094510 - RNA, 14 nt, Mycobacterium bovis subsp bovis AF2122/97
ggccuuggcgacgu

SEQ ID NO: 3094511 - RNA, 15 nt, Mycobacterium bovis subsp bovis AF2122/97
ggccuuggcggcggc

SEQ ID NO: 3094512 - RNA, 15 nt, Mycobacterium bovis subsp bovis AF2122/97
ggccuuggcgggauc

SEQ ID NO: 3094513 - RNA, 22 nt, Mycobacterium bovis subsp bovis AF2122/97
ggccuuguugccgcgccacugu

SEQ ID NO: 3094514 - RNA, 17 nt, Mycobacterium bovis subsp bovis AF2122/97
ggccuuugagcgcggcc

SEQ ID NO: 3094515 - RNA, 12 nt, Mycobacterium bovis subsp bovis AF2122/97
ggcgaaacccgg

SEQ ID NO: 3094516 - RNA, 14 nt, Mycobacterium bovis subsp bovis AF2122/97
ggcgaaacgcccgg

SEQ ID NO: 3094517 - RNA, 23 nt, Mycobacterium bovis subsp bovis AF2122/97
ggcgaaauagcccaagccgaucg

SEQ ID NO: 3094518 - RNA, 21 nt, Mycobacterium bovis subsp bovis AF2122/97
ggcgaaaucgucgaaccggau

SEQ ID NO: 3094519 - RNA, 16 nt, Mycobacterium bovis subsp bovis AF2122/97
ggcgaaauuccgggcc

SEQ ID NO: 3094520 - RNA, 22 nt, Mycobacterium bovis subsp bovis AF2122/97
ggcgaacaacuuggccaucccg

SEQ ID NO: 3094521 - RNA, 19 nt, Mycobacterium bovis subsp bovis AF2122/97
ggcgaacacgucggccagu

SEQ ID NO: 3094522 - RNA, 17 nt, Mycobacterium bovis subsp bovis AF2122/97
ggcgaacagugacgcca

SEQ ID NO: 3094523 - RNA, 14 nt, Mycobacterium bovis subsp bovis AF2122/97
ggcgaaccagcgcg

SEQ ID NO: 3094524 - RNA, 23 nt, Mycobacterium bovis subsp bovis AF2122/97
ggcgaacccgcagucggucacgc

SEQ ID NO: 3094525 - RNA, 16 nt, Mycobacterium bovis subsp bovis AF2122/97
ggcgaacccgccgaug

SEQ ID NO: 3094526 - RNA, 22 nt, Mycobacterium bovis subsp bovis AF2122/97
ggcgaacccgccgaugcugccg

SEQ ID NO: 3094527 - RNA, 15 nt, Mycobacterium bovis subsp bovis AF2122/97
ggcgaacccuccgca

SEQ ID NO: 3094528 - RNA, 17 nt, Mycobacterium bovis subsp bovis AF2122/97
ggcgaacccuccgcagc

SEQ ID NO: 3094529 - RNA, 19 nt, Mycobacterium bovis subsp bovis AF2122/97
ggcgaacccuccgcagcua

SEQ ID NO: 3094530 - RNA, 16 nt, Mycobacterium bovis subsp bovis AF2122/97
ggcgaaccgucagcgc

SEQ ID NO: 3094531 - RNA, 18 nt, Mycobacterium bovis subsp bovis AF2122/97
ggcgaaccgucagcgcgc

SEQ ID NO: 3094532 - RNA, 21 nt, Mycobacterium bovis subsp bovis AF2122/97
ggcgaacggauucccgcccag

SEQ ID NO: 3094533 - RNA, 22 nt, Mycobacterium bovis subsp bovis AF2122/97
ggcgaacggauucccgcccagc

SEQ ID NO: 3094534 - RNA, 16 nt, Mycobacterium bovis subsp bovis AF2122/97
ggcgaacggcaccgcg

SEQ ID NO: 3094535 - RNA, 17 nt, Mycobacterium bovis subsp bovis AF2122/97
ggcgaacggcaccgcgc

SEQ ID NO: 3094536 - RNA, 18 nt, Mycobacterium bovis subsp bovis AF2122/97
ggcgaacggcaccgcgcc

SEQ ID NO: 3094537 - RNA, 23 nt, Mycobacterium bovis subsp bovis AF2122/97
ggcgaacuccaucaccacaccgg

SEQ ID NO: 3094538 - RNA, 23 nt, Mycobacterium bovis subsp bovis AF2122/97
ggcgaacucgaggucgagcgccg

SEQ ID NO: 3094539 - RNA, 19 nt, Mycobacterium bovis subsp bovis AF2122/97
ggcgaacucgcgcaggaag

SEQ ID NO: 3094540 - RNA, 20 nt, Mycobacterium bovis subsp bovis AF2122/97
ggcgaacucggcgaugaacg

SEQ ID NO: 3094541 - RNA, 17 nt, Mycobacterium bovis subsp bovis AF2122/97
ggcgaacugggugcggu

SEQ ID NO: 3094542 - RNA, 14 nt, Mycobacterium bovis subsp bovis AF2122/97
ggcgaacugguagc

SEQ ID NO: 3094543 - RNA, 13 nt, Mycobacterium bovis subsp bovis AF2122/97
ggcgaagauaucg

SEQ ID NO: 3094544 - RNA, 12 nt, Mycobacterium bovis subsp bovis AF2122/97
ggcgaagcccga

SEQ ID NO: 3094545 - RNA, 23 nt, Mycobacterium bovis subsp bovis AF2122/97
ggcgaagguccgugccgaugccg

SEQ ID NO: 3094546 - RNA, 16 nt, Mycobacterium bovis subsp bovis AF2122/97
ggcgaagucacgcacc

SEQ ID NO: 3094547 - RNA, 19 nt, Mycobacterium bovis subsp bovis AF2122/97
ggcgaagucacgcacccgg

SEQ ID NO: 3094548 - RNA, 22 nt, Mycobacterium bovis subsp bovis AF2122/97
ggcgaagucacgcacccggcgc

SEQ ID NO: 3094549 - RNA, 14 nt, Mycobacterium bovis subsp bovis AF2122/97
ggcgaagucgucga

SEQ ID NO: 3094550 - RNA, 12 nt, Mycobacterium bovis subsp bovis AF2122/97
ggcgaaguuggu

SEQ ID NO: 3094551 - RNA, 15 nt, Mycobacterium bovis subsp bovis AF2122/97
ggcgaaguuggugac

SEQ ID NO: 3094552 - RNA, 19 nt, Mycobacterium bovis subsp bovis AF2122/97
ggcgaauacgaccgucgcg

SEQ ID NO: 3094553 - RNA, 17 nt, Mycobacterium bovis subsp bovis AF2122/97
ggcgaauccgcacaggu

SEQ ID NO: 3094554 - RNA, 14 nt, Mycobacterium bovis subsp bovis AF2122/97
ggcgaaugacggcc

SEQ ID NO: 3094555 - RNA, 15 nt, Mycobacterium bovis subsp bovis AF2122/97
ggcgaaugcgggccu

SEQ ID NO: 3094556 - RNA, 17 nt, Mycobacterium bovis subsp bovis AF2122/97
ggcgaaugcgggccucc

SEQ ID NO: 3094557 - RNA, 20 nt, Mycobacterium bovis subsp bovis AF2122/97
ggcgaaugcgggccuccugc

SEQ ID NO: 3094558 - RNA, 23 nt, Mycobacterium bovis subsp bovis AF2122/97
ggcgaaugcgggccuccugcugg

SEQ ID NO: 3094559 - RNA, 14 nt, Mycobacterium bovis subsp bovis AF2122/97
ggcgaaugucgcuc

SEQ ID NO: 3094560 - RNA, 22 nt, Mycobacterium bovis subsp bovis AF2122/97
ggcgacaaucgagaacgcccgc

SEQ ID NO: 3094561 - RNA, 23 nt, Mycobacterium bovis subsp bovis AF2122/97
ggcgacacccugggugccggcag

SEQ ID NO: 3094562 - RNA, 15 nt, Mycobacterium bovis subsp bovis AF2122/97
ggcgacacgccagcc

SEQ ID NO: 3094563 - RNA, 23 nt, Mycobacterium bovis subsp bovis AF2122/97
ggcgacacgccagccgugccggu

SEQ ID NO: 3094564 - RNA, 13 nt, Mycobacterium bovis subsp bovis AF2122/97
ggcgacagcgcgg

SEQ ID NO: 3094565 - RNA, 14 nt, Mycobacterium bovis subsp bovis AF2122/97
ggcgacagcgcggc

SEQ ID NO: 3094566 - RNA, 17 nt, Mycobacterium bovis subsp bovis AF2122/97
ggcgacagcggcgacau

SEQ ID NO: 3094567 - RNA, 13 nt, Mycobacterium bovis subsp bovis AF2122/97
ggcgacagcuugg

SEQ ID NO: 3094568 - RNA, 23 nt, Mycobacterium bovis subsp bovis AF2122/97
ggcgacaguagggucguacgucg

SEQ ID NO: 3094569 - RNA, 18 nt, Mycobacterium bovis subsp bovis AF2122/97
ggcgacaucaccaccgac

SEQ ID NO: 3094570 - RNA, 18 nt, Mycobacterium bovis subsp bovis AF2122/97
ggcgacauccacaccgcg

SEQ ID NO: 3094571 - RNA, 22 nt, Mycobacterium bovis subsp bovis AF2122/97
ggcgacauccacaccgcggcgg

SEQ ID NO: 3094572 - RNA, 23 nt, Mycobacterium bovis subsp bovis AF2122/97
ggcgacauccacaccgcggcggc

SEQ ID NO: 3094573 - RNA, 17 nt, Mycobacterium bovis subsp bovis AF2122/97
ggcgacaucgagaucgc

SEQ ID NO: 3094574 - RNA, 14 nt, Mycobacterium bovis subsp bovis AF2122/97
ggcgacaucggccc

SEQ ID NO: 3094575 - RNA, 20 nt, Mycobacterium bovis subsp bovis AF2122/97
ggcgacaugaucugccaccg

SEQ ID NO: 3094576 - RNA, 17 nt, Mycobacterium bovis subsp bovis AF2122/97
ggcgaccaacacgucga

SEQ ID NO: 3094577 - RNA, 22 nt, Mycobacterium bovis subsp bovis AF2122/97
ggcgaccaacacgucgagcagc

SEQ ID NO: 3094578 - RNA, 13 nt, Mycobacterium bovis subsp bovis AF2122/97
ggcgaccaccacc

SEQ ID NO: 3094579 - RNA, 14 nt, Mycobacterium bovis subsp bovis AF2122/97
ggcgaccaccaccg

SEQ ID NO: 3094580 - RNA, 17 nt, Mycobacterium bovis subsp bovis AF2122/97
ggcgaccaccaccgccg

SEQ ID NO: 3094581 - RNA, 20 nt, Mycobacterium bovis subsp bovis AF2122/97
ggcgaccaccaccgccgccg

SEQ ID NO: 3094582 - RNA, 22 nt, Mycobacterium bovis subsp bovis AF2122/97
ggcgaccaccaccgccgccgaa

SEQ ID NO: 3094583 - RNA, 15 nt, Mycobacterium bovis subsp bovis AF2122/97
ggcgaccaccagcgc

SEQ ID NO: 3094584 - RNA, 17 nt, Mycobacterium bovis subsp bovis AF2122/97
ggcgaccaccagcgccg

SEQ ID NO: 3094585 - RNA, 19 nt, Mycobacterium bovis subsp bovis AF2122/97
ggcgaccacccccggcagg

SEQ ID NO: 3094586 - RNA, 14 nt, Mycobacterium bovis subsp bovis AF2122/97
ggcgaccaccgcgg

SEQ ID NO: 3094587 - RNA, 19 nt, Mycobacterium bovis subsp bovis AF2122/97
ggcgaccaccgcggcugcu

SEQ ID NO: 3094588 - RNA, 22 nt, Mycobacterium bovis subsp bovis AF2122/97
ggcgaccaccgcggcugcuccg

SEQ ID NO: 3094589 - RNA, 17 nt, Mycobacterium bovis subsp bovis AF2122/97
ggcgaccaccgcgucgg

SEQ ID NO: 3094590 - RNA, 23 nt, Mycobacterium bovis subsp bovis AF2122/97
ggcgaccaccguuugagcggcca

SEQ ID NO: 3094591 - RNA, 16 nt, Mycobacterium bovis subsp bovis AF2122/97
ggcgaccacgccgccg

SEQ ID NO: 3094592 - RNA, 17 nt, Mycobacterium bovis subsp bovis AF2122/97
ggcgaccacgccgccgg

SEQ ID NO: 3094593 - RNA, 12 nt, Mycobacterium bovis subsp bovis AF2122/97
ggcgaccacggc

SEQ ID NO: 3094594 - RNA, 19 nt, Mycobacterium bovis subsp bovis AF2122/97
ggcgaccacgucggcgaac

SEQ ID NO: 3094595 - RNA, 18 nt, Mycobacterium bovis subsp bovis AF2122/97
ggcgaccagaggaugucg

SEQ ID NO: 3094596 - RNA, 19 nt, Mycobacterium bovis subsp bovis AF2122/97
ggcgaccagcucagcugcg

SEQ ID NO: 3094597 - RNA, 13 nt, Mycobacterium bovis subsp bovis AF2122/97
ggcgaccaggagc

SEQ ID NO: 3094598 - RNA, 14 nt, Mycobacterium bovis subsp bovis AF2122/97
ggcgaccaggagcc

SEQ ID NO: 3094599 - RNA, 18 nt, Mycobacterium bovis subsp bovis AF2122/97
ggcgaccaggagccucca

SEQ ID NO: 3094600 - RNA, 22 nt, Mycobacterium bovis subsp bovis AF2122/97
ggcgaccaggagccuccagcgc

SEQ ID NO: 3094601 - RNA, 11 nt, Mycobacterium bovis subsp bovis AF2122/97
ggcgacccagc

SEQ ID NO: 3094602 - RNA, 15 nt, Mycobacterium bovis subsp bovis AF2122/97
ggcgacccagcggua

SEQ ID NO: 3094603 - RNA, 21 nt, Mycobacterium bovis subsp bovis AF2122/97
ggcgaccccgaacauccgccg

SEQ ID NO: 3094604 - RNA, 13 nt, Mycobacterium bovis subsp bovis AF2122/97
ggcgaccccggcc

SEQ ID NO: 3094605 - RNA, 14 nt, Mycobacterium bovis subsp bovis AF2122/97
ggcgacccgcuggg

SEQ ID NO: 3094606 - RNA, 15 nt, Mycobacterium bovis subsp bovis AF2122/97
ggcgacccgcugggu

SEQ ID NO: 3094607 - RNA, 14 nt, Mycobacterium bovis subsp bovis AF2122/97
ggcgacccggucgc

SEQ ID NO: 3094608 - RNA, 19 nt, Mycobacterium bovis subsp bovis AF2122/97
ggcgacccgucccccgcac

SEQ ID NO: 3094609 - RNA, 23 nt, Mycobacterium bovis subsp bovis AF2122/97
ggcgacccgucccccgcacgcgg

SEQ ID NO: 3094610 - RNA, 19 nt, Mycobacterium bovis subsp bovis AF2122/97
ggcgacccguucucgguga

SEQ ID NO: 3094611 - RNA, 14 nt, Mycobacterium bovis subsp bovis AF2122/97
ggcgaccgacgccg

SEQ ID NO: 3094612 - RNA, 18 nt, Mycobacterium bovis subsp bovis AF2122/97
ggcgaccgagacggcguc

SEQ ID NO: 3094613 - RNA, 20 nt, Mycobacterium bovis subsp bovis AF2122/97
ggcgaccgagacggcgucgg

SEQ ID NO: 3094614 - RNA, 21 nt, Mycobacterium bovis subsp bovis AF2122/97
ggcgaccgccaucacgaccag

SEQ ID NO: 3094615 - RNA, 16 nt, Mycobacterium bovis subsp bovis AF2122/97
ggcgaccgcgcucacc

SEQ ID NO: 3094616 - RNA, 19 nt, Mycobacterium bovis subsp bovis AF2122/97
ggcgaccgcgcucaccggg

SEQ ID NO: 3094617 - RNA, 21 nt, Mycobacterium bovis subsp bovis AF2122/97
ggcgaccgcgcucaccggggc

SEQ ID NO: 3094618 - RNA, 12 nt, Mycobacterium bovis subsp bovis AF2122/97
ggcgaccgcggu

SEQ ID NO: 3094619 - RNA, 15 nt, Mycobacterium bovis subsp bovis AF2122/97
ggcgaccgcggucgc

SEQ ID NO: 3094620 - RNA, 15 nt, Mycobacterium bovis subsp bovis AF2122/97
ggcgaccggccggcc

SEQ ID NO: 3094621 - RNA, 12 nt, Mycobacterium bovis subsp bovis AF2122/97
ggcgaccggcga

SEQ ID NO: 3094622 - RNA, 22 nt, Mycobacterium bovis subsp bovis AF2122/97
ggcgaccgggaucggcuccgcc

SEQ ID NO: 3094623 - RNA, 14 nt, Mycobacterium bovis subsp bovis AF2122/97
ggcgaccggggauc

SEQ ID NO: 3094624 - RNA, 22 nt, Mycobacterium bovis subsp bovis AF2122/97
ggcgaccggugccugcaacgcc

SEQ ID NO: 3094625 - RNA, 14 nt, Mycobacterium bovis subsp bovis AF2122/97
ggcgaccgucaacc

SEQ ID NO: 3094626 - RNA, 21 nt, Mycobacterium bovis subsp bovis AF2122/97
ggcgaccgucgauuucgacga

SEQ ID NO: 3094627 - RNA, 13 nt, Mycobacterium bovis subsp bovis AF2122/97
ggcgaccgucggg

SEQ ID NO: 3094628 - RNA, 21 nt, Mycobacterium bovis subsp bovis AF2122/97
ggcgaccuccggaaucgcccg

SEQ ID NO: 3094629 - RNA, 17 nt, Mycobacterium bovis subsp bovis AF2122/97
ggcgaccucggcggcgg

SEQ ID NO: 3094630 - RNA, 13 nt, Mycobacterium bovis subsp bovis AF2122/97
ggcgaccugcucg

SEQ ID NO: 3094631 - RNA, 14 nt, Mycobacterium bovis subsp bovis AF2122/97
ggcgacgaacgccg

SEQ ID NO: 3094632 - RNA, 23 nt, Mycobacterium bovis subsp bovis AF2122/97
ggcgacgacaucugcccagcggu

SEQ ID NO: 3094633 - RNA, 12 nt, Mycobacterium bovis subsp bovis AF2122/97
ggcgacgacccg

SEQ ID NO: 3094634 - RNA, 13 nt, Mycobacterium bovis subsp bovis AF2122/97
ggcgacgacccgg

SEQ ID NO: 3094635 - RNA, 16 nt, Mycobacterium bovis subsp bovis AF2122/97
ggcgacgacccggguc

SEQ ID NO: 3094636 - RNA, 20 nt, Mycobacterium bovis subsp bovis AF2122/97
ggcgacgacccgggucggca

SEQ ID NO: 3094637 - RNA, 18 nt, Mycobacterium bovis subsp bovis AF2122/97
ggcgacgaccgucggcuc

SEQ ID NO: 3094638 - RNA, 11 nt, Mycobacterium bovis subsp bovis AF2122/97
ggcgacgaggc

SEQ ID NO: 3094639 - RNA, 16 nt, Mycobacterium bovis subsp bovis AF2122/97
ggcgacgauccgcacg

SEQ ID NO: 3094640 - RNA, 17 nt, Mycobacterium bovis subsp bovis AF2122/97
ggcgacgaucucggcgg

SEQ ID NO: 3094641 - RNA, 19 nt, Mycobacterium bovis subsp bovis AF2122/97
ggcgacgaucucggcggcc

SEQ ID NO: 3094642 - RNA, 22 nt, Mycobacterium bovis subsp bovis AF2122/97
ggcgacgaucucggcggccgcg

SEQ ID NO: 3094643 - RNA, 17 nt, Mycobacterium bovis subsp bovis AF2122/97
ggcgacgaugucgagcg

SEQ ID NO: 3094644 - RNA, 22 nt, Mycobacterium bovis subsp bovis AF2122/97
ggcgacgaugucgagcgcgauc

SEQ ID NO: 3094645 - RNA, 17 nt, Mycobacterium bovis subsp bovis AF2122/97
ggcgacgauucgagcgg

SEQ ID NO: 3094646 - RNA, 14 nt, Mycobacterium bovis subsp bovis AF2122/97
ggcgacgccgcugg

SEQ ID NO: 3094647 - RNA, 19 nt, Mycobacterium bovis subsp bovis AF2122/97
ggcgacgccgucuagcaca

SEQ ID NO: 3094648 - RNA, 23 nt, Mycobacterium bovis subsp bovis AF2122/97
ggcgacgcgacacacgccgccgg

SEQ ID NO: 3094649 - RNA, 21 nt, Mycobacterium bovis subsp bovis AF2122/97
ggcgacgcggaguccgucgac

SEQ ID NO: 3094650 - RNA, 16 nt, Mycobacterium bovis subsp bovis AF2122/97
ggcgacgcggcgccgc

SEQ ID NO: 3094651 - RNA, 17 nt, Mycobacterium bovis subsp bovis AF2122/97
ggcgacgcggcgccgcc

SEQ ID NO: 3094652 - RNA, 13 nt, Mycobacterium bovis subsp bovis AF2122/97
ggcgacggacucc

SEQ ID NO: 3094653 - RNA, 13 nt, Mycobacterium bovis subsp bovis AF2122/97
ggcgacggccaag

SEQ ID NO: 3094654 - RNA, 14 nt, Mycobacterium bovis subsp bovis AF2122/97
ggcgacggccagcg

SEQ ID NO: 3094655 - RNA, 17 nt, Mycobacterium bovis subsp bovis AF2122/97
ggcgacggccagcgcgu

SEQ ID NO: 3094656 - RNA, 16 nt, Mycobacterium bovis subsp bovis AF2122/97
ggcgacggcgcccaua

SEQ ID NO: 3094657 - RNA, 17 nt, Mycobacterium bovis subsp bovis AF2122/97
ggcgacggcgcccauag

SEQ ID NO: 3094658 - RNA, 13 nt, Mycobacterium bovis subsp bovis AF2122/97
ggcgacggcggcg

SEQ ID NO: 3094659 - RNA, 17 nt, Mycobacterium bovis subsp bovis AF2122/97
ggcgacggcggcgucga

SEQ ID NO: 3094660 - RNA, 18 nt, Mycobacterium bovis subsp bovis AF2122/97
ggcgacggcgucgaugac

SEQ ID NO: 3094661 - RNA, 20 nt, Mycobacterium bovis subsp bovis AF2122/97
ggcgacggcucuaccggucc

SEQ ID NO: 3094662 - RNA, 15 nt, Mycobacterium bovis subsp bovis AF2122/97
ggcgacggucgugau

SEQ ID NO: 3094663 - RNA, 14 nt, Mycobacterium bovis subsp bovis AF2122/97
ggcgacggugccac

SEQ ID NO: 3094664 - RNA, 17 nt, Mycobacterium bovis subsp bovis AF2122/97
ggcgacggugccaccgc

SEQ ID NO: 3094665 - RNA, 22 nt, Mycobacterium bovis subsp bovis AF2122/97
ggcgacgguucccagcuuccgc

SEQ ID NO: 3094666 - RNA, 23 nt, Mycobacterium bovis subsp bovis AF2122/97
ggcgacguagacgguccggucgc

SEQ ID NO: 3094667 - RNA, 22 nt, Mycobacterium bovis subsp bovis AF2122/97
ggcgacgucaucgccgacccgc

SEQ ID NO: 3094668 - RNA, 13 nt, Mycobacterium bovis subsp bovis AF2122/97
ggcgacgucgaca

SEQ ID NO: 3094669 - RNA, 16 nt, Mycobacterium bovis subsp bovis AF2122/97
ggcgacgucgcgggug

SEQ ID NO: 3094670 - RNA, 17 nt, Mycobacterium bovis subsp bovis AF2122/97
ggcgacgucggcgguga

SEQ ID NO: 3094671 - RNA, 13 nt, Mycobacterium bovis subsp bovis AF2122/97
ggcgacgucucgc

SEQ ID NO: 3094672 - RNA, 13 nt, Mycobacterium bovis subsp bovis AF2122/97
ggcgacguuccgc

SEQ ID NO: 3094673 - RNA, 16 nt, Mycobacterium bovis subsp bovis AF2122/97
ggcgacguuccgcucg

SEQ ID NO: 3094674 - RNA, 17 nt, Mycobacterium bovis subsp bovis AF2122/97
ggcgacguuccgcucga

SEQ ID NO: 3094675 - RNA, 18 nt, Mycobacterium bovis subsp bovis AF2122/97
ggcgacguuccgcucgag

SEQ ID NO: 3094676 - RNA, 18 nt, Mycobacterium bovis subsp bovis AF2122/97
ggcgacguuggcgggagc

SEQ ID NO: 3094677 - RNA, 16 nt, Mycobacterium bovis subsp bovis AF2122/97
ggcgacuacccagcca

SEQ ID NO: 3094678 - RNA, 22 nt, Mycobacterium bovis subsp bovis AF2122/97
ggcgacuacccagccagccgcg

SEQ ID NO: 3094679 - RNA, 21 nt, Mycobacterium bovis subsp bovis AF2122/97
ggcgacucgaggaccugcucg

SEQ ID NO: 3094680 - RNA, 22 nt, Mycobacterium bovis subsp bovis AF2122/97
ggcgacucgaggaccugcucgg

SEQ ID NO: 3094681 - RNA, 16 nt, Mycobacterium bovis subsp bovis AF2122/97
ggcgacucugcggggc

SEQ ID NO: 3094682 - RNA, 16 nt, Mycobacterium bovis subsp bovis AF2122/97
ggcgacugcagcgaag

SEQ ID NO: 3094683 - RNA, 18 nt, Mycobacterium bovis subsp bovis AF2122/97
ggcgacugcagcgaagcc

SEQ ID NO: 3094684 - RNA, 22 nt, Mycobacterium bovis subsp bovis AF2122/97
ggcgacugucccauacgugucg

SEQ ID NO: 3094685 - RNA, 15 nt, Mycobacterium bovis subsp bovis AF2122/97
ggcgacugucugguc

SEQ ID NO: 3094686 - RNA, 20 nt, Mycobacterium bovis subsp bovis AF2122/97
ggcgacugucuggucggcua

SEQ ID NO: 3094687 - RNA, 18 nt, Mycobacterium bovis subsp bovis AF2122/97
ggcgacuucuucgcgcaa

SEQ ID NO: 3094688 - RNA, 22 nt, Mycobacterium bovis subsp bovis AF2122/97
ggcgagaaaaugacccacacac

SEQ ID NO: 3094689 - RNA, 15 nt, Mycobacterium bovis subsp bovis AF2122/97
ggcgagaacccacgc

SEQ ID NO: 3094690 - RNA, 14 nt, Mycobacterium bovis subsp bovis AF2122/97
ggcgagacgcucca

SEQ ID NO: 3094691 - RNA, 21 nt, Mycobacterium bovis subsp bovis AF2122/97
ggcgagacggcguugauccgc

SEQ ID NO: 3094692 - RNA, 18 nt, Mycobacterium bovis subsp bovis AF2122/97
ggcgagagggcggggcag

SEQ ID NO: 3094693 - RNA, 24 nt, Mycobacterium bovis subsp bovis AF2122/97
ggcgagcaacucguccagcagugc

SEQ ID NO: 3094694 - RNA, 12 nt, Mycobacterium bovis subsp bovis AF2122/97
ggcgagcaccac

SEQ ID NO: 3094695 - RNA, 14 nt, Mycobacterium bovis subsp bovis AF2122/97
ggcgagcaccaccc

SEQ ID NO: 3094696 - RNA, 16 nt, Mycobacterium bovis subsp bovis AF2122/97
ggcgagcaccacccca

SEQ ID NO: 3094697 - RNA, 15 nt, Mycobacterium bovis subsp bovis AF2122/97
ggcgagcaccgugcc

SEQ ID NO: 3094698 - RNA, 14 nt, Mycobacterium bovis subsp bovis AF2122/97
ggcgagcagcaggu

SEQ ID NO: 3094699 - RNA, 22 nt, Mycobacterium bovis subsp bovis AF2122/97
ggcgagcagucgcaaaagcccc

SEQ ID NO: 3094700 - RNA, 16 nt, Mycobacterium bovis subsp bovis AF2122/97
ggcgagcaucucgaca

SEQ ID NO: 3094701 - RNA, 17 nt, Mycobacterium bovis subsp bovis AF2122/97
ggcgagcaucucgacau

SEQ ID NO: 3094702 - RNA, 18 nt, Mycobacterium bovis subsp bovis AF2122/97
ggcgagcaucucgacauc

SEQ ID NO: 3094703 - RNA, 17 nt, Mycobacterium bovis subsp bovis AF2122/97
ggcgagccagcuucccg

SEQ ID NO: 3094704 - RNA, 13 nt, Mycobacterium bovis subsp bovis AF2122/97
ggcgagccgccac

SEQ ID NO: 3094705 - RNA, 14 nt, Mycobacterium bovis subsp bovis AF2122/97
ggcgagccgccacc

SEQ ID NO: 3094706 - RNA, 17 nt, Mycobacterium bovis subsp bovis AF2122/97
ggcgagccgcgcccaau

SEQ ID NO: 3094707 - RNA, 15 nt, Mycobacterium bovis subsp bovis AF2122/97
ggcgagccggcgcgc

SEQ ID NO: 3094708 - RNA, 17 nt, Mycobacterium bovis subsp bovis AF2122/97
ggcgagcgcaucggcca

SEQ ID NO: 3094709 - RNA, 22 nt, Mycobacterium bovis subsp bovis AF2122/97
ggcgagcgcgccaaucgcccag

SEQ ID NO: 3094710 - RNA, 16 nt, Mycobacterium bovis subsp bovis AF2122/97
ggcgagcgcggccugc

SEQ ID NO: 3094711 - RNA, 20 nt, Mycobacterium bovis subsp bovis AF2122/97
ggcgagcgcggccugcacca

SEQ ID NO: 3094712 - RNA, 14 nt, Mycobacterium bovis subsp bovis AF2122/97
ggcgagcggccagu

SEQ ID NO: 3094713 - RNA, 13 nt, Mycobacterium bovis subsp bovis AF2122/97
ggcgagcggccuc

SEQ ID NO: 3094714 - RNA, 15 nt, Mycobacterium bovis subsp bovis AF2122/97
ggcgagcggccucca

SEQ ID NO: 3094715 - RNA, 21 nt, Mycobacterium bovis subsp bovis AF2122/97
ggcgagcggccuccagcaccc

SEQ ID NO: 3094716 - RNA, 18 nt, Mycobacterium bovis subsp bovis AF2122/97
ggcgagcuaacacccgag

SEQ ID NO: 3094717 - RNA, 13 nt, Mycobacterium bovis subsp bovis AF2122/97
ggcgagcucgucg

SEQ ID NO: 3094718 - RNA, 15 nt, Mycobacterium bovis subsp bovis AF2122/97
ggcgagcucgucgag

SEQ ID NO: 3094719 - RNA, 17 nt, Mycobacterium bovis subsp bovis AF2122/97
ggcgagcucgucgagcg

SEQ ID NO: 3094720 - RNA, 18 nt, Mycobacterium bovis subsp bovis AF2122/97
ggcgagcucgucgagcgc

SEQ ID NO: 3094721 - RNA, 17 nt, Mycobacterium bovis subsp bovis AF2122/97
ggcgaggauguaguugg

SEQ ID NO: 3094722 - RNA, 15 nt, Mycobacterium bovis subsp bovis AF2122/97
ggcgaggcagcaccc

SEQ ID NO: 3094723 - RNA, 18 nt, Mycobacterium bovis subsp bovis AF2122/97
ggcgaggccucggcggcc

SEQ ID NO: 3094724 - RNA, 19 nt, Mycobacterium bovis subsp bovis AF2122/97
ggcgaggccucggcggccg

SEQ ID NO: 3094725 - RNA, 21 nt, Mycobacterium bovis subsp bovis AF2122/97
ggcgaggccucggcggccgug

SEQ ID NO: 3094726 - RNA, 18 nt, Mycobacterium bovis subsp bovis AF2122/97
ggcgaggcgagucaccgg

SEQ ID NO: 3094727 - RNA, 16 nt, Mycobacterium bovis subsp bovis AF2122/97
ggcgaggcggucgccg

SEQ ID NO: 3094728 - RNA, 17 nt, Mycobacterium bovis subsp bovis AF2122/97
ggcgaggcggucgccga

SEQ ID NO: 3094729 - RNA, 15 nt, Mycobacterium bovis subsp bovis AF2122/97
ggcgagggcgcgccg

SEQ ID NO: 3094730 - RNA, 19 nt, Mycobacterium bovis subsp bovis AF2122/97
ggcgagggcggucagcggc

SEQ ID NO: 3094731 - RNA, 20 nt, Mycobacterium bovis subsp bovis AF2122/97
ggcgagggcggucagcggcc

SEQ ID NO: 3094732 - RNA, 20 nt, Mycobacterium bovis subsp bovis AF2122/97
ggcgagggcuaccggcgccg

SEQ ID NO: 3094733 - RNA, 17 nt, Mycobacterium bovis subsp bovis AF2122/97
ggcgagggcugacggga

SEQ ID NO: 3094734 - RNA, 20 nt, Mycobacterium bovis subsp bovis AF2122/97
ggcgagggugaagacaccgg

SEQ ID NO: 3094735 - RNA, 20 nt, Mycobacterium bovis subsp bovis AF2122/97
ggcgagguauaaacgcggcg

SEQ ID NO: 3094736 - RNA, 24 nt, Mycobacterium bovis subsp bovis AF2122/97
ggcgagguauaaacgcggcgcgcu

SEQ ID NO: 3094737 - RNA, 16 nt, Mycobacterium bovis subsp bovis AF2122/97
ggcgaggucccggccg

SEQ ID NO: 3094738 - RNA, 16 nt, Mycobacterium bovis subsp bovis AF2122/97
ggcgaggugcucggau

SEQ ID NO: 3094739 - RNA, 16 nt, Mycobacterium bovis subsp bovis AF2122/97
ggcgagguggucacgc

SEQ ID NO: 3094740 - RNA, 22 nt, Mycobacterium bovis subsp bovis AF2122/97
ggcgagguggucacgcagucgg

SEQ ID NO: 3094741 - RNA, 20 nt, Mycobacterium bovis subsp bovis AF2122/97
ggcgagguugcgccgaccgg

SEQ ID NO: 3094742 - RNA, 17 nt, Mycobacterium bovis subsp bovis AF2122/97
ggcgaguacggccugcc

SEQ ID NO: 3094743 - RNA, 15 nt, Mycobacterium bovis subsp bovis AF2122/97
ggcgagucccggcgg

SEQ ID NO: 3094744 - RNA, 17 nt, Mycobacterium bovis subsp bovis AF2122/97
ggcgagucgggggccgc

SEQ ID NO: 3094745 - RNA, 24 nt, Mycobacterium bovis subsp bovis AF2122/97
ggcgagugggauucugacgaccgg

SEQ ID NO: 3094746 - RNA, 15 nt, Mycobacterium bovis subsp bovis AF2122/97
ggcgagugguccagc

SEQ ID NO: 3094747 - RNA, 21 nt, Mycobacterium bovis subsp bovis AF2122/97
ggcgagugucuuagccagcag

SEQ ID NO: 3094748 - RNA, 20 nt, Mycobacterium bovis subsp bovis AF2122/97
ggcgaguuaggccgccagcc

SEQ ID NO: 3094749 - RNA, 19 nt, Mycobacterium bovis subsp bovis AF2122/97
ggcgauaaggaccgcgccc

SEQ ID NO: 3094750 - RNA, 21 nt, Mycobacterium bovis subsp bovis AF2122/97
ggcgauaaggaccgcgcccag

SEQ ID NO: 3094751 - RNA, 15 nt, Mycobacterium bovis subsp bovis AF2122/97
ggcgauacagcgaca

SEQ ID NO: 3094752 - RNA, 15 nt, Mycobacterium bovis subsp bovis AF2122/97
ggcgauaccgguugc

SEQ ID NO: 3094753 - RNA, 21 nt, Mycobacterium bovis subsp bovis AF2122/97
ggcgauacgcgcgucggguau

SEQ ID NO: 3094754 - RNA, 14 nt, Mycobacterium bovis subsp bovis AF2122/97
ggcgauaucggccc

SEQ ID NO: 3094755 - RNA, 17 nt, Mycobacterium bovis subsp bovis AF2122/97
ggcgauaucggccccca

SEQ ID NO: 3094756 - RNA, 18 nt, Mycobacterium bovis subsp bovis AF2122/97
ggcgaucaaagccagcac

SEQ ID NO: 3094757 - RNA, 16 nt, Mycobacterium bovis subsp bovis AF2122/97
ggcgaucaaccgcugu

SEQ ID NO: 3094758 - RNA, 14 nt, Mycobacterium bovis subsp bovis AF2122/97
ggcgaucaacucgg

SEQ ID NO: 3094759 - RNA, 20 nt, Mycobacterium bovis subsp bovis AF2122/97
ggcgaucaacucgggcagcg

SEQ ID NO: 3094760 - RNA, 14 nt, Mycobacterium bovis subsp bovis AF2122/97
ggcgaucaagccuc

SEQ ID NO: 3094761 - RNA, 16 nt, Mycobacterium bovis subsp bovis AF2122/97
ggcgaucaauugcccg

SEQ ID NO: 3094762 - RNA, 15 nt, Mycobacterium bovis subsp bovis AF2122/97
ggcgaucaccgcgcc

SEQ ID NO: 3094763 - RNA, 19 nt, Mycobacterium bovis subsp bovis AF2122/97
ggcgaucaccgcgccggag

SEQ ID NO: 3094764 - RNA, 12 nt, Mycobacterium bovis subsp bovis AF2122/97
ggcgaucaccgu

SEQ ID NO: 3094765 - RNA, 14 nt, Mycobacterium bovis subsp bovis AF2122/97
ggcgaucagcagcc

SEQ ID NO: 3094766 - RNA, 16 nt, Mycobacterium bovis subsp bovis AF2122/97
ggcgaucagcagccgc

SEQ ID NO: 3094767 - RNA, 18 nt, Mycobacterium bovis subsp bovis AF2122/97
ggcgaucagcagccgccg

SEQ ID NO: 3094768 - RNA, 21 nt, Mycobacterium bovis subsp bovis AF2122/97
ggcgaucagcagccgccgaug

SEQ ID NO: 3094769 - RNA, 23 nt, Mycobacterium bovis subsp bovis AF2122/97
ggcgaucagcagccgccgaugau

SEQ ID NO: 3094770 - RNA, 20 nt, Mycobacterium bovis subsp bovis AF2122/97
ggcgaucaucaggugcgccu

SEQ ID NO: 3094771 - RNA, 17 nt, Mycobacterium bovis subsp bovis AF2122/97
ggcgaucaugagcagca

SEQ ID NO: 3094772 - RNA, 17 nt, Mycobacterium bovis subsp bovis AF2122/97
ggcgaucccgccggggc

SEQ ID NO: 3094773 - RNA, 15 nt, Mycobacterium bovis subsp bovis AF2122/97
ggcgauccgauacag

SEQ ID NO: 3094774 - RNA, 22 nt, Mycobacterium bovis subsp bovis AF2122/97
ggcgauccgauacagugcgcgg

SEQ ID NO: 3094775 - RNA, 19 nt, Mycobacterium bovis subsp bovis AF2122/97
ggcgauccggucggccagg

SEQ ID NO: 3094776 - RNA, 20 nt, Mycobacterium bovis subsp bovis AF2122/97
ggcgaucgcaagcgcggcga

SEQ ID NO: 3094777 - RNA, 23 nt, Mycobacterium bovis subsp bovis AF2122/97
ggcgaucgcauccgcgguuggca

SEQ ID NO: 3094778 - RNA, 13 nt, Mycobacterium bovis subsp bovis AF2122/97
ggcgaucgcccgg

SEQ ID NO: 3094779 - RNA, 16 nt, Mycobacterium bovis subsp bovis AF2122/97
ggcgaucgucaagccg

SEQ ID NO: 3094780 - RNA, 20 nt, Mycobacterium bovis subsp bovis AF2122/97
ggcgaucgucaagccgggca

SEQ ID NO: 3094781 - RNA, 16 nt, Mycobacterium bovis subsp bovis AF2122/97
ggcgaucuccggcgga

SEQ ID NO: 3094782 - RNA, 16 nt, Mycobacterium bovis subsp bovis AF2122/97
ggcgaucucgaccgua

SEQ ID NO: 3094783 - RNA, 20 nt, Mycobacterium bovis subsp bovis AF2122/97
ggcgaucucgucgcggucga

SEQ ID NO: 3094784 - RNA, 22 nt, Mycobacterium bovis subsp bovis AF2122/97
ggcgaucucuaccagccgcccc

SEQ ID NO: 3094785 - RNA, 16 nt, Mycobacterium bovis subsp bovis AF2122/97
ggcgaucugcucgaga

SEQ ID NO: 3094786 - RNA, 12 nt, Mycobacterium bovis subsp bovis AF2122/97
ggcgaucugcug

SEQ ID NO: 3094787 - RNA, 16 nt, Mycobacterium bovis subsp bovis AF2122/97
ggcgaucugcugcucg

SEQ ID NO: 3094788 - RNA, 23 nt, Mycobacterium bovis subsp bovis AF2122/97
ggcgaucugggcuuucagcaccg

SEQ ID NO: 3094789 - RNA, 18 nt, Mycobacterium bovis subsp bovis AF2122/97
ggcgaucugggugccggu

SEQ ID NO: 3094790 - RNA, 13 nt, Mycobacterium bovis subsp bovis AF2122/97
ggcgaucuggucg

SEQ ID NO: 3094791 - RNA, 21 nt, Mycobacterium bovis subsp bovis AF2122/97
ggcgaucuggucggcggccuc

SEQ ID NO: 3094792 - RNA, 19 nt, Mycobacterium bovis subsp bovis AF2122/97
ggcgaucuugcgacgcccg

SEQ ID NO: 3094793 - RNA, 20 nt, Mycobacterium bovis subsp bovis AF2122/97
ggcgaucuuguccagggugg

SEQ ID NO: 3094794 - RNA, 22 nt, Mycobacterium bovis subsp bovis AF2122/97
ggcgaugaacgggaucgacccg

SEQ ID NO: 3094795 - RNA, 19 nt, Mycobacterium bovis subsp bovis AF2122/97
ggcgaugaccacgccgacg

SEQ ID NO: 3094796 - RNA, 21 nt, Mycobacterium bovis subsp bovis AF2122/97
ggcgaugaccacgccgacgaa

SEQ ID NO: 3094797 - RNA, 20 nt, Mycobacterium bovis subsp bovis AF2122/97
ggcgaugacccggaaucccg

SEQ ID NO: 3094798 - RNA, 12 nt, Mycobacterium bovis subsp bovis AF2122/97
ggcgaugagcgc

SEQ ID NO: 3094799 - RNA, 14 nt, Mycobacterium bovis subsp bovis AF2122/97
ggcgaugagcgugc

SEQ ID NO: 3094800 - RNA, 21 nt, Mycobacterium bovis subsp bovis AF2122/97
ggcgaugagcgugccgcagcg

SEQ ID NO: 3094801 - RNA, 19 nt, Mycobacterium bovis subsp bovis AF2122/97
ggcgaugaggaacguuucg

SEQ ID NO: 3094802 - RNA, 21 nt, Mycobacterium bovis subsp bovis AF2122/97
ggcgaugagggcuugugguga

SEQ ID NO: 3094803 - RNA, 23 nt, Mycobacterium bovis subsp bovis AF2122/97
ggcgaugagggcuuguggugagc

SEQ ID NO: 3094804 - RNA, 23 nt, Mycobacterium bovis subsp bovis AF2122/97
ggcgaugagguggccgcgcaggg

SEQ ID NO: 3094805 - RNA, 19 nt, Mycobacterium bovis subsp bovis AF2122/97
ggcgaugaugacggcggcc

SEQ ID NO: 3094806 - RNA, 17 nt, Mycobacterium bovis subsp bovis AF2122/97
ggcgaugauguugagcu

SEQ ID NO: 3094807 - RNA, 14 nt, Mycobacterium bovis subsp bovis AF2122/97
ggcgaugcagccgg

SEQ ID NO: 3094808 - RNA, 17 nt, Mycobacterium bovis subsp bovis AF2122/97
ggcgaugcagccgggaa

SEQ ID NO: 3094809 - RNA, 15 nt, Mycobacterium bovis subsp bovis AF2122/97
ggcgaugcgcaccag

SEQ ID NO: 3094810 - RNA, 14 nt, Mycobacterium bovis subsp bovis AF2122/97
ggcgaugcgcgccc

SEQ ID NO: 3094811 - RNA, 21 nt, Mycobacterium bovis subsp bovis AF2122/97
ggcgaugcgggccgccaggcg

SEQ ID NO: 3094812 - RNA, 22 nt, Mycobacterium bovis subsp bovis AF2122/97
ggcgaugcgggccgccaggcgg

SEQ ID NO: 3094813 - RNA, 19 nt, Mycobacterium bovis subsp bovis AF2122/97
ggcgaugcguccgcccagc

SEQ ID NO: 3094814 - RNA, 17 nt, Mycobacterium bovis subsp bovis AF2122/97
ggcgauggcaccggcgu

SEQ ID NO: 3094815 - RNA, 13 nt, Mycobacterium bovis subsp bovis AF2122/97
ggcgauggucggg

SEQ ID NO: 3094816 - RNA, 16 nt, Mycobacterium bovis subsp bovis AF2122/97
ggcgauggucuccucg

SEQ ID NO: 3094817 - RNA, 18 nt, Mycobacterium bovis subsp bovis AF2122/97
ggcgaugucggcuggugg

SEQ ID NO: 3094818 - RNA, 19 nt, Mycobacterium bovis subsp bovis AF2122/97
ggcgaugucggcugguggg

SEQ ID NO: 3094819 - RNA, 16 nt, Mycobacterium bovis subsp bovis AF2122/97
ggcgauuacggccagu

SEQ ID NO: 3094820 - RNA, 12 nt, Mycobacterium bovis subsp bovis AF2122/97
ggcgauucccgc

SEQ ID NO: 3094821 - RNA, 21 nt, Mycobacterium bovis subsp bovis AF2122/97
ggcgauucgcaaucagcuggu

SEQ ID NO: 3094822 - RNA, 18 nt, Mycobacterium bovis subsp bovis AF2122/97
ggcgauucugcgucugcu

SEQ ID NO: 3094823 - RNA, 19 nt, Mycobacterium bovis subsp bovis AF2122/97
ggcgauucugcgucugcuc

SEQ ID NO: 3094824 - RNA, 18 nt, Mycobacterium bovis subsp bovis AF2122/97
ggcgauugauccgguggc

SEQ ID NO: 3094825 - RNA, 17 nt, Mycobacterium bovis subsp bovis AF2122/97
ggcgauugcagcuucgg

SEQ ID NO: 3094826 - RNA, 16 nt, Mycobacterium bovis subsp bovis AF2122/97
ggcgauuggcugugau

SEQ ID NO: 3094827 - RNA, 24 nt, Mycobacterium bovis subsp bovis AF2122/97
ggcgauuggcugugaucgagucgc

SEQ ID NO: 3094828 - RNA, 20 nt, Mycobacterium bovis subsp bovis AF2122/97
ggcgauugucggggccgcag

SEQ ID NO: 3094829 - RNA, 17 nt, Mycobacterium bovis subsp bovis AF2122/97
ggcgauuucggcgccgg

SEQ ID NO: 3094830 - RNA, 19 nt, Mycobacterium bovis subsp bovis AF2122/97
ggcgauuucggcgccggcg

SEQ ID NO: 3094831 - RNA, 20 nt, Mycobacterium bovis subsp bovis AF2122/97
ggcgauuucggcgccggcgu

SEQ ID NO: 3094832 - RNA, 22 nt, Mycobacterium bovis subsp bovis AF2122/97
ggcgauuugcuugcgcguggca

SEQ ID NO: 3094833 - RNA, 18 nt, Mycobacterium bovis subsp bovis AF2122/97
ggcgauuuugcgucugcu

SEQ ID NO: 3094834 - RNA, 19 nt, Mycobacterium bovis subsp bovis AF2122/97
ggcgauuuugcgucugcuc

SEQ ID NO: 3094835 - RNA, 23 nt, Mycobacterium bovis subsp bovis AF2122/97
ggcgauuuugcgucugcucgccg

SEQ ID NO: 3094836 - RNA, 21 nt, Mycobacterium bovis subsp bovis AF2122/97
ggcgauuuugcgucugcucgg

SEQ ID NO: 3094837 - RNA, 16 nt, Mycobacterium bovis subsp bovis AF2122/97
ggcgcaaaccacccgc

SEQ ID NO: 3094838 - RNA, 17 nt, Mycobacterium bovis subsp bovis AF2122/97
ggcgcaaaccacccgca

SEQ ID NO: 3094839 - RNA, 18 nt, Mycobacterium bovis subsp bovis AF2122/97
ggcgcaaaccacccgcaa

SEQ ID NO: 3094840 - RNA, 20 nt, Mycobacterium bovis subsp bovis AF2122/97
ggcgcaaaccacccgcaaca

SEQ ID NO: 3094841 - RNA, 23 nt, Mycobacterium bovis subsp bovis AF2122/97
ggcgcaacaaccgguuggcgauc

SEQ ID NO: 3094842 - RNA, 13 nt, Mycobacterium bovis subsp bovis AF2122/97
ggcgcaacgagag

SEQ ID NO: 3094843 - RNA, 17 nt, Mycobacterium bovis subsp bovis AF2122/97
ggcgcaacgagagcggc

SEQ ID NO: 3094844 - RNA, 20 nt, Mycobacterium bovis subsp bovis AF2122/97
ggcgcaacgagagcggcucc

SEQ ID NO: 3094845 - RNA, 21 nt, Mycobacterium bovis subsp bovis AF2122/97
ggcgcaacgagagcggcuccg

SEQ ID NO: 3094846 - RNA, 18 nt, Mycobacterium bovis subsp bovis AF2122/97
ggcgcaacgggacgucac

SEQ ID NO: 3094847 - RNA, 20 nt, Mycobacterium bovis subsp bovis AF2122/97
ggcgcaacgggacgucaccg

SEQ ID NO: 3094848 - RNA, 15 nt, Mycobacterium bovis subsp bovis AF2122/97
ggcgcaacucgacca

SEQ ID NO: 3094849 - RNA, 18 nt, Mycobacterium bovis subsp bovis AF2122/97
ggcgcaacucgaccacuu

SEQ ID NO: 3094850 - RNA, 21 nt, Mycobacterium bovis subsp bovis AF2122/97
ggcgcaagaaugccgccgacg

SEQ ID NO: 3094851 - RNA, 18 nt, Mycobacterium bovis subsp bovis AF2122/97
ggcgcaagcgccgcgcuu

SEQ ID NO: 3094852 - RNA, 15 nt, Mycobacterium bovis subsp bovis AF2122/97
ggcgcaagguggcau

SEQ ID NO: 3094853 - RNA, 18 nt, Mycobacterium bovis subsp bovis AF2122/97
ggcgcaccacaccacggu

SEQ ID NO: 3094854 - RNA, 18 nt, Mycobacterium bovis subsp bovis AF2122/97
ggcgcaccaccgccccgc

SEQ ID NO: 3094855 - RNA, 15 nt, Mycobacterium bovis subsp bovis AF2122/97
ggcgcaccagggagc

SEQ ID NO: 3094856 - RNA, 16 nt, Mycobacterium bovis subsp bovis AF2122/97
ggcgcaccgucgcggg

SEQ ID NO: 3094857 - RNA, 17 nt, Mycobacterium bovis subsp bovis AF2122/97
ggcgcaccugggcugcc

SEQ ID NO: 3094858 - RNA, 19 nt, Mycobacterium bovis subsp bovis AF2122/97
ggcgcaccugggcugccgg

SEQ ID NO: 3094859 - RNA, 16 nt, Mycobacterium bovis subsp bovis AF2122/97
ggcgcacgaaaccgca

SEQ ID NO: 3094860 - RNA, 18 nt, Mycobacterium bovis subsp bovis AF2122/97
ggcgcacgaaaccgcagc

SEQ ID NO: 3094861 - RNA, 19 nt, Mycobacterium bovis subsp bovis AF2122/97
ggcgcacgaaaccgcagcg

SEQ ID NO: 3094862 - RNA, 14 nt, Mycobacterium bovis subsp bovis AF2122/97
ggcgcacgauggug

SEQ ID NO: 3094863 - RNA, 15 nt, Mycobacterium bovis subsp bovis AF2122/97
ggcgcacucccggau

SEQ ID NO: 3094864 - RNA, 18 nt, Mycobacterium bovis subsp bovis AF2122/97
ggcgcacugguugggcga

SEQ ID NO: 3094865 - RNA, 20 nt, Mycobacterium bovis subsp bovis AF2122/97
ggcgcacugguugggcgaga

SEQ ID NO: 3094866 - RNA, 20 nt, Mycobacterium bovis subsp bovis AF2122/97
ggcgcagcacauccugcagc

SEQ ID NO: 3094867 - RNA, 24 nt, Mycobacterium bovis subsp bovis AF2122/97
ggcgcagcacauccugcagcucgg

SEQ ID NO: 3094868 - RNA, 17 nt, Mycobacterium bovis subsp bovis AF2122/97
ggcgcagcaccgucggc

SEQ ID NO: 3094869 - RNA, 15 nt, Mycobacterium bovis subsp bovis AF2122/97
ggcgcagcacggcgg

SEQ ID NO: 3094870 - RNA, 17 nt, Mycobacterium bovis subsp bovis AF2122/97
ggcgcagcacggcggcc

SEQ ID NO: 3094871 - RNA, 18 nt, Mycobacterium bovis subsp bovis AF2122/97
ggcgcagcaucucgucga

SEQ ID NO: 3094872 - RNA, 20 nt, Mycobacterium bovis subsp bovis AF2122/97
ggcgcagcaucucgucgauc

SEQ ID NO: 3094873 - RNA, 14 nt, Mycobacterium bovis subsp bovis AF2122/97
ggcgcagccugccg

SEQ ID NO: 3094874 - RNA, 21 nt, Mycobacterium bovis subsp bovis AF2122/97
ggcgcagccugccgaugacga

SEQ ID NO: 3094875 - RNA, 15 nt, Mycobacterium bovis subsp bovis AF2122/97
ggcgcagcgaccggu

SEQ ID NO: 3094876 - RNA, 13 nt, Mycobacterium bovis subsp bovis AF2122/97
ggcgcagcgacgc

SEQ ID NO: 3094877 - RNA, 16 nt, Mycobacterium bovis subsp bovis AF2122/97
ggcgcagcgacgcgau

SEQ ID NO: 3094878 - RNA, 15 nt, Mycobacterium bovis subsp bovis AF2122/97
ggcgcagcgccagcg

SEQ ID NO: 3094879 - RNA, 13 nt, Mycobacterium bovis subsp bovis AF2122/97
ggcgcagcgccau

SEQ ID NO: 3094880 - RNA, 13 nt, Mycobacterium bovis subsp bovis AF2122/97
ggcgcagcgucuc

SEQ ID NO: 3094881 - RNA, 21 nt, Mycobacterium bovis subsp bovis AF2122/97
ggcgcagcgugagugcagcac

SEQ ID NO: 3094882 - RNA, 13 nt, Mycobacterium bovis subsp bovis AF2122/97
ggcgcagcucacc

SEQ ID NO: 3094883 - RNA, 14 nt, Mycobacterium bovis subsp bovis AF2122/97
ggcgcagcucaccg

SEQ ID NO: 3094884 - RNA, 20 nt, Mycobacterium bovis subsp bovis AF2122/97
ggcgcagcugguuugcggug

SEQ ID NO: 3094885 - RNA, 17 nt, Mycobacterium bovis subsp bovis AF2122/97
ggcgcaggucgcgcagu

SEQ ID NO: 3094886 - RNA, 19 nt, Mycobacterium bovis subsp bovis AF2122/97
ggcgcaggucgcgcaguug

SEQ ID NO: 3094887 - RNA, 15 nt, Mycobacterium bovis subsp bovis AF2122/97
ggcgcaguuggcacc

SEQ ID NO: 3094888 - RNA, 18 nt, Mycobacterium bovis subsp bovis AF2122/97
ggcgcaguuggcaccagc

SEQ ID NO: 3094889 - RNA, 19 nt, Mycobacterium bovis subsp bovis AF2122/97
ggcgcaguuggcaccagcc

SEQ ID NO: 3094890 - RNA, 21 nt, Mycobacterium bovis subsp bovis AF2122/97
ggcgcaguuggcaccagccgg

SEQ ID NO: 3094891 - RNA, 16 nt, Mycobacterium bovis subsp bovis AF2122/97
ggcgcauaccggcguc

SEQ ID NO: 3094892 - RNA, 15 nt, Mycobacterium bovis subsp bovis AF2122/97
ggcgcauaggcggcc

SEQ ID NO: 3094893 - RNA, 18 nt, Mycobacterium bovis subsp bovis AF2122/97
ggcgcauagggccaccgc

SEQ ID NO: 3094894 - RNA, 22 nt, Mycobacterium bovis subsp bovis AF2122/97
ggcgcaucagcuuuugcaccgg

SEQ ID NO: 3094895 - RNA, 21 nt, Mycobacterium bovis subsp bovis AF2122/97
ggcgcaugugaaagacaaccc

SEQ ID NO: 3094896 - RNA, 16 nt, Mycobacterium bovis subsp bovis AF2122/97
ggcgcauuccggcgcc

SEQ ID NO: 3094897 - RNA, 17 nt, Mycobacterium bovis subsp bovis AF2122/97
ggcgcauuccggcgcca

SEQ ID NO: 3094898 - RNA, 19 nt, Mycobacterium bovis subsp bovis AF2122/97
ggcgcauuccggcgccagg

SEQ ID NO: 3094899 - RNA, 19 nt, Mycobacterium bovis subsp bovis AF2122/97
ggcgcauuggccugaugca

SEQ ID NO: 3094900 - RNA, 13 nt, Mycobacterium bovis subsp bovis AF2122/97
ggcgccaacgggc

SEQ ID NO: 3094901 - RNA, 13 nt, Mycobacterium bovis subsp bovis AF2122/97
ggcgccaccaccc

SEQ ID NO: 3094902 - RNA, 15 nt, Mycobacterium bovis subsp bovis AF2122/97
ggcgccacccgcgcc

SEQ ID NO: 3094903 - RNA, 20 nt, Mycobacterium bovis subsp bovis AF2122/97
ggcgccaccgccgcugccgg

SEQ ID NO: 3094904 - RNA, 17 nt, Mycobacterium bovis subsp bovis AF2122/97
ggcgccaccggcgccgc

SEQ ID NO: 3094905 - RNA, 15 nt, Mycobacterium bovis subsp bovis AF2122/97
ggcgccaccgucacc

SEQ ID NO: 3094906 - RNA, 15 nt, Mycobacterium bovis subsp bovis AF2122/97
ggcgccaccgucgcc

SEQ ID NO: 3094907 - RNA, 16 nt, Mycobacterium bovis subsp bovis AF2122/97
ggcgccaccgucgccg

SEQ ID NO: 3094908 - RNA, 14 nt, Mycobacterium bovis subsp bovis AF2122/97
ggcgccacggcagc

SEQ ID NO: 3094909 - RNA, 15 nt, Mycobacterium bovis subsp bovis AF2122/97
ggcgccacggcagcg

SEQ ID NO: 3094910 - RNA, 19 nt, Mycobacterium bovis subsp bovis AF2122/97
ggcgccacggcagcgccca

SEQ ID NO: 3094911 - RNA, 14 nt, Mycobacterium bovis subsp bovis AF2122/97
ggcgccacggguga

SEQ ID NO: 3094912 - RNA, 18 nt, Mycobacterium bovis subsp bovis AF2122/97
ggcgccacugaccgcgau

SEQ ID NO: 3094913 - RNA, 23 nt, Mycobacterium bovis subsp bovis AF2122/97
ggcgccacugaccgcgaucgccg

SEQ ID NO: 3094914 - RNA, 17 nt, Mycobacterium bovis subsp bovis AF2122/97
ggcgccagaucgacgcc

SEQ ID NO: 3094915 - RNA, 11 nt, Mycobacterium bovis subsp bovis AF2122/97
ggcgccagcag

SEQ ID NO: 3094916 - RNA, 13 nt, Mycobacterium bovis subsp bovis AF2122/97
ggcgccagccgac

SEQ ID NO: 3094917 - RNA, 13 nt, Mycobacterium bovis subsp bovis AF2122/97
ggcgccagcgccg

SEQ ID NO: 3094918 - RNA, 14 nt, Mycobacterium bovis subsp bovis AF2122/97
ggcgccagcgccgc

SEQ ID NO: 3094919 - RNA, 16 nt, Mycobacterium bovis subsp bovis AF2122/97
ggcgccagcgccgcca

SEQ ID NO: 3094920 - RNA, 22 nt, Mycobacterium bovis subsp bovis AF2122/97
ggcgccauagccgcgacccgcg

SEQ ID NO: 3094921 - RNA, 18 nt, Mycobacterium bovis subsp bovis AF2122/97
ggcgccauccccgccggc

SEQ ID NO: 3094922 - RNA, 20 nt, Mycobacterium bovis subsp bovis AF2122/97
ggcgccaucccgccgcccgc

SEQ ID NO: 3094923 - RNA, 20 nt, Mycobacterium bovis subsp bovis AF2122/97
ggcgccaucgggucaccccc

SEQ ID NO: 3094924 - RNA, 16 nt, Mycobacterium bovis subsp bovis AF2122/97
ggcgccaugaagccgg

SEQ ID NO: 3094925 - RNA, 17 nt, Mycobacterium bovis subsp bovis AF2122/97
ggcgccaugaagccggg

SEQ ID NO: 3094926 - RNA, 19 nt, Mycobacterium bovis subsp bovis AF2122/97
ggcgccauggucgcugcgu

SEQ ID NO: 3094927 - RNA, 22 nt, Mycobacterium bovis subsp bovis AF2122/97
ggcgcccacaaauauccugcgg

SEQ ID NO: 3094928 - RNA, 19 nt, Mycobacterium bovis subsp bovis AF2122/97
ggcgcccacaucgucggcg

SEQ ID NO: 3094929 - RNA, 23 nt, Mycobacterium bovis subsp bovis AF2122/97
ggcgcccacaucgucggcgggcg

SEQ ID NO: 3094930 - RNA, 13 nt, Mycobacterium bovis subsp bovis AF2122/97
ggcgcccagcgac

SEQ ID NO: 3094931 - RNA, 14 nt, Mycobacterium bovis subsp bovis AF2122/97
ggcgcccagcgccu

SEQ ID NO: 3094932 - RNA, 14 nt, Mycobacterium bovis subsp bovis AF2122/97
ggcgcccagcucga

SEQ ID NO: 3094933 - RNA, 14 nt, Mycobacterium bovis subsp bovis AF2122/97
ggcgcccagcucgu

SEQ ID NO: 3094934 - RNA, 15 nt, Mycobacterium bovis subsp bovis AF2122/97
ggcgcccaggccgau

SEQ ID NO: 3094935 - RNA, 14 nt, Mycobacterium bovis subsp bovis AF2122/97
ggcgccccaccggc

SEQ ID NO: 3094936 - RNA, 21 nt, Mycobacterium bovis subsp bovis AF2122/97
ggcgccccagggggcgugccg

SEQ ID NO: 3094937 - RNA, 21 nt, Mycobacterium bovis subsp bovis AF2122/97
ggcgcccccgccauugccgcc

SEQ ID NO: 3094938 - RNA, 15 nt, Mycobacterium bovis subsp bovis AF2122/97
ggcgcccgaagccgg

SEQ ID NO: 3094939 - RNA, 16 nt, Mycobacterium bovis subsp bovis AF2122/97
ggcgcccgaagccggg

SEQ ID NO: 3094940 - RNA, 20 nt, Mycobacterium bovis subsp bovis AF2122/97
ggcgcccgaagccgggcccc

SEQ ID NO: 3094941 - RNA, 15 nt, Mycobacterium bovis subsp bovis AF2122/97
ggcgcccgagaccgg

SEQ ID NO: 3094942 - RNA, 20 nt, Mycobacterium bovis subsp bovis AF2122/97
ggcgcccgagauccccaaau

SEQ ID NO: 3094943 - RNA, 17 nt, Mycobacterium bovis subsp bovis AF2122/97
ggcgcccgccaccggag

SEQ ID NO: 3094944 - RNA, 18 nt, Mycobacterium bovis subsp bovis AF2122/97
ggcgcccgccaccggagg

SEQ ID NO: 3094945 - RNA, 13 nt, Mycobacterium bovis subsp bovis AF2122/97
ggcgcccgccccg

SEQ ID NO: 3094946 - RNA, 16 nt, Mycobacterium bovis subsp bovis AF2122/97
ggcgcccgccccgcgc

SEQ ID NO: 3094947 - RNA, 13 nt, Mycobacterium bovis subsp bovis AF2122/97
ggcgcccgcccga

SEQ ID NO: 3094948 - RNA, 19 nt, Mycobacterium bovis subsp bovis AF2122/97
ggcgcccgcccgagccgcu

SEQ ID NO: 3094949 - RNA, 12 nt, Mycobacterium bovis subsp bovis AF2122/97
ggcgcccgccgg

SEQ ID NO: 3094950 - RNA, 13 nt, Mycobacterium bovis subsp bovis AF2122/97
ggcgcccgccggc

SEQ ID NO: 3094951 - RNA, 15 nt, Mycobacterium bovis subsp bovis AF2122/97
ggcgcccgccggcaa

SEQ ID NO: 3094952 - RNA, 14 nt, Mycobacterium bovis subsp bovis AF2122/97
ggcgcccgcggucc

SEQ ID NO: 3094953 - RNA, 21 nt, Mycobacterium bovis subsp bovis AF2122/97
ggcgcccgcguggccggucac

SEQ ID NO: 3094954 - RNA, 16 nt, Mycobacterium bovis subsp bovis AF2122/97
ggcgcccgcucggccg

SEQ ID NO: 3094955 - RNA, 20 nt, Mycobacterium bovis subsp bovis AF2122/97
ggcgcccgcucggccgcagc

SEQ ID NO: 3094956 - RNA, 23 nt, Mycobacterium bovis subsp bovis AF2122/97
ggcgcccgcucggccgcagccag

SEQ ID NO: 3094957 - RNA, 15 nt, Mycobacterium bovis subsp bovis AF2122/97
ggcgcccggcggauc

SEQ ID NO: 3094958 - RNA, 16 nt, Mycobacterium bovis subsp bovis AF2122/97
ggcgcccggggcggug

SEQ ID NO: 3094959 - RNA, 20 nt, Mycobacterium bovis subsp bovis AF2122/97
ggcgcccgggucccggcagc

SEQ ID NO: 3094960 - RNA, 17 nt, Mycobacterium bovis subsp bovis AF2122/97
ggcgcccgucuccagca

SEQ ID NO: 3094961 - RNA, 18 nt, Mycobacterium bovis subsp bovis AF2122/97
ggcgcccgugccgcccgc

SEQ ID NO: 3094962 - RNA, 23 nt, Mycobacterium bovis subsp bovis AF2122/97
ggcgcccgugccgcccgcgccgc

SEQ ID NO: 3094963 - RNA, 21 nt, Mycobacterium bovis subsp bovis AF2122/97
ggcgcccucaugucgggcaac

SEQ ID NO: 3094964 - RNA, 14 nt, Mycobacterium bovis subsp bovis AF2122/97
ggcgcccuccuugg

SEQ ID NO: 3094965 - RNA, 20 nt, Mycobacterium bovis subsp bovis AF2122/97
ggcgcccuuaagccggcgcg

SEQ ID NO: 3094966 - RNA, 13 nt, Mycobacterium bovis subsp bovis AF2122/97
ggcgcccuugagc

SEQ ID NO: 3094967 - RNA, 15 nt, Mycobacterium bovis subsp bovis AF2122/97
ggcgccgaacaccgg

SEQ ID NO: 3094968 - RNA, 16 nt, Mycobacterium bovis subsp bovis AF2122/97
ggcgccgaacaccggc

SEQ ID NO: 3094969 - RNA, 18 nt, Mycobacterium bovis subsp bovis AF2122/97
ggcgccgaacaccggcuc

SEQ ID NO: 3094970 - RNA, 17 nt, Mycobacterium bovis subsp bovis AF2122/97
ggcgccgaaccagcgau

SEQ ID NO: 3094971 - RNA, 17 nt, Mycobacterium bovis subsp bovis AF2122/97
ggcgccgaacccggugu

SEQ ID NO: 3094972 - RNA, 21 nt, Mycobacterium bovis subsp bovis AF2122/97
ggcgccgaagagucgugccgc

SEQ ID NO: 3094973 - RNA, 13 nt, Mycobacterium bovis subsp bovis AF2122/97
ggcgccgaaguag

SEQ ID NO: 3094974 - RNA, 14 nt, Mycobacterium bovis subsp bovis AF2122/97
ggcgccgacaccgg

SEQ ID NO: 3094975 - RNA, 20 nt, Mycobacterium bovis subsp bovis AF2122/97
ggcgccgacaccggcugacc

SEQ ID NO: 3094976 - RNA, 23 nt, Mycobacterium bovis subsp bovis AF2122/97
ggcgccgacaccggcugaccgac

SEQ ID NO: 3094977 - RNA, 23 nt, Mycobacterium bovis subsp bovis AF2122/97
ggcgccgaccacauuccgcaguc

SEQ ID NO: 3094978 - RNA, 17 nt, Mycobacterium bovis subsp bovis AF2122/97
ggcgccgacgacuccgg

SEQ ID NO: 3094979 - RNA, 22 nt, Mycobacterium bovis subsp bovis AF2122/97
ggcgccgacgacuccggcaagc

SEQ ID NO: 3094980 - RNA, 20 nt, Mycobacterium bovis subsp bovis AF2122/97
ggcgccgacguacaggacgg

SEQ ID NO: 3094981 - RNA, 16 nt, Mycobacterium bovis subsp bovis AF2122/97
ggcgccgagcagcccg

SEQ ID NO: 3094982 - RNA, 18 nt, Mycobacterium bovis subsp bovis AF2122/97
ggcgccgauaccggcggc

SEQ ID NO: 3094983 - RNA, 19 nt, Mycobacterium bovis subsp bovis AF2122/97
ggcgccgauaccggcggcg

SEQ ID NO: 3094984 - RNA, 22 nt, Mycobacterium bovis subsp bovis AF2122/97
ggcgccgauaccggcggcgagc

SEQ ID NO: 3094985 - RNA, 14 nt, Mycobacterium bovis subsp bovis AF2122/97
ggcgccgcaaccgc

SEQ ID NO: 3094986 - RNA, 23 nt, Mycobacterium bovis subsp bovis AF2122/97
ggcgccgcacagagugaggcgcu

SEQ ID NO: 3094987 - RNA, 20 nt, Mycobacterium bovis subsp bovis AF2122/97
ggcgccgcaccaagcagcga

SEQ ID NO: 3094988 - RNA, 23 nt, Mycobacterium bovis subsp bovis AF2122/97
ggcgccgcaccaagcagcgacca

SEQ ID NO: 3094989 - RNA, 11 nt, Mycobacterium bovis subsp bovis AF2122/97
ggcgccgcaga

SEQ ID NO: 3094990 - RNA, 19 nt, Mycobacterium bovis subsp bovis AF2122/97
ggcgccgcagaucaccgcc

SEQ ID NO: 3094991 - RNA, 13 nt, Mycobacterium bovis subsp bovis AF2122/97
ggcgccgcagcgc

SEQ ID NO: 3094992 - RNA, 14 nt, Mycobacterium bovis subsp bovis AF2122/97
ggcgccgcagcgcu

SEQ ID NO: 3094993 - RNA, 19 nt, Mycobacterium bovis subsp bovis AF2122/97
ggcgccgcagcgcucgcgu

SEQ ID NO: 3094994 - RNA, 17 nt, Mycobacterium bovis subsp bovis AF2122/97
ggcgccgccaagggccc

SEQ ID NO: 3094995 - RNA, 13 nt, Mycobacterium bovis subsp bovis AF2122/97
ggcgccgccagca

SEQ ID NO: 3094996 - RNA, 22 nt, Mycobacterium bovis subsp bovis AF2122/97
ggcgccgccagcaccaccggcu

SEQ ID NO: 3094997 - RNA, 11 nt, Mycobacterium bovis subsp bovis AF2122/97
ggcgccgccca

SEQ ID NO: 3094998 - RNA, 13 nt, Mycobacterium bovis subsp bovis AF2122/97
ggcgccgcccaac

SEQ ID NO: 3094999 - RNA, 12 nt, Mycobacterium bovis subsp bovis AF2122/97
ggcgccgcccag

SEQ ID NO: 3095000 - RNA, 11 nt, Mycobacterium bovis subsp bovis AF2122/97
ggcgccgcccg

SEQ ID NO: 3095001 - RNA, 12 nt, Mycobacterium bovis subsp bovis AF2122/97
ggcgccgcccgc

SEQ ID NO: 3095002 - RNA, 13 nt, Mycobacterium bovis subsp bovis AF2122/97
ggcgccgcccgcg

SEQ ID NO: 3095003 - RNA, 14 nt, Mycobacterium bovis subsp bovis AF2122/97
ggcgccgcccgcgc

SEQ ID NO: 3095004 - RNA, 16 nt, Mycobacterium bovis subsp bovis AF2122/97
ggcgccgcccgcgcca

SEQ ID NO: 3095005 - RNA, 16 nt, Mycobacterium bovis subsp bovis AF2122/97
ggcgccgcccgcgccg

SEQ ID NO: 3095006 - RNA, 19 nt, Mycobacterium bovis subsp bovis AF2122/97
ggcgccgcccuaaggggca

SEQ ID NO: 3095007 - RNA, 18 nt, Mycobacterium bovis subsp bovis AF2122/97
ggcgccgcccuugccgcc

SEQ ID NO: 3095008 - RNA, 20 nt, Mycobacterium bovis subsp bovis AF2122/97
ggcgccgcccuugccgccgg

SEQ ID NO: 3095009 - RNA, 16 nt, Mycobacterium bovis subsp bovis AF2122/97
ggcgccgccgaucccg

SEQ ID NO: 3095010 - RNA, 12 nt, Mycobacterium bovis subsp bovis AF2122/97
ggcgccgccggc

SEQ ID NO: 3095011 - RNA, 21 nt, Mycobacterium bovis subsp bovis AF2122/97
ggcgccgccggcacccgccgu

SEQ ID NO: 3095012 - RNA, 17 nt, Mycobacterium bovis subsp bovis AF2122/97
ggcgccgccggcaccgc

SEQ ID NO: 3095013 - RNA, 13 nt, Mycobacterium bovis subsp bovis AF2122/97
ggcgccgccggcg

SEQ ID NO: 3095014 - RNA, 14 nt, Mycobacterium bovis subsp bovis AF2122/97
ggcgccgccggcgc

SEQ ID NO: 3095015 - RNA, 17 nt, Mycobacterium bovis subsp bovis AF2122/97
ggcgccgccggcgccgc

SEQ ID NO: 3095016 - RNA, 12 nt, Mycobacterium bovis subsp bovis AF2122/97
ggcgccgccggu

SEQ ID NO: 3095017 - RNA, 16 nt, Mycobacterium bovis subsp bovis AF2122/97
ggcgccgccggugcca

SEQ ID NO: 3095018 - RNA, 18 nt, Mycobacterium bovis subsp bovis AF2122/97
ggcgccgccggugccacc

SEQ ID NO: 3095019 - RNA, 11 nt, Mycobacterium bovis subsp bovis AF2122/97
ggcgccgccgu

SEQ ID NO: 3095020 - RNA, 16 nt, Mycobacterium bovis subsp bovis AF2122/97
ggcgccgccguccagc

SEQ ID NO: 3095021 - RNA, 20 nt, Mycobacterium bovis subsp bovis AF2122/97
ggcgccgccguccagcgccg

SEQ ID NO: 3095022 - RNA, 23 nt, Mycobacterium bovis subsp bovis AF2122/97
ggcgccgccguccagcgccgcgg

SEQ ID NO: 3095023 - RNA, 14 nt, Mycobacterium bovis subsp bovis AF2122/97
ggcgccgccgucgc

SEQ ID NO: 3095024 - RNA, 16 nt, Mycobacterium bovis subsp bovis AF2122/97
ggcgccgccgucgccg

SEQ ID NO: 3095025 - RNA, 15 nt, Mycobacterium bovis subsp bovis AF2122/97
ggcgccgccguuacc

SEQ ID NO: 3095026 - RNA, 22 nt, Mycobacterium bovis subsp bovis AF2122/97
ggcgccgccguuaccgccggcg

SEQ ID NO: 3095027 - RNA, 23 nt, Mycobacterium bovis subsp bovis AF2122/97
ggcgccgccguuaccgccggcgc

SEQ ID NO: 3095028 - RNA, 15 nt, Mycobacterium bovis subsp bovis AF2122/97
ggcgccgccguuccc

SEQ ID NO: 3095029 - RNA, 13 nt, Mycobacterium bovis subsp bovis AF2122/97
ggcgccgccguug

SEQ ID NO: 3095030 - RNA, 21 nt, Mycobacterium bovis subsp bovis AF2122/97
ggcgccgccuggacgccgccg

SEQ ID NO: 3095031 - RNA, 13 nt, Mycobacterium bovis subsp bovis AF2122/97
ggcgccgcgccga

SEQ ID NO: 3095032 - RNA, 16 nt, Mycobacterium bovis subsp bovis AF2122/97
ggcgccgcgccgauuc

SEQ ID NO: 3095033 - RNA, 22 nt, Mycobacterium bovis subsp bovis AF2122/97
ggcgccgcgccgauuccaccgc

SEQ ID NO: 3095034 - RNA, 12 nt, Mycobacterium bovis subsp bovis AF2122/97
ggcgccgcgcgc

SEQ ID NO: 3095035 - RNA, 17 nt, Mycobacterium bovis subsp bovis AF2122/97
ggcgccgcgcucgacga

SEQ ID NO: 3095036 - RNA, 14 nt, Mycobacterium bovis subsp bovis AF2122/97
ggcgccgcggcugg

SEQ ID NO: 3095037 - RNA, 19 nt, Mycobacterium bovis subsp bovis AF2122/97
ggcgccggaacgagcggcc

SEQ ID NO: 3095038 - RNA, 22 nt, Mycobacterium bovis subsp bovis AF2122/97
ggcgccggaacgagcggccgcg

SEQ ID NO: 3095039 - RNA, 14 nt, Mycobacterium bovis subsp bovis AF2122/97
ggcgccggagccgc

SEQ ID NO: 3095040 - RNA, 15 nt, Mycobacterium bovis subsp bovis AF2122/97
ggcgccggagccgcc

SEQ ID NO: 3095041 - RNA, 19 nt, Mycobacterium bovis subsp bovis AF2122/97
ggcgccggauauggcagug

SEQ ID NO: 3095042 - RNA, 13 nt, Mycobacterium bovis subsp bovis AF2122/97
ggcgccggccagc

SEQ ID NO: 3095043 - RNA, 13 nt, Mycobacterium bovis subsp bovis AF2122/97
ggcgccggccagu

SEQ ID NO: 3095044 - RNA, 13 nt, Mycobacterium bovis subsp bovis AF2122/97
ggcgccggccggc

SEQ ID NO: 3095045 - RNA, 16 nt, Mycobacterium bovis subsp bovis AF2122/97
ggcgccggccggcagg

SEQ ID NO: 3095046 - RNA, 17 nt, Mycobacterium bovis subsp bovis AF2122/97
ggcgccggccggcagga

SEQ ID NO: 3095047 - RNA, 14 nt, Mycobacterium bovis subsp bovis AF2122/97
ggcgccggccggcg

SEQ ID NO: 3095048 - RNA, 15 nt, Mycobacterium bovis subsp bovis AF2122/97
ggcgccggccggcgc

SEQ ID NO: 3095049 - RNA, 18 nt, Mycobacterium bovis subsp bovis AF2122/97
ggcgccggccggcgcggu

SEQ ID NO: 3095050 - RNA, 16 nt, Mycobacterium bovis subsp bovis AF2122/97
ggcgccggccucgccg

SEQ ID NO: 3095051 - RNA, 19 nt, Mycobacterium bovis subsp bovis AF2122/97
ggcgccggccucgccgggg

SEQ ID NO: 3095052 - RNA, 12 nt, Mycobacterium bovis subsp bovis AF2122/97
ggcgccggcgcc

SEQ ID NO: 3095053 - RNA, 16 nt, Mycobacterium bovis subsp bovis AF2122/97
ggcgccggcgcugcug

SEQ ID NO: 3095054 - RNA, 12 nt, Mycobacterium bovis subsp bovis AF2122/97
ggcgccggcggc

SEQ ID NO: 3095055 - RNA, 13 nt, Mycobacterium bovis subsp bovis AF2122/97
ggcgccggcggcc

SEQ ID NO: 3095056 - RNA, 16 nt, Mycobacterium bovis subsp bovis AF2122/97
ggcgccggcggccgcg

SEQ ID NO: 3095057 - RNA, 17 nt, Mycobacterium bovis subsp bovis AF2122/97
ggcgccggcggccgcgg

SEQ ID NO: 3095058 - RNA, 12 nt, Mycobacterium bovis subsp bovis AF2122/97
ggcgccggcguc

SEQ ID NO: 3095059 - RNA, 14 nt, Mycobacterium bovis subsp bovis AF2122/97
ggcgccggcgucgg

SEQ ID NO: 3095060 - RNA, 23 nt, Mycobacterium bovis subsp bovis AF2122/97
ggcgccggcgucggcgcccagcu

SEQ ID NO: 3095061 - RNA, 14 nt, Mycobacterium bovis subsp bovis AF2122/97
ggcgccggcuugga

SEQ ID NO: 3095062 - RNA, 12 nt, Mycobacterium bovis subsp bovis AF2122/97
ggcgccggggcc

SEQ ID NO: 3095063 - RNA, 14 nt, Mycobacterium bovis subsp bovis AF2122/97
ggcgccggggccgc

SEQ ID NO: 3095064 - RNA, 18 nt, Mycobacterium bovis subsp bovis AF2122/97
ggcgccggggccgccgau

SEQ ID NO: 3095065 - RNA, 22 nt, Mycobacterium bovis subsp bovis AF2122/97
ggcgccggggccgccgaugcca

SEQ ID NO: 3095066 - RNA, 19 nt, Mycobacterium bovis subsp bovis AF2122/97
ggcgccgggggcgccgccg

SEQ ID NO: 3095067 - RNA, 20 nt, Mycobacterium bovis subsp bovis AF2122/97
ggcgccgggucacgugggcc

SEQ ID NO: 3095068 - RNA, 17 nt, Mycobacterium bovis subsp bovis AF2122/97
ggcgccgggucgauggg

SEQ ID NO: 3095069 - RNA, 12 nt, Mycobacterium bovis subsp bovis AF2122/97
ggcgccggucgc

SEQ ID NO: 3095070 - RNA, 14 nt, Mycobacterium bovis subsp bovis AF2122/97
ggcgccggucgccg

SEQ ID NO: 3095071 - RNA, 18 nt, Mycobacterium bovis subsp bovis AF2122/97
ggcgccggucgccggcug

SEQ ID NO: 3095072 - RNA, 20 nt, Mycobacterium bovis subsp bovis AF2122/97
ggcgccggucgccggcuggg

SEQ ID NO: 3095073 - RNA, 13 nt, Mycobacterium bovis subsp bovis AF2122/97
ggcgccggugccg

SEQ ID NO: 3095074 - RNA, 15 nt, Mycobacterium bovis subsp bovis AF2122/97
ggcgccggugccgcc

SEQ ID NO: 3095075 - RNA, 16 nt, Mycobacterium bovis subsp bovis AF2122/97
ggcgccggugccgccu

SEQ ID NO: 3095076 - RNA, 16 nt, Mycobacterium bovis subsp bovis AF2122/97
ggcgccggugcggcgg

SEQ ID NO: 3095077 - RNA, 17 nt, Mycobacterium bovis subsp bovis AF2122/97
ggcgccggugcggcggg

SEQ ID NO: 3095078 - RNA, 18 nt, Mycobacterium bovis subsp bovis AF2122/97
ggcgccggugcggcgggc

SEQ ID NO: 3095079 - RNA, 14 nt, Mycobacterium bovis subsp bovis AF2122/97
ggcgccggugggcg

SEQ ID NO: 3095080 - RNA, 20 nt, Mycobacterium bovis subsp bovis AF2122/97
ggcgccggugguaacggcgg

SEQ ID NO: 3095081 - RNA, 19 nt, Mycobacterium bovis subsp bovis AF2122/97
ggcgccggugguaccggcg

SEQ ID NO: 3095082 - RNA, 20 nt, Mycobacterium bovis subsp bovis AF2122/97
ggcgccggugguaccggcgg

SEQ ID NO: 3095083 - RNA, 22 nt, Mycobacterium bovis subsp bovis AF2122/97
ggcgccggugguaccggcggcg

SEQ ID NO: 3095084 - RNA, 21 nt, Mycobacterium bovis subsp bovis AF2122/97
ggcgccgguguuuccgaaacc

SEQ ID NO: 3095085 - RNA, 22 nt, Mycobacterium bovis subsp bovis AF2122/97
ggcgccgucaauggaaccgguu

SEQ ID NO: 3095086 - RNA, 22 nt, Mycobacterium bovis subsp bovis AF2122/97
ggcgccgucgaaauacccgguc

SEQ ID NO: 3095087 - RNA, 15 nt, Mycobacterium bovis subsp bovis AF2122/97
ggcgccgucgaugac

SEQ ID NO: 3095088 - RNA, 17 nt, Mycobacterium bovis subsp bovis AF2122/97
ggcgccgucgcccagcg

SEQ ID NO: 3095089 - RNA, 13 nt, Mycobacterium bovis subsp bovis AF2122/97
ggcgccgucgccg

SEQ ID NO: 3095090 - RNA, 17 nt, Mycobacterium bovis subsp bovis AF2122/97
ggcgccgucggagccgg

SEQ ID NO: 3095091 - RNA, 18 nt, Mycobacterium bovis subsp bovis AF2122/97
ggcgccgucggagccggc

SEQ ID NO: 3095092 - RNA, 15 nt, Mycobacterium bovis subsp bovis AF2122/97
ggcgccgucggccga

SEQ ID NO: 3095093 - RNA, 16 nt, Mycobacterium bovis subsp bovis AF2122/97
ggcgccgucggccgag

SEQ ID NO: 3095094 - RNA, 15 nt, Mycobacterium bovis subsp bovis AF2122/97
ggcgccgucgucagc

SEQ ID NO: 3095095 - RNA, 15 nt, Mycobacterium bovis subsp bovis AF2122/97
ggcgccgucguugug

SEQ ID NO: 3095096 - RNA, 17 nt, Mycobacterium bovis subsp bovis AF2122/97
ggcgccgucucgaucgc

SEQ ID NO: 3095097 - RNA, 18 nt, Mycobacterium bovis subsp bovis AF2122/97
ggcgccgucucgaucgcg

SEQ ID NO: 3095098 - RNA, 20 nt, Mycobacterium bovis subsp bovis AF2122/97
ggcgccgucucgaucgcggu

SEQ ID NO: 3095099 - RNA, 13 nt, Mycobacterium bovis subsp bovis AF2122/97
ggcgccgucucgc

SEQ ID NO: 3095100 - RNA, 18 nt, Mycobacterium bovis subsp bovis AF2122/97
ggcgccgucucgcggugc

SEQ ID NO: 3095101 - RNA, 20 nt, Mycobacterium bovis subsp bovis AF2122/97
ggcgccgugaucagcucgcg

SEQ ID NO: 3095102 - RNA, 17 nt, Mycobacterium bovis subsp bovis AF2122/97
ggcgccguuagcgucgc

SEQ ID NO: 3095103 - RNA, 15 nt, Mycobacterium bovis subsp bovis AF2122/97
ggcgccguugccacc

SEQ ID NO: 3095104 - RNA, 22 nt, Mycobacterium bovis subsp bovis AF2122/97
ggcgccguugccaccguugccg

SEQ ID NO: 3095105 - RNA, 20 nt, Mycobacterium bovis subsp bovis AF2122/97
ggcgccguugccggcguugc

SEQ ID NO: 3095106 - RNA, 17 nt, Mycobacterium bovis subsp bovis AF2122/97
ggcgccguugucggcgg

SEQ ID NO: 3095107 - RNA, 19 nt, Mycobacterium bovis subsp bovis AF2122/97
ggcgccuacaccggcgcuc

SEQ ID NO: 3095108 - RNA, 16 nt, Mycobacterium bovis subsp bovis AF2122/97
ggcgccuagcacgaag

SEQ ID NO: 3095109 - RNA, 22 nt, Mycobacterium bovis subsp bovis AF2122/97
ggcgccuagcacgaagcuggcg

SEQ ID NO: 3095110 - RNA, 20 nt, Mycobacterium bovis subsp bovis AF2122/97
ggcgccucaucggacagcgc

SEQ ID NO: 3095111 - RNA, 17 nt, Mycobacterium bovis subsp bovis AF2122/97
ggcgccuccgcucggua

SEQ ID NO: 3095112 - RNA, 15 nt, Mycobacterium bovis subsp bovis AF2122/97
ggcgccuccggcacc

SEQ ID NO: 3095113 - RNA, 17 nt, Mycobacterium bovis subsp bovis AF2122/97
ggcgccucggaccagac

SEQ ID NO: 3095114 - RNA, 15 nt, Mycobacterium bovis subsp bovis AF2122/97
ggcgccucguugccg

SEQ ID NO: 3095115 - RNA, 12 nt, Mycobacterium bovis subsp bovis AF2122/97
ggcgccugacuc

SEQ ID NO: 3095116 - RNA, 20 nt, Mycobacterium bovis subsp bovis AF2122/97
ggcgccuucaccuggugugc

SEQ ID NO: 3095117 - RNA, 11 nt, Mycobacterium bovis subsp bovis AF2122/97
ggcgccuuggu

SEQ ID NO: 3095118 - RNA, 22 nt, Mycobacterium bovis subsp bovis AF2122/97
ggcgccuugguccguagcgcgg

SEQ ID NO: 3095119 - RNA, 16 nt, Mycobacterium bovis subsp bovis AF2122/97
ggcgccuuggucgccg

SEQ ID NO: 3095120 - RNA, 19 nt, Mycobacterium bovis subsp bovis AF2122/97
ggcgccuuggucgccgccu

SEQ ID NO: 3095121 - RNA, 14 nt, Mycobacterium bovis subsp bovis AF2122/97
ggcgcgaaacgccg

SEQ ID NO: 3095122 - RNA, 19 nt, Mycobacterium bovis subsp bovis AF2122/97
ggcgcgaauauucgcuggg

SEQ ID NO: 3095123 - RNA, 16 nt, Mycobacterium bovis subsp bovis AF2122/97
ggcgcgacagccgugg

SEQ ID NO: 3095124 - RNA, 15 nt, Mycobacterium bovis subsp bovis AF2122/97
ggcgcgaccccaggc

SEQ ID NO: 3095125 - RNA, 15 nt, Mycobacterium bovis subsp bovis AF2122/97
ggcgcgaccgcggcg

SEQ ID NO: 3095126 - RNA, 12 nt, Mycobacterium bovis subsp bovis AF2122/97
ggcgcgaccggu

SEQ ID NO: 3095127 - RNA, 20 nt, Mycobacterium bovis subsp bovis AF2122/97
ggcgcgacguagacgacguc

SEQ ID NO: 3095128 - RNA, 16 nt, Mycobacterium bovis subsp bovis AF2122/97
ggcgcgagcagacgca

SEQ ID NO: 3095129 - RNA, 22 nt, Mycobacterium bovis subsp bovis AF2122/97
ggcgcgagccggcucagacgac

SEQ ID NO: 3095130 - RNA, 16 nt, Mycobacterium bovis subsp bovis AF2122/97
ggcgcgaggaacgccg

SEQ ID NO: 3095131 - RNA, 21 nt, Mycobacterium bovis subsp bovis AF2122/97
ggcgcgaggaacgccggggcg

SEQ ID NO: 3095132 - RNA, 15 nt, Mycobacterium bovis subsp bovis AF2122/97
ggcgcgaggacgcug

SEQ ID NO: 3095133 - RNA, 18 nt, Mycobacterium bovis subsp bovis AF2122/97
ggcgcgauacagacgggg

SEQ ID NO: 3095134 - RNA, 21 nt, Mycobacterium bovis subsp bovis AF2122/97
ggcgcgauacagacggggauc

SEQ ID NO: 3095135 - RNA, 21 nt, Mycobacterium bovis subsp bovis AF2122/97
ggcgcgauagauacccgcggc

SEQ ID NO: 3095136 - RNA, 24 nt, Mycobacterium bovis subsp bovis AF2122/97
ggcgcgauagauacccgcggcagc

SEQ ID NO: 3095137 - RNA, 21 nt, Mycobacterium bovis subsp bovis AF2122/97
ggcgcgaucagguaccggcgg

SEQ ID NO: 3095138 - RNA, 13 nt, Mycobacterium bovis subsp bovis AF2122/97
ggcgcgaucgcgc

SEQ ID NO: 3095139 - RNA, 17 nt, Mycobacterium bovis subsp bovis AF2122/97
ggcgcgaucgcgcccgc

SEQ ID NO: 3095140 - RNA, 24 nt, Mycobacterium bovis subsp bovis AF2122/97
ggcgcgaucgcucauucgugcccg

SEQ ID NO: 3095141 - RNA, 20 nt, Mycobacterium bovis subsp bovis AF2122/97
ggcgcgaucggugccgaagc

SEQ ID NO: 3095142 - RNA, 22 nt, Mycobacterium bovis subsp bovis AF2122/97
ggcgcgaucggugccgaagcug

SEQ ID NO: 3095143 - RNA, 20 nt, Mycobacterium bovis subsp bovis AF2122/97
ggcgcgcaacguagccagca

SEQ ID NO: 3095144 - RNA, 22 nt, Mycobacterium bovis subsp bovis AF2122/97
ggcgcgcaagugcuggccgaag

SEQ ID NO: 3095145 - RNA, 17 nt, Mycobacterium bovis subsp bovis AF2122/97
ggcgcgcaccaccgcgg

SEQ ID NO: 3095146 - RNA, 21 nt, Mycobacterium bovis subsp bovis AF2122/97
ggcgcgcaccaccgcggcggc

SEQ ID NO: 3095147 - RNA, 22 nt, Mycobacterium bovis subsp bovis AF2122/97
ggcgcgcaccaccgcggcggcg

SEQ ID NO: 3095148 - RNA, 15 nt, Mycobacterium bovis subsp bovis AF2122/97
ggcgcgcaccccggc

SEQ ID NO: 3095149 - RNA, 17 nt, Mycobacterium bovis subsp bovis AF2122/97
ggcgcgcaccccggcau

SEQ ID NO: 3095150 - RNA, 21 nt, Mycobacterium bovis subsp bovis AF2122/97
ggcgcgcagcgauucgccuag

SEQ ID NO: 3095151 - RNA, 14 nt, Mycobacterium bovis subsp bovis AF2122/97
ggcgcgcagcuugg

SEQ ID NO: 3095152 - RNA, 15 nt, Mycobacterium bovis subsp bovis AF2122/97
ggcgcgcaggaccug

SEQ ID NO: 3095153 - RNA, 18 nt, Mycobacterium bovis subsp bovis AF2122/97
ggcgcgcagguagcgcuc

SEQ ID NO: 3095154 - RNA, 20 nt, Mycobacterium bovis subsp bovis AF2122/97
ggcgcgcagguagcgcucga

SEQ ID NO: 3095155 - RNA, 15 nt, Mycobacterium bovis subsp bovis AF2122/97
ggcgcgcaucugcuc

SEQ ID NO: 3095156 - RNA, 18 nt, Mycobacterium bovis subsp bovis AF2122/97
ggcgcgccccaccgcgcc

SEQ ID NO: 3095157 - RNA, 18 nt, Mycobacterium bovis subsp bovis AF2122/97
ggcgcgccgaguugcccg

SEQ ID NO: 3095158 - RNA, 18 nt, Mycobacterium bovis subsp bovis AF2122/97
ggcgcgccgaucggcacc

SEQ ID NO: 3095159 - RNA, 21 nt, Mycobacterium bovis subsp bovis AF2122/97
ggcgcgccgaucggcaccgug

SEQ ID NO: 3095160 - RNA, 21 nt, Mycobacterium bovis subsp bovis AF2122/97
ggcgcgccgaugaacguggcg

SEQ ID NO: 3095161 - RNA, 16 nt, Mycobacterium bovis subsp bovis AF2122/97
ggcgcgccgcacccgg

SEQ ID NO: 3095162 - RNA, 18 nt, Mycobacterium bovis subsp bovis AF2122/97
ggcgcgccgcaucggcga

SEQ ID NO: 3095163 - RNA, 15 nt, Mycobacterium bovis subsp bovis AF2122/97
ggcgcgccggccaug

SEQ ID NO: 3095164 - RNA, 16 nt, Mycobacterium bovis subsp bovis AF2122/97
ggcgcgccgggcggcg

SEQ ID NO: 3095165 - RNA, 14 nt, Mycobacterium bovis subsp bovis AF2122/97
ggcgcgccggucgc

SEQ ID NO: 3095166 - RNA, 19 nt, Mycobacterium bovis subsp bovis AF2122/97
ggcgcgccggucgccgacg

SEQ ID NO: 3095167 - RNA, 22 nt, Mycobacterium bovis subsp bovis AF2122/97
ggcgcgccggucgccgacggcg

SEQ ID NO: 3095168 - RNA, 23 nt, Mycobacterium bovis subsp bovis AF2122/97
ggcgcgccguacguucaccaccg

SEQ ID NO: 3095169 - RNA, 22 nt, Mycobacterium bovis subsp bovis AF2122/97
ggcgcgccguucugaucugcgc

SEQ ID NO: 3095170 - RNA, 17 nt, Mycobacterium bovis subsp bovis AF2122/97
ggcgcgccugugccacc

SEQ ID NO: 3095171 - RNA, 13 nt, Mycobacterium bovis subsp bovis AF2122/97
ggcgcgcgcccgg

SEQ ID NO: 3095172 - RNA, 13 nt, Mycobacterium bovis subsp bovis AF2122/97
ggcgcgcgcgccg

SEQ ID NO: 3095173 - RNA, 15 nt, Mycobacterium bovis subsp bovis AF2122/97
ggcgcgcggggccuc

SEQ ID NO: 3095174 - RNA, 21 nt, Mycobacterium bovis subsp bovis AF2122/97
ggcgcgcggguugucggcgac

SEQ ID NO: 3095175 - RNA, 22 nt, Mycobacterium bovis subsp bovis AF2122/97
ggcgcgcggguugucggcgacc

SEQ ID NO: 3095176 - RNA, 18 nt, Mycobacterium bovis subsp bovis AF2122/97
ggcgcgcucaacggcgaa

SEQ ID NO: 3095177 - RNA, 14 nt, Mycobacterium bovis subsp bovis AF2122/97
ggcgcgcucaucga

SEQ ID NO: 3095178 - RNA, 18 nt, Mycobacterium bovis subsp bovis AF2122/97
ggcgcgcucaucgaccgc

SEQ ID NO: 3095179 - RNA, 19 nt, Mycobacterium bovis subsp bovis AF2122/97
ggcgcgcucaucgaccggg

SEQ ID NO: 3095180 - RNA, 17 nt, Mycobacterium bovis subsp bovis AF2122/97
ggcgcgcuggcgggcgg

SEQ ID NO: 3095181 - RNA, 18 nt, Mycobacterium bovis subsp bovis AF2122/97
ggcgcggagagccugcuc

SEQ ID NO: 3095182 - RNA, 19 nt, Mycobacterium bovis subsp bovis AF2122/97
ggcgcggagagccugcucg

SEQ ID NO: 3095183 - RNA, 15 nt, Mycobacterium bovis subsp bovis AF2122/97
ggcgcggagugccca

SEQ ID NO: 3095184 - RNA, 21 nt, Mycobacterium bovis subsp bovis AF2122/97
ggcgcggauacgggcagugaa

SEQ ID NO: 3095185 - RNA, 14 nt, Mycobacterium bovis subsp bovis AF2122/97
ggcgcggcacccgg

SEQ ID NO: 3095186 - RNA, 19 nt, Mycobacterium bovis subsp bovis AF2122/97
ggcgcggcacccggucggc

SEQ ID NO: 3095187 - RNA, 21 nt, Mycobacterium bovis subsp bovis AF2122/97
ggcgcggcacccggucggcca

SEQ ID NO: 3095188 - RNA, 16 nt, Mycobacterium bovis subsp bovis AF2122/97
ggcgcggcaggccugg

SEQ ID NO: 3095189 - RNA, 18 nt, Mycobacterium bovis subsp bovis AF2122/97
ggcgcggccgcagccagc

SEQ ID NO: 3095190 - RNA, 14 nt, Mycobacterium bovis subsp bovis AF2122/97
ggcgcggccggccg

SEQ ID NO: 3095191 - RNA, 16 nt, Mycobacterium bovis subsp bovis AF2122/97
ggcgcggccggccgcu

SEQ ID NO: 3095192 - RNA, 15 nt, Mycobacterium bovis subsp bovis AF2122/97
ggcgcggcgacaagc

SEQ ID NO: 3095193 - RNA, 16 nt, Mycobacterium bovis subsp bovis AF2122/97
ggcgcggcgagcacgc

SEQ ID NO: 3095194 - RNA, 22 nt, Mycobacterium bovis subsp bovis AF2122/97
ggcgcggcgagcacgcgggcac

SEQ ID NO: 3095195 - RNA, 11 nt, Mycobacterium bovis subsp bovis AF2122/97
ggcgcggcgga

SEQ ID NO: 3095196 - RNA, 12 nt, Mycobacterium bovis subsp bovis AF2122/97
ggcgcggcggcg

SEQ ID NO: 3095197 - RNA, 13 nt, Mycobacterium bovis subsp bovis AF2122/97
ggcgcggcggcgu

SEQ ID NO: 3095198 - RNA, 14 nt, Mycobacterium bovis subsp bovis AF2122/97
ggcgcggcggcguc

SEQ ID NO: 3095199 - RNA, 16 nt, Mycobacterium bovis subsp bovis AF2122/97
ggcgcggcggcgucga

SEQ ID NO: 3095200 - RNA, 22 nt, Mycobacterium bovis subsp bovis AF2122/97
ggcgcggcggcgucgagggagc

SEQ ID NO: 3095201 - RNA, 16 nt, Mycobacterium bovis subsp bovis AF2122/97
ggcgcgggccggcgac

SEQ ID NO: 3095202 - RNA, 18 nt, Mycobacterium bovis subsp bovis AF2122/97
ggcgcgggccggcgacug

SEQ ID NO: 3095203 - RNA, 14 nt, Mycobacterium bovis subsp bovis AF2122/97
ggcgcgggcgccgg

SEQ ID NO: 3095204 - RNA, 16 nt, Mycobacterium bovis subsp bovis AF2122/97
ggcgcggggccgccgc

SEQ ID NO: 3095205 - RNA, 24 nt, Mycobacterium bovis subsp bovis AF2122/97
ggcgcggggccgccgcggccggcg

SEQ ID NO: 3095206 - RNA, 14 nt, Mycobacterium bovis subsp bovis AF2122/97
ggcgcggggcggcc

SEQ ID NO: 3095207 - RNA, 16 nt, Mycobacterium bovis subsp bovis AF2122/97
ggcgcggggcggccug

SEQ ID NO: 3095208 - RNA, 23 nt, Mycobacterium bovis subsp bovis AF2122/97
ggcgcggguccagccaccgaccc

SEQ ID NO: 3095209 - RNA, 22 nt, Mycobacterium bovis subsp bovis AF2122/97
ggcgcgggucggcgaccgcgcu

SEQ ID NO: 3095210 - RNA, 17 nt, Mycobacterium bovis subsp bovis AF2122/97
ggcgcgggugaccaggc

SEQ ID NO: 3095211 - RNA, 21 nt, Mycobacterium bovis subsp bovis AF2122/97
ggcgcgggugaccaggcggcg

SEQ ID NO: 3095212 - RNA, 24 nt, Mycobacterium bovis subsp bovis AF2122/97
ggcgcgggugaccaggcggcgcgg

SEQ ID NO: 3095213 - RNA, 16 nt, Mycobacterium bovis subsp bovis AF2122/97
ggcgcgggugcgccgg

SEQ ID NO: 3095214 - RNA, 18 nt, Mycobacterium bovis subsp bovis AF2122/97
ggcgcgggugcgccggcg

SEQ ID NO: 3095215 - RNA, 17 nt, Mycobacterium bovis subsp bovis AF2122/97
ggcgcgguaaccacgcg

SEQ ID NO: 3095216 - RNA, 13 nt, Mycobacterium bovis subsp bovis AF2122/97
ggcgcggucaccg

SEQ ID NO: 3095217 - RNA, 13 nt, Mycobacterium bovis subsp bovis AF2122/97
ggcgcggugccgg

SEQ ID NO: 3095218 - RNA, 14 nt, Mycobacterium bovis subsp bovis AF2122/97
ggcgcggugcgcgc

SEQ ID NO: 3095219 - RNA, 17 nt, Mycobacterium bovis subsp bovis AF2122/97
ggcgcgguuucggcguc

SEQ ID NO: 3095220 - RNA, 22 nt, Mycobacterium bovis subsp bovis AF2122/97
ggcgcguaggcccaacgacggc

SEQ ID NO: 3095221 - RNA, 21 nt, Mycobacterium bovis subsp bovis AF2122/97
ggcgcguaguaaugcucgacg

SEQ ID NO: 3095222 - RNA, 22 nt, Mycobacterium bovis subsp bovis AF2122/97
ggcgcguaguaaugcucgacgu

SEQ ID NO: 3095223 - RNA, 22 nt, Mycobacterium bovis subsp bovis AF2122/97
ggcgcguagugccacgaggacc

SEQ ID NO: 3095224 - RNA, 16 nt, Mycobacterium bovis subsp bovis AF2122/97
ggcgcguaucgcgucu

SEQ ID NO: 3095225 - RNA, 14 nt, Mycobacterium bovis subsp bovis AF2122/97
ggcgcgucauggcg

SEQ ID NO: 3095226 - RNA, 18 nt, Mycobacterium bovis subsp bovis AF2122/97
ggcgcgucauggcgagua

SEQ ID NO: 3095227 - RNA, 18 nt, Mycobacterium bovis subsp bovis AF2122/97
ggcgcguccgggcucgcg

SEQ ID NO: 3095228 - RNA, 20 nt, Mycobacterium bovis subsp bovis AF2122/97
ggcgcguccgggcucgcgcu

SEQ ID NO: 3095229 - RNA, 23 nt, Mycobacterium bovis subsp bovis AF2122/97
ggcgcguccgggcucgcgcucga

SEQ ID NO: 3095230 - RNA, 15 nt, Mycobacterium bovis subsp bovis AF2122/97
ggcgcguccucgccg

SEQ ID NO: 3095231 - RNA, 23 nt, Mycobacterium bovis subsp bovis AF2122/97
ggcgcguccucgccgcacgccgg

SEQ ID NO: 3095232 - RNA, 21 nt, Mycobacterium bovis subsp bovis AF2122/97
ggcgcgucgcggaaguagcgc

SEQ ID NO: 3095233 - RNA, 17 nt, Mycobacterium bovis subsp bovis AF2122/97
ggcgcgucggcguuggg

SEQ ID NO: 3095234 - RNA, 18 nt, Mycobacterium bovis subsp bovis AF2122/97
ggcgcguggaaaccggug

SEQ ID NO: 3095235 - RNA, 19 nt, Mycobacterium bovis subsp bovis AF2122/97
ggcgcguggaaaccggugg

SEQ ID NO: 3095236 - RNA, 17 nt, Mycobacterium bovis subsp bovis AF2122/97
ggcgcguggucgggaac

SEQ ID NO: 3095237 - RNA, 20 nt, Mycobacterium bovis subsp bovis AF2122/97
ggcgcuaaaacgccagucga

SEQ ID NO: 3095238 - RNA, 23 nt, Mycobacterium bovis subsp bovis AF2122/97
ggcgcuaccagccauagugcggc

SEQ ID NO: 3095239 - RNA, 16 nt, Mycobacterium bovis subsp bovis AF2122/97
ggcgcuaggaacgcca

SEQ ID NO: 3095240 - RNA, 21 nt, Mycobacterium bovis subsp bovis AF2122/97
ggcgcucaaugcggucaacga

SEQ ID NO: 3095241 - RNA, 22 nt, Mycobacterium bovis subsp bovis AF2122/97
ggcgcucaaugcggucaacgac

SEQ ID NO: 3095242 - RNA, 13 nt, Mycobacterium bovis subsp bovis AF2122/97
ggcgcucagcgcg

SEQ ID NO: 3095243 - RNA, 14 nt, Mycobacterium bovis subsp bovis AF2122/97
ggcgcucagcgcgg

SEQ ID NO: 3095244 - RNA, 15 nt, Mycobacterium bovis subsp bovis AF2122/97
ggcgcucagcgcggc

SEQ ID NO: 3095245 - RNA, 19 nt, Mycobacterium bovis subsp bovis AF2122/97
ggcgcucauaggccggcgg

SEQ ID NO: 3095246 - RNA, 20 nt, Mycobacterium bovis subsp bovis AF2122/97
ggcgcucauaggccggcggu

SEQ ID NO: 3095247 - RNA, 17 nt, Mycobacterium bovis subsp bovis AF2122/97
ggcgcucaucacccagc

SEQ ID NO: 3095248 - RNA, 16 nt, Mycobacterium bovis subsp bovis AF2122/97
ggcgcuccacugacca

SEQ ID NO: 3095249 - RNA, 15 nt, Mycobacterium bovis subsp bovis AF2122/97
ggcgcucccggagca

SEQ ID NO: 3095250 - RNA, 13 nt, Mycobacterium bovis subsp bovis AF2122/97
ggcgcuccggcgu

SEQ ID NO: 3095251 - RNA, 21 nt, Mycobacterium bovis subsp bovis AF2122/97
ggcgcuccuucagggcgucga

SEQ ID NO: 3095252 - RNA, 21 nt, Mycobacterium bovis subsp bovis AF2122/97
ggcgcucgcgcgcugggcgcg

SEQ ID NO: 3095253 - RNA, 18 nt, Mycobacterium bovis subsp bovis AF2122/97
ggcgcucggccauagcgc

SEQ ID NO: 3095254 - RNA, 20 nt, Mycobacterium bovis subsp bovis AF2122/97
ggcgcucgucgcggcccgcg

SEQ ID NO: 3095255 - RNA, 23 nt, Mycobacterium bovis subsp bovis AF2122/97
ggcgcucucguguaucgagcggc

SEQ ID NO: 3095256 - RNA, 16 nt, Mycobacterium bovis subsp bovis AF2122/97
ggcgcugaacgcgagc

SEQ ID NO: 3095257 - RNA, 19 nt, Mycobacterium bovis subsp bovis AF2122/97
ggcgcugaacuagggucgg

SEQ ID NO: 3095258 - RNA, 15 nt, Mycobacterium bovis subsp bovis AF2122/97
ggcgcugaagccgac

SEQ ID NO: 3095259 - RNA, 17 nt, Mycobacterium bovis subsp bovis AF2122/97
ggcgcugaagccgacga

SEQ ID NO: 3095260 - RNA, 22 nt, Mycobacterium bovis subsp bovis AF2122/97
ggcgcugaagccgacgauccac

SEQ ID NO: 3095261 - RNA, 12 nt, Mycobacterium bovis subsp bovis AF2122/97
ggcgcugaucgc

SEQ ID NO: 3095262 - RNA, 14 nt, Mycobacterium bovis subsp bovis AF2122/97
ggcgcugaucgcgc

SEQ ID NO: 3095263 - RNA, 16 nt, Mycobacterium bovis subsp bovis AF2122/97
ggcgcugaucgcgcgc

SEQ ID NO: 3095264 - RNA, 21 nt, Mycobacterium bovis subsp bovis AF2122/97
ggcgcugaucgcgcgcaccgg

SEQ ID NO: 3095265 - RNA, 14 nt, Mycobacterium bovis subsp bovis AF2122/97
ggcgcugaucggca

SEQ ID NO: 3095266 - RNA, 16 nt, Mycobacterium bovis subsp bovis AF2122/97
ggcgcugaugcgcugg

SEQ ID NO: 3095267 - RNA, 17 nt, Mycobacterium bovis subsp bovis AF2122/97
ggcgcugaugcgcuggg

SEQ ID NO: 3095268 - RNA, 15 nt, Mycobacterium bovis subsp bovis AF2122/97
ggcgcugaugcuggc

SEQ ID NO: 3095269 - RNA, 18 nt, Mycobacterium bovis subsp bovis AF2122/97
ggcgcugaugcuggccau

SEQ ID NO: 3095270 - RNA, 21 nt, Mycobacterium bovis subsp bovis AF2122/97
ggcgcugauggugcugcggcg

SEQ ID NO: 3095271 - RNA, 12 nt, Mycobacterium bovis subsp bovis AF2122/97
ggcgcugcagca

SEQ ID NO: 3095272 - RNA, 16 nt, Mycobacterium bovis subsp bovis AF2122/97
ggcgcugcagcauggc

SEQ ID NO: 3095273 - RNA, 14 nt, Mycobacterium bovis subsp bovis AF2122/97
ggcgcugcagcugc

SEQ ID NO: 3095274 - RNA, 14 nt, Mycobacterium bovis subsp bovis AF2122/97
ggcgcugcccgccg

SEQ ID NO: 3095275 - RNA, 19 nt, Mycobacterium bovis subsp bovis AF2122/97
ggcgcugcccgggcugccg

SEQ ID NO: 3095276 - RNA, 15 nt, Mycobacterium bovis subsp bovis AF2122/97
ggcgcugccgggauc

SEQ ID NO: 3095277 - RNA, 21 nt, Mycobacterium bovis subsp bovis AF2122/97
ggcgcugcgcaccgccgcgcg

SEQ ID NO: 3095278 - RNA, 15 nt, Mycobacterium bovis subsp bovis AF2122/97
ggcgcugcggcgugc

SEQ ID NO: 3095279 - RNA, 17 nt, Mycobacterium bovis subsp bovis AF2122/97
ggcgcugcggcgugccg

SEQ ID NO: 3095280 - RNA, 20 nt, Mycobacterium bovis subsp bovis AF2122/97
ggcgcugcggcgugccgggu

SEQ ID NO: 3095281 - RNA, 21 nt, Mycobacterium bovis subsp bovis AF2122/97
ggcgcugcucugagcuugguc

SEQ ID NO: 3095282 - RNA, 12 nt, Mycobacterium bovis subsp bovis AF2122/97
ggcgcugcuggc

SEQ ID NO: 3095283 - RNA, 16 nt, Mycobacterium bovis subsp bovis AF2122/97
ggcgcuggacggcggg

SEQ ID NO: 3095284 - RNA, 18 nt, Mycobacterium bovis subsp bovis AF2122/97
ggcgcuggacggcgggcc

SEQ ID NO: 3095285 - RNA, 21 nt, Mycobacterium bovis subsp bovis AF2122/97
ggcgcuggacggcgggccgcg

SEQ ID NO: 3095286 - RNA, 14 nt, Mycobacterium bovis subsp bovis AF2122/97
ggcgcuggccagca

SEQ ID NO: 3095287 - RNA, 12 nt, Mycobacterium bovis subsp bovis AF2122/97
ggcgcuggcccg

SEQ ID NO: 3095288 - RNA, 14 nt, Mycobacterium bovis subsp bovis AF2122/97
ggcgcuggccgucg

SEQ ID NO: 3095289 - RNA, 21 nt, Mycobacterium bovis subsp bovis AF2122/97
ggcgcuggccgucgaagacga

SEQ ID NO: 3095290 - RNA, 17 nt, Mycobacterium bovis subsp bovis AF2122/97
ggcgcuggcgggcgauc

SEQ ID NO: 3095291 - RNA, 17 nt, Mycobacterium bovis subsp bovis AF2122/97
ggcgcugggguccgcgu

SEQ ID NO: 3095292 - RNA, 18 nt, Mycobacterium bovis subsp bovis AF2122/97
ggcgcuggugcgccacgc

SEQ ID NO: 3095293 - RNA, 23 nt, Mycobacterium bovis subsp bovis AF2122/97
ggcgcuggugcgccacgccaccg

SEQ ID NO: 3095294 - RNA, 16 nt, Mycobacterium bovis subsp bovis AF2122/97
ggcgcugguuggcacg

SEQ ID NO: 3095295 - RNA, 21 nt, Mycobacterium bovis subsp bovis AF2122/97
ggcgcuucugcuacccgagcc

SEQ ID NO: 3095296 - RNA, 22 nt, Mycobacterium bovis subsp bovis AF2122/97
ggcgcuucugcuacccgagccg

SEQ ID NO: 3095297 - RNA, 21 nt, Mycobacterium bovis subsp bovis AF2122/97
ggcgcuuggccggauccucga

SEQ ID NO: 3095298 - RNA, 17 nt, Mycobacterium bovis subsp bovis AF2122/97
ggcgcuuugggcugccg

SEQ ID NO: 3095299 - RNA, 16 nt, Mycobacterium bovis subsp bovis AF2122/97
ggcggaaaaucggcug

SEQ ID NO: 3095300 - RNA, 20 nt, Mycobacterium bovis subsp bovis AF2122/97
ggcggaaacaaccccgcggu

SEQ ID NO: 3095301 - RNA, 21 nt, Mycobacterium bovis subsp bovis AF2122/97
ggcggaaauggcgucgccggc

SEQ ID NO: 3095302 - RNA, 23 nt, Mycobacterium bovis subsp bovis AF2122/97
ggcggaacaagguauggccggag

SEQ ID NO: 3095303 - RNA, 19 nt, Mycobacterium bovis subsp bovis AF2122/97
ggcggaacaccgacgacac

SEQ ID NO: 3095304 - RNA, 18 nt, Mycobacterium bovis subsp bovis AF2122/97
ggcggaaccugucaacau

SEQ ID NO: 3095305 - RNA, 19 nt, Mycobacterium bovis subsp bovis AF2122/97
ggcggaacuguaggucaca

SEQ ID NO: 3095306 - RNA, 18 nt, Mycobacterium bovis subsp bovis AF2122/97
ggcggaacuugccggugc

SEQ ID NO: 3095307 - RNA, 18 nt, Mycobacterium bovis subsp bovis AF2122/97
ggcggaagaccggaucgc

SEQ ID NO: 3095308 - RNA, 17 nt, Mycobacterium bovis subsp bovis AF2122/97
ggcggaagcggcggccc

SEQ ID NO: 3095309 - RNA, 17 nt, Mycobacterium bovis subsp bovis AF2122/97
ggcggaaggacggcagc

SEQ ID NO: 3095310 - RNA, 18 nt, Mycobacterium bovis subsp bovis AF2122/97
ggcggaaggacggcagcc

SEQ ID NO: 3095311 - RNA, 14 nt, Mycobacterium bovis subsp bovis AF2122/97
ggcggacaccucgg

SEQ ID NO: 3095312 - RNA, 15 nt, Mycobacterium bovis subsp bovis AF2122/97
ggcggacaccucggg

SEQ ID NO: 3095313 - RNA, 16 nt, Mycobacterium bovis subsp bovis AF2122/97
ggcggacaccucgggc

SEQ ID NO: 3095314 - RNA, 15 nt, Mycobacterium bovis subsp bovis AF2122/97
ggcggacagggcggc

SEQ ID NO: 3095315 - RNA, 22 nt, Mycobacterium bovis subsp bovis AF2122/97
ggcggaccaggccgcgcgcacc

SEQ ID NO: 3095316 - RNA, 16 nt, Mycobacterium bovis subsp bovis AF2122/97
ggcggacccgcucgcg

SEQ ID NO: 3095317 - RNA, 20 nt, Mycobacterium bovis subsp bovis AF2122/97
ggcggacccgcucgcggcga

SEQ ID NO: 3095318 - RNA, 16 nt, Mycobacterium bovis subsp bovis AF2122/97
ggcggacccggugacc

SEQ ID NO: 3095319 - RNA, 20 nt, Mycobacterium bovis subsp bovis AF2122/97
ggcggacccggugacccgcu

SEQ ID NO: 3095320 - RNA, 15 nt, Mycobacterium bovis subsp bovis AF2122/97
ggcggacccucgccg

SEQ ID NO: 3095321 - RNA, 16 nt, Mycobacterium bovis subsp bovis AF2122/97
ggcggacccucgccga

SEQ ID NO: 3095322 - RNA, 14 nt, Mycobacterium bovis subsp bovis AF2122/97
ggcggaccgcagcg

SEQ ID NO: 3095323 - RNA, 19 nt, Mycobacterium bovis subsp bovis AF2122/97
ggcggaccgguaggcaccg

SEQ ID NO: 3095324 - RNA, 20 nt, Mycobacterium bovis subsp bovis AF2122/97
ggcggacgccgcgccggcgg

SEQ ID NO: 3095325 - RNA, 16 nt, Mycobacterium bovis subsp bovis AF2122/97
ggcggacggcgucgag

SEQ ID NO: 3095326 - RNA, 23 nt, Mycobacterium bovis subsp bovis AF2122/97
ggcggacgugaccagaucgacgc

SEQ ID NO: 3095327 - RNA, 13 nt, Mycobacterium bovis subsp bovis AF2122/97
ggcggacucacga

SEQ ID NO: 3095328 - RNA, 17 nt, Mycobacterium bovis subsp bovis AF2122/97
ggcggacugagagaugg

SEQ ID NO: 3095329 - RNA, 19 nt, Mycobacterium bovis subsp bovis AF2122/97
ggcggagaaaagcgcgcua

SEQ ID NO: 3095330 - RNA, 15 nt, Mycobacterium bovis subsp bovis AF2122/97
ggcggagccggguga

SEQ ID NO: 3095331 - RNA, 20 nt, Mycobacterium bovis subsp bovis AF2122/97
ggcggagcgggccagcaccc

SEQ ID NO: 3095332 - RNA, 22 nt, Mycobacterium bovis subsp bovis AF2122/97
ggcggagcgggccagcacccgc

SEQ ID NO: 3095333 - RNA, 13 nt, Mycobacterium bovis subsp bovis AF2122/97
ggcggaggcuggg

SEQ ID NO: 3095334 - RNA, 20 nt, Mycobacterium bovis subsp bovis AF2122/97
ggcggagucgcgcagggcga

SEQ ID NO: 3095335 - RNA, 22 nt, Mycobacterium bovis subsp bovis AF2122/97
ggcggauacaugguccggccgc

SEQ ID NO: 3095336 - RNA, 16 nt, Mycobacterium bovis subsp bovis AF2122/97
ggcggauagucgcggg

SEQ ID NO: 3095337 - RNA, 17 nt, Mycobacterium bovis subsp bovis AF2122/97
ggcggauaugaugaucg

SEQ ID NO: 3095338 - RNA, 20 nt, Mycobacterium bovis subsp bovis AF2122/97
ggcggauaugaugaucgguu

SEQ ID NO: 3095339 - RNA, 13 nt, Mycobacterium bovis subsp bovis AF2122/97
ggcggaucccgag

SEQ ID NO: 3095340 - RNA, 17 nt, Mycobacterium bovis subsp bovis AF2122/97
ggcggaucccgaggcgc

SEQ ID NO: 3095341 - RNA, 18 nt, Mycobacterium bovis subsp bovis AF2122/97
ggcggaucgccggggacg

SEQ ID NO: 3095342 - RNA, 13 nt, Mycobacterium bovis subsp bovis AF2122/97
ggcggaucgcgag

SEQ ID NO: 3095343 - RNA, 20 nt, Mycobacterium bovis subsp bovis AF2122/97
ggcggaucgcgagcgccgcu

SEQ ID NO: 3095344 - RNA, 15 nt, Mycobacterium bovis subsp bovis AF2122/97
ggcggaucggcggcc

SEQ ID NO: 3095345 - RNA, 24 nt, Mycobacterium bovis subsp bovis AF2122/97
ggcggaucggcggccggcacgggc

SEQ ID NO: 3095346 - RNA, 19 nt, Mycobacterium bovis subsp bovis AF2122/97
ggcggaucugaucggcgcg

SEQ ID NO: 3095347 - RNA, 12 nt, Mycobacterium bovis subsp bovis AF2122/97
ggcggauggcgu

SEQ ID NO: 3095348 - RNA, 14 nt, Mycobacterium bovis subsp bovis AF2122/97
ggcggauucggcgc

SEQ ID NO: 3095349 - RNA, 19 nt, Mycobacterium bovis subsp bovis AF2122/97
ggcggauucggcgcugcgg

SEQ ID NO: 3095350 - RNA, 18 nt, Mycobacterium bovis subsp bovis AF2122/97
ggcggcaaacacugcggc

SEQ ID NO: 3095351 - RNA, 19 nt, Mycobacterium bovis subsp bovis AF2122/97
ggcggcaaccccgagcgga

SEQ ID NO: 3095352 - RNA, 15 nt, Mycobacterium bovis subsp bovis AF2122/97
ggcggcaaccgccgc

SEQ ID NO: 3095353 - RNA, 20 nt, Mycobacterium bovis subsp bovis AF2122/97
ggcggcaaccgccgccacca

SEQ ID NO: 3095354 - RNA, 23 nt, Mycobacterium bovis subsp bovis AF2122/97
ggcggcaacgccgggcuguucgg

SEQ ID NO: 3095355 - RNA, 13 nt, Mycobacterium bovis subsp bovis AF2122/97
ggcggcaacggcg

SEQ ID NO: 3095356 - RNA, 15 nt, Mycobacterium bovis subsp bovis AF2122/97
ggcggcaacggcgga

SEQ ID NO: 3095357 - RNA, 16 nt, Mycobacterium bovis subsp bovis AF2122/97
ggcggcaacggcggca

SEQ ID NO: 3095358 - RNA, 17 nt, Mycobacterium bovis subsp bovis AF2122/97
ggcggcaacggcggcau

SEQ ID NO: 3095359 - RNA, 16 nt, Mycobacterium bovis subsp bovis AF2122/97
ggcggcaacggcggcg

SEQ ID NO: 3095360 - RNA, 17 nt, Mycobacterium bovis subsp bovis AF2122/97
ggcggcaacggcggcga

SEQ ID NO: 3095361 - RNA, 15 nt, Mycobacterium bovis subsp bovis AF2122/97
ggcggcaacggcggu

SEQ ID NO: 3095362 - RNA, 16 nt, Mycobacterium bovis subsp bovis AF2122/97
ggcggcaacgggggcg

SEQ ID NO: 3095363 - RNA, 15 nt, Mycobacterium bovis subsp bovis AF2122/97
ggcggcaagggcggc

SEQ ID NO: 3095364 - RNA, 17 nt, Mycobacterium bovis subsp bovis AF2122/97
ggcggcaagggcggcaa

SEQ ID NO: 3095365 - RNA, 20 nt, Mycobacterium bovis subsp bovis AF2122/97
ggcggcaaggguggggccgg

SEQ ID NO: 3095366 - RNA, 17 nt, Mycobacterium bovis subsp bovis AF2122/97
ggcggcacccggguggc

SEQ ID NO: 3095367 - RNA, 13 nt, Mycobacterium bovis subsp bovis AF2122/97
ggcggcacgcuga

SEQ ID NO: 3095368 - RNA, 16 nt, Mycobacterium bovis subsp bovis AF2122/97
ggcggcacuacgcagc

SEQ ID NO: 3095369 - RNA, 18 nt, Mycobacterium bovis subsp bovis AF2122/97
ggcggcacuacgcagccg

SEQ ID NO: 3095370 - RNA, 16 nt, Mycobacterium bovis subsp bovis AF2122/97
ggcggcagcacccaca

SEQ ID NO: 3095371 - RNA, 20 nt, Mycobacterium bovis subsp bovis AF2122/97
ggcggcagcgaggcucgcag

SEQ ID NO: 3095372 - RNA, 22 nt, Mycobacterium bovis subsp bovis AF2122/97
ggcggcagcgagucgacgucga

SEQ ID NO: 3095373 - RNA, 12 nt, Mycobacterium bovis subsp bovis AF2122/97
ggcggcagcggc

SEQ ID NO: 3095374 - RNA, 13 nt, Mycobacterium bovis subsp bovis AF2122/97
ggcggcagcggcg

SEQ ID NO: 3095375 - RNA, 16 nt, Mycobacterium bovis subsp bovis AF2122/97
ggcggcagcggcgauc

SEQ ID NO: 3095376 - RNA, 15 nt, Mycobacterium bovis subsp bovis AF2122/97
ggcggcagcggcggu

SEQ ID NO: 3095377 - RNA, 14 nt, Mycobacterium bovis subsp bovis AF2122/97
ggcggcagcugcug

SEQ ID NO: 3095378 - RNA, 12 nt, Mycobacterium bovis subsp bovis AF2122/97
ggcggcaggccg

SEQ ID NO: 3095379 - RNA, 22 nt, Mycobacterium bovis subsp bovis AF2122/97
ggcggcagguagaucagcaugc

SEQ ID NO: 3095380 - RNA, 21 nt, Mycobacterium bovis subsp bovis AF2122/97
ggcggcaggugcggcggcauc

SEQ ID NO: 3095381 - RNA, 18 nt, Mycobacterium bovis subsp bovis AF2122/97
ggcggcagucgcgguacc

SEQ ID NO: 3095382 - RNA, 20 nt, Mycobacterium bovis subsp bovis AF2122/97
ggcggcauacauccaggcug

SEQ ID NO: 3095383 - RNA, 18 nt, Mycobacterium bovis subsp bovis AF2122/97
ggcggcauagcucagacc

SEQ ID NO: 3095384 - RNA, 22 nt, Mycobacterium bovis subsp bovis AF2122/97
ggcggcauagcucagaccggcg

SEQ ID NO: 3095385 - RNA, 14 nt, Mycobacterium bovis subsp bovis AF2122/97
ggcggcaucaccug

SEQ ID NO: 3095386 - RNA, 12 nt, Mycobacterium bovis subsp bovis AF2122/97
ggcggcaucccc

SEQ ID NO: 3095387 - RNA, 16 nt, Mycobacterium bovis subsp bovis AF2122/97
ggcggcauccugcacg

SEQ ID NO: 3095388 - RNA, 21 nt, Mycobacterium bovis subsp bovis AF2122/97
ggcggcaucgaguucggcccg

SEQ ID NO: 3095389 - RNA, 13 nt, Mycobacterium bovis subsp bovis AF2122/97
ggcggcaucgccg

SEQ ID NO: 3095390 - RNA, 14 nt, Mycobacterium bovis subsp bovis AF2122/97
ggcggcaucgccga

SEQ ID NO: 3095391 - RNA, 15 nt, Mycobacterium bovis subsp bovis AF2122/97
ggcggcaucgccgag

SEQ ID NO: 3095392 - RNA, 19 nt, Mycobacterium bovis subsp bovis AF2122/97
ggcggcaucgggguuggug

SEQ ID NO: 3095393 - RNA, 22 nt, Mycobacterium bovis subsp bovis AF2122/97
ggcggcaucgggguuggugaac

SEQ ID NO: 3095394 - RNA, 20 nt, Mycobacterium bovis subsp bovis AF2122/97
ggcggcaucggugguaacac

SEQ ID NO: 3095395 - RNA, 23 nt, Mycobacterium bovis subsp bovis AF2122/97
ggcggcaugaagcaguuggccga

SEQ ID NO: 3095396 - RNA, 16 nt, Mycobacterium bovis subsp bovis AF2122/97
ggcggcauguucaucg

SEQ ID NO: 3095397 - RNA, 21 nt, Mycobacterium bovis subsp bovis AF2122/97
ggcggcauuggcggugccggu

SEQ ID NO: 3095398 - RNA, 12 nt, Mycobacterium bovis subsp bovis AF2122/97
ggcggccaccag

SEQ ID NO: 3095399 - RNA, 14 nt, Mycobacterium bovis subsp bovis AF2122/97
ggcggccaccaugu

SEQ ID NO: 3095400 - RNA, 13 nt, Mycobacterium bovis subsp bovis AF2122/97
ggcggccaccguc

SEQ ID NO: 3095401 - RNA, 18 nt, Mycobacterium bovis subsp bovis AF2122/97
ggcggccaccgucagcgc

SEQ ID NO: 3095402 - RNA, 20 nt, Mycobacterium bovis subsp bovis AF2122/97
ggcggccaccgucagcgcga

SEQ ID NO: 3095403 - RNA, 22 nt, Mycobacterium bovis subsp bovis AF2122/97
ggcggccaccgucagcgcgacc

SEQ ID NO: 3095404 - RNA, 19 nt, Mycobacterium bovis subsp bovis AF2122/97
ggcggccaccugcuggccg

SEQ ID NO: 3095405 - RNA, 15 nt, Mycobacterium bovis subsp bovis AF2122/97
ggcggccacgccggc

SEQ ID NO: 3095406 - RNA, 16 nt, Mycobacterium bovis subsp bovis AF2122/97
ggcggccacguggucg

SEQ ID NO: 3095407 - RNA, 19 nt, Mycobacterium bovis subsp bovis AF2122/97
ggcggccacguggucggcg

SEQ ID NO: 3095408 - RNA, 10 nt, Mycobacterium bovis subsp bovis AF2122/97
ggcggccagc

SEQ ID NO: 3095409 - RNA, 11 nt, Mycobacterium bovis subsp bovis AF2122/97
ggcggccagca

SEQ ID NO: 3095410 - RNA, 20 nt, Mycobacterium bovis subsp bovis AF2122/97
ggcggccagcaucgcggugg

SEQ ID NO: 3095411 - RNA, 21 nt, Mycobacterium bovis subsp bovis AF2122/97
ggcggccagcaucgcgguggu

SEQ ID NO: 3095412 - RNA, 15 nt, Mycobacterium bovis subsp bovis AF2122/97
ggcggccagcaucgg

SEQ ID NO: 3095413 - RNA, 21 nt, Mycobacterium bovis subsp bovis AF2122/97
ggcggccagcaucggguggcg

SEQ ID NO: 3095414 - RNA, 18 nt, Mycobacterium bovis subsp bovis AF2122/97
ggcggccagccuaccggc

SEQ ID NO: 3095415 - RNA, 15 nt, Mycobacterium bovis subsp bovis AF2122/97
ggcggccagcgcacc

SEQ ID NO: 3095416 - RNA, 13 nt, Mycobacterium bovis subsp bovis AF2122/97
ggcggccagcucg

SEQ ID NO: 3095417 - RNA, 22 nt, Mycobacterium bovis subsp bovis AF2122/97
ggcggccagggugcccucggcc

SEQ ID NO: 3095418 - RNA, 14 nt, Mycobacterium bovis subsp bovis AF2122/97
ggcggccaguucgg

SEQ ID NO: 3095419 - RNA, 16 nt, Mycobacterium bovis subsp bovis AF2122/97
ggcggccaguucggcg

SEQ ID NO: 3095420 - RNA, 23 nt, Mycobacterium bovis subsp bovis AF2122/97
ggcggccaucgacgacacguuga

SEQ ID NO: 3095421 - RNA, 20 nt, Mycobacterium bovis subsp bovis AF2122/97
ggcggccaugucagcggccu

SEQ ID NO: 3095422 - RNA, 23 nt, Mycobacterium bovis subsp bovis AF2122/97
ggcggccaugucagcggccugcu

SEQ ID NO: 3095423 - RNA, 15 nt, Mycobacterium bovis subsp bovis AF2122/97
ggcggcccaccggcc

SEQ ID NO: 3095424 - RNA, 18 nt, Mycobacterium bovis subsp bovis AF2122/97
ggcggccccaggggcacc

SEQ ID NO: 3095425 - RNA, 13 nt, Mycobacterium bovis subsp bovis AF2122/97
ggcggcccccggc

SEQ ID NO: 3095426 - RNA, 16 nt, Mycobacterium bovis subsp bovis AF2122/97
ggcggcccccggcagc

SEQ ID NO: 3095427 - RNA, 17 nt, Mycobacterium bovis subsp bovis AF2122/97
ggcggcccccggcagcg

SEQ ID NO: 3095428 - RNA, 20 nt, Mycobacterium bovis subsp bovis AF2122/97
ggcggcccccggcagcgugc

SEQ ID NO: 3095429 - RNA, 13 nt, Mycobacterium bovis subsp bovis AF2122/97
ggcggccccgcgc

SEQ ID NO: 3095430 - RNA, 22 nt, Mycobacterium bovis subsp bovis AF2122/97
ggcggccccggcauugcccgag

SEQ ID NO: 3095431 - RNA, 13 nt, Mycobacterium bovis subsp bovis AF2122/97
ggcggcccgaucc

SEQ ID NO: 3095432 - RNA, 14 nt, Mycobacterium bovis subsp bovis AF2122/97
ggcggcccgcagcc

SEQ ID NO: 3095433 - RNA, 12 nt, Mycobacterium bovis subsp bovis AF2122/97
ggcggcccgcuc

SEQ ID NO: 3095434 - RNA, 18 nt, Mycobacterium bovis subsp bovis AF2122/97
ggcggcccggccgaacgc

SEQ ID NO: 3095435 - RNA, 18 nt, Mycobacterium bovis subsp bovis AF2122/97
ggcggcccggguuggccg

SEQ ID NO: 3095436 - RNA, 17 nt, Mycobacterium bovis subsp bovis AF2122/97
ggcggcccggucuacgc

SEQ ID NO: 3095437 - RNA, 14 nt, Mycobacterium bovis subsp bovis AF2122/97
ggcggcccggugga

SEQ ID NO: 3095438 - RNA, 14 nt, Mycobacterium bovis subsp bovis AF2122/97
ggcggccgagcgca

SEQ ID NO: 3095439 - RNA, 15 nt, Mycobacterium bovis subsp bovis AF2122/97
ggcggccgagcgcac

SEQ ID NO: 3095440 - RNA, 17 nt, Mycobacterium bovis subsp bovis AF2122/97
ggcggccgccaguucgg

SEQ ID NO: 3095441 - RNA, 12 nt, Mycobacterium bovis subsp bovis AF2122/97
ggcggccgccgc

SEQ ID NO: 3095442 - RNA, 13 nt, Mycobacterium bovis subsp bovis AF2122/97
ggcggccgccgcg

SEQ ID NO: 3095443 - RNA, 13 nt, Mycobacterium bovis subsp bovis AF2122/97
ggcggccgccggg

SEQ ID NO: 3095444 - RNA, 13 nt, Mycobacterium bovis subsp bovis AF2122/97
ggcggccgcgacc

SEQ ID NO: 3095445 - RNA, 23 nt, Mycobacterium bovis subsp bovis AF2122/97
ggcggccgcgaccagcgccgcac

SEQ ID NO: 3095446 - RNA, 16 nt, Mycobacterium bovis subsp bovis AF2122/97
ggcggccgcgauggcg

SEQ ID NO: 3095447 - RNA, 21 nt, Mycobacterium bovis subsp bovis AF2122/97
ggcggccgcggugcccgucgg

SEQ ID NO: 3095448 - RNA, 13 nt, Mycobacterium bovis subsp bovis AF2122/97
ggcggccggcacg

SEQ ID NO: 3095449 - RNA, 19 nt, Mycobacterium bovis subsp bovis AF2122/97
ggcggccggcacgggcggg

SEQ ID NO: 3095450 - RNA, 23 nt, Mycobacterium bovis subsp bovis AF2122/97
ggcggccggcacgggcggggacg

SEQ ID NO: 3095451 - RNA, 12 nt, Mycobacterium bovis subsp bovis AF2122/97
ggcggccggcgc

SEQ ID NO: 3095452 - RNA, 17 nt, Mycobacterium bovis subsp bovis AF2122/97
ggcggccggcgccggcg

SEQ ID NO: 3095453 - RNA, 20 nt, Mycobacterium bovis subsp bovis AF2122/97
ggcggccgggucggugacga

SEQ ID NO: 3095454 - RNA, 14 nt, Mycobacterium bovis subsp bovis AF2122/97
ggcggccgucaccg

SEQ ID NO: 3095455 - RNA, 18 nt, Mycobacterium bovis subsp bovis AF2122/97
ggcggccgucaccggucg

SEQ ID NO: 3095456 - RNA, 19 nt, Mycobacterium bovis subsp bovis AF2122/97
ggcggccgucaccggucgg

SEQ ID NO: 3095457 - RNA, 12 nt, Mycobacterium bovis subsp bovis AF2122/97
ggcggccgucgu

SEQ ID NO: 3095458 - RNA, 15 nt, Mycobacterium bovis subsp bovis AF2122/97
ggcggccgucgucgg

SEQ ID NO: 3095459 - RNA, 18 nt, Mycobacterium bovis subsp bovis AF2122/97
ggcggccgucgucggcca

SEQ ID NO: 3095460 - RNA, 15 nt, Mycobacterium bovis subsp bovis AF2122/97
ggcggccgugucggg

SEQ ID NO: 3095461 - RNA, 20 nt, Mycobacterium bovis subsp bovis AF2122/97
ggcggccgugucgggcgcga

SEQ ID NO: 3095462 - RNA, 14 nt, Mycobacterium bovis subsp bovis AF2122/97
ggcggccuccccga

SEQ ID NO: 3095463 - RNA, 11 nt, Mycobacterium bovis subsp bovis AF2122/97
ggcggccuccg

SEQ ID NO: 3095464 - RNA, 15 nt, Mycobacterium bovis subsp bovis AF2122/97
ggcggccuccucccc

SEQ ID NO: 3095465 - RNA, 17 nt, Mycobacterium bovis subsp bovis AF2122/97
ggcggccucgccggcgc

SEQ ID NO: 3095466 - RNA, 18 nt, Mycobacterium bovis subsp bovis AF2122/97
ggcggccucgccggcgcg

SEQ ID NO: 3095467 - RNA, 22 nt, Mycobacterium bovis subsp bovis AF2122/97
ggcggccucgccggcgcgcagc

SEQ ID NO: 3095468 - RNA, 13 nt, Mycobacterium bovis subsp bovis AF2122/97
ggcggccucgggc

SEQ ID NO: 3095469 - RNA, 16 nt, Mycobacterium bovis subsp bovis AF2122/97
ggcggccucggggccg

SEQ ID NO: 3095470 - RNA, 19 nt, Mycobacterium bovis subsp bovis AF2122/97
ggcggccucggggccggag

SEQ ID NO: 3095471 - RNA, 13 nt, Mycobacterium bovis subsp bovis AF2122/97
ggcggccugcccg

SEQ ID NO: 3095472 - RNA, 17 nt, Mycobacterium bovis subsp bovis AF2122/97
ggcggccugggccagcc

SEQ ID NO: 3095473 - RNA, 20 nt, Mycobacterium bovis subsp bovis AF2122/97
ggcggccuggucggccaggu

SEQ ID NO: 3095474 - RNA, 23 nt, Mycobacterium bovis subsp bovis AF2122/97
ggcggccuggucggccaggucga

SEQ ID NO: 3095475 - RNA, 14 nt, Mycobacterium bovis subsp bovis AF2122/97
ggcggccuugccgg

SEQ ID NO: 3095476 - RNA, 21 nt, Mycobacterium bovis subsp bovis AF2122/97
ggcggccuugccgggccgcgc

SEQ ID NO: 3095477 - RNA, 24 nt, Mycobacterium bovis subsp bovis AF2122/97
ggcggccuugccgggccgcgcggg

SEQ ID NO: 3095478 - RNA, 21 nt, Mycobacterium bovis subsp bovis AF2122/97
ggcggccuugcgggcucucgg

SEQ ID NO: 3095479 - RNA, 17 nt, Mycobacterium bovis subsp bovis AF2122/97
ggcggcgaacucggcga

SEQ ID NO: 3095480 - RNA, 19 nt, Mycobacterium bovis subsp bovis AF2122/97
ggcggcgaacucggcgaug

SEQ ID NO: 3095481 - RNA, 22 nt, Mycobacterium bovis subsp bovis AF2122/97
ggcggcgaagaagccggcaagc

SEQ ID NO: 3095482 - RNA, 21 nt, Mycobacterium bovis subsp bovis AF2122/97
ggcggcgacacgccaggugau

SEQ ID NO: 3095483 - RNA, 20 nt, Mycobacterium bovis subsp bovis AF2122/97
ggcggcgaccagcucagcug

SEQ ID NO: 3095484 - RNA, 19 nt, Mycobacterium bovis subsp bovis AF2122/97
ggcggcgaccgccagcgug

SEQ ID NO: 3095485 - RNA, 21 nt, Mycobacterium bovis subsp bovis AF2122/97
ggcggcgaccgccagcgugga

SEQ ID NO: 3095486 - RNA, 21 nt, Mycobacterium bovis subsp bovis AF2122/97
ggcggcgaccucggcggcggc

SEQ ID NO: 3095487 - RNA, 14 nt, Mycobacterium bovis subsp bovis AF2122/97
ggcggcgacgagcg

SEQ ID NO: 3095488 - RNA, 15 nt, Mycobacterium bovis subsp bovis AF2122/97
ggcggcgacgagcgc

SEQ ID NO: 3095489 - RNA, 16 nt, Mycobacterium bovis subsp bovis AF2122/97
ggcggcgacgagcgca

SEQ ID NO: 3095490 - RNA, 15 nt, Mycobacterium bovis subsp bovis AF2122/97
ggcggcgacggccgc

SEQ ID NO: 3095491 - RNA, 16 nt, Mycobacterium bovis subsp bovis AF2122/97
ggcggcgacggccgcu

SEQ ID NO: 3095492 - RNA, 13 nt, Mycobacterium bovis subsp bovis AF2122/97
ggcggcgacggcg

SEQ ID NO: 3095493 - RNA, 20 nt, Mycobacterium bovis subsp bovis AF2122/97
ggcggcgacggcggagucgc

SEQ ID NO: 3095494 - RNA, 21 nt, Mycobacterium bovis subsp bovis AF2122/97
ggcggcgagcggccuccagca

SEQ ID NO: 3095495 - RNA, 19 nt, Mycobacterium bovis subsp bovis AF2122/97
ggcggcgaggcggucgccg

SEQ ID NO: 3095496 - RNA, 22 nt, Mycobacterium bovis subsp bovis AF2122/97
ggcggcgagguauaaacgcggc

SEQ ID NO: 3095497 - RNA, 20 nt, Mycobacterium bovis subsp bovis AF2122/97
ggcggcgauacccaucgauc

SEQ ID NO: 3095498 - RNA, 19 nt, Mycobacterium bovis subsp bovis AF2122/97
ggcggcgaucaacucgggc

SEQ ID NO: 3095499 - RNA, 20 nt, Mycobacterium bovis subsp bovis AF2122/97
ggcggcgaucaacucgggca

SEQ ID NO: 3095500 - RNA, 17 nt, Mycobacterium bovis subsp bovis AF2122/97
ggcggcgauccggucgg

SEQ ID NO: 3095501 - RNA, 19 nt, Mycobacterium bovis subsp bovis AF2122/97
ggcggcgaugguaucgccg

SEQ ID NO: 3095502 - RNA, 20 nt, Mycobacterium bovis subsp bovis AF2122/97
ggcggcgaugguaucgccgc

SEQ ID NO: 3095503 - RNA, 13 nt, Mycobacterium bovis subsp bovis AF2122/97
ggcggcgccgaag

SEQ ID NO: 3095504 - RNA, 11 nt, Mycobacterium bovis subsp bovis AF2122/97
ggcggcgccgg

SEQ ID NO: 3095505 - RNA, 19 nt, Mycobacterium bovis subsp bovis AF2122/97
ggcggcgccggaggcggcg

SEQ ID NO: 3095506 - RNA, 21 nt, Mycobacterium bovis subsp bovis AF2122/97
ggcggcgccggccucgccggg

SEQ ID NO: 3095507 - RNA, 14 nt, Mycobacterium bovis subsp bovis AF2122/97
ggcggcgccggcgc

SEQ ID NO: 3095508 - RNA, 21 nt, Mycobacterium bovis subsp bovis AF2122/97
ggcggcgcgugcgguggcgcg

SEQ ID NO: 3095509 - RNA, 14 nt, Mycobacterium bovis subsp bovis AF2122/97
ggcggcgcucggcc

SEQ ID NO: 3095510 - RNA, 14 nt, Mycobacterium bovis subsp bovis AF2122/97
ggcggcgcugcagc

SEQ ID NO: 3095511 - RNA, 18 nt, Mycobacterium bovis subsp bovis AF2122/97
ggcggcgcugcagcugcu

SEQ ID NO: 3095512 - RNA, 19 nt, Mycobacterium bovis subsp bovis AF2122/97
ggcggcgcugcagcugcuc

SEQ ID NO: 3095513 - RNA, 20 nt, Mycobacterium bovis subsp bovis AF2122/97
ggcggcgcugcagcugcucg

SEQ ID NO: 3095514 - RNA, 14 nt, Mycobacterium bovis subsp bovis AF2122/97
ggcggcgcugcgcg

SEQ ID NO: 3095515 - RNA, 22 nt, Mycobacterium bovis subsp bovis AF2122/97
ggcggcgcuggucgcgguggcg

SEQ ID NO: 3095516 - RNA, 15 nt, Mycobacterium bovis subsp bovis AF2122/97
ggcggcggaggcugg

SEQ ID NO: 3095517 - RNA, 18 nt, Mycobacterium bovis subsp bovis AF2122/97
ggcggcggaggcugggcu

SEQ ID NO: 3095518 - RNA, 18 nt, Mycobacterium bovis subsp bovis AF2122/97
ggcggcggauuccggcau

SEQ ID NO: 3095519 - RNA, 14 nt, Mycobacterium bovis subsp bovis AF2122/97
ggcggcggccagcc

SEQ ID NO: 3095520 - RNA, 23 nt, Mycobacterium bovis subsp bovis AF2122/97
ggcggcggccauagugaggccga

SEQ ID NO: 3095521 - RNA, 16 nt, Mycobacterium bovis subsp bovis AF2122/97
ggcggcggccgcagcg

SEQ ID NO: 3095522 - RNA, 19 nt, Mycobacterium bovis subsp bovis AF2122/97
ggcggcggccgcagcggcc

SEQ ID NO: 3095523 - RNA, 12 nt, Mycobacterium bovis subsp bovis AF2122/97
ggcggcggccug

SEQ ID NO: 3095524 - RNA, 13 nt, Mycobacterium bovis subsp bovis AF2122/97
ggcggcggcggca

SEQ ID NO: 3095525 - RNA, 14 nt, Mycobacterium bovis subsp bovis AF2122/97
ggcggcggcggcaa

SEQ ID NO: 3095526 - RNA, 14 nt, Mycobacterium bovis subsp bovis AF2122/97
ggcggcggcguagc

SEQ ID NO: 3095527 - RNA, 22 nt, Mycobacterium bovis subsp bovis AF2122/97
ggcggcggcuguugcggcggcg

SEQ ID NO: 3095528 - RNA, 23 nt, Mycobacterium bovis subsp bovis AF2122/97
ggcggcggcuguugcggcggcgc

SEQ ID NO: 3095529 - RNA, 21 nt, Mycobacterium bovis subsp bovis AF2122/97
ggcggcggggacucugccacc

SEQ ID NO: 3095530 - RNA, 13 nt, Mycobacterium bovis subsp bovis AF2122/97
ggcggcgggggcg

SEQ ID NO: 3095531 - RNA, 12 nt, Mycobacterium bovis subsp bovis AF2122/97
ggcggcggucga

SEQ ID NO: 3095532 - RNA, 15 nt, Mycobacterium bovis subsp bovis AF2122/97
ggcggcggucggcug

SEQ ID NO: 3095533 - RNA, 16 nt, Mycobacterium bovis subsp bovis AF2122/97
ggcggcggucggcugg

SEQ ID NO: 3095534 - RNA, 17 nt, Mycobacterium bovis subsp bovis AF2122/97
ggcggcggucggcuggg

SEQ ID NO: 3095535 - RNA, 17 nt, Mycobacterium bovis subsp bovis AF2122/97
ggcggcgguggccagcg

SEQ ID NO: 3095536 - RNA, 13 nt, Mycobacterium bovis subsp bovis AF2122/97
ggcggcgguggcg

SEQ ID NO: 3095537 - RNA, 14 nt, Mycobacterium bovis subsp bovis AF2122/97
ggcggcggugggcg

SEQ ID NO: 3095538 - RNA, 15 nt, Mycobacterium bovis subsp bovis AF2122/97
ggcggcggugggcgc

SEQ ID NO: 3095539 - RNA, 20 nt, Mycobacterium bovis subsp bovis AF2122/97
ggcggcggugggcgcggacc

SEQ ID NO: 3095540 - RNA, 16 nt, Mycobacterium bovis subsp bovis AF2122/97
ggcggcguagcagaag

SEQ ID NO: 3095541 - RNA, 13 nt, Mycobacterium bovis subsp bovis AF2122/97
ggcggcguccagc

SEQ ID NO: 3095542 - RNA, 16 nt, Mycobacterium bovis subsp bovis AF2122/97
ggcggcguccagcagc

SEQ ID NO: 3095543 - RNA, 21 nt, Mycobacterium bovis subsp bovis AF2122/97
ggcggcguccaucgcgcgccg

SEQ ID NO: 3095544 - RNA, 17 nt, Mycobacterium bovis subsp bovis AF2122/97
ggcggcgucgacggcuc

SEQ ID NO: 3095545 - RNA, 19 nt, Mycobacterium bovis subsp bovis AF2122/97
ggcggcgucgagcaccucc

SEQ ID NO: 3095546 - RNA, 15 nt, Mycobacterium bovis subsp bovis AF2122/97
ggcggcgucgcgguu

SEQ ID NO: 3095547 - RNA, 14 nt, Mycobacterium bovis subsp bovis AF2122/97
ggcggcgucugcgc

SEQ ID NO: 3095548 - RNA, 17 nt, Mycobacterium bovis subsp bovis AF2122/97
ggcggcgugaagugagc

SEQ ID NO: 3095549 - RNA, 19 nt, Mycobacterium bovis subsp bovis AF2122/97
ggcggcgugcuccugcccg

SEQ ID NO: 3095550 - RNA, 18 nt, Mycobacterium bovis subsp bovis AF2122/97
ggcggcguuaccaccguc

SEQ ID NO: 3095551 - RNA, 14 nt, Mycobacterium bovis subsp bovis AF2122/97
ggcggcguugagcu

SEQ ID NO: 3095552 - RNA, 20 nt, Mycobacterium bovis subsp bovis AF2122/97
ggcggcguugagcuggcggu

SEQ ID NO: 3095553 - RNA, 12 nt, Mycobacterium bovis subsp bovis AF2122/97
ggcggcuaccca

SEQ ID NO: 3095554 - RNA, 17 nt, Mycobacterium bovis subsp bovis AF2122/97
ggcggcuacuccaacug

SEQ ID NO: 3095555 - RNA, 16 nt, Mycobacterium bovis subsp bovis AF2122/97
ggcggcucacgaccgg

SEQ ID NO: 3095556 - RNA, 12 nt, Mycobacterium bovis subsp bovis AF2122/97
ggcggcuccacc

SEQ ID NO: 3095557 - RNA, 13 nt, Mycobacterium bovis subsp bovis AF2122/97
ggcggcuccaccg

SEQ ID NO: 3095558 - RNA, 15 nt, Mycobacterium bovis subsp bovis AF2122/97
ggcggcuccaccggg

SEQ ID NO: 3095559 - RNA, 13 nt, Mycobacterium bovis subsp bovis AF2122/97
ggcggcucccggg

SEQ ID NO: 3095560 - RNA, 21 nt, Mycobacterium bovis subsp bovis AF2122/97
ggcggcuccgcccggcguguc

SEQ ID NO: 3095561 - RNA, 15 nt, Mycobacterium bovis subsp bovis AF2122/97
ggcggcucgggugcg

SEQ ID NO: 3095562 - RNA, 20 nt, Mycobacterium bovis subsp bovis AF2122/97
ggcggcucgggugcgcccgg

SEQ ID NO: 3095563 - RNA, 18 nt, Mycobacterium bovis subsp bovis AF2122/97
ggcggcucuagaucgccg

SEQ ID NO: 3095564 - RNA, 17 nt, Mycobacterium bovis subsp bovis AF2122/97
ggcggcugaacggcagc

SEQ ID NO: 3095565 - RNA, 18 nt, Mycobacterium bovis subsp bovis AF2122/97
ggcggcugcacgcugcgg

SEQ ID NO: 3095566 - RNA, 13 nt, Mycobacterium bovis subsp bovis AF2122/97
ggcggcugcagcc

SEQ ID NO: 3095567 - RNA, 17 nt, Mycobacterium bovis subsp bovis AF2122/97
ggcggcugcagccgacc

SEQ ID NO: 3095568 - RNA, 19 nt, Mycobacterium bovis subsp bovis AF2122/97
ggcggcuguggucgcugcu

SEQ ID NO: 3095569 - RNA, 20 nt, Mycobacterium bovis subsp bovis AF2122/97
ggcggcuuagaacgugcugg

SEQ ID NO: 3095570 - RNA, 21 nt, Mycobacterium bovis subsp bovis AF2122/97
ggcggcuuagaacgugcuggu

SEQ ID NO: 3095571 - RNA, 23 nt, Mycobacterium bovis subsp bovis AF2122/97
ggcggcuucaaagaggauccgcu

SEQ ID NO: 3095572 - RNA, 15 nt, Mycobacterium bovis subsp bovis AF2122/97
ggcggcuuccucgag

SEQ ID NO: 3095573 - RNA, 14 nt, Mycobacterium bovis subsp bovis AF2122/97
ggcggcuucgacgu

SEQ ID NO: 3095574 - RNA, 19 nt, Mycobacterium bovis subsp bovis AF2122/97
ggcggcuucgacgucggcg

SEQ ID NO: 3095575 - RNA, 17 nt, Mycobacterium bovis subsp bovis AF2122/97
ggcggcuucgauugcgc

SEQ ID NO: 3095576 - RNA, 23 nt, Mycobacterium bovis subsp bovis AF2122/97
ggcggcuucgauugcgcugcacc

SEQ ID NO: 3095577 - RNA, 16 nt, Mycobacterium bovis subsp bovis AF2122/97
ggcggcuucgccgacg

SEQ ID NO: 3095578 - RNA, 19 nt, Mycobacterium bovis subsp bovis AF2122/97
ggcggcuucgcuaauacac

SEQ ID NO: 3095579 - RNA, 23 nt, Mycobacterium bovis subsp bovis AF2122/97
ggcggcuucguggcggcgcgcgc

SEQ ID NO: 3095580 - RNA, 24 nt, Mycobacterium bovis subsp bovis AF2122/97
ggcggcuugaucagccgccaaccg

SEQ ID NO: 3095581 - RNA, 19 nt, Mycobacterium bovis subsp bovis AF2122/97
ggcgggacaaccgggcggg

SEQ ID NO: 3095582 - RNA, 22 nt, Mycobacterium bovis subsp bovis AF2122/97
ggcgggacccgugagcucgucg

SEQ ID NO: 3095583 - RNA, 23 nt, Mycobacterium bovis subsp bovis AF2122/97
ggcgggacccgugagcucgucga

SEQ ID NO: 3095584 - RNA, 14 nt, Mycobacterium bovis subsp bovis AF2122/97
ggcgggacgggggc

SEQ ID NO: 3095585 - RNA, 14 nt, Mycobacterium bovis subsp bovis AF2122/97
ggcgggacucggcg

SEQ ID NO: 3095586 - RNA, 16 nt, Mycobacterium bovis subsp bovis AF2122/97
ggcgggacucggcgag

SEQ ID NO: 3095587 - RNA, 15 nt, Mycobacterium bovis subsp bovis AF2122/97
ggcgggaugcagcug

SEQ ID NO: 3095588 - RNA, 15 nt, Mycobacterium bovis subsp bovis AF2122/97
ggcgggcaccuccgc

SEQ ID NO: 3095589 - RNA, 19 nt, Mycobacterium bovis subsp bovis AF2122/97
ggcgggcacgcacaaguuc

SEQ ID NO: 3095590 - RNA, 18 nt, Mycobacterium bovis subsp bovis AF2122/97
ggcgggcacucagcaggg

SEQ ID NO: 3095591 - RNA, 23 nt, Mycobacterium bovis subsp bovis AF2122/97
ggcgggcaguugacccaugccga

SEQ ID NO: 3095592 - RNA, 14 nt, Mycobacterium bovis subsp bovis AF2122/97
ggcgggccaccgua

SEQ ID NO: 3095593 - RNA, 21 nt, Mycobacterium bovis subsp bovis AF2122/97
ggcgggcccgaugaggacauc

SEQ ID NO: 3095594 - RNA, 13 nt, Mycobacterium bovis subsp bovis AF2122/97
ggcgggcccgccg

SEQ ID NO: 3095595 - RNA, 14 nt, Mycobacterium bovis subsp bovis AF2122/97
ggcgggcccgccgg

SEQ ID NO: 3095596 - RNA, 15 nt, Mycobacterium bovis subsp bovis AF2122/97
ggcgggccgcgcggc

SEQ ID NO: 3095597 - RNA, 15 nt, Mycobacterium bovis subsp bovis AF2122/97
ggcgggccugcgcga

SEQ ID NO: 3095598 - RNA, 12 nt, Mycobacterium bovis subsp bovis AF2122/97
ggcgggcggcag

SEQ ID NO: 3095599 - RNA, 13 nt, Mycobacterium bovis subsp bovis AF2122/97
ggcgggcggcagc

SEQ ID NO: 3095600 - RNA, 14 nt, Mycobacterium bovis subsp bovis AF2122/97
ggcgggcggccgcu

SEQ ID NO: 3095601 - RNA, 15 nt, Mycobacterium bovis subsp bovis AF2122/97
ggcgggcguccacgc

SEQ ID NO: 3095602 - RNA, 13 nt, Mycobacterium bovis subsp bovis AF2122/97
ggcgggcucgccc

SEQ ID NO: 3095603 - RNA, 23 nt, Mycobacterium bovis subsp bovis AF2122/97
ggcgggcucgcuucaggcaccgg

SEQ ID NO: 3095604 - RNA, 23 nt, Mycobacterium bovis subsp bovis AF2122/97
ggcgggcucuacucgcggccggc

SEQ ID NO: 3095605 - RNA, 21 nt, Mycobacterium bovis subsp bovis AF2122/97
ggcgggcugauuucgugcgau

SEQ ID NO: 3095606 - RNA, 14 nt, Mycobacterium bovis subsp bovis AF2122/97
ggcgggcugguguc

SEQ ID NO: 3095607 - RNA, 19 nt, Mycobacterium bovis subsp bovis AF2122/97
ggcggggaaaccggccagc

SEQ ID NO: 3095608 - RNA, 15 nt, Mycobacterium bovis subsp bovis AF2122/97
ggcggggacggcggc

SEQ ID NO: 3095609 - RNA, 13 nt, Mycobacterium bovis subsp bovis AF2122/97
ggcggggccggcg

SEQ ID NO: 3095610 - RNA, 15 nt, Mycobacterium bovis subsp bovis AF2122/97
ggcggggccggcggc

SEQ ID NO: 3095611 - RNA, 16 nt, Mycobacterium bovis subsp bovis AF2122/97
ggcggggccggcggcu

SEQ ID NO: 3095612 - RNA, 12 nt, Mycobacterium bovis subsp bovis AF2122/97
ggcggggcgccg

SEQ ID NO: 3095613 - RNA, 13 nt, Mycobacterium bovis subsp bovis AF2122/97
ggcggggcgccgg

SEQ ID NO: 3095614 - RNA, 15 nt, Mycobacterium bovis subsp bovis AF2122/97
ggcggggcggcggug

SEQ ID NO: 3095615 - RNA, 16 nt, Mycobacterium bovis subsp bovis AF2122/97
ggcgggggcgucgccg

SEQ ID NO: 3095616 - RNA, 20 nt, Mycobacterium bovis subsp bovis AF2122/97
ggcgggguugaucaccgaca

SEQ ID NO: 3095617 - RNA, 18 nt, Mycobacterium bovis subsp bovis AF2122/97
ggcggguaagcgaccgac

SEQ ID NO: 3095618 - RNA, 19 nt, Mycobacterium bovis subsp bovis AF2122/97
ggcggguagcucgcugacc

SEQ ID NO: 3095619 - RNA, 17 nt, Mycobacterium bovis subsp bovis AF2122/97
ggcggguccucgcggag

SEQ ID NO: 3095620 - RNA, 18 nt, Mycobacterium bovis subsp bovis AF2122/97
ggcggguccucgcggagc

SEQ ID NO: 3095621 - RNA, 19 nt, Mycobacterium bovis subsp bovis AF2122/97
ggcgggugccgagcuggcg

SEQ ID NO: 3095622 - RNA, 15 nt, Mycobacterium bovis subsp bovis AF2122/97
ggcgggugcgacauc

SEQ ID NO: 3095623 - RNA, 14 nt, Mycobacterium bovis subsp bovis AF2122/97
ggcggguggcuccu

SEQ ID NO: 3095624 - RNA, 17 nt, Mycobacterium bovis subsp bovis AF2122/97
ggcggguuuucucgccg

SEQ ID NO: 3095625 - RNA, 16 nt, Mycobacterium bovis subsp bovis AF2122/97
ggcgguaaagcucacc

SEQ ID NO: 3095626 - RNA, 17 nt, Mycobacterium bovis subsp bovis AF2122/97
ggcgguaaaugccugcc

SEQ ID NO: 3095627 - RNA, 21 nt, Mycobacterium bovis subsp bovis AF2122/97
ggcgguaaaugccugcccacc

SEQ ID NO: 3095628 - RNA, 15 nt, Mycobacterium bovis subsp bovis AF2122/97
ggcgguaacggcggu

SEQ ID NO: 3095629 - RNA, 23 nt, Mycobacterium bovis subsp bovis AF2122/97
ggcgguaaguacuagccggucgg

SEQ ID NO: 3095630 - RNA, 13 nt, Mycobacterium bovis subsp bovis AF2122/97
ggcgguaauacag

SEQ ID NO: 3095631 - RNA, 15 nt, Mycobacterium bovis subsp bovis AF2122/97
ggcgguaaucgcgag

SEQ ID NO: 3095632 - RNA, 14 nt, Mycobacterium bovis subsp bovis AF2122/97
ggcgguaccgccgc

SEQ ID NO: 3095633 - RNA, 20 nt, Mycobacterium bovis subsp bovis AF2122/97
ggcgguaccgccgcugccgg

SEQ ID NO: 3095634 - RNA, 22 nt, Mycobacterium bovis subsp bovis AF2122/97
ggcgguaccgggaucccacggc

SEQ ID NO: 3095635 - RNA, 13 nt, Mycobacterium bovis subsp bovis AF2122/97
ggcgguacggguc

SEQ ID NO: 3095636 - RNA, 17 nt, Mycobacterium bovis subsp bovis AF2122/97
ggcgguagccgaccagc

SEQ ID NO: 3095637 - RNA, 18 nt, Mycobacterium bovis subsp bovis AF2122/97
ggcgguagccgaccagcg

SEQ ID NO: 3095638 - RNA, 14 nt, Mycobacterium bovis subsp bovis AF2122/97
ggcgguagccgacg

SEQ ID NO: 3095639 - RNA, 14 nt, Mycobacterium bovis subsp bovis AF2122/97
ggcgguagcuuccg

SEQ ID NO: 3095640 - RNA, 23 nt, Mycobacterium bovis subsp bovis AF2122/97
ggcgguaguacucgcgcagguag

SEQ ID NO: 3095641 - RNA, 18 nt, Mycobacterium bovis subsp bovis AF2122/97
ggcgguagucggccagcu

SEQ ID NO: 3095642 - RNA, 23 nt, Mycobacterium bovis subsp bovis AF2122/97
ggcgguagucggccagcucgcgg

SEQ ID NO: 3095643 - RNA, 22 nt, Mycobacterium bovis subsp bovis AF2122/97
ggcgguaucgaaagccaacucg

SEQ ID NO: 3095644 - RNA, 13 nt, Mycobacterium bovis subsp bovis AF2122/97
ggcgguaucggca

SEQ ID NO: 3095645 - RNA, 19 nt, Mycobacterium bovis subsp bovis AF2122/97
ggcgguaugcucgcuggcg

SEQ ID NO: 3095646 - RNA, 13 nt, Mycobacterium bovis subsp bovis AF2122/97
ggcggucaccacc

SEQ ID NO: 3095647 - RNA, 14 nt, Mycobacterium bovis subsp bovis AF2122/97
ggcggucaccaccg

SEQ ID NO: 3095648 - RNA, 19 nt, Mycobacterium bovis subsp bovis AF2122/97
ggcggucaccaccgacccg

SEQ ID NO: 3095649 - RNA, 20 nt, Mycobacterium bovis subsp bovis AF2122/97
ggcggucaccaccgacccgc

SEQ ID NO: 3095650 - RNA, 15 nt, Mycobacterium bovis subsp bovis AF2122/97
ggcggucaccacgcg

SEQ ID NO: 3095651 - RNA, 14 nt, Mycobacterium bovis subsp bovis AF2122/97
ggcggucagcggcc

SEQ ID NO: 3095652 - RNA, 15 nt, Mycobacterium bovis subsp bovis AF2122/97
ggcggucagcggcca

SEQ ID NO: 3095653 - RNA, 14 nt, Mycobacterium bovis subsp bovis AF2122/97
ggcggucagcggcu

SEQ ID NO: 3095654 - RNA, 15 nt, Mycobacterium bovis subsp bovis AF2122/97
ggcggucagcggcuc

SEQ ID NO: 3095655 - RNA, 20 nt, Mycobacterium bovis subsp bovis AF2122/97
ggcggucagcggcucggcgg

SEQ ID NO: 3095656 - RNA, 11 nt, Mycobacterium bovis subsp bovis AF2122/97
ggcggucaggc

SEQ ID NO: 3095657 - RNA, 17 nt, Mycobacterium bovis subsp bovis AF2122/97
ggcgguccaaucgccgg

SEQ ID NO: 3095658 - RNA, 13 nt, Mycobacterium bovis subsp bovis AF2122/97
ggcgguccaccgg

SEQ ID NO: 3095659 - RNA, 17 nt, Mycobacterium bovis subsp bovis AF2122/97
ggcggucccugaagcca

SEQ ID NO: 3095660 - RNA, 20 nt, Mycobacterium bovis subsp bovis AF2122/97
ggcggucccugaagccagcg

SEQ ID NO: 3095661 - RNA, 22 nt, Mycobacterium bovis subsp bovis AF2122/97
ggcgguccgaugcgcgcggcgc

SEQ ID NO: 3095662 - RNA, 22 nt, Mycobacterium bovis subsp bovis AF2122/97
ggcggucgaucauggcggcagc

SEQ ID NO: 3095663 - RNA, 16 nt, Mycobacterium bovis subsp bovis AF2122/97
ggcggucgccacaccc

SEQ ID NO: 3095664 - RNA, 13 nt, Mycobacterium bovis subsp bovis AF2122/97
ggcggucgccgcg

SEQ ID NO: 3095665 - RNA, 21 nt, Mycobacterium bovis subsp bovis AF2122/97
ggcggucggaaugccgucgcc

SEQ ID NO: 3095666 - RNA, 15 nt, Mycobacterium bovis subsp bovis AF2122/97
ggcggucggccggcu

SEQ ID NO: 3095667 - RNA, 18 nt, Mycobacterium bovis subsp bovis AF2122/97
ggcggucugcagugcagc

SEQ ID NO: 3095668 - RNA, 20 nt, Mycobacterium bovis subsp bovis AF2122/97
ggcggucugcagugcagcga

SEQ ID NO: 3095669 - RNA, 22 nt, Mycobacterium bovis subsp bovis AF2122/97
ggcggucugcagugcagcgauc

SEQ ID NO: 3095670 - RNA, 12 nt, Mycobacterium bovis subsp bovis AF2122/97
ggcggucugcgc

SEQ ID NO: 3095671 - RNA, 16 nt, Mycobacterium bovis subsp bovis AF2122/97
ggcggucugggugagc

SEQ ID NO: 3095672 - RNA, 18 nt, Mycobacterium bovis subsp bovis AF2122/97
ggcggucuugccgcaggc

SEQ ID NO: 3095673 - RNA, 20 nt, Mycobacterium bovis subsp bovis AF2122/97
ggcggucuugccgcaggccu

SEQ ID NO: 3095674 - RNA, 19 nt, Mycobacterium bovis subsp bovis AF2122/97
ggcggucuuuuugggcuug

SEQ ID NO: 3095675 - RNA, 15 nt, Mycobacterium bovis subsp bovis AF2122/97
ggcggugaacaccgc

SEQ ID NO: 3095676 - RNA, 17 nt, Mycobacterium bovis subsp bovis AF2122/97
ggcggugaacaccgccu

SEQ ID NO: 3095677 - RNA, 23 nt, Mycobacterium bovis subsp bovis AF2122/97
ggcggugaacuucuccaccagcg

SEQ ID NO: 3095678 - RNA, 16 nt, Mycobacterium bovis subsp bovis AF2122/97
ggcggugacggcggca

SEQ ID NO: 3095679 - RNA, 18 nt, Mycobacterium bovis subsp bovis AF2122/97
ggcggugacggcggcaac

SEQ ID NO: 3095680 - RNA, 19 nt, Mycobacterium bovis subsp bovis AF2122/97
ggcggugagcaacuggcau

SEQ ID NO: 3095681 - RNA, 18 nt, Mycobacterium bovis subsp bovis AF2122/97
ggcggugcacaccgucgc

SEQ ID NO: 3095682 - RNA, 15 nt, Mycobacterium bovis subsp bovis AF2122/97
ggcggugcagaucgg

SEQ ID NO: 3095683 - RNA, 15 nt, Mycobacterium bovis subsp bovis AF2122/97
ggcggugcagcaggg

SEQ ID NO: 3095684 - RNA, 16 nt, Mycobacterium bovis subsp bovis AF2122/97
ggcggugcccagcagc

SEQ ID NO: 3095685 - RNA, 14 nt, Mycobacterium bovis subsp bovis AF2122/97
ggcggugccgacgg

SEQ ID NO: 3095686 - RNA, 13 nt, Mycobacterium bovis subsp bovis AF2122/97
ggcggugccgccg

SEQ ID NO: 3095687 - RNA, 12 nt, Mycobacterium bovis subsp bovis AF2122/97
ggcggugccggc

SEQ ID NO: 3095688 - RNA, 15 nt, Mycobacterium bovis subsp bovis AF2122/97
ggcggugccgguagc

SEQ ID NO: 3095689 - RNA, 17 nt, Mycobacterium bovis subsp bovis AF2122/97
ggcggugccgguagcgg

SEQ ID NO: 3095690 - RNA, 15 nt, Mycobacterium bovis subsp bovis AF2122/97
ggcggugccgguggu

SEQ ID NO: 3095691 - RNA, 15 nt, Mycobacterium bovis subsp bovis AF2122/97
ggcggugccgucagc

SEQ ID NO: 3095692 - RNA, 15 nt, Mycobacterium bovis subsp bovis AF2122/97
ggcggugccgucgcc

SEQ ID NO: 3095693 - RNA, 18 nt, Mycobacterium bovis subsp bovis AF2122/97
ggcggugccgugcucacg

SEQ ID NO: 3095694 - RNA, 13 nt, Mycobacterium bovis subsp bovis AF2122/97
ggcggugcgcacc

SEQ ID NO: 3095695 - RNA, 15 nt, Mycobacterium bovis subsp bovis AF2122/97
ggcggugcgcaccac

SEQ ID NO: 3095696 - RNA, 17 nt, Mycobacterium bovis subsp bovis AF2122/97
ggcggugcgcaccaccg

SEQ ID NO: 3095697 - RNA, 18 nt, Mycobacterium bovis subsp bovis AF2122/97
ggcggugcgcaccaccga

SEQ ID NO: 3095698 - RNA, 16 nt, Mycobacterium bovis subsp bovis AF2122/97
ggcggugcgcagcuug

SEQ ID NO: 3095699 - RNA, 23 nt, Mycobacterium bovis subsp bovis AF2122/97
ggcggugcggguggugccggcgg

SEQ ID NO: 3095700 - RNA, 14 nt, Mycobacterium bovis subsp bovis AF2122/97
ggcgguggccaccc

SEQ ID NO: 3095701 - RNA, 20 nt, Mycobacterium bovis subsp bovis AF2122/97
ggcgguggccacccggccgc

SEQ ID NO: 3095702 - RNA, 23 nt, Mycobacterium bovis subsp bovis AF2122/97
ggcgguggccacccggccgcgcg

SEQ ID NO: 3095703 - RNA, 15 nt, Mycobacterium bovis subsp bovis AF2122/97
ggcgguggcccgauu

SEQ ID NO: 3095704 - RNA, 23 nt, Mycobacterium bovis subsp bovis AF2122/97
ggcgguggccggcgagggugagc

SEQ ID NO: 3095705 - RNA, 14 nt, Mycobacterium bovis subsp bovis AF2122/97
ggcgguggccgucg

SEQ ID NO: 3095706 - RNA, 13 nt, Mycobacterium bovis subsp bovis AF2122/97
ggcggugggcagc

SEQ ID NO: 3095707 - RNA, 18 nt, Mycobacterium bovis subsp bovis AF2122/97
ggcggugggcagcagcug

SEQ ID NO: 3095708 - RNA, 18 nt, Mycobacterium bovis subsp bovis AF2122/97
ggcggugggcuuggcgcc

SEQ ID NO: 3095709 - RNA, 18 nt, Mycobacterium bovis subsp bovis AF2122/97
ggcgguggggccggcguc

SEQ ID NO: 3095710 - RNA, 12 nt, Mycobacterium bovis subsp bovis AF2122/97
ggcggugggucg

SEQ ID NO: 3095711 - RNA, 17 nt, Mycobacterium bovis subsp bovis AF2122/97
ggcggugguaccggcgc

SEQ ID NO: 3095712 - RNA, 13 nt, Mycobacterium bovis subsp bovis AF2122/97
ggcgguggucccg

SEQ ID NO: 3095713 - RNA, 16 nt, Mycobacterium bovis subsp bovis AF2122/97
ggcgguggugucgcuc

SEQ ID NO: 3095714 - RNA, 20 nt, Mycobacterium bovis subsp bovis AF2122/97
ggcgguggugucgcucgcga

SEQ ID NO: 3095715 - RNA, 17 nt, Mycobacterium bovis subsp bovis AF2122/97
ggcgguguagccgcggu

SEQ ID NO: 3095716 - RNA, 20 nt, Mycobacterium bovis subsp bovis AF2122/97
ggcgguguccagaacggugg

SEQ ID NO: 3095717 - RNA, 13 nt, Mycobacterium bovis subsp bovis AF2122/97
ggcggugucggcg

SEQ ID NO: 3095718 - RNA, 14 nt, Mycobacterium bovis subsp bovis AF2122/97
ggcggugucggcgc

SEQ ID NO: 3095719 - RNA, 18 nt, Mycobacterium bovis subsp bovis AF2122/97
ggcggugucgucaucggg

SEQ ID NO: 3095720 - RNA, 23 nt, Mycobacterium bovis subsp bovis AF2122/97
ggcggugucgucaucggggccug

SEQ ID NO: 3095721 - RNA, 15 nt, Mycobacterium bovis subsp bovis AF2122/97
ggcggugucgucgag

SEQ ID NO: 3095722 - RNA, 16 nt, Mycobacterium bovis subsp bovis AF2122/97
ggcgguguugcucccg

SEQ ID NO: 3095723 - RNA, 16 nt, Mycobacterium bovis subsp bovis AF2122/97
ggcgguuaucgucggg

SEQ ID NO: 3095724 - RNA, 22 nt, Mycobacterium bovis subsp bovis AF2122/97
ggcgguuaucgucgggucaccc

SEQ ID NO: 3095725 - RNA, 21 nt, Mycobacterium bovis subsp bovis AF2122/97
ggcgguuccauacagccgccg

SEQ ID NO: 3095726 - RNA, 16 nt, Mycobacterium bovis subsp bovis AF2122/97
ggcgguuccggccggc

SEQ ID NO: 3095727 - RNA, 22 nt, Mycobacterium bovis subsp bovis AF2122/97
ggcgguugccccgaccgccgug

SEQ ID NO: 3095728 - RNA, 16 nt, Mycobacterium bovis subsp bovis AF2122/97
ggcgguugcccgagcg

SEQ ID NO: 3095729 - RNA, 15 nt, Mycobacterium bovis subsp bovis AF2122/97
ggcgguuggugcagc

SEQ ID NO: 3095730 - RNA, 18 nt, Mycobacterium bovis subsp bovis AF2122/97
ggcguaaucaagcagcgu

SEQ ID NO: 3095731 - RNA, 21 nt, Mycobacterium bovis subsp bovis AF2122/97
ggcguaaucgggaaguacggc

SEQ ID NO: 3095732 - RNA, 23 nt, Mycobacterium bovis subsp bovis AF2122/97
ggcguacccguuaugcgccgccc

SEQ ID NO: 3095733 - RNA, 14 nt, Mycobacterium bovis subsp bovis AF2122/97
ggcguacucggcgc

SEQ ID NO: 3095734 - RNA, 15 nt, Mycobacterium bovis subsp bovis AF2122/97
ggcguacucggcgcg

SEQ ID NO: 3095735 - RNA, 19 nt, Mycobacterium bovis subsp bovis AF2122/97
ggcguacucggcgcgcagc

SEQ ID NO: 3095736 - RNA, 16 nt, Mycobacterium bovis subsp bovis AF2122/97
ggcguagacguccgcg

SEQ ID NO: 3095737 - RNA, 18 nt, Mycobacterium bovis subsp bovis AF2122/97
ggcguagacguccgcggu

SEQ ID NO: 3095738 - RNA, 13 nt, Mycobacterium bovis subsp bovis AF2122/97
ggcguagaugcgc

SEQ ID NO: 3095739 - RNA, 17 nt, Mycobacterium bovis subsp bovis AF2122/97
ggcguagcagaaggccg

SEQ ID NO: 3095740 - RNA, 22 nt, Mycobacterium bovis subsp bovis AF2122/97
ggcguaggcaggaucgccugag

SEQ ID NO: 3095741 - RNA, 24 nt, Mycobacterium bovis subsp bovis AF2122/97
ggcguaggcaggaucgccugagcg

SEQ ID NO: 3095742 - RNA, 13 nt, Mycobacterium bovis subsp bovis AF2122/97
ggcguaggcgaug

SEQ ID NO: 3095743 - RNA, 15 nt, Mycobacterium bovis subsp bovis AF2122/97
ggcguagggcugucc

SEQ ID NO: 3095744 - RNA, 19 nt, Mycobacterium bovis subsp bovis AF2122/97
ggcguagucgcugucggca

SEQ ID NO: 3095745 - RNA, 12 nt, Mycobacterium bovis subsp bovis AF2122/97
ggcguagucggc

SEQ ID NO: 3095746 - RNA, 14 nt, Mycobacterium bovis subsp bovis AF2122/97
ggcguagucggcgg

SEQ ID NO: 3095747 - RNA, 21 nt, Mycobacterium bovis subsp bovis AF2122/97
ggcguagucggcggugcagau

SEQ ID NO: 3095748 - RNA, 14 nt, Mycobacterium bovis subsp bovis AF2122/97
ggcguagugcagcu

SEQ ID NO: 3095749 - RNA, 16 nt, Mycobacterium bovis subsp bovis AF2122/97
ggcguagugcucgccg

SEQ ID NO: 3095750 - RNA, 17 nt, Mycobacterium bovis subsp bovis AF2122/97
ggcguauucggugcacg

SEQ ID NO: 3095751 - RNA, 22 nt, Mycobacterium bovis subsp bovis AF2122/97
ggcguauugcaccgccaggucg

SEQ ID NO: 3095752 - RNA, 15 nt, Mycobacterium bovis subsp bovis AF2122/97
ggcguauugcggccu

SEQ ID NO: 3095753 - RNA, 20 nt, Mycobacterium bovis subsp bovis AF2122/97
ggcgucaaaggccuugacgu

SEQ ID NO: 3095754 - RNA, 21 nt, Mycobacterium bovis subsp bovis AF2122/97
ggcgucaaaggccuugacgua

SEQ ID NO: 3095755 - RNA, 20 nt, Mycobacterium bovis subsp bovis AF2122/97
ggcgucaagcaaguccaccg

SEQ ID NO: 3095756 - RNA, 22 nt, Mycobacterium bovis subsp bovis AF2122/97
ggcgucaagcaaguccaccgga

SEQ ID NO: 3095757 - RNA, 23 nt, Mycobacterium bovis subsp bovis AF2122/97
ggcgucaagcaaguccaccggau

SEQ ID NO: 3095758 - RNA, 14 nt, Mycobacterium bovis subsp bovis AF2122/97
ggcgucaccccggu

SEQ ID NO: 3095759 - RNA, 20 nt, Mycobacterium bovis subsp bovis AF2122/97
ggcgucaccgccggugcuga

SEQ ID NO: 3095760 - RNA, 22 nt, Mycobacterium bovis subsp bovis AF2122/97
ggcgucaccgccggugcugacg

SEQ ID NO: 3095761 - RNA, 12 nt, Mycobacterium bovis subsp bovis AF2122/97
ggcgucaccgcg

SEQ ID NO: 3095762 - RNA, 13 nt, Mycobacterium bovis subsp bovis AF2122/97
ggcgucaccgcgg

SEQ ID NO: 3095763 - RNA, 14 nt, Mycobacterium bovis subsp bovis AF2122/97
ggcgucaggcacaa

SEQ ID NO: 3095764 - RNA, 16 nt, Mycobacterium bovis subsp bovis AF2122/97
ggcgucagugcagaag

SEQ ID NO: 3095765 - RNA, 21 nt, Mycobacterium bovis subsp bovis AF2122/97
ggcgucaucgacuugccgccg

SEQ ID NO: 3095766 - RNA, 16 nt, Mycobacterium bovis subsp bovis AF2122/97
ggcgucaugaugucga

SEQ ID NO: 3095767 - RNA, 19 nt, Mycobacterium bovis subsp bovis AF2122/97
ggcgucaugaugucgacau

SEQ ID NO: 3095768 - RNA, 23 nt, Mycobacterium bovis subsp bovis AF2122/97
ggcguccagaagaagaugaucgc

SEQ ID NO: 3095769 - RNA, 12 nt, Mycobacterium bovis subsp bovis AF2122/97
ggcguccagcag

SEQ ID NO: 3095770 - RNA, 22 nt, Mycobacterium bovis subsp bovis AF2122/97
ggcguccaguccgaucacccgc

SEQ ID NO: 3095771 - RNA, 15 nt, Mycobacterium bovis subsp bovis AF2122/97
ggcguccaucagaga

SEQ ID NO: 3095772 - RNA, 21 nt, Mycobacterium bovis subsp bovis AF2122/97
ggcgucccagccgaucacggg

SEQ ID NO: 3095773 - RNA, 22 nt, Mycobacterium bovis subsp bovis AF2122/97
ggcgucccagggcacaucgggc

SEQ ID NO: 3095774 - RNA, 19 nt, Mycobacterium bovis subsp bovis AF2122/97
ggcgucccggcggucagcg

SEQ ID NO: 3095775 - RNA, 13 nt, Mycobacterium bovis subsp bovis AF2122/97
ggcguccgaccgg

SEQ ID NO: 3095776 - RNA, 15 nt, Mycobacterium bovis subsp bovis AF2122/97
ggcguccgcccagca

SEQ ID NO: 3095777 - RNA, 14 nt, Mycobacterium bovis subsp bovis AF2122/97
ggcguccgccggcg

SEQ ID NO: 3095778 - RNA, 13 nt, Mycobacterium bovis subsp bovis AF2122/97
ggcguccgggauc

SEQ ID NO: 3095779 - RNA, 15 nt, Mycobacterium bovis subsp bovis AF2122/97
ggcguccucgucgag

SEQ ID NO: 3095780 - RNA, 23 nt, Mycobacterium bovis subsp bovis AF2122/97
ggcguccuucuuguuggucccga

SEQ ID NO: 3095781 - RNA, 17 nt, Mycobacterium bovis subsp bovis AF2122/97
ggcguccuugcgcagca

SEQ ID NO: 3095782 - RNA, 22 nt, Mycobacterium bovis subsp bovis AF2122/97
ggcgucgaacagugccucgcgu

SEQ ID NO: 3095783 - RNA, 23 nt, Mycobacterium bovis subsp bovis AF2122/97
ggcgucgaaggugaccaggcgga

SEQ ID NO: 3095784 - RNA, 23 nt, Mycobacterium bovis subsp bovis AF2122/97
ggcgucgaagugggugaaccgga

SEQ ID NO: 3095785 - RNA, 19 nt, Mycobacterium bovis subsp bovis AF2122/97
ggcgucgaauucagcugca

SEQ ID NO: 3095786 - RNA, 20 nt, Mycobacterium bovis subsp bovis AF2122/97
ggcgucgaauucagcugcac

SEQ ID NO: 3095787 - RNA, 12 nt, Mycobacterium bovis subsp bovis AF2122/97
ggcgucgaccac

SEQ ID NO: 3095788 - RNA, 13 nt, Mycobacterium bovis subsp bovis AF2122/97
ggcgucgaccacg

SEQ ID NO: 3095789 - RNA, 14 nt, Mycobacterium bovis subsp bovis AF2122/97
ggcgucgacccaga

SEQ ID NO: 3095790 - RNA, 16 nt, Mycobacterium bovis subsp bovis AF2122/97
ggcgucgaccgcggcc

SEQ ID NO: 3095791 - RNA, 23 nt, Mycobacterium bovis subsp bovis AF2122/97
ggcgucgacgauucccgcggaca

SEQ ID NO: 3095792 - RNA, 19 nt, Mycobacterium bovis subsp bovis AF2122/97
ggcgucgacgucgacggcg

SEQ ID NO: 3095793 - RNA, 22 nt, Mycobacterium bovis subsp bovis AF2122/97
ggcgucgacgucgacggcgaug

SEQ ID NO: 3095794 - RNA, 22 nt, Mycobacterium bovis subsp bovis AF2122/97
ggcgucgagauagucggccggc

SEQ ID NO: 3095795 - RNA, 13 nt, Mycobacterium bovis subsp bovis AF2122/97
ggcgucgagcucg

SEQ ID NO: 3095796 - RNA, 16 nt, Mycobacterium bovis subsp bovis AF2122/97
ggcgucgaguucgguu

SEQ ID NO: 3095797 - RNA, 18 nt, Mycobacterium bovis subsp bovis AF2122/97
ggcgucgaucagggcccc

SEQ ID NO: 3095798 - RNA, 14 nt, Mycobacterium bovis subsp bovis AF2122/97
ggcgucgaucucga

SEQ ID NO: 3095799 - RNA, 19 nt, Mycobacterium bovis subsp bovis AF2122/97
ggcgucgaugaccuuggga

SEQ ID NO: 3095800 - RNA, 21 nt, Mycobacterium bovis subsp bovis AF2122/97
ggcgucgaugccggcugccgc

SEQ ID NO: 3095801 - RNA, 18 nt, Mycobacterium bovis subsp bovis AF2122/97
ggcgucgaugguccagcc

SEQ ID NO: 3095802 - RNA, 23 nt, Mycobacterium bovis subsp bovis AF2122/97
ggcgucgaugguccagcccugcg

SEQ ID NO: 3095803 - RNA, 15 nt, Mycobacterium bovis subsp bovis AF2122/97
ggcgucgaugucguc

SEQ ID NO: 3095804 - RNA, 17 nt, Mycobacterium bovis subsp bovis AF2122/97
ggcgucgcaacgcgauc

SEQ ID NO: 3095805 - RNA, 19 nt, Mycobacterium bovis subsp bovis AF2122/97
ggcgucgcaacgcgaucac

SEQ ID NO: 3095806 - RNA, 22 nt, Mycobacterium bovis subsp bovis AF2122/97
ggcgucgccgccauugccgccg

SEQ ID NO: 3095807 - RNA, 14 nt, Mycobacterium bovis subsp bovis AF2122/97
ggcgucgccgccgg

SEQ ID NO: 3095808 - RNA, 12 nt, Mycobacterium bovis subsp bovis AF2122/97
ggcgucgccggc

SEQ ID NO: 3095809 - RNA, 16 nt, Mycobacterium bovis subsp bovis AF2122/97
ggcgucgccggcaccg

SEQ ID NO: 3095810 - RNA, 14 nt, Mycobacterium bovis subsp bovis AF2122/97
ggcgucgccggccc

SEQ ID NO: 3095811 - RNA, 17 nt, Mycobacterium bovis subsp bovis AF2122/97
ggcgucgccggccccgc

SEQ ID NO: 3095812 - RNA, 19 nt, Mycobacterium bovis subsp bovis AF2122/97
ggcgucgccggccccgccg

SEQ ID NO: 3095813 - RNA, 22 nt, Mycobacterium bovis subsp bovis AF2122/97
ggcgucgccggccccgccggcg

SEQ ID NO: 3095814 - RNA, 20 nt, Mycobacterium bovis subsp bovis AF2122/97
ggcgucgcggaucuguuccu

SEQ ID NO: 3095815 - RNA, 23 nt, Mycobacterium bovis subsp bovis AF2122/97
ggcgucgcgguuguggcugaucc

SEQ ID NO: 3095816 - RNA, 15 nt, Mycobacterium bovis subsp bovis AF2122/97
ggcgucgcucgucgu

SEQ ID NO: 3095817 - RNA, 17 nt, Mycobacterium bovis subsp bovis AF2122/97
ggcgucgcugcgcuggu

SEQ ID NO: 3095818 - RNA, 14 nt, Mycobacterium bovis subsp bovis AF2122/97
ggcgucgcuggcca

SEQ ID NO: 3095819 - RNA, 17 nt, Mycobacterium bovis subsp bovis AF2122/97
ggcgucggacaugccga

SEQ ID NO: 3095820 - RNA, 14 nt, Mycobacterium bovis subsp bovis AF2122/97
ggcgucggccaccc

SEQ ID NO: 3095821 - RNA, 17 nt, Mycobacterium bovis subsp bovis AF2122/97
ggcgucggccacccggu

SEQ ID NO: 3095822 - RNA, 13 nt, Mycobacterium bovis subsp bovis AF2122/97
ggcgucggccggc

SEQ ID NO: 3095823 - RNA, 12 nt, Mycobacterium bovis subsp bovis AF2122/97
ggcgucggcgac

SEQ ID NO: 3095824 - RNA, 17 nt, Mycobacterium bovis subsp bovis AF2122/97
ggcgucggcgcggccgu

SEQ ID NO: 3095825 - RNA, 17 nt, Mycobacterium bovis subsp bovis AF2122/97
ggcgucggcuucucgau

SEQ ID NO: 3095826 - RNA, 23 nt, Mycobacterium bovis subsp bovis AF2122/97
ggcgucggcuucucgaucggcgc

SEQ ID NO: 3095827 - RNA, 21 nt, Mycobacterium bovis subsp bovis AF2122/97
ggcgucgggguggcgguccgg

SEQ ID NO: 3095828 - RNA, 13 nt, Mycobacterium bovis subsp bovis AF2122/97
ggcgucguccgcg

SEQ ID NO: 3095829 - RNA, 15 nt, Mycobacterium bovis subsp bovis AF2122/97
ggcgucgucgacggc

SEQ ID NO: 3095830 - RNA, 20 nt, Mycobacterium bovis subsp bovis AF2122/97
ggcgucgucgaguuggccau

SEQ ID NO: 3095831 - RNA, 15 nt, Mycobacterium bovis subsp bovis AF2122/97
ggcgucgucgaugau

SEQ ID NO: 3095832 - RNA, 14 nt, Mycobacterium bovis subsp bovis AF2122/97
ggcgucgucggcgg

SEQ ID NO: 3095833 - RNA, 16 nt, Mycobacterium bovis subsp bovis AF2122/97
ggcgucgucggcggcg

SEQ ID NO: 3095834 - RNA, 18 nt, Mycobacterium bovis subsp bovis AF2122/97
ggcgucgucggcggcgac

SEQ ID NO: 3095835 - RNA, 14 nt, Mycobacterium bovis subsp bovis AF2122/97
ggcgucgucgguga

SEQ ID NO: 3095836 - RNA, 17 nt, Mycobacterium bovis subsp bovis AF2122/97
ggcgucgugcgcggccg

SEQ ID NO: 3095837 - RNA, 22 nt, Mycobacterium bovis subsp bovis AF2122/97
ggcgucgugcgcggccggcacg

SEQ ID NO: 3095838 - RNA, 16 nt, Mycobacterium bovis subsp bovis AF2122/97
ggcgucgugguggcua

SEQ ID NO: 3095839 - RNA, 23 nt, Mycobacterium bovis subsp bovis AF2122/97
ggcgucguucgagaccccgacga

SEQ ID NO: 3095840 - RNA, 18 nt, Mycobacterium bovis subsp bovis AF2122/97
ggcgucguucgcgggugc

SEQ ID NO: 3095841 - RNA, 15 nt, Mycobacterium bovis subsp bovis AF2122/97
ggcgucguugaggaa

SEQ ID NO: 3095842 - RNA, 14 nt, Mycobacterium bovis subsp bovis AF2122/97
ggcgucugcgccag

SEQ ID NO: 3095843 - RNA, 16 nt, Mycobacterium bovis subsp bovis AF2122/97
ggcgucuuccucggcc

SEQ ID NO: 3095844 - RNA, 20 nt, Mycobacterium bovis subsp bovis AF2122/97
ggcgucuuccucggccaccc

SEQ ID NO: 3095845 - RNA, 21 nt, Mycobacterium bovis subsp bovis AF2122/97
ggcgucuuggaaggcgcgcgc

SEQ ID NO: 3095846 - RNA, 19 nt, Mycobacterium bovis subsp bovis AF2122/97
ggcgugaaaaacgcccgcg

SEQ ID NO: 3095847 - RNA, 18 nt, Mycobacterium bovis subsp bovis AF2122/97
ggcgugaagugagcucgg

SEQ ID NO: 3095848 - RNA, 15 nt, Mycobacterium bovis subsp bovis AF2122/97
ggcgugacagggcgg

SEQ ID NO: 3095849 - RNA, 21 nt, Mycobacterium bovis subsp bovis AF2122/97
ggcgugacagggcggcaaccu

SEQ ID NO: 3095850 - RNA, 20 nt, Mycobacterium bovis subsp bovis AF2122/97
ggcgugaccuaccuccucgg

SEQ ID NO: 3095851 - RNA, 23 nt, Mycobacterium bovis subsp bovis AF2122/97
ggcgugaccuaccuccucggcgu

SEQ ID NO: 3095852 - RNA, 22 nt, Mycobacterium bovis subsp bovis AF2122/97
ggcgugacguagugcaccgccu

SEQ ID NO: 3095853 - RNA, 15 nt, Mycobacterium bovis subsp bovis AF2122/97
ggcgugacugguggc

SEQ ID NO: 3095854 - RNA, 16 nt, Mycobacterium bovis subsp bovis AF2122/97
ggcgugacugguggcg

SEQ ID NO: 3095855 - RNA, 19 nt, Mycobacterium bovis subsp bovis AF2122/97
ggcgugacugguggcgcca

SEQ ID NO: 3095856 - RNA, 17 nt, Mycobacterium bovis subsp bovis AF2122/97
ggcgugauagcccuugc

SEQ ID NO: 3095857 - RNA, 18 nt, Mycobacterium bovis subsp bovis AF2122/97
ggcgugaucccgcccaag

SEQ ID NO: 3095858 - RNA, 17 nt, Mycobacterium bovis subsp bovis AF2122/97
ggcgugcacugaccgcg

SEQ ID NO: 3095859 - RNA, 23 nt, Mycobacterium bovis subsp bovis AF2122/97
ggcgugcagaauccguucgacga

SEQ ID NO: 3095860 - RNA, 16 nt, Mycobacterium bovis subsp bovis AF2122/97
ggcgugcagacccggu

SEQ ID NO: 3095861 - RNA, 13 nt, Mycobacterium bovis subsp bovis AF2122/97
ggcgugcaucgcg

SEQ ID NO: 3095862 - RNA, 20 nt, Mycobacterium bovis subsp bovis AF2122/97
ggcgugcaucgcgauuccgg

SEQ ID NO: 3095863 - RNA, 13 nt, Mycobacterium bovis subsp bovis AF2122/97
ggcgugccccagu

SEQ ID NO: 3095864 - RNA, 15 nt, Mycobacterium bovis subsp bovis AF2122/97
ggcgugccgaccagc

SEQ ID NO: 3095865 - RNA, 16 nt, Mycobacterium bovis subsp bovis AF2122/97
ggcgugccgaccagca

SEQ ID NO: 3095866 - RNA, 13 nt, Mycobacterium bovis subsp bovis AF2122/97
ggcgugccgucgc

SEQ ID NO: 3095867 - RNA, 14 nt, Mycobacterium bovis subsp bovis AF2122/97
ggcgugcgcgguga

SEQ ID NO: 3095868 - RNA, 22 nt, Mycobacterium bovis subsp bovis AF2122/97
ggcgugcggucauauaggagcg

SEQ ID NO: 3095869 - RNA, 12 nt, Mycobacterium bovis subsp bovis AF2122/97
ggcgugcgugga

SEQ ID NO: 3095870 - RNA, 13 nt, Mycobacterium bovis subsp bovis AF2122/97
ggcgugcucgccg

SEQ ID NO: 3095871 - RNA, 19 nt, Mycobacterium bovis subsp bovis AF2122/97
ggcgugcucggaggcgauc

SEQ ID NO: 3095872 - RNA, 16 nt, Mycobacterium bovis subsp bovis AF2122/97
ggcgugcugccgaagc

SEQ ID NO: 3095873 - RNA, 13 nt, Mycobacterium bovis subsp bovis AF2122/97
ggcgugcugcuag

SEQ ID NO: 3095874 - RNA, 24 nt, Mycobacterium bovis subsp bovis AF2122/97
ggcgugcuugaccgccuggaagga

SEQ ID NO: 3095875 - RNA, 22 nt, Mycobacterium bovis subsp bovis AF2122/97
ggcguggaagccgacgaccagc

SEQ ID NO: 3095876 - RNA, 19 nt, Mycobacterium bovis subsp bovis AF2122/97
ggcguggaucuuggccagc

SEQ ID NO: 3095877 - RNA, 16 nt, Mycobacterium bovis subsp bovis AF2122/97
ggcguggaugcccggu

SEQ ID NO: 3095878 - RNA, 17 nt, Mycobacterium bovis subsp bovis AF2122/97
ggcguggcaguacaccg

SEQ ID NO: 3095879 - RNA, 15 nt, Mycobacterium bovis subsp bovis AF2122/97
ggcguggccccaccg

SEQ ID NO: 3095880 - RNA, 17 nt, Mycobacterium bovis subsp bovis AF2122/97
ggcguggccccaccgaa

SEQ ID NO: 3095881 - RNA, 17 nt, Mycobacterium bovis subsp bovis AF2122/97
ggcguggcccucggcga

SEQ ID NO: 3095882 - RNA, 15 nt, Mycobacterium bovis subsp bovis AF2122/97
ggcguggcgggggcu

SEQ ID NO: 3095883 - RNA, 23 nt, Mycobacterium bovis subsp bovis AF2122/97
ggcguggcugccuucggcgagcg

SEQ ID NO: 3095884 - RNA, 15 nt, Mycobacterium bovis subsp bovis AF2122/97
ggcgugggcaccccg

SEQ ID NO: 3095885 - RNA, 19 nt, Mycobacterium bovis subsp bovis AF2122/97
ggcgugggcaccccgcggu

SEQ ID NO: 3095886 - RNA, 14 nt, Mycobacterium bovis subsp bovis AF2122/97
ggcgugggccgcug

SEQ ID NO: 3095887 - RNA, 14 nt, Mycobacterium bovis subsp bovis AF2122/97
ggcgugggugucgg

SEQ ID NO: 3095888 - RNA, 19 nt, Mycobacterium bovis subsp bovis AF2122/97
ggcgugggugucggcuagc

SEQ ID NO: 3095889 - RNA, 22 nt, Mycobacterium bovis subsp bovis AF2122/97
ggcguggucaccccuucgccag

SEQ ID NO: 3095890 - RNA, 24 nt, Mycobacterium bovis subsp bovis AF2122/97
ggcguggucaccccuucgccagcg

SEQ ID NO: 3095891 - RNA, 19 nt, Mycobacterium bovis subsp bovis AF2122/97
ggcguggucgcgcggcacc

SEQ ID NO: 3095892 - RNA, 12 nt, Mycobacterium bovis subsp bovis AF2122/97
ggcguggucucg

SEQ ID NO: 3095893 - RNA, 16 nt, Mycobacterium bovis subsp bovis AF2122/97
ggcguggucucgguca

SEQ ID NO: 3095894 - RNA, 22 nt, Mycobacterium bovis subsp bovis AF2122/97
ggcguggugagccucggcgagc

SEQ ID NO: 3095895 - RNA, 14 nt, Mycobacterium bovis subsp bovis AF2122/97
ggcguguacgucga

SEQ ID NO: 3095896 - RNA, 16 nt, Mycobacterium bovis subsp bovis AF2122/97
ggcguguacgucgauc

SEQ ID NO: 3095897 - RNA, 18 nt, Mycobacterium bovis subsp bovis AF2122/97
ggcguguagccugcggcg

SEQ ID NO: 3095898 - RNA, 18 nt, Mycobacterium bovis subsp bovis AF2122/97
ggcgugucgccgccacca

SEQ ID NO: 3095899 - RNA, 17 nt, Mycobacterium bovis subsp bovis AF2122/97
ggcgugucgucgcggcc

SEQ ID NO: 3095900 - RNA, 22 nt, Mycobacterium bovis subsp bovis AF2122/97
ggcguguggcuuugacugcugg

SEQ ID NO: 3095901 - RNA, 20 nt, Mycobacterium bovis subsp bovis AF2122/97
ggcgugugugcgccuccggg

SEQ ID NO: 3095902 - RNA, 14 nt, Mycobacterium bovis subsp bovis AF2122/97
ggcguuacgcucgg

SEQ ID NO: 3095903 - RNA, 16 nt, Mycobacterium bovis subsp bovis AF2122/97
ggcguuacguggugga

SEQ ID NO: 3095904 - RNA, 19 nt, Mycobacterium bovis subsp bovis AF2122/97
ggcguuagcguagcccgag

SEQ ID NO: 3095905 - RNA, 17 nt, Mycobacterium bovis subsp bovis AF2122/97
ggcguuagucgaucacg

SEQ ID NO: 3095906 - RNA, 21 nt, Mycobacterium bovis subsp bovis AF2122/97
ggcguucaccacgaucgcgag

SEQ ID NO: 3095907 - RNA, 14 nt, Mycobacterium bovis subsp bovis AF2122/97
ggcguucagcggcc

SEQ ID NO: 3095908 - RNA, 18 nt, Mycobacterium bovis subsp bovis AF2122/97
ggcguucagcggccagca

SEQ ID NO: 3095909 - RNA, 19 nt, Mycobacterium bovis subsp bovis AF2122/97
ggcguucagcggccagcag

SEQ ID NO: 3095910 - RNA, 18 nt, Mycobacterium bovis subsp bovis AF2122/97
ggcguucccccacucgga

SEQ ID NO: 3095911 - RNA, 17 nt, Mycobacterium bovis subsp bovis AF2122/97
ggcguucccccggcacc

SEQ ID NO: 3095912 - RNA, 19 nt, Mycobacterium bovis subsp bovis AF2122/97
ggcguucccccggcaccgc

SEQ ID NO: 3095913 - RNA, 17 nt, Mycobacterium bovis subsp bovis AF2122/97
ggcguuccgggccgauc

SEQ ID NO: 3095914 - RNA, 18 nt, Mycobacterium bovis subsp bovis AF2122/97
ggcguucgacucgaccgc

SEQ ID NO: 3095915 - RNA, 16 nt, Mycobacterium bovis subsp bovis AF2122/97
ggcguucgccggggcg

SEQ ID NO: 3095916 - RNA, 21 nt, Mycobacterium bovis subsp bovis AF2122/97
ggcguucucgauugucgccgc

SEQ ID NO: 3095917 - RNA, 20 nt, Mycobacterium bovis subsp bovis AF2122/97
ggcguugaccagcacgacug

SEQ ID NO: 3095918 - RNA, 17 nt, Mycobacterium bovis subsp bovis AF2122/97
ggcguugagcuggcggu

SEQ ID NO: 3095919 - RNA, 18 nt, Mycobacterium bovis subsp bovis AF2122/97
ggcguugccaagauccuu

SEQ ID NO: 3095920 - RNA, 12 nt, Mycobacterium bovis subsp bovis AF2122/97
ggcguugccacc

SEQ ID NO: 3095921 - RNA, 14 nt, Mycobacterium bovis subsp bovis AF2122/97
ggcguugccaccgg

SEQ ID NO: 3095922 - RNA, 20 nt, Mycobacterium bovis subsp bovis AF2122/97
ggcguugccgaaacccgagu

SEQ ID NO: 3095923 - RNA, 12 nt, Mycobacterium bovis subsp bovis AF2122/97
ggcguugccgcc

SEQ ID NO: 3095924 - RNA, 22 nt, Mycobacterium bovis subsp bovis AF2122/97
ggcguugccgccguucccaccc

SEQ ID NO: 3095925 - RNA, 13 nt, Mycobacterium bovis subsp bovis AF2122/97
ggcguugccgccu

SEQ ID NO: 3095926 - RNA, 21 nt, Mycobacterium bovis subsp bovis AF2122/97
ggcguugcggaaucagcaccc

SEQ ID NO: 3095927 - RNA, 19 nt, Mycobacterium bovis subsp bovis AF2122/97
ggcguugcugaugucgccg

SEQ ID NO: 3095928 - RNA, 20 nt, Mycobacterium bovis subsp bovis AF2122/97
ggcguugcugaugucgccgg

SEQ ID NO: 3095929 - RNA, 14 nt, Mycobacterium bovis subsp bovis AF2122/97
ggcguuggcaugag

SEQ ID NO: 3095930 - RNA, 14 nt, Mycobacterium bovis subsp bovis AF2122/97
ggcguuggccagca

SEQ ID NO: 3095931 - RNA, 21 nt, Mycobacterium bovis subsp bovis AF2122/97
ggcguuggcgaucucgacggc

SEQ ID NO: 3095932 - RNA, 14 nt, Mycobacterium bovis subsp bovis AF2122/97
ggcguuggcgccgu

SEQ ID NO: 3095933 - RNA, 14 nt, Mycobacterium bovis subsp bovis AF2122/97
ggcguuggcggcaa

SEQ ID NO: 3095934 - RNA, 13 nt, Mycobacterium bovis subsp bovis AF2122/97
ggcguuggcggcu

SEQ ID NO: 3095935 - RNA, 20 nt, Mycobacterium bovis subsp bovis AF2122/97
ggcguugggaucgcgcagcg

SEQ ID NO: 3095936 - RNA, 20 nt, Mycobacterium bovis subsp bovis AF2122/97
ggcguugucgguuggcagcc

SEQ ID NO: 3095937 - RNA, 17 nt, Mycobacterium bovis subsp bovis AF2122/97
ggcguuguggcgugugg

SEQ ID NO: 3095938 - RNA, 19 nt, Mycobacterium bovis subsp bovis AF2122/97
ggcguuguugaccagcacg

SEQ ID NO: 3095939 - RNA, 20 nt, Mycobacterium bovis subsp bovis AF2122/97
ggcguuucccggguccugga

SEQ ID NO: 3095940 - RNA, 21 nt, Mycobacterium bovis subsp bovis AF2122/97
ggcguuucccugccgcugugg

SEQ ID NO: 3095941 - RNA, 22 nt, Mycobacterium bovis subsp bovis AF2122/97
ggcguuugagaacaacgggauc

SEQ ID NO: 3095942 - RNA, 16 nt, Mycobacterium bovis subsp bovis AF2122/97
ggcguuugaugcgggc

SEQ ID NO: 3095943 - RNA, 22 nt, Mycobacterium bovis subsp bovis AF2122/97
ggcguuuucaauuucacugcga

SEQ ID NO: 3095944 - RNA, 20 nt, Mycobacterium bovis subsp bovis AF2122/97
ggcguuuuccgggcuguucg

SEQ ID NO: 3095945 - RNA, 21 nt, Mycobacterium bovis subsp bovis AF2122/97
ggcguuuuccgggcuguucgc

SEQ ID NO: 3095946 - RNA, 16 nt, Mycobacterium bovis subsp bovis AF2122/97
ggcguuuucggugagc

SEQ ID NO: 3095947 - RNA, 14 nt, Mycobacterium bovis subsp bovis AF2122/97
ggcuaacaccgcag

SEQ ID NO: 3095948 - RNA, 22 nt, Mycobacterium bovis subsp bovis AF2122/97
ggcuaacuggacuggggcgcca

SEQ ID NO: 3095949 - RNA, 22 nt, Mycobacterium bovis subsp bovis AF2122/97
ggcuaagccuucggugucgccg

SEQ ID NO: 3095950 - RNA, 16 nt, Mycobacterium bovis subsp bovis AF2122/97
ggcuaauagcucgccg

SEQ ID NO: 3095951 - RNA, 17 nt, Mycobacterium bovis subsp bovis AF2122/97
ggcuaaucagccaggcc

SEQ ID NO: 3095952 - RNA, 15 nt, Mycobacterium bovis subsp bovis AF2122/97
ggcuacaucggcggc

SEQ ID NO: 3095953 - RNA, 17 nt, Mycobacterium bovis subsp bovis AF2122/97
ggcuacaucggcggcgu

SEQ ID NO: 3095954 - RNA, 20 nt, Mycobacterium bovis subsp bovis AF2122/97
ggcuacaucggcggcgucga

SEQ ID NO: 3095955 - RNA, 22 nt, Mycobacterium bovis subsp bovis AF2122/97
ggcuacaucggcggcgucgacg

SEQ ID NO: 3095956 - RNA, 18 nt, Mycobacterium bovis subsp bovis AF2122/97
ggcuacccaauaggcgaa

SEQ ID NO: 3095957 - RNA, 18 nt, Mycobacterium bovis subsp bovis AF2122/97
ggcuacccaccggccggu

SEQ ID NO: 3095958 - RNA, 22 nt, Mycobacterium bovis subsp bovis AF2122/97
ggcuaccccagggagugccgca

SEQ ID NO: 3095959 - RNA, 12 nt, Mycobacterium bovis subsp bovis AF2122/97
ggcuaccgccga

SEQ ID NO: 3095960 - RNA, 13 nt, Mycobacterium bovis subsp bovis AF2122/97
ggcuaccgccgac

SEQ ID NO: 3095961 - RNA, 20 nt, Mycobacterium bovis subsp bovis AF2122/97
ggcuaccgccuugucggcga

SEQ ID NO: 3095962 - RNA, 17 nt, Mycobacterium bovis subsp bovis AF2122/97
ggcuaccgcgcucccgg

SEQ ID NO: 3095963 - RNA, 14 nt, Mycobacterium bovis subsp bovis AF2122/97
ggcuaccggcagcu

SEQ ID NO: 3095964 - RNA, 15 nt, Mycobacterium bovis subsp bovis AF2122/97
ggcuaccggcgccgc

SEQ ID NO: 3095965 - RNA, 19 nt, Mycobacterium bovis subsp bovis AF2122/97
ggcuaccggcgccgcgcgg

SEQ ID NO: 3095966 - RNA, 12 nt, Mycobacterium bovis subsp bovis AF2122/97
ggcuaccggcgu

SEQ ID NO: 3095967 - RNA, 14 nt, Mycobacterium bovis subsp bovis AF2122/97
ggcuaccggcgugu

SEQ ID NO: 3095968 - RNA, 13 nt, Mycobacterium bovis subsp bovis AF2122/97
ggcuaccuaaccc

SEQ ID NO: 3095969 - RNA, 15 nt, Mycobacterium bovis subsp bovis AF2122/97
ggcuaccuaacccgc

SEQ ID NO: 3095970 - RNA, 16 nt, Mycobacterium bovis subsp bovis AF2122/97
ggcuaccuaacccgcg

SEQ ID NO: 3095971 - RNA, 17 nt, Mycobacterium bovis subsp bovis AF2122/97
ggcuaccuaacccgcgc

SEQ ID NO: 3095972 - RNA, 18 nt, Mycobacterium bovis subsp bovis AF2122/97
ggcuaccuaacccgcgcc

SEQ ID NO: 3095973 - RNA, 22 nt, Mycobacterium bovis subsp bovis AF2122/97
ggcuaccuaacccgcgccggcc

SEQ ID NO: 3095974 - RNA, 23 nt, Mycobacterium bovis subsp bovis AF2122/97
ggcuaccuaacccgcgccggccg

SEQ ID NO: 3095975 - RNA, 13 nt, Mycobacterium bovis subsp bovis AF2122/97
ggcuaccuuggac

SEQ ID NO: 3095976 - RNA, 15 nt, Mycobacterium bovis subsp bovis AF2122/97
ggcuacgccccacug

SEQ ID NO: 3095977 - RNA, 14 nt, Mycobacterium bovis subsp bovis AF2122/97
ggcuacgcgcgccc

SEQ ID NO: 3095978 - RNA, 17 nt, Mycobacterium bovis subsp bovis AF2122/97
ggcuacgcgcgcccgau

SEQ ID NO: 3095979 - RNA, 13 nt, Mycobacterium bovis subsp bovis AF2122/97
ggcuacggccagu

SEQ ID NO: 3095980 - RNA, 13 nt, Mycobacterium bovis subsp bovis AF2122/97
ggcuacggcgaca

SEQ ID NO: 3095981 - RNA, 13 nt, Mycobacterium bovis subsp bovis AF2122/97
ggcuacgggccgc

SEQ ID NO: 3095982 - RNA, 14 nt, Mycobacterium bovis subsp bovis AF2122/97
ggcuacgggccgcu

SEQ ID NO: 3095983 - RNA, 19 nt, Mycobacterium bovis subsp bovis AF2122/97
ggcuacuaggcccagcacg

SEQ ID NO: 3095984 - RNA, 22 nt, Mycobacterium bovis subsp bovis AF2122/97
ggcuacucgaaacccauguuug

SEQ ID NO: 3095985 - RNA, 23 nt, Mycobacterium bovis subsp bovis AF2122/97
ggcuagcgccgaucuucgcgcgc

SEQ ID NO: 3095986 - RNA, 23 nt, Mycobacterium bovis subsp bovis AF2122/97
ggcuagcugugcuucguugucgg

SEQ ID NO: 3095987 - RNA, 14 nt, Mycobacterium bovis subsp bovis AF2122/97
ggcuaggccagcac

SEQ ID NO: 3095988 - RNA, 19 nt, Mycobacterium bovis subsp bovis AF2122/97
ggcuagggcccuggcggcc

SEQ ID NO: 3095989 - RNA, 13 nt, Mycobacterium bovis subsp bovis AF2122/97
ggcuaggucagcg

SEQ ID NO: 3095990 - RNA, 15 nt, Mycobacterium bovis subsp bovis AF2122/97
ggcuagucggggugg

SEQ ID NO: 3095991 - RNA, 16 nt, Mycobacterium bovis subsp bovis AF2122/97
ggcuauggcgccgcgg

SEQ ID NO: 3095992 - RNA, 15 nt, Mycobacterium bovis subsp bovis AF2122/97
ggcuauggguucgcg

SEQ ID NO: 3095993 - RNA, 16 nt, Mycobacterium bovis subsp bovis AF2122/97
ggcuauuggccugaug

SEQ ID NO: 3095994 - RNA, 21 nt, Mycobacterium bovis subsp bovis AF2122/97
ggcucaaacggaauguagccg

SEQ ID NO: 3095995 - RNA, 18 nt, Mycobacterium bovis subsp bovis AF2122/97
ggcucaacaccgaguucc

SEQ ID NO: 3095996 - RNA, 16 nt, Mycobacterium bovis subsp bovis AF2122/97
ggcucaaccucuggcg

SEQ ID NO: 3095997 - RNA, 21 nt, Mycobacterium bovis subsp bovis AF2122/97
ggcucaaccucuggcggcggg

SEQ ID NO: 3095998 - RNA, 15 nt, Mycobacterium bovis subsp bovis AF2122/97
ggcucaaggacgcac

SEQ ID NO: 3095999 - RNA, 22 nt, Mycobacterium bovis subsp bovis AF2122/97
ggcucacacauagcgauucgcg

SEQ ID NO: 3096000 - RNA, 13 nt, Mycobacterium bovis subsp bovis AF2122/97
ggcucacagcaca

SEQ ID NO: 3096001 - RNA, 14 nt, Mycobacterium bovis subsp bovis AF2122/97
ggcucacagcacag

SEQ ID NO: 3096002 - RNA, 19 nt, Mycobacterium bovis subsp bovis AF2122/97
ggcucacagcacagcgcag

SEQ ID NO: 3096003 - RNA, 20 nt, Mycobacterium bovis subsp bovis AF2122/97
ggcucacagcacagcgcagc

SEQ ID NO: 3096004 - RNA, 16 nt, Mycobacterium bovis subsp bovis AF2122/97
ggcucaccaggcgagc

SEQ ID NO: 3096005 - RNA, 13 nt, Mycobacterium bovis subsp bovis AF2122/97
ggcucacccuugg

SEQ ID NO: 3096006 - RNA, 14 nt, Mycobacterium bovis subsp bovis AF2122/97
ggcucacccuugga

SEQ ID NO: 3096007 - RNA, 20 nt, Mycobacterium bovis subsp bovis AF2122/97
ggcucaccgaucccgcggcc

SEQ ID NO: 3096008 - RNA, 13 nt, Mycobacterium bovis subsp bovis AF2122/97
ggcucaccgcgca

SEQ ID NO: 3096009 - RNA, 22 nt, Mycobacterium bovis subsp bovis AF2122/97
ggcucacgaccggccaacgccg

SEQ ID NO: 3096010 - RNA, 16 nt, Mycobacterium bovis subsp bovis AF2122/97
ggcucacgcuccgccg

SEQ ID NO: 3096011 - RNA, 17 nt, Mycobacterium bovis subsp bovis AF2122/97
ggcucacgcuccgccgg

SEQ ID NO: 3096012 - RNA, 20 nt, Mycobacterium bovis subsp bovis AF2122/97
ggcucagaacccuccgcacc

SEQ ID NO: 3096013 - RNA, 15 nt, Mycobacterium bovis subsp bovis AF2122/97
ggcucagcagcgccg

SEQ ID NO: 3096014 - RNA, 19 nt, Mycobacterium bovis subsp bovis AF2122/97
ggcucagcagcgccgcgcg

SEQ ID NO: 3096015 - RNA, 21 nt, Mycobacterium bovis subsp bovis AF2122/97
ggcucagcagcgccgcgcggg

SEQ ID NO: 3096016 - RNA, 15 nt, Mycobacterium bovis subsp bovis AF2122/97
ggcucagcgguggcg

SEQ ID NO: 3096017 - RNA, 15 nt, Mycobacterium bovis subsp bovis AF2122/97
ggcucagcgugcgcu

SEQ ID NO: 3096018 - RNA, 17 nt, Mycobacterium bovis subsp bovis AF2122/97
ggcucagcugguggcgg

SEQ ID NO: 3096019 - RNA, 17 nt, Mycobacterium bovis subsp bovis AF2122/97
ggcucaggugcucagcu

SEQ ID NO: 3096020 - RNA, 20 nt, Mycobacterium bovis subsp bovis AF2122/97
ggcucagucacgcacucccg

SEQ ID NO: 3096021 - RNA, 11 nt, Mycobacterium bovis subsp bovis AF2122/97
ggcucauggca

SEQ ID NO: 3096022 - RNA, 12 nt, Mycobacterium bovis subsp bovis AF2122/97
ggcucauggcau

SEQ ID NO: 3096023 - RNA, 14 nt, Mycobacterium bovis subsp bovis AF2122/97
ggcuccaacgaugg

SEQ ID NO: 3096024 - RNA, 15 nt, Mycobacterium bovis subsp bovis AF2122/97
ggcuccaauugcggc

SEQ ID NO: 3096025 - RNA, 18 nt, Mycobacterium bovis subsp bovis AF2122/97
ggcuccaauugcggccgc

SEQ ID NO: 3096026 - RNA, 21 nt, Mycobacterium bovis subsp bovis AF2122/97
ggcuccaauugcggccgcgcg

SEQ ID NO: 3096027 - RNA, 20 nt, Mycobacterium bovis subsp bovis AF2122/97
ggcuccacccuugccgcugg

SEQ ID NO: 3096028 - RNA, 14 nt, Mycobacterium bovis subsp bovis AF2122/97
ggcuccaccgggcc

SEQ ID NO: 3096029 - RNA, 20 nt, Mycobacterium bovis subsp bovis AF2122/97
ggcuccaccgggcccgccgg

SEQ ID NO: 3096030 - RNA, 21 nt, Mycobacterium bovis subsp bovis AF2122/97
ggcuccaccgggcccgccggc

SEQ ID NO: 3096031 - RNA, 19 nt, Mycobacterium bovis subsp bovis AF2122/97
ggcuccacuuggggcgcca

SEQ ID NO: 3096032 - RNA, 16 nt, Mycobacterium bovis subsp bovis AF2122/97
ggcuccagcgcgcgcc

SEQ ID NO: 3096033 - RNA, 21 nt, Mycobacterium bovis subsp bovis AF2122/97
ggcuccagcgcgcgccgcagc

SEQ ID NO: 3096034 - RNA, 21 nt, Mycobacterium bovis subsp bovis AF2122/97
ggcuccaucgucugguggcag

SEQ ID NO: 3096035 - RNA, 15 nt, Mycobacterium bovis subsp bovis AF2122/97
ggcucccccaccagg

SEQ ID NO: 3096036 - RNA, 13 nt, Mycobacterium bovis subsp bovis AF2122/97
ggcuccccggcaa

SEQ ID NO: 3096037 - RNA, 19 nt, Mycobacterium bovis subsp bovis AF2122/97
ggcucccgcaauggggcgc

SEQ ID NO: 3096038 - RNA, 18 nt, Mycobacterium bovis subsp bovis AF2122/97
ggcucccggggguuccac

SEQ ID NO: 3096039 - RNA, 17 nt, Mycobacterium bovis subsp bovis AF2122/97
ggcucccuuuuccaaag

SEQ ID NO: 3096040 - RNA, 22 nt, Mycobacterium bovis subsp bovis AF2122/97
ggcuccgaacauggccagcauc

SEQ ID NO: 3096041 - RNA, 21 nt, Mycobacterium bovis subsp bovis AF2122/97
ggcuccgacgaaacucucccg

SEQ ID NO: 3096042 - RNA, 12 nt, Mycobacterium bovis subsp bovis AF2122/97
ggcuccgcagcg

SEQ ID NO: 3096043 - RNA, 17 nt, Mycobacterium bovis subsp bovis AF2122/97
ggcuccgcagcgaagac

SEQ ID NO: 3096044 - RNA, 22 nt, Mycobacterium bovis subsp bovis AF2122/97
ggcuccgccacuggcgccggug

SEQ ID NO: 3096045 - RNA, 20 nt, Mycobacterium bovis subsp bovis AF2122/97
ggcuccgcccggcgugucgc

SEQ ID NO: 3096046 - RNA, 22 nt, Mycobacterium bovis subsp bovis AF2122/97
ggcuccgcccggcgugucgccg

SEQ ID NO: 3096047 - RNA, 16 nt, Mycobacterium bovis subsp bovis AF2122/97
ggcuccgccgcgggcu

SEQ ID NO: 3096048 - RNA, 15 nt, Mycobacterium bovis subsp bovis AF2122/97
ggcuccgccguugcc

SEQ ID NO: 3096049 - RNA, 16 nt, Mycobacterium bovis subsp bovis AF2122/97
ggcuccgccguugccg

SEQ ID NO: 3096050 - RNA, 18 nt, Mycobacterium bovis subsp bovis AF2122/97
ggcuccgccguugccgcc

SEQ ID NO: 3096051 - RNA, 12 nt, Mycobacterium bovis subsp bovis AF2122/97
ggcuccggccgc

SEQ ID NO: 3096052 - RNA, 17 nt, Mycobacterium bovis subsp bovis AF2122/97
ggcuccggccggccagc

SEQ ID NO: 3096053 - RNA, 18 nt, Mycobacterium bovis subsp bovis AF2122/97
ggcuccggccggccagca

SEQ ID NO: 3096054 - RNA, 19 nt, Mycobacterium bovis subsp bovis AF2122/97
ggcuccggccggccagcac

SEQ ID NO: 3096055 - RNA, 20 nt, Mycobacterium bovis subsp bovis AF2122/97
ggcuccggccggccagcacc

SEQ ID NO: 3096056 - RNA, 16 nt, Mycobacterium bovis subsp bovis AF2122/97
ggcuccggcggcagcg

SEQ ID NO: 3096057 - RNA, 17 nt, Mycobacterium bovis subsp bovis AF2122/97
ggcuccggcggcagcgg

SEQ ID NO: 3096058 - RNA, 18 nt, Mycobacterium bovis subsp bovis AF2122/97
ggcuccggcggcagcggc

SEQ ID NO: 3096059 - RNA, 20 nt, Mycobacterium bovis subsp bovis AF2122/97
ggcuccggcggcagcggcgc

SEQ ID NO: 3096060 - RNA, 23 nt, Mycobacterium bovis subsp bovis AF2122/97
ggcuccggcggcagcggcgccgc

SEQ ID NO: 3096061 - RNA, 14 nt, Mycobacterium bovis subsp bovis AF2122/97
ggcuccggcggugc

SEQ ID NO: 3096062 - RNA, 16 nt, Mycobacterium bovis subsp bovis AF2122/97
ggcuccggcggugccg

SEQ ID NO: 3096063 - RNA, 23 nt, Mycobacterium bovis subsp bovis AF2122/97
ggcuccggcggugccgucgccgc

SEQ ID NO: 3096064 - RNA, 16 nt, Mycobacterium bovis subsp bovis AF2122/97
ggcuccgggacgguga

SEQ ID NO: 3096065 - RNA, 17 nt, Mycobacterium bovis subsp bovis AF2122/97
ggcuccgggaugaagcu

SEQ ID NO: 3096066 - RNA, 20 nt, Mycobacterium bovis subsp bovis AF2122/97
ggcuccgggaugaagcucga

SEQ ID NO: 3096067 - RNA, 16 nt, Mycobacterium bovis subsp bovis AF2122/97
ggcuccgggcgcucgg

SEQ ID NO: 3096068 - RNA, 17 nt, Mycobacterium bovis subsp bovis AF2122/97
ggcuccgggcgcucggu

SEQ ID NO: 3096069 - RNA, 17 nt, Mycobacterium bovis subsp bovis AF2122/97
ggcuccguuguccagcg

SEQ ID NO: 3096070 - RNA, 23 nt, Mycobacterium bovis subsp bovis AF2122/97
ggcuccguuguccagcgcgacgu

SEQ ID NO: 3096071 - RNA, 19 nt, Mycobacterium bovis subsp bovis AF2122/97
ggcuccuccccggcccgcu

SEQ ID NO: 3096072 - RNA, 21 nt, Mycobacterium bovis subsp bovis AF2122/97
ggcuccuggucgccgugggcc

SEQ ID NO: 3096073 - RNA, 21 nt, Mycobacterium bovis subsp bovis AF2122/97
ggcucgaaccgacgcguccgg

SEQ ID NO: 3096074 - RNA, 16 nt, Mycobacterium bovis subsp bovis AF2122/97
ggcucgaauacggugc

SEQ ID NO: 3096075 - RNA, 15 nt, Mycobacterium bovis subsp bovis AF2122/97
ggcucgacgcgucgc

SEQ ID NO: 3096076 - RNA, 19 nt, Mycobacterium bovis subsp bovis AF2122/97
ggcucgagcaagaucaccu

SEQ ID NO: 3096077 - RNA, 15 nt, Mycobacterium bovis subsp bovis AF2122/97
ggcucgagcucggcg

SEQ ID NO: 3096078 - RNA, 16 nt, Mycobacterium bovis subsp bovis AF2122/97
ggcucgagcucggcga

SEQ ID NO: 3096079 - RNA, 18 nt, Mycobacterium bovis subsp bovis AF2122/97
ggcucgagcucggcgaug

SEQ ID NO: 3096080 - RNA, 16 nt, Mycobacterium bovis subsp bovis AF2122/97
ggcucgagucgcagca

SEQ ID NO: 3096081 - RNA, 22 nt, Mycobacterium bovis subsp bovis AF2122/97
ggcucgagucgcagcacgggug

SEQ ID NO: 3096082 - RNA, 22 nt, Mycobacterium bovis subsp bovis AF2122/97
ggcucgaguguggccgaaagcc

SEQ ID NO: 3096083 - RNA, 17 nt, Mycobacterium bovis subsp bovis AF2122/97
ggcucgauguccucgag

SEQ ID NO: 3096084 - RNA, 18 nt, Mycobacterium bovis subsp bovis AF2122/97
ggcucgcauguucuccac

SEQ ID NO: 3096085 - RNA, 20 nt, Mycobacterium bovis subsp bovis AF2122/97
ggcucgcauguucuccacgc

SEQ ID NO: 3096086 - RNA, 23 nt, Mycobacterium bovis subsp bovis AF2122/97
ggcucgcauguucuccacgccga

SEQ ID NO: 3096087 - RNA, 16 nt, Mycobacterium bovis subsp bovis AF2122/97
ggcucgcauucggcga

SEQ ID NO: 3096088 - RNA, 16 nt, Mycobacterium bovis subsp bovis AF2122/97
ggcucgccaguucgcg

SEQ ID NO: 3096089 - RNA, 21 nt, Mycobacterium bovis subsp bovis AF2122/97
ggcucgccgaaaagggcgaca

SEQ ID NO: 3096090 - RNA, 13 nt, Mycobacterium bovis subsp bovis AF2122/97
ggcucgccgaacc

SEQ ID NO: 3096091 - RNA, 13 nt, Mycobacterium bovis subsp bovis AF2122/97
ggcucgccggcga

SEQ ID NO: 3096092 - RNA, 14 nt, Mycobacterium bovis subsp bovis AF2122/97
ggcucgccggcgac

SEQ ID NO: 3096093 - RNA, 17 nt, Mycobacterium bovis subsp bovis AF2122/97
ggcucgccggcgaccgg

SEQ ID NO: 3096094 - RNA, 16 nt, Mycobacterium bovis subsp bovis AF2122/97
ggcucgccggcggccc

SEQ ID NO: 3096095 - RNA, 19 nt, Mycobacterium bovis subsp bovis AF2122/97
ggcucgccggcggcccgcu

SEQ ID NO: 3096096 - RNA, 20 nt, Mycobacterium bovis subsp bovis AF2122/97
ggcucgccggcggcccgcuc

SEQ ID NO: 3096097 - RNA, 21 nt, Mycobacterium bovis subsp bovis AF2122/97
ggcucgcgcucgauggcggcc

SEQ ID NO: 3096098 - RNA, 24 nt, Mycobacterium bovis subsp bovis AF2122/97
ggcucgcgcucgauggcggccacc

SEQ ID NO: 3096099 - RNA, 17 nt, Mycobacterium bovis subsp bovis AF2122/97
ggcucgcguggccgccg

SEQ ID NO: 3096100 - RNA, 21 nt, Mycobacterium bovis subsp bovis AF2122/97
ggcucgcguggccgccggcgc

SEQ ID NO: 3096101 - RNA, 15 nt, Mycobacterium bovis subsp bovis AF2122/97
ggcucgcucgccgag

SEQ ID NO: 3096102 - RNA, 17 nt, Mycobacterium bovis subsp bovis AF2122/97
ggcucgcucgccgagcu

SEQ ID NO: 3096103 - RNA, 21 nt, Mycobacterium bovis subsp bovis AF2122/97
ggcucgcucgccgagcugugc

SEQ ID NO: 3096104 - RNA, 17 nt, Mycobacterium bovis subsp bovis AF2122/97
ggcucggccagccagcg

SEQ ID NO: 3096105 - RNA, 18 nt, Mycobacterium bovis subsp bovis AF2122/97
ggcucggccagccagcgg

SEQ ID NO: 3096106 - RNA, 20 nt, Mycobacterium bovis subsp bovis AF2122/97
ggcucggccagccagcgggc

SEQ ID NO: 3096107 - RNA, 15 nt, Mycobacterium bovis subsp bovis AF2122/97
ggcucggcccccgag

SEQ ID NO: 3096108 - RNA, 13 nt, Mycobacterium bovis subsp bovis AF2122/97
ggcucggccggag

SEQ ID NO: 3096109 - RNA, 19 nt, Mycobacterium bovis subsp bovis AF2122/97
ggcucggcgaaacccggga

SEQ ID NO: 3096110 - RNA, 21 nt, Mycobacterium bovis subsp bovis AF2122/97
ggcucggcgaaacccgggauc

SEQ ID NO: 3096111 - RNA, 15 nt, Mycobacterium bovis subsp bovis AF2122/97
ggcucggcgcagcac

SEQ ID NO: 3096112 - RNA, 12 nt, Mycobacterium bovis subsp bovis AF2122/97
ggcucggcggcc

SEQ ID NO: 3096113 - RNA, 15 nt, Mycobacterium bovis subsp bovis AF2122/97
ggcucggcggcccgg

SEQ ID NO: 3096114 - RNA, 21 nt, Mycobacterium bovis subsp bovis AF2122/97
ggcucgggcaaggccaccggc

SEQ ID NO: 3096115 - RNA, 22 nt, Mycobacterium bovis subsp bovis AF2122/97
ggcucgggcaaggccaccggcg

SEQ ID NO: 3096116 - RNA, 13 nt, Mycobacterium bovis subsp bovis AF2122/97
ggcucgggcagcg

SEQ ID NO: 3096117 - RNA, 18 nt, Mycobacterium bovis subsp bovis AF2122/97
ggcucgggugcgcccggc

SEQ ID NO: 3096118 - RNA, 18 nt, Mycobacterium bovis subsp bovis AF2122/97
ggcucggugacccccgag

SEQ ID NO: 3096119 - RNA, 16 nt, Mycobacterium bovis subsp bovis AF2122/97
ggcucgguggcgccgg

SEQ ID NO: 3096120 - RNA, 19 nt, Mycobacterium bovis subsp bovis AF2122/97
ggcucguaggugggcucgu

SEQ ID NO: 3096121 - RNA, 24 nt, Mycobacterium bovis subsp bovis AF2122/97
ggcucguaggugggcucguagcgc

SEQ ID NO: 3096122 - RNA, 20 nt, Mycobacterium bovis subsp bovis AF2122/97
ggcucgucagguuccgcgac

SEQ ID NO: 3096123 - RNA, 21 nt, Mycobacterium bovis subsp bovis AF2122/97
ggcucgucagguuccgcgaca

SEQ ID NO: 3096124 - RNA, 22 nt, Mycobacterium bovis subsp bovis AF2122/97
ggcucgucgaguggaucacaca

SEQ ID NO: 3096125 - RNA, 16 nt, Mycobacterium bovis subsp bovis AF2122/97
ggcucgucgauccccg

SEQ ID NO: 3096126 - RNA, 19 nt, Mycobacterium bovis subsp bovis AF2122/97
ggcucgucgaugucgacgu

SEQ ID NO: 3096127 - RNA, 16 nt, Mycobacterium bovis subsp bovis AF2122/97
ggcucgugcgcuuggu

SEQ ID NO: 3096128 - RNA, 19 nt, Mycobacterium bovis subsp bovis AF2122/97
ggcucguggcgacggcguc

SEQ ID NO: 3096129 - RNA, 21 nt, Mycobacterium bovis subsp bovis AF2122/97
ggcucguguccgccgucaccc

SEQ ID NO: 3096130 - RNA, 16 nt, Mycobacterium bovis subsp bovis AF2122/97
ggcucguugcgggcgg

SEQ ID NO: 3096131 - RNA, 16 nt, Mycobacterium bovis subsp bovis AF2122/97
ggcucuacucgcggcc

SEQ ID NO: 3096132 - RNA, 22 nt, Mycobacterium bovis subsp bovis AF2122/97
ggcucuacucgcggccggcguc

SEQ ID NO: 3096133 - RNA, 19 nt, Mycobacterium bovis subsp bovis AF2122/97
ggcucuagaucgccgagcg

SEQ ID NO: 3096134 - RNA, 14 nt, Mycobacterium bovis subsp bovis AF2122/97
ggcucuaucagacg

SEQ ID NO: 3096135 - RNA, 16 nt, Mycobacterium bovis subsp bovis AF2122/97
ggcucucacgagcggc

SEQ ID NO: 3096136 - RNA, 23 nt, Mycobacterium bovis subsp bovis AF2122/97
ggcucucgaguccaggcagcuug

SEQ ID NO: 3096137 - RNA, 13 nt, Mycobacterium bovis subsp bovis AF2122/97
ggcucucggcguc

SEQ ID NO: 3096138 - RNA, 20 nt, Mycobacterium bovis subsp bovis AF2122/97
ggcucucggugguccagcgc

SEQ ID NO: 3096139 - RNA, 21 nt, Mycobacterium bovis subsp bovis AF2122/97
ggcucucggugguccagcgcu

SEQ ID NO: 3096140 - RNA, 16 nt, Mycobacterium bovis subsp bovis AF2122/97
ggcucucuucgcgcgc

SEQ ID NO: 3096141 - RNA, 19 nt, Mycobacterium bovis subsp bovis AF2122/97
ggcucucuucgcgcgcugg

SEQ ID NO: 3096142 - RNA, 20 nt, Mycobacterium bovis subsp bovis AF2122/97
ggcucucuucgcgcgcuggg

SEQ ID NO: 3096143 - RNA, 19 nt, Mycobacterium bovis subsp bovis AF2122/97
ggcucugaggucaccggcg

SEQ ID NO: 3096144 - RNA, 22 nt, Mycobacterium bovis subsp bovis AF2122/97
ggcucugaggucaccggcgacc

SEQ ID NO: 3096145 - RNA, 14 nt, Mycobacterium bovis subsp bovis AF2122/97
ggcucuucgcggau

SEQ ID NO: 3096146 - RNA, 18 nt, Mycobacterium bovis subsp bovis AF2122/97
ggcugaaacauccccgag

SEQ ID NO: 3096147 - RNA, 18 nt, Mycobacterium bovis subsp bovis AF2122/97
ggcugaaaccuugcggca

SEQ ID NO: 3096148 - RNA, 13 nt, Mycobacterium bovis subsp bovis AF2122/97
ggcugaacaccgc

SEQ ID NO: 3096149 - RNA, 14 nt, Mycobacterium bovis subsp bovis AF2122/97
ggcugaacaccgcg

SEQ ID NO: 3096150 - RNA, 18 nt, Mycobacterium bovis subsp bovis AF2122/97
ggcugaaggacggcagcu

SEQ ID NO: 3096151 - RNA, 20 nt, Mycobacterium bovis subsp bovis AF2122/97
ggcugacaacgacaacaccc

SEQ ID NO: 3096152 - RNA, 23 nt, Mycobacterium bovis subsp bovis AF2122/97
ggcugacaacgacaacacccacg

SEQ ID NO: 3096153 - RNA, 14 nt, Mycobacterium bovis subsp bovis AF2122/97
ggcugaccaaccca

SEQ ID NO: 3096154 - RNA, 19 nt, Mycobacterium bovis subsp bovis AF2122/97
ggcugaccgaagaagcccg

SEQ ID NO: 3096155 - RNA, 20 nt, Mycobacterium bovis subsp bovis AF2122/97
ggcugaccgaagaagcccga

SEQ ID NO: 3096156 - RNA, 20 nt, Mycobacterium bovis subsp bovis AF2122/97
ggcugaccgaauggccgccg

SEQ ID NO: 3096157 - RNA, 21 nt, Mycobacterium bovis subsp bovis AF2122/97
ggcugaccgaauggccgccgc

SEQ ID NO: 3096158 - RNA, 14 nt, Mycobacterium bovis subsp bovis AF2122/97
ggcugaccgacccg

SEQ ID NO: 3096159 - RNA, 17 nt, Mycobacterium bovis subsp bovis AF2122/97
ggcugaccggggcgccc

SEQ ID NO: 3096160 - RNA, 21 nt, Mycobacterium bovis subsp bovis AF2122/97
ggcugaccggggcgcccggcc

SEQ ID NO: 3096161 - RNA, 13 nt, Mycobacterium bovis subsp bovis AF2122/97
ggcugaccggggu

SEQ ID NO: 3096162 - RNA, 21 nt, Mycobacterium bovis subsp bovis AF2122/97
ggcugaccggggucggccugc

SEQ ID NO: 3096163 - RNA, 13 nt, Mycobacterium bovis subsp bovis AF2122/97
ggcugaccuccca

SEQ ID NO: 3096164 - RNA, 16 nt, Mycobacterium bovis subsp bovis AF2122/97
ggcugacgaucuccac

SEQ ID NO: 3096165 - RNA, 23 nt, Mycobacterium bovis subsp bovis AF2122/97
ggcugagacgguguugcucgccg

SEQ ID NO: 3096166 - RNA, 13 nt, Mycobacterium bovis subsp bovis AF2122/97
ggcugagcagcgc

SEQ ID NO: 3096167 - RNA, 17 nt, Mycobacterium bovis subsp bovis AF2122/97
ggcugagcagcgcggcc

SEQ ID NO: 3096168 - RNA, 13 nt, Mycobacterium bovis subsp bovis AF2122/97
ggcugagcccgcc

SEQ ID NO: 3096169 - RNA, 14 nt, Mycobacterium bovis subsp bovis AF2122/97
ggcugagcccgccg

SEQ ID NO: 3096170 - RNA, 16 nt, Mycobacterium bovis subsp bovis AF2122/97
ggcugagcccgccgcg

SEQ ID NO: 3096171 - RNA, 18 nt, Mycobacterium bovis subsp bovis AF2122/97
ggcugagcccgccgcgac

SEQ ID NO: 3096172 - RNA, 23 nt, Mycobacterium bovis subsp bovis AF2122/97
ggcugagccgcaucuggccggcg

SEQ ID NO: 3096173 - RNA, 17 nt, Mycobacterium bovis subsp bovis AF2122/97
ggcugaggaacgccggc

SEQ ID NO: 3096174 - RNA, 19 nt, Mycobacterium bovis subsp bovis AF2122/97
ggcugaggaacgccggcau

SEQ ID NO: 3096175 - RNA, 21 nt, Mycobacterium bovis subsp bovis AF2122/97
ggcugaggcggcgacgaccgu

SEQ ID NO: 3096176 - RNA, 15 nt, Mycobacterium bovis subsp bovis AF2122/97
ggcugaucccggcca

SEQ ID NO: 3096177 - RNA, 19 nt, Mycobacterium bovis subsp bovis AF2122/97
ggcugaucccggccaggcc

SEQ ID NO: 3096178 - RNA, 18 nt, Mycobacterium bovis subsp bovis AF2122/97
ggcugauggcggcgaccc

SEQ ID NO: 3096179 - RNA, 15 nt, Mycobacterium bovis subsp bovis AF2122/97
ggcugauucgagcca

SEQ ID NO: 3096180 - RNA, 13 nt, Mycobacterium bovis subsp bovis AF2122/97
ggcugauuggccc

SEQ ID NO: 3096181 - RNA, 14 nt, Mycobacterium bovis subsp bovis AF2122/97
ggcugauuggccca

SEQ ID NO: 3096182 - RNA, 19 nt, Mycobacterium bovis subsp bovis AF2122/97
ggcugauuggcccaccgcc

SEQ ID NO: 3096183 - RNA, 18 nt, Mycobacterium bovis subsp bovis AF2122/97
ggcugcaaccagcggcac

SEQ ID NO: 3096184 - RNA, 19 nt, Mycobacterium bovis subsp bovis AF2122/97
ggcugcaaccagcggcaca

SEQ ID NO: 3096185 - RNA, 15 nt, Mycobacterium bovis subsp bovis AF2122/97
ggcugcacgcucguu

SEQ ID NO: 3096186 - RNA, 15 nt, Mycobacterium bovis subsp bovis AF2122/97
ggcugcacgcugcgg

SEQ ID NO: 3096187 - RNA, 20 nt, Mycobacterium bovis subsp bovis AF2122/97
ggcugcaguaaaugggccuc

SEQ ID NO: 3096188 - RNA, 14 nt, Mycobacterium bovis subsp bovis AF2122/97
ggcugcagugccgc

SEQ ID NO: 3096189 - RNA, 15 nt, Mycobacterium bovis subsp bovis AF2122/97
ggcugcagugccgca

SEQ ID NO: 3096190 - RNA, 21 nt, Mycobacterium bovis subsp bovis AF2122/97
ggcugcagugccgcacccaga

SEQ ID NO: 3096191 - RNA, 22 nt, Mycobacterium bovis subsp bovis AF2122/97
ggcugccagcgccgccgccgac

SEQ ID NO: 3096192 - RNA, 21 nt, Mycobacterium bovis subsp bovis AF2122/97
ggcugccagugccgcccacca

SEQ ID NO: 3096193 - RNA, 22 nt, Mycobacterium bovis subsp bovis AF2122/97
ggcugccauuccagaucaacgc

SEQ ID NO: 3096194 - RNA, 14 nt, Mycobacterium bovis subsp bovis AF2122/97
ggcugccccuccgg

SEQ ID NO: 3096195 - RNA, 12 nt, Mycobacterium bovis subsp bovis AF2122/97
ggcugcccgcgg

SEQ ID NO: 3096196 - RNA, 22 nt, Mycobacterium bovis subsp bovis AF2122/97
ggcugcccguucugcccaggca

SEQ ID NO: 3096197 - RNA, 20 nt, Mycobacterium bovis subsp bovis AF2122/97
ggcugccgaaguugaagaag

SEQ ID NO: 3096198 - RNA, 19 nt, Mycobacterium bovis subsp bovis AF2122/97
ggcugccgcaaacgcggcg

SEQ ID NO: 3096199 - RNA, 22 nt, Mycobacterium bovis subsp bovis AF2122/97
ggcugccgcaaacgcggcgucg

SEQ ID NO: 3096200 - RNA, 23 nt, Mycobacterium bovis subsp bovis AF2122/97
ggcugccgcaaacgcggcgucga

SEQ ID NO: 3096201 - RNA, 20 nt, Mycobacterium bovis subsp bovis AF2122/97
ggcugccgcaugcgcuccgg

SEQ ID NO: 3096202 - RNA, 21 nt, Mycobacterium bovis subsp bovis AF2122/97
ggcugccgcccaugccgggau

SEQ ID NO: 3096203 - RNA, 14 nt, Mycobacterium bovis subsp bovis AF2122/97
ggcugccgccguug

SEQ ID NO: 3096204 - RNA, 21 nt, Mycobacterium bovis subsp bovis AF2122/97
ggcugccgccguugccgucgu

SEQ ID NO: 3096205 - RNA, 20 nt, Mycobacterium bovis subsp bovis AF2122/97
ggcugccgcugcgccgucgc

SEQ ID NO: 3096206 - RNA, 22 nt, Mycobacterium bovis subsp bovis AF2122/97
ggcugccguugauucggccgcc

SEQ ID NO: 3096207 - RNA, 23 nt, Mycobacterium bovis subsp bovis AF2122/97
ggcugccguugauucggccgccg

SEQ ID NO: 3096208 - RNA, 15 nt, Mycobacterium bovis subsp bovis AF2122/97
ggcugccuucggcga

SEQ ID NO: 3096209 - RNA, 17 nt, Mycobacterium bovis subsp bovis AF2122/97
ggcugccuucggcgagc

SEQ ID NO: 3096210 - RNA, 22 nt, Mycobacterium bovis subsp bovis AF2122/97
ggcugcgacaggacgucggcga

SEQ ID NO: 3096211 - RNA, 15 nt, Mycobacterium bovis subsp bovis AF2122/97
ggcugcgaccggcuc

SEQ ID NO: 3096212 - RNA, 18 nt, Mycobacterium bovis subsp bovis AF2122/97
ggcugcgaccggcuccgg

SEQ ID NO: 3096213 - RNA, 13 nt, Mycobacterium bovis subsp bovis AF2122/97
ggcugcgcaguga

SEQ ID NO: 3096214 - RNA, 19 nt, Mycobacterium bovis subsp bovis AF2122/97
ggcugcgccgaacaccaca

SEQ ID NO: 3096215 - RNA, 13 nt, Mycobacterium bovis subsp bovis AF2122/97
ggcugcgccggaa

SEQ ID NO: 3096216 - RNA, 14 nt, Mycobacterium bovis subsp bovis AF2122/97
ggcugcgcgcucgg

SEQ ID NO: 3096217 - RNA, 20 nt, Mycobacterium bovis subsp bovis AF2122/97
ggcugcgcgucgagcagcac

SEQ ID NO: 3096218 - RNA, 19 nt, Mycobacterium bovis subsp bovis AF2122/97
ggcugcgcuacccagcgcg

SEQ ID NO: 3096219 - RNA, 17 nt, Mycobacterium bovis subsp bovis AF2122/97
ggcugcgcucgcccgcg

SEQ ID NO: 3096220 - RNA, 18 nt, Mycobacterium bovis subsp bovis AF2122/97
ggcugcgcucgcccgcgg

SEQ ID NO: 3096221 - RNA, 22 nt, Mycobacterium bovis subsp bovis AF2122/97
ggcugcgcuuugcacagcggca

SEQ ID NO: 3096222 - RNA, 18 nt, Mycobacterium bovis subsp bovis AF2122/97
ggcugcggaugcgcggcg

SEQ ID NO: 3096223 - RNA, 19 nt, Mycobacterium bovis subsp bovis AF2122/97
ggcugcggaugcgcggcgg

SEQ ID NO: 3096224 - RNA, 13 nt, Mycobacterium bovis subsp bovis AF2122/97
ggcugcggccgcg

SEQ ID NO: 3096225 - RNA, 21 nt, Mycobacterium bovis subsp bovis AF2122/97
ggcugcgucgucugcagaccu

SEQ ID NO: 3096226 - RNA, 14 nt, Mycobacterium bovis subsp bovis AF2122/97
ggcugcguggcggg

SEQ ID NO: 3096227 - RNA, 15 nt, Mycobacterium bovis subsp bovis AF2122/97
ggcugcguuggcugg

SEQ ID NO: 3096228 - RNA, 12 nt, Mycobacterium bovis subsp bovis AF2122/97
ggcugcuccugg

SEQ ID NO: 3096229 - RNA, 13 nt, Mycobacterium bovis subsp bovis AF2122/97
ggcugcucgacgg

SEQ ID NO: 3096230 - RNA, 14 nt, Mycobacterium bovis subsp bovis AF2122/97
ggcugcucgacggc

SEQ ID NO: 3096231 - RNA, 13 nt, Mycobacterium bovis subsp bovis AF2122/97
ggcugcugcgcgg

SEQ ID NO: 3096232 - RNA, 16 nt, Mycobacterium bovis subsp bovis AF2122/97
ggcugcugcgcggugc

SEQ ID NO: 3096233 - RNA, 23 nt, Mycobacterium bovis subsp bovis AF2122/97
ggcugcugcgcggugccggccgu

SEQ ID NO: 3096234 - RNA, 14 nt, Mycobacterium bovis subsp bovis AF2122/97
ggcugcuguuggua

SEQ ID NO: 3096235 - RNA, 21 nt, Mycobacterium bovis subsp bovis AF2122/97
ggcugcuuggucgcccagcca

SEQ ID NO: 3096236 - RNA, 18 nt, Mycobacterium bovis subsp bovis AF2122/97
ggcuggaccacucgccgg

SEQ ID NO: 3096237 - RNA, 21 nt, Mycobacterium bovis subsp bovis AF2122/97
ggcuggaccacucgccggcgg

SEQ ID NO: 3096238 - RNA, 14 nt, Mycobacterium bovis subsp bovis AF2122/97
ggcuggacggcgcc

SEQ ID NO: 3096239 - RNA, 16 nt, Mycobacterium bovis subsp bovis AF2122/97
ggcuggcaccucccgg

SEQ ID NO: 3096240 - RNA, 17 nt, Mycobacterium bovis subsp bovis AF2122/97
ggcuggcaucccgggca

SEQ ID NO: 3096241 - RNA, 22 nt, Mycobacterium bovis subsp bovis AF2122/97
ggcuggcaucccgggcagucca

SEQ ID NO: 3096242 - RNA, 12 nt, Mycobacterium bovis subsp bovis AF2122/97
ggcuggccagca

SEQ ID NO: 3096243 - RNA, 15 nt, Mycobacterium bovis subsp bovis AF2122/97
ggcuggccagcacgc

SEQ ID NO: 3096244 - RNA, 16 nt, Mycobacterium bovis subsp bovis AF2122/97
ggcuggccagcacgcc

SEQ ID NO: 3096245 - RNA, 17 nt, Mycobacterium bovis subsp bovis AF2122/97
ggcuggccagcugcggc

SEQ ID NO: 3096246 - RNA, 18 nt, Mycobacterium bovis subsp bovis AF2122/97
ggcuggccgacucgaggu

SEQ ID NO: 3096247 - RNA, 16 nt, Mycobacterium bovis subsp bovis AF2122/97
ggcuggccgccaccgc

SEQ ID NO: 3096248 - RNA, 22 nt, Mycobacterium bovis subsp bovis AF2122/97
ggcuggccgccuccgcggcauu

SEQ ID NO: 3096249 - RNA, 15 nt, Mycobacterium bovis subsp bovis AF2122/97
ggcuggccgcgccuc

SEQ ID NO: 3096250 - RNA, 16 nt, Mycobacterium bovis subsp bovis AF2122/97
ggcuggcgccccaggu

SEQ ID NO: 3096251 - RNA, 12 nt, Mycobacterium bovis subsp bovis AF2122/97
ggcuggcggccu

SEQ ID NO: 3096252 - RNA, 13 nt, Mycobacterium bovis subsp bovis AF2122/97
ggcuggcggccua

SEQ ID NO: 3096253 - RNA, 14 nt, Mycobacterium bovis subsp bovis AF2122/97
ggcuggcggcgugg

SEQ ID NO: 3096254 - RNA, 16 nt, Mycobacterium bovis subsp bovis AF2122/97
ggcuggcgucaccgcg

SEQ ID NO: 3096255 - RNA, 17 nt, Mycobacterium bovis subsp bovis AF2122/97
ggcuggcgugcugcuag

SEQ ID NO: 3096256 - RNA, 21 nt, Mycobacterium bovis subsp bovis AF2122/97
ggcuggcguugcugaugucgc

SEQ ID NO: 3096257 - RNA, 14 nt, Mycobacterium bovis subsp bovis AF2122/97
ggcugggauagcgc

SEQ ID NO: 3096258 - RNA, 13 nt, Mycobacterium bovis subsp bovis AF2122/97
ggcugggcccgcc

SEQ ID NO: 3096259 - RNA, 14 nt, Mycobacterium bovis subsp bovis AF2122/97
ggcugggcccgccg

SEQ ID NO: 3096260 - RNA, 18 nt, Mycobacterium bovis subsp bovis AF2122/97
ggcugggcgccaccaucg

SEQ ID NO: 3096261 - RNA, 13 nt, Mycobacterium bovis subsp bovis AF2122/97
ggcugggcggucg

SEQ ID NO: 3096262 - RNA, 14 nt, Mycobacterium bovis subsp bovis AF2122/97
ggcuggggccgcuu

SEQ ID NO: 3096263 - RNA, 21 nt, Mycobacterium bovis subsp bovis AF2122/97
ggcuggguaugcacccaggca

SEQ ID NO: 3096264 - RNA, 22 nt, Mycobacterium bovis subsp bovis AF2122/97
ggcugggucagguugucggcga

SEQ ID NO: 3096265 - RNA, 15 nt, Mycobacterium bovis subsp bovis AF2122/97
ggcugguagcugcgg

SEQ ID NO: 3096266 - RNA, 13 nt, Mycobacterium bovis subsp bovis AF2122/97
ggcugguagucgg

SEQ ID NO: 3096267 - RNA, 16 nt, Mycobacterium bovis subsp bovis AF2122/97
ggcugguaucgagcac

SEQ ID NO: 3096268 - RNA, 15 nt, Mycobacterium bovis subsp bovis AF2122/97
ggcugguccgggugc

SEQ ID NO: 3096269 - RNA, 12 nt, Mycobacterium bovis subsp bovis AF2122/97
ggcuggucgccg

SEQ ID NO: 3096270 - RNA, 19 nt, Mycobacterium bovis subsp bovis AF2122/97
ggcuggucuacccgcggcg

SEQ ID NO: 3096271 - RNA, 20 nt, Mycobacterium bovis subsp bovis AF2122/97
ggcuggucuacccgcggcgc

SEQ ID NO: 3096272 - RNA, 13 nt, Mycobacterium bovis subsp bovis AF2122/97
ggcuggugccaac

SEQ ID NO: 3096273 - RNA, 20 nt, Mycobacterium bovis subsp bovis AF2122/97
ggcuggugccaacugcgccg

SEQ ID NO: 3096274 - RNA, 20 nt, Mycobacterium bovis subsp bovis AF2122/97
ggcuggugccuuaccaccgu

SEQ ID NO: 3096275 - RNA, 18 nt, Mycobacterium bovis subsp bovis AF2122/97
ggcuggugggacgcggcc

SEQ ID NO: 3096276 - RNA, 19 nt, Mycobacterium bovis subsp bovis AF2122/97
ggcuggugggggagcggcc

SEQ ID NO: 3096277 - RNA, 21 nt, Mycobacterium bovis subsp bovis AF2122/97
ggcuggugggggagcggccgc

SEQ ID NO: 3096278 - RNA, 15 nt, Mycobacterium bovis subsp bovis AF2122/97
ggcugguguccagcc

SEQ ID NO: 3096279 - RNA, 20 nt, Mycobacterium bovis subsp bovis AF2122/97
ggcugguguccagccaggcg

SEQ ID NO: 3096280 - RNA, 13 nt, Mycobacterium bovis subsp bovis AF2122/97
ggcuggugucggg

SEQ ID NO: 3096281 - RNA, 22 nt, Mycobacterium bovis subsp bovis AF2122/97
ggcuguaaaaaugcuucgccaa

SEQ ID NO: 3096282 - RNA, 15 nt, Mycobacterium bovis subsp bovis AF2122/97
ggcuguaacacccgg

SEQ ID NO: 3096283 - RNA, 20 nt, Mycobacterium bovis subsp bovis AF2122/97
ggcuguaacacccggccgcc

SEQ ID NO: 3096284 - RNA, 21 nt, Mycobacterium bovis subsp bovis AF2122/97
ggcuguaacacccggccgccg

SEQ ID NO: 3096285 - RNA, 22 nt, Mycobacterium bovis subsp bovis AF2122/97
ggcuguaacacccggccgccga

SEQ ID NO: 3096286 - RNA, 17 nt, Mycobacterium bovis subsp bovis AF2122/97
ggcuguacccgaccagc

SEQ ID NO: 3096287 - RNA, 14 nt, Mycobacterium bovis subsp bovis AF2122/97
ggcuguaggcgauc

SEQ ID NO: 3096288 - RNA, 21 nt, Mycobacterium bovis subsp bovis AF2122/97
ggcugucacaagccugccggc

SEQ ID NO: 3096289 - RNA, 15 nt, Mycobacterium bovis subsp bovis AF2122/97
ggcugucacgccugc

SEQ ID NO: 3096290 - RNA, 18 nt, Mycobacterium bovis subsp bovis AF2122/97
ggcugucacgccugccac

SEQ ID NO: 3096291 - RNA, 19 nt, Mycobacterium bovis subsp bovis AF2122/97
ggcugucacgccugccacc

SEQ ID NO: 3096292 - RNA, 22 nt, Mycobacterium bovis subsp bovis AF2122/97
ggcugucacgccugccaccggc

SEQ ID NO: 3096293 - RNA, 20 nt, Mycobacterium bovis subsp bovis AF2122/97
ggcugucaguucccgcuuga

SEQ ID NO: 3096294 - RNA, 14 nt, Mycobacterium bovis subsp bovis AF2122/97
ggcuguccaccgag

SEQ ID NO: 3096295 - RNA, 15 nt, Mycobacterium bovis subsp bovis AF2122/97
ggcuguccagcagcg

SEQ ID NO: 3096296 - RNA, 19 nt, Mycobacterium bovis subsp bovis AF2122/97
ggcuguccgaccucgccgc

SEQ ID NO: 3096297 - RNA, 20 nt, Mycobacterium bovis subsp bovis AF2122/97
ggcuguccgaccucgccgcg

SEQ ID NO: 3096298 - RNA, 20 nt, Mycobacterium bovis subsp bovis AF2122/97
ggcuguccgcgggccgcgcg

SEQ ID NO: 3096299 - RNA, 21 nt, Mycobacterium bovis subsp bovis AF2122/97
ggcugucgagucgguccugcc

SEQ ID NO: 3096300 - RNA, 18 nt, Mycobacterium bovis subsp bovis AF2122/97
ggcugucguaugauucac

SEQ ID NO: 3096301 - RNA, 17 nt, Mycobacterium bovis subsp bovis AF2122/97
ggcugucgugauacagc

SEQ ID NO: 3096302 - RNA, 23 nt, Mycobacterium bovis subsp bovis AF2122/97
ggcugucgugauacagcucggug

SEQ ID NO: 3096303 - RNA, 19 nt, Mycobacterium bovis subsp bovis AF2122/97
ggcugucgugccucucggg

SEQ ID NO: 3096304 - RNA, 23 nt, Mycobacterium bovis subsp bovis AF2122/97
ggcugucgugccucucgggggcc

SEQ ID NO: 3096305 - RNA, 17 nt, Mycobacterium bovis subsp bovis AF2122/97
ggcugugaacagcgcgu

SEQ ID NO: 3096306 - RNA, 18 nt, Mycobacterium bovis subsp bovis AF2122/97
ggcugugaucgagucgcg

SEQ ID NO: 3096307 - RNA, 23 nt, Mycobacterium bovis subsp bovis AF2122/97
ggcugugauguuguucagcaggc

SEQ ID NO: 3096308 - RNA, 12 nt, Mycobacterium bovis subsp bovis AF2122/97
ggcugugcaggc

SEQ ID NO: 3096309 - RNA, 17 nt, Mycobacterium bovis subsp bovis AF2122/97
ggcugugccccagggca

SEQ ID NO: 3096310 - RNA, 13 nt, Mycobacterium bovis subsp bovis AF2122/97
ggcugugccggcc

SEQ ID NO: 3096311 - RNA, 13 nt, Mycobacterium bovis subsp bovis AF2122/97
ggcuguggccgcg

SEQ ID NO: 3096312 - RNA, 18 nt, Mycobacterium bovis subsp bovis AF2122/97
ggcuguggccgcgucgcg

SEQ ID NO: 3096313 - RNA, 22 nt, Mycobacterium bovis subsp bovis AF2122/97
ggcuguucggccauggcggcgc

SEQ ID NO: 3096314 - RNA, 17 nt, Mycobacterium bovis subsp bovis AF2122/97
ggcuguugacgccacga

SEQ ID NO: 3096315 - RNA, 16 nt, Mycobacterium bovis subsp bovis AF2122/97
ggcuguugcggcggcg

SEQ ID NO: 3096316 - RNA, 20 nt, Mycobacterium bovis subsp bovis AF2122/97
ggcuguugcguucggucagu

SEQ ID NO: 3096317 - RNA, 14 nt, Mycobacterium bovis subsp bovis AF2122/97
ggcuuaccggcggg

SEQ ID NO: 3096318 - RNA, 15 nt, Mycobacterium bovis subsp bovis AF2122/97
ggcuuaccggcgggc

SEQ ID NO: 3096319 - RNA, 20 nt, Mycobacterium bovis subsp bovis AF2122/97
ggcuuacuugaucucggcga

SEQ ID NO: 3096320 - RNA, 23 nt, Mycobacterium bovis subsp bovis AF2122/97
ggcuuacuugaucucggcgagca

SEQ ID NO: 3096321 - RNA, 21 nt, Mycobacterium bovis subsp bovis AF2122/97
ggcuuaugcgucugcucgccc

SEQ ID NO: 3096322 - RNA, 22 nt, Mycobacterium bovis subsp bovis AF2122/97
ggcuuaugcgucugcucgccgg

SEQ ID NO: 3096323 - RNA, 20 nt, Mycobacterium bovis subsp bovis AF2122/97
ggcuucaacccgggcagcau

SEQ ID NO: 3096324 - RNA, 21 nt, Mycobacterium bovis subsp bovis AF2122/97
ggcuucaagauuaccgaagcc

SEQ ID NO: 3096325 - RNA, 17 nt, Mycobacterium bovis subsp bovis AF2122/97
ggcuucagcacgcggga

SEQ ID NO: 3096326 - RNA, 13 nt, Mycobacterium bovis subsp bovis AF2122/97
ggcuucaucuggc

SEQ ID NO: 3096327 - RNA, 19 nt, Mycobacterium bovis subsp bovis AF2122/97
ggcuuccaacucggcggcc

SEQ ID NO: 3096328 - RNA, 19 nt, Mycobacterium bovis subsp bovis AF2122/97
ggcuuccagcucgggggcg

SEQ ID NO: 3096329 - RNA, 19 nt, Mycobacterium bovis subsp bovis AF2122/97
ggcuuccagggcgacggcc

SEQ ID NO: 3096330 - RNA, 15 nt, Mycobacterium bovis subsp bovis AF2122/97
ggcuuccccagcagu

SEQ ID NO: 3096331 - RNA, 23 nt, Mycobacterium bovis subsp bovis AF2122/97
ggcuuccccagcaguucgccgcg

SEQ ID NO: 3096332 - RNA, 23 nt, Mycobacterium bovis subsp bovis AF2122/97
ggcuuccgacaugaaccggucga

SEQ ID NO: 3096333 - RNA, 17 nt, Mycobacterium bovis subsp bovis AF2122/97
ggcuuccggcaagucga

SEQ ID NO: 3096334 - RNA, 18 nt, Mycobacterium bovis subsp bovis AF2122/97
ggcuuccggcgcgaccgg

SEQ ID NO: 3096335 - RNA, 19 nt, Mycobacterium bovis subsp bovis AF2122/97
ggcuuccuccgacgcgauc

SEQ ID NO: 3096336 - RNA, 19 nt, Mycobacterium bovis subsp bovis AF2122/97
ggcuucgacgcuuccuggg

SEQ ID NO: 3096337 - RNA, 17 nt, Mycobacterium bovis subsp bovis AF2122/97
ggcuucgacggcggcca

SEQ ID NO: 3096338 - RNA, 18 nt, Mycobacterium bovis subsp bovis AF2122/97
ggcuucgacgucggcgac

SEQ ID NO: 3096339 - RNA, 19 nt, Mycobacterium bovis subsp bovis AF2122/97
ggcuucgacgucggcgacc

SEQ ID NO: 3096340 - RNA, 22 nt, Mycobacterium bovis subsp bovis AF2122/97
ggcuucgacgucggcgaccagg

SEQ ID NO: 3096341 - RNA, 20 nt, Mycobacterium bovis subsp bovis AF2122/97
ggcuucgaguuuggcgacga

SEQ ID NO: 3096342 - RNA, 14 nt, Mycobacterium bovis subsp bovis AF2122/97
ggcuucgauugcgc

SEQ ID NO: 3096343 - RNA, 21 nt, Mycobacterium bovis subsp bovis AF2122/97
ggcuucgauugcgcugcaccg

SEQ ID NO: 3096344 - RNA, 15 nt, Mycobacterium bovis subsp bovis AF2122/97
ggcuucgccgcggga

SEQ ID NO: 3096345 - RNA, 19 nt, Mycobacterium bovis subsp bovis AF2122/97
ggcuucgccgcgggacaga

SEQ ID NO: 3096346 - RNA, 22 nt, Mycobacterium bovis subsp bovis AF2122/97
ggcuucgcgguuggcggcgaug

SEQ ID NO: 3096347 - RNA, 23 nt, Mycobacterium bovis subsp bovis AF2122/97
ggcuucgcuggcuugggccagcg

SEQ ID NO: 3096348 - RNA, 15 nt, Mycobacterium bovis subsp bovis AF2122/97
ggcuucggcgagcgc

SEQ ID NO: 3096349 - RNA, 15 nt, Mycobacterium bovis subsp bovis AF2122/97
ggcuucggcggccga

SEQ ID NO: 3096350 - RNA, 20 nt, Mycobacterium bovis subsp bovis AF2122/97
ggcuucggcggccgagcgca

SEQ ID NO: 3096351 - RNA, 13 nt, Mycobacterium bovis subsp bovis AF2122/97
ggcuucgucgaca

SEQ ID NO: 3096352 - RNA, 19 nt, Mycobacterium bovis subsp bovis AF2122/97
ggcuucgucggccagcagc

SEQ ID NO: 3096353 - RNA, 20 nt, Mycobacterium bovis subsp bovis AF2122/97
ggcuucgucggccagcagca

SEQ ID NO: 3096354 - RNA, 21 nt, Mycobacterium bovis subsp bovis AF2122/97
ggcuucuucuucuugaccgcg

SEQ ID NO: 3096355 - RNA, 23 nt, Mycobacterium bovis subsp bovis AF2122/97
ggcuucuugaccacgaacgcgcg

SEQ ID NO: 3096356 - RNA, 18 nt, Mycobacterium bovis subsp bovis AF2122/97
ggcuugacccuugggcac

SEQ ID NO: 3096357 - RNA, 19 nt, Mycobacterium bovis subsp bovis AF2122/97
ggcuugacugcacaccacc

SEQ ID NO: 3096358 - RNA, 20 nt, Mycobacterium bovis subsp bovis AF2122/97
ggcuugacugcacaccaccg

SEQ ID NO: 3096359 - RNA, 22 nt, Mycobacterium bovis subsp bovis AF2122/97
ggcuugcaaggucgcugcuugc

SEQ ID NO: 3096360 - RNA, 13 nt, Mycobacterium bovis subsp bovis AF2122/97
ggcuugcaccugc

SEQ ID NO: 3096361 - RNA, 15 nt, Mycobacterium bovis subsp bovis AF2122/97
ggcuugcaccugcaa

SEQ ID NO: 3096362 - RNA, 19 nt, Mycobacterium bovis subsp bovis AF2122/97
ggcuugcccggcucggcag

SEQ ID NO: 3096363 - RNA, 21 nt, Mycobacterium bovis subsp bovis AF2122/97
ggcuugccgauggcgguggcg

SEQ ID NO: 3096364 - RNA, 18 nt, Mycobacterium bovis subsp bovis AF2122/97
ggcuugcgauuggcuggg

SEQ ID NO: 3096365 - RNA, 16 nt, Mycobacterium bovis subsp bovis AF2122/97
ggcuugcgcagcagcg

SEQ ID NO: 3096366 - RNA, 19 nt, Mycobacterium bovis subsp bovis AF2122/97
ggcuugcgcgacgagacgc

SEQ ID NO: 3096367 - RNA, 20 nt, Mycobacterium bovis subsp bovis AF2122/97
ggcuugcgcgcaggugcugg

SEQ ID NO: 3096368 - RNA, 17 nt, Mycobacterium bovis subsp bovis AF2122/97
ggcuugcggcacccagu

SEQ ID NO: 3096369 - RNA, 21 nt, Mycobacterium bovis subsp bovis AF2122/97
ggcuugcgugaugguugcucg

SEQ ID NO: 3096370 - RNA, 14 nt, Mycobacterium bovis subsp bovis AF2122/97
ggcuuggaccagcg

SEQ ID NO: 3096371 - RNA, 23 nt, Mycobacterium bovis subsp bovis AF2122/97
ggcuuggaccagcguggggccgc

SEQ ID NO: 3096372 - RNA, 23 nt, Mycobacterium bovis subsp bovis AF2122/97
ggcuuggaucucauccauguuga

SEQ ID NO: 3096373 - RNA, 14 nt, Mycobacterium bovis subsp bovis AF2122/97
ggcuuggccaucac

SEQ ID NO: 3096374 - RNA, 23 nt, Mycobacterium bovis subsp bovis AF2122/97
ggcuuggccguaggcggcgaccc

SEQ ID NO: 3096375 - RNA, 13 nt, Mycobacterium bovis subsp bovis AF2122/97
ggcuuggcgacga

SEQ ID NO: 3096376 - RNA, 22 nt, Mycobacterium bovis subsp bovis AF2122/97
ggcuuggcgccgaugccggcca

SEQ ID NO: 3096377 - RNA, 14 nt, Mycobacterium bovis subsp bovis AF2122/97
ggcuuggcgggacc

SEQ ID NO: 3096378 - RNA, 16 nt, Mycobacterium bovis subsp bovis AF2122/97
ggcuugggccagcgca

SEQ ID NO: 3096379 - RNA, 15 nt, Mycobacterium bovis subsp bovis AF2122/97
ggcuugggccaggcc

SEQ ID NO: 3096380 - RNA, 15 nt, Mycobacterium bovis subsp bovis AF2122/97
ggcuugggcgguagc

SEQ ID NO: 3096381 - RNA, 23 nt, Mycobacterium bovis subsp bovis AF2122/97
ggcuugggcgguagccgacgaca

SEQ ID NO: 3096382 - RNA, 19 nt, Mycobacterium bovis subsp bovis AF2122/97
ggcuuggggucccgccggg

SEQ ID NO: 3096383 - RNA, 23 nt, Mycobacterium bovis subsp bovis AF2122/97
ggcuuggguugauuggccccggc

SEQ ID NO: 3096384 - RNA, 18 nt, Mycobacterium bovis subsp bovis AF2122/97
ggcuuggugaaccgcgcg

SEQ ID NO: 3096385 - RNA, 21 nt, Mycobacterium bovis subsp bovis AF2122/97
ggcuuggugaaccgcgcggcg

SEQ ID NO: 3096386 - RNA, 13 nt, Mycobacterium bovis subsp bovis AF2122/97
ggcuuggugccca

SEQ ID NO: 3096387 - RNA, 16 nt, Mycobacterium bovis subsp bovis AF2122/97
ggcuuggugcccagcg

SEQ ID NO: 3096388 - RNA, 19 nt, Mycobacterium bovis subsp bovis AF2122/97
ggcuugucagccgcgaccg

SEQ ID NO: 3096389 - RNA, 15 nt, Mycobacterium bovis subsp bovis AF2122/97
ggcuugucauccccg

SEQ ID NO: 3096390 - RNA, 21 nt, Mycobacterium bovis subsp bovis AF2122/97
ggcuugucgaccacgaccguc

SEQ ID NO: 3096391 - RNA, 14 nt, Mycobacterium bovis subsp bovis AF2122/97
ggcuugucgccggc

SEQ ID NO: 3096392 - RNA, 16 nt, Mycobacterium bovis subsp bovis AF2122/97
ggcuuguucggacuca

SEQ ID NO: 3096393 - RNA, 16 nt, Mycobacterium bovis subsp bovis AF2122/97
ggcuuucgcgugcggc

SEQ ID NO: 3096394 - RNA, 15 nt, Mycobacterium bovis subsp bovis AF2122/97
ggcuuugagccgcuc

SEQ ID NO: 3096395 - RNA, 13 nt, Mycobacterium bovis subsp bovis AF2122/97
ggcuuugcggcgc

SEQ ID NO: 3096396 - RNA, 15 nt, Mycobacterium bovis subsp bovis AF2122/97
ggcuuugucaccggc

SEQ ID NO: 3096397 - RNA, 19 nt, Mycobacterium bovis subsp bovis AF2122/97
ggcuuuugcgcccagcacg

SEQ ID NO: 3096398 - RNA, 17 nt, Mycobacterium bovis subsp bovis AF2122/97
ggcuuuugcgucugcuc

SEQ ID NO: 3096399 - RNA, 18 nt, Mycobacterium bovis subsp bovis AF2122/97
ggcuuuugcgucugcucg

SEQ ID NO: 3096400 - RNA, 12 nt, Mycobacterium bovis subsp bovis AF2122/97
gggaaaagcccg

SEQ ID NO: 3096401 - RNA, 12 nt, Mycobacterium bovis subsp bovis AF2122/97
gggaaacaccgg

SEQ ID NO: 3096402 - RNA, 21 nt, Mycobacterium bovis subsp bovis AF2122/97
gggaaaguuguaucgcagcau

SEQ ID NO: 3096403 - RNA, 17 nt, Mycobacterium bovis subsp bovis AF2122/97
gggaaccacggucagca

SEQ ID NO: 3096404 - RNA, 20 nt, Mycobacterium bovis subsp bovis AF2122/97
gggaaccagaugaaccccga

SEQ ID NO: 3096405 - RNA, 16 nt, Mycobacterium bovis subsp bovis AF2122/97
gggaaccagcggucgg

SEQ ID NO: 3096406 - RNA, 19 nt, Mycobacterium bovis subsp bovis AF2122/97
gggaaccauugcccgacga

SEQ ID NO: 3096407 - RNA, 20 nt, Mycobacterium bovis subsp bovis AF2122/97
gggaaccguccaagccggcu

SEQ ID NO: 3096408 - RNA, 19 nt, Mycobacterium bovis subsp bovis AF2122/97
gggaacgaguacgggcagg

SEQ ID NO: 3096409 - RNA, 19 nt, Mycobacterium bovis subsp bovis AF2122/97
gggaacgaugccgccggcg

SEQ ID NO: 3096410 - RNA, 23 nt, Mycobacterium bovis subsp bovis AF2122/97
gggaacgaugccgccggcgggcg

SEQ ID NO: 3096411 - RNA, 20 nt, Mycobacterium bovis subsp bovis AF2122/97
gggaacgcggaagccgccua

SEQ ID NO: 3096412 - RNA, 15 nt, Mycobacterium bovis subsp bovis AF2122/97
gggaacgcggcggcg

SEQ ID NO: 3096413 - RNA, 16 nt, Mycobacterium bovis subsp bovis AF2122/97
gggaacgcucgucgac

SEQ ID NO: 3096414 - RNA, 18 nt, Mycobacterium bovis subsp bovis AF2122/97
gggaacguccgcgccgag

SEQ ID NO: 3096415 - RNA, 22 nt, Mycobacterium bovis subsp bovis AF2122/97
gggaacguccgcgccgagcccg

SEQ ID NO: 3096416 - RNA, 21 nt, Mycobacterium bovis subsp bovis AF2122/97
gggaacgugacccccagcagg

SEQ ID NO: 3096417 - RNA, 23 nt, Mycobacterium bovis subsp bovis AF2122/97
gggaacuggaccacagccgcgcc

SEQ ID NO: 3096418 - RNA, 12 nt, Mycobacterium bovis subsp bovis AF2122/97
gggaagacgacc

SEQ ID NO: 3096419 - RNA, 20 nt, Mycobacterium bovis subsp bovis AF2122/97
gggaagacgaccgugcuggg

SEQ ID NO: 3096420 - RNA, 20 nt, Mycobacterium bovis subsp bovis AF2122/97
gggaagagccgggcucgucg

SEQ ID NO: 3096421 - RNA, 21 nt, Mycobacterium bovis subsp bovis AF2122/97
gggaagccguuuucgaaacug

SEQ ID NO: 3096422 - RNA, 12 nt, Mycobacterium bovis subsp bovis AF2122/97
gggaagccugcg

SEQ ID NO: 3096423 - RNA, 18 nt, Mycobacterium bovis subsp bovis AF2122/97
gggaagcgcguccaacca

SEQ ID NO: 3096424 - RNA, 21 nt, Mycobacterium bovis subsp bovis AF2122/97
gggaaggaaccgggcaaauca

SEQ ID NO: 3096425 - RNA, 17 nt, Mycobacterium bovis subsp bovis AF2122/97
gggaaggcucaccacgg

SEQ ID NO: 3096426 - RNA, 19 nt, Mycobacterium bovis subsp bovis AF2122/97
gggaaucacccacucgccg

SEQ ID NO: 3096427 - RNA, 23 nt, Mycobacterium bovis subsp bovis AF2122/97
gggaaucacccacucgccgagcu

SEQ ID NO: 3096428 - RNA, 18 nt, Mycobacterium bovis subsp bovis AF2122/97
gggaauggcccuugcucg

SEQ ID NO: 3096429 - RNA, 12 nt, Mycobacterium bovis subsp bovis AF2122/97
gggaaugucgaa

SEQ ID NO: 3096430 - RNA, 20 nt, Mycobacterium bovis subsp bovis AF2122/97
gggaaugucgaaacccacgu

SEQ ID NO: 3096431 - RNA, 22 nt, Mycobacterium bovis subsp bovis AF2122/97
gggacaaagccgaacgacagca

SEQ ID NO: 3096432 - RNA, 15 nt, Mycobacterium bovis subsp bovis AF2122/97
gggacaacucgcgug

SEQ ID NO: 3096433 - RNA, 21 nt, Mycobacterium bovis subsp bovis AF2122/97
gggacaacucgcguggcaccg

SEQ ID NO: 3096434 - RNA, 22 nt, Mycobacterium bovis subsp bovis AF2122/97
gggacaaucguccacccgagcu

SEQ ID NO: 3096435 - RNA, 15 nt, Mycobacterium bovis subsp bovis AF2122/97
gggacaaucucggcc

SEQ ID NO: 3096436 - RNA, 18 nt, Mycobacterium bovis subsp bovis AF2122/97
gggacaaucucggccgca

SEQ ID NO: 3096437 - RNA, 12 nt, Mycobacterium bovis subsp bovis AF2122/97
gggacaccaucu

SEQ ID NO: 3096438 - RNA, 20 nt, Mycobacterium bovis subsp bovis AF2122/97
gggacaccaucuccgccguc

SEQ ID NO: 3096439 - RNA, 12 nt, Mycobacterium bovis subsp bovis AF2122/97
gggacagcgccg

SEQ ID NO: 3096440 - RNA, 14 nt, Mycobacterium bovis subsp bovis AF2122/97
gggacaguucgcgc

SEQ ID NO: 3096441 - RNA, 20 nt, Mycobacterium bovis subsp bovis AF2122/97
gggaccacccgguccugcuc

SEQ ID NO: 3096442 - RNA, 22 nt, Mycobacterium bovis subsp bovis AF2122/97
gggaccacccgguccugcucgc

SEQ ID NO: 3096443 - RNA, 11 nt, Mycobacterium bovis subsp bovis AF2122/97
gggaccaccgg

SEQ ID NO: 3096444 - RNA, 15 nt, Mycobacterium bovis subsp bovis AF2122/97
gggaccacgccgacg

SEQ ID NO: 3096445 - RNA, 16 nt, Mycobacterium bovis subsp bovis AF2122/97
gggaccauagccugcg

SEQ ID NO: 3096446 - RNA, 17 nt, Mycobacterium bovis subsp bovis AF2122/97
gggacccgagcagugga

SEQ ID NO: 3096447 - RNA, 17 nt, Mycobacterium bovis subsp bovis AF2122/97
gggacccggaccuucgg

SEQ ID NO: 3096448 - RNA, 18 nt, Mycobacterium bovis subsp bovis AF2122/97
gggacccggcgccgucga

SEQ ID NO: 3096449 - RNA, 18 nt, Mycobacterium bovis subsp bovis AF2122/97
gggaccgagaacugcucg

SEQ ID NO: 3096450 - RNA, 20 nt, Mycobacterium bovis subsp bovis AF2122/97
gggaccgaucuuggccaccg

SEQ ID NO: 3096451 - RNA, 12 nt, Mycobacterium bovis subsp bovis AF2122/97
gggaccgcccga

SEQ ID NO: 3096452 - RNA, 13 nt, Mycobacterium bovis subsp bovis AF2122/97
gggaccgcccgag

SEQ ID NO: 3096453 - RNA, 14 nt, Mycobacterium bovis subsp bovis AF2122/97
gggaccgcgccagg

SEQ ID NO: 3096454 - RNA, 18 nt, Mycobacterium bovis subsp bovis AF2122/97
gggaccgggaacccgagc

SEQ ID NO: 3096455 - RNA, 21 nt, Mycobacterium bovis subsp bovis AF2122/97
gggaccgggcguuucccugcc

SEQ ID NO: 3096456 - RNA, 13 nt, Mycobacterium bovis subsp bovis AF2122/97
gggaccggggacg

SEQ ID NO: 3096457 - RNA, 20 nt, Mycobacterium bovis subsp bovis AF2122/97
gggaccuugaucgagcaggg

SEQ ID NO: 3096458 - RNA, 20 nt, Mycobacterium bovis subsp bovis AF2122/97
gggacgaaaaaaucgugcgg

SEQ ID NO: 3096459 - RNA, 24 nt, Mycobacterium bovis subsp bovis AF2122/97
gggacgacgccaccugacgugcgg

SEQ ID NO: 3096460 - RNA, 15 nt, Mycobacterium bovis subsp bovis AF2122/97
gggacgacggcaaga

SEQ ID NO: 3096461 - RNA, 20 nt, Mycobacterium bovis subsp bovis AF2122/97
gggacgcccgugcggcucgc

SEQ ID NO: 3096462 - RNA, 21 nt, Mycobacterium bovis subsp bovis AF2122/97
gggacgccgugugcaucggcg

SEQ ID NO: 3096463 - RNA, 21 nt, Mycobacterium bovis subsp bovis AF2122/97
gggacgccuugaucggcgagg

SEQ ID NO: 3096464 - RNA, 14 nt, Mycobacterium bovis subsp bovis AF2122/97
gggacgcgccccag

SEQ ID NO: 3096465 - RNA, 13 nt, Mycobacterium bovis subsp bovis AF2122/97
gggacgcggccga

SEQ ID NO: 3096466 - RNA, 12 nt, Mycobacterium bovis subsp bovis AF2122/97
gggacggcgaau

SEQ ID NO: 3096467 - RNA, 15 nt, Mycobacterium bovis subsp bovis AF2122/97
gggacggcggcaagg

SEQ ID NO: 3096468 - RNA, 17 nt, Mycobacterium bovis subsp bovis AF2122/97
gggacggcggcaagggc

SEQ ID NO: 3096469 - RNA, 12 nt, Mycobacterium bovis subsp bovis AF2122/97
gggacgggcgcg

SEQ ID NO: 3096470 - RNA, 17 nt, Mycobacterium bovis subsp bovis AF2122/97
gggacgggcgcgucggc

SEQ ID NO: 3096471 - RNA, 17 nt, Mycobacterium bovis subsp bovis AF2122/97
gggacgggucgccgcca

SEQ ID NO: 3096472 - RNA, 19 nt, Mycobacterium bovis subsp bovis AF2122/97
gggacguuguccaccgcca

SEQ ID NO: 3096473 - RNA, 12 nt, Mycobacterium bovis subsp bovis AF2122/97
gggacucggcga

SEQ ID NO: 3096474 - RNA, 21 nt, Mycobacterium bovis subsp bovis AF2122/97
gggacucugccacccagcacg

SEQ ID NO: 3096475 - RNA, 23 nt, Mycobacterium bovis subsp bovis AF2122/97
gggacucugccacccagcacgcg

SEQ ID NO: 3096476 - RNA, 12 nt, Mycobacterium bovis subsp bovis AF2122/97
gggacugcagcg

SEQ ID NO: 3096477 - RNA, 13 nt, Mycobacterium bovis subsp bovis AF2122/97
gggacuggcguga

SEQ ID NO: 3096478 - RNA, 16 nt, Mycobacterium bovis subsp bovis AF2122/97
gggacugugggggcgc

SEQ ID NO: 3096479 - RNA, 18 nt, Mycobacterium bovis subsp bovis AF2122/97
gggagaaaacggcggcgc

SEQ ID NO: 3096480 - RNA, 22 nt, Mycobacterium bovis subsp bovis AF2122/97
gggagacgcugcgcgccagaca

SEQ ID NO: 3096481 - RNA, 16 nt, Mycobacterium bovis subsp bovis AF2122/97
gggagaucucguccag

SEQ ID NO: 3096482 - RNA, 19 nt, Mycobacterium bovis subsp bovis AF2122/97
gggagcaccgaccagggcc

SEQ ID NO: 3096483 - RNA, 20 nt, Mycobacterium bovis subsp bovis AF2122/97
gggagcacuaccccacaagc

SEQ ID NO: 3096484 - RNA, 19 nt, Mycobacterium bovis subsp bovis AF2122/97
gggagcagagaaaccgcga

SEQ ID NO: 3096485 - RNA, 14 nt, Mycobacterium bovis subsp bovis AF2122/97
gggagcagccgaac

SEQ ID NO: 3096486 - RNA, 13 nt, Mycobacterium bovis subsp bovis AF2122/97
gggagccaccggc

SEQ ID NO: 3096487 - RNA, 14 nt, Mycobacterium bovis subsp bovis AF2122/97
gggagccaccggcg

SEQ ID NO: 3096488 - RNA, 17 nt, Mycobacterium bovis subsp bovis AF2122/97
gggagccacugcggcau

SEQ ID NO: 3096489 - RNA, 18 nt, Mycobacterium bovis subsp bovis AF2122/97
gggagcccgagcucaccg

SEQ ID NO: 3096490 - RNA, 15 nt, Mycobacterium bovis subsp bovis AF2122/97
gggagcccggcggcc

SEQ ID NO: 3096491 - RNA, 15 nt, Mycobacterium bovis subsp bovis AF2122/97
gggagcgccgcaggg

SEQ ID NO: 3096492 - RNA, 21 nt, Mycobacterium bovis subsp bovis AF2122/97
gggagcgccgcagggucccgu

SEQ ID NO: 3096493 - RNA, 12 nt, Mycobacterium bovis subsp bovis AF2122/97
gggagcggcugc

SEQ ID NO: 3096494 - RNA, 16 nt, Mycobacterium bovis subsp bovis AF2122/97
gggagcggcugcacgc

SEQ ID NO: 3096495 - RNA, 14 nt, Mycobacterium bovis subsp bovis AF2122/97
gggagcggcugcgg

SEQ ID NO: 3096496 - RNA, 21 nt, Mycobacterium bovis subsp bovis AF2122/97
gggagcguaguucaccaacgc

SEQ ID NO: 3096497 - RNA, 16 nt, Mycobacterium bovis subsp bovis AF2122/97
gggagcugaucacgca

SEQ ID NO: 3096498 - RNA, 15 nt, Mycobacterium bovis subsp bovis AF2122/97
gggagcugcggcggc

SEQ ID NO: 3096499 - RNA, 20 nt, Mycobacterium bovis subsp bovis AF2122/97
gggaggccaacccugcggcg

SEQ ID NO: 3096500 - RNA, 16 nt, Mycobacterium bovis subsp bovis AF2122/97
gggaggccaccgcgaa

SEQ ID NO: 3096501 - RNA, 22 nt, Mycobacterium bovis subsp bovis AF2122/97
gggaggcggcgccgcacccaca

SEQ ID NO: 3096502 - RNA, 14 nt, Mycobacterium bovis subsp bovis AF2122/97
gggagggaccaccc

SEQ ID NO: 3096503 - RNA, 22 nt, Mycobacterium bovis subsp bovis AF2122/97
gggagguacccccagcacccgg

SEQ ID NO: 3096504 - RNA, 22 nt, Mycobacterium bovis subsp bovis AF2122/97
gggagguggcgcggggccgccg

SEQ ID NO: 3096505 - RNA, 22 nt, Mycobacterium bovis subsp bovis AF2122/97
gggagucgucggcaugggccgg

SEQ ID NO: 3096506 - RNA, 16 nt, Mycobacterium bovis subsp bovis AF2122/97
gggagucuucggcgac

SEQ ID NO: 3096507 - RNA, 17 nt, Mycobacterium bovis subsp bovis AF2122/97
gggagugcgccggcugg

SEQ ID NO: 3096508 - RNA, 21 nt, Mycobacterium bovis subsp bovis AF2122/97
gggagugcgccggcuggcggc

SEQ ID NO: 3096509 - RNA, 15 nt, Mycobacterium bovis subsp bovis AF2122/97
gggagugucagcgcc

SEQ ID NO: 3096510 - RNA, 13 nt, Mycobacterium bovis subsp bovis AF2122/97
gggaguucgcgca

SEQ ID NO: 3096511 - RNA, 21 nt, Mycobacterium bovis subsp bovis AF2122/97
gggaguucgcgcagcaccggc

SEQ ID NO: 3096512 - RNA, 22 nt, Mycobacterium bovis subsp bovis AF2122/97
gggaguucggggugcgcccagg

SEQ ID NO: 3096513 - RNA, 20 nt, Mycobacterium bovis subsp bovis AF2122/97
gggaguugcuugcagggcca

SEQ ID NO: 3096514 - RNA, 17 nt, Mycobacterium bovis subsp bovis AF2122/97
gggauacucgucgucgg

SEQ ID NO: 3096515 - RNA, 21 nt, Mycobacterium bovis subsp bovis AF2122/97
gggauacucgucgucggcagg

SEQ ID NO: 3096516 - RNA, 16 nt, Mycobacterium bovis subsp bovis AF2122/97
gggauaucgucgacgc

SEQ ID NO: 3096517 - RNA, 13 nt, Mycobacterium bovis subsp bovis AF2122/97
gggaucaccgauc

SEQ ID NO: 3096518 - RNA, 13 nt, Mycobacterium bovis subsp bovis AF2122/97
gggaucacgaccg

SEQ ID NO: 3096519 - RNA, 15 nt, Mycobacterium bovis subsp bovis AF2122/97
gggaucacgaucaca

SEQ ID NO: 3096520 - RNA, 14 nt, Mycobacterium bovis subsp bovis AF2122/97
gggaucacgccacc

SEQ ID NO: 3096521 - RNA, 12 nt, Mycobacterium bovis subsp bovis AF2122/97
gggaucagcucc

SEQ ID NO: 3096522 - RNA, 17 nt, Mycobacterium bovis subsp bovis AF2122/97
gggaucaugaccaucga

SEQ ID NO: 3096523 - RNA, 19 nt, Mycobacterium bovis subsp bovis AF2122/97
gggauccacgcaaacgggg

SEQ ID NO: 3096524 - RNA, 20 nt, Mycobacterium bovis subsp bovis AF2122/97
gggauccaugcgggugguga

SEQ ID NO: 3096525 - RNA, 18 nt, Mycobacterium bovis subsp bovis AF2122/97
gggaucccacggcgggcg

SEQ ID NO: 3096526 - RNA, 13 nt, Mycobacterium bovis subsp bovis AF2122/97
gggaucccccgcg

SEQ ID NO: 3096527 - RNA, 22 nt, Mycobacterium bovis subsp bovis AF2122/97
gggaucccgacgaagguggcau

SEQ ID NO: 3096528 - RNA, 17 nt, Mycobacterium bovis subsp bovis AF2122/97
gggauccgaagagccag

SEQ ID NO: 3096529 - RNA, 21 nt, Mycobacterium bovis subsp bovis AF2122/97
gggauccgaagagccagcaac

SEQ ID NO: 3096530 - RNA, 16 nt, Mycobacterium bovis subsp bovis AF2122/97
gggauccgcgcgcugg

SEQ ID NO: 3096531 - RNA, 20 nt, Mycobacterium bovis subsp bovis AF2122/97
gggauccuccggguuggcga

SEQ ID NO: 3096532 - RNA, 14 nt, Mycobacterium bovis subsp bovis AF2122/97
gggaucgaccaugg

SEQ ID NO: 3096533 - RNA, 14 nt, Mycobacterium bovis subsp bovis AF2122/97
gggaucgacccgcc

SEQ ID NO: 3096534 - RNA, 21 nt, Mycobacterium bovis subsp bovis AF2122/97
gggaucgagagccgaccgggu

SEQ ID NO: 3096535 - RNA, 13 nt, Mycobacterium bovis subsp bovis AF2122/97
gggaucgcccagg

SEQ ID NO: 3096536 - RNA, 19 nt, Mycobacterium bovis subsp bovis AF2122/97
gggaucgccguccagcaau

SEQ ID NO: 3096537 - RNA, 17 nt, Mycobacterium bovis subsp bovis AF2122/97
gggaucgcgcagcgccg

SEQ ID NO: 3096538 - RNA, 14 nt, Mycobacterium bovis subsp bovis AF2122/97
gggaucgcugccag

SEQ ID NO: 3096539 - RNA, 17 nt, Mycobacterium bovis subsp bovis AF2122/97
gggaucgcugccagcgg

SEQ ID NO: 3096540 - RNA, 17 nt, Mycobacterium bovis subsp bovis AF2122/97
gggaucgcuggccgcga

SEQ ID NO: 3096541 - RNA, 16 nt, Mycobacterium bovis subsp bovis AF2122/97
gggaucggcuccgccg

SEQ ID NO: 3096542 - RNA, 15 nt, Mycobacterium bovis subsp bovis AF2122/97
gggaucgggcccucc

SEQ ID NO: 3096543 - RNA, 15 nt, Mycobacterium bovis subsp bovis AF2122/97
gggaucggggcaccg

SEQ ID NO: 3096544 - RNA, 17 nt, Mycobacterium bovis subsp bovis AF2122/97
gggaucgguggcggcac

SEQ ID NO: 3096545 - RNA, 13 nt, Mycobacterium bovis subsp bovis AF2122/97
gggaucgugccgg

SEQ ID NO: 3096546 - RNA, 16 nt, Mycobacterium bovis subsp bovis AF2122/97
gggaucuagaugcgga

SEQ ID NO: 3096547 - RNA, 21 nt, Mycobacterium bovis subsp bovis AF2122/97
gggaucugcgccgcgcgcggc

SEQ ID NO: 3096548 - RNA, 18 nt, Mycobacterium bovis subsp bovis AF2122/97
gggaucugggucuguggu

SEQ ID NO: 3096549 - RNA, 19 nt, Mycobacterium bovis subsp bovis AF2122/97
gggaucuuaggcacucccg

SEQ ID NO: 3096550 - RNA, 20 nt, Mycobacterium bovis subsp bovis AF2122/97
gggaugaagaacgcgagcgc

SEQ ID NO: 3096551 - RNA, 16 nt, Mycobacterium bovis subsp bovis AF2122/97
gggaugagaucaucca

SEQ ID NO: 3096552 - RNA, 17 nt, Mycobacterium bovis subsp bovis AF2122/97
gggaugcagcugcccgg

SEQ ID NO: 3096553 - RNA, 20 nt, Mycobacterium bovis subsp bovis AF2122/97
gggaugcaugucuuguggug

SEQ ID NO: 3096554 - RNA, 14 nt, Mycobacterium bovis subsp bovis AF2122/97
gggaugcccgcuga

SEQ ID NO: 3096555 - RNA, 15 nt, Mycobacterium bovis subsp bovis AF2122/97
gggaugccggcgaag

SEQ ID NO: 3096556 - RNA, 18 nt, Mycobacterium bovis subsp bovis AF2122/97
gggaugcgaccgccggac

SEQ ID NO: 3096557 - RNA, 16 nt, Mycobacterium bovis subsp bovis AF2122/97
gggaugcgcgcccgac

SEQ ID NO: 3096558 - RNA, 23 nt, Mycobacterium bovis subsp bovis AF2122/97
gggaugcucgauccacugccgcg

SEQ ID NO: 3096559 - RNA, 17 nt, Mycobacterium bovis subsp bovis AF2122/97
gggauggacaccaccuc

SEQ ID NO: 3096560 - RNA, 21 nt, Mycobacterium bovis subsp bovis AF2122/97
gggauggacggcagccagcca

SEQ ID NO: 3096561 - RNA, 15 nt, Mycobacterium bovis subsp bovis AF2122/97
gggauggcaccaccc

SEQ ID NO: 3096562 - RNA, 14 nt, Mycobacterium bovis subsp bovis AF2122/97
gggauggccgccga

SEQ ID NO: 3096563 - RNA, 23 nt, Mycobacterium bovis subsp bovis AF2122/97
gggauggcucacccaggcgccga

SEQ ID NO: 3096564 - RNA, 16 nt, Mycobacterium bovis subsp bovis AF2122/97
gggaugggggagccgg

SEQ ID NO: 3096565 - RNA, 13 nt, Mycobacterium bovis subsp bovis AF2122/97
gggauggucccgc

SEQ ID NO: 3096566 - RNA, 17 nt, Mycobacterium bovis subsp bovis AF2122/97
gggauguagugcugcuc

SEQ ID NO: 3096567 - RNA, 18 nt, Mycobacterium bovis subsp bovis AF2122/97
gggauguagugcugcucg

SEQ ID NO: 3096568 - RNA, 21 nt, Mycobacterium bovis subsp bovis AF2122/97
gggauguagugcugcucgaca

SEQ ID NO: 3096569 - RNA, 19 nt, Mycobacterium bovis subsp bovis AF2122/97
gggauguccgcggccacca

SEQ ID NO: 3096570 - RNA, 14 nt, Mycobacterium bovis subsp bovis AF2122/97
gggauucggccaga

SEQ ID NO: 3096571 - RNA, 14 nt, Mycobacterium bovis subsp bovis AF2122/97
gggauucggguucc

SEQ ID NO: 3096572 - RNA, 19 nt, Mycobacterium bovis subsp bovis AF2122/97
gggauucgucgugcgggcg

SEQ ID NO: 3096573 - RNA, 23 nt, Mycobacterium bovis subsp bovis AF2122/97
gggauucgucgugcgggcgggcg

SEQ ID NO: 3096574 - RNA, 13 nt, Mycobacterium bovis subsp bovis AF2122/97
gggauucguuguc

SEQ ID NO: 3096575 - RNA, 18 nt, Mycobacterium bovis subsp bovis AF2122/97
gggauucugacgaccggc

SEQ ID NO: 3096576 - RNA, 16 nt, Mycobacterium bovis subsp bovis AF2122/97
gggauugcgggccugc

SEQ ID NO: 3096577 - RNA, 19 nt, Mycobacterium bovis subsp bovis AF2122/97
gggauugcgggccugcacg

SEQ ID NO: 3096578 - RNA, 22 nt, Mycobacterium bovis subsp bovis AF2122/97
gggauugcgggccugcacgccg

SEQ ID NO: 3096579 - RNA, 12 nt, Mycobacterium bovis subsp bovis AF2122/97
gggcaaacccgg

SEQ ID NO: 3096580 - RNA, 20 nt, Mycobacterium bovis subsp bovis AF2122/97
gggcaaacugggcaccggcg

SEQ ID NO: 3096581 - RNA, 18 nt, Mycobacterium bovis subsp bovis AF2122/97
gggcaaaucaagcacagc

SEQ ID NO: 3096582 - RNA, 19 nt, Mycobacterium bovis subsp bovis AF2122/97
gggcaaaucaagcacagcc

SEQ ID NO: 3096583 - RNA, 22 nt, Mycobacterium bovis subsp bovis AF2122/97
gggcaaaucaagcacagcccgg

SEQ ID NO: 3096584 - RNA, 15 nt, Mycobacterium bovis subsp bovis AF2122/97
gggcaaccagcagca

SEQ ID NO: 3096585 - RNA, 20 nt, Mycobacterium bovis subsp bovis AF2122/97
gggcaaccagcagcagguug

SEQ ID NO: 3096586 - RNA, 13 nt, Mycobacterium bovis subsp bovis AF2122/97
gggcaacgcgaac

SEQ ID NO: 3096587 - RNA, 19 nt, Mycobacterium bovis subsp bovis AF2122/97
gggcaacggacgggaucgc

SEQ ID NO: 3096588 - RNA, 15 nt, Mycobacterium bovis subsp bovis AF2122/97
gggcaacggccgcua

SEQ ID NO: 3096589 - RNA, 17 nt, Mycobacterium bovis subsp bovis AF2122/97
gggcaacucggugacgu

SEQ ID NO: 3096590 - RNA, 14 nt, Mycobacterium bovis subsp bovis AF2122/97
gggcaacugcagca

SEQ ID NO: 3096591 - RNA, 18 nt, Mycobacterium bovis subsp bovis AF2122/97
gggcaacuucagcaacgg

SEQ ID NO: 3096592 - RNA, 16 nt, Mycobacterium bovis subsp bovis AF2122/97
gggcaagaaaguucca

SEQ ID NO: 3096593 - RNA, 17 nt, Mycobacterium bovis subsp bovis AF2122/97
gggcaagcugaccgcca

SEQ ID NO: 3096594 - RNA, 14 nt, Mycobacterium bovis subsp bovis AF2122/97
gggcaaggccaccg

SEQ ID NO: 3096595 - RNA, 16 nt, Mycobacterium bovis subsp bovis AF2122/97
gggcaaggccaccggc

SEQ ID NO: 3096596 - RNA, 17 nt, Mycobacterium bovis subsp bovis AF2122/97
gggcaaggccaccggcg

SEQ ID NO: 3096597 - RNA, 17 nt, Mycobacterium bovis subsp bovis AF2122/97
gggcaaggcggcggcca

SEQ ID NO: 3096598 - RNA, 16 nt, Mycobacterium bovis subsp bovis AF2122/97
gggcaaucacaucaaa

SEQ ID NO: 3096599 - RNA, 19 nt, Mycobacterium bovis subsp bovis AF2122/97
gggcaaucaccgccggcgg

SEQ ID NO: 3096600 - RNA, 20 nt, Mycobacterium bovis subsp bovis AF2122/97
gggcaauccggucagcgcgg

SEQ ID NO: 3096601 - RNA, 22 nt, Mycobacterium bovis subsp bovis AF2122/97
gggcaaucgcucugugucgccg

SEQ ID NO: 3096602 - RNA, 20 nt, Mycobacterium bovis subsp bovis AF2122/97
gggcaaugucgacaccggcg

SEQ ID NO: 3096603 - RNA, 20 nt, Mycobacterium bovis subsp bovis AF2122/97
gggcacaaccagaucuguac

SEQ ID NO: 3096604 - RNA, 14 nt, Mycobacterium bovis subsp bovis AF2122/97
gggcacaaggguca

SEQ ID NO: 3096605 - RNA, 20 nt, Mycobacterium bovis subsp bovis AF2122/97
gggcacaauaggcuccagcg

SEQ ID NO: 3096606 - RNA, 17 nt, Mycobacterium bovis subsp bovis AF2122/97
gggcacaccgacgccgc

SEQ ID NO: 3096607 - RNA, 18 nt, Mycobacterium bovis subsp bovis AF2122/97
gggcacaccgacgccgcc

SEQ ID NO: 3096608 - RNA, 17 nt, Mycobacterium bovis subsp bovis AF2122/97
gggcacaccgcaccugg

SEQ ID NO: 3096609 - RNA, 20 nt, Mycobacterium bovis subsp bovis AF2122/97
gggcaccacccuugccgaug

SEQ ID NO: 3096610 - RNA, 22 nt, Mycobacterium bovis subsp bovis AF2122/97
gggcaccacgcugugcucgacg

SEQ ID NO: 3096611 - RNA, 19 nt, Mycobacterium bovis subsp bovis AF2122/97
gggcaccacuuggguggcg

SEQ ID NO: 3096612 - RNA, 17 nt, Mycobacterium bovis subsp bovis AF2122/97
gggcaccagucgcccca

SEQ ID NO: 3096613 - RNA, 22 nt, Mycobacterium bovis subsp bovis AF2122/97
gggcaccccgcgguagccgacc

SEQ ID NO: 3096614 - RNA, 22 nt, Mycobacterium bovis subsp bovis AF2122/97
gggcaccgagcugagcggccag

SEQ ID NO: 3096615 - RNA, 16 nt, Mycobacterium bovis subsp bovis AF2122/97
gggcaccgguuugacg

SEQ ID NO: 3096616 - RNA, 22 nt, Mycobacterium bovis subsp bovis AF2122/97
gggcaccgguuugacguccagg

SEQ ID NO: 3096617 - RNA, 12 nt, Mycobacterium bovis subsp bovis AF2122/97
gggcaccgucgg

SEQ ID NO: 3096618 - RNA, 18 nt, Mycobacterium bovis subsp bovis AF2122/97
gggcaccguuaccgccgu

SEQ ID NO: 3096619 - RNA, 21 nt, Mycobacterium bovis subsp bovis AF2122/97
gggcaccguuaccgccgucgc

SEQ ID NO: 3096620 - RNA, 18 nt, Mycobacterium bovis subsp bovis AF2122/97
gggcaccuuggccggccc

SEQ ID NO: 3096621 - RNA, 22 nt, Mycobacterium bovis subsp bovis AF2122/97
gggcaccuuggccggccccgcc

SEQ ID NO: 3096622 - RNA, 22 nt, Mycobacterium bovis subsp bovis AF2122/97
gggcacgaacaucagaucgccg

SEQ ID NO: 3096623 - RNA, 12 nt, Mycobacterium bovis subsp bovis AF2122/97
gggcacgaucgu

SEQ ID NO: 3096624 - RNA, 15 nt, Mycobacterium bovis subsp bovis AF2122/97
gggcacgcgaggcgc

SEQ ID NO: 3096625 - RNA, 12 nt, Mycobacterium bovis subsp bovis AF2122/97
gggcacggccgu

SEQ ID NO: 3096626 - RNA, 14 nt, Mycobacterium bovis subsp bovis AF2122/97
gggcacgggcaacg

SEQ ID NO: 3096627 - RNA, 14 nt, Mycobacterium bovis subsp bovis AF2122/97
gggcacguggcggu

SEQ ID NO: 3096628 - RNA, 15 nt, Mycobacterium bovis subsp bovis AF2122/97
gggcacguucggcgc

SEQ ID NO: 3096629 - RNA, 20 nt, Mycobacterium bovis subsp bovis AF2122/97
gggcacguugugaucgucag

SEQ ID NO: 3096630 - RNA, 16 nt, Mycobacterium bovis subsp bovis AF2122/97
gggcacucagcagggg

SEQ ID NO: 3096631 - RNA, 14 nt, Mycobacterium bovis subsp bovis AF2122/97
gggcacucuugucc

SEQ ID NO: 3096632 - RNA, 12 nt, Mycobacterium bovis subsp bovis AF2122/97
gggcagcaaaaa

SEQ ID NO: 3096633 - RNA, 15 nt, Mycobacterium bovis subsp bovis AF2122/97
gggcagcaccagcgc

SEQ ID NO: 3096634 - RNA, 17 nt, Mycobacterium bovis subsp bovis AF2122/97
gggcagcacccgcgcca

SEQ ID NO: 3096635 - RNA, 18 nt, Mycobacterium bovis subsp bovis AF2122/97
gggcagcacccgcgccag

SEQ ID NO: 3096636 - RNA, 16 nt, Mycobacterium bovis subsp bovis AF2122/97
gggcagcacgucacgc

SEQ ID NO: 3096637 - RNA, 14 nt, Mycobacterium bovis subsp bovis AF2122/97
gggcagcaucaaca

SEQ ID NO: 3096638 - RNA, 22 nt, Mycobacterium bovis subsp bovis AF2122/97
gggcagcaucaacaccggcugg

SEQ ID NO: 3096639 - RNA, 16 nt, Mycobacterium bovis subsp bovis AF2122/97
gggcagccccuccgcg

SEQ ID NO: 3096640 - RNA, 11 nt, Mycobacterium bovis subsp bovis AF2122/97
gggcagccgca

SEQ ID NO: 3096641 - RNA, 13 nt, Mycobacterium bovis subsp bovis AF2122/97
gggcagccgcccg

SEQ ID NO: 3096642 - RNA, 14 nt, Mycobacterium bovis subsp bovis AF2122/97
gggcagccgcccgc

SEQ ID NO: 3096643 - RNA, 15 nt, Mycobacterium bovis subsp bovis AF2122/97
gggcagccgcccgcc

SEQ ID NO: 3096644 - RNA, 22 nt, Mycobacterium bovis subsp bovis AF2122/97
gggcagccgcccgcccaccucg

SEQ ID NO: 3096645 - RNA, 11 nt, Mycobacterium bovis subsp bovis AF2122/97
gggcagccgcg

SEQ ID NO: 3096646 - RNA, 13 nt, Mycobacterium bovis subsp bovis AF2122/97
gggcagccgcgcc

SEQ ID NO: 3096647 - RNA, 11 nt, Mycobacterium bovis subsp bovis AF2122/97
gggcagccugc

SEQ ID NO: 3096648 - RNA, 16 nt, Mycobacterium bovis subsp bovis AF2122/97
gggcagccugcugcau

SEQ ID NO: 3096649 - RNA, 19 nt, Mycobacterium bovis subsp bovis AF2122/97
gggcagcgaaacgagccgg

SEQ ID NO: 3096650 - RNA, 14 nt, Mycobacterium bovis subsp bovis AF2122/97
gggcagcgccucca

SEQ ID NO: 3096651 - RNA, 16 nt, Mycobacterium bovis subsp bovis AF2122/97
gggcagcgcgaucacc

SEQ ID NO: 3096652 - RNA, 15 nt, Mycobacterium bovis subsp bovis AF2122/97
gggcagcgcggccag

SEQ ID NO: 3096653 - RNA, 16 nt, Mycobacterium bovis subsp bovis AF2122/97
gggcagcgcggccagu

SEQ ID NO: 3096654 - RNA, 17 nt, Mycobacterium bovis subsp bovis AF2122/97
gggcagcgcgugcugug

SEQ ID NO: 3096655 - RNA, 18 nt, Mycobacterium bovis subsp bovis AF2122/97
gggcagcgggccgcccuu

SEQ ID NO: 3096656 - RNA, 22 nt, Mycobacterium bovis subsp bovis AF2122/97
gggcagcuccaccaggacgugg

SEQ ID NO: 3096657 - RNA, 11 nt, Mycobacterium bovis subsp bovis AF2122/97
gggcagcuggc

SEQ ID NO: 3096658 - RNA, 12 nt, Mycobacterium bovis subsp bovis AF2122/97
gggcagcugggc

SEQ ID NO: 3096659 - RNA, 15 nt, Mycobacterium bovis subsp bovis AF2122/97
gggcagcugguaggu

SEQ ID NO: 3096660 - RNA, 14 nt, Mycobacterium bovis subsp bovis AF2122/97
gggcagcuguucgg

SEQ ID NO: 3096661 - RNA, 20 nt, Mycobacterium bovis subsp bovis AF2122/97
gggcaggagcagcacgucga

SEQ ID NO: 3096662 - RNA, 15 nt, Mycobacterium bovis subsp bovis AF2122/97
gggcaggaucgaggc

SEQ ID NO: 3096663 - RNA, 13 nt, Mycobacterium bovis subsp bovis AF2122/97
gggcaggcggcca

SEQ ID NO: 3096664 - RNA, 14 nt, Mycobacterium bovis subsp bovis AF2122/97
gggcaggcggccag

SEQ ID NO: 3096665 - RNA, 14 nt, Mycobacterium bovis subsp bovis AF2122/97
gggcaguagcugug

SEQ ID NO: 3096666 - RNA, 21 nt, Mycobacterium bovis subsp bovis AF2122/97
gggcaguaucaucggcgcugg

SEQ ID NO: 3096667 - RNA, 16 nt, Mycobacterium bovis subsp bovis AF2122/97
gggcagucaggccuag

SEQ ID NO: 3096668 - RNA, 21 nt, Mycobacterium bovis subsp bovis AF2122/97
gggcagucaggccuagcgcgg

SEQ ID NO: 3096669 - RNA, 18 nt, Mycobacterium bovis subsp bovis AF2122/97
gggcagucccggugggcg

SEQ ID NO: 3096670 - RNA, 14 nt, Mycobacterium bovis subsp bovis AF2122/97
gggcagucgagugc

SEQ ID NO: 3096671 - RNA, 13 nt, Mycobacterium bovis subsp bovis AF2122/97
gggcagugaacau

SEQ ID NO: 3096672 - RNA, 13 nt, Mycobacterium bovis subsp bovis AF2122/97
gggcagugcgcgg

SEQ ID NO: 3096673 - RNA, 18 nt, Mycobacterium bovis subsp bovis AF2122/97
gggcaguggcagcccguc

SEQ ID NO: 3096674 - RNA, 22 nt, Mycobacterium bovis subsp bovis AF2122/97
gggcaguuguugacagacacag

SEQ ID NO: 3096675 - RNA, 18 nt, Mycobacterium bovis subsp bovis AF2122/97
gggcaguuuggcggcagg

SEQ ID NO: 3096676 - RNA, 19 nt, Mycobacterium bovis subsp bovis AF2122/97
gggcaguuuggcggcaggu

SEQ ID NO: 3096677 - RNA, 15 nt, Mycobacterium bovis subsp bovis AF2122/97
gggcauaacccgcac

SEQ ID NO: 3096678 - RNA, 13 nt, Mycobacterium bovis subsp bovis AF2122/97
gggcauacagcau

SEQ ID NO: 3096679 - RNA, 17 nt, Mycobacterium bovis subsp bovis AF2122/97
gggcaucaagaaacgug

SEQ ID NO: 3096680 - RNA, 15 nt, Mycobacterium bovis subsp bovis AF2122/97
gggcaucaccgacgc

SEQ ID NO: 3096681 - RNA, 19 nt, Mycobacterium bovis subsp bovis AF2122/97
gggcaucagcagagccccg

SEQ ID NO: 3096682 - RNA, 14 nt, Mycobacterium bovis subsp bovis AF2122/97
gggcauccuucacc

SEQ ID NO: 3096683 - RNA, 14 nt, Mycobacterium bovis subsp bovis AF2122/97
gggcaucgucgccg

SEQ ID NO: 3096684 - RNA, 18 nt, Mycobacterium bovis subsp bovis AF2122/97
gggcaucgucgccgagcg

SEQ ID NO: 3096685 - RNA, 22 nt, Mycobacterium bovis subsp bovis AF2122/97
gggcaucgucgucgcugccgcc

SEQ ID NO: 3096686 - RNA, 21 nt, Mycobacterium bovis subsp bovis AF2122/97
gggcaucucggcuacgccucg

SEQ ID NO: 3096687 - RNA, 14 nt, Mycobacterium bovis subsp bovis AF2122/97
gggcauggcggcgu

SEQ ID NO: 3096688 - RNA, 16 nt, Mycobacterium bovis subsp bovis AF2122/97
gggcauggugguggcc

SEQ ID NO: 3096689 - RNA, 16 nt, Mycobacterium bovis subsp bovis AF2122/97
gggcauucccgcucgc

SEQ ID NO: 3096690 - RNA, 23 nt, Mycobacterium bovis subsp bovis AF2122/97
gggcauucccgcucgcaggccgg

SEQ ID NO: 3096691 - RNA, 16 nt, Mycobacterium bovis subsp bovis AF2122/97
gggcauugcggcgcgg

SEQ ID NO: 3096692 - RNA, 19 nt, Mycobacterium bovis subsp bovis AF2122/97
gggccaaagcgcgggcggu

SEQ ID NO: 3096693 - RNA, 15 nt, Mycobacterium bovis subsp bovis AF2122/97
gggccaaccggucgu

SEQ ID NO: 3096694 - RNA, 15 nt, Mycobacterium bovis subsp bovis AF2122/97
gggccaacgacgcca

SEQ ID NO: 3096695 - RNA, 16 nt, Mycobacterium bovis subsp bovis AF2122/97
gggccaaugccguuga

SEQ ID NO: 3096696 - RNA, 19 nt, Mycobacterium bovis subsp bovis AF2122/97
gggccacaccugcgccacc

SEQ ID NO: 3096697 - RNA, 15 nt, Mycobacterium bovis subsp bovis AF2122/97
gggccacagcaacgu

SEQ ID NO: 3096698 - RNA, 17 nt, Mycobacterium bovis subsp bovis AF2122/97
gggccaccaccacggcc

SEQ ID NO: 3096699 - RNA, 13 nt, Mycobacterium bovis subsp bovis AF2122/97
gggccaccaccuc

SEQ ID NO: 3096700 - RNA, 16 nt, Mycobacterium bovis subsp bovis AF2122/97
gggccaccacgcgccg

SEQ ID NO: 3096701 - RNA, 20 nt, Mycobacterium bovis subsp bovis AF2122/97
gggccaccaguuguccggcu

SEQ ID NO: 3096702 - RNA, 14 nt, Mycobacterium bovis subsp bovis AF2122/97
gggccaccgccgcc

SEQ ID NO: 3096703 - RNA, 21 nt, Mycobacterium bovis subsp bovis AF2122/97
gggccaccgcugucagccgac

SEQ ID NO: 3096704 - RNA, 22 nt, Mycobacterium bovis subsp bovis AF2122/97
gggccaccgcugucagccgacc

SEQ ID NO: 3096705 - RNA, 14 nt, Mycobacterium bovis subsp bovis AF2122/97
gggccaccggcgcc

SEQ ID NO: 3096706 - RNA, 19 nt, Mycobacterium bovis subsp bovis AF2122/97
gggccacgaugaucccaag

SEQ ID NO: 3096707 - RNA, 22 nt, Mycobacterium bovis subsp bovis AF2122/97
gggccacgcuucuuccgcgcgc

SEQ ID NO: 3096708 - RNA, 14 nt, Mycobacterium bovis subsp bovis AF2122/97
gggccacggcugcg

SEQ ID NO: 3096709 - RNA, 15 nt, Mycobacterium bovis subsp bovis AF2122/97
gggccacguagcagc

SEQ ID NO: 3096710 - RNA, 13 nt, Mycobacterium bovis subsp bovis AF2122/97
gggccacguccug

SEQ ID NO: 3096711 - RNA, 21 nt, Mycobacterium bovis subsp bovis AF2122/97
gggccacguccugcccgucgu

SEQ ID NO: 3096712 - RNA, 12 nt, Mycobacterium bovis subsp bovis AF2122/97
gggccacgucga

SEQ ID NO: 3096713 - RNA, 16 nt, Mycobacterium bovis subsp bovis AF2122/97
gggccacuggccgguu

SEQ ID NO: 3096714 - RNA, 19 nt, Mycobacterium bovis subsp bovis AF2122/97
gggccacuggccgguucgc

SEQ ID NO: 3096715 - RNA, 22 nt, Mycobacterium bovis subsp bovis AF2122/97
gggccacuugaugcucgaugcg

SEQ ID NO: 3096716 - RNA, 22 nt, Mycobacterium bovis subsp bovis AF2122/97
gggccagauuucugggagccgg

SEQ ID NO: 3096717 - RNA, 21 nt, Mycobacterium bovis subsp bovis AF2122/97
gggccagcaaguacgcgucgg

SEQ ID NO: 3096718 - RNA, 17 nt, Mycobacterium bovis subsp bovis AF2122/97
gggccagcagccgcgac

SEQ ID NO: 3096719 - RNA, 12 nt, Mycobacterium bovis subsp bovis AF2122/97
gggccagccgcu

SEQ ID NO: 3096720 - RNA, 13 nt, Mycobacterium bovis subsp bovis AF2122/97
gggccagccgcuc

SEQ ID NO: 3096721 - RNA, 17 nt, Mycobacterium bovis subsp bovis AF2122/97
gggccagccgcucaccc

SEQ ID NO: 3096722 - RNA, 21 nt, Mycobacterium bovis subsp bovis AF2122/97
gggccagccgcucacccgguc

SEQ ID NO: 3096723 - RNA, 17 nt, Mycobacterium bovis subsp bovis AF2122/97
gggccagcggcagccug

SEQ ID NO: 3096724 - RNA, 21 nt, Mycobacterium bovis subsp bovis AF2122/97
gggccaggcccucgacggcgu

SEQ ID NO: 3096725 - RNA, 17 nt, Mycobacterium bovis subsp bovis AF2122/97
gggccaggccgaugccg

SEQ ID NO: 3096726 - RNA, 12 nt, Mycobacterium bovis subsp bovis AF2122/97
gggccaggcgaa

SEQ ID NO: 3096727 - RNA, 13 nt, Mycobacterium bovis subsp bovis AF2122/97
gggccaggcugcg

SEQ ID NO: 3096728 - RNA, 18 nt, Mycobacterium bovis subsp bovis AF2122/97
gggccaggucagccgcgc

SEQ ID NO: 3096729 - RNA, 23 nt, Mycobacterium bovis subsp bovis AF2122/97
gggccaggucagccgcgcggguc

SEQ ID NO: 3096730 - RNA, 21 nt, Mycobacterium bovis subsp bovis AF2122/97
gggccagugaaaccaccggcc

SEQ ID NO: 3096731 - RNA, 19 nt, Mycobacterium bovis subsp bovis AF2122/97
gggccauaaaugcgcguuc

SEQ ID NO: 3096732 - RNA, 23 nt, Mycobacterium bovis subsp bovis AF2122/97
gggccauaaaugcgcguucgacc

SEQ ID NO: 3096733 - RNA, 19 nt, Mycobacterium bovis subsp bovis AF2122/97
gggccaucgcauccccagc

SEQ ID NO: 3096734 - RNA, 23 nt, Mycobacterium bovis subsp bovis AF2122/97
gggccaugcuaggaccaccagcg

SEQ ID NO: 3096735 - RNA, 18 nt, Mycobacterium bovis subsp bovis AF2122/97
gggccauggguagccgcc

SEQ ID NO: 3096736 - RNA, 20 nt, Mycobacterium bovis subsp bovis AF2122/97
gggccauggguagccgccca

SEQ ID NO: 3096737 - RNA, 21 nt, Mycobacterium bovis subsp bovis AF2122/97
gggccauguggacggcauagc

SEQ ID NO: 3096738 - RNA, 17 nt, Mycobacterium bovis subsp bovis AF2122/97
gggcccacacggugcga

SEQ ID NO: 3096739 - RNA, 16 nt, Mycobacterium bovis subsp bovis AF2122/97
gggcccaccgcugcgg

SEQ ID NO: 3096740 - RNA, 22 nt, Mycobacterium bovis subsp bovis AF2122/97
gggcccaccgcugcggcaccac

SEQ ID NO: 3096741 - RNA, 13 nt, Mycobacterium bovis subsp bovis AF2122/97
gggcccagcaggu

SEQ ID NO: 3096742 - RNA, 14 nt, Mycobacterium bovis subsp bovis AF2122/97
gggcccagccggac

SEQ ID NO: 3096743 - RNA, 15 nt, Mycobacterium bovis subsp bovis AF2122/97
gggcccagccggacc

SEQ ID NO: 3096744 - RNA, 19 nt, Mycobacterium bovis subsp bovis AF2122/97
gggcccaggacagcagccg

SEQ ID NO: 3096745 - RNA, 18 nt, Mycobacterium bovis subsp bovis AF2122/97
gggccccacaucgccccc

SEQ ID NO: 3096746 - RNA, 16 nt, Mycobacterium bovis subsp bovis AF2122/97
gggccccaugccgacc

SEQ ID NO: 3096747 - RNA, 15 nt, Mycobacterium bovis subsp bovis AF2122/97
gggccccgccgaugc

SEQ ID NO: 3096748 - RNA, 15 nt, Mycobacterium bovis subsp bovis AF2122/97
gggccccgcgccggc

SEQ ID NO: 3096749 - RNA, 12 nt, Mycobacterium bovis subsp bovis AF2122/97
gggccccgcggc

SEQ ID NO: 3096750 - RNA, 19 nt, Mycobacterium bovis subsp bovis AF2122/97
gggccccgcggcgccgcca

SEQ ID NO: 3096751 - RNA, 13 nt, Mycobacterium bovis subsp bovis AF2122/97
gggccccuccggc

SEQ ID NO: 3096752 - RNA, 20 nt, Mycobacterium bovis subsp bovis AF2122/97
gggcccgaccuguccaccca

SEQ ID NO: 3096753 - RNA, 11 nt, Mycobacterium bovis subsp bovis AF2122/97
gggcccgacgu

SEQ ID NO: 3096754 - RNA, 19 nt, Mycobacterium bovis subsp bovis AF2122/97
gggcccgagcuggccguca

SEQ ID NO: 3096755 - RNA, 13 nt, Mycobacterium bovis subsp bovis AF2122/97
gggcccgaugagg

SEQ ID NO: 3096756 - RNA, 13 nt, Mycobacterium bovis subsp bovis AF2122/97
gggcccgccggcc

SEQ ID NO: 3096757 - RNA, 16 nt, Mycobacterium bovis subsp bovis AF2122/97
gggcccgccggccccg

SEQ ID NO: 3096758 - RNA, 18 nt, Mycobacterium bovis subsp bovis AF2122/97
gggcccgccggccccgcc

SEQ ID NO: 3096759 - RNA, 19 nt, Mycobacterium bovis subsp bovis AF2122/97
gggcccgccggccccgccg

SEQ ID NO: 3096760 - RNA, 11 nt, Mycobacterium bovis subsp bovis AF2122/97
gggcccgccgu

SEQ ID NO: 3096761 - RNA, 19 nt, Mycobacterium bovis subsp bovis AF2122/97
gggcccgccgucaccgccg

SEQ ID NO: 3096762 - RNA, 16 nt, Mycobacterium bovis subsp bovis AF2122/97
gggcccgcgcggcggu

SEQ ID NO: 3096763 - RNA, 21 nt, Mycobacterium bovis subsp bovis AF2122/97
gggcccgcguucucggcaccc

SEQ ID NO: 3096764 - RNA, 22 nt, Mycobacterium bovis subsp bovis AF2122/97
gggcccgcguucucggcacccu

SEQ ID NO: 3096765 - RNA, 13 nt, Mycobacterium bovis subsp bovis AF2122/97
gggcccgcugggc

SEQ ID NO: 3096766 - RNA, 15 nt, Mycobacterium bovis subsp bovis AF2122/97
gggcccggcgagcua

SEQ ID NO: 3096767 - RNA, 16 nt, Mycobacterium bovis subsp bovis AF2122/97
gggcccuagccggcgc

SEQ ID NO: 3096768 - RNA, 20 nt, Mycobacterium bovis subsp bovis AF2122/97
gggcccuccacugcgagcgc

SEQ ID NO: 3096769 - RNA, 14 nt, Mycobacterium bovis subsp bovis AF2122/97
gggcccugcuggcc

SEQ ID NO: 3096770 - RNA, 14 nt, Mycobacterium bovis subsp bovis AF2122/97
gggcccuggcggcc

SEQ ID NO: 3096771 - RNA, 19 nt, Mycobacterium bovis subsp bovis AF2122/97
gggcccuggcggcccgggu

SEQ ID NO: 3096772 - RNA, 14 nt, Mycobacterium bovis subsp bovis AF2122/97
gggcccugggagau

SEQ ID NO: 3096773 - RNA, 22 nt, Mycobacterium bovis subsp bovis AF2122/97
gggcccuucacuguugcccuug

SEQ ID NO: 3096774 - RNA, 21 nt, Mycobacterium bovis subsp bovis AF2122/97
gggcccuuugcuguccccgcc

SEQ ID NO: 3096775 - RNA, 12 nt, Mycobacterium bovis subsp bovis AF2122/97
gggccgaagcgc

SEQ ID NO: 3096776 - RNA, 20 nt, Mycobacterium bovis subsp bovis AF2122/97
gggccgaagcgcgcgcguga

SEQ ID NO: 3096777 - RNA, 18 nt, Mycobacterium bovis subsp bovis AF2122/97
gggccgaauaccacaccg

SEQ ID NO: 3096778 - RNA, 14 nt, Mycobacterium bovis subsp bovis AF2122/97
gggccgaccagagc

SEQ ID NO: 3096779 - RNA, 19 nt, Mycobacterium bovis subsp bovis AF2122/97
gggccgacgggacaacccg

SEQ ID NO: 3096780 - RNA, 16 nt, Mycobacterium bovis subsp bovis AF2122/97
gggccgacugggcgcg

SEQ ID NO: 3096781 - RNA, 13 nt, Mycobacterium bovis subsp bovis AF2122/97
gggccgagcgcac

SEQ ID NO: 3096782 - RNA, 16 nt, Mycobacterium bovis subsp bovis AF2122/97
gggccgagcgcaccac

SEQ ID NO: 3096783 - RNA, 16 nt, Mycobacterium bovis subsp bovis AF2122/97
gggccgagcgcgccgu

SEQ ID NO: 3096784 - RNA, 21 nt, Mycobacterium bovis subsp bovis AF2122/97
gggccgagcgcgccguugccg

SEQ ID NO: 3096785 - RNA, 17 nt, Mycobacterium bovis subsp bovis AF2122/97
gggccgaguucgucagc

SEQ ID NO: 3096786 - RNA, 22 nt, Mycobacterium bovis subsp bovis AF2122/97
gggccgauugcucggggaggaa

SEQ ID NO: 3096787 - RNA, 23 nt, Mycobacterium bovis subsp bovis AF2122/97
gggccgcacguauccacggucga

SEQ ID NO: 3096788 - RNA, 15 nt, Mycobacterium bovis subsp bovis AF2122/97
gggccgccaccagcg

SEQ ID NO: 3096789 - RNA, 16 nt, Mycobacterium bovis subsp bovis AF2122/97
gggccgccaccagcgc

SEQ ID NO: 3096790 - RNA, 15 nt, Mycobacterium bovis subsp bovis AF2122/97
gggccgccagcggcg

SEQ ID NO: 3096791 - RNA, 16 nt, Mycobacterium bovis subsp bovis AF2122/97
gggccgccagcggcga

SEQ ID NO: 3096792 - RNA, 12 nt, Mycobacterium bovis subsp bovis AF2122/97
gggccgccagcu

SEQ ID NO: 3096793 - RNA, 14 nt, Mycobacterium bovis subsp bovis AF2122/97
gggccgccgaagcu

SEQ ID NO: 3096794 - RNA, 12 nt, Mycobacterium bovis subsp bovis AF2122/97
gggccgccgagc

SEQ ID NO: 3096795 - RNA, 13 nt, Mycobacterium bovis subsp bovis AF2122/97
gggccgccgagcg

SEQ ID NO: 3096796 - RNA, 16 nt, Mycobacterium bovis subsp bovis AF2122/97
gggccgccgagcggac

SEQ ID NO: 3096797 - RNA, 17 nt, Mycobacterium bovis subsp bovis AF2122/97
gggccgccgagcggacc

SEQ ID NO: 3096798 - RNA, 22 nt, Mycobacterium bovis subsp bovis AF2122/97
gggccgccgagcggaccaccgc

SEQ ID NO: 3096799 - RNA, 12 nt, Mycobacterium bovis subsp bovis AF2122/97
gggccgccgccc

SEQ ID NO: 3096800 - RNA, 13 nt, Mycobacterium bovis subsp bovis AF2122/97
gggccgccgcccu

SEQ ID NO: 3096801 - RNA, 13 nt, Mycobacterium bovis subsp bovis AF2122/97
gggccgccgcggc

SEQ ID NO: 3096802 - RNA, 11 nt, Mycobacterium bovis subsp bovis AF2122/97
gggccgccgcu

SEQ ID NO: 3096803 - RNA, 14 nt, Mycobacterium bovis subsp bovis AF2122/97
gggccgccucgcgg

SEQ ID NO: 3096804 - RNA, 17 nt, Mycobacterium bovis subsp bovis AF2122/97
gggccgcgcccuguccu

SEQ ID NO: 3096805 - RNA, 23 nt, Mycobacterium bovis subsp bovis AF2122/97
gggccgcgcgcacuugcguggcg

SEQ ID NO: 3096806 - RNA, 23 nt, Mycobacterium bovis subsp bovis AF2122/97
gggccgcgcgcagagcguacagg

SEQ ID NO: 3096807 - RNA, 18 nt, Mycobacterium bovis subsp bovis AF2122/97
gggccgcgcgggccgccg

SEQ ID NO: 3096808 - RNA, 12 nt, Mycobacterium bovis subsp bovis AF2122/97
gggccgcgcuga

SEQ ID NO: 3096809 - RNA, 14 nt, Mycobacterium bovis subsp bovis AF2122/97
gggccgcggccaca

SEQ ID NO: 3096810 - RNA, 20 nt, Mycobacterium bovis subsp bovis AF2122/97
gggccgcggccacaucgcca

SEQ ID NO: 3096811 - RNA, 17 nt, Mycobacterium bovis subsp bovis AF2122/97
gggccgcggcggccagc

SEQ ID NO: 3096812 - RNA, 23 nt, Mycobacterium bovis subsp bovis AF2122/97
gggccgcucacaagccgugcagc

SEQ ID NO: 3096813 - RNA, 21 nt, Mycobacterium bovis subsp bovis AF2122/97
gggccgcuccaccacgaccgc

SEQ ID NO: 3096814 - RNA, 14 nt, Mycobacterium bovis subsp bovis AF2122/97
gggccgcucgccuc

SEQ ID NO: 3096815 - RNA, 21 nt, Mycobacterium bovis subsp bovis AF2122/97
gggccggaccaucagcgucga

SEQ ID NO: 3096816 - RNA, 13 nt, Mycobacterium bovis subsp bovis AF2122/97
gggccggagccgg

SEQ ID NO: 3096817 - RNA, 15 nt, Mycobacterium bovis subsp bovis AF2122/97
gggccggagccggug

SEQ ID NO: 3096818 - RNA, 16 nt, Mycobacterium bovis subsp bovis AF2122/97
gggccggagccggugc

SEQ ID NO: 3096819 - RNA, 18 nt, Mycobacterium bovis subsp bovis AF2122/97
gggccggagccggugccg

SEQ ID NO: 3096820 - RNA, 23 nt, Mycobacterium bovis subsp bovis AF2122/97
gggccggagccggugccgacggc

SEQ ID NO: 3096821 - RNA, 20 nt, Mycobacterium bovis subsp bovis AF2122/97
gggccggaugacgcccaggg

SEQ ID NO: 3096822 - RNA, 18 nt, Mycobacterium bovis subsp bovis AF2122/97
gggccggaugggcgucga

SEQ ID NO: 3096823 - RNA, 17 nt, Mycobacterium bovis subsp bovis AF2122/97
gggccggcaccgcagcg

SEQ ID NO: 3096824 - RNA, 18 nt, Mycobacterium bovis subsp bovis AF2122/97
gggccggcacugccgagc

SEQ ID NO: 3096825 - RNA, 14 nt, Mycobacterium bovis subsp bovis AF2122/97
gggccggccgagcg

SEQ ID NO: 3096826 - RNA, 14 nt, Mycobacterium bovis subsp bovis AF2122/97
gggccggccgccgc

SEQ ID NO: 3096827 - RNA, 13 nt, Mycobacterium bovis subsp bovis AF2122/97
gggccggccggca

SEQ ID NO: 3096828 - RNA, 13 nt, Mycobacterium bovis subsp bovis AF2122/97
gggccggcgcggu

SEQ ID NO: 3096829 - RNA, 15 nt, Mycobacterium bovis subsp bovis AF2122/97
gggccggcggcucgg

SEQ ID NO: 3096830 - RNA, 13 nt, Mycobacterium bovis subsp bovis AF2122/97
gggccggcgucga

SEQ ID NO: 3096831 - RNA, 14 nt, Mycobacterium bovis subsp bovis AF2122/97
gggccggcuagggc

SEQ ID NO: 3096832 - RNA, 20 nt, Mycobacterium bovis subsp bovis AF2122/97
gggccgggcuccucugguug

SEQ ID NO: 3096833 - RNA, 13 nt, Mycobacterium bovis subsp bovis AF2122/97
gggccgguccggg

SEQ ID NO: 3096834 - RNA, 19 nt, Mycobacterium bovis subsp bovis AF2122/97
gggccgguccggggcaacg

SEQ ID NO: 3096835 - RNA, 19 nt, Mycobacterium bovis subsp bovis AF2122/97
gggccggucgugccggggc

SEQ ID NO: 3096836 - RNA, 12 nt, Mycobacterium bovis subsp bovis AF2122/97
gggccggugcga

SEQ ID NO: 3096837 - RNA, 21 nt, Mycobacterium bovis subsp bovis AF2122/97
gggccgguugaugguccgcca

SEQ ID NO: 3096838 - RNA, 13 nt, Mycobacterium bovis subsp bovis AF2122/97
gggccguacggcg

SEQ ID NO: 3096839 - RNA, 14 nt, Mycobacterium bovis subsp bovis AF2122/97
gggccguacggcgc

SEQ ID NO: 3096840 - RNA, 17 nt, Mycobacterium bovis subsp bovis AF2122/97
gggccguacggcgcgua

SEQ ID NO: 3096841 - RNA, 20 nt, Mycobacterium bovis subsp bovis AF2122/97
gggccgucaguuaaaggugg

SEQ ID NO: 3096842 - RNA, 22 nt, Mycobacterium bovis subsp bovis AF2122/97
gggccguccggcuuggcggcga

SEQ ID NO: 3096843 - RNA, 23 nt, Mycobacterium bovis subsp bovis AF2122/97
gggccguccggcuuggcggcgau

SEQ ID NO: 3096844 - RNA, 13 nt, Mycobacterium bovis subsp bovis AF2122/97
gggccguccgggu

SEQ ID NO: 3096845 - RNA, 16 nt, Mycobacterium bovis subsp bovis AF2122/97
gggccgucgccgucca

SEQ ID NO: 3096846 - RNA, 12 nt, Mycobacterium bovis subsp bovis AF2122/97
gggccgucggca

SEQ ID NO: 3096847 - RNA, 13 nt, Mycobacterium bovis subsp bovis AF2122/97
gggccgucgggga

SEQ ID NO: 3096848 - RNA, 15 nt, Mycobacterium bovis subsp bovis AF2122/97
gggccgucucgccgu

SEQ ID NO: 3096849 - RNA, 18 nt, Mycobacterium bovis subsp bovis AF2122/97
gggccgucucgccgugga

SEQ ID NO: 3096850 - RNA, 21 nt, Mycobacterium bovis subsp bovis AF2122/97
gggccguuuguagaucugggc

SEQ ID NO: 3096851 - RNA, 21 nt, Mycobacterium bovis subsp bovis AF2122/97
gggccuaucccgaaucucacc

SEQ ID NO: 3096852 - RNA, 19 nt, Mycobacterium bovis subsp bovis AF2122/97
gggccucagcuaccccggc

SEQ ID NO: 3096853 - RNA, 20 nt, Mycobacterium bovis subsp bovis AF2122/97
gggccucagcuaccccggcg

SEQ ID NO: 3096854 - RNA, 22 nt, Mycobacterium bovis subsp bovis AF2122/97
gggccucagcuaccccggcggu

SEQ ID NO: 3096855 - RNA, 16 nt, Mycobacterium bovis subsp bovis AF2122/97
gggccuccacccgcca

SEQ ID NO: 3096856 - RNA, 12 nt, Mycobacterium bovis subsp bovis AF2122/97
gggccuccugcu

SEQ ID NO: 3096857 - RNA, 16 nt, Mycobacterium bovis subsp bovis AF2122/97
gggccuccugcuggcc

SEQ ID NO: 3096858 - RNA, 15 nt, Mycobacterium bovis subsp bovis AF2122/97
gggccucgaccgcca

SEQ ID NO: 3096859 - RNA, 17 nt, Mycobacterium bovis subsp bovis AF2122/97
gggccucgaccgccagc

SEQ ID NO: 3096860 - RNA, 22 nt, Mycobacterium bovis subsp bovis AF2122/97
gggccucgaccgccagccgcga

SEQ ID NO: 3096861 - RNA, 19 nt, Mycobacterium bovis subsp bovis AF2122/97
gggccucgaucagcgccgg

SEQ ID NO: 3096862 - RNA, 15 nt, Mycobacterium bovis subsp bovis AF2122/97
gggccucggucgcca

SEQ ID NO: 3096863 - RNA, 23 nt, Mycobacterium bovis subsp bovis AF2122/97
gggccucguugaccagaaccugg

SEQ ID NO: 3096864 - RNA, 15 nt, Mycobacterium bovis subsp bovis AF2122/97
gggccugaaccacgc

SEQ ID NO: 3096865 - RNA, 16 nt, Mycobacterium bovis subsp bovis AF2122/97
gggccugaguguuguc

SEQ ID NO: 3096866 - RNA, 16 nt, Mycobacterium bovis subsp bovis AF2122/97
gggccugcacgccggc

SEQ ID NO: 3096867 - RNA, 18 nt, Mycobacterium bovis subsp bovis AF2122/97
gggccugcacgccggcgc

SEQ ID NO: 3096868 - RNA, 20 nt, Mycobacterium bovis subsp bovis AF2122/97
gggccugcacgccggcgcug

SEQ ID NO: 3096869 - RNA, 13 nt, Mycobacterium bovis subsp bovis AF2122/97
gggccugcccggc

SEQ ID NO: 3096870 - RNA, 13 nt, Mycobacterium bovis subsp bovis AF2122/97
gggccugcgcaga

SEQ ID NO: 3096871 - RNA, 16 nt, Mycobacterium bovis subsp bovis AF2122/97
gggccugcguccgacg

SEQ ID NO: 3096872 - RNA, 16 nt, Mycobacterium bovis subsp bovis AF2122/97
gggccuggcccacgcc

SEQ ID NO: 3096873 - RNA, 16 nt, Mycobacterium bovis subsp bovis AF2122/97
gggccugggccgcaca

SEQ ID NO: 3096874 - RNA, 17 nt, Mycobacterium bovis subsp bovis AF2122/97
gggccuggucccaccgc

SEQ ID NO: 3096875 - RNA, 19 nt, Mycobacterium bovis subsp bovis AF2122/97
gggccuucagcucaccacc

SEQ ID NO: 3096876 - RNA, 13 nt, Mycobacterium bovis subsp bovis AF2122/97
gggccuucgccac

SEQ ID NO: 3096877 - RNA, 21 nt, Mycobacterium bovis subsp bovis AF2122/97
gggccuuguugccgcgccacu

SEQ ID NO: 3096878 - RNA, 21 nt, Mycobacterium bovis subsp bovis AF2122/97
gggcgaaacgcccgggcggcg

SEQ ID NO: 3096879 - RNA, 15 nt, Mycobacterium bovis subsp bovis AF2122/97
gggcgaacggcaccg

SEQ ID NO: 3096880 - RNA, 17 nt, Mycobacterium bovis subsp bovis AF2122/97
gggcgaacggcaccgcg

SEQ ID NO: 3096881 - RNA, 14 nt, Mycobacterium bovis subsp bovis AF2122/97
gggcgaagcccaga

SEQ ID NO: 3096882 - RNA, 18 nt, Mycobacterium bovis subsp bovis AF2122/97
gggcgaauccggcgggug

SEQ ID NO: 3096883 - RNA, 13 nt, Mycobacterium bovis subsp bovis AF2122/97
gggcgaccaccac

SEQ ID NO: 3096884 - RNA, 19 nt, Mycobacterium bovis subsp bovis AF2122/97
gggcgaccaccaccgccgc

SEQ ID NO: 3096885 - RNA, 22 nt, Mycobacterium bovis subsp bovis AF2122/97
gggcgaccaccaccgccgccga

SEQ ID NO: 3096886 - RNA, 13 nt, Mycobacterium bovis subsp bovis AF2122/97
gggcgaccaccgc

SEQ ID NO: 3096887 - RNA, 20 nt, Mycobacterium bovis subsp bovis AF2122/97
gggcgacccguucucgguga

SEQ ID NO: 3096888 - RNA, 20 nt, Mycobacterium bovis subsp bovis AF2122/97
gggcgaccugguggacucgg

SEQ ID NO: 3096889 - RNA, 13 nt, Mycobacterium bovis subsp bovis AF2122/97
gggcgacgacgug

SEQ ID NO: 3096890 - RNA, 13 nt, Mycobacterium bovis subsp bovis AF2122/97
gggcgacgcggcg

SEQ ID NO: 3096891 - RNA, 13 nt, Mycobacterium bovis subsp bovis AF2122/97
gggcgacguccgc

SEQ ID NO: 3096892 - RNA, 15 nt, Mycobacterium bovis subsp bovis AF2122/97
gggcgagaccgcgag

SEQ ID NO: 3096893 - RNA, 20 nt, Mycobacterium bovis subsp bovis AF2122/97
gggcgagccaguaccaggua

SEQ ID NO: 3096894 - RNA, 18 nt, Mycobacterium bovis subsp bovis AF2122/97
gggcgagccgugccagca

SEQ ID NO: 3096895 - RNA, 15 nt, Mycobacterium bovis subsp bovis AF2122/97
gggcgagcgcggccu

SEQ ID NO: 3096896 - RNA, 15 nt, Mycobacterium bovis subsp bovis AF2122/97
gggcgagcucgucga

SEQ ID NO: 3096897 - RNA, 19 nt, Mycobacterium bovis subsp bovis AF2122/97
gggcgagguaauccgcggg

SEQ ID NO: 3096898 - RNA, 16 nt, Mycobacterium bovis subsp bovis AF2122/97
gggcgaguacaggcgc

SEQ ID NO: 3096899 - RNA, 20 nt, Mycobacterium bovis subsp bovis AF2122/97
gggcgaguagucgacgucga

SEQ ID NO: 3096900 - RNA, 17 nt, Mycobacterium bovis subsp bovis AF2122/97
gggcgagucccggcggu

SEQ ID NO: 3096901 - RNA, 16 nt, Mycobacterium bovis subsp bovis AF2122/97
gggcgagucgaucucg

SEQ ID NO: 3096902 - RNA, 17 nt, Mycobacterium bovis subsp bovis AF2122/97
gggcgagucgggggccg

SEQ ID NO: 3096903 - RNA, 19 nt, Mycobacterium bovis subsp bovis AF2122/97
gggcgauaaggaccgcgcc

SEQ ID NO: 3096904 - RNA, 18 nt, Mycobacterium bovis subsp bovis AF2122/97
gggcgaucgacaccguga

SEQ ID NO: 3096905 - RNA, 16 nt, Mycobacterium bovis subsp bovis AF2122/97
gggcgaucgucagcca

SEQ ID NO: 3096906 - RNA, 18 nt, Mycobacterium bovis subsp bovis AF2122/97
gggcgaugacgccaucga

SEQ ID NO: 3096907 - RNA, 20 nt, Mycobacterium bovis subsp bovis AF2122/97
gggcgaugcgggccgccagg

SEQ ID NO: 3096908 - RNA, 21 nt, Mycobacterium bovis subsp bovis AF2122/97
gggcgaugcgggccgccaggc

SEQ ID NO: 3096909 - RNA, 14 nt, Mycobacterium bovis subsp bovis AF2122/97
gggcgauggcaccg

SEQ ID NO: 3096910 - RNA, 16 nt, Mycobacterium bovis subsp bovis AF2122/97
gggcgaugucggcugg

SEQ ID NO: 3096911 - RNA, 22 nt, Mycobacterium bovis subsp bovis AF2122/97
gggcgauucugugucugcucgc

SEQ ID NO: 3096912 - RNA, 22 nt, Mycobacterium bovis subsp bovis AF2122/97
gggcgauuuccaucgcgaccuc

SEQ ID NO: 3096913 - RNA, 15 nt, Mycobacterium bovis subsp bovis AF2122/97
gggcgauuucggcgc

SEQ ID NO: 3096914 - RNA, 16 nt, Mycobacterium bovis subsp bovis AF2122/97
gggcgauuucggcgcc

SEQ ID NO: 3096915 - RNA, 19 nt, Mycobacterium bovis subsp bovis AF2122/97
gggcgauuuugcgucugcu

SEQ ID NO: 3096916 - RNA, 21 nt, Mycobacterium bovis subsp bovis AF2122/97
gggcgauuuugcgucugcucg

SEQ ID NO: 3096917 - RNA, 19 nt, Mycobacterium bovis subsp bovis AF2122/97
gggcgcaacgagagcggcu

SEQ ID NO: 3096918 - RNA, 14 nt, Mycobacterium bovis subsp bovis AF2122/97
gggcgcaacgggac

SEQ ID NO: 3096919 - RNA, 14 nt, Mycobacterium bovis subsp bovis AF2122/97
gggcgcaccaggga

SEQ ID NO: 3096920 - RNA, 16 nt, Mycobacterium bovis subsp bovis AF2122/97
gggcgcagagucaacg

SEQ ID NO: 3096921 - RNA, 13 nt, Mycobacterium bovis subsp bovis AF2122/97
gggcgcagguugg

SEQ ID NO: 3096922 - RNA, 22 nt, Mycobacterium bovis subsp bovis AF2122/97
gggcgcagguuggcaagcacgg

SEQ ID NO: 3096923 - RNA, 12 nt, Mycobacterium bovis subsp bovis AF2122/97
gggcgccccagg

SEQ ID NO: 3096924 - RNA, 20 nt, Mycobacterium bovis subsp bovis AF2122/97
gggcgccccagggggcgugc

SEQ ID NO: 3096925 - RNA, 12 nt, Mycobacterium bovis subsp bovis AF2122/97
gggcgcccgccc

SEQ ID NO: 3096926 - RNA, 18 nt, Mycobacterium bovis subsp bovis AF2122/97
gggcgcccgccccgcgcc

SEQ ID NO: 3096927 - RNA, 17 nt, Mycobacterium bovis subsp bovis AF2122/97
gggcgcccgcgugacgc

SEQ ID NO: 3096928 - RNA, 12 nt, Mycobacterium bovis subsp bovis AF2122/97
gggcgcccggcc

SEQ ID NO: 3096929 - RNA, 16 nt, Mycobacterium bovis subsp bovis AF2122/97
gggcgcccggccaggu

SEQ ID NO: 3096930 - RNA, 20 nt, Mycobacterium bovis subsp bovis AF2122/97
gggcgcccuuaagccggcgc

SEQ ID NO: 3096931 - RNA, 16 nt, Mycobacterium bovis subsp bovis AF2122/97
gggcgccgacaccggc

SEQ ID NO: 3096932 - RNA, 12 nt, Mycobacterium bovis subsp bovis AF2122/97
gggcgccgacga

SEQ ID NO: 3096933 - RNA, 15 nt, Mycobacterium bovis subsp bovis AF2122/97
gggcgccgcgcucga

SEQ ID NO: 3096934 - RNA, 17 nt, Mycobacterium bovis subsp bovis AF2122/97
gggcgccgcuaggugac

SEQ ID NO: 3096935 - RNA, 22 nt, Mycobacterium bovis subsp bovis AF2122/97
gggcgccugaugcggccggcgc

SEQ ID NO: 3096936 - RNA, 16 nt, Mycobacterium bovis subsp bovis AF2122/97
gggcgcgaacggcggu

SEQ ID NO: 3096937 - RNA, 16 nt, Mycobacterium bovis subsp bovis AF2122/97
gggcgcgagcagacgc

SEQ ID NO: 3096938 - RNA, 15 nt, Mycobacterium bovis subsp bovis AF2122/97
gggcgcgcaucugcu

SEQ ID NO: 3096939 - RNA, 23 nt, Mycobacterium bovis subsp bovis AF2122/97
gggcgcgccggccaugccuucgg

SEQ ID NO: 3096940 - RNA, 23 nt, Mycobacterium bovis subsp bovis AF2122/97
gggcgcgcuaucaugaccaccga

SEQ ID NO: 3096941 - RNA, 17 nt, Mycobacterium bovis subsp bovis AF2122/97
gggcgcgcucaucgacc

SEQ ID NO: 3096942 - RNA, 21 nt, Mycobacterium bovis subsp bovis AF2122/97
gggcgcgcugcccacggaggg

SEQ ID NO: 3096943 - RNA, 21 nt, Mycobacterium bovis subsp bovis AF2122/97
gggcgcgcuggcgggcggcgu

SEQ ID NO: 3096944 - RNA, 13 nt, Mycobacterium bovis subsp bovis AF2122/97
gggcgcggaucug

SEQ ID NO: 3096945 - RNA, 18 nt, Mycobacterium bovis subsp bovis AF2122/97
gggcgcggaucugcagca

SEQ ID NO: 3096946 - RNA, 16 nt, Mycobacterium bovis subsp bovis AF2122/97
gggcgcgggcgccggg

SEQ ID NO: 3096947 - RNA, 12 nt, Mycobacterium bovis subsp bovis AF2122/97
gggcgcggggcg

SEQ ID NO: 3096948 - RNA, 16 nt, Mycobacterium bovis subsp bovis AF2122/97
gggcgcggggcggccu

SEQ ID NO: 3096949 - RNA, 18 nt, Mycobacterium bovis subsp bovis AF2122/97
gggcgcgggugaccaggc

SEQ ID NO: 3096950 - RNA, 18 nt, Mycobacterium bovis subsp bovis AF2122/97
gggcgcgggugcgccggc

SEQ ID NO: 3096951 - RNA, 22 nt, Mycobacterium bovis subsp bovis AF2122/97
gggcgcguagcucagcgguaga

SEQ ID NO: 3096952 - RNA, 13 nt, Mycobacterium bovis subsp bovis AF2122/97
gggcgcgucggcg

SEQ ID NO: 3096953 - RNA, 19 nt, Mycobacterium bovis subsp bovis AF2122/97
gggcgcgugggcgugcagg

SEQ ID NO: 3096954 - RNA, 23 nt, Mycobacterium bovis subsp bovis AF2122/97
gggcgcgugggcgugcaggcugg

SEQ ID NO: 3096955 - RNA, 13 nt, Mycobacterium bovis subsp bovis AF2122/97
gggcgcucggucu

SEQ ID NO: 3096956 - RNA, 18 nt, Mycobacterium bovis subsp bovis AF2122/97
gggcgcugccaauccgau

SEQ ID NO: 3096957 - RNA, 22 nt, Mycobacterium bovis subsp bovis AF2122/97
gggcgcuugcaccaggggcgcg

SEQ ID NO: 3096958 - RNA, 12 nt, Mycobacterium bovis subsp bovis AF2122/97
gggcggagccga

SEQ ID NO: 3096959 - RNA, 13 nt, Mycobacterium bovis subsp bovis AF2122/97
gggcggagccgau

SEQ ID NO: 3096960 - RNA, 19 nt, Mycobacterium bovis subsp bovis AF2122/97
gggcggauacaugguccgg

SEQ ID NO: 3096961 - RNA, 15 nt, Mycobacterium bovis subsp bovis AF2122/97
gggcggaucgccggg

SEQ ID NO: 3096962 - RNA, 18 nt, Mycobacterium bovis subsp bovis AF2122/97
gggcggcaacggcggcaa

SEQ ID NO: 3096963 - RNA, 21 nt, Mycobacterium bovis subsp bovis AF2122/97
gggcggcaacgggggcgccgg

SEQ ID NO: 3096964 - RNA, 18 nt, Mycobacterium bovis subsp bovis AF2122/97
gggcggcauagcucagac

SEQ ID NO: 3096965 - RNA, 18 nt, Mycobacterium bovis subsp bovis AF2122/97
gggcggcauuggcggugc

SEQ ID NO: 3096966 - RNA, 21 nt, Mycobacterium bovis subsp bovis AF2122/97
gggcggccaccgcacgcuggc

SEQ ID NO: 3096967 - RNA, 12 nt, Mycobacterium bovis subsp bovis AF2122/97
gggcggccagca

SEQ ID NO: 3096968 - RNA, 14 nt, Mycobacterium bovis subsp bovis AF2122/97
gggcggccaggcgc

SEQ ID NO: 3096969 - RNA, 13 nt, Mycobacterium bovis subsp bovis AF2122/97
gggcggcccaccg

SEQ ID NO: 3096970 - RNA, 17 nt, Mycobacterium bovis subsp bovis AF2122/97
gggcggcccaccggcca

SEQ ID NO: 3096971 - RNA, 18 nt, Mycobacterium bovis subsp bovis AF2122/97
gggcggcccaccggccac

SEQ ID NO: 3096972 - RNA, 14 nt, Mycobacterium bovis subsp bovis AF2122/97
gggcggccggcggc

SEQ ID NO: 3096973 - RNA, 16 nt, Mycobacterium bovis subsp bovis AF2122/97
gggcggccggcggcca

SEQ ID NO: 3096974 - RNA, 20 nt, Mycobacterium bovis subsp bovis AF2122/97
gggcggcgaccucggcggcg

SEQ ID NO: 3096975 - RNA, 21 nt, Mycobacterium bovis subsp bovis AF2122/97
gggcggcggugggcgcggacc

SEQ ID NO: 3096976 - RNA, 19 nt, Mycobacterium bovis subsp bovis AF2122/97
gggcggcgucgcggaucug

SEQ ID NO: 3096977 - RNA, 22 nt, Mycobacterium bovis subsp bovis AF2122/97
gggcggcgucggugagcgcguc

SEQ ID NO: 3096978 - RNA, 15 nt, Mycobacterium bovis subsp bovis AF2122/97
gggcggcgucugcgc

SEQ ID NO: 3096979 - RNA, 14 nt, Mycobacterium bovis subsp bovis AF2122/97
gggcggcucgucga

SEQ ID NO: 3096980 - RNA, 16 nt, Mycobacterium bovis subsp bovis AF2122/97
gggcgggaaccccggc

SEQ ID NO: 3096981 - RNA, 17 nt, Mycobacterium bovis subsp bovis AF2122/97
gggcgggaaccccggcc

SEQ ID NO: 3096982 - RNA, 19 nt, Mycobacterium bovis subsp bovis AF2122/97
gggcgggauggccgccgac

SEQ ID NO: 3096983 - RNA, 14 nt, Mycobacterium bovis subsp bovis AF2122/97
gggcgggccugcgc

SEQ ID NO: 3096984 - RNA, 23 nt, Mycobacterium bovis subsp bovis AF2122/97
gggcgggccugcgcgauccgcgc

SEQ ID NO: 3096985 - RNA, 20 nt, Mycobacterium bovis subsp bovis AF2122/97
gggcgguagccauccgugaa

SEQ ID NO: 3096986 - RNA, 15 nt, Mycobacterium bovis subsp bovis AF2122/97
gggcggugaggcagc

SEQ ID NO: 3096987 - RNA, 17 nt, Mycobacterium bovis subsp bovis AF2122/97
gggcggugaggcagcga

SEQ ID NO: 3096988 - RNA, 19 nt, Mycobacterium bovis subsp bovis AF2122/97
gggcggugcacaccgucgc

SEQ ID NO: 3096989 - RNA, 10 nt, Mycobacterium bovis subsp bovis AF2122/97
gggcgguggg

SEQ ID NO: 3096990 - RNA, 16 nt, Mycobacterium bovis subsp bovis AF2122/97
gggcguacucggcgcg

SEQ ID NO: 3096991 - RNA, 20 nt, Mycobacterium bovis subsp bovis AF2122/97
gggcgucaagcaaguccacc

SEQ ID NO: 3096992 - RNA, 21 nt, Mycobacterium bovis subsp bovis AF2122/97
gggcgucaagcaaguccaccg

SEQ ID NO: 3096993 - RNA, 16 nt, Mycobacterium bovis subsp bovis AF2122/97
gggcguccacgcugac

SEQ ID NO: 3096994 - RNA, 15 nt, Mycobacterium bovis subsp bovis AF2122/97
gggcguccgccggcg

SEQ ID NO: 3096995 - RNA, 23 nt, Mycobacterium bovis subsp bovis AF2122/97
gggcguccuucuuguuggucccg

SEQ ID NO: 3096996 - RNA, 16 nt, Mycobacterium bovis subsp bovis AF2122/97
gggcgucgaagaccgc

SEQ ID NO: 3096997 - RNA, 16 nt, Mycobacterium bovis subsp bovis AF2122/97
gggcgucgaccacgca

SEQ ID NO: 3096998 - RNA, 21 nt, Mycobacterium bovis subsp bovis AF2122/97
gggcgucgcaacccggccugg

SEQ ID NO: 3096999 - RNA, 18 nt, Mycobacterium bovis subsp bovis AF2122/97
gggcgucgcaacgcgauc

SEQ ID NO: 3097000 - RNA, 16 nt, Mycobacterium bovis subsp bovis AF2122/97
gggcgucgccgccggg

SEQ ID NO: 3097001 - RNA, 18 nt, Mycobacterium bovis subsp bovis AF2122/97
gggcgucgccgccgggca

SEQ ID NO: 3097002 - RNA, 19 nt, Mycobacterium bovis subsp bovis AF2122/97
gggcgucguagucgucggc

SEQ ID NO: 3097003 - RNA, 18 nt, Mycobacterium bovis subsp bovis AF2122/97
gggcgucgucgaguuggc

SEQ ID NO: 3097004 - RNA, 22 nt, Mycobacterium bovis subsp bovis AF2122/97
gggcgucgucggugaucaccgc

SEQ ID NO: 3097005 - RNA, 18 nt, Mycobacterium bovis subsp bovis AF2122/97
gggcgucugcagcgggcg

SEQ ID NO: 3097006 - RNA, 18 nt, Mycobacterium bovis subsp bovis AF2122/97
gggcgugacgggcaggag

SEQ ID NO: 3097007 - RNA, 18 nt, Mycobacterium bovis subsp bovis AF2122/97
gggcgugaucccgcccaa

SEQ ID NO: 3097008 - RNA, 14 nt, Mycobacterium bovis subsp bovis AF2122/97
gggcgugccgccgc

SEQ ID NO: 3097009 - RNA, 16 nt, Mycobacterium bovis subsp bovis AF2122/97
gggcgugcuacacccg

SEQ ID NO: 3097010 - RNA, 17 nt, Mycobacterium bovis subsp bovis AF2122/97
gggcgugcuacacccgu

SEQ ID NO: 3097011 - RNA, 12 nt, Mycobacterium bovis subsp bovis AF2122/97
gggcgugcucgc

SEQ ID NO: 3097012 - RNA, 16 nt, Mycobacterium bovis subsp bovis AF2122/97
gggcgugcucgccggg

SEQ ID NO: 3097013 - RNA, 13 nt, Mycobacterium bovis subsp bovis AF2122/97
gggcgugggcacc

SEQ ID NO: 3097014 - RNA, 23 nt, Mycobacterium bovis subsp bovis AF2122/97
gggcgugguaaccagggcagccg

SEQ ID NO: 3097015 - RNA, 17 nt, Mycobacterium bovis subsp bovis AF2122/97
gggcguggugagcagug

SEQ ID NO: 3097016 - RNA, 20 nt, Mycobacterium bovis subsp bovis AF2122/97
gggcguguaaccccaggcgc

SEQ ID NO: 3097017 - RNA, 18 nt, Mycobacterium bovis subsp bovis AF2122/97
gggcgugugcaguccgau

SEQ ID NO: 3097018 - RNA, 21 nt, Mycobacterium bovis subsp bovis AF2122/97
gggcguuggcggcaagggugg

SEQ ID NO: 3097019 - RNA, 16 nt, Mycobacterium bovis subsp bovis AF2122/97
gggcguuggcgggcug

SEQ ID NO: 3097020 - RNA, 21 nt, Mycobacterium bovis subsp bovis AF2122/97
gggcguuucagacacuggucg

SEQ ID NO: 3097021 - RNA, 22 nt, Mycobacterium bovis subsp bovis AF2122/97
gggcguuucagacacuggucgc

SEQ ID NO: 3097022 - RNA, 17 nt, Mycobacterium bovis subsp bovis AF2122/97
gggcuaauccagcagca

SEQ ID NO: 3097023 - RNA, 17 nt, Mycobacterium bovis subsp bovis AF2122/97
gggcuaccggcagcugc

SEQ ID NO: 3097024 - RNA, 19 nt, Mycobacterium bovis subsp bovis AF2122/97
gggcuaccggcagcugcuc

SEQ ID NO: 3097025 - RNA, 20 nt, Mycobacterium bovis subsp bovis AF2122/97
gggcuaccggcagcugcucg

SEQ ID NO: 3097026 - RNA, 14 nt, Mycobacterium bovis subsp bovis AF2122/97
gggcuaccggcgcc

SEQ ID NO: 3097027 - RNA, 21 nt, Mycobacterium bovis subsp bovis AF2122/97
gggcuaccggcgccgcgcggc

SEQ ID NO: 3097028 - RNA, 18 nt, Mycobacterium bovis subsp bovis AF2122/97
gggcuacuaggcccagca

SEQ ID NO: 3097029 - RNA, 13 nt, Mycobacterium bovis subsp bovis AF2122/97
gggcuagucgggg

SEQ ID NO: 3097030 - RNA, 15 nt, Mycobacterium bovis subsp bovis AF2122/97
gggcuaucguggcgg

SEQ ID NO: 3097031 - RNA, 15 nt, Mycobacterium bovis subsp bovis AF2122/97
gggcucaagucuccc

SEQ ID NO: 3097032 - RNA, 14 nt, Mycobacterium bovis subsp bovis AF2122/97
gggcuccaacaggu

SEQ ID NO: 3097033 - RNA, 21 nt, Mycobacterium bovis subsp bovis AF2122/97
gggcuccaauugcggccgcgc

SEQ ID NO: 3097034 - RNA, 22 nt, Mycobacterium bovis subsp bovis AF2122/97
gggcuccccggauuccucguca

SEQ ID NO: 3097035 - RNA, 16 nt, Mycobacterium bovis subsp bovis AF2122/97
gggcuccucgugcacg

SEQ ID NO: 3097036 - RNA, 23 nt, Mycobacterium bovis subsp bovis AF2122/97
gggcucgacguauuggcgcagca

SEQ ID NO: 3097037 - RNA, 12 nt, Mycobacterium bovis subsp bovis AF2122/97
gggcucggcagg

SEQ ID NO: 3097038 - RNA, 13 nt, Mycobacterium bovis subsp bovis AF2122/97
gggcucggcggcc

SEQ ID NO: 3097039 - RNA, 14 nt, Mycobacterium bovis subsp bovis AF2122/97
gggcucggcggccc

SEQ ID NO: 3097040 - RNA, 18 nt, Mycobacterium bovis subsp bovis AF2122/97
gggcucgguggcgccggg

SEQ ID NO: 3097041 - RNA, 19 nt, Mycobacterium bovis subsp bovis AF2122/97
gggcucguaggugggcucg

SEQ ID NO: 3097042 - RNA, 14 nt, Mycobacterium bovis subsp bovis AF2122/97
gggcucguccagca

SEQ ID NO: 3097043 - RNA, 16 nt, Mycobacterium bovis subsp bovis AF2122/97
gggcucguccagcaac

SEQ ID NO: 3097044 - RNA, 21 nt, Mycobacterium bovis subsp bovis AF2122/97
gggcucgucgaguggaucaca

SEQ ID NO: 3097045 - RNA, 19 nt, Mycobacterium bovis subsp bovis AF2122/97
gggcucuacucgcggccgg

SEQ ID NO: 3097046 - RNA, 19 nt, Mycobacterium bovis subsp bovis AF2122/97
gggcucucgaguccaggca

SEQ ID NO: 3097047 - RNA, 16 nt, Mycobacterium bovis subsp bovis AF2122/97
gggcucucggcgucga

SEQ ID NO: 3097048 - RNA, 22 nt, Mycobacterium bovis subsp bovis AF2122/97
gggcucugcugccagccgaagc

SEQ ID NO: 3097049 - RNA, 17 nt, Mycobacterium bovis subsp bovis AF2122/97
gggcucuggccaguccg

SEQ ID NO: 3097050 - RNA, 20 nt, Mycobacterium bovis subsp bovis AF2122/97
gggcucuucgcagcgguggu

SEQ ID NO: 3097051 - RNA, 15 nt, Mycobacterium bovis subsp bovis AF2122/97
gggcugaggcggcga

SEQ ID NO: 3097052 - RNA, 20 nt, Mycobacterium bovis subsp bovis AF2122/97
gggcugauggacggugcgca

SEQ ID NO: 3097053 - RNA, 13 nt, Mycobacterium bovis subsp bovis AF2122/97
gggcugcccgcgg

SEQ ID NO: 3097054 - RNA, 13 nt, Mycobacterium bovis subsp bovis AF2122/97
gggcugccgccca

SEQ ID NO: 3097055 - RNA, 12 nt, Mycobacterium bovis subsp bovis AF2122/97
gggcugcggaug

SEQ ID NO: 3097056 - RNA, 19 nt, Mycobacterium bovis subsp bovis AF2122/97
gggcugcugcucggccugg

SEQ ID NO: 3097057 - RNA, 18 nt, Mycobacterium bovis subsp bovis AF2122/97
gggcugcuugcgcccggc

SEQ ID NO: 3097058 - RNA, 17 nt, Mycobacterium bovis subsp bovis AF2122/97
gggcugggauagcgcgg

SEQ ID NO: 3097059 - RNA, 17 nt, Mycobacterium bovis subsp bovis AF2122/97
gggcuggguggccaacc

SEQ ID NO: 3097060 - RNA, 14 nt, Mycobacterium bovis subsp bovis AF2122/97
gggcuguccaccga

SEQ ID NO: 3097061 - RNA, 16 nt, Mycobacterium bovis subsp bovis AF2122/97
gggcuguccgaccucg

SEQ ID NO: 3097062 - RNA, 22 nt, Mycobacterium bovis subsp bovis AF2122/97
gggcuguucggccauggcggcg

SEQ ID NO: 3097063 - RNA, 15 nt, Mycobacterium bovis subsp bovis AF2122/97
gggcuguugacgcca

SEQ ID NO: 3097064 - RNA, 21 nt, Mycobacterium bovis subsp bovis AF2122/97
gggcuguugacgccacgacgc

SEQ ID NO: 3097065 - RNA, 22 nt, Mycobacterium bovis subsp bovis AF2122/97
gggcuguugacgccacgacgcc

SEQ ID NO: 3097066 - RNA, 21 nt, Mycobacterium bovis subsp bovis AF2122/97
gggcuuacuuaaccaggcgag

SEQ ID NO: 3097067 - RNA, 19 nt, Mycobacterium bovis subsp bovis AF2122/97
gggcuuagcgcgggccugg

SEQ ID NO: 3097068 - RNA, 18 nt, Mycobacterium bovis subsp bovis AF2122/97
gggcuuaugcgucugcuc

SEQ ID NO: 3097069 - RNA, 22 nt, Mycobacterium bovis subsp bovis AF2122/97
gggcuuccgacaugaaccgguc

SEQ ID NO: 3097070 - RNA, 14 nt, Mycobacterium bovis subsp bovis AF2122/97
gggcuucggccaga

SEQ ID NO: 3097071 - RNA, 17 nt, Mycobacterium bovis subsp bovis AF2122/97
gggcuucugcgucugcu

SEQ ID NO: 3097072 - RNA, 14 nt, Mycobacterium bovis subsp bovis AF2122/97
gggcuugagcgccg

SEQ ID NO: 3097073 - RNA, 16 nt, Mycobacterium bovis subsp bovis AF2122/97
gggcuugccgcgcacc

SEQ ID NO: 3097074 - RNA, 17 nt, Mycobacterium bovis subsp bovis AF2122/97
gggcuugccgcgcacca

SEQ ID NO: 3097075 - RNA, 19 nt, Mycobacterium bovis subsp bovis AF2122/97
gggcuuggccgcgccgguc

SEQ ID NO: 3097076 - RNA, 20 nt, Mycobacterium bovis subsp bovis AF2122/97
gggcuuggggucccgccggg

SEQ ID NO: 3097077 - RNA, 14 nt, Mycobacterium bovis subsp bovis AF2122/97
gggcuuggugccca

SEQ ID NO: 3097078 - RNA, 15 nt, Mycobacterium bovis subsp bovis AF2122/97
gggcuugugggccgg

SEQ ID NO: 3097079 - RNA, 19 nt, Mycobacterium bovis subsp bovis AF2122/97
gggcuuuagugucugcucg

SEQ ID NO: 3097080 - RNA, 20 nt, Mycobacterium bovis subsp bovis AF2122/97
gggcuuuagugucugcucgc

SEQ ID NO: 3097081 - RNA, 23 nt, Mycobacterium bovis subsp bovis AF2122/97
gggcuuucgcgugcggcugccag

SEQ ID NO: 3097082 - RNA, 15 nt, Mycobacterium bovis subsp bovis AF2122/97
gggcuuugccgucga

SEQ ID NO: 3097083 - RNA, 17 nt, Mycobacterium bovis subsp bovis AF2122/97
gggcuuugucaccggcu

SEQ ID NO: 3097084 - RNA, 18 nt, Mycobacterium bovis subsp bovis AF2122/97
gggcuuuuacgucugcuc

SEQ ID NO: 3097085 - RNA, 18 nt, Mycobacterium bovis subsp bovis AF2122/97
gggcuuuugcgucugcuc

SEQ ID NO: 3097086 - RNA, 19 nt, Mycobacterium bovis subsp bovis AF2122/97
gggcuuuugcgucugcucg

SEQ ID NO: 3097087 - RNA, 20 nt, Mycobacterium bovis subsp bovis AF2122/97
gggcuuuugcgucugcucgc

SEQ ID NO: 3097088 - RNA, 20 nt, Mycobacterium bovis subsp bovis AF2122/97
ggggaaaccggccagccgac

SEQ ID NO: 3097089 - RNA, 16 nt, Mycobacterium bovis subsp bovis AF2122/97
ggggaaagccgcagcc

SEQ ID NO: 3097090 - RNA, 16 nt, Mycobacterium bovis subsp bovis AF2122/97
ggggaacaccgcggug

SEQ ID NO: 3097091 - RNA, 16 nt, Mycobacterium bovis subsp bovis AF2122/97
ggggaacagcagcgca

SEQ ID NO: 3097092 - RNA, 21 nt, Mycobacterium bovis subsp bovis AF2122/97
ggggaagaucucggccaggau

SEQ ID NO: 3097093 - RNA, 13 nt, Mycobacterium bovis subsp bovis AF2122/97
ggggaagccugcg

SEQ ID NO: 3097094 - RNA, 14 nt, Mycobacterium bovis subsp bovis AF2122/97
ggggaagccugcgg

SEQ ID NO: 3097095 - RNA, 19 nt, Mycobacterium bovis subsp bovis AF2122/97
ggggaaguuggcugagcag

SEQ ID NO: 3097096 - RNA, 24 nt, Mycobacterium bovis subsp bovis AF2122/97
ggggaaguuggcugagcagcgcgg

SEQ ID NO: 3097097 - RNA, 14 nt, Mycobacterium bovis subsp bovis AF2122/97
ggggaaucacccac

SEQ ID NO: 3097098 - RNA, 22 nt, Mycobacterium bovis subsp bovis AF2122/97
ggggaaugaguguugccgacga

SEQ ID NO: 3097099 - RNA, 14 nt, Mycobacterium bovis subsp bovis AF2122/97
ggggaccccgccag

SEQ ID NO: 3097100 - RNA, 11 nt, Mycobacterium bovis subsp bovis AF2122/97
ggggacccgga

SEQ ID NO: 3097101 - RNA, 23 nt, Mycobacterium bovis subsp bovis AF2122/97
ggggacccggaccuucggcggug

SEQ ID NO: 3097102 - RNA, 18 nt, Mycobacterium bovis subsp bovis AF2122/97
ggggacccggggccguug

SEQ ID NO: 3097103 - RNA, 14 nt, Mycobacterium bovis subsp bovis AF2122/97
ggggaccgcggcgc

SEQ ID NO: 3097104 - RNA, 16 nt, Mycobacterium bovis subsp bovis AF2122/97
ggggaccgcggcgcgu

SEQ ID NO: 3097105 - RNA, 21 nt, Mycobacterium bovis subsp bovis AF2122/97
ggggaccucggcgaucaagcc

SEQ ID NO: 3097106 - RNA, 16 nt, Mycobacterium bovis subsp bovis AF2122/97
ggggacgccgcggcgc

SEQ ID NO: 3097107 - RNA, 16 nt, Mycobacterium bovis subsp bovis AF2122/97
ggggacggcggcgagg

SEQ ID NO: 3097108 - RNA, 20 nt, Mycobacterium bovis subsp bovis AF2122/97
ggggacggcggcgaggcggu

SEQ ID NO: 3097109 - RNA, 14 nt, Mycobacterium bovis subsp bovis AF2122/97
ggggacgggcggcc

SEQ ID NO: 3097110 - RNA, 17 nt, Mycobacterium bovis subsp bovis AF2122/97
ggggacgggcggccagg

SEQ ID NO: 3097111 - RNA, 15 nt, Mycobacterium bovis subsp bovis AF2122/97
ggggacgggucgccg

SEQ ID NO: 3097112 - RNA, 17 nt, Mycobacterium bovis subsp bovis AF2122/97
ggggacgugcccggugu

SEQ ID NO: 3097113 - RNA, 23 nt, Mycobacterium bovis subsp bovis AF2122/97
ggggacucauggccggucugcug

SEQ ID NO: 3097114 - RNA, 14 nt, Mycobacterium bovis subsp bovis AF2122/97
ggggagcggccgcc

SEQ ID NO: 3097115 - RNA, 16 nt, Mycobacterium bovis subsp bovis AF2122/97
ggggagcuauucggug

SEQ ID NO: 3097116 - RNA, 19 nt, Mycobacterium bovis subsp bovis AF2122/97
ggggagcuauucggugucg

SEQ ID NO: 3097117 - RNA, 13 nt, Mycobacterium bovis subsp bovis AF2122/97
ggggaggaaaucc

SEQ ID NO: 3097118 - RNA, 16 nt, Mycobacterium bovis subsp bovis AF2122/97
ggggaggaaauccaau

SEQ ID NO: 3097119 - RNA, 12 nt, Mycobacterium bovis subsp bovis AF2122/97
ggggaggcuagg

SEQ ID NO: 3097120 - RNA, 17 nt, Mycobacterium bovis subsp bovis AF2122/97
ggggaguaguggugggc

SEQ ID NO: 3097121 - RNA, 19 nt, Mycobacterium bovis subsp bovis AF2122/97
ggggaguucgcgcagcacc

SEQ ID NO: 3097122 - RNA, 20 nt, Mycobacterium bovis subsp bovis AF2122/97
ggggaguucgcgcagcaccg

SEQ ID NO: 3097123 - RNA, 21 nt, Mycobacterium bovis subsp bovis AF2122/97
ggggaguucgcgcagcaccgg

SEQ ID NO: 3097124 - RNA, 16 nt, Mycobacterium bovis subsp bovis AF2122/97
ggggaguugcuugcag

SEQ ID NO: 3097125 - RNA, 15 nt, Mycobacterium bovis subsp bovis AF2122/97
ggggaguuggugaac

SEQ ID NO: 3097126 - RNA, 21 nt, Mycobacterium bovis subsp bovis AF2122/97
ggggauaccgcugggucgccg

SEQ ID NO: 3097127 - RNA, 14 nt, Mycobacterium bovis subsp bovis AF2122/97
ggggaucagcgagu

SEQ ID NO: 3097128 - RNA, 12 nt, Mycobacterium bovis subsp bovis AF2122/97
ggggaucagcgu

SEQ ID NO: 3097129 - RNA, 19 nt, Mycobacterium bovis subsp bovis AF2122/97
ggggaucgcuggccgcgag

SEQ ID NO: 3097130 - RNA, 18 nt, Mycobacterium bovis subsp bovis AF2122/97
ggggaucguccggccggg

SEQ ID NO: 3097131 - RNA, 21 nt, Mycobacterium bovis subsp bovis AF2122/97
ggggaugacgguuugcagcgg

SEQ ID NO: 3097132 - RNA, 14 nt, Mycobacterium bovis subsp bovis AF2122/97
ggggauggagccgg

SEQ ID NO: 3097133 - RNA, 17 nt, Mycobacterium bovis subsp bovis AF2122/97
ggggaugggggagccgg

SEQ ID NO: 3097134 - RNA, 14 nt, Mycobacterium bovis subsp bovis AF2122/97
ggggauggucccgc

SEQ ID NO: 3097135 - RNA, 18 nt, Mycobacterium bovis subsp bovis AF2122/97
ggggauguuuuuggccgc

SEQ ID NO: 3097136 - RNA, 17 nt, Mycobacterium bovis subsp bovis AF2122/97
ggggauuucgcgucugc

SEQ ID NO: 3097137 - RNA, 20 nt, Mycobacterium bovis subsp bovis AF2122/97
ggggauuuugcgucugcucg

SEQ ID NO: 3097138 - RNA, 17 nt, Mycobacterium bovis subsp bovis AF2122/97
ggggcaaacggggucaa

SEQ ID NO: 3097139 - RNA, 21 nt, Mycobacterium bovis subsp bovis AF2122/97
ggggcaacgaucagguuggcg

SEQ ID NO: 3097140 - RNA, 16 nt, Mycobacterium bovis subsp bovis AF2122/97
ggggcaauccccugga

SEQ ID NO: 3097141 - RNA, 20 nt, Mycobacterium bovis subsp bovis AF2122/97
ggggcaccacgcugugcucg

SEQ ID NO: 3097142 - RNA, 18 nt, Mycobacterium bovis subsp bovis AF2122/97
ggggcaccgagcugagcg

SEQ ID NO: 3097143 - RNA, 21 nt, Mycobacterium bovis subsp bovis AF2122/97
ggggcaccguuaccgccgucg

SEQ ID NO: 3097144 - RNA, 16 nt, Mycobacterium bovis subsp bovis AF2122/97
ggggcacgacgccggc

SEQ ID NO: 3097145 - RNA, 16 nt, Mycobacterium bovis subsp bovis AF2122/97
ggggcacuggggucug

SEQ ID NO: 3097146 - RNA, 18 nt, Mycobacterium bovis subsp bovis AF2122/97
ggggcacuuccagcccgg

SEQ ID NO: 3097147 - RNA, 18 nt, Mycobacterium bovis subsp bovis AF2122/97
ggggcagccgggcgucgc

SEQ ID NO: 3097148 - RNA, 13 nt, Mycobacterium bovis subsp bovis AF2122/97
ggggcagcgacgg

SEQ ID NO: 3097149 - RNA, 14 nt, Mycobacterium bovis subsp bovis AF2122/97
ggggcagcgacggc

SEQ ID NO: 3097150 - RNA, 13 nt, Mycobacterium bovis subsp bovis AF2122/97
ggggcagcgcggc

SEQ ID NO: 3097151 - RNA, 20 nt, Mycobacterium bovis subsp bovis AF2122/97
ggggcagguccgccccguug

SEQ ID NO: 3097152 - RNA, 18 nt, Mycobacterium bovis subsp bovis AF2122/97
ggggcaggucgagcgccc

SEQ ID NO: 3097153 - RNA, 14 nt, Mycobacterium bovis subsp bovis AF2122/97
ggggcagucaacuc

SEQ ID NO: 3097154 - RNA, 19 nt, Mycobacterium bovis subsp bovis AF2122/97
ggggcaucggugcgguucg

SEQ ID NO: 3097155 - RNA, 13 nt, Mycobacterium bovis subsp bovis AF2122/97
ggggccccaugcc

SEQ ID NO: 3097156 - RNA, 15 nt, Mycobacterium bovis subsp bovis AF2122/97
ggggccccaugccga

SEQ ID NO: 3097157 - RNA, 15 nt, Mycobacterium bovis subsp bovis AF2122/97
ggggccccgcgccgg

SEQ ID NO: 3097158 - RNA, 19 nt, Mycobacterium bovis subsp bovis AF2122/97
ggggccccgcggcgccgcc

SEQ ID NO: 3097159 - RNA, 16 nt, Mycobacterium bovis subsp bovis AF2122/97
ggggcccgaccugucc

SEQ ID NO: 3097160 - RNA, 15 nt, Mycobacterium bovis subsp bovis AF2122/97
ggggccgagccgaca

SEQ ID NO: 3097161 - RNA, 20 nt, Mycobacterium bovis subsp bovis AF2122/97
ggggccgccagcugcgcagc

SEQ ID NO: 3097162 - RNA, 13 nt, Mycobacterium bovis subsp bovis AF2122/97
ggggccgccgcgg

SEQ ID NO: 3097163 - RNA, 20 nt, Mycobacterium bovis subsp bovis AF2122/97
ggggccgccgcggccggcgc

SEQ ID NO: 3097164 - RNA, 20 nt, Mycobacterium bovis subsp bovis AF2122/97
ggggccggcacugccgagca

SEQ ID NO: 3097165 - RNA, 13 nt, Mycobacterium bovis subsp bovis AF2122/97
ggggccgggcucc

SEQ ID NO: 3097166 - RNA, 14 nt, Mycobacterium bovis subsp bovis AF2122/97
ggggccggucgggc

SEQ ID NO: 3097167 - RNA, 11 nt, Mycobacterium bovis subsp bovis AF2122/97
ggggccgucgg

SEQ ID NO: 3097168 - RNA, 20 nt, Mycobacterium bovis subsp bovis AF2122/97
ggggccgucgucggucaccg

SEQ ID NO: 3097169 - RNA, 19 nt, Mycobacterium bovis subsp bovis AF2122/97
ggggccgucucgccgugga

SEQ ID NO: 3097170 - RNA, 20 nt, Mycobacterium bovis subsp bovis AF2122/97
ggggccucguugaccagaac

SEQ ID NO: 3097171 - RNA, 11 nt, Mycobacterium bovis subsp bovis AF2122/97
ggggccugcgu

SEQ ID NO: 3097172 - RNA, 14 nt, Mycobacterium bovis subsp bovis AF2122/97
ggggccugcguccg

SEQ ID NO: 3097173 - RNA, 18 nt, Mycobacterium bovis subsp bovis AF2122/97
ggggccuggucccaccgc

SEQ ID NO: 3097174 - RNA, 23 nt, Mycobacterium bovis subsp bovis AF2122/97
ggggccuugggcguacucggcgc

SEQ ID NO: 3097175 - RNA, 12 nt, Mycobacterium bovis subsp bovis AF2122/97
ggggcgaccugg

SEQ ID NO: 3097176 - RNA, 15 nt, Mycobacterium bovis subsp bovis AF2122/97
ggggcgcaccgagcg

SEQ ID NO: 3097177 - RNA, 14 nt, Mycobacterium bovis subsp bovis AF2122/97
ggggcgcagcgcgg

SEQ ID NO: 3097178 - RNA, 15 nt, Mycobacterium bovis subsp bovis AF2122/97
ggggcgcagcgcggc

SEQ ID NO: 3097179 - RNA, 12 nt, Mycobacterium bovis subsp bovis AF2122/97
ggggcgcccggc

SEQ ID NO: 3097180 - RNA, 13 nt, Mycobacterium bovis subsp bovis AF2122/97
ggggcgcccggcc

SEQ ID NO: 3097181 - RNA, 15 nt, Mycobacterium bovis subsp bovis AF2122/97
ggggcgcccggccag

SEQ ID NO: 3097182 - RNA, 15 nt, Mycobacterium bovis subsp bovis AF2122/97
ggggcgccgccguug

SEQ ID NO: 3097183 - RNA, 23 nt, Mycobacterium bovis subsp bovis AF2122/97
ggggcgccggauauggcaguguc

SEQ ID NO: 3097184 - RNA, 14 nt, Mycobacterium bovis subsp bovis AF2122/97
ggggcgccugaugc

SEQ ID NO: 3097185 - RNA, 18 nt, Mycobacterium bovis subsp bovis AF2122/97
ggggcgccuuaggcgucc

SEQ ID NO: 3097186 - RNA, 23 nt, Mycobacterium bovis subsp bovis AF2122/97
ggggcgccuuaggcguccgagcg

SEQ ID NO: 3097187 - RNA, 12 nt, Mycobacterium bovis subsp bovis AF2122/97
ggggcgcgccgg

SEQ ID NO: 3097188 - RNA, 17 nt, Mycobacterium bovis subsp bovis AF2122/97
ggggcgcgccggcuagg

SEQ ID NO: 3097189 - RNA, 11 nt, Mycobacterium bovis subsp bovis AF2122/97
ggggcgcgugg

SEQ ID NO: 3097190 - RNA, 16 nt, Mycobacterium bovis subsp bovis AF2122/97
ggggcgcucgcgcgcu

SEQ ID NO: 3097191 - RNA, 22 nt, Mycobacterium bovis subsp bovis AF2122/97
ggggcgcuuccguggcccaacc

SEQ ID NO: 3097192 - RNA, 14 nt, Mycobacterium bovis subsp bovis AF2122/97
ggggcggcgguggg

SEQ ID NO: 3097193 - RNA, 15 nt, Mycobacterium bovis subsp bovis AF2122/97
ggggcggugggcgcu

SEQ ID NO: 3097194 - RNA, 23 nt, Mycobacterium bovis subsp bovis AF2122/97
ggggcguaguuaugccaaaccga

SEQ ID NO: 3097195 - RNA, 14 nt, Mycobacterium bovis subsp bovis AF2122/97
ggggcgucgccgcc

SEQ ID NO: 3097196 - RNA, 22 nt, Mycobacterium bovis subsp bovis AF2122/97
ggggcgucguucgcgggugcgc

SEQ ID NO: 3097197 - RNA, 22 nt, Mycobacterium bovis subsp bovis AF2122/97
ggggcgugccgccgcagauggg

SEQ ID NO: 3097198 - RNA, 20 nt, Mycobacterium bovis subsp bovis AF2122/97
ggggcguuagggccgccauc

SEQ ID NO: 3097199 - RNA, 18 nt, Mycobacterium bovis subsp bovis AF2122/97
ggggcguuguugggcgag

SEQ ID NO: 3097200 - RNA, 18 nt, Mycobacterium bovis subsp bovis AF2122/97
ggggcuacuaggcccagc

SEQ ID NO: 3097201 - RNA, 20 nt, Mycobacterium bovis subsp bovis AF2122/97
ggggcuacuaggcccagcac

SEQ ID NO: 3097202 - RNA, 15 nt, Mycobacterium bovis subsp bovis AF2122/97
ggggcucagcggugg

SEQ ID NO: 3097203 - RNA, 16 nt, Mycobacterium bovis subsp bovis AF2122/97
ggggcucagcgguggc

SEQ ID NO: 3097204 - RNA, 17 nt, Mycobacterium bovis subsp bovis AF2122/97
ggggcucguaggugggc

SEQ ID NO: 3097205 - RNA, 22 nt, Mycobacterium bovis subsp bovis AF2122/97
ggggcucucgaguccaggcagc

SEQ ID NO: 3097206 - RNA, 13 nt, Mycobacterium bovis subsp bovis AF2122/97
ggggcugccgccg

SEQ ID NO: 3097207 - RNA, 23 nt, Mycobacterium bovis subsp bovis AF2122/97
ggggcugccggugagugcgcgau

SEQ ID NO: 3097208 - RNA, 20 nt, Mycobacterium bovis subsp bovis AF2122/97
ggggcugcugcucggccugg

SEQ ID NO: 3097209 - RNA, 19 nt, Mycobacterium bovis subsp bovis AF2122/97
ggggcugggcgccaugcgc

SEQ ID NO: 3097210 - RNA, 13 nt, Mycobacterium bovis subsp bovis AF2122/97
ggggcuguacucg

SEQ ID NO: 3097211 - RNA, 14 nt, Mycobacterium bovis subsp bovis AF2122/97
ggggcuguagucga

SEQ ID NO: 3097212 - RNA, 12 nt, Mycobacterium bovis subsp bovis AF2122/97
ggggcugugcag

SEQ ID NO: 3097213 - RNA, 14 nt, Mycobacterium bovis subsp bovis AF2122/97
ggggcugugcaggc

SEQ ID NO: 3097214 - RNA, 18 nt, Mycobacterium bovis subsp bovis AF2122/97
ggggcuucugcgucugcu

SEQ ID NO: 3097215 - RNA, 20 nt, Mycobacterium bovis subsp bovis AF2122/97
ggggcuucugcgucugcucg

SEQ ID NO: 3097216 - RNA, 22 nt, Mycobacterium bovis subsp bovis AF2122/97
ggggcuucugcgucugcucgcg

SEQ ID NO: 3097217 - RNA, 19 nt, Mycobacterium bovis subsp bovis AF2122/97
ggggcuuuuacgucugcuc

SEQ ID NO: 3097218 - RNA, 19 nt, Mycobacterium bovis subsp bovis AF2122/97
ggggcuuuugcgucugcuc

SEQ ID NO: 3097219 - RNA, 20 nt, Mycobacterium bovis subsp bovis AF2122/97
ggggcuuuugcgucugcucg

SEQ ID NO: 3097220 - RNA, 12 nt, Mycobacterium bovis subsp bovis AF2122/97
gggggacccgga

SEQ ID NO: 3097221 - RNA, 14 nt, Mycobacterium bovis subsp bovis AF2122/97
gggggacgggucgc

SEQ ID NO: 3097222 - RNA, 15 nt, Mycobacterium bovis subsp bovis AF2122/97
gggggagcggccgcc

SEQ ID NO: 3097223 - RNA, 16 nt, Mycobacterium bovis subsp bovis AF2122/97
gggggauccagcaggc

SEQ ID NO: 3097224 - RNA, 23 nt, Mycobacterium bovis subsp bovis AF2122/97
gggggaucucgagccgcggcaac

SEQ ID NO: 3097225 - RNA, 19 nt, Mycobacterium bovis subsp bovis AF2122/97
gggggauuucgcgucugcu

SEQ ID NO: 3097226 - RNA, 20 nt, Mycobacterium bovis subsp bovis AF2122/97
gggggauuucgcgucugcuc

SEQ ID NO: 3097227 - RNA, 21 nt, Mycobacterium bovis subsp bovis AF2122/97
gggggauuucgcgucugcucg

SEQ ID NO: 3097228 - RNA, 13 nt, Mycobacterium bovis subsp bovis AF2122/97
gggggcagcuccg

SEQ ID NO: 3097229 - RNA, 13 nt, Mycobacterium bovis subsp bovis AF2122/97
gggggcaggucga

SEQ ID NO: 3097230 - RNA, 11 nt, Mycobacterium bovis subsp bovis AF2122/97
gggggccggca

SEQ ID NO: 3097231 - RNA, 13 nt, Mycobacterium bovis subsp bovis AF2122/97
gggggcgccggcg

SEQ ID NO: 3097232 - RNA, 21 nt, Mycobacterium bovis subsp bovis AF2122/97
gggggcuuaugcgucugcucg

SEQ ID NO: 3097233 - RNA, 20 nt, Mycobacterium bovis subsp bovis AF2122/97
gggggcuuauguguccgcuc

SEQ ID NO: 3097234 - RNA, 19 nt, Mycobacterium bovis subsp bovis AF2122/97
gggggcuucugcgucugcu

SEQ ID NO: 3097235 - RNA, 21 nt, Mycobacterium bovis subsp bovis AF2122/97
gggggcuucugcgucugcucg

SEQ ID NO: 3097236 - RNA, 19 nt, Mycobacterium bovis subsp bovis AF2122/97
gggggcuuuugcgucugcu

SEQ ID NO: 3097237 - RNA, 20 nt, Mycobacterium bovis subsp bovis AF2122/97
gggggcuuuugcgucugcug

SEQ ID NO: 3097238 - RNA, 17 nt, Mycobacterium bovis subsp bovis AF2122/97
gggggucuugccgagca

SEQ ID NO: 3097239 - RNA, 14 nt, Mycobacterium bovis subsp bovis AF2122/97
gggguacaggcugc

SEQ ID NO: 3097240 - RNA, 20 nt, Mycobacterium bovis subsp bovis AF2122/97
gggguaccucccgcgugcgg

SEQ ID NO: 3097241 - RNA, 14 nt, Mycobacterium bovis subsp bovis AF2122/97
gggguaggggucga

SEQ ID NO: 3097242 - RNA, 18 nt, Mycobacterium bovis subsp bovis AF2122/97
gggguaguugaggccguc

SEQ ID NO: 3097243 - RNA, 20 nt, Mycobacterium bovis subsp bovis AF2122/97
gggguaucgacccuccagca

SEQ ID NO: 3097244 - RNA, 24 nt, Mycobacterium bovis subsp bovis AF2122/97
gggguaucgacccuccagcacgcc

SEQ ID NO: 3097245 - RNA, 21 nt, Mycobacterium bovis subsp bovis AF2122/97
gggguaucgccagccaaccgu

SEQ ID NO: 3097246 - RNA, 17 nt, Mycobacterium bovis subsp bovis AF2122/97
ggggucaaucggguucg

SEQ ID NO: 3097247 - RNA, 11 nt, Mycobacterium bovis subsp bovis AF2122/97
gggguccagcg

SEQ ID NO: 3097248 - RNA, 14 nt, Mycobacterium bovis subsp bovis AF2122/97
gggguccagcgucc

SEQ ID NO: 3097249 - RNA, 20 nt, Mycobacterium bovis subsp bovis AF2122/97
gggguccggauggccccgcc

SEQ ID NO: 3097250 - RNA, 13 nt, Mycobacterium bovis subsp bovis AF2122/97
gggguccggcggc

SEQ ID NO: 3097251 - RNA, 13 nt, Mycobacterium bovis subsp bovis AF2122/97
ggggucgaacgcg

SEQ ID NO: 3097252 - RNA, 15 nt, Mycobacterium bovis subsp bovis AF2122/97
ggggucgcaggccag

SEQ ID NO: 3097253 - RNA, 16 nt, Mycobacterium bovis subsp bovis AF2122/97
ggggucgcaggccagg

SEQ ID NO: 3097254 - RNA, 16 nt, Mycobacterium bovis subsp bovis AF2122/97
ggggucgccggcaccg

SEQ ID NO: 3097255 - RNA, 13 nt, Mycobacterium bovis subsp bovis AF2122/97
ggggucgcugccg

SEQ ID NO: 3097256 - RNA, 16 nt, Mycobacterium bovis subsp bovis AF2122/97
ggggucggcccgccaa

SEQ ID NO: 3097257 - RNA, 21 nt, Mycobacterium bovis subsp bovis AF2122/97
ggggucggccugcggcaccgg

SEQ ID NO: 3097258 - RNA, 21 nt, Mycobacterium bovis subsp bovis AF2122/97
ggggugcacgccuugagccga

SEQ ID NO: 3097259 - RNA, 12 nt, Mycobacterium bovis subsp bovis AF2122/97
ggggugccggcg

SEQ ID NO: 3097260 - RNA, 22 nt, Mycobacterium bovis subsp bovis AF2122/97
ggggugcgcgcgaccauacccg

SEQ ID NO: 3097261 - RNA, 15 nt, Mycobacterium bovis subsp bovis AF2122/97
gggguggcagcgcgg

SEQ ID NO: 3097262 - RNA, 20 nt, Mycobacterium bovis subsp bovis AF2122/97
gggguggccaccagcggcau

SEQ ID NO: 3097263 - RNA, 19 nt, Mycobacterium bovis subsp bovis AF2122/97
gggguggcgcgggccggcg

SEQ ID NO: 3097264 - RNA, 12 nt, Mycobacterium bovis subsp bovis AF2122/97
gggguggcggca

SEQ ID NO: 3097265 - RNA, 15 nt, Mycobacterium bovis subsp bovis AF2122/97
gggguggcggcaggu

SEQ ID NO: 3097266 - RNA, 11 nt, Mycobacterium bovis subsp bovis AF2122/97
ggggugguggu

SEQ ID NO: 3097267 - RNA, 14 nt, Mycobacterium bovis subsp bovis AF2122/97
gggguggugguagc

SEQ ID NO: 3097268 - RNA, 16 nt, Mycobacterium bovis subsp bovis AF2122/97
ggggugugcgggcggu

SEQ ID NO: 3097269 - RNA, 21 nt, Mycobacterium bovis subsp bovis AF2122/97
gggguuaggaguggccgggcg

SEQ ID NO: 3097270 - RNA, 16 nt, Mycobacterium bovis subsp bovis AF2122/97
gggguugcggcagcug

SEQ ID NO: 3097271 - RNA, 17 nt, Mycobacterium bovis subsp bovis AF2122/97
gggguugcggcagcugg

SEQ ID NO: 3097272 - RNA, 15 nt, Mycobacterium bovis subsp bovis AF2122/97
gggguugggcggggu

SEQ ID NO: 3097273 - RNA, 20 nt, Mycobacterium bovis subsp bovis AF2122/97
gggguuuaguuuaucggccg

SEQ ID NO: 3097274 - RNA, 15 nt, Mycobacterium bovis subsp bovis AF2122/97
gggguuucaggcggc

SEQ ID NO: 3097275 - RNA, 14 nt, Mycobacterium bovis subsp bovis AF2122/97
ggguaaccagcgcc

SEQ ID NO: 3097276 - RNA, 22 nt, Mycobacterium bovis subsp bovis AF2122/97
ggguaacguguucacggccgca

SEQ ID NO: 3097277 - RNA, 22 nt, Mycobacterium bovis subsp bovis AF2122/97
ggguaagcgaccgacgccauug

SEQ ID NO: 3097278 - RNA, 15 nt, Mycobacterium bovis subsp bovis AF2122/97
ggguaauacggcgcc

SEQ ID NO: 3097279 - RNA, 21 nt, Mycobacterium bovis subsp bovis AF2122/97
ggguaauucuugacgccgaug

SEQ ID NO: 3097280 - RNA, 14 nt, Mycobacterium bovis subsp bovis AF2122/97
ggguacaucgaggc

SEQ ID NO: 3097281 - RNA, 14 nt, Mycobacterium bovis subsp bovis AF2122/97
ggguaccaggcgcc

SEQ ID NO: 3097282 - RNA, 16 nt, Mycobacterium bovis subsp bovis AF2122/97
ggguacccaucugcuc

SEQ ID NO: 3097283 - RNA, 17 nt, Mycobacterium bovis subsp bovis AF2122/97
ggguacccaucugcuca

SEQ ID NO: 3097284 - RNA, 17 nt, Mycobacterium bovis subsp bovis AF2122/97
ggguacccgggaaugga

SEQ ID NO: 3097285 - RNA, 19 nt, Mycobacterium bovis subsp bovis AF2122/97
ggguacgacaccgcagcgg

SEQ ID NO: 3097286 - RNA, 19 nt, Mycobacterium bovis subsp bovis AF2122/97
ggguacggucucacggcgc

SEQ ID NO: 3097287 - RNA, 16 nt, Mycobacterium bovis subsp bovis AF2122/97
ggguacugcggcucgc

SEQ ID NO: 3097288 - RNA, 15 nt, Mycobacterium bovis subsp bovis AF2122/97
ggguagacaccgcga

SEQ ID NO: 3097289 - RNA, 18 nt, Mycobacterium bovis subsp bovis AF2122/97
ggguagaccuucucgccg

SEQ ID NO: 3097290 - RNA, 20 nt, Mycobacterium bovis subsp bovis AF2122/97
ggguagaccuucucgccgcc

SEQ ID NO: 3097291 - RNA, 19 nt, Mycobacterium bovis subsp bovis AF2122/97
ggguagacggggcgagcau

SEQ ID NO: 3097292 - RNA, 23 nt, Mycobacterium bovis subsp bovis AF2122/97
ggguagauguucacgccgccgga

SEQ ID NO: 3097293 - RNA, 14 nt, Mycobacterium bovis subsp bovis AF2122/97
ggguagccaaccug

SEQ ID NO: 3097294 - RNA, 13 nt, Mycobacterium bovis subsp bovis AF2122/97
ggguagccgccca

SEQ ID NO: 3097295 - RNA, 15 nt, Mycobacterium bovis subsp bovis AF2122/97
ggguagccgcccagc

SEQ ID NO: 3097296 - RNA, 13 nt, Mycobacterium bovis subsp bovis AF2122/97
ggguagccgccgg

SEQ ID NO: 3097297 - RNA, 15 nt, Mycobacterium bovis subsp bovis AF2122/97
ggguagccgccggcg

SEQ ID NO: 3097298 - RNA, 16 nt, Mycobacterium bovis subsp bovis AF2122/97
ggguagccgccggcgc

SEQ ID NO: 3097299 - RNA, 13 nt, Mycobacterium bovis subsp bovis AF2122/97
ggguagccgucga

SEQ ID NO: 3097300 - RNA, 19 nt, Mycobacterium bovis subsp bovis AF2122/97
ggguagcgcgagcagacgu

SEQ ID NO: 3097301 - RNA, 14 nt, Mycobacterium bovis subsp bovis AF2122/97
ggguagcggcgccg

SEQ ID NO: 3097302 - RNA, 18 nt, Mycobacterium bovis subsp bovis AF2122/97
ggguagcguucaaggucu

SEQ ID NO: 3097303 - RNA, 17 nt, Mycobacterium bovis subsp bovis AF2122/97
ggguagcugccgcggcc

SEQ ID NO: 3097304 - RNA, 13 nt, Mycobacterium bovis subsp bovis AF2122/97
ggguaggccgccg

SEQ ID NO: 3097305 - RNA, 23 nt, Mycobacterium bovis subsp bovis AF2122/97
ggguagggcaucgucgccgagcg

SEQ ID NO: 3097306 - RNA, 16 nt, Mycobacterium bovis subsp bovis AF2122/97
ggguaguugaggccgu

SEQ ID NO: 3097307 - RNA, 17 nt, Mycobacterium bovis subsp bovis AF2122/97
ggguauccacgccgggc

SEQ ID NO: 3097308 - RNA, 19 nt, Mycobacterium bovis subsp bovis AF2122/97
ggguaucgacccuccagca

SEQ ID NO: 3097309 - RNA, 20 nt, Mycobacterium bovis subsp bovis AF2122/97
ggguaucgacccuccagcac

SEQ ID NO: 3097310 - RNA, 21 nt, Mycobacterium bovis subsp bovis AF2122/97
ggguaucgacccuccagcacg

SEQ ID NO: 3097311 - RNA, 22 nt, Mycobacterium bovis subsp bovis AF2122/97
ggguaucgacccuccagcacgc

SEQ ID NO: 3097312 - RNA, 14 nt, Mycobacterium bovis subsp bovis AF2122/97
ggguaugcacccag

SEQ ID NO: 3097313 - RNA, 17 nt, Mycobacterium bovis subsp bovis AF2122/97
ggguaugcacccaggca

SEQ ID NO: 3097314 - RNA, 20 nt, Mycobacterium bovis subsp bovis AF2122/97
ggguauugauugacugcuug

SEQ ID NO: 3097315 - RNA, 14 nt, Mycobacterium bovis subsp bovis AF2122/97
gggucaacgccauc

SEQ ID NO: 3097316 - RNA, 16 nt, Mycobacterium bovis subsp bovis AF2122/97
gggucaacgccaucac

SEQ ID NO: 3097317 - RNA, 16 nt, Mycobacterium bovis subsp bovis AF2122/97
gggucaagaucggugc

SEQ ID NO: 3097318 - RNA, 20 nt, Mycobacterium bovis subsp bovis AF2122/97
gggucaaugcuggcagcggc

SEQ ID NO: 3097319 - RNA, 21 nt, Mycobacterium bovis subsp bovis AF2122/97
gggucaaugcuggcagcggcc

SEQ ID NO: 3097320 - RNA, 15 nt, Mycobacterium bovis subsp bovis AF2122/97
gggucacaaaaccug

SEQ ID NO: 3097321 - RNA, 23 nt, Mycobacterium bovis subsp bovis AF2122/97
gggucaccagcgcaucggccagc

SEQ ID NO: 3097322 - RNA, 12 nt, Mycobacterium bovis subsp bovis AF2122/97
gggucacccccg

SEQ ID NO: 3097323 - RNA, 21 nt, Mycobacterium bovis subsp bovis AF2122/97
gggucaccucgucgccuagcc

SEQ ID NO: 3097324 - RNA, 22 nt, Mycobacterium bovis subsp bovis AF2122/97
gggucacgaccugcucauccac

SEQ ID NO: 3097325 - RNA, 13 nt, Mycobacterium bovis subsp bovis AF2122/97
gggucagcccagc

SEQ ID NO: 3097326 - RNA, 17 nt, Mycobacterium bovis subsp bovis AF2122/97
gggucagcugggacccg

SEQ ID NO: 3097327 - RNA, 19 nt, Mycobacterium bovis subsp bovis AF2122/97
gggucagcugggacccgag

SEQ ID NO: 3097328 - RNA, 21 nt, Mycobacterium bovis subsp bovis AF2122/97
gggucagcugggacccgagca

SEQ ID NO: 3097329 - RNA, 17 nt, Mycobacterium bovis subsp bovis AF2122/97
gggucaggcgaaccugg

SEQ ID NO: 3097330 - RNA, 16 nt, Mycobacterium bovis subsp bovis AF2122/97
gggucagggguucgag

SEQ ID NO: 3097331 - RNA, 17 nt, Mycobacterium bovis subsp bovis AF2122/97
gggucagguugucggcg

SEQ ID NO: 3097332 - RNA, 20 nt, Mycobacterium bovis subsp bovis AF2122/97
gggucagugcgggcggcguc

SEQ ID NO: 3097333 - RNA, 14 nt, Mycobacterium bovis subsp bovis AF2122/97
gggucaucagccgc

SEQ ID NO: 3097334 - RNA, 13 nt, Mycobacterium bovis subsp bovis AF2122/97
gggucaucgccag

SEQ ID NO: 3097335 - RNA, 17 nt, Mycobacterium bovis subsp bovis AF2122/97
gggucaucgccagcggc

SEQ ID NO: 3097336 - RNA, 17 nt, Mycobacterium bovis subsp bovis AF2122/97
ggguccacgcgcucggu

SEQ ID NO: 3097337 - RNA, 17 nt, Mycobacterium bovis subsp bovis AF2122/97
ggguccagcgucccgau

SEQ ID NO: 3097338 - RNA, 20 nt, Mycobacterium bovis subsp bovis AF2122/97
ggguccaucggggccgucgg

SEQ ID NO: 3097339 - RNA, 12 nt, Mycobacterium bovis subsp bovis AF2122/97
gggucccgccac

SEQ ID NO: 3097340 - RNA, 13 nt, Mycobacterium bovis subsp bovis AF2122/97
gggucccgccacc

SEQ ID NO: 3097341 - RNA, 13 nt, Mycobacterium bovis subsp bovis AF2122/97
gggucccgcuggc

SEQ ID NO: 3097342 - RNA, 13 nt, Mycobacterium bovis subsp bovis AF2122/97
gggucccggccgg

SEQ ID NO: 3097343 - RNA, 22 nt, Mycobacterium bovis subsp bovis AF2122/97
gggucccggccgggucuuccgg

SEQ ID NO: 3097344 - RNA, 22 nt, Mycobacterium bovis subsp bovis AF2122/97
ggguccgaaguacuggccgccg

SEQ ID NO: 3097345 - RNA, 23 nt, Mycobacterium bovis subsp bovis AF2122/97
ggguccgaaguacuggccgccgc

SEQ ID NO: 3097346 - RNA, 22 nt, Mycobacterium bovis subsp bovis AF2122/97
ggguccgacgguguagccgccg

SEQ ID NO: 3097347 - RNA, 23 nt, Mycobacterium bovis subsp bovis AF2122/97
ggguccgacgguguagccgccgg

SEQ ID NO: 3097348 - RNA, 16 nt, Mycobacterium bovis subsp bovis AF2122/97
ggguccgccgggcccc

SEQ ID NO: 3097349 - RNA, 18 nt, Mycobacterium bovis subsp bovis AF2122/97
ggguccgcgucggcggcg

SEQ ID NO: 3097350 - RNA, 22 nt, Mycobacterium bovis subsp bovis AF2122/97
ggguccgcgucggcggcgaccg

SEQ ID NO: 3097351 - RNA, 15 nt, Mycobacterium bovis subsp bovis AF2122/97
ggguccggauggccc

SEQ ID NO: 3097352 - RNA, 17 nt, Mycobacterium bovis subsp bovis AF2122/97
ggguccggauggccccg

SEQ ID NO: 3097353 - RNA, 13 nt, Mycobacterium bovis subsp bovis AF2122/97
ggguccggcggcc

SEQ ID NO: 3097354 - RNA, 14 nt, Mycobacterium bovis subsp bovis AF2122/97
ggguccggcggccg

SEQ ID NO: 3097355 - RNA, 19 nt, Mycobacterium bovis subsp bovis AF2122/97
ggguccggcggccgccauc

SEQ ID NO: 3097356 - RNA, 15 nt, Mycobacterium bovis subsp bovis AF2122/97
ggguccgggcggccg

SEQ ID NO: 3097357 - RNA, 17 nt, Mycobacterium bovis subsp bovis AF2122/97
ggguccgggggaagcgc

SEQ ID NO: 3097358 - RNA, 19 nt, Mycobacterium bovis subsp bovis AF2122/97
ggguccguuuuaccucggc

SEQ ID NO: 3097359 - RNA, 20 nt, Mycobacterium bovis subsp bovis AF2122/97
ggguccguuuuaccucggcc

SEQ ID NO: 3097360 - RNA, 16 nt, Mycobacterium bovis subsp bovis AF2122/97
ggguccuggaucagcc

SEQ ID NO: 3097361 - RNA, 20 nt, Mycobacterium bovis subsp bovis AF2122/97
gggucgaacaggccggccgc

SEQ ID NO: 3097362 - RNA, 22 nt, Mycobacterium bovis subsp bovis AF2122/97
gggucgaacaugauccgccggc

SEQ ID NO: 3097363 - RNA, 20 nt, Mycobacterium bovis subsp bovis AF2122/97
gggucgaacuugaucaccgc

SEQ ID NO: 3097364 - RNA, 19 nt, Mycobacterium bovis subsp bovis AF2122/97
gggucgaccccggccagga

SEQ ID NO: 3097365 - RNA, 12 nt, Mycobacterium bovis subsp bovis AF2122/97
gggucgaccgga

SEQ ID NO: 3097366 - RNA, 20 nt, Mycobacterium bovis subsp bovis AF2122/97
gggucgaccggaaugcccgg

SEQ ID NO: 3097367 - RNA, 12 nt, Mycobacterium bovis subsp bovis AF2122/97
gggucgaucacc

SEQ ID NO: 3097368 - RNA, 15 nt, Mycobacterium bovis subsp bovis AF2122/97
gggucgauccggugc

SEQ ID NO: 3097369 - RNA, 22 nt, Mycobacterium bovis subsp bovis AF2122/97
gggucgauggguaccgcgggga

SEQ ID NO: 3097370 - RNA, 15 nt, Mycobacterium bovis subsp bovis AF2122/97
gggucgaugucggca

SEQ ID NO: 3097371 - RNA, 16 nt, Mycobacterium bovis subsp bovis AF2122/97
gggucgcaaccgccgc

SEQ ID NO: 3097372 - RNA, 17 nt, Mycobacterium bovis subsp bovis AF2122/97
gggucgcaaccgccgcc

SEQ ID NO: 3097373 - RNA, 23 nt, Mycobacterium bovis subsp bovis AF2122/97
gggucgcaauauccggccgagcc

SEQ ID NO: 3097374 - RNA, 17 nt, Mycobacterium bovis subsp bovis AF2122/97
gggucgcgcugccaguu

SEQ ID NO: 3097375 - RNA, 21 nt, Mycobacterium bovis subsp bovis AF2122/97
gggucgcgcuggcgccggcca

SEQ ID NO: 3097376 - RNA, 23 nt, Mycobacterium bovis subsp bovis AF2122/97
gggucgcgcuggcgccggccagc

SEQ ID NO: 3097377 - RNA, 13 nt, Mycobacterium bovis subsp bovis AF2122/97
gggucgcugccgc

SEQ ID NO: 3097378 - RNA, 17 nt, Mycobacterium bovis subsp bovis AF2122/97
gggucgcugccgccguc

SEQ ID NO: 3097379 - RNA, 15 nt, Mycobacterium bovis subsp bovis AF2122/97
gggucggcacgaccc

SEQ ID NO: 3097380 - RNA, 18 nt, Mycobacterium bovis subsp bovis AF2122/97
gggucggcacgacccggg

SEQ ID NO: 3097381 - RNA, 16 nt, Mycobacterium bovis subsp bovis AF2122/97
gggucggcgaccaccc

SEQ ID NO: 3097382 - RNA, 15 nt, Mycobacterium bovis subsp bovis AF2122/97
gggucggcgaccgcg

SEQ ID NO: 3097383 - RNA, 13 nt, Mycobacterium bovis subsp bovis AF2122/97
gggucgggcaccg

SEQ ID NO: 3097384 - RNA, 15 nt, Mycobacterium bovis subsp bovis AF2122/97
gggucgggcaccgcg

SEQ ID NO: 3097385 - RNA, 17 nt, Mycobacterium bovis subsp bovis AF2122/97
gggucggggaagacgac

SEQ ID NO: 3097386 - RNA, 14 nt, Mycobacterium bovis subsp bovis AF2122/97
gggucgggucccag

SEQ ID NO: 3097387 - RNA, 19 nt, Mycobacterium bovis subsp bovis AF2122/97
gggucgggucccagccugg

SEQ ID NO: 3097388 - RNA, 21 nt, Mycobacterium bovis subsp bovis AF2122/97
gggucgguuuccuccggcagc

SEQ ID NO: 3097389 - RNA, 22 nt, Mycobacterium bovis subsp bovis AF2122/97
gggucgguuuccuccggcagca

SEQ ID NO: 3097390 - RNA, 16 nt, Mycobacterium bovis subsp bovis AF2122/97
gggucguacaacacgg

SEQ ID NO: 3097391 - RNA, 17 nt, Mycobacterium bovis subsp bovis AF2122/97
gggucgucaugccaguc

SEQ ID NO: 3097392 - RNA, 18 nt, Mycobacterium bovis subsp bovis AF2122/97
gggucgucauugcccuug

SEQ ID NO: 3097393 - RNA, 15 nt, Mycobacterium bovis subsp bovis AF2122/97
gggucguccgccugc

SEQ ID NO: 3097394 - RNA, 19 nt, Mycobacterium bovis subsp bovis AF2122/97
gggucguccgccugcaccg

SEQ ID NO: 3097395 - RNA, 18 nt, Mycobacterium bovis subsp bovis AF2122/97
gggucguugaggccggug

SEQ ID NO: 3097396 - RNA, 19 nt, Mycobacterium bovis subsp bovis AF2122/97
gggucguugaggccgguga

SEQ ID NO: 3097397 - RNA, 16 nt, Mycobacterium bovis subsp bovis AF2122/97
gggucugcgccgccgg

SEQ ID NO: 3097398 - RNA, 21 nt, Mycobacterium bovis subsp bovis AF2122/97
gggucugcgccgccggcggcg

SEQ ID NO: 3097399 - RNA, 15 nt, Mycobacterium bovis subsp bovis AF2122/97
gggucugggucaggc

SEQ ID NO: 3097400 - RNA, 19 nt, Mycobacterium bovis subsp bovis AF2122/97
gggucuucuaccccgguga

SEQ ID NO: 3097401 - RNA, 14 nt, Mycobacterium bovis subsp bovis AF2122/97
gggucuugacggcg

SEQ ID NO: 3097402 - RNA, 17 nt, Mycobacterium bovis subsp bovis AF2122/97
gggucuugacggcgcca

SEQ ID NO: 3097403 - RNA, 20 nt, Mycobacterium bovis subsp bovis AF2122/97
gggucuugacggcgccaggc

SEQ ID NO: 3097404 - RNA, 15 nt, Mycobacterium bovis subsp bovis AF2122/97
gggucuugccgagca

SEQ ID NO: 3097405 - RNA, 15 nt, Mycobacterium bovis subsp bovis AF2122/97
gggucuuugcccgcc

SEQ ID NO: 3097406 - RNA, 17 nt, Mycobacterium bovis subsp bovis AF2122/97
gggucuuugcccgccac

SEQ ID NO: 3097407 - RNA, 21 nt, Mycobacterium bovis subsp bovis AF2122/97
gggugaacaacucauagacca

SEQ ID NO: 3097408 - RNA, 13 nt, Mycobacterium bovis subsp bovis AF2122/97
gggugaaccaauu

SEQ ID NO: 3097409 - RNA, 14 nt, Mycobacterium bovis subsp bovis AF2122/97
gggugaacgcggac

SEQ ID NO: 3097410 - RNA, 21 nt, Mycobacterium bovis subsp bovis AF2122/97
gggugaagacaccggcgucga

SEQ ID NO: 3097411 - RNA, 22 nt, Mycobacterium bovis subsp bovis AF2122/97
gggugaagagaagucucgcggc

SEQ ID NO: 3097412 - RNA, 21 nt, Mycobacterium bovis subsp bovis AF2122/97
gggugaaguggcgcagcaccg

SEQ ID NO: 3097413 - RNA, 19 nt, Mycobacterium bovis subsp bovis AF2122/97
gggugaaucgacaccgccc

SEQ ID NO: 3097414 - RNA, 21 nt, Mycobacterium bovis subsp bovis AF2122/97
gggugacaucgcgaggcguca

SEQ ID NO: 3097415 - RNA, 18 nt, Mycobacterium bovis subsp bovis AF2122/97
gggugaccaggccgagcu

SEQ ID NO: 3097416 - RNA, 15 nt, Mycobacterium bovis subsp bovis AF2122/97
gggugaccaggcggc

SEQ ID NO: 3097417 - RNA, 17 nt, Mycobacterium bovis subsp bovis AF2122/97
gggugaccaggcggcgc

SEQ ID NO: 3097418 - RNA, 11 nt, Mycobacterium bovis subsp bovis AF2122/97
gggugacgaug

SEQ ID NO: 3097419 - RNA, 15 nt, Mycobacterium bovis subsp bovis AF2122/97
gggugacgaugacga

SEQ ID NO: 3097420 - RNA, 17 nt, Mycobacterium bovis subsp bovis AF2122/97
gggugacuucgcugcgg

SEQ ID NO: 3097421 - RNA, 15 nt, Mycobacterium bovis subsp bovis AF2122/97
gggugagccgagcca

SEQ ID NO: 3097422 - RNA, 13 nt, Mycobacterium bovis subsp bovis AF2122/97
gggugagcgaccu

SEQ ID NO: 3097423 - RNA, 14 nt, Mycobacterium bovis subsp bovis AF2122/97
gggugaggcgguga

SEQ ID NO: 3097424 - RNA, 18 nt, Mycobacterium bovis subsp bovis AF2122/97
gggugaguucggcguaga

SEQ ID NO: 3097425 - RNA, 22 nt, Mycobacterium bovis subsp bovis AF2122/97
gggugaucgaaaacgggggcgc

SEQ ID NO: 3097426 - RNA, 22 nt, Mycobacterium bovis subsp bovis AF2122/97
gggugcaccgaagauggccagc

SEQ ID NO: 3097427 - RNA, 18 nt, Mycobacterium bovis subsp bovis AF2122/97
gggugcagaucgccccag

SEQ ID NO: 3097428 - RNA, 12 nt, Mycobacterium bovis subsp bovis AF2122/97
gggugcagcacg

SEQ ID NO: 3097429 - RNA, 18 nt, Mycobacterium bovis subsp bovis AF2122/97
gggugcagcacggcgccg

SEQ ID NO: 3097430 - RNA, 19 nt, Mycobacterium bovis subsp bovis AF2122/97
gggugcagcacggcgccgc

SEQ ID NO: 3097431 - RNA, 22 nt, Mycobacterium bovis subsp bovis AF2122/97
gggugcagcacggcgccgccac

SEQ ID NO: 3097432 - RNA, 13 nt, Mycobacterium bovis subsp bovis AF2122/97
gggugcagugacc

SEQ ID NO: 3097433 - RNA, 21 nt, Mycobacterium bovis subsp bovis AF2122/97
gggugccagcccguugcagga

SEQ ID NO: 3097434 - RNA, 18 nt, Mycobacterium bovis subsp bovis AF2122/97
gggugcccggcggccaac

SEQ ID NO: 3097435 - RNA, 14 nt, Mycobacterium bovis subsp bovis AF2122/97
gggugcccucggcc

SEQ ID NO: 3097436 - RNA, 20 nt, Mycobacterium bovis subsp bovis AF2122/97
gggugcccucggccgccuga

SEQ ID NO: 3097437 - RNA, 23 nt, Mycobacterium bovis subsp bovis AF2122/97
gggugcccucggccgccugacgg

SEQ ID NO: 3097438 - RNA, 13 nt, Mycobacterium bovis subsp bovis AF2122/97
gggugccgaucga

SEQ ID NO: 3097439 - RNA, 13 nt, Mycobacterium bovis subsp bovis AF2122/97
gggugccggcgcc

SEQ ID NO: 3097440 - RNA, 15 nt, Mycobacterium bovis subsp bovis AF2122/97
gggugccggcgucgc

SEQ ID NO: 3097441 - RNA, 22 nt, Mycobacterium bovis subsp bovis AF2122/97
gggugccgguguugccgccggu

SEQ ID NO: 3097442 - RNA, 12 nt, Mycobacterium bovis subsp bovis AF2122/97
gggugccgucgg

SEQ ID NO: 3097443 - RNA, 15 nt, Mycobacterium bovis subsp bovis AF2122/97
gggugcgacgcgacc

SEQ ID NO: 3097444 - RNA, 14 nt, Mycobacterium bovis subsp bovis AF2122/97
gggugcgagcgaca

SEQ ID NO: 3097445 - RNA, 18 nt, Mycobacterium bovis subsp bovis AF2122/97
gggugcgcccggccaagc

SEQ ID NO: 3097446 - RNA, 17 nt, Mycobacterium bovis subsp bovis AF2122/97
gggugcgccgcagcagg

SEQ ID NO: 3097447 - RNA, 13 nt, Mycobacterium bovis subsp bovis AF2122/97
gggugcgccguca

SEQ ID NO: 3097448 - RNA, 21 nt, Mycobacterium bovis subsp bovis AF2122/97
gggugcgccgucagcccaggu

SEQ ID NO: 3097449 - RNA, 18 nt, Mycobacterium bovis subsp bovis AF2122/97
gggugcgcgaggucggcg

SEQ ID NO: 3097450 - RNA, 20 nt, Mycobacterium bovis subsp bovis AF2122/97
gggugcgcgcgaccauaccc

SEQ ID NO: 3097451 - RNA, 18 nt, Mycobacterium bovis subsp bovis AF2122/97
gggugcgcuugcggccgc

SEQ ID NO: 3097452 - RNA, 17 nt, Mycobacterium bovis subsp bovis AF2122/97
gggugcgucgacccagc

SEQ ID NO: 3097453 - RNA, 18 nt, Mycobacterium bovis subsp bovis AF2122/97
gggugcgugcgcgucggu

SEQ ID NO: 3097454 - RNA, 17 nt, Mycobacterium bovis subsp bovis AF2122/97
gggugcucucguggaug

SEQ ID NO: 3097455 - RNA, 13 nt, Mycobacterium bovis subsp bovis AF2122/97
gggugcugcgcgc

SEQ ID NO: 3097456 - RNA, 16 nt, Mycobacterium bovis subsp bovis AF2122/97
gggugcugcgcgcggc

SEQ ID NO: 3097457 - RNA, 14 nt, Mycobacterium bovis subsp bovis AF2122/97
gggugcuggcagga

SEQ ID NO: 3097458 - RNA, 14 nt, Mycobacterium bovis subsp bovis AF2122/97
ggguggaaucaggg

SEQ ID NO: 3097459 - RNA, 19 nt, Mycobacterium bovis subsp bovis AF2122/97
ggguggaguuggcugccgg

SEQ ID NO: 3097460 - RNA, 15 nt, Mycobacterium bovis subsp bovis AF2122/97
ggguggaucuucacc

SEQ ID NO: 3097461 - RNA, 17 nt, Mycobacterium bovis subsp bovis AF2122/97
ggguggauuggugccgg

SEQ ID NO: 3097462 - RNA, 12 nt, Mycobacterium bovis subsp bovis AF2122/97
ggguggccagca

SEQ ID NO: 3097463 - RNA, 20 nt, Mycobacterium bovis subsp bovis AF2122/97
ggguggccagcaacugccgc

SEQ ID NO: 3097464 - RNA, 16 nt, Mycobacterium bovis subsp bovis AF2122/97
ggguggcccgaccggg

SEQ ID NO: 3097465 - RNA, 13 nt, Mycobacterium bovis subsp bovis AF2122/97
ggguggccgacga

SEQ ID NO: 3097466 - RNA, 19 nt, Mycobacterium bovis subsp bovis AF2122/97
ggguggccgacgauagcgg

SEQ ID NO: 3097467 - RNA, 22 nt, Mycobacterium bovis subsp bovis AF2122/97
ggguggcgccggugcggcgggc

SEQ ID NO: 3097468 - RNA, 13 nt, Mycobacterium bovis subsp bovis AF2122/97
ggguggcgcggua

SEQ ID NO: 3097469 - RNA, 12 nt, Mycobacterium bovis subsp bovis AF2122/97
ggguggcggcgu

SEQ ID NO: 3097470 - RNA, 14 nt, Mycobacterium bovis subsp bovis AF2122/97
ggguggcggcguca

SEQ ID NO: 3097471 - RNA, 21 nt, Mycobacterium bovis subsp bovis AF2122/97
ggguggcgucgaucucgauca

SEQ ID NO: 3097472 - RNA, 23 nt, Mycobacterium bovis subsp bovis AF2122/97
gggugggcaagcugaccgccagc

SEQ ID NO: 3097473 - RNA, 12 nt, Mycobacterium bovis subsp bovis AF2122/97
gggugggcguga

SEQ ID NO: 3097474 - RNA, 14 nt, Mycobacterium bovis subsp bovis AF2122/97
gggugguaccggcg

SEQ ID NO: 3097475 - RNA, 16 nt, Mycobacterium bovis subsp bovis AF2122/97
gggugguaccggcggc

SEQ ID NO: 3097476 - RNA, 17 nt, Mycobacterium bovis subsp bovis AF2122/97
gggugguaccggcggcg

SEQ ID NO: 3097477 - RNA, 18 nt, Mycobacterium bovis subsp bovis AF2122/97
gggugguaccggcggcgc

SEQ ID NO: 3097478 - RNA, 19 nt, Mycobacterium bovis subsp bovis AF2122/97
gggugguaccggcggcgcc

SEQ ID NO: 3097479 - RNA, 16 nt, Mycobacterium bovis subsp bovis AF2122/97
gggugguagcugacgc

SEQ ID NO: 3097480 - RNA, 21 nt, Mycobacterium bovis subsp bovis AF2122/97
gggugguagcugacgcugcuc

SEQ ID NO: 3097481 - RNA, 23 nt, Mycobacterium bovis subsp bovis AF2122/97
gggugguagcugacgcugcucug

SEQ ID NO: 3097482 - RNA, 23 nt, Mycobacterium bovis subsp bovis AF2122/97
ggguggugaaguagucggcgccg

SEQ ID NO: 3097483 - RNA, 13 nt, Mycobacterium bovis subsp bovis AF2122/97
gggugguggugga

SEQ ID NO: 3097484 - RNA, 19 nt, Mycobacterium bovis subsp bovis AF2122/97
ggguggugucgcggccgcc

SEQ ID NO: 3097485 - RNA, 22 nt, Mycobacterium bovis subsp bovis AF2122/97
gggugguguggccucgucccgg

SEQ ID NO: 3097486 - RNA, 21 nt, Mycobacterium bovis subsp bovis AF2122/97
gggugguucaccucggcgacg

SEQ ID NO: 3097487 - RNA, 22 nt, Mycobacterium bovis subsp bovis AF2122/97
gggugguucaccucggcgacga

SEQ ID NO: 3097488 - RNA, 21 nt, Mycobacterium bovis subsp bovis AF2122/97
ggguguagccagcggcugccc

SEQ ID NO: 3097489 - RNA, 20 nt, Mycobacterium bovis subsp bovis AF2122/97
ggguguauggccaccacgca

SEQ ID NO: 3097490 - RNA, 22 nt, Mycobacterium bovis subsp bovis AF2122/97
gggugucgacaaccgcugccgc

SEQ ID NO: 3097491 - RNA, 15 nt, Mycobacterium bovis subsp bovis AF2122/97
gggugucgggcgcgc

SEQ ID NO: 3097492 - RNA, 15 nt, Mycobacterium bovis subsp bovis AF2122/97
gggugucggugucga

SEQ ID NO: 3097493 - RNA, 18 nt, Mycobacterium bovis subsp bovis AF2122/97
gggugugcaggccgcgga

SEQ ID NO: 3097494 - RNA, 14 nt, Mycobacterium bovis subsp bovis AF2122/97
gggugugcgggcgg

SEQ ID NO: 3097495 - RNA, 23 nt, Mycobacterium bovis subsp bovis AF2122/97
ggguguuccacaccaggccgagc

SEQ ID NO: 3097496 - RNA, 14 nt, Mycobacterium bovis subsp bovis AF2122/97
ggguguucgauggg

SEQ ID NO: 3097497 - RNA, 18 nt, Mycobacterium bovis subsp bovis AF2122/97
ggguguugaucucgccgg

SEQ ID NO: 3097498 - RNA, 20 nt, Mycobacterium bovis subsp bovis AF2122/97
ggguguugaucucgccggug

SEQ ID NO: 3097499 - RNA, 15 nt, Mycobacterium bovis subsp bovis AF2122/97
ggguguugcuggccg

SEQ ID NO: 3097500 - RNA, 16 nt, Mycobacterium bovis subsp bovis AF2122/97
ggguguugucgucgag

SEQ ID NO: 3097501 - RNA, 17 nt, Mycobacterium bovis subsp bovis AF2122/97
ggguguuugucgcggug

SEQ ID NO: 3097502 - RNA, 19 nt, Mycobacterium bovis subsp bovis AF2122/97
ggguguuugucgcgguggu

SEQ ID NO: 3097503 - RNA, 19 nt, Mycobacterium bovis subsp bovis AF2122/97
ggguuacccgcagcgugcc

SEQ ID NO: 3097504 - RNA, 17 nt, Mycobacterium bovis subsp bovis AF2122/97
ggguuacucgcagcgcc

SEQ ID NO: 3097505 - RNA, 18 nt, Mycobacterium bovis subsp bovis AF2122/97
ggguuacucgcagcgccg

SEQ ID NO: 3097506 - RNA, 14 nt, Mycobacterium bovis subsp bovis AF2122/97
ggguucacugccgg

SEQ ID NO: 3097507 - RNA, 22 nt, Mycobacterium bovis subsp bovis AF2122/97
ggguucacuuccgggcagcugg

SEQ ID NO: 3097508 - RNA, 16 nt, Mycobacterium bovis subsp bovis AF2122/97
ggguuccggauccgau

SEQ ID NO: 3097509 - RNA, 14 nt, Mycobacterium bovis subsp bovis AF2122/97
ggguucgacguuga

SEQ ID NO: 3097510 - RNA, 18 nt, Mycobacterium bovis subsp bovis AF2122/97
ggguucgccgaagccgga

SEQ ID NO: 3097511 - RNA, 16 nt, Mycobacterium bovis subsp bovis AF2122/97
ggguugaccgccaccc

SEQ ID NO: 3097512 - RNA, 16 nt, Mycobacterium bovis subsp bovis AF2122/97
ggguugaggaucccgg

SEQ ID NO: 3097513 - RNA, 11 nt, Mycobacterium bovis subsp bovis AF2122/97
ggguugaucgc

SEQ ID NO: 3097514 - RNA, 17 nt, Mycobacterium bovis subsp bovis AF2122/97
ggguugauuggccccgg

SEQ ID NO: 3097515 - RNA, 13 nt, Mycobacterium bovis subsp bovis AF2122/97
ggguugccgccga

SEQ ID NO: 3097516 - RNA, 21 nt, Mycobacterium bovis subsp bovis AF2122/97
ggguugcggagcucacgccgg

SEQ ID NO: 3097517 - RNA, 16 nt, Mycobacterium bovis subsp bovis AF2122/97
ggguugcggcagcugg

SEQ ID NO: 3097518 - RNA, 14 nt, Mycobacterium bovis subsp bovis AF2122/97
ggguugcggucacc

SEQ ID NO: 3097519 - RNA, 22 nt, Mycobacterium bovis subsp bovis AF2122/97
ggguuggccgaacagcugcccg

SEQ ID NO: 3097520 - RNA, 14 nt, Mycobacterium bovis subsp bovis AF2122/97
ggguuggccggcgc

SEQ ID NO: 3097521 - RNA, 20 nt, Mycobacterium bovis subsp bovis AF2122/97
ggguuggcucggcgcagcac

SEQ ID NO: 3097522 - RNA, 14 nt, Mycobacterium bovis subsp bovis AF2122/97
ggguugggcggagc

SEQ ID NO: 3097523 - RNA, 14 nt, Mycobacterium bovis subsp bovis AF2122/97
ggguugggcggggu

SEQ ID NO: 3097524 - RNA, 15 nt, Mycobacterium bovis subsp bovis AF2122/97
ggguugguuggcucg

SEQ ID NO: 3097525 - RNA, 13 nt, Mycobacterium bovis subsp bovis AF2122/97
ggguugugccgcc

SEQ ID NO: 3097526 - RNA, 22 nt, Mycobacterium bovis subsp bovis AF2122/97
ggguuguucggcagccaugcgg

SEQ ID NO: 3097527 - RNA, 23 nt, Mycobacterium bovis subsp bovis AF2122/97
ggguuucaaagcgacagcgcggc

SEQ ID NO: 3097528 - RNA, 22 nt, Mycobacterium bovis subsp bovis AF2122/97
ggguuuccaagucggagcgggg

SEQ ID NO: 3097529 - RNA, 23 nt, Mycobacterium bovis subsp bovis AF2122/97
ggguuucgaucuucucgcggacg

SEQ ID NO: 3097530 - RNA, 20 nt, Mycobacterium bovis subsp bovis AF2122/97
ggguuucgcucgcaccgccc

SEQ ID NO: 3097531 - RNA, 12 nt, Mycobacterium bovis subsp bovis AF2122/97
gguaaagccccg

SEQ ID NO: 3097532 - RNA, 14 nt, Mycobacterium bovis subsp bovis AF2122/97
gguaaagggcucga

SEQ ID NO: 3097533 - RNA, 15 nt, Mycobacterium bovis subsp bovis AF2122/97
gguaacaccggcgag

SEQ ID NO: 3097534 - RNA, 14 nt, Mycobacterium bovis subsp bovis AF2122/97
gguaaccagcgcca

SEQ ID NO: 3097535 - RNA, 21 nt, Mycobacterium bovis subsp bovis AF2122/97
gguaaccagcgccacgaugac

SEQ ID NO: 3097536 - RNA, 13 nt, Mycobacterium bovis subsp bovis AF2122/97
gguaaccggcgga

SEQ ID NO: 3097537 - RNA, 20 nt, Mycobacterium bovis subsp bovis AF2122/97
gguaacgccaacaccggcau

SEQ ID NO: 3097538 - RNA, 17 nt, Mycobacterium bovis subsp bovis AF2122/97
gguaacgcgacaagguc

SEQ ID NO: 3097539 - RNA, 14 nt, Mycobacterium bovis subsp bovis AF2122/97
gguaagcagccagc

SEQ ID NO: 3097540 - RNA, 13 nt, Mycobacterium bovis subsp bovis AF2122/97
gguaagccggcgu

SEQ ID NO: 3097541 - RNA, 19 nt, Mycobacterium bovis subsp bovis AF2122/97
gguaagcgaacggguaguc

SEQ ID NO: 3097542 - RNA, 21 nt, Mycobacterium bovis subsp bovis AF2122/97
gguaagcgaacggguagucgg

SEQ ID NO: 3097543 - RNA, 14 nt, Mycobacterium bovis subsp bovis AF2122/97
gguaaggccggccg

SEQ ID NO: 3097544 - RNA, 21 nt, Mycobacterium bovis subsp bovis AF2122/97
gguaaggcuugucagccgcga

SEQ ID NO: 3097545 - RNA, 15 nt, Mycobacterium bovis subsp bovis AF2122/97
gguaauacgucccga

SEQ ID NO: 3097546 - RNA, 18 nt, Mycobacterium bovis subsp bovis AF2122/97
gguaaucaccuggcuggu

SEQ ID NO: 3097547 - RNA, 17 nt, Mycobacterium bovis subsp bovis AF2122/97
gguaauccacuccagcg

SEQ ID NO: 3097548 - RNA, 13 nt, Mycobacterium bovis subsp bovis AF2122/97
gguaaucgcgaga

SEQ ID NO: 3097549 - RNA, 18 nt, Mycobacterium bovis subsp bovis AF2122/97
gguaauucuugacgccga

SEQ ID NO: 3097550 - RNA, 15 nt, Mycobacterium bovis subsp bovis AF2122/97
gguacacccgcucgc

SEQ ID NO: 3097551 - RNA, 16 nt, Mycobacterium bovis subsp bovis AF2122/97
gguacacccgcucgcc

SEQ ID NO: 3097552 - RNA, 23 nt, Mycobacterium bovis subsp bovis AF2122/97
gguacacccgcucgcccgccgcc

SEQ ID NO: 3097553 - RNA, 21 nt, Mycobacterium bovis subsp bovis AF2122/97
gguacagcgcuucacgggccg

SEQ ID NO: 3097554 - RNA, 16 nt, Mycobacterium bovis subsp bovis AF2122/97
gguacaucaccacgau

SEQ ID NO: 3097555 - RNA, 13 nt, Mycobacterium bovis subsp bovis AF2122/97
gguacaucccggu

SEQ ID NO: 3097556 - RNA, 21 nt, Mycobacterium bovis subsp bovis AF2122/97
gguacaucgaggccacgccag

SEQ ID NO: 3097557 - RNA, 16 nt, Mycobacterium bovis subsp bovis AF2122/97
gguaccaccggcacgg

SEQ ID NO: 3097558 - RNA, 19 nt, Mycobacterium bovis subsp bovis AF2122/97
gguaccacgcuggcgcgua

SEQ ID NO: 3097559 - RNA, 15 nt, Mycobacterium bovis subsp bovis AF2122/97
gguaccaucaccgcg

SEQ ID NO: 3097560 - RNA, 17 nt, Mycobacterium bovis subsp bovis AF2122/97
gguaccaucaccgcgcc

SEQ ID NO: 3097561 - RNA, 17 nt, Mycobacterium bovis subsp bovis AF2122/97
gguacccaccucccgca

SEQ ID NO: 3097562 - RNA, 19 nt, Mycobacterium bovis subsp bovis AF2122/97
gguacccaccucccgcagc

SEQ ID NO: 3097563 - RNA, 19 nt, Mycobacterium bovis subsp bovis AF2122/97
gguacccaucgucgagccg

SEQ ID NO: 3097564 - RNA, 13 nt, Mycobacterium bovis subsp bovis AF2122/97
gguaccccagcgc

SEQ ID NO: 3097565 - RNA, 21 nt, Mycobacterium bovis subsp bovis AF2122/97
gguacccgcacccguugcgac

SEQ ID NO: 3097566 - RNA, 23 nt, Mycobacterium bovis subsp bovis AF2122/97
gguaccgacggggauggagccgg

SEQ ID NO: 3097567 - RNA, 18 nt, Mycobacterium bovis subsp bovis AF2122/97
gguaccgagaacaccacg

SEQ ID NO: 3097568 - RNA, 19 nt, Mycobacterium bovis subsp bovis AF2122/97
gguaccgagaacaccacgc

SEQ ID NO: 3097569 - RNA, 17 nt, Mycobacterium bovis subsp bovis AF2122/97
gguaccgaucagcaggg

SEQ ID NO: 3097570 - RNA, 17 nt, Mycobacterium bovis subsp bovis AF2122/97
gguaccgccacuggcgc

SEQ ID NO: 3097571 - RNA, 17 nt, Mycobacterium bovis subsp bovis AF2122/97
gguaccgccgcugccgg

SEQ ID NO: 3097572 - RNA, 20 nt, Mycobacterium bovis subsp bovis AF2122/97
gguaccgccgcugccggugg

SEQ ID NO: 3097573 - RNA, 15 nt, Mycobacterium bovis subsp bovis AF2122/97
gguaccgcgguguuc

SEQ ID NO: 3097574 - RNA, 20 nt, Mycobacterium bovis subsp bovis AF2122/97
gguaccgcgugcgccgggga

SEQ ID NO: 3097575 - RNA, 16 nt, Mycobacterium bovis subsp bovis AF2122/97
gguaccgcuuguccac

SEQ ID NO: 3097576 - RNA, 17 nt, Mycobacterium bovis subsp bovis AF2122/97
gguaccggaaucggcgg

SEQ ID NO: 3097577 - RNA, 14 nt, Mycobacterium bovis subsp bovis AF2122/97
gguaccggcgccgc

SEQ ID NO: 3097578 - RNA, 11 nt, Mycobacterium bovis subsp bovis AF2122/97
gguaccggcgg

SEQ ID NO: 3097579 - RNA, 23 nt, Mycobacterium bovis subsp bovis AF2122/97
gguaccgggacgaaucccgcgcc

SEQ ID NO: 3097580 - RNA, 20 nt, Mycobacterium bovis subsp bovis AF2122/97
gguaccgggaucccacggcg

SEQ ID NO: 3097581 - RNA, 20 nt, Mycobacterium bovis subsp bovis AF2122/97
gguaccucaacaccaggccg

SEQ ID NO: 3097582 - RNA, 21 nt, Mycobacterium bovis subsp bovis AF2122/97
gguaccucgucgagcgugcgc

SEQ ID NO: 3097583 - RNA, 15 nt, Mycobacterium bovis subsp bovis AF2122/97
gguacgcaucucgag

SEQ ID NO: 3097584 - RNA, 18 nt, Mycobacterium bovis subsp bovis AF2122/97
gguacgccaggugcagca

SEQ ID NO: 3097585 - RNA, 14 nt, Mycobacterium bovis subsp bovis AF2122/97
gguacgccgccgcg

SEQ ID NO: 3097586 - RNA, 19 nt, Mycobacterium bovis subsp bovis AF2122/97
gguacgccggucggugcgg

SEQ ID NO: 3097587 - RNA, 23 nt, Mycobacterium bovis subsp bovis AF2122/97
gguacgcgcugaaucaccccggc

SEQ ID NO: 3097588 - RNA, 19 nt, Mycobacterium bovis subsp bovis AF2122/97
gguacggaccguggcagcu

SEQ ID NO: 3097589 - RNA, 23 nt, Mycobacterium bovis subsp bovis AF2122/97
gguacggaccguggcagcugcuc

SEQ ID NO: 3097590 - RNA, 19 nt, Mycobacterium bovis subsp bovis AF2122/97
gguacggucucacggcgcg

SEQ ID NO: 3097591 - RNA, 14 nt, Mycobacterium bovis subsp bovis AF2122/97
gguacguaaucgag

SEQ ID NO: 3097592 - RNA, 21 nt, Mycobacterium bovis subsp bovis AF2122/97
gguacgugaauuaaggugacc

SEQ ID NO: 3097593 - RNA, 20 nt, Mycobacterium bovis subsp bovis AF2122/97
gguacucgccccacuugccg

SEQ ID NO: 3097594 - RNA, 14 nt, Mycobacterium bovis subsp bovis AF2122/97
gguacugcgcagcg

SEQ ID NO: 3097595 - RNA, 18 nt, Mycobacterium bovis subsp bovis AF2122/97
gguacugugggcgaucgg

SEQ ID NO: 3097596 - RNA, 15 nt, Mycobacterium bovis subsp bovis AF2122/97
gguagacauggguga

SEQ ID NO: 3097597 - RNA, 20 nt, Mycobacterium bovis subsp bovis AF2122/97
gguagaccuucucgccgccg

SEQ ID NO: 3097598 - RNA, 12 nt, Mycobacterium bovis subsp bovis AF2122/97
gguagagguugu

SEQ ID NO: 3097599 - RNA, 20 nt, Mycobacterium bovis subsp bovis AF2122/97
gguagauguucacgccgccg

SEQ ID NO: 3097600 - RNA, 18 nt, Mycobacterium bovis subsp bovis AF2122/97
gguagcacagcagcaacg

SEQ ID NO: 3097601 - RNA, 16 nt, Mycobacterium bovis subsp bovis AF2122/97
gguagcacccacggcg

SEQ ID NO: 3097602 - RNA, 18 nt, Mycobacterium bovis subsp bovis AF2122/97
gguagcacccacggcgag

SEQ ID NO: 3097603 - RNA, 17 nt, Mycobacterium bovis subsp bovis AF2122/97
gguagcacugucgaggu

SEQ ID NO: 3097604 - RNA, 16 nt, Mycobacterium bovis subsp bovis AF2122/97
gguagccauccgugaa

SEQ ID NO: 3097605 - RNA, 23 nt, Mycobacterium bovis subsp bovis AF2122/97
gguagccaugggauucggccaga

SEQ ID NO: 3097606 - RNA, 16 nt, Mycobacterium bovis subsp bovis AF2122/97
gguagccauucggugu

SEQ ID NO: 3097607 - RNA, 15 nt, Mycobacterium bovis subsp bovis AF2122/97
gguagccgaccagcg

SEQ ID NO: 3097608 - RNA, 14 nt, Mycobacterium bovis subsp bovis AF2122/97
gguagccgcccagc

SEQ ID NO: 3097609 - RNA, 22 nt, Mycobacterium bovis subsp bovis AF2122/97
gguagccgcccagcguugucgg

SEQ ID NO: 3097610 - RNA, 14 nt, Mycobacterium bovis subsp bovis AF2122/97
gguagccgccggcg

SEQ ID NO: 3097611 - RNA, 14 nt, Mycobacterium bovis subsp bovis AF2122/97
gguagccggcgugc

SEQ ID NO: 3097612 - RNA, 16 nt, Mycobacterium bovis subsp bovis AF2122/97
gguagccgucgauccc

SEQ ID NO: 3097613 - RNA, 13 nt, Mycobacterium bovis subsp bovis AF2122/97
gguagccugacca

SEQ ID NO: 3097614 - RNA, 15 nt, Mycobacterium bovis subsp bovis AF2122/97
gguagccugaccagc

SEQ ID NO: 3097615 - RNA, 21 nt, Mycobacterium bovis subsp bovis AF2122/97
gguagcgcucgaucagguugg

SEQ ID NO: 3097616 - RNA, 15 nt, Mycobacterium bovis subsp bovis AF2122/97
gguagcggaccugcg

SEQ ID NO: 3097617 - RNA, 20 nt, Mycobacterium bovis subsp bovis AF2122/97
gguagcggaucaagcgcaca

SEQ ID NO: 3097618 - RNA, 16 nt, Mycobacterium bovis subsp bovis AF2122/97
gguagcggcgccgccc

SEQ ID NO: 3097619 - RNA, 12 nt, Mycobacterium bovis subsp bovis AF2122/97
gguagcggcggc

SEQ ID NO: 3097620 - RNA, 21 nt, Mycobacterium bovis subsp bovis AF2122/97
gguagcguucaaggucuccag

SEQ ID NO: 3097621 - RNA, 13 nt, Mycobacterium bovis subsp bovis AF2122/97
gguagcguucggc

SEQ ID NO: 3097622 - RNA, 20 nt, Mycobacterium bovis subsp bovis AF2122/97
gguagcucccugggcgucga

SEQ ID NO: 3097623 - RNA, 17 nt, Mycobacterium bovis subsp bovis AF2122/97
gguagcugacgugucgg

SEQ ID NO: 3097624 - RNA, 17 nt, Mycobacterium bovis subsp bovis AF2122/97
gguagcugccgcggccg

SEQ ID NO: 3097625 - RNA, 21 nt, Mycobacterium bovis subsp bovis AF2122/97
gguagcugccgcggccggcgu

SEQ ID NO: 3097626 - RNA, 21 nt, Mycobacterium bovis subsp bovis AF2122/97
gguagcuuccgcgacgcucgc

SEQ ID NO: 3097627 - RNA, 23 nt, Mycobacterium bovis subsp bovis AF2122/97
gguagcuuccgcgacgcucgcug

SEQ ID NO: 3097628 - RNA, 20 nt, Mycobacterium bovis subsp bovis AF2122/97
gguaggaacuacccgccagc

SEQ ID NO: 3097629 - RNA, 22 nt, Mycobacterium bovis subsp bovis AF2122/97
gguaggacuugauaucggcggg

SEQ ID NO: 3097630 - RNA, 21 nt, Mycobacterium bovis subsp bovis AF2122/97
gguaggcaggccggcucgccg

SEQ ID NO: 3097631 - RNA, 13 nt, Mycobacterium bovis subsp bovis AF2122/97
gguaggccgccgg

SEQ ID NO: 3097632 - RNA, 13 nt, Mycobacterium bovis subsp bovis AF2122/97
gguaggccggcaa

SEQ ID NO: 3097633 - RNA, 12 nt, Mycobacterium bovis subsp bovis AF2122/97
gguaggcggcca

SEQ ID NO: 3097634 - RNA, 18 nt, Mycobacterium bovis subsp bovis AF2122/97
gguaggcggccagcgcgc

SEQ ID NO: 3097635 - RNA, 17 nt, Mycobacterium bovis subsp bovis AF2122/97
gguaggucaccaggcug

SEQ ID NO: 3097636 - RNA, 13 nt, Mycobacterium bovis subsp bovis AF2122/97
gguaguagcugac

SEQ ID NO: 3097637 - RNA, 15 nt, Mycobacterium bovis subsp bovis AF2122/97
gguaguagcugacca

SEQ ID NO: 3097638 - RNA, 14 nt, Mycobacterium bovis subsp bovis AF2122/97
gguaguaggccugg

SEQ ID NO: 3097639 - RNA, 16 nt, Mycobacterium bovis subsp bovis AF2122/97
gguagucgcgaccgcg

SEQ ID NO: 3097640 - RNA, 16 nt, Mycobacterium bovis subsp bovis AF2122/97
gguagucguugccgau

SEQ ID NO: 3097641 - RNA, 15 nt, Mycobacterium bovis subsp bovis AF2122/97
gguaguggucuucgg

SEQ ID NO: 3097642 - RNA, 14 nt, Mycobacterium bovis subsp bovis AF2122/97
gguaguucaccgcg

SEQ ID NO: 3097643 - RNA, 18 nt, Mycobacterium bovis subsp bovis AF2122/97
gguaguugucccgccgcg

SEQ ID NO: 3097644 - RNA, 23 nt, Mycobacterium bovis subsp bovis AF2122/97
gguaucaggggaucccccgcgcg

SEQ ID NO: 3097645 - RNA, 17 nt, Mycobacterium bovis subsp bovis AF2122/97
gguauccacgccgggca

SEQ ID NO: 3097646 - RNA, 14 nt, Mycobacterium bovis subsp bovis AF2122/97
gguaucccccagcc

SEQ ID NO: 3097647 - RNA, 18 nt, Mycobacterium bovis subsp bovis AF2122/97
gguaucgacccuccagca

SEQ ID NO: 3097648 - RNA, 16 nt, Mycobacterium bovis subsp bovis AF2122/97
gguaucgagggcagcc

SEQ ID NO: 3097649 - RNA, 17 nt, Mycobacterium bovis subsp bovis AF2122/97
gguaucgagggcagccg

SEQ ID NO: 3097650 - RNA, 15 nt, Mycobacterium bovis subsp bovis AF2122/97
gguaucggcgugcug

SEQ ID NO: 3097651 - RNA, 16 nt, Mycobacterium bovis subsp bovis AF2122/97
gguaucgucauugcga

SEQ ID NO: 3097652 - RNA, 16 nt, Mycobacterium bovis subsp bovis AF2122/97
gguaucgucccggcga

SEQ ID NO: 3097653 - RNA, 17 nt, Mycobacterium bovis subsp bovis AF2122/97
gguaugccgaacggugu

SEQ ID NO: 3097654 - RNA, 15 nt, Mycobacterium bovis subsp bovis AF2122/97
gguauguccgccauu

SEQ ID NO: 3097655 - RNA, 16 nt, Mycobacterium bovis subsp bovis AF2122/97
gguauucguggucggc

SEQ ID NO: 3097656 - RNA, 20 nt, Mycobacterium bovis subsp bovis AF2122/97
gguauucguggucggccucg

SEQ ID NO: 3097657 - RNA, 14 nt, Mycobacterium bovis subsp bovis AF2122/97
ggucaaacgcgcgc

SEQ ID NO: 3097658 - RNA, 16 nt, Mycobacterium bovis subsp bovis AF2122/97
ggucaaacgcgcgcgc

SEQ ID NO: 3097659 - RNA, 14 nt, Mycobacterium bovis subsp bovis AF2122/97
ggucaaagcacucg

SEQ ID NO: 3097660 - RNA, 13 nt, Mycobacterium bovis subsp bovis AF2122/97
ggucaaaucaacg

SEQ ID NO: 3097661 - RNA, 17 nt, Mycobacterium bovis subsp bovis AF2122/97
ggucaaauccagcagcc

SEQ ID NO: 3097662 - RNA, 19 nt, Mycobacterium bovis subsp bovis AF2122/97
ggucaaaugaauggugacc

SEQ ID NO: 3097663 - RNA, 14 nt, Mycobacterium bovis subsp bovis AF2122/97
ggucaacaagacga

SEQ ID NO: 3097664 - RNA, 14 nt, Mycobacterium bovis subsp bovis AF2122/97
ggucaacagcggca

SEQ ID NO: 3097665 - RNA, 13 nt, Mycobacterium bovis subsp bovis AF2122/97
ggucaacagcguc

SEQ ID NO: 3097666 - RNA, 16 nt, Mycobacterium bovis subsp bovis AF2122/97
ggucaacccucgccac

SEQ ID NO: 3097667 - RNA, 17 nt, Mycobacterium bovis subsp bovis AF2122/97
ggucaaccgcgcccuag

SEQ ID NO: 3097668 - RNA, 15 nt, Mycobacterium bovis subsp bovis AF2122/97
ggucaaccgcgucga

SEQ ID NO: 3097669 - RNA, 20 nt, Mycobacterium bovis subsp bovis AF2122/97
ggucaaccgcgucgaagccg

SEQ ID NO: 3097670 - RNA, 19 nt, Mycobacterium bovis subsp bovis AF2122/97
ggucaacgaguugcggaua

SEQ ID NO: 3097671 - RNA, 15 nt, Mycobacterium bovis subsp bovis AF2122/97
ggucaacgccaucac

SEQ ID NO: 3097672 - RNA, 17 nt, Mycobacterium bovis subsp bovis AF2122/97
ggucaacgccaucaccc

SEQ ID NO: 3097673 - RNA, 15 nt, Mycobacterium bovis subsp bovis AF2122/97
ggucaacgcuucggc

SEQ ID NO: 3097674 - RNA, 14 nt, Mycobacterium bovis subsp bovis AF2122/97
ggucaacggcagau

SEQ ID NO: 3097675 - RNA, 21 nt, Mycobacterium bovis subsp bovis AF2122/97
ggucaacggcagaucccacgc

SEQ ID NO: 3097676 - RNA, 14 nt, Mycobacterium bovis subsp bovis AF2122/97
ggucaacgugaacu

SEQ ID NO: 3097677 - RNA, 20 nt, Mycobacterium bovis subsp bovis AF2122/97
ggucaacgugaugcguucgg

SEQ ID NO: 3097678 - RNA, 21 nt, Mycobacterium bovis subsp bovis AF2122/97
ggucaacgugaugcguucggc

SEQ ID NO: 3097679 - RNA, 21 nt, Mycobacterium bovis subsp bovis AF2122/97
ggucaagaucggugccagcac

SEQ ID NO: 3097680 - RNA, 14 nt, Mycobacterium bovis subsp bovis AF2122/97
ggucaagccggcgc

SEQ ID NO: 3097681 - RNA, 21 nt, Mycobacterium bovis subsp bovis AF2122/97
ggucaaugccggccgcggggc

SEQ ID NO: 3097682 - RNA, 20 nt, Mycobacterium bovis subsp bovis AF2122/97
ggucaaugcgcuggcgccgc

SEQ ID NO: 3097683 - RNA, 21 nt, Mycobacterium bovis subsp bovis AF2122/97
ggucaaugcgcuggcgccgcc

SEQ ID NO: 3097684 - RNA, 23 nt, Mycobacterium bovis subsp bovis AF2122/97
ggucaaugcgcuggcgccgccgg

SEQ ID NO: 3097685 - RNA, 14 nt, Mycobacterium bovis subsp bovis AF2122/97
ggucaaugcuggca

SEQ ID NO: 3097686 - RNA, 20 nt, Mycobacterium bovis subsp bovis AF2122/97
ggucaaugcuggcagcggcc

SEQ ID NO: 3097687 - RNA, 17 nt, Mycobacterium bovis subsp bovis AF2122/97
ggucaauugugcggccc

SEQ ID NO: 3097688 - RNA, 20 nt, Mycobacterium bovis subsp bovis AF2122/97
ggucacaaacccagcaucgg

SEQ ID NO: 3097689 - RNA, 17 nt, Mycobacterium bovis subsp bovis AF2122/97
ggucacacccagcgcgc

SEQ ID NO: 3097690 - RNA, 16 nt, Mycobacterium bovis subsp bovis AF2122/97
ggucaccaagacaccg

SEQ ID NO: 3097691 - RNA, 15 nt, Mycobacterium bovis subsp bovis AF2122/97
ggucaccacgcggcg

SEQ ID NO: 3097692 - RNA, 18 nt, Mycobacterium bovis subsp bovis AF2122/97
ggucaccacgcggcgguc

SEQ ID NO: 3097693 - RNA, 22 nt, Mycobacterium bovis subsp bovis AF2122/97
ggucaccagcgcaucggccagc

SEQ ID NO: 3097694 - RNA, 17 nt, Mycobacterium bovis subsp bovis AF2122/97
ggucaccaucaccggug

SEQ ID NO: 3097695 - RNA, 20 nt, Mycobacterium bovis subsp bovis AF2122/97
ggucaccauggcgccgcgcc

SEQ ID NO: 3097696 - RNA, 21 nt, Mycobacterium bovis subsp bovis AF2122/97
ggucaccauggcgccgcgccg

SEQ ID NO: 3097697 - RNA, 22 nt, Mycobacterium bovis subsp bovis AF2122/97
ggucaccauggcgccgcgccga

SEQ ID NO: 3097698 - RNA, 15 nt, Mycobacterium bovis subsp bovis AF2122/97
ggucacccaucaacg

SEQ ID NO: 3097699 - RNA, 21 nt, Mycobacterium bovis subsp bovis AF2122/97
ggucacccaucaacgccggcg

SEQ ID NO: 3097700 - RNA, 20 nt, Mycobacterium bovis subsp bovis AF2122/97
ggucaccccggcucggccac

SEQ ID NO: 3097701 - RNA, 23 nt, Mycobacterium bovis subsp bovis AF2122/97
ggucaccccggcucggccaccga

SEQ ID NO: 3097702 - RNA, 21 nt, Mycobacterium bovis subsp bovis AF2122/97
ggucaccccuucgccagcgcc

SEQ ID NO: 3097703 - RNA, 22 nt, Mycobacterium bovis subsp bovis AF2122/97
ggucacccguguucgccacacc

SEQ ID NO: 3097704 - RNA, 17 nt, Mycobacterium bovis subsp bovis AF2122/97
ggucaccgcgucaccgg

SEQ ID NO: 3097705 - RNA, 19 nt, Mycobacterium bovis subsp bovis AF2122/97
ggucaccggacugcgccgg

SEQ ID NO: 3097706 - RNA, 12 nt, Mycobacterium bovis subsp bovis AF2122/97
ggucaccggccg

SEQ ID NO: 3097707 - RNA, 15 nt, Mycobacterium bovis subsp bovis AF2122/97
ggucaccggccgccg

SEQ ID NO: 3097708 - RNA, 11 nt, Mycobacterium bovis subsp bovis AF2122/97
ggucaccggcg

SEQ ID NO: 3097709 - RNA, 15 nt, Mycobacterium bovis subsp bovis AF2122/97
ggucaccggcgaccg

SEQ ID NO: 3097710 - RNA, 20 nt, Mycobacterium bovis subsp bovis AF2122/97
ggucaccggcuucuccucca

SEQ ID NO: 3097711 - RNA, 22 nt, Mycobacterium bovis subsp bovis AF2122/97
ggucaccggcuucuccuccaga

SEQ ID NO: 3097712 - RNA, 20 nt, Mycobacterium bovis subsp bovis AF2122/97
ggucaccgucugcaccggca

SEQ ID NO: 3097713 - RNA, 16 nt, Mycobacterium bovis subsp bovis AF2122/97
ggucaccucgccggcg

SEQ ID NO: 3097714 - RNA, 18 nt, Mycobacterium bovis subsp bovis AF2122/97
ggucaccucgccggcggg

SEQ ID NO: 3097715 - RNA, 12 nt, Mycobacterium bovis subsp bovis AF2122/97
ggucaccugcgg

SEQ ID NO: 3097716 - RNA, 14 nt, Mycobacterium bovis subsp bovis AF2122/97
ggucacgcagcacc

SEQ ID NO: 3097717 - RNA, 22 nt, Mycobacterium bovis subsp bovis AF2122/97
ggucacgcagucgggcagcgcu

SEQ ID NO: 3097718 - RNA, 22 nt, Mycobacterium bovis subsp bovis AF2122/97
ggucacgcgacuugcaccccgu

SEQ ID NO: 3097719 - RNA, 20 nt, Mycobacterium bovis subsp bovis AF2122/97
ggucacgcguuccauggccc

SEQ ID NO: 3097720 - RNA, 17 nt, Mycobacterium bovis subsp bovis AF2122/97
ggucacgguagcguucg

SEQ ID NO: 3097721 - RNA, 22 nt, Mycobacterium bovis subsp bovis AF2122/97
ggucacgguucgcccgucgcca

SEQ ID NO: 3097722 - RNA, 15 nt, Mycobacterium bovis subsp bovis AF2122/97
ggucacgucgaugag

SEQ ID NO: 3097723 - RNA, 18 nt, Mycobacterium bovis subsp bovis AF2122/97
ggucacgugggccaugcu

SEQ ID NO: 3097724 - RNA, 15 nt, Mycobacterium bovis subsp bovis AF2122/97
ggucacuccggcggc

SEQ ID NO: 3097725 - RNA, 19 nt, Mycobacterium bovis subsp bovis AF2122/97
ggucacugguccaacgauc

SEQ ID NO: 3097726 - RNA, 19 nt, Mycobacterium bovis subsp bovis AF2122/97
ggucagcaauacggcggcg

SEQ ID NO: 3097727 - RNA, 23 nt, Mycobacterium bovis subsp bovis AF2122/97
ggucagcaauacggcggcgccgc

SEQ ID NO: 3097728 - RNA, 14 nt, Mycobacterium bovis subsp bovis AF2122/97
ggucagcaccacca

SEQ ID NO: 3097729 - RNA, 16 nt, Mycobacterium bovis subsp bovis AF2122/97
ggucagcaccaccagc

SEQ ID NO: 3097730 - RNA, 17 nt, Mycobacterium bovis subsp bovis AF2122/97
ggucagcaccaccagca

SEQ ID NO: 3097731 - RNA, 23 nt, Mycobacterium bovis subsp bovis AF2122/97
ggucagcacccaacccggcggca

SEQ ID NO: 3097732 - RNA, 15 nt, Mycobacterium bovis subsp bovis AF2122/97
ggucagcaccggcgc

SEQ ID NO: 3097733 - RNA, 21 nt, Mycobacterium bovis subsp bovis AF2122/97
ggucagccccaugaucuggug

SEQ ID NO: 3097734 - RNA, 14 nt, Mycobacterium bovis subsp bovis AF2122/97
ggucagcccggcgc

SEQ ID NO: 3097735 - RNA, 21 nt, Mycobacterium bovis subsp bovis AF2122/97
ggucagccgcgcgggucacga

SEQ ID NO: 3097736 - RNA, 12 nt, Mycobacterium bovis subsp bovis AF2122/97
ggucagccgcgg

SEQ ID NO: 3097737 - RNA, 13 nt, Mycobacterium bovis subsp bovis AF2122/97
ggucagccgcggg

SEQ ID NO: 3097738 - RNA, 14 nt, Mycobacterium bovis subsp bovis AF2122/97
ggucagccggccau

SEQ ID NO: 3097739 - RNA, 22 nt, Mycobacterium bovis subsp bovis AF2122/97
ggucagccggccauacgcgcgc

SEQ ID NO: 3097740 - RNA, 14 nt, Mycobacterium bovis subsp bovis AF2122/97
ggucagccgugccg

SEQ ID NO: 3097741 - RNA, 15 nt, Mycobacterium bovis subsp bovis AF2122/97
ggucagccgugccgu

SEQ ID NO: 3097742 - RNA, 15 nt, Mycobacterium bovis subsp bovis AF2122/97
ggucagccuuuccac

SEQ ID NO: 3097743 - RNA, 14 nt, Mycobacterium bovis subsp bovis AF2122/97
ggucagcgaccuca

SEQ ID NO: 3097744 - RNA, 19 nt, Mycobacterium bovis subsp bovis AF2122/97
ggucagcgaccucacugcg

SEQ ID NO: 3097745 - RNA, 20 nt, Mycobacterium bovis subsp bovis AF2122/97
ggucagcgaccucacugcgg

SEQ ID NO: 3097746 - RNA, 21 nt, Mycobacterium bovis subsp bovis AF2122/97
ggucagcgaccucacugcggc

SEQ ID NO: 3097747 - RNA, 21 nt, Mycobacterium bovis subsp bovis AF2122/97
ggucagcgccgacuccaguuc

SEQ ID NO: 3097748 - RNA, 13 nt, Mycobacterium bovis subsp bovis AF2122/97
ggucagcgccgag

SEQ ID NO: 3097749 - RNA, 14 nt, Mycobacterium bovis subsp bovis AF2122/97
ggucagcgccgcgc

SEQ ID NO: 3097750 - RNA, 19 nt, Mycobacterium bovis subsp bovis AF2122/97
ggucagcgccgcgccccag

SEQ ID NO: 3097751 - RNA, 16 nt, Mycobacterium bovis subsp bovis AF2122/97
ggucagcgcggcgacc

SEQ ID NO: 3097752 - RNA, 14 nt, Mycobacterium bovis subsp bovis AF2122/97
ggucagcgcggcgc

SEQ ID NO: 3097753 - RNA, 16 nt, Mycobacterium bovis subsp bovis AF2122/97
ggucagcgcugccacc

SEQ ID NO: 3097754 - RNA, 17 nt, Mycobacterium bovis subsp bovis AF2122/97
ggucagcgcugccaccg

SEQ ID NO: 3097755 - RNA, 22 nt, Mycobacterium bovis subsp bovis AF2122/97
ggucagcggauccaggccucgc

SEQ ID NO: 3097756 - RNA, 13 nt, Mycobacterium bovis subsp bovis AF2122/97
ggucagcggcugg

SEQ ID NO: 3097757 - RNA, 18 nt, Mycobacterium bovis subsp bovis AF2122/97
ggucagcggcugggcggu

SEQ ID NO: 3097758 - RNA, 17 nt, Mycobacterium bovis subsp bovis AF2122/97
ggucagcgggcuugccg

SEQ ID NO: 3097759 - RNA, 17 nt, Mycobacterium bovis subsp bovis AF2122/97
ggucagcgugcagguag

SEQ ID NO: 3097760 - RNA, 18 nt, Mycobacterium bovis subsp bovis AF2122/97
ggucagcgugcagguagg

SEQ ID NO: 3097761 - RNA, 19 nt, Mycobacterium bovis subsp bovis AF2122/97
ggucagcgugcagguaggu

SEQ ID NO: 3097762 - RNA, 16 nt, Mycobacterium bovis subsp bovis AF2122/97
ggucagcucgagcgcc

SEQ ID NO: 3097763 - RNA, 20 nt, Mycobacterium bovis subsp bovis AF2122/97
ggucagcucggugaugucgg

SEQ ID NO: 3097764 - RNA, 20 nt, Mycobacterium bovis subsp bovis AF2122/97
ggucagcucgucggcgaugg

SEQ ID NO: 3097765 - RNA, 17 nt, Mycobacterium bovis subsp bovis AF2122/97
ggucagcugacgggccg

SEQ ID NO: 3097766 - RNA, 17 nt, Mycobacterium bovis subsp bovis AF2122/97
ggucagcugggacccga

SEQ ID NO: 3097767 - RNA, 22 nt, Mycobacterium bovis subsp bovis AF2122/97
ggucaggcaggaggcguccggc

SEQ ID NO: 3097768 - RNA, 18 nt, Mycobacterium bovis subsp bovis AF2122/97
ggucaggcaguccaccgc

SEQ ID NO: 3097769 - RNA, 18 nt, Mycobacterium bovis subsp bovis AF2122/97
ggucaggccgccgcggcg

SEQ ID NO: 3097770 - RNA, 19 nt, Mycobacterium bovis subsp bovis AF2122/97
ggucaggccgccgcggcga

SEQ ID NO: 3097771 - RNA, 19 nt, Mycobacterium bovis subsp bovis AF2122/97
ggucaggcggccgucgucg

SEQ ID NO: 3097772 - RNA, 22 nt, Mycobacterium bovis subsp bovis AF2122/97
ggucaggcggccgucgucggcc

SEQ ID NO: 3097773 - RNA, 21 nt, Mycobacterium bovis subsp bovis AF2122/97
ggucaggcuaguugccaacac

SEQ ID NO: 3097774 - RNA, 20 nt, Mycobacterium bovis subsp bovis AF2122/97
ggucagggacgaacugcuga

SEQ ID NO: 3097775 - RNA, 13 nt, Mycobacterium bovis subsp bovis AF2122/97
ggucagggugggc

SEQ ID NO: 3097776 - RNA, 20 nt, Mycobacterium bovis subsp bovis AF2122/97
ggucaggucugacagaccgg

SEQ ID NO: 3097777 - RNA, 22 nt, Mycobacterium bovis subsp bovis AF2122/97
ggucaggugauucgcgcagcgc

SEQ ID NO: 3097778 - RNA, 19 nt, Mycobacterium bovis subsp bovis AF2122/97
ggucagguuggcacgcugu

SEQ ID NO: 3097779 - RNA, 14 nt, Mycobacterium bovis subsp bovis AF2122/97
ggucagguugucgg

SEQ ID NO: 3097780 - RNA, 17 nt, Mycobacterium bovis subsp bovis AF2122/97
ggucagguugucggcga

SEQ ID NO: 3097781 - RNA, 15 nt, Mycobacterium bovis subsp bovis AF2122/97
ggucaguaggcggau

SEQ ID NO: 3097782 - RNA, 13 nt, Mycobacterium bovis subsp bovis AF2122/97
ggucagucccgug

SEQ ID NO: 3097783 - RNA, 18 nt, Mycobacterium bovis subsp bovis AF2122/97
ggucaguccgacaccggc

SEQ ID NO: 3097784 - RNA, 21 nt, Mycobacterium bovis subsp bovis AF2122/97
ggucaguccgacaccggcggc

SEQ ID NO: 3097785 - RNA, 23 nt, Mycobacterium bovis subsp bovis AF2122/97
ggucaguccgacaccggcggcau

SEQ ID NO: 3097786 - RNA, 14 nt, Mycobacterium bovis subsp bovis AF2122/97
ggucaguccgucgg

SEQ ID NO: 3097787 - RNA, 19 nt, Mycobacterium bovis subsp bovis AF2122/97
ggucaguccgucggccugg

SEQ ID NO: 3097788 - RNA, 15 nt, Mycobacterium bovis subsp bovis AF2122/97
ggucagugcgaugcg

SEQ ID NO: 3097789 - RNA, 15 nt, Mycobacterium bovis subsp bovis AF2122/97
ggucagugcgggcgg

SEQ ID NO: 3097790 - RNA, 14 nt, Mycobacterium bovis subsp bovis AF2122/97
ggucagugggcggu

SEQ ID NO: 3097791 - RNA, 22 nt, Mycobacterium bovis subsp bovis AF2122/97
ggucauaagggcaugcgcucag

SEQ ID NO: 3097792 - RNA, 17 nt, Mycobacterium bovis subsp bovis AF2122/97
ggucauaccaagcgcgg

SEQ ID NO: 3097793 - RNA, 22 nt, Mycobacterium bovis subsp bovis AF2122/97
ggucauagucgaauggcaacac

SEQ ID NO: 3097794 - RNA, 16 nt, Mycobacterium bovis subsp bovis AF2122/97
ggucauauugcggugc

SEQ ID NO: 3097795 - RNA, 20 nt, Mycobacterium bovis subsp bovis AF2122/97
ggucauauugcggugcaucg

SEQ ID NO: 3097796 - RNA, 18 nt, Mycobacterium bovis subsp bovis AF2122/97
ggucauauugugggugcg

SEQ ID NO: 3097797 - RNA, 17 nt, Mycobacterium bovis subsp bovis AF2122/97
ggucaucaugucgaggu

SEQ ID NO: 3097798 - RNA, 15 nt, Mycobacterium bovis subsp bovis AF2122/97
ggucaucgagcugac

SEQ ID NO: 3097799 - RNA, 13 nt, Mycobacterium bovis subsp bovis AF2122/97
ggucaucggcgcc

SEQ ID NO: 3097800 - RNA, 14 nt, Mycobacterium bovis subsp bovis AF2122/97
ggucaucggcgcca

SEQ ID NO: 3097801 - RNA, 15 nt, Mycobacterium bovis subsp bovis AF2122/97
ggucaucgggcagcg

SEQ ID NO: 3097802 - RNA, 15 nt, Mycobacterium bovis subsp bovis AF2122/97
ggucaucgguugacc

SEQ ID NO: 3097803 - RNA, 16 nt, Mycobacterium bovis subsp bovis AF2122/97
ggucaugccgccgccg

SEQ ID NO: 3097804 - RNA, 14 nt, Mycobacterium bovis subsp bovis AF2122/97
ggucaugggcgcgu

SEQ ID NO: 3097805 - RNA, 16 nt, Mycobacterium bovis subsp bovis AF2122/97
ggucaugucggccacc

SEQ ID NO: 3097806 - RNA, 20 nt, Mycobacterium bovis subsp bovis AF2122/97
ggucaugucggccaccggcg

SEQ ID NO: 3097807 - RNA, 21 nt, Mycobacterium bovis subsp bovis AF2122/97
ggucauguucggggcgcacca

SEQ ID NO: 3097808 - RNA, 15 nt, Mycobacterium bovis subsp bovis AF2122/97
ggucauugccggcga

SEQ ID NO: 3097809 - RNA, 18 nt, Mycobacterium bovis subsp bovis AF2122/97
ggucauugccggcgacga

SEQ ID NO: 3097810 - RNA, 17 nt, Mycobacterium bovis subsp bovis AF2122/97
gguccaaagcacguccu

SEQ ID NO: 3097811 - RNA, 13 nt, Mycobacterium bovis subsp bovis AF2122/97
gguccaacagcgc

SEQ ID NO: 3097812 - RNA, 21 nt, Mycobacterium bovis subsp bovis AF2122/97
gguccaaccaccgguccagcg

SEQ ID NO: 3097813 - RNA, 22 nt, Mycobacterium bovis subsp bovis AF2122/97
gguccaaccaccgguccagcgc

SEQ ID NO: 3097814 - RNA, 19 nt, Mycobacterium bovis subsp bovis AF2122/97
gguccaaccacgagcauca

SEQ ID NO: 3097815 - RNA, 15 nt, Mycobacterium bovis subsp bovis AF2122/97
gguccaaccgggccg

SEQ ID NO: 3097816 - RNA, 19 nt, Mycobacterium bovis subsp bovis AF2122/97
gguccaaccgggccggcua

SEQ ID NO: 3097817 - RNA, 18 nt, Mycobacterium bovis subsp bovis AF2122/97
gguccaagugggccggcg

SEQ ID NO: 3097818 - RNA, 19 nt, Mycobacterium bovis subsp bovis AF2122/97
gguccacaaaccgugcacg

SEQ ID NO: 3097819 - RNA, 13 nt, Mycobacterium bovis subsp bovis AF2122/97
gguccacagccgg

SEQ ID NO: 3097820 - RNA, 16 nt, Mycobacterium bovis subsp bovis AF2122/97
gguccacagccggcgg

SEQ ID NO: 3097821 - RNA, 16 nt, Mycobacterium bovis subsp bovis AF2122/97
gguccaccccgccgau

SEQ ID NO: 3097822 - RNA, 15 nt, Mycobacterium bovis subsp bovis AF2122/97
gguccaccgcugccg

SEQ ID NO: 3097823 - RNA, 12 nt, Mycobacterium bovis subsp bovis AF2122/97
gguccaccggcc

SEQ ID NO: 3097824 - RNA, 13 nt, Mycobacterium bovis subsp bovis AF2122/97
gguccaccggcca

SEQ ID NO: 3097825 - RNA, 14 nt, Mycobacterium bovis subsp bovis AF2122/97
gguccaccggccag

SEQ ID NO: 3097826 - RNA, 18 nt, Mycobacterium bovis subsp bovis AF2122/97
gguccaccggcccucgcc

SEQ ID NO: 3097827 - RNA, 18 nt, Mycobacterium bovis subsp bovis AF2122/97
gguccaccuuggucgcca

SEQ ID NO: 3097828 - RNA, 19 nt, Mycobacterium bovis subsp bovis AF2122/97
gguccaccuuggucgccaa

SEQ ID NO: 3097829 - RNA, 22 nt, Mycobacterium bovis subsp bovis AF2122/97
gguccagacaucagugcgccgg

SEQ ID NO: 3097830 - RNA, 17 nt, Mycobacterium bovis subsp bovis AF2122/97
gguccagacccagcucg

SEQ ID NO: 3097831 - RNA, 14 nt, Mycobacterium bovis subsp bovis AF2122/97
gguccagcacaucg

SEQ ID NO: 3097832 - RNA, 18 nt, Mycobacterium bovis subsp bovis AF2122/97
gguccagcacaucggcga

SEQ ID NO: 3097833 - RNA, 13 nt, Mycobacterium bovis subsp bovis AF2122/97
gguccagcagcuc

SEQ ID NO: 3097834 - RNA, 14 nt, Mycobacterium bovis subsp bovis AF2122/97
gguccagccaccgc

SEQ ID NO: 3097835 - RNA, 20 nt, Mycobacterium bovis subsp bovis AF2122/97
gguccagccgguccagaccc

SEQ ID NO: 3097836 - RNA, 23 nt, Mycobacterium bovis subsp bovis AF2122/97
gguccagccgguccagacccagc

SEQ ID NO: 3097837 - RNA, 14 nt, Mycobacterium bovis subsp bovis AF2122/97
gguccagccgguga

SEQ ID NO: 3097838 - RNA, 20 nt, Mycobacterium bovis subsp bovis AF2122/97
gguccagccuuuuucggcga

SEQ ID NO: 3097839 - RNA, 12 nt, Mycobacterium bovis subsp bovis AF2122/97
gguccagcgccg

SEQ ID NO: 3097840 - RNA, 14 nt, Mycobacterium bovis subsp bovis AF2122/97
gguccagcggccgc

SEQ ID NO: 3097841 - RNA, 18 nt, Mycobacterium bovis subsp bovis AF2122/97
gguccagcggccgccgcg

SEQ ID NO: 3097842 - RNA, 13 nt, Mycobacterium bovis subsp bovis AF2122/97
gguccaggcccug

SEQ ID NO: 3097843 - RNA, 15 nt, Mycobacterium bovis subsp bovis AF2122/97
gguccaggcccuggc

SEQ ID NO: 3097844 - RNA, 19 nt, Mycobacterium bovis subsp bovis AF2122/97
gguccaggccggcacccac

SEQ ID NO: 3097845 - RNA, 20 nt, Mycobacterium bovis subsp bovis AF2122/97
gguccaggccggcacccacc

SEQ ID NO: 3097846 - RNA, 15 nt, Mycobacterium bovis subsp bovis AF2122/97
gguccaggcguugga

SEQ ID NO: 3097847 - RNA, 13 nt, Mycobacterium bovis subsp bovis AF2122/97
gguccaggucggg

SEQ ID NO: 3097848 - RNA, 22 nt, Mycobacterium bovis subsp bovis AF2122/97
gguccagguucuucuccaccac

SEQ ID NO: 3097849 - RNA, 17 nt, Mycobacterium bovis subsp bovis AF2122/97
gguccagugggaugacc

SEQ ID NO: 3097850 - RNA, 17 nt, Mycobacterium bovis subsp bovis AF2122/97
gguccaucagcacggug

SEQ ID NO: 3097851 - RNA, 15 nt, Mycobacterium bovis subsp bovis AF2122/97
gguccaucgcgcugc

SEQ ID NO: 3097852 - RNA, 16 nt, Mycobacterium bovis subsp bovis AF2122/97
gguccaucuggcgcgc

SEQ ID NO: 3097853 - RNA, 18 nt, Mycobacterium bovis subsp bovis AF2122/97
gguccaucuggcgcgccg

SEQ ID NO: 3097854 - RNA, 18 nt, Mycobacterium bovis subsp bovis AF2122/97
ggucccacaccuccucga

SEQ ID NO: 3097855 - RNA, 12 nt, Mycobacterium bovis subsp bovis AF2122/97
ggucccacggcg

SEQ ID NO: 3097856 - RNA, 14 nt, Mycobacterium bovis subsp bovis AF2122/97
ggucccagccuggc

SEQ ID NO: 3097857 - RNA, 22 nt, Mycobacterium bovis subsp bovis AF2122/97
ggucccagguuggagcccgagc

SEQ ID NO: 3097858 - RNA, 14 nt, Mycobacterium bovis subsp bovis AF2122/97
ggucccccgcagcc

SEQ ID NO: 3097859 - RNA, 15 nt, Mycobacterium bovis subsp bovis AF2122/97
ggucccccgcccaca

SEQ ID NO: 3097860 - RNA, 22 nt, Mycobacterium bovis subsp bovis AF2122/97
gguccccgcagcucgaccagga

SEQ ID NO: 3097861 - RNA, 14 nt, Mycobacterium bovis subsp bovis AF2122/97
gguccccgccggcg

SEQ ID NO: 3097862 - RNA, 15 nt, Mycobacterium bovis subsp bovis AF2122/97
gguccccgccggcgg

SEQ ID NO: 3097863 - RNA, 16 nt, Mycobacterium bovis subsp bovis AF2122/97
gguccccgccggcggg

SEQ ID NO: 3097864 - RNA, 16 nt, Mycobacterium bovis subsp bovis AF2122/97
ggucccgagggcggca

SEQ ID NO: 3097865 - RNA, 19 nt, Mycobacterium bovis subsp bovis AF2122/97
ggucccgaucaccccgguc

SEQ ID NO: 3097866 - RNA, 16 nt, Mycobacterium bovis subsp bovis AF2122/97
ggucccgaugaccuug

SEQ ID NO: 3097867 - RNA, 14 nt, Mycobacterium bovis subsp bovis AF2122/97
ggucccgccgugcc

SEQ ID NO: 3097868 - RNA, 19 nt, Mycobacterium bovis subsp bovis AF2122/97
ggucccgccgugccgcggc

SEQ ID NO: 3097869 - RNA, 15 nt, Mycobacterium bovis subsp bovis AF2122/97
ggucccgcucugguc

SEQ ID NO: 3097870 - RNA, 23 nt, Mycobacterium bovis subsp bovis AF2122/97
ggucccggacgugccgggucacc

SEQ ID NO: 3097871 - RNA, 15 nt, Mycobacterium bovis subsp bovis AF2122/97
ggucccggcagcugg

SEQ ID NO: 3097872 - RNA, 19 nt, Mycobacterium bovis subsp bovis AF2122/97
ggucccggccgggucuucc

SEQ ID NO: 3097873 - RNA, 12 nt, Mycobacterium bovis subsp bovis AF2122/97
ggucccgugcgc

SEQ ID NO: 3097874 - RNA, 14 nt, Mycobacterium bovis subsp bovis AF2122/97
ggucccgugcgcgc

SEQ ID NO: 3097875 - RNA, 22 nt, Mycobacterium bovis subsp bovis AF2122/97
ggucccgugcgcgcgcagcuga

SEQ ID NO: 3097876 - RNA, 17 nt, Mycobacterium bovis subsp bovis AF2122/97
ggucccguugccgccca

SEQ ID NO: 3097877 - RNA, 21 nt, Mycobacterium bovis subsp bovis AF2122/97
ggucccguugccgcccacuag

SEQ ID NO: 3097878 - RNA, 18 nt, Mycobacterium bovis subsp bovis AF2122/97
ggucccugaagccagcgc

SEQ ID NO: 3097879 - RNA, 17 nt, Mycobacterium bovis subsp bovis AF2122/97
ggucccuuuguggggcc

SEQ ID NO: 3097880 - RNA, 21 nt, Mycobacterium bovis subsp bovis AF2122/97
ggucccuuuguggggccgggc

SEQ ID NO: 3097881 - RNA, 13 nt, Mycobacterium bovis subsp bovis AF2122/97
gguccgaccagcg

SEQ ID NO: 3097882 - RNA, 17 nt, Mycobacterium bovis subsp bovis AF2122/97
gguccgaccagcggccg

SEQ ID NO: 3097883 - RNA, 21 nt, Mycobacterium bovis subsp bovis AF2122/97
gguccgaccagcggccgaccg

SEQ ID NO: 3097884 - RNA, 15 nt, Mycobacterium bovis subsp bovis AF2122/97
gguccgacgggccac

SEQ ID NO: 3097885 - RNA, 16 nt, Mycobacterium bovis subsp bovis AF2122/97
gguccgagcggcaucg

SEQ ID NO: 3097886 - RNA, 18 nt, Mycobacterium bovis subsp bovis AF2122/97
gguccgaugcgcgcggcg

SEQ ID NO: 3097887 - RNA, 14 nt, Mycobacterium bovis subsp bovis AF2122/97
gguccgccacggcg

SEQ ID NO: 3097888 - RNA, 20 nt, Mycobacterium bovis subsp bovis AF2122/97
gguccgccagcgcgaaccug

SEQ ID NO: 3097889 - RNA, 19 nt, Mycobacterium bovis subsp bovis AF2122/97
gguccgccauuggcgccgu

SEQ ID NO: 3097890 - RNA, 14 nt, Mycobacterium bovis subsp bovis AF2122/97
gguccgccggugcc

SEQ ID NO: 3097891 - RNA, 15 nt, Mycobacterium bovis subsp bovis AF2122/97
gguccgccggugccg

SEQ ID NO: 3097892 - RNA, 20 nt, Mycobacterium bovis subsp bovis AF2122/97
gguccgccggugccgccguc

SEQ ID NO: 3097893 - RNA, 13 nt, Mycobacterium bovis subsp bovis AF2122/97
gguccgccgucga

SEQ ID NO: 3097894 - RNA, 12 nt, Mycobacterium bovis subsp bovis AF2122/97
gguccgcggccg

SEQ ID NO: 3097895 - RNA, 13 nt, Mycobacterium bovis subsp bovis AF2122/97
gguccgcgugcug

SEQ ID NO: 3097896 - RNA, 16 nt, Mycobacterium bovis subsp bovis AF2122/97
gguccgcgugcugccg

SEQ ID NO: 3097897 - RNA, 16 nt, Mycobacterium bovis subsp bovis AF2122/97
gguccgcuacggcguc

SEQ ID NO: 3097898 - RNA, 17 nt, Mycobacterium bovis subsp bovis AF2122/97
gguccgcuacggcgucc

SEQ ID NO: 3097899 - RNA, 22 nt, Mycobacterium bovis subsp bovis AF2122/97
gguccggaaauuccggcgcggc

SEQ ID NO: 3097900 - RNA, 15 nt, Mycobacterium bovis subsp bovis AF2122/97
gguccggaaccggua

SEQ ID NO: 3097901 - RNA, 17 nt, Mycobacterium bovis subsp bovis AF2122/97
gguccggauggccccgc

SEQ ID NO: 3097902 - RNA, 22 nt, Mycobacterium bovis subsp bovis AF2122/97
gguccggcgaaaagacugcgcc

SEQ ID NO: 3097903 - RNA, 18 nt, Mycobacterium bovis subsp bovis AF2122/97
gguccggcgaacugcgau

SEQ ID NO: 3097904 - RNA, 12 nt, Mycobacterium bovis subsp bovis AF2122/97
gguccggcggcc

SEQ ID NO: 3097905 - RNA, 14 nt, Mycobacterium bovis subsp bovis AF2122/97
gguccggcggccgc

SEQ ID NO: 3097906 - RNA, 14 nt, Mycobacterium bovis subsp bovis AF2122/97
gguccggcggccgg

SEQ ID NO: 3097907 - RNA, 18 nt, Mycobacterium bovis subsp bovis AF2122/97
gguccggcggccgguaga

SEQ ID NO: 3097908 - RNA, 16 nt, Mycobacterium bovis subsp bovis AF2122/97
gguccggcguacgccg

SEQ ID NO: 3097909 - RNA, 21 nt, Mycobacterium bovis subsp bovis AF2122/97
gguccggcguacgccguaccc

SEQ ID NO: 3097910 - RNA, 19 nt, Mycobacterium bovis subsp bovis AF2122/97
gguccgggaagucgcugaa

SEQ ID NO: 3097911 - RNA, 14 nt, Mycobacterium bovis subsp bovis AF2122/97
gguccgggcggccg

SEQ ID NO: 3097912 - RNA, 17 nt, Mycobacterium bovis subsp bovis AF2122/97
gguccggggaaagccgc

SEQ ID NO: 3097913 - RNA, 13 nt, Mycobacterium bovis subsp bovis AF2122/97
gguccggggcaac

SEQ ID NO: 3097914 - RNA, 17 nt, Mycobacterium bovis subsp bovis AF2122/97
gguccgucaccaccgcc

SEQ ID NO: 3097915 - RNA, 18 nt, Mycobacterium bovis subsp bovis AF2122/97
gguccgucaccaccgccg

SEQ ID NO: 3097916 - RNA, 18 nt, Mycobacterium bovis subsp bovis AF2122/97
gguccgucgagucgccga

SEQ ID NO: 3097917 - RNA, 17 nt, Mycobacterium bovis subsp bovis AF2122/97
gguccgugccgaugccg

SEQ ID NO: 3097918 - RNA, 21 nt, Mycobacterium bovis subsp bovis AF2122/97
gguccgugccgaugccggcga

SEQ ID NO: 3097919 - RNA, 16 nt, Mycobacterium bovis subsp bovis AF2122/97
gguccguucgaugcca

SEQ ID NO: 3097920 - RNA, 15 nt, Mycobacterium bovis subsp bovis AF2122/97
gguccguucgcgccg

SEQ ID NO: 3097921 - RNA, 22 nt, Mycobacterium bovis subsp bovis AF2122/97
gguccguuuuaccucggccgcc

SEQ ID NO: 3097922 - RNA, 22 nt, Mycobacterium bovis subsp bovis AF2122/97
gguccuccagcgcacuacucga

SEQ ID NO: 3097923 - RNA, 22 nt, Mycobacterium bovis subsp bovis AF2122/97
gguccucgaucagacgcucgac

SEQ ID NO: 3097924 - RNA, 14 nt, Mycobacterium bovis subsp bovis AF2122/97
gguccucgcggagc

SEQ ID NO: 3097925 - RNA, 14 nt, Mycobacterium bovis subsp bovis AF2122/97
gguccugcgccgca

SEQ ID NO: 3097926 - RNA, 12 nt, Mycobacterium bovis subsp bovis AF2122/97
gguccugcgguc

SEQ ID NO: 3097927 - RNA, 15 nt, Mycobacterium bovis subsp bovis AF2122/97
gguccugcggucgcg

SEQ ID NO: 3097928 - RNA, 18 nt, Mycobacterium bovis subsp bovis AF2122/97
gguccugcggucgcggag

SEQ ID NO: 3097929 - RNA, 12 nt, Mycobacterium bovis subsp bovis AF2122/97
gguccugcucgc

SEQ ID NO: 3097930 - RNA, 19 nt, Mycobacterium bovis subsp bovis AF2122/97
gguccugcucgcacagcac

SEQ ID NO: 3097931 - RNA, 19 nt, Mycobacterium bovis subsp bovis AF2122/97
gguccugggauccggcggc

SEQ ID NO: 3097932 - RNA, 18 nt, Mycobacterium bovis subsp bovis AF2122/97
gguccugguguagccgag

SEQ ID NO: 3097933 - RNA, 22 nt, Mycobacterium bovis subsp bovis AF2122/97
gguccuucuccagauccacgcc

SEQ ID NO: 3097934 - RNA, 18 nt, Mycobacterium bovis subsp bovis AF2122/97
gguccuucugccgggaga

SEQ ID NO: 3097935 - RNA, 19 nt, Mycobacterium bovis subsp bovis AF2122/97
gguccuugucggccccggc

SEQ ID NO: 3097936 - RNA, 20 nt, Mycobacterium bovis subsp bovis AF2122/97
gguccuugucggccccggcc

SEQ ID NO: 3097937 - RNA, 23 nt, Mycobacterium bovis subsp bovis AF2122/97
ggucgaaacgguacgccgccgcg

SEQ ID NO: 3097938 - RNA, 19 nt, Mycobacterium bovis subsp bovis AF2122/97
ggucgaagaccaagagcgc

SEQ ID NO: 3097939 - RNA, 21 nt, Mycobacterium bovis subsp bovis AF2122/97
ggucgaagaccaagagcgcgc

SEQ ID NO: 3097940 - RNA, 23 nt, Mycobacterium bovis subsp bovis AF2122/97
ggucgaauaguugaccaggccga

SEQ ID NO: 3097941 - RNA, 21 nt, Mycobacterium bovis subsp bovis AF2122/97
ggucgaaucgcugccgccgau

SEQ ID NO: 3097942 - RNA, 22 nt, Mycobacterium bovis subsp bovis AF2122/97
ggucgaaucgcugccgccgauc

SEQ ID NO: 3097943 - RNA, 16 nt, Mycobacterium bovis subsp bovis AF2122/97
ggucgaaucgugucgc

SEQ ID NO: 3097944 - RNA, 23 nt, Mycobacterium bovis subsp bovis AF2122/97
ggucgacaccgcggugccccgga

SEQ ID NO: 3097945 - RNA, 19 nt, Mycobacterium bovis subsp bovis AF2122/97
ggucgacagcgaaggcgcc

SEQ ID NO: 3097946 - RNA, 21 nt, Mycobacterium bovis subsp bovis AF2122/97
ggucgacagcgaaggcgccga

SEQ ID NO: 3097947 - RNA, 14 nt, Mycobacterium bovis subsp bovis AF2122/97
ggucgacagcgcag

SEQ ID NO: 3097948 - RNA, 18 nt, Mycobacterium bovis subsp bovis AF2122/97
ggucgacauaggccaccu

SEQ ID NO: 3097949 - RNA, 13 nt, Mycobacterium bovis subsp bovis AF2122/97
ggucgaccacccg

SEQ ID NO: 3097950 - RNA, 18 nt, Mycobacterium bovis subsp bovis AF2122/97
ggucgaccacccgcaggg

SEQ ID NO: 3097951 - RNA, 19 nt, Mycobacterium bovis subsp bovis AF2122/97
ggucgacccaacgcagauc

SEQ ID NO: 3097952 - RNA, 16 nt, Mycobacterium bovis subsp bovis AF2122/97
ggucgaccggcguugc

SEQ ID NO: 3097953 - RNA, 11 nt, Mycobacterium bovis subsp bovis AF2122/97
ggucgacgacg

SEQ ID NO: 3097954 - RNA, 12 nt, Mycobacterium bovis subsp bovis AF2122/97
ggucgacgagau

SEQ ID NO: 3097955 - RNA, 20 nt, Mycobacterium bovis subsp bovis AF2122/97
ggucgacgagauccagcgcc

SEQ ID NO: 3097956 - RNA, 21 nt, Mycobacterium bovis subsp bovis AF2122/97
ggucgacgaucucgccggcga

SEQ ID NO: 3097957 - RNA, 20 nt, Mycobacterium bovis subsp bovis AF2122/97
ggucgacgaucucuccugga

SEQ ID NO: 3097958 - RNA, 14 nt, Mycobacterium bovis subsp bovis AF2122/97
ggucgacgccgacc

SEQ ID NO: 3097959 - RNA, 16 nt, Mycobacterium bovis subsp bovis AF2122/97
ggucgacgccgagacc

SEQ ID NO: 3097960 - RNA, 21 nt, Mycobacterium bovis subsp bovis AF2122/97
ggucgacggaaucgucggcgc

SEQ ID NO: 3097961 - RNA, 23 nt, Mycobacterium bovis subsp bovis AF2122/97
ggucgacggaaucgucggcgcgg

SEQ ID NO: 3097962 - RNA, 15 nt, Mycobacterium bovis subsp bovis AF2122/97
ggucgacggccacgg

SEQ ID NO: 3097963 - RNA, 12 nt, Mycobacterium bovis subsp bovis AF2122/97
ggucgacgggca

SEQ ID NO: 3097964 - RNA, 20 nt, Mycobacterium bovis subsp bovis AF2122/97
ggucgacggggcggucggcc

SEQ ID NO: 3097965 - RNA, 17 nt, Mycobacterium bovis subsp bovis AF2122/97
ggucgacgggucggcgc

SEQ ID NO: 3097966 - RNA, 20 nt, Mycobacterium bovis subsp bovis AF2122/97
ggucgacuccagcaccagca

SEQ ID NO: 3097967 - RNA, 23 nt, Mycobacterium bovis subsp bovis AF2122/97
ggucgacuccagcaccagcacgg

SEQ ID NO: 3097968 - RNA, 22 nt, Mycobacterium bovis subsp bovis AF2122/97
ggucgagcacgcugcugcgggu

SEQ ID NO: 3097969 - RNA, 23 nt, Mycobacterium bovis subsp bovis AF2122/97
ggucgagcacgcugcugcgggug

SEQ ID NO: 3097970 - RNA, 14 nt, Mycobacterium bovis subsp bovis AF2122/97
ggucgagcaggcga

SEQ ID NO: 3097971 - RNA, 15 nt, Mycobacterium bovis subsp bovis AF2122/97
ggucgagcaggcgag

SEQ ID NO: 3097972 - RNA, 17 nt, Mycobacterium bovis subsp bovis AF2122/97
ggucgagcagugccucg

SEQ ID NO: 3097973 - RNA, 22 nt, Mycobacterium bovis subsp bovis AF2122/97
ggucgagcagugccucggcgau

SEQ ID NO: 3097974 - RNA, 23 nt, Mycobacterium bovis subsp bovis AF2122/97
ggucgagcgaacccuucgcggug

SEQ ID NO: 3097975 - RNA, 19 nt, Mycobacterium bovis subsp bovis AF2122/97
ggucgagcgcccacuggug

SEQ ID NO: 3097976 - RNA, 13 nt, Mycobacterium bovis subsp bovis AF2122/97
ggucgagcgccuu

SEQ ID NO: 3097977 - RNA, 22 nt, Mycobacterium bovis subsp bovis AF2122/97
ggucgagcgcuucgucgccgaa

SEQ ID NO: 3097978 - RNA, 14 nt, Mycobacterium bovis subsp bovis AF2122/97
ggucgagcggucgc

SEQ ID NO: 3097979 - RNA, 21 nt, Mycobacterium bovis subsp bovis AF2122/97
ggucgaggcaggccucggcgc

SEQ ID NO: 3097980 - RNA, 12 nt, Mycobacterium bovis subsp bovis AF2122/97
ggucgagggcgg

SEQ ID NO: 3097981 - RNA, 14 nt, Mycobacterium bovis subsp bovis AF2122/97
ggucgagggcggcg

SEQ ID NO: 3097982 - RNA, 15 nt, Mycobacterium bovis subsp bovis AF2122/97
ggucgaggucggcga

SEQ ID NO: 3097983 - RNA, 17 nt, Mycobacterium bovis subsp bovis AF2122/97
ggucgaggucggcgauc

SEQ ID NO: 3097984 - RNA, 13 nt, Mycobacterium bovis subsp bovis AF2122/97
ggucgaggugacu

SEQ ID NO: 3097985 - RNA, 18 nt, Mycobacterium bovis subsp bovis AF2122/97
ggucgagguggcgggcga

SEQ ID NO: 3097986 - RNA, 19 nt, Mycobacterium bovis subsp bovis AF2122/97
ggucgagguggcgggcgau

SEQ ID NO: 3097987 - RNA, 17 nt, Mycobacterium bovis subsp bovis AF2122/97
ggucgaguccgacgggg

SEQ ID NO: 3097988 - RNA, 12 nt, Mycobacterium bovis subsp bovis AF2122/97
ggucgaguugaa

SEQ ID NO: 3097989 - RNA, 16 nt, Mycobacterium bovis subsp bovis AF2122/97
ggucgaguugaagaau

SEQ ID NO: 3097990 - RNA, 15 nt, Mycobacterium bovis subsp bovis AF2122/97
ggucgauaccggcgu

SEQ ID NO: 3097991 - RNA, 17 nt, Mycobacterium bovis subsp bovis AF2122/97
ggucgauaccggcgugc

SEQ ID NO: 3097992 - RNA, 20 nt, Mycobacterium bovis subsp bovis AF2122/97
ggucgauaccggcgugcagu

SEQ ID NO: 3097993 - RNA, 18 nt, Mycobacterium bovis subsp bovis AF2122/97
ggucgaucaacaccaacg

SEQ ID NO: 3097994 - RNA, 13 nt, Mycobacterium bovis subsp bovis AF2122/97
ggucgaucaccga

SEQ ID NO: 3097995 - RNA, 15 nt, Mycobacterium bovis subsp bovis AF2122/97
ggucgaucaccgaca

SEQ ID NO: 3097996 - RNA, 17 nt, Mycobacterium bovis subsp bovis AF2122/97
ggucgaucaccgacacc

SEQ ID NO: 3097997 - RNA, 20 nt, Mycobacterium bovis subsp bovis AF2122/97
ggucgaucaccgacaccgug

SEQ ID NO: 3097998 - RNA, 23 nt, Mycobacterium bovis subsp bovis AF2122/97
ggucgaucaugacgagccgagcc

SEQ ID NO: 3097999 - RNA, 16 nt, Mycobacterium bovis subsp bovis AF2122/97
ggucgaucauggcggc

SEQ ID NO: 3098000 - RNA, 20 nt, Mycobacterium bovis subsp bovis AF2122/97
ggucgauccacucggcgauc

SEQ ID NO: 3098001 - RNA, 12 nt, Mycobacterium bovis subsp bovis AF2122/97
ggucgauccggu

SEQ ID NO: 3098002 - RNA, 18 nt, Mycobacterium bovis subsp bovis AF2122/97
ggucgauccggugccgaa

SEQ ID NO: 3098003 - RNA, 21 nt, Mycobacterium bovis subsp bovis AF2122/97
ggucgaucugacugacgguca

SEQ ID NO: 3098004 - RNA, 13 nt, Mycobacterium bovis subsp bovis AF2122/97
ggucgaucugcgc

SEQ ID NO: 3098005 - RNA, 15 nt, Mycobacterium bovis subsp bovis AF2122/97
ggucgaugaccucca

SEQ ID NO: 3098006 - RNA, 23 nt, Mycobacterium bovis subsp bovis AF2122/97
ggucgaugacgccgucagcggcc

SEQ ID NO: 3098007 - RNA, 23 nt, Mycobacterium bovis subsp bovis AF2122/97
ggucgaugccuucguagcggccg

SEQ ID NO: 3098008 - RNA, 14 nt, Mycobacterium bovis subsp bovis AF2122/97
ggucgaugcgcaac

SEQ ID NO: 3098009 - RNA, 12 nt, Mycobacterium bovis subsp bovis AF2122/97
ggucgaugcugc

SEQ ID NO: 3098010 - RNA, 17 nt, Mycobacterium bovis subsp bovis AF2122/97
ggucgaugucggggccg

SEQ ID NO: 3098011 - RNA, 15 nt, Mycobacterium bovis subsp bovis AF2122/97
ggucgaugucgucga

SEQ ID NO: 3098012 - RNA, 15 nt, Mycobacterium bovis subsp bovis AF2122/97
ggucgauuucggcgc

SEQ ID NO: 3098013 - RNA, 16 nt, Mycobacterium bovis subsp bovis AF2122/97
ggucgcaaccgccgcc

SEQ ID NO: 3098014 - RNA, 18 nt, Mycobacterium bovis subsp bovis AF2122/97
ggucgcaauauccggccg

SEQ ID NO: 3098015 - RNA, 21 nt, Mycobacterium bovis subsp bovis AF2122/97
ggucgcaauauccggccgagc

SEQ ID NO: 3098016 - RNA, 22 nt, Mycobacterium bovis subsp bovis AF2122/97
ggucgcaauauccggccgagcc

SEQ ID NO: 3098017 - RNA, 18 nt, Mycobacterium bovis subsp bovis AF2122/97
ggucgcaccccggcggcg

SEQ ID NO: 3098018 - RNA, 16 nt, Mycobacterium bovis subsp bovis AF2122/97
ggucgcaccgccggcc

SEQ ID NO: 3098019 - RNA, 14 nt, Mycobacterium bovis subsp bovis AF2122/97
ggucgcauggucga

SEQ ID NO: 3098020 - RNA, 16 nt, Mycobacterium bovis subsp bovis AF2122/97
ggucgcauggucgacg

SEQ ID NO: 3098021 - RNA, 17 nt, Mycobacterium bovis subsp bovis AF2122/97
ggucgcauggucgacga

SEQ ID NO: 3098022 - RNA, 15 nt, Mycobacterium bovis subsp bovis AF2122/97
ggucgccaacccgau

SEQ ID NO: 3098023 - RNA, 15 nt, Mycobacterium bovis subsp bovis AF2122/97
ggucgccaacgccag

SEQ ID NO: 3098024 - RNA, 19 nt, Mycobacterium bovis subsp bovis AF2122/97
ggucgccaacgccagcacc

SEQ ID NO: 3098025 - RNA, 21 nt, Mycobacterium bovis subsp bovis AF2122/97
ggucgccaacgccagcaccag

SEQ ID NO: 3098026 - RNA, 15 nt, Mycobacterium bovis subsp bovis AF2122/97
ggucgccaauacgug

SEQ ID NO: 3098027 - RNA, 13 nt, Mycobacterium bovis subsp bovis AF2122/97
ggucgccacaccc

SEQ ID NO: 3098028 - RNA, 19 nt, Mycobacterium bovis subsp bovis AF2122/97
ggucgccaccgccggcagc

SEQ ID NO: 3098029 - RNA, 20 nt, Mycobacterium bovis subsp bovis AF2122/97
ggucgccaccgccggcagca

SEQ ID NO: 3098030 - RNA, 22 nt, Mycobacterium bovis subsp bovis AF2122/97
ggucgccauguugaagcgaagc

SEQ ID NO: 3098031 - RNA, 20 nt, Mycobacterium bovis subsp bovis AF2122/97
ggucgcccaacaccgcgccg

SEQ ID NO: 3098032 - RNA, 12 nt, Mycobacterium bovis subsp bovis AF2122/97
ggucgcccaggc

SEQ ID NO: 3098033 - RNA, 13 nt, Mycobacterium bovis subsp bovis AF2122/97
ggucgcccaggcc

SEQ ID NO: 3098034 - RNA, 20 nt, Mycobacterium bovis subsp bovis AF2122/97
ggucgcccgaucggcggauc

SEQ ID NO: 3098035 - RNA, 14 nt, Mycobacterium bovis subsp bovis AF2122/97
ggucgcccgcuacc

SEQ ID NO: 3098036 - RNA, 21 nt, Mycobacterium bovis subsp bovis AF2122/97
ggucgcccgugucguaccagc

SEQ ID NO: 3098037 - RNA, 20 nt, Mycobacterium bovis subsp bovis AF2122/97
ggucgccgaauggcugggcu

SEQ ID NO: 3098038 - RNA, 17 nt, Mycobacterium bovis subsp bovis AF2122/97
ggucgccgaccacucga

SEQ ID NO: 3098039 - RNA, 13 nt, Mycobacterium bovis subsp bovis AF2122/97
ggucgccgacggc

SEQ ID NO: 3098040 - RNA, 16 nt, Mycobacterium bovis subsp bovis AF2122/97
ggucgccgacggcgac

SEQ ID NO: 3098041 - RNA, 21 nt, Mycobacterium bovis subsp bovis AF2122/97
ggucgccgacggcgaccaccg

SEQ ID NO: 3098042 - RNA, 11 nt, Mycobacterium bovis subsp bovis AF2122/97
ggucgccgaga

SEQ ID NO: 3098043 - RNA, 15 nt, Mycobacterium bovis subsp bovis AF2122/97
ggucgccgagaccgg

SEQ ID NO: 3098044 - RNA, 16 nt, Mycobacterium bovis subsp bovis AF2122/97
ggucgccgcaucggcg

SEQ ID NO: 3098045 - RNA, 15 nt, Mycobacterium bovis subsp bovis AF2122/97
ggucgccgccgccac

SEQ ID NO: 3098046 - RNA, 13 nt, Mycobacterium bovis subsp bovis AF2122/97
ggucgccgccuuc

SEQ ID NO: 3098047 - RNA, 22 nt, Mycobacterium bovis subsp bovis AF2122/97
ggucgccgccuuccuggcgggc

SEQ ID NO: 3098048 - RNA, 22 nt, Mycobacterium bovis subsp bovis AF2122/97
ggucgccgcuuucuuggcgggc

SEQ ID NO: 3098049 - RNA, 18 nt, Mycobacterium bovis subsp bovis AF2122/97
ggucgccggaccagagcc

SEQ ID NO: 3098050 - RNA, 16 nt, Mycobacterium bovis subsp bovis AF2122/97
ggucgccggacugcgg

SEQ ID NO: 3098051 - RNA, 17 nt, Mycobacterium bovis subsp bovis AF2122/97
ggucgccggacugcggc

SEQ ID NO: 3098052 - RNA, 18 nt, Mycobacterium bovis subsp bovis AF2122/97
ggucgccggacugcggcc

SEQ ID NO: 3098053 - RNA, 15 nt, Mycobacterium bovis subsp bovis AF2122/97
ggucgccggcaccgg

SEQ ID NO: 3098054 - RNA, 12 nt, Mycobacterium bovis subsp bovis AF2122/97
ggucgccggcca

SEQ ID NO: 3098055 - RNA, 12 nt, Mycobacterium bovis subsp bovis AF2122/97
ggucgccggcgu

SEQ ID NO: 3098056 - RNA, 13 nt, Mycobacterium bovis subsp bovis AF2122/97
ggucgccggcguc

SEQ ID NO: 3098057 - RNA, 19 nt, Mycobacterium bovis subsp bovis AF2122/97
ggucgccgggacgauaccg

SEQ ID NO: 3098058 - RNA, 13 nt, Mycobacterium bovis subsp bovis AF2122/97
ggucgccggggcc

SEQ ID NO: 3098059 - RNA, 23 nt, Mycobacterium bovis subsp bovis AF2122/97
ggucgccggucaucgccgaaacc

SEQ ID NO: 3098060 - RNA, 16 nt, Mycobacterium bovis subsp bovis AF2122/97
ggucgccucaccggcg

SEQ ID NO: 3098061 - RNA, 17 nt, Mycobacterium bovis subsp bovis AF2122/97
ggucgccuccgggguga

SEQ ID NO: 3098062 - RNA, 21 nt, Mycobacterium bovis subsp bovis AF2122/97
ggucgccucgcuaacucccca

SEQ ID NO: 3098063 - RNA, 14 nt, Mycobacterium bovis subsp bovis AF2122/97
ggucgccugccauc

SEQ ID NO: 3098064 - RNA, 20 nt, Mycobacterium bovis subsp bovis AF2122/97
ggucgccugcccccgcgcgc

SEQ ID NO: 3098065 - RNA, 19 nt, Mycobacterium bovis subsp bovis AF2122/97
ggucgccuucccagccgac

SEQ ID NO: 3098066 - RNA, 19 nt, Mycobacterium bovis subsp bovis AF2122/97
ggucgcgauagccgccgcg

SEQ ID NO: 3098067 - RNA, 18 nt, Mycobacterium bovis subsp bovis AF2122/97
ggucgcgcagcuccaccg

SEQ ID NO: 3098068 - RNA, 23 nt, Mycobacterium bovis subsp bovis AF2122/97
ggucgcgcccucagccgcggcca

SEQ ID NO: 3098069 - RNA, 15 nt, Mycobacterium bovis subsp bovis AF2122/97
ggucgcgcgacggcc

SEQ ID NO: 3098070 - RNA, 14 nt, Mycobacterium bovis subsp bovis AF2122/97
ggucgcgcugaagg

SEQ ID NO: 3098071 - RNA, 19 nt, Mycobacterium bovis subsp bovis AF2122/97
ggucgcgcuggcgccggcc

SEQ ID NO: 3098072 - RNA, 20 nt, Mycobacterium bovis subsp bovis AF2122/97
ggucgcgcuggcgccggcca

SEQ ID NO: 3098073 - RNA, 18 nt, Mycobacterium bovis subsp bovis AF2122/97
ggucgcggaucucaucgg

SEQ ID NO: 3098074 - RNA, 13 nt, Mycobacterium bovis subsp bovis AF2122/97
ggucgcggcugcc

SEQ ID NO: 3098075 - RNA, 12 nt, Mycobacterium bovis subsp bovis AF2122/97
ggucgcggggcc

SEQ ID NO: 3098076 - RNA, 13 nt, Mycobacterium bovis subsp bovis AF2122/97
ggucgcgggugcc

SEQ ID NO: 3098077 - RNA, 19 nt, Mycobacterium bovis subsp bovis AF2122/97
ggucgcggucccacggccg

SEQ ID NO: 3098078 - RNA, 16 nt, Mycobacterium bovis subsp bovis AF2122/97
ggucgcgucggcugcc

SEQ ID NO: 3098079 - RNA, 18 nt, Mycobacterium bovis subsp bovis AF2122/97
ggucgcgucggcugccgc

SEQ ID NO: 3098080 - RNA, 20 nt, Mycobacterium bovis subsp bovis AF2122/97
ggucgcugauccgggcgccg

SEQ ID NO: 3098081 - RNA, 22 nt, Mycobacterium bovis subsp bovis AF2122/97
ggucgcugauccgggcgccgau

SEQ ID NO: 3098082 - RNA, 19 nt, Mycobacterium bovis subsp bovis AF2122/97
ggucgcugccgccgucgcc

SEQ ID NO: 3098083 - RNA, 19 nt, Mycobacterium bovis subsp bovis AF2122/97
ggucgcugccggcugacga

SEQ ID NO: 3098084 - RNA, 22 nt, Mycobacterium bovis subsp bovis AF2122/97
ggucgcugccggcugacgacca

SEQ ID NO: 3098085 - RNA, 13 nt, Mycobacterium bovis subsp bovis AF2122/97
ggucgcugcgaug

SEQ ID NO: 3098086 - RNA, 14 nt, Mycobacterium bovis subsp bovis AF2122/97
ggucgcugcugccg

SEQ ID NO: 3098087 - RNA, 15 nt, Mycobacterium bovis subsp bovis AF2122/97
ggucgcugcugccgc

SEQ ID NO: 3098088 - RNA, 23 nt, Mycobacterium bovis subsp bovis AF2122/97
ggucgcugcugccgcaccggugc

SEQ ID NO: 3098089 - RNA, 16 nt, Mycobacterium bovis subsp bovis AF2122/97
ggucgcugcugcgauc

SEQ ID NO: 3098090 - RNA, 20 nt, Mycobacterium bovis subsp bovis AF2122/97
ggucgcugcugcgaucgccg

SEQ ID NO: 3098091 - RNA, 17 nt, Mycobacterium bovis subsp bovis AF2122/97
ggucgcugcuugcgggc

SEQ ID NO: 3098092 - RNA, 12 nt, Mycobacterium bovis subsp bovis AF2122/97
ggucgcugucgg

SEQ ID NO: 3098093 - RNA, 16 nt, Mycobacterium bovis subsp bovis AF2122/97
ggucggaacuagccag

SEQ ID NO: 3098094 - RNA, 17 nt, Mycobacterium bovis subsp bovis AF2122/97
ggucggaaugccgucgc

SEQ ID NO: 3098095 - RNA, 19 nt, Mycobacterium bovis subsp bovis AF2122/97
ggucggaaugccgucgccg

SEQ ID NO: 3098096 - RNA, 23 nt, Mycobacterium bovis subsp bovis AF2122/97
ggucggacagcgucucggaggcg

SEQ ID NO: 3098097 - RNA, 19 nt, Mycobacterium bovis subsp bovis AF2122/97
ggucggaccacccggcgcg

SEQ ID NO: 3098098 - RNA, 19 nt, Mycobacterium bovis subsp bovis AF2122/97
ggucggagacgucuucggg

SEQ ID NO: 3098099 - RNA, 13 nt, Mycobacterium bovis subsp bovis AF2122/97
ggucggagcgggc

SEQ ID NO: 3098100 - RNA, 16 nt, Mycobacterium bovis subsp bovis AF2122/97
ggucggagcggugccg

SEQ ID NO: 3098101 - RNA, 16 nt, Mycobacterium bovis subsp bovis AF2122/97
ggucggaucgauuccg

SEQ ID NO: 3098102 - RNA, 20 nt, Mycobacterium bovis subsp bovis AF2122/97
ggucggaucgauuccgccgc

SEQ ID NO: 3098103 - RNA, 13 nt, Mycobacterium bovis subsp bovis AF2122/97
ggucggaucggcg

SEQ ID NO: 3098104 - RNA, 16 nt, Mycobacterium bovis subsp bovis AF2122/97
ggucggcaccaccacg

SEQ ID NO: 3098105 - RNA, 17 nt, Mycobacterium bovis subsp bovis AF2122/97
ggucggcacgacccggg

SEQ ID NO: 3098106 - RNA, 19 nt, Mycobacterium bovis subsp bovis AF2122/97
ggucggcacgacccgggaa

SEQ ID NO: 3098107 - RNA, 19 nt, Mycobacterium bovis subsp bovis AF2122/97
ggucggcagcgacgccggc

SEQ ID NO: 3098108 - RNA, 19 nt, Mycobacterium bovis subsp bovis AF2122/97
ggucggcaucggagauacg

SEQ ID NO: 3098109 - RNA, 22 nt, Mycobacterium bovis subsp bovis AF2122/97
ggucggcauugaucggugccca

SEQ ID NO: 3098110 - RNA, 11 nt, Mycobacterium bovis subsp bovis AF2122/97
ggucggccacc

SEQ ID NO: 3098111 - RNA, 15 nt, Mycobacterium bovis subsp bovis AF2122/97
ggucggccaccaacu

SEQ ID NO: 3098112 - RNA, 14 nt, Mycobacterium bovis subsp bovis AF2122/97
ggucggccaccgug

SEQ ID NO: 3098113 - RNA, 16 nt, Mycobacterium bovis subsp bovis AF2122/97
ggucggccaccgugga

SEQ ID NO: 3098114 - RNA, 20 nt, Mycobacterium bovis subsp bovis AF2122/97
ggucggccacgcgcacucga

SEQ ID NO: 3098115 - RNA, 13 nt, Mycobacterium bovis subsp bovis AF2122/97
ggucggccaggcc

SEQ ID NO: 3098116 - RNA, 16 nt, Mycobacterium bovis subsp bovis AF2122/97
ggucggcccacggugu

SEQ ID NO: 3098117 - RNA, 19 nt, Mycobacterium bovis subsp bovis AF2122/97
ggucggcccuccaccggug

SEQ ID NO: 3098118 - RNA, 12 nt, Mycobacterium bovis subsp bovis AF2122/97
ggucggccgccu

SEQ ID NO: 3098119 - RNA, 22 nt, Mycobacterium bovis subsp bovis AF2122/97
ggucggccgcuggaggcggcgc

SEQ ID NO: 3098120 - RNA, 15 nt, Mycobacterium bovis subsp bovis AF2122/97
ggucggccggcucgu

SEQ ID NO: 3098121 - RNA, 14 nt, Mycobacterium bovis subsp bovis AF2122/97
ggucggccucgaga

SEQ ID NO: 3098122 - RNA, 22 nt, Mycobacterium bovis subsp bovis AF2122/97
ggucggccugcgaacacgcgau

SEQ ID NO: 3098123 - RNA, 17 nt, Mycobacterium bovis subsp bovis AF2122/97
ggucggccugcggcaac

SEQ ID NO: 3098124 - RNA, 18 nt, Mycobacterium bovis subsp bovis AF2122/97
ggucggccugcggcaccg

SEQ ID NO: 3098125 - RNA, 18 nt, Mycobacterium bovis subsp bovis AF2122/97
ggucggcgaaaggccagu

SEQ ID NO: 3098126 - RNA, 17 nt, Mycobacterium bovis subsp bovis AF2122/97
ggucggcgaacgcggcg

SEQ ID NO: 3098127 - RNA, 13 nt, Mycobacterium bovis subsp bovis AF2122/97
ggucggcgaccac

SEQ ID NO: 3098128 - RNA, 15 nt, Mycobacterium bovis subsp bovis AF2122/97
ggucggcgaccacca

SEQ ID NO: 3098129 - RNA, 22 nt, Mycobacterium bovis subsp bovis AF2122/97
ggucggcgaucaugggagcggg

SEQ ID NO: 3098130 - RNA, 15 nt, Mycobacterium bovis subsp bovis AF2122/97
ggucggcgaucugcg

SEQ ID NO: 3098131 - RNA, 23 nt, Mycobacterium bovis subsp bovis AF2122/97
ggucggcgcgccguugccggcca

SEQ ID NO: 3098132 - RNA, 22 nt, Mycobacterium bovis subsp bovis AF2122/97
ggucggcuacggccagugccau

SEQ ID NO: 3098133 - RNA, 17 nt, Mycobacterium bovis subsp bovis AF2122/97
ggucggcugauuggccc

SEQ ID NO: 3098134 - RNA, 13 nt, Mycobacterium bovis subsp bovis AF2122/97
ggucggcugucac

SEQ ID NO: 3098135 - RNA, 22 nt, Mycobacterium bovis subsp bovis AF2122/97
ggucggcugucgugccucucgg

SEQ ID NO: 3098136 - RNA, 15 nt, Mycobacterium bovis subsp bovis AF2122/97
ggucggcuuccggug

SEQ ID NO: 3098137 - RNA, 18 nt, Mycobacterium bovis subsp bovis AF2122/97
ggucggcuuccggugccg

SEQ ID NO: 3098138 - RNA, 16 nt, Mycobacterium bovis subsp bovis AF2122/97
ggucgggacgcugccg

SEQ ID NO: 3098139 - RNA, 16 nt, Mycobacterium bovis subsp bovis AF2122/97
ggucgggcccggcgag

SEQ ID NO: 3098140 - RNA, 12 nt, Mycobacterium bovis subsp bovis AF2122/97
ggucgggcggcg

SEQ ID NO: 3098141 - RNA, 18 nt, Mycobacterium bovis subsp bovis AF2122/97
ggucggggaacgcggcga

SEQ ID NO: 3098142 - RNA, 17 nt, Mycobacterium bovis subsp bovis AF2122/97
ggucgggguccgcggca

SEQ ID NO: 3098143 - RNA, 16 nt, Mycobacterium bovis subsp bovis AF2122/97
ggucgggucgaucacc

SEQ ID NO: 3098144 - RNA, 15 nt, Mycobacterium bovis subsp bovis AF2122/97
ggucgggucgcaccc

SEQ ID NO: 3098145 - RNA, 18 nt, Mycobacterium bovis subsp bovis AF2122/97
ggucgguaacggcggugc

SEQ ID NO: 3098146 - RNA, 16 nt, Mycobacterium bovis subsp bovis AF2122/97
ggucgguaccgguacc

SEQ ID NO: 3098147 - RNA, 18 nt, Mycobacterium bovis subsp bovis AF2122/97
ggucgguaccgguaccug

SEQ ID NO: 3098148 - RNA, 21 nt, Mycobacterium bovis subsp bovis AF2122/97
ggucggucaccauggcgccgc

SEQ ID NO: 3098149 - RNA, 14 nt, Mycobacterium bovis subsp bovis AF2122/97
ggucgguccgguga

SEQ ID NO: 3098150 - RNA, 15 nt, Mycobacterium bovis subsp bovis AF2122/97
ggucggugacgaaga

SEQ ID NO: 3098151 - RNA, 16 nt, Mycobacterium bovis subsp bovis AF2122/97
ggucggugacgaagag

SEQ ID NO: 3098152 - RNA, 22 nt, Mycobacterium bovis subsp bovis AF2122/97
ggucggugacgaagagcaccgc

SEQ ID NO: 3098153 - RNA, 17 nt, Mycobacterium bovis subsp bovis AF2122/97
ggucggugauggucagc

SEQ ID NO: 3098154 - RNA, 22 nt, Mycobacterium bovis subsp bovis AF2122/97
ggucggugaugguuucggcggg

SEQ ID NO: 3098155 - RNA, 22 nt, Mycobacterium bovis subsp bovis AF2122/97
ggucggugcggaacacgaugcg

SEQ ID NO: 3098156 - RNA, 21 nt, Mycobacterium bovis subsp bovis AF2122/97
ggucggugcugaccccgccgg

SEQ ID NO: 3098157 - RNA, 22 nt, Mycobacterium bovis subsp bovis AF2122/97
ggucggugcugaccccgccggc

SEQ ID NO: 3098158 - RNA, 19 nt, Mycobacterium bovis subsp bovis AF2122/97
ggucgguggucucgacggc

SEQ ID NO: 3098159 - RNA, 20 nt, Mycobacterium bovis subsp bovis AF2122/97
ggucgguggucucgacggcg

SEQ ID NO: 3098160 - RNA, 15 nt, Mycobacterium bovis subsp bovis AF2122/97
ggucgguuccggugu

SEQ ID NO: 3098161 - RNA, 16 nt, Mycobacterium bovis subsp bovis AF2122/97
ggucgguucggccgga

SEQ ID NO: 3098162 - RNA, 17 nt, Mycobacterium bovis subsp bovis AF2122/97
ggucguacgcauggcgg

SEQ ID NO: 3098163 - RNA, 16 nt, Mycobacterium bovis subsp bovis AF2122/97
ggucguaggacaccac

SEQ ID NO: 3098164 - RNA, 19 nt, Mycobacterium bovis subsp bovis AF2122/97
ggucgucacggaccgccac

SEQ ID NO: 3098165 - RNA, 22 nt, Mycobacterium bovis subsp bovis AF2122/97
ggucgucaguaauucggccauc

SEQ ID NO: 3098166 - RNA, 21 nt, Mycobacterium bovis subsp bovis AF2122/97
ggucgucaugccagucgccga

SEQ ID NO: 3098167 - RNA, 19 nt, Mycobacterium bovis subsp bovis AF2122/97
ggucgucccgauggcggug

SEQ ID NO: 3098168 - RNA, 21 nt, Mycobacterium bovis subsp bovis AF2122/97
ggucguccgccugcaccgccg

SEQ ID NO: 3098169 - RNA, 14 nt, Mycobacterium bovis subsp bovis AF2122/97
ggucguccggcggc

SEQ ID NO: 3098170 - RNA, 22 nt, Mycobacterium bovis subsp bovis AF2122/97
ggucgucgaaauggauugcggc

SEQ ID NO: 3098171 - RNA, 14 nt, Mycobacterium bovis subsp bovis AF2122/97
ggucgucgaacggc

SEQ ID NO: 3098172 - RNA, 18 nt, Mycobacterium bovis subsp bovis AF2122/97
ggucgucgaacggcagcc

SEQ ID NO: 3098173 - RNA, 13 nt, Mycobacterium bovis subsp bovis AF2122/97
ggucgucggcguc

SEQ ID NO: 3098174 - RNA, 19 nt, Mycobacterium bovis subsp bovis AF2122/97
ggucgucuuccaggagcgc

SEQ ID NO: 3098175 - RNA, 18 nt, Mycobacterium bovis subsp bovis AF2122/97
ggucgugaaaccacaccu

SEQ ID NO: 3098176 - RNA, 15 nt, Mycobacterium bovis subsp bovis AF2122/97
ggucgugcaggcgac

SEQ ID NO: 3098177 - RNA, 19 nt, Mycobacterium bovis subsp bovis AF2122/97
ggucgugcaggcgacggcu

SEQ ID NO: 3098178 - RNA, 15 nt, Mycobacterium bovis subsp bovis AF2122/97
ggucgugggccacca

SEQ ID NO: 3098179 - RNA, 13 nt, Mycobacterium bovis subsp bovis AF2122/97
ggucgugucgcca

SEQ ID NO: 3098180 - RNA, 16 nt, Mycobacterium bovis subsp bovis AF2122/97
ggucgugucgccacac

SEQ ID NO: 3098181 - RNA, 16 nt, Mycobacterium bovis subsp bovis AF2122/97
ggucguucccgccggc

SEQ ID NO: 3098182 - RNA, 17 nt, Mycobacterium bovis subsp bovis AF2122/97
ggucguucccgccggca

SEQ ID NO: 3098183 - RNA, 16 nt, Mycobacterium bovis subsp bovis AF2122/97
ggucguugaggccggu

SEQ ID NO: 3098184 - RNA, 18 nt, Mycobacterium bovis subsp bovis AF2122/97
ggucguugaggccgguga

SEQ ID NO: 3098185 - RNA, 15 nt, Mycobacterium bovis subsp bovis AF2122/97
ggucguuggcggcgg

SEQ ID NO: 3098186 - RNA, 16 nt, Mycobacterium bovis subsp bovis AF2122/97
ggucguuggcggcggu

SEQ ID NO: 3098187 - RNA, 14 nt, Mycobacterium bovis subsp bovis AF2122/97
ggucguugucgggg

SEQ ID NO: 3098188 - RNA, 20 nt, Mycobacterium bovis subsp bovis AF2122/97
ggucguuucccuggccgccg

SEQ ID NO: 3098189 - RNA, 22 nt, Mycobacterium bovis subsp bovis AF2122/97
ggucguuucccuggccgccgcc

SEQ ID NO: 3098190 - RNA, 16 nt, Mycobacterium bovis subsp bovis AF2122/97
ggucuacccgcggcgc

SEQ ID NO: 3098191 - RNA, 15 nt, Mycobacterium bovis subsp bovis AF2122/97
ggucuacuucggcgc

SEQ ID NO: 3098192 - RNA, 14 nt, Mycobacterium bovis subsp bovis AF2122/97
ggucucacggcgcg

SEQ ID NO: 3098193 - RNA, 15 nt, Mycobacterium bovis subsp bovis AF2122/97
ggucucacucaucgg

SEQ ID NO: 3098194 - RNA, 17 nt, Mycobacterium bovis subsp bovis AF2122/97
ggucucagugcucgccc

SEQ ID NO: 3098195 - RNA, 20 nt, Mycobacterium bovis subsp bovis AF2122/97
ggucucauagugcaggucga

SEQ ID NO: 3098196 - RNA, 13 nt, Mycobacterium bovis subsp bovis AF2122/97
ggucucaucccag

SEQ ID NO: 3098197 - RNA, 20 nt, Mycobacterium bovis subsp bovis AF2122/97
ggucucaugcacccgguacc

SEQ ID NO: 3098198 - RNA, 15 nt, Mycobacterium bovis subsp bovis AF2122/97
ggucuccaccaggug

SEQ ID NO: 3098199 - RNA, 21 nt, Mycobacterium bovis subsp bovis AF2122/97
ggucucccagaggucgagcgc

SEQ ID NO: 3098200 - RNA, 21 nt, Mycobacterium bovis subsp bovis AF2122/97
ggucuccggacgcacgauccg

SEQ ID NO: 3098201 - RNA, 16 nt, Mycobacterium bovis subsp bovis AF2122/97
ggucuccggaucgccg

SEQ ID NO: 3098202 - RNA, 18 nt, Mycobacterium bovis subsp bovis AF2122/97
ggucuccggaucgccgaa

SEQ ID NO: 3098203 - RNA, 13 nt, Mycobacterium bovis subsp bovis AF2122/97
ggucuccggcgca

SEQ ID NO: 3098204 - RNA, 13 nt, Mycobacterium bovis subsp bovis AF2122/97
ggucucgaccgcg

SEQ ID NO: 3098205 - RNA, 15 nt, Mycobacterium bovis subsp bovis AF2122/97
ggucucgaccgcgcc

SEQ ID NO: 3098206 - RNA, 17 nt, Mycobacterium bovis subsp bovis AF2122/97
ggucucgacggcggccg

SEQ ID NO: 3098207 - RNA, 15 nt, Mycobacterium bovis subsp bovis AF2122/97
ggucucgagggugaa

SEQ ID NO: 3098208 - RNA, 16 nt, Mycobacterium bovis subsp bovis AF2122/97
ggucucgcaccagucg

SEQ ID NO: 3098209 - RNA, 11 nt, Mycobacterium bovis subsp bovis AF2122/97
ggucucggccg

SEQ ID NO: 3098210 - RNA, 17 nt, Mycobacterium bovis subsp bovis AF2122/97
ggucucgguaggcggug

SEQ ID NO: 3098211 - RNA, 13 nt, Mycobacterium bovis subsp bovis AF2122/97
ggucucggugcgg

SEQ ID NO: 3098212 - RNA, 14 nt, Mycobacterium bovis subsp bovis AF2122/97
ggucucggugcggc

SEQ ID NO: 3098213 - RNA, 20 nt, Mycobacterium bovis subsp bovis AF2122/97
ggucucgucgcggguccagg

SEQ ID NO: 3098214 - RNA, 21 nt, Mycobacterium bovis subsp bovis AF2122/97
ggucucuagcaaagccagcgc

SEQ ID NO: 3098215 - RNA, 21 nt, Mycobacterium bovis subsp bovis AF2122/97
ggucugacagaccgggcacca

SEQ ID NO: 3098216 - RNA, 17 nt, Mycobacterium bovis subsp bovis AF2122/97
ggucugacaucggccaa

SEQ ID NO: 3098217 - RNA, 19 nt, Mycobacterium bovis subsp bovis AF2122/97
ggucugcagugcagcgauc

SEQ ID NO: 3098218 - RNA, 20 nt, Mycobacterium bovis subsp bovis AF2122/97
ggucugccaaaagggcggca

SEQ ID NO: 3098219 - RNA, 16 nt, Mycobacterium bovis subsp bovis AF2122/97
ggucugcgccaaaauc

SEQ ID NO: 3098220 - RNA, 16 nt, Mycobacterium bovis subsp bovis AF2122/97
ggucugcgccgccggc

SEQ ID NO: 3098221 - RNA, 18 nt, Mycobacterium bovis subsp bovis AF2122/97
ggucugcgccgccggcgg

SEQ ID NO: 3098222 - RNA, 23 nt, Mycobacterium bovis subsp bovis AF2122/97
ggucugcgccuucgccagcggcg

SEQ ID NO: 3098223 - RNA, 15 nt, Mycobacterium bovis subsp bovis AF2122/97
ggucugcgcgucgcg

SEQ ID NO: 3098224 - RNA, 16 nt, Mycobacterium bovis subsp bovis AF2122/97
ggucugcggccgauac

SEQ ID NO: 3098225 - RNA, 11 nt, Mycobacterium bovis subsp bovis AF2122/97
ggucugcucau

SEQ ID NO: 3098226 - RNA, 10 nt, Mycobacterium bovis subsp bovis AF2122/97
ggucugcucc

SEQ ID NO: 3098227 - RNA, 16 nt, Mycobacterium bovis subsp bovis AF2122/97
ggucugcuccaggcgc

SEQ ID NO: 3098228 - RNA, 17 nt, Mycobacterium bovis subsp bovis AF2122/97
ggucugcuccaggcgcg

SEQ ID NO: 3098229 - RNA, 15 nt, Mycobacterium bovis subsp bovis AF2122/97
ggucuggacugcagc

SEQ ID NO: 3098230 - RNA, 18 nt, Mycobacterium bovis subsp bovis AF2122/97
ggucuggcaggccagcau

SEQ ID NO: 3098231 - RNA, 14 nt, Mycobacterium bovis subsp bovis AF2122/97
ggucuucaggccgc

SEQ ID NO: 3098232 - RNA, 21 nt, Mycobacterium bovis subsp bovis AF2122/97
ggucuucaucgccgugcgccg

SEQ ID NO: 3098233 - RNA, 13 nt, Mycobacterium bovis subsp bovis AF2122/97
ggucuucgccguc

SEQ ID NO: 3098234 - RNA, 21 nt, Mycobacterium bovis subsp bovis AF2122/97
ggucuucuucaccgccuuggu

SEQ ID NO: 3098235 - RNA, 15 nt, Mycobacterium bovis subsp bovis AF2122/97
ggucuugaacccgau

SEQ ID NO: 3098236 - RNA, 14 nt, Mycobacterium bovis subsp bovis AF2122/97
ggucuugccgagca

SEQ ID NO: 3098237 - RNA, 21 nt, Mycobacterium bovis subsp bovis AF2122/97
ggucuuggaaagcccgcucgg

SEQ ID NO: 3098238 - RNA, 16 nt, Mycobacterium bovis subsp bovis AF2122/97
ggucuuggcgauccag

SEQ ID NO: 3098239 - RNA, 19 nt, Mycobacterium bovis subsp bovis AF2122/97
ggucuuggcgauccaggcc

SEQ ID NO: 3098240 - RNA, 22 nt, Mycobacterium bovis subsp bovis AF2122/97
ggucuuggugcucuugcgggga

SEQ ID NO: 3098241 - RNA, 20 nt, Mycobacterium bovis subsp bovis AF2122/97
ggucuuucacguagcgaccg

SEQ ID NO: 3098242 - RNA, 16 nt, Mycobacterium bovis subsp bovis AF2122/97
ggucuuuguccacgag

SEQ ID NO: 3098243 - RNA, 23 nt, Mycobacterium bovis subsp bovis AF2122/97
ggucuuuguccacgaggcaacca

SEQ ID NO: 3098244 - RNA, 15 nt, Mycobacterium bovis subsp bovis AF2122/97
ggugaaaaaggcgac

SEQ ID NO: 3098245 - RNA, 18 nt, Mycobacterium bovis subsp bovis AF2122/97
ggugaaaaucgccaucgg

SEQ ID NO: 3098246 - RNA, 15 nt, Mycobacterium bovis subsp bovis AF2122/97
ggugaaaugacggcu

SEQ ID NO: 3098247 - RNA, 16 nt, Mycobacterium bovis subsp bovis AF2122/97
ggugaaauucgcggcg

SEQ ID NO: 3098248 - RNA, 18 nt, Mycobacterium bovis subsp bovis AF2122/97
ggugaaauucgcggcggu

SEQ ID NO: 3098249 - RNA, 14 nt, Mycobacterium bovis subsp bovis AF2122/97
ggugaacaccagca

SEQ ID NO: 3098250 - RNA, 22 nt, Mycobacterium bovis subsp bovis AF2122/97
ggugaacaccgccucugcaucg

SEQ ID NO: 3098251 - RNA, 19 nt, Mycobacterium bovis subsp bovis AF2122/97
ggugaacaugugaccggcg

SEQ ID NO: 3098252 - RNA, 14 nt, Mycobacterium bovis subsp bovis AF2122/97
ggugaacccgccgg

SEQ ID NO: 3098253 - RNA, 15 nt, Mycobacterium bovis subsp bovis AF2122/97
ggugaaccgcgcggc

SEQ ID NO: 3098254 - RNA, 16 nt, Mycobacterium bovis subsp bovis AF2122/97
ggugaaccgcgcggcg

SEQ ID NO: 3098255 - RNA, 21 nt, Mycobacterium bovis subsp bovis AF2122/97
ggugaaccgcgcggcgaucga

SEQ ID NO: 3098256 - RNA, 19 nt, Mycobacterium bovis subsp bovis AF2122/97
ggugaacgagaugccgcga

SEQ ID NO: 3098257 - RNA, 19 nt, Mycobacterium bovis subsp bovis AF2122/97
ggugaacgcggacaccgcg

SEQ ID NO: 3098258 - RNA, 22 nt, Mycobacterium bovis subsp bovis AF2122/97
ggugaacgcggacaccgcggcg

SEQ ID NO: 3098259 - RNA, 21 nt, Mycobacterium bovis subsp bovis AF2122/97
ggugaacggcaaggucgcggc

SEQ ID NO: 3098260 - RNA, 15 nt, Mycobacterium bovis subsp bovis AF2122/97
ggugaacggcagcac

SEQ ID NO: 3098261 - RNA, 22 nt, Mycobacterium bovis subsp bovis AF2122/97
ggugaacgucacguggucggcc

SEQ ID NO: 3098262 - RNA, 21 nt, Mycobacterium bovis subsp bovis AF2122/97
ggugaacucguucagcgucga

SEQ ID NO: 3098263 - RNA, 17 nt, Mycobacterium bovis subsp bovis AF2122/97
ggugaagacaccggcgu

SEQ ID NO: 3098264 - RNA, 17 nt, Mycobacterium bovis subsp bovis AF2122/97
ggugaagccgagcgccc

SEQ ID NO: 3098265 - RNA, 21 nt, Mycobacterium bovis subsp bovis AF2122/97
ggugaagccguagacguugag

SEQ ID NO: 3098266 - RNA, 13 nt, Mycobacterium bovis subsp bovis AF2122/97
ggugaaggcaaac

SEQ ID NO: 3098267 - RNA, 20 nt, Mycobacterium bovis subsp bovis AF2122/97
ggugaaggcaaacaccagcc

SEQ ID NO: 3098268 - RNA, 22 nt, Mycobacterium bovis subsp bovis AF2122/97
ggugaaggcaaacaccagcccg

SEQ ID NO: 3098269 - RNA, 18 nt, Mycobacterium bovis subsp bovis AF2122/97
ggugaaggccccgccggu

SEQ ID NO: 3098270 - RNA, 20 nt, Mycobacterium bovis subsp bovis AF2122/97
ggugaaguagucggcgccga

SEQ ID NO: 3098271 - RNA, 20 nt, Mycobacterium bovis subsp bovis AF2122/97
ggugaaguccgagacgucgg

SEQ ID NO: 3098272 - RNA, 21 nt, Mycobacterium bovis subsp bovis AF2122/97
ggugaaguccuccacgcuggc

SEQ ID NO: 3098273 - RNA, 19 nt, Mycobacterium bovis subsp bovis AF2122/97
ggugaaguggcgcaccacc

SEQ ID NO: 3098274 - RNA, 16 nt, Mycobacterium bovis subsp bovis AF2122/97
ggugaauaaggcugca

SEQ ID NO: 3098275 - RNA, 17 nt, Mycobacterium bovis subsp bovis AF2122/97
ggugaauccgugcaggg

SEQ ID NO: 3098276 - RNA, 20 nt, Mycobacterium bovis subsp bovis AF2122/97
ggugaaucgacaccgcccga

SEQ ID NO: 3098277 - RNA, 17 nt, Mycobacterium bovis subsp bovis AF2122/97
ggugaaugccgucgccg

SEQ ID NO: 3098278 - RNA, 17 nt, Mycobacterium bovis subsp bovis AF2122/97
ggugaauguugccgccg

SEQ ID NO: 3098279 - RNA, 22 nt, Mycobacterium bovis subsp bovis AF2122/97
ggugaauucacgaugcucgccg

SEQ ID NO: 3098280 - RNA, 22 nt, Mycobacterium bovis subsp bovis AF2122/97
ggugacaaguggugcccuugaa

SEQ ID NO: 3098281 - RNA, 13 nt, Mycobacterium bovis subsp bovis AF2122/97
ggugacaccaaca

SEQ ID NO: 3098282 - RNA, 16 nt, Mycobacterium bovis subsp bovis AF2122/97
ggugacagauccgccc

SEQ ID NO: 3098283 - RNA, 13 nt, Mycobacterium bovis subsp bovis AF2122/97
ggugacaucgcga

SEQ ID NO: 3098284 - RNA, 16 nt, Mycobacterium bovis subsp bovis AF2122/97
ggugacaucgcgaggc

SEQ ID NO: 3098285 - RNA, 21 nt, Mycobacterium bovis subsp bovis AF2122/97
ggugacaucgcgaggcgucac

SEQ ID NO: 3098286 - RNA, 21 nt, Mycobacterium bovis subsp bovis AF2122/97
ggugacauguugccgcugacg

SEQ ID NO: 3098287 - RNA, 12 nt, Mycobacterium bovis subsp bovis AF2122/97
ggugaccaacac

SEQ ID NO: 3098288 - RNA, 16 nt, Mycobacterium bovis subsp bovis AF2122/97
ggugaccaccccggcc

SEQ ID NO: 3098289 - RNA, 18 nt, Mycobacterium bovis subsp bovis AF2122/97
ggugaccaccccggccaa

SEQ ID NO: 3098290 - RNA, 23 nt, Mycobacterium bovis subsp bovis AF2122/97
ggugaccaccccggccaacccgu

SEQ ID NO: 3098291 - RNA, 16 nt, Mycobacterium bovis subsp bovis AF2122/97
ggugaccacggcaagc

SEQ ID NO: 3098292 - RNA, 16 nt, Mycobacterium bovis subsp bovis AF2122/97
ggugaccagcaggccg

SEQ ID NO: 3098293 - RNA, 17 nt, Mycobacterium bovis subsp bovis AF2122/97
ggugaccagcaggccgg

SEQ ID NO: 3098294 - RNA, 16 nt, Mycobacterium bovis subsp bovis AF2122/97
ggugaccaggccggcc

SEQ ID NO: 3098295 - RNA, 18 nt, Mycobacterium bovis subsp bovis AF2122/97
ggugaccagggugacgga

SEQ ID NO: 3098296 - RNA, 23 nt, Mycobacterium bovis subsp bovis AF2122/97
ggugacccgcuauucggcggcau

SEQ ID NO: 3098297 - RNA, 15 nt, Mycobacterium bovis subsp bovis AF2122/97
ggugacccgcugggc

SEQ ID NO: 3098298 - RNA, 15 nt, Mycobacterium bovis subsp bovis AF2122/97
ggugacccguucagc

SEQ ID NO: 3098299 - RNA, 16 nt, Mycobacterium bovis subsp bovis AF2122/97
ggugacccugguggug

SEQ ID NO: 3098300 - RNA, 19 nt, Mycobacterium bovis subsp bovis AF2122/97
ggugaccgacgcggacagg

SEQ ID NO: 3098301 - RNA, 18 nt, Mycobacterium bovis subsp bovis AF2122/97
ggugaccgagaucgucgc

SEQ ID NO: 3098302 - RNA, 16 nt, Mycobacterium bovis subsp bovis AF2122/97
ggugaccgcgggcgcc

SEQ ID NO: 3098303 - RNA, 17 nt, Mycobacterium bovis subsp bovis AF2122/97
ggugaccggcucggcgg

SEQ ID NO: 3098304 - RNA, 18 nt, Mycobacterium bovis subsp bovis AF2122/97
ggugaccggcucggcggu

SEQ ID NO: 3098305 - RNA, 21 nt, Mycobacterium bovis subsp bovis AF2122/97
ggugaccgggucgaucaccga

SEQ ID NO: 3098306 - RNA, 12 nt, Mycobacterium bovis subsp bovis AF2122/97
ggugaccggguu

SEQ ID NO: 3098307 - RNA, 23 nt, Mycobacterium bovis subsp bovis AF2122/97
ggugaccgguguuccgcccagcg

SEQ ID NO: 3098308 - RNA, 13 nt, Mycobacterium bovis subsp bovis AF2122/97
ggugaccguggcg

SEQ ID NO: 3098309 - RNA, 19 nt, Mycobacterium bovis subsp bovis AF2122/97
ggugaccguggcggggaaa

SEQ ID NO: 3098310 - RNA, 12 nt, Mycobacterium bovis subsp bovis AF2122/97
ggugaccucggc

SEQ ID NO: 3098311 - RNA, 21 nt, Mycobacterium bovis subsp bovis AF2122/97
ggugaccucgucgaccgggaa

SEQ ID NO: 3098312 - RNA, 22 nt, Mycobacterium bovis subsp bovis AF2122/97
ggugacgaagagcaccgcgccc

SEQ ID NO: 3098313 - RNA, 19 nt, Mycobacterium bovis subsp bovis AF2122/97
ggugacgacaugguuggug

SEQ ID NO: 3098314 - RNA, 19 nt, Mycobacterium bovis subsp bovis AF2122/97
ggugacgacgagggcggga

SEQ ID NO: 3098315 - RNA, 14 nt, Mycobacterium bovis subsp bovis AF2122/97
ggugacgacgucgc

SEQ ID NO: 3098316 - RNA, 23 nt, Mycobacterium bovis subsp bovis AF2122/97
ggugacgagcacaugcucgacgc

SEQ ID NO: 3098317 - RNA, 21 nt, Mycobacterium bovis subsp bovis AF2122/97
ggugacgagccaccaccgccg

SEQ ID NO: 3098318 - RNA, 23 nt, Mycobacterium bovis subsp bovis AF2122/97
ggugacgagccaccaccgccgac

SEQ ID NO: 3098319 - RNA, 20 nt, Mycobacterium bovis subsp bovis AF2122/97
ggugacgaucaggccgucgc

SEQ ID NO: 3098320 - RNA, 16 nt, Mycobacterium bovis subsp bovis AF2122/97
ggugacgauugccacc

SEQ ID NO: 3098321 - RNA, 17 nt, Mycobacterium bovis subsp bovis AF2122/97
ggugacgauugccacca

SEQ ID NO: 3098322 - RNA, 13 nt, Mycobacterium bovis subsp bovis AF2122/97
ggugacgcaacau

SEQ ID NO: 3098323 - RNA, 16 nt, Mycobacterium bovis subsp bovis AF2122/97
ggugacgcaacaucgg

SEQ ID NO: 3098324 - RNA, 16 nt, Mycobacterium bovis subsp bovis AF2122/97
ggugacgcacagcagc

SEQ ID NO: 3098325 - RNA, 23 nt, Mycobacterium bovis subsp bovis AF2122/97
ggugacgcacagcagcaccgcga

SEQ ID NO: 3098326 - RNA, 13 nt, Mycobacterium bovis subsp bovis AF2122/97
ggugacgccagcc

SEQ ID NO: 3098327 - RNA, 16 nt, Mycobacterium bovis subsp bovis AF2122/97
ggugacgcccgcuccg

SEQ ID NO: 3098328 - RNA, 17 nt, Mycobacterium bovis subsp bovis AF2122/97
ggugacgccgccagcac

SEQ ID NO: 3098329 - RNA, 18 nt, Mycobacterium bovis subsp bovis AF2122/97
ggugacgccgccagcacc

SEQ ID NO: 3098330 - RNA, 19 nt, Mycobacterium bovis subsp bovis AF2122/97
ggugacgccgccagcaccu

SEQ ID NO: 3098331 - RNA, 17 nt, Mycobacterium bovis subsp bovis AF2122/97
ggugacgcgccguaaca

SEQ ID NO: 3098332 - RNA, 20 nt, Mycobacterium bovis subsp bovis AF2122/97
ggugacggccggcggucggg

SEQ ID NO: 3098333 - RNA, 13 nt, Mycobacterium bovis subsp bovis AF2122/97
ggugacggcggca

SEQ ID NO: 3098334 - RNA, 19 nt, Mycobacterium bovis subsp bovis AF2122/97
ggugacggcggcaacggcg

SEQ ID NO: 3098335 - RNA, 15 nt, Mycobacterium bovis subsp bovis AF2122/97
ggugacggcggcugu

SEQ ID NO: 3098336 - RNA, 22 nt, Mycobacterium bovis subsp bovis AF2122/97
ggugacggcggcugucggccgg

SEQ ID NO: 3098337 - RNA, 22 nt, Mycobacterium bovis subsp bovis AF2122/97
ggugacgggaaacuccgcggcg

SEQ ID NO: 3098338 - RNA, 16 nt, Mycobacterium bovis subsp bovis AF2122/97
ggugacgggguugacc

SEQ ID NO: 3098339 - RNA, 21 nt, Mycobacterium bovis subsp bovis AF2122/97
ggugacgguguugguggccgg

SEQ ID NO: 3098340 - RNA, 20 nt, Mycobacterium bovis subsp bovis AF2122/97
ggugacucagaacguggccg

SEQ ID NO: 3098341 - RNA, 16 nt, Mycobacterium bovis subsp bovis AF2122/97
ggugacuucgcugcgg

SEQ ID NO: 3098342 - RNA, 23 nt, Mycobacterium bovis subsp bovis AF2122/97
ggugacuucgcugcggugggcca

SEQ ID NO: 3098343 - RNA, 20 nt, Mycobacterium bovis subsp bovis AF2122/97
ggugacuucgguggcgggcu

SEQ ID NO: 3098344 - RNA, 21 nt, Mycobacterium bovis subsp bovis AF2122/97
ggugacuucguggccuugaca

SEQ ID NO: 3098345 - RNA, 14 nt, Mycobacterium bovis subsp bovis AF2122/97
ggugagaccagguu

SEQ ID NO: 3098346 - RNA, 20 nt, Mycobacterium bovis subsp bovis AF2122/97
ggugagaucaugaggugagc

SEQ ID NO: 3098347 - RNA, 12 nt, Mycobacterium bovis subsp bovis AF2122/97
ggugagcaacgc

SEQ ID NO: 3098348 - RNA, 15 nt, Mycobacterium bovis subsp bovis AF2122/97
ggugagcaccggaua

SEQ ID NO: 3098349 - RNA, 19 nt, Mycobacterium bovis subsp bovis AF2122/97
ggugagcaccugggcgcgc

SEQ ID NO: 3098350 - RNA, 22 nt, Mycobacterium bovis subsp bovis AF2122/97
ggugagcagcucggugacaagc

SEQ ID NO: 3098351 - RNA, 18 nt, Mycobacterium bovis subsp bovis AF2122/97
ggugagcauggcuagggc

SEQ ID NO: 3098352 - RNA, 13 nt, Mycobacterium bovis subsp bovis AF2122/97
ggugagccgagcc

SEQ ID NO: 3098353 - RNA, 23 nt, Mycobacterium bovis subsp bovis AF2122/97
ggugagccgagccagcuccggcg

SEQ ID NO: 3098354 - RNA, 15 nt, Mycobacterium bovis subsp bovis AF2122/97
ggugagccgguggcc

SEQ ID NO: 3098355 - RNA, 12 nt, Mycobacterium bovis subsp bovis AF2122/97
ggugagccgugc

SEQ ID NO: 3098356 - RNA, 23 nt, Mycobacterium bovis subsp bovis AF2122/97
ggugagccgugccgccagcaacc

SEQ ID NO: 3098357 - RNA, 21 nt, Mycobacterium bovis subsp bovis AF2122/97
ggugagccucggcgagccgug

SEQ ID NO: 3098358 - RNA, 19 nt, Mycobacterium bovis subsp bovis AF2122/97
ggugagccucuuggucaac

SEQ ID NO: 3098359 - RNA, 15 nt, Mycobacterium bovis subsp bovis AF2122/97
ggugagcgaccuggg

SEQ ID NO: 3098360 - RNA, 15 nt, Mycobacterium bovis subsp bovis AF2122/97
ggugagcgagcgcgc

SEQ ID NO: 3098361 - RNA, 16 nt, Mycobacterium bovis subsp bovis AF2122/97
ggugagcgagcgcgcg

SEQ ID NO: 3098362 - RNA, 23 nt, Mycobacterium bovis subsp bovis AF2122/97
ggugagcgggcaagucgcccagc

SEQ ID NO: 3098363 - RNA, 19 nt, Mycobacterium bovis subsp bovis AF2122/97
ggugagcuuagcgcauggg

SEQ ID NO: 3098364 - RNA, 17 nt, Mycobacterium bovis subsp bovis AF2122/97
ggugaggcgggucgccg

SEQ ID NO: 3098365 - RNA, 20 nt, Mycobacterium bovis subsp bovis AF2122/97
ggugagggaacccacagugg

SEQ ID NO: 3098366 - RNA, 17 nt, Mycobacterium bovis subsp bovis AF2122/97
ggugaggugaccaacgg

SEQ ID NO: 3098367 - RNA, 23 nt, Mycobacterium bovis subsp bovis AF2122/97
ggugagguugacccccggguaga

SEQ ID NO: 3098368 - RNA, 20 nt, Mycobacterium bovis subsp bovis AF2122/97
ggugaguagauugcugacga

SEQ ID NO: 3098369 - RNA, 18 nt, Mycobacterium bovis subsp bovis AF2122/97
ggugaguccgcugagcgg

SEQ ID NO: 3098370 - RNA, 19 nt, Mycobacterium bovis subsp bovis AF2122/97
ggugaguccgcugagcggg

SEQ ID NO: 3098371 - RNA, 13 nt, Mycobacterium bovis subsp bovis AF2122/97
ggugagugcgucu

SEQ ID NO: 3098372 - RNA, 16 nt, Mycobacterium bovis subsp bovis AF2122/97
ggugagugcgucucgg

SEQ ID NO: 3098373 - RNA, 13 nt, Mycobacterium bovis subsp bovis AF2122/97
ggugaguucgccg

SEQ ID NO: 3098374 - RNA, 20 nt, Mycobacterium bovis subsp bovis AF2122/97
ggugaucaaaccggcggcga

SEQ ID NO: 3098375 - RNA, 21 nt, Mycobacterium bovis subsp bovis AF2122/97
ggugaucaccaugaucagcgc

SEQ ID NO: 3098376 - RNA, 12 nt, Mycobacterium bovis subsp bovis AF2122/97
ggugaucaccga

SEQ ID NO: 3098377 - RNA, 16 nt, Mycobacterium bovis subsp bovis AF2122/97
ggugaucaccgacacc

SEQ ID NO: 3098378 - RNA, 13 nt, Mycobacterium bovis subsp bovis AF2122/97
ggugaucaccgcg

SEQ ID NO: 3098379 - RNA, 15 nt, Mycobacterium bovis subsp bovis AF2122/97
ggugaucagcagcag

SEQ ID NO: 3098380 - RNA, 18 nt, Mycobacterium bovis subsp bovis AF2122/97
ggugaucagcucagugau

SEQ ID NO: 3098381 - RNA, 12 nt, Mycobacterium bovis subsp bovis AF2122/97
ggugaucgcaca

SEQ ID NO: 3098382 - RNA, 13 nt, Mycobacterium bovis subsp bovis AF2122/97
ggugaucgccacc

SEQ ID NO: 3098383 - RNA, 20 nt, Mycobacterium bovis subsp bovis AF2122/97
ggugaucgcgguggcggugu

SEQ ID NO: 3098384 - RNA, 12 nt, Mycobacterium bovis subsp bovis AF2122/97
ggugaucggcga

SEQ ID NO: 3098385 - RNA, 19 nt, Mycobacterium bovis subsp bovis AF2122/97
ggugaucgggcagcacgcc

SEQ ID NO: 3098386 - RNA, 22 nt, Mycobacterium bovis subsp bovis AF2122/97
ggugaucugguauucaugcccg

SEQ ID NO: 3098387 - RNA, 19 nt, Mycobacterium bovis subsp bovis AF2122/97
ggugaucuuggcgcccgcc

SEQ ID NO: 3098388 - RNA, 22 nt, Mycobacterium bovis subsp bovis AF2122/97
ggugaugacgccgucggcgcgc

SEQ ID NO: 3098389 - RNA, 18 nt, Mycobacterium bovis subsp bovis AF2122/97
ggugaugagucaggcgcc

SEQ ID NO: 3098390 - RNA, 20 nt, Mycobacterium bovis subsp bovis AF2122/97
ggugaugagucaggcgccgc

SEQ ID NO: 3098391 - RNA, 18 nt, Mycobacterium bovis subsp bovis AF2122/97
ggugaugcccagcgccga

SEQ ID NO: 3098392 - RNA, 14 nt, Mycobacterium bovis subsp bovis AF2122/97
ggugaugccgauga

SEQ ID NO: 3098393 - RNA, 13 nt, Mycobacterium bovis subsp bovis AF2122/97
ggugaugccgccg

SEQ ID NO: 3098394 - RNA, 23 nt, Mycobacterium bovis subsp bovis AF2122/97
ggugaugggggagccggugacgg

SEQ ID NO: 3098395 - RNA, 17 nt, Mycobacterium bovis subsp bovis AF2122/97
ggugauggugaccagca

SEQ ID NO: 3098396 - RNA, 14 nt, Mycobacterium bovis subsp bovis AF2122/97
ggugaugguggcaa

SEQ ID NO: 3098397 - RNA, 21 nt, Mycobacterium bovis subsp bovis AF2122/97
ggugauggugugcagcagcau

SEQ ID NO: 3098398 - RNA, 19 nt, Mycobacterium bovis subsp bovis AF2122/97
ggugauguagagcucaccg

SEQ ID NO: 3098399 - RNA, 22 nt, Mycobacterium bovis subsp bovis AF2122/97
ggugaugucggugcguccggug

SEQ ID NO: 3098400 - RNA, 17 nt, Mycobacterium bovis subsp bovis AF2122/97
ggugauugcggccgccg

SEQ ID NO: 3098401 - RNA, 18 nt, Mycobacterium bovis subsp bovis AF2122/97
ggugauugcggccgccga

SEQ ID NO: 3098402 - RNA, 17 nt, Mycobacterium bovis subsp bovis AF2122/97
ggugauuggucacaccc

SEQ ID NO: 3098403 - RNA, 18 nt, Mycobacterium bovis subsp bovis AF2122/97
ggugcaacacgccggccc

SEQ ID NO: 3098404 - RNA, 20 nt, Mycobacterium bovis subsp bovis AF2122/97
ggugcaacacgccggcccgg

SEQ ID NO: 3098405 - RNA, 21 nt, Mycobacterium bovis subsp bovis AF2122/97
ggugcaacaggcgcgucggug

SEQ ID NO: 3098406 - RNA, 15 nt, Mycobacterium bovis subsp bovis AF2122/97
ggugcaaccgugccg

SEQ ID NO: 3098407 - RNA, 13 nt, Mycobacterium bovis subsp bovis AF2122/97
ggugcaacgcgcc

SEQ ID NO: 3098408 - RNA, 15 nt, Mycobacterium bovis subsp bovis AF2122/97
ggugcaacgcgccuu

SEQ ID NO: 3098409 - RNA, 17 nt, Mycobacterium bovis subsp bovis AF2122/97
ggugcacaacccgugca

SEQ ID NO: 3098410 - RNA, 14 nt, Mycobacterium bovis subsp bovis AF2122/97
ggugcacaccgucg

SEQ ID NO: 3098411 - RNA, 20 nt, Mycobacterium bovis subsp bovis AF2122/97
ggugcacaccgucgcaccca

SEQ ID NO: 3098412 - RNA, 19 nt, Mycobacterium bovis subsp bovis AF2122/97
ggugcaccgaagauggcca

SEQ ID NO: 3098413 - RNA, 15 nt, Mycobacterium bovis subsp bovis AF2122/97
ggugcaccgauucca

SEQ ID NO: 3098414 - RNA, 16 nt, Mycobacterium bovis subsp bovis AF2122/97
ggugcacgccuugagc

SEQ ID NO: 3098415 - RNA, 18 nt, Mycobacterium bovis subsp bovis AF2122/97
ggugcacgccuugagccg

SEQ ID NO: 3098416 - RNA, 22 nt, Mycobacterium bovis subsp bovis AF2122/97
ggugcacgccuugagccgaggc

SEQ ID NO: 3098417 - RNA, 20 nt, Mycobacterium bovis subsp bovis AF2122/97
ggugcacggcuuuucgacgc

SEQ ID NO: 3098418 - RNA, 18 nt, Mycobacterium bovis subsp bovis AF2122/97
ggugcacgguaucggugc

SEQ ID NO: 3098419 - RNA, 17 nt, Mycobacterium bovis subsp bovis AF2122/97
ggugcagaauucggcgc

SEQ ID NO: 3098420 - RNA, 16 nt, Mycobacterium bovis subsp bovis AF2122/97
ggugcagaccaccgcc

SEQ ID NO: 3098421 - RNA, 15 nt, Mycobacterium bovis subsp bovis AF2122/97
ggugcagaucgcccc

SEQ ID NO: 3098422 - RNA, 15 nt, Mycobacterium bovis subsp bovis AF2122/97
ggugcagaucggcuc

SEQ ID NO: 3098423 - RNA, 18 nt, Mycobacterium bovis subsp bovis AF2122/97
ggugcagaucggcucacc

SEQ ID NO: 3098424 - RNA, 19 nt, Mycobacterium bovis subsp bovis AF2122/97
ggugcagaucggcucaccg

SEQ ID NO: 3098425 - RNA, 22 nt, Mycobacterium bovis subsp bovis AF2122/97
ggugcagcaccagccacgccag

SEQ ID NO: 3098426 - RNA, 14 nt, Mycobacterium bovis subsp bovis AF2122/97
ggugcagcacggcg

SEQ ID NO: 3098427 - RNA, 16 nt, Mycobacterium bovis subsp bovis AF2122/97
ggugcagcacggcgcc

SEQ ID NO: 3098428 - RNA, 18 nt, Mycobacterium bovis subsp bovis AF2122/97
ggugcagcacggcgccgc

SEQ ID NO: 3098429 - RNA, 19 nt, Mycobacterium bovis subsp bovis AF2122/97
ggugcagcacggcgccgcc

SEQ ID NO: 3098430 - RNA, 22 nt, Mycobacterium bovis subsp bovis AF2122/97
ggugcagcacgugugcgggcac

SEQ ID NO: 3098431 - RNA, 12 nt, Mycobacterium bovis subsp bovis AF2122/97
ggugcagcagcg

SEQ ID NO: 3098432 - RNA, 13 nt, Mycobacterium bovis subsp bovis AF2122/97
ggugcagcagggc

SEQ ID NO: 3098433 - RNA, 12 nt, Mycobacterium bovis subsp bovis AF2122/97
ggugcagccaga

SEQ ID NO: 3098434 - RNA, 13 nt, Mycobacterium bovis subsp bovis AF2122/97
ggugcagcccgcc

SEQ ID NO: 3098435 - RNA, 24 nt, Mycobacterium bovis subsp bovis AF2122/97
ggugcagcccgccggauccgccag

SEQ ID NO: 3098436 - RNA, 13 nt, Mycobacterium bovis subsp bovis AF2122/97
ggugcagccgcgg

SEQ ID NO: 3098437 - RNA, 20 nt, Mycobacterium bovis subsp bovis AF2122/97
ggugcagccgcggucguugg

SEQ ID NO: 3098438 - RNA, 19 nt, Mycobacterium bovis subsp bovis AF2122/97
ggugcagcgacuccguacc

SEQ ID NO: 3098439 - RNA, 16 nt, Mycobacterium bovis subsp bovis AF2122/97
ggugcagcgccgacag

SEQ ID NO: 3098440 - RNA, 17 nt, Mycobacterium bovis subsp bovis AF2122/97
ggugcagcgugcagcgg

SEQ ID NO: 3098441 - RNA, 17 nt, Mycobacterium bovis subsp bovis AF2122/97
ggugcaggugagugcgg

SEQ ID NO: 3098442 - RNA, 19 nt, Mycobacterium bovis subsp bovis AF2122/97
ggugcaggugaugcaugcu

SEQ ID NO: 3098443 - RNA, 16 nt, Mycobacterium bovis subsp bovis AF2122/97
ggugcagucgauuucg

SEQ ID NO: 3098444 - RNA, 21 nt, Mycobacterium bovis subsp bovis AF2122/97
ggugcagucgauuucggcggc

SEQ ID NO: 3098445 - RNA, 18 nt, Mycobacterium bovis subsp bovis AF2122/97
ggugcaucgccacagucg

SEQ ID NO: 3098446 - RNA, 18 nt, Mycobacterium bovis subsp bovis AF2122/97
ggugcaucgccaccaccg

SEQ ID NO: 3098447 - RNA, 14 nt, Mycobacterium bovis subsp bovis AF2122/97
ggugcauucgcaug

SEQ ID NO: 3098448 - RNA, 15 nt, Mycobacterium bovis subsp bovis AF2122/97
ggugcauucgcaugu

SEQ ID NO: 3098449 - RNA, 19 nt, Mycobacterium bovis subsp bovis AF2122/97
ggugcauucugcggcaagu

SEQ ID NO: 3098450 - RNA, 19 nt, Mycobacterium bovis subsp bovis AF2122/97
ggugccaaacgccgcccgc

SEQ ID NO: 3098451 - RNA, 22 nt, Mycobacterium bovis subsp bovis AF2122/97
ggugccaaaggacgacaccgcg

SEQ ID NO: 3098452 - RNA, 21 nt, Mycobacterium bovis subsp bovis AF2122/97
ggugccaacugcgccguucgc

SEQ ID NO: 3098453 - RNA, 21 nt, Mycobacterium bovis subsp bovis AF2122/97
ggugccaccagugagcccgcu

SEQ ID NO: 3098454 - RNA, 20 nt, Mycobacterium bovis subsp bovis AF2122/97
ggugccacccuugccgccgg

SEQ ID NO: 3098455 - RNA, 13 nt, Mycobacterium bovis subsp bovis AF2122/97
ggugccaccgacg

SEQ ID NO: 3098456 - RNA, 14 nt, Mycobacterium bovis subsp bovis AF2122/97
ggugccaccgacgc

SEQ ID NO: 3098457 - RNA, 12 nt, Mycobacterium bovis subsp bovis AF2122/97
ggugccaccgcg

SEQ ID NO: 3098458 - RNA, 22 nt, Mycobacterium bovis subsp bovis AF2122/97
ggugccaccgcgacggcaggcu

SEQ ID NO: 3098459 - RNA, 13 nt, Mycobacterium bovis subsp bovis AF2122/97
ggugccaccggcu

SEQ ID NO: 3098460 - RNA, 18 nt, Mycobacterium bovis subsp bovis AF2122/97
ggugccacguucgcgggc

SEQ ID NO: 3098461 - RNA, 23 nt, Mycobacterium bovis subsp bovis AF2122/97
ggugccacugccguugccgccgg

SEQ ID NO: 3098462 - RNA, 16 nt, Mycobacterium bovis subsp bovis AF2122/97
ggugccagcaccacgu

SEQ ID NO: 3098463 - RNA, 22 nt, Mycobacterium bovis subsp bovis AF2122/97
ggugccagcaccacgucgacga

SEQ ID NO: 3098464 - RNA, 19 nt, Mycobacterium bovis subsp bovis AF2122/97
ggugccagcacuccaccgc

SEQ ID NO: 3098465 - RNA, 11 nt, Mycobacterium bovis subsp bovis AF2122/97
ggugccagcag

SEQ ID NO: 3098466 - RNA, 12 nt, Mycobacterium bovis subsp bovis AF2122/97
ggugccagcagg

SEQ ID NO: 3098467 - RNA, 13 nt, Mycobacterium bovis subsp bovis AF2122/97
ggugccagcaggc

SEQ ID NO: 3098468 - RNA, 21 nt, Mycobacterium bovis subsp bovis AF2122/97
ggugccagccggucgaugccg

SEQ ID NO: 3098469 - RNA, 16 nt, Mycobacterium bovis subsp bovis AF2122/97
ggugccaucgggcgcg

SEQ ID NO: 3098470 - RNA, 22 nt, Mycobacterium bovis subsp bovis AF2122/97
ggugcccaagcaguccacgagc

SEQ ID NO: 3098471 - RNA, 22 nt, Mycobacterium bovis subsp bovis AF2122/97
ggugcccagcgcuuugaugccg

SEQ ID NO: 3098472 - RNA, 20 nt, Mycobacterium bovis subsp bovis AF2122/97
ggugcccaggaaggcgacgc

SEQ ID NO: 3098473 - RNA, 14 nt, Mycobacterium bovis subsp bovis AF2122/97
ggugcccgacccgc

SEQ ID NO: 3098474 - RNA, 21 nt, Mycobacterium bovis subsp bovis AF2122/97
ggugcccgacuugacggcggg

SEQ ID NO: 3098475 - RNA, 21 nt, Mycobacterium bovis subsp bovis AF2122/97
ggugcccggccaaaauggcgc

SEQ ID NO: 3098476 - RNA, 12 nt, Mycobacterium bovis subsp bovis AF2122/97
ggugcccggccg

SEQ ID NO: 3098477 - RNA, 17 nt, Mycobacterium bovis subsp bovis AF2122/97
ggugcccggccgccagc

SEQ ID NO: 3098478 - RNA, 15 nt, Mycobacterium bovis subsp bovis AF2122/97
ggugcccugccggca

SEQ ID NO: 3098479 - RNA, 17 nt, Mycobacterium bovis subsp bovis AF2122/97
ggugcccugccggcagc

SEQ ID NO: 3098480 - RNA, 16 nt, Mycobacterium bovis subsp bovis AF2122/97
ggugccgaacagcggg

SEQ ID NO: 3098481 - RNA, 16 nt, Mycobacterium bovis subsp bovis AF2122/97
ggugccgaaccggcgc

SEQ ID NO: 3098482 - RNA, 13 nt, Mycobacterium bovis subsp bovis AF2122/97
ggugccgacccgc

SEQ ID NO: 3098483 - RNA, 14 nt, Mycobacterium bovis subsp bovis AF2122/97
ggugccgacccgcc

SEQ ID NO: 3098484 - RNA, 18 nt, Mycobacterium bovis subsp bovis AF2122/97
ggugccgacccgccgcgc

SEQ ID NO: 3098485 - RNA, 21 nt, Mycobacterium bovis subsp bovis AF2122/97
ggugccgacccgccgcgcccg

SEQ ID NO: 3098486 - RNA, 16 nt, Mycobacterium bovis subsp bovis AF2122/97
ggugccgacgaugacg

SEQ ID NO: 3098487 - RNA, 17 nt, Mycobacterium bovis subsp bovis AF2122/97
ggugccgacggcgccga

SEQ ID NO: 3098488 - RNA, 20 nt, Mycobacterium bovis subsp bovis AF2122/97
ggugccgacggcgccgaacc

SEQ ID NO: 3098489 - RNA, 19 nt, Mycobacterium bovis subsp bovis AF2122/97
ggugccgagcacucggcca

SEQ ID NO: 3098490 - RNA, 21 nt, Mycobacterium bovis subsp bovis AF2122/97
ggugccgagcacucggccacg

SEQ ID NO: 3098491 - RNA, 23 nt, Mycobacterium bovis subsp bovis AF2122/97
ggugccgagcgcaaggucgacgg

SEQ ID NO: 3098492 - RNA, 15 nt, Mycobacterium bovis subsp bovis AF2122/97
ggugccgagcuggcg

SEQ ID NO: 3098493 - RNA, 18 nt, Mycobacterium bovis subsp bovis AF2122/97
ggugccgaucagcagugg

SEQ ID NO: 3098494 - RNA, 14 nt, Mycobacterium bovis subsp bovis AF2122/97
ggugccgcagcagg

SEQ ID NO: 3098495 - RNA, 15 nt, Mycobacterium bovis subsp bovis AF2122/97
ggugccgcagcaggg

SEQ ID NO: 3098496 - RNA, 13 nt, Mycobacterium bovis subsp bovis AF2122/97
ggugccgcagcuu

SEQ ID NO: 3098497 - RNA, 15 nt, Mycobacterium bovis subsp bovis AF2122/97
ggugccgccaccacc

SEQ ID NO: 3098498 - RNA, 20 nt, Mycobacterium bovis subsp bovis AF2122/97
ggugccgccaccaccggcgc

SEQ ID NO: 3098499 - RNA, 23 nt, Mycobacterium bovis subsp bovis AF2122/97
ggugccgccaccaccggcgccuc

SEQ ID NO: 3098500 - RNA, 19 nt, Mycobacterium bovis subsp bovis AF2122/97
ggugccgccaccggcgucc

SEQ ID NO: 3098501 - RNA, 12 nt, Mycobacterium bovis subsp bovis AF2122/97
ggugccgccauc

SEQ ID NO: 3098502 - RNA, 17 nt, Mycobacterium bovis subsp bovis AF2122/97
ggugccgccaucgccgc

SEQ ID NO: 3098503 - RNA, 13 nt, Mycobacterium bovis subsp bovis AF2122/97
ggugccgcccgag

SEQ ID NO: 3098504 - RNA, 12 nt, Mycobacterium bovis subsp bovis AF2122/97
ggugccgcccgc

SEQ ID NO: 3098505 - RNA, 13 nt, Mycobacterium bovis subsp bovis AF2122/97
ggugccgcccgcg

SEQ ID NO: 3098506 - RNA, 19 nt, Mycobacterium bovis subsp bovis AF2122/97
ggugccgcccgcgccgccg

SEQ ID NO: 3098507 - RNA, 18 nt, Mycobacterium bovis subsp bovis AF2122/97
ggugccgcccgcgccucc

SEQ ID NO: 3098508 - RNA, 13 nt, Mycobacterium bovis subsp bovis AF2122/97
ggugccgccgccg

SEQ ID NO: 3098509 - RNA, 18 nt, Mycobacterium bovis subsp bovis AF2122/97
ggugccgccgccggcgcc

SEQ ID NO: 3098510 - RNA, 20 nt, Mycobacterium bovis subsp bovis AF2122/97
ggugccgccgccggcgccgg

SEQ ID NO: 3098511 - RNA, 16 nt, Mycobacterium bovis subsp bovis AF2122/97
ggugccgccgcggcca

SEQ ID NO: 3098512 - RNA, 22 nt, Mycobacterium bovis subsp bovis AF2122/97
ggugccgccgcggccaccaccg

SEQ ID NO: 3098513 - RNA, 22 nt, Mycobacterium bovis subsp bovis AF2122/97
ggugccgccgggugcaacggcg

SEQ ID NO: 3098514 - RNA, 21 nt, Mycobacterium bovis subsp bovis AF2122/97
ggugccgccggugccgccauu

SEQ ID NO: 3098515 - RNA, 14 nt, Mycobacterium bovis subsp bovis AF2122/97
ggugccgccgucga

SEQ ID NO: 3098516 - RNA, 15 nt, Mycobacterium bovis subsp bovis AF2122/97
ggugccgccgucgau

SEQ ID NO: 3098517 - RNA, 13 nt, Mycobacterium bovis subsp bovis AF2122/97
ggugccgcgcagc

SEQ ID NO: 3098518 - RNA, 13 nt, Mycobacterium bovis subsp bovis AF2122/97
ggugccgcggcca

SEQ ID NO: 3098519 - RNA, 23 nt, Mycobacterium bovis subsp bovis AF2122/97
ggugccgcggccaccgccgccgc

SEQ ID NO: 3098520 - RNA, 22 nt, Mycobacterium bovis subsp bovis AF2122/97
ggugccgcggcuaggccaagcc

SEQ ID NO: 3098521 - RNA, 22 nt, Mycobacterium bovis subsp bovis AF2122/97
ggugccgcgguaggugcauguc

SEQ ID NO: 3098522 - RNA, 20 nt, Mycobacterium bovis subsp bovis AF2122/97
ggugccggacuuggccugcg

SEQ ID NO: 3098523 - RNA, 16 nt, Mycobacterium bovis subsp bovis AF2122/97
ggugccggcagcggcg

SEQ ID NO: 3098524 - RNA, 17 nt, Mycobacterium bovis subsp bovis AF2122/97
ggugccggcauagaucg

SEQ ID NO: 3098525 - RNA, 16 nt, Mycobacterium bovis subsp bovis AF2122/97
ggugccggccaucgcc

SEQ ID NO: 3098526 - RNA, 16 nt, Mycobacterium bovis subsp bovis AF2122/97
ggugccggcccugcuc

SEQ ID NO: 3098527 - RNA, 21 nt, Mycobacterium bovis subsp bovis AF2122/97
ggugccggccguucgugggca

SEQ ID NO: 3098528 - RNA, 20 nt, Mycobacterium bovis subsp bovis AF2122/97
ggugccggcgacgcuaccgc

SEQ ID NO: 3098529 - RNA, 22 nt, Mycobacterium bovis subsp bovis AF2122/97
ggugccggcgacgcuaccgccg

SEQ ID NO: 3098530 - RNA, 12 nt, Mycobacterium bovis subsp bovis AF2122/97
ggugccggcgcc

SEQ ID NO: 3098531 - RNA, 13 nt, Mycobacterium bovis subsp bovis AF2122/97
ggugccggcgcca

SEQ ID NO: 3098532 - RNA, 14 nt, Mycobacterium bovis subsp bovis AF2122/97
ggugccggcgccac

SEQ ID NO: 3098533 - RNA, 15 nt, Mycobacterium bovis subsp bovis AF2122/97
ggugccggcgccacc

SEQ ID NO: 3098534 - RNA, 18 nt, Mycobacterium bovis subsp bovis AF2122/97
ggugccggcgccgccagc

SEQ ID NO: 3098535 - RNA, 14 nt, Mycobacterium bovis subsp bovis AF2122/97
ggugccggcggcgc

SEQ ID NO: 3098536 - RNA, 12 nt, Mycobacterium bovis subsp bovis AF2122/97
ggugccggcggu

SEQ ID NO: 3098537 - RNA, 22 nt, Mycobacterium bovis subsp bovis AF2122/97
ggugccggcggugacggcggca

SEQ ID NO: 3098538 - RNA, 19 nt, Mycobacterium bovis subsp bovis AF2122/97
ggugccggcguaggcagga

SEQ ID NO: 3098539 - RNA, 14 nt, Mycobacterium bovis subsp bovis AF2122/97
ggugccggcgucgc

SEQ ID NO: 3098540 - RNA, 15 nt, Mycobacterium bovis subsp bovis AF2122/97
ggugccggcgucgcu

SEQ ID NO: 3098541 - RNA, 22 nt, Mycobacterium bovis subsp bovis AF2122/97
ggugccggcgucgcuggccagg

SEQ ID NO: 3098542 - RNA, 14 nt, Mycobacterium bovis subsp bovis AF2122/97
ggugccggcguugc

SEQ ID NO: 3098543 - RNA, 16 nt, Mycobacterium bovis subsp bovis AF2122/97
ggugccggcguugccg

SEQ ID NO: 3098544 - RNA, 19 nt, Mycobacterium bovis subsp bovis AF2122/97
ggugccgggaugccgccgc

SEQ ID NO: 3098545 - RNA, 15 nt, Mycobacterium bovis subsp bovis AF2122/97
ggugccgggcaccac

SEQ ID NO: 3098546 - RNA, 17 nt, Mycobacterium bovis subsp bovis AF2122/97
ggugccgggcaccacca

SEQ ID NO: 3098547 - RNA, 21 nt, Mycobacterium bovis subsp bovis AF2122/97
ggugccggggccccaugccga

SEQ ID NO: 3098548 - RNA, 14 nt, Mycobacterium bovis subsp bovis AF2122/97
ggugccgggguggc

SEQ ID NO: 3098549 - RNA, 19 nt, Mycobacterium bovis subsp bovis AF2122/97
ggugccgggguggcgcgcc

SEQ ID NO: 3098550 - RNA, 23 nt, Mycobacterium bovis subsp bovis AF2122/97
ggugccggucaccucgccggcgg

SEQ ID NO: 3098551 - RNA, 19 nt, Mycobacterium bovis subsp bovis AF2122/97
ggugccggugauggccgac

SEQ ID NO: 3098552 - RNA, 13 nt, Mycobacterium bovis subsp bovis AF2122/97
ggugccggugcgc

SEQ ID NO: 3098553 - RNA, 15 nt, Mycobacterium bovis subsp bovis AF2122/97
ggugccgucagcggc

SEQ ID NO: 3098554 - RNA, 16 nt, Mycobacterium bovis subsp bovis AF2122/97
ggugccgucagcggcg

SEQ ID NO: 3098555 - RNA, 19 nt, Mycobacterium bovis subsp bovis AF2122/97
ggugccgucagcggcggcc

SEQ ID NO: 3098556 - RNA, 13 nt, Mycobacterium bovis subsp bovis AF2122/97
ggugccgucgccg

SEQ ID NO: 3098557 - RNA, 14 nt, Mycobacterium bovis subsp bovis AF2122/97
ggugccgucgggua

SEQ ID NO: 3098558 - RNA, 22 nt, Mycobacterium bovis subsp bovis AF2122/97
ggugccgugaucggcgcccggg

SEQ ID NO: 3098559 - RNA, 17 nt, Mycobacterium bovis subsp bovis AF2122/97
ggugccguggauugcgc

SEQ ID NO: 3098560 - RNA, 21 nt, Mycobacterium bovis subsp bovis AF2122/97
ggugccguggauugcgccagg

SEQ ID NO: 3098561 - RNA, 20 nt, Mycobacterium bovis subsp bovis AF2122/97
ggugccguugcgucugcucg

SEQ ID NO: 3098562 - RNA, 17 nt, Mycobacterium bovis subsp bovis AF2122/97
ggugccguuggagccgc

SEQ ID NO: 3098563 - RNA, 19 nt, Mycobacterium bovis subsp bovis AF2122/97
ggugccuacaccggcaagc

SEQ ID NO: 3098564 - RNA, 20 nt, Mycobacterium bovis subsp bovis AF2122/97
ggugccuacaccggcaagcc

SEQ ID NO: 3098565 - RNA, 21 nt, Mycobacterium bovis subsp bovis AF2122/97
ggugccuacaccggcaagcca

SEQ ID NO: 3098566 - RNA, 14 nt, Mycobacterium bovis subsp bovis AF2122/97
ggugccugcaacgc

SEQ ID NO: 3098567 - RNA, 19 nt, Mycobacterium bovis subsp bovis AF2122/97
ggugcgaauggugcaacgc

SEQ ID NO: 3098568 - RNA, 15 nt, Mycobacterium bovis subsp bovis AF2122/97
ggugcgagcgacacc

SEQ ID NO: 3098569 - RNA, 15 nt, Mycobacterium bovis subsp bovis AF2122/97
ggugcgauccggcgc

SEQ ID NO: 3098570 - RNA, 16 nt, Mycobacterium bovis subsp bovis AF2122/97
ggugcgauccggcgca

SEQ ID NO: 3098571 - RNA, 12 nt, Mycobacterium bovis subsp bovis AF2122/97
ggugcgcaccag

SEQ ID NO: 3098572 - RNA, 12 nt, Mycobacterium bovis subsp bovis AF2122/97
ggugcgcacggc

SEQ ID NO: 3098573 - RNA, 13 nt, Mycobacterium bovis subsp bovis AF2122/97
ggugcgcacggcg

SEQ ID NO: 3098574 - RNA, 16 nt, Mycobacterium bovis subsp bovis AF2122/97
ggugcgcacggcggcc

SEQ ID NO: 3098575 - RNA, 15 nt, Mycobacterium bovis subsp bovis AF2122/97
ggugcgcagcugcgg

SEQ ID NO: 3098576 - RNA, 15 nt, Mycobacterium bovis subsp bovis AF2122/97
ggugcgcagggccug

SEQ ID NO: 3098577 - RNA, 23 nt, Mycobacterium bovis subsp bovis AF2122/97
ggugcgccacgccaccgcgguca

SEQ ID NO: 3098578 - RNA, 18 nt, Mycobacterium bovis subsp bovis AF2122/97
ggugcgccauucccggug

SEQ ID NO: 3098579 - RNA, 18 nt, Mycobacterium bovis subsp bovis AF2122/97
ggugcgcccgccggcgcg

SEQ ID NO: 3098580 - RNA, 14 nt, Mycobacterium bovis subsp bovis AF2122/97
ggugcgcccggcca

SEQ ID NO: 3098581 - RNA, 23 nt, Mycobacterium bovis subsp bovis AF2122/97
ggugcgcccggccaagccggcga

SEQ ID NO: 3098582 - RNA, 13 nt, Mycobacterium bovis subsp bovis AF2122/97
ggugcgccgaucc

SEQ ID NO: 3098583 - RNA, 13 nt, Mycobacterium bovis subsp bovis AF2122/97
ggugcgccgcagc

SEQ ID NO: 3098584 - RNA, 14 nt, Mycobacterium bovis subsp bovis AF2122/97
ggugcgccgccauc

SEQ ID NO: 3098585 - RNA, 19 nt, Mycobacterium bovis subsp bovis AF2122/97
ggugcgccgcgggcugacc

SEQ ID NO: 3098586 - RNA, 13 nt, Mycobacterium bovis subsp bovis AF2122/97
ggugcgccggcgu

SEQ ID NO: 3098587 - RNA, 20 nt, Mycobacterium bovis subsp bovis AF2122/97
ggugcgccgguccucgucgg

SEQ ID NO: 3098588 - RNA, 18 nt, Mycobacterium bovis subsp bovis AF2122/97
ggugcgccguggcaucgc

SEQ ID NO: 3098589 - RNA, 13 nt, Mycobacterium bovis subsp bovis AF2122/97
ggugcgcgaagga

SEQ ID NO: 3098590 - RNA, 15 nt, Mycobacterium bovis subsp bovis AF2122/97
ggugcgcgaccagga

SEQ ID NO: 3098591 - RNA, 20 nt, Mycobacterium bovis subsp bovis AF2122/97
ggugcgcgaggucggcggcg

SEQ ID NO: 3098592 - RNA, 24 nt, Mycobacterium bovis subsp bovis AF2122/97
ggugcgcgaggucggcggcgcagg

SEQ ID NO: 3098593 - RNA, 18 nt, Mycobacterium bovis subsp bovis AF2122/97
ggugcgcgcgaccauacc

SEQ ID NO: 3098594 - RNA, 16 nt, Mycobacterium bovis subsp bovis AF2122/97
ggugcgcggagagcgc

SEQ ID NO: 3098595 - RNA, 22 nt, Mycobacterium bovis subsp bovis AF2122/97
ggugcgcgugacgaccagcccc

SEQ ID NO: 3098596 - RNA, 12 nt, Mycobacterium bovis subsp bovis AF2122/97
ggugcgcuggcc

SEQ ID NO: 3098597 - RNA, 16 nt, Mycobacterium bovis subsp bovis AF2122/97
ggugcgcuggcccaau

SEQ ID NO: 3098598 - RNA, 13 nt, Mycobacterium bovis subsp bovis AF2122/97
ggugcgcuggcgg

SEQ ID NO: 3098599 - RNA, 18 nt, Mycobacterium bovis subsp bovis AF2122/97
ggugcgcuugcggccgcg

SEQ ID NO: 3098600 - RNA, 18 nt, Mycobacterium bovis subsp bovis AF2122/97
ggugcggaacacgaugcg

SEQ ID NO: 3098601 - RNA, 22 nt, Mycobacterium bovis subsp bovis AF2122/97
ggugcggaacacgaugcgcggu

SEQ ID NO: 3098602 - RNA, 17 nt, Mycobacterium bovis subsp bovis AF2122/97
ggugcggaccugcgccg

SEQ ID NO: 3098603 - RNA, 19 nt, Mycobacterium bovis subsp bovis AF2122/97
ggugcggacuucgaugucg

SEQ ID NO: 3098604 - RNA, 23 nt, Mycobacterium bovis subsp bovis AF2122/97
ggugcggacuucgaugucgaggu

SEQ ID NO: 3098605 - RNA, 21 nt, Mycobacterium bovis subsp bovis AF2122/97
ggugcggauguccuugcgguc

SEQ ID NO: 3098606 - RNA, 16 nt, Mycobacterium bovis subsp bovis AF2122/97
ggugcggcaacagcgc

SEQ ID NO: 3098607 - RNA, 18 nt, Mycobacterium bovis subsp bovis AF2122/97
ggugcggcaacagcgcca

SEQ ID NO: 3098608 - RNA, 12 nt, Mycobacterium bovis subsp bovis AF2122/97
ggugcggccacu

SEQ ID NO: 3098609 - RNA, 15 nt, Mycobacterium bovis subsp bovis AF2122/97
ggugcggccgcggcg

SEQ ID NO: 3098610 - RNA, 19 nt, Mycobacterium bovis subsp bovis AF2122/97
ggugcggccguggcguggc

SEQ ID NO: 3098611 - RNA, 16 nt, Mycobacterium bovis subsp bovis AF2122/97
ggugcggcgggcucgc

SEQ ID NO: 3098612 - RNA, 14 nt, Mycobacterium bovis subsp bovis AF2122/97
ggugcgggcgccgc

SEQ ID NO: 3098613 - RNA, 22 nt, Mycobacterium bovis subsp bovis AF2122/97
ggugcgggcgugguaaccaggg

SEQ ID NO: 3098614 - RNA, 13 nt, Mycobacterium bovis subsp bovis AF2122/97
ggugcggggccgg

SEQ ID NO: 3098615 - RNA, 17 nt, Mycobacterium bovis subsp bovis AF2122/97
ggugcggggccggucgg

SEQ ID NO: 3098616 - RNA, 15 nt, Mycobacterium bovis subsp bovis AF2122/97
ggugcgggguuggcc

SEQ ID NO: 3098617 - RNA, 19 nt, Mycobacterium bovis subsp bovis AF2122/97
ggugcgggugggacaccau

SEQ ID NO: 3098618 - RNA, 16 nt, Mycobacterium bovis subsp bovis AF2122/97
ggugcgggugggcaca

SEQ ID NO: 3098619 - RNA, 16 nt, Mycobacterium bovis subsp bovis AF2122/97
ggugcggucuccgccc

SEQ ID NO: 3098620 - RNA, 17 nt, Mycobacterium bovis subsp bovis AF2122/97
ggugcggugauuccagc

SEQ ID NO: 3098621 - RNA, 13 nt, Mycobacterium bovis subsp bovis AF2122/97
ggugcgguucgcu

SEQ ID NO: 3098622 - RNA, 19 nt, Mycobacterium bovis subsp bovis AF2122/97
ggugcgguucgcugcggcg

SEQ ID NO: 3098623 - RNA, 18 nt, Mycobacterium bovis subsp bovis AF2122/97
ggugcgguuucaccgacg

SEQ ID NO: 3098624 - RNA, 22 nt, Mycobacterium bovis subsp bovis AF2122/97
ggugcgguuucaccgacgacgc

SEQ ID NO: 3098625 - RNA, 15 nt, Mycobacterium bovis subsp bovis AF2122/97
ggugcguccaggcca

SEQ ID NO: 3098626 - RNA, 20 nt, Mycobacterium bovis subsp bovis AF2122/97
ggugcguccaggccagggcg

SEQ ID NO: 3098627 - RNA, 18 nt, Mycobacterium bovis subsp bovis AF2122/97
ggugcuaaccgacgcuga

SEQ ID NO: 3098628 - RNA, 15 nt, Mycobacterium bovis subsp bovis AF2122/97
ggugcuacugggugg

SEQ ID NO: 3098629 - RNA, 16 nt, Mycobacterium bovis subsp bovis AF2122/97
ggugcucaccuccacg

SEQ ID NO: 3098630 - RNA, 18 nt, Mycobacterium bovis subsp bovis AF2122/97
ggugcucagcggcucgcc

SEQ ID NO: 3098631 - RNA, 19 nt, Mycobacterium bovis subsp bovis AF2122/97
ggugcucagcggcucgccu

SEQ ID NO: 3098632 - RNA, 19 nt, Mycobacterium bovis subsp bovis AF2122/97
ggugcucgcgaucugcucg

SEQ ID NO: 3098633 - RNA, 17 nt, Mycobacterium bovis subsp bovis AF2122/97
ggugcucggaucggcuc

SEQ ID NO: 3098634 - RNA, 15 nt, Mycobacterium bovis subsp bovis AF2122/97
ggugcucgggcggcg

SEQ ID NO: 3098635 - RNA, 17 nt, Mycobacterium bovis subsp bovis AF2122/97
ggugcucgggcggcgau

SEQ ID NO: 3098636 - RNA, 20 nt, Mycobacterium bovis subsp bovis AF2122/97
ggugcucgucggugucgguu

SEQ ID NO: 3098637 - RNA, 23 nt, Mycobacterium bovis subsp bovis AF2122/97
ggugcucucguggauggccgcca

SEQ ID NO: 3098638 - RNA, 16 nt, Mycobacterium bovis subsp bovis AF2122/97
ggugcugaccccgccg

SEQ ID NO: 3098639 - RNA, 22 nt, Mycobacterium bovis subsp bovis AF2122/97
ggugcugaccccgccggcugcg

SEQ ID NO: 3098640 - RNA, 20 nt, Mycobacterium bovis subsp bovis AF2122/97
ggugcugaucgguccggcga

SEQ ID NO: 3098641 - RNA, 21 nt, Mycobacterium bovis subsp bovis AF2122/97
ggugcugaucgguccggcgaa

SEQ ID NO: 3098642 - RNA, 16 nt, Mycobacterium bovis subsp bovis AF2122/97
ggugcugcgcgcggcg

SEQ ID NO: 3098643 - RNA, 17 nt, Mycobacterium bovis subsp bovis AF2122/97
ggugcugguauagccgg

SEQ ID NO: 3098644 - RNA, 15 nt, Mycobacterium bovis subsp bovis AF2122/97
ggugcuggucaacag

SEQ ID NO: 3098645 - RNA, 15 nt, Mycobacterium bovis subsp bovis AF2122/97
ggugcuggucgccgc

SEQ ID NO: 3098646 - RNA, 20 nt, Mycobacterium bovis subsp bovis AF2122/97
ggugcuggugaucugcuggg

SEQ ID NO: 3098647 - RNA, 16 nt, Mycobacterium bovis subsp bovis AF2122/97
ggugcuguuugguugc

SEQ ID NO: 3098648 - RNA, 18 nt, Mycobacterium bovis subsp bovis AF2122/97
ggugcuuccucgcgagcu

SEQ ID NO: 3098649 - RNA, 22 nt, Mycobacterium bovis subsp bovis AF2122/97
ggugcuuccucgcgagcucccu

SEQ ID NO: 3098650 - RNA, 14 nt, Mycobacterium bovis subsp bovis AF2122/97
ggugcuugucgccg

SEQ ID NO: 3098651 - RNA, 23 nt, Mycobacterium bovis subsp bovis AF2122/97
gguggaaaaagcccgacacgaaa

SEQ ID NO: 3098652 - RNA, 20 nt, Mycobacterium bovis subsp bovis AF2122/97
gguggaaaagccacggcugc

SEQ ID NO: 3098653 - RNA, 15 nt, Mycobacterium bovis subsp bovis AF2122/97
gguggaaacccugca

SEQ ID NO: 3098654 - RNA, 17 nt, Mycobacterium bovis subsp bovis AF2122/97
gguggaauccaccagcc

SEQ ID NO: 3098655 - RNA, 13 nt, Mycobacterium bovis subsp bovis AF2122/97
gguggaccaccgg

SEQ ID NO: 3098656 - RNA, 12 nt, Mycobacterium bovis subsp bovis AF2122/97
gguggacccggc

SEQ ID NO: 3098657 - RNA, 14 nt, Mycobacterium bovis subsp bovis AF2122/97
gguggacgaccgcg

SEQ ID NO: 3098658 - RNA, 18 nt, Mycobacterium bovis subsp bovis AF2122/97
gguggacgaccgcgcggc

SEQ ID NO: 3098659 - RNA, 23 nt, Mycobacterium bovis subsp bovis AF2122/97
gguggacgaccgcgcggcacuug

SEQ ID NO: 3098660 - RNA, 21 nt, Mycobacterium bovis subsp bovis AF2122/97
gguggacgagccagaggugga

SEQ ID NO: 3098661 - RNA, 17 nt, Mycobacterium bovis subsp bovis AF2122/97
gguggacgaggcggucg

SEQ ID NO: 3098662 - RNA, 16 nt, Mycobacterium bovis subsp bovis AF2122/97
gguggacgaucuggca

SEQ ID NO: 3098663 - RNA, 19 nt, Mycobacterium bovis subsp bovis AF2122/97
gguggacgcagagucaacg

SEQ ID NO: 3098664 - RNA, 20 nt, Mycobacterium bovis subsp bovis AF2122/97
gguggacgcagagucaacga

SEQ ID NO: 3098665 - RNA, 21 nt, Mycobacterium bovis subsp bovis AF2122/97
gguggacgugcagccgcaggu

SEQ ID NO: 3098666 - RNA, 15 nt, Mycobacterium bovis subsp bovis AF2122/97
gguggagagccgacg

SEQ ID NO: 3098667 - RNA, 13 nt, Mycobacterium bovis subsp bovis AF2122/97
gguggagcggcgc

SEQ ID NO: 3098668 - RNA, 22 nt, Mycobacterium bovis subsp bovis AF2122/97
gguggaggcguagucggcggug

SEQ ID NO: 3098669 - RNA, 21 nt, Mycobacterium bovis subsp bovis AF2122/97
gguggaguuuccgaagcccgg

SEQ ID NO: 3098670 - RNA, 22 nt, Mycobacterium bovis subsp bovis AF2122/97
gguggaguuuccgaagcccggg

SEQ ID NO: 3098671 - RNA, 20 nt, Mycobacterium bovis subsp bovis AF2122/97
gguggaugcgaugcgcgccg

SEQ ID NO: 3098672 - RNA, 21 nt, Mycobacterium bovis subsp bovis AF2122/97
gguggcaacgggucggcauug

SEQ ID NO: 3098673 - RNA, 23 nt, Mycobacterium bovis subsp bovis AF2122/97
gguggcaaucgaggaaggugugc

SEQ ID NO: 3098674 - RNA, 14 nt, Mycobacterium bovis subsp bovis AF2122/97
gguggcacccgcgu

SEQ ID NO: 3098675 - RNA, 14 nt, Mycobacterium bovis subsp bovis AF2122/97
gguggcaccggcgg

SEQ ID NO: 3098676 - RNA, 16 nt, Mycobacterium bovis subsp bovis AF2122/97
gguggcaccggcggcg

SEQ ID NO: 3098677 - RNA, 17 nt, Mycobacterium bovis subsp bovis AF2122/97
gguggcaccggcggcga

SEQ ID NO: 3098678 - RNA, 19 nt, Mycobacterium bovis subsp bovis AF2122/97
gguggcacgcugagcgucc

SEQ ID NO: 3098679 - RNA, 14 nt, Mycobacterium bovis subsp bovis AF2122/97
gguggcacggcccc

SEQ ID NO: 3098680 - RNA, 22 nt, Mycobacterium bovis subsp bovis AF2122/97
gguggcagagccgccguugccg

SEQ ID NO: 3098681 - RNA, 14 nt, Mycobacterium bovis subsp bovis AF2122/97
gguggcagcacagc

SEQ ID NO: 3098682 - RNA, 13 nt, Mycobacterium bovis subsp bovis AF2122/97
gguggcagcgcac

SEQ ID NO: 3098683 - RNA, 15 nt, Mycobacterium bovis subsp bovis AF2122/97
gguggcagcggcgau

SEQ ID NO: 3098684 - RNA, 13 nt, Mycobacterium bovis subsp bovis AF2122/97
gguggcaugcgac

SEQ ID NO: 3098685 - RNA, 21 nt, Mycobacterium bovis subsp bovis AF2122/97
gguggcaugcgacagaugccg

SEQ ID NO: 3098686 - RNA, 18 nt, Mycobacterium bovis subsp bovis AF2122/97
gguggccaacaccgccag

SEQ ID NO: 3098687 - RNA, 14 nt, Mycobacterium bovis subsp bovis AF2122/97
gguggccaccaccg

SEQ ID NO: 3098688 - RNA, 15 nt, Mycobacterium bovis subsp bovis AF2122/97
gguggccaccagcgg

SEQ ID NO: 3098689 - RNA, 20 nt, Mycobacterium bovis subsp bovis AF2122/97
gguggccacccggccgcgcg

SEQ ID NO: 3098690 - RNA, 22 nt, Mycobacterium bovis subsp bovis AF2122/97
gguggccacccggccgcgcggg

SEQ ID NO: 3098691 - RNA, 15 nt, Mycobacterium bovis subsp bovis AF2122/97
gguggccacgcccag

SEQ ID NO: 3098692 - RNA, 22 nt, Mycobacterium bovis subsp bovis AF2122/97
gguggccagaucgaacgcagcc

SEQ ID NO: 3098693 - RNA, 16 nt, Mycobacterium bovis subsp bovis AF2122/97
gguggccagcacgugc

SEQ ID NO: 3098694 - RNA, 14 nt, Mycobacterium bovis subsp bovis AF2122/97
gguggccagcgcgg

SEQ ID NO: 3098695 - RNA, 14 nt, Mycobacterium bovis subsp bovis AF2122/97
gguggccaucgcgc

SEQ ID NO: 3098696 - RNA, 15 nt, Mycobacterium bovis subsp bovis AF2122/97
gguggccaucgcgcg

SEQ ID NO: 3098697 - RNA, 22 nt, Mycobacterium bovis subsp bovis AF2122/97
gguggccaucgcgcggaccaga

SEQ ID NO: 3098698 - RNA, 17 nt, Mycobacterium bovis subsp bovis AF2122/97
gguggccaugacggcuc

SEQ ID NO: 3098699 - RNA, 21 nt, Mycobacterium bovis subsp bovis AF2122/97
gguggccaugacggcuccgau

SEQ ID NO: 3098700 - RNA, 18 nt, Mycobacterium bovis subsp bovis AF2122/97
gguggccccgauggcgau

SEQ ID NO: 3098701 - RNA, 20 nt, Mycobacterium bovis subsp bovis AF2122/97
gguggcccggaacaccgacg

SEQ ID NO: 3098702 - RNA, 12 nt, Mycobacterium bovis subsp bovis AF2122/97
gguggccgacga

SEQ ID NO: 3098703 - RNA, 12 nt, Mycobacterium bovis subsp bovis AF2122/97
gguggccgccac

SEQ ID NO: 3098704 - RNA, 15 nt, Mycobacterium bovis subsp bovis AF2122/97
gguggccgcggcggu

SEQ ID NO: 3098705 - RNA, 13 nt, Mycobacterium bovis subsp bovis AF2122/97
gguggccgcugcc

SEQ ID NO: 3098706 - RNA, 20 nt, Mycobacterium bovis subsp bovis AF2122/97
gguggccggcaacggcgcgc

SEQ ID NO: 3098707 - RNA, 18 nt, Mycobacterium bovis subsp bovis AF2122/97
gguggccggcgaggguga

SEQ ID NO: 3098708 - RNA, 21 nt, Mycobacterium bovis subsp bovis AF2122/97
gguggccggggugccggcgau

SEQ ID NO: 3098709 - RNA, 21 nt, Mycobacterium bovis subsp bovis AF2122/97
gguggccgggucgaucaccga

SEQ ID NO: 3098710 - RNA, 12 nt, Mycobacterium bovis subsp bovis AF2122/97
gguggccgucgg

SEQ ID NO: 3098711 - RNA, 17 nt, Mycobacterium bovis subsp bovis AF2122/97
gguggcgaucaucggcc

SEQ ID NO: 3098712 - RNA, 21 nt, Mycobacterium bovis subsp bovis AF2122/97
gguggcgccauccccgccggc

SEQ ID NO: 3098713 - RNA, 11 nt, Mycobacterium bovis subsp bovis AF2122/97
gguggcgccga

SEQ ID NO: 3098714 - RNA, 15 nt, Mycobacterium bovis subsp bovis AF2122/97
gguggcgccgaacgc

SEQ ID NO: 3098715 - RNA, 13 nt, Mycobacterium bovis subsp bovis AF2122/97
gguggcgccgacc

SEQ ID NO: 3098716 - RNA, 11 nt, Mycobacterium bovis subsp bovis AF2122/97
gguggcgccgg

SEQ ID NO: 3098717 - RNA, 14 nt, Mycobacterium bovis subsp bovis AF2122/97
gguggcgccggccg

SEQ ID NO: 3098718 - RNA, 15 nt, Mycobacterium bovis subsp bovis AF2122/97
gguggcgccggggcg

SEQ ID NO: 3098719 - RNA, 17 nt, Mycobacterium bovis subsp bovis AF2122/97
gguggcgccggggcgca

SEQ ID NO: 3098720 - RNA, 17 nt, Mycobacterium bovis subsp bovis AF2122/97
gguggcgccguugucgg

SEQ ID NO: 3098721 - RNA, 19 nt, Mycobacterium bovis subsp bovis AF2122/97
gguggcgcggacccgccgu

SEQ ID NO: 3098722 - RNA, 18 nt, Mycobacterium bovis subsp bovis AF2122/97
gguggcgcggggccgccg

SEQ ID NO: 3098723 - RNA, 15 nt, Mycobacterium bovis subsp bovis AF2122/97
gguggcgcggugccg

SEQ ID NO: 3098724 - RNA, 16 nt, Mycobacterium bovis subsp bovis AF2122/97
gguggcggcagcagcg

SEQ ID NO: 3098725 - RNA, 22 nt, Mycobacterium bovis subsp bovis AF2122/97
gguggcggccuccgaggaauac

SEQ ID NO: 3098726 - RNA, 20 nt, Mycobacterium bovis subsp bovis AF2122/97
gguggcggcgagcagcaggu

SEQ ID NO: 3098727 - RNA, 13 nt, Mycobacterium bovis subsp bovis AF2122/97
gguggcggcggcg

SEQ ID NO: 3098728 - RNA, 15 nt, Mycobacterium bovis subsp bovis AF2122/97
gguggcggcggcggc

SEQ ID NO: 3098729 - RNA, 18 nt, Mycobacterium bovis subsp bovis AF2122/97
gguggcggcggcggcaac

SEQ ID NO: 3098730 - RNA, 21 nt, Mycobacterium bovis subsp bovis AF2122/97
gguggcgggguugaucaccga

SEQ ID NO: 3098731 - RNA, 21 nt, Mycobacterium bovis subsp bovis AF2122/97
gguggcgguaccuagccgcag

SEQ ID NO: 3098732 - RNA, 23 nt, Mycobacterium bovis subsp bovis AF2122/97
gguggcggucaccacgcggcggu

SEQ ID NO: 3098733 - RNA, 17 nt, Mycobacterium bovis subsp bovis AF2122/97
gguggcggugucggcgc

SEQ ID NO: 3098734 - RNA, 23 nt, Mycobacterium bovis subsp bovis AF2122/97
gguggcguaauugucgauguccg

SEQ ID NO: 3098735 - RNA, 14 nt, Mycobacterium bovis subsp bovis AF2122/97
gguggcgucaccgc

SEQ ID NO: 3098736 - RNA, 16 nt, Mycobacterium bovis subsp bovis AF2122/97
gguggcgucaccgccg

SEQ ID NO: 3098737 - RNA, 23 nt, Mycobacterium bovis subsp bovis AF2122/97
gguggcgucaccgccggugcuga

SEQ ID NO: 3098738 - RNA, 23 nt, Mycobacterium bovis subsp bovis AF2122/97
gguggcguccagggcgccgaucg

SEQ ID NO: 3098739 - RNA, 15 nt, Mycobacterium bovis subsp bovis AF2122/97
gguggcgucgcgguu

SEQ ID NO: 3098740 - RNA, 21 nt, Mycobacterium bovis subsp bovis AF2122/97
gguggcguggcccucggcgau

SEQ ID NO: 3098741 - RNA, 21 nt, Mycobacterium bovis subsp bovis AF2122/97
gguggcgugggcacuugcccg

SEQ ID NO: 3098742 - RNA, 13 nt, Mycobacterium bovis subsp bovis AF2122/97
gguggcguggugg

SEQ ID NO: 3098743 - RNA, 18 nt, Mycobacterium bovis subsp bovis AF2122/97
gguggcguuugaugcggg

SEQ ID NO: 3098744 - RNA, 22 nt, Mycobacterium bovis subsp bovis AF2122/97
gguggcguuugaugcgggcggc

SEQ ID NO: 3098745 - RNA, 13 nt, Mycobacterium bovis subsp bovis AF2122/97
gguggcucgggug

SEQ ID NO: 3098746 - RNA, 12 nt, Mycobacterium bovis subsp bovis AF2122/97
gguggcugcugg

SEQ ID NO: 3098747 - RNA, 16 nt, Mycobacterium bovis subsp bovis AF2122/97
gguggcuucaacccgg

SEQ ID NO: 3098748 - RNA, 17 nt, Mycobacterium bovis subsp bovis AF2122/97
gguggcuucaacccggg

SEQ ID NO: 3098749 - RNA, 21 nt, Mycobacterium bovis subsp bovis AF2122/97
gguggcuucaacccgggcagc

SEQ ID NO: 3098750 - RNA, 22 nt, Mycobacterium bovis subsp bovis AF2122/97
gguggcuucaacccgggcagca

SEQ ID NO: 3098751 - RNA, 21 nt, Mycobacterium bovis subsp bovis AF2122/97
gguggcuuuugcgucugcucg

SEQ ID NO: 3098752 - RNA, 24 nt, Mycobacterium bovis subsp bovis AF2122/97
ggugggaaguagugcaucggcagc

SEQ ID NO: 3098753 - RNA, 16 nt, Mycobacterium bovis subsp bovis AF2122/97
ggugggacaggucggg

SEQ ID NO: 3098754 - RNA, 19 nt, Mycobacterium bovis subsp bovis AF2122/97
ggugggacaggucggggcg

SEQ ID NO: 3098755 - RNA, 14 nt, Mycobacterium bovis subsp bovis AF2122/97
ggugggagcagccg

SEQ ID NO: 3098756 - RNA, 15 nt, Mycobacterium bovis subsp bovis AF2122/97
ggugggagcagccga

SEQ ID NO: 3098757 - RNA, 12 nt, Mycobacterium bovis subsp bovis AF2122/97
ggugggcagcag

SEQ ID NO: 3098758 - RNA, 16 nt, Mycobacterium bovis subsp bovis AF2122/97
ggugggcagcagcugg

SEQ ID NO: 3098759 - RNA, 14 nt, Mycobacterium bovis subsp bovis AF2122/97
ggugggcagcaggc

SEQ ID NO: 3098760 - RNA, 17 nt, Mycobacterium bovis subsp bovis AF2122/97
ggugggcagcaggccca

SEQ ID NO: 3098761 - RNA, 15 nt, Mycobacterium bovis subsp bovis AF2122/97
ggugggccagcagca

SEQ ID NO: 3098762 - RNA, 19 nt, Mycobacterium bovis subsp bovis AF2122/97
ggugggcgcagagucaacg

SEQ ID NO: 3098763 - RNA, 22 nt, Mycobacterium bovis subsp bovis AF2122/97
ggugggcgggcaaucaccgccg

SEQ ID NO: 3098764 - RNA, 15 nt, Mycobacterium bovis subsp bovis AF2122/97
ggugggcgugacugg

SEQ ID NO: 3098765 - RNA, 14 nt, Mycobacterium bovis subsp bovis AF2122/97
ggugggcguggcug

SEQ ID NO: 3098766 - RNA, 19 nt, Mycobacterium bovis subsp bovis AF2122/97
ggugggcuaggucgcgcug

SEQ ID NO: 3098767 - RNA, 23 nt, Mycobacterium bovis subsp bovis AF2122/97
gguggggagcuauucggugucgc

SEQ ID NO: 3098768 - RNA, 14 nt, Mycobacterium bovis subsp bovis AF2122/97
gguggggauggcgc

SEQ ID NO: 3098769 - RNA, 18 nt, Mycobacterium bovis subsp bovis AF2122/97
gguggggauggcgcccag

SEQ ID NO: 3098770 - RNA, 16 nt, Mycobacterium bovis subsp bovis AF2122/97
gguggggccggcgucg

SEQ ID NO: 3098771 - RNA, 17 nt, Mycobacterium bovis subsp bovis AF2122/97
gguggggccggcgucga

SEQ ID NO: 3098772 - RNA, 22 nt, Mycobacterium bovis subsp bovis AF2122/97
gguggggcgcacgauggugugc

SEQ ID NO: 3098773 - RNA, 17 nt, Mycobacterium bovis subsp bovis AF2122/97
gguggggcgguggccgg

SEQ ID NO: 3098774 - RNA, 13 nt, Mycobacterium bovis subsp bovis AF2122/97
gguggggucgccg

SEQ ID NO: 3098775 - RNA, 23 nt, Mycobacterium bovis subsp bovis AF2122/97
ggugggucggggcggcauuggcg

SEQ ID NO: 3098776 - RNA, 13 nt, Mycobacterium bovis subsp bovis AF2122/97
ggugggugcagca

SEQ ID NO: 3098777 - RNA, 16 nt, Mycobacterium bovis subsp bovis AF2122/97
ggugguaagacgccga

SEQ ID NO: 3098778 - RNA, 14 nt, Mycobacterium bovis subsp bovis AF2122/97
ggugguaccggcgc

SEQ ID NO: 3098779 - RNA, 14 nt, Mycobacterium bovis subsp bovis AF2122/97
ggugguagcggcgg

SEQ ID NO: 3098780 - RNA, 15 nt, Mycobacterium bovis subsp bovis AF2122/97
ggugguagcggcggu

SEQ ID NO: 3098781 - RNA, 20 nt, Mycobacterium bovis subsp bovis AF2122/97
ggugguaucggcgugcuggc

SEQ ID NO: 3098782 - RNA, 14 nt, Mycobacterium bovis subsp bovis AF2122/97
gguggucaccacca

SEQ ID NO: 3098783 - RNA, 13 nt, Mycobacterium bovis subsp bovis AF2122/97
gguggucagcacc

SEQ ID NO: 3098784 - RNA, 17 nt, Mycobacterium bovis subsp bovis AF2122/97
gguggucagcaccggcg

SEQ ID NO: 3098785 - RNA, 14 nt, Mycobacterium bovis subsp bovis AF2122/97
gguggucagguugg

SEQ ID NO: 3098786 - RNA, 21 nt, Mycobacterium bovis subsp bovis AF2122/97
gguggucagguuggcacgcug

SEQ ID NO: 3098787 - RNA, 22 nt, Mycobacterium bovis subsp bovis AF2122/97
gguggucaguccgacaccggcg

SEQ ID NO: 3098788 - RNA, 17 nt, Mycobacterium bovis subsp bovis AF2122/97
gguggucccccgcagcc

SEQ ID NO: 3098789 - RNA, 22 nt, Mycobacterium bovis subsp bovis AF2122/97
gguggucccgauggcgaugcgc

SEQ ID NO: 3098790 - RNA, 12 nt, Mycobacterium bovis subsp bovis AF2122/97
ggugguccuggc

SEQ ID NO: 3098791 - RNA, 20 nt, Mycobacterium bovis subsp bovis AF2122/97
gguggucgcgaccgaccgca

SEQ ID NO: 3098792 - RNA, 12 nt, Mycobacterium bovis subsp bovis AF2122/97
gguggucggcga

SEQ ID NO: 3098793 - RNA, 14 nt, Mycobacterium bovis subsp bovis AF2122/97
gguggucgggcgca

SEQ ID NO: 3098794 - RNA, 13 nt, Mycobacterium bovis subsp bovis AF2122/97
gguggucgucccg

SEQ ID NO: 3098795 - RNA, 22 nt, Mycobacterium bovis subsp bovis AF2122/97
gguggucgucccgauggcggug

SEQ ID NO: 3098796 - RNA, 22 nt, Mycobacterium bovis subsp bovis AF2122/97
gguggucugccaaaagggcggc

SEQ ID NO: 3098797 - RNA, 23 nt, Mycobacterium bovis subsp bovis AF2122/97
gguggucugccaaaagggcggca

SEQ ID NO: 3098798 - RNA, 16 nt, Mycobacterium bovis subsp bovis AF2122/97
gguggucugcgcggug

SEQ ID NO: 3098799 - RNA, 18 nt, Mycobacterium bovis subsp bovis AF2122/97
gguggucuuggcccggcg

SEQ ID NO: 3098800 - RNA, 22 nt, Mycobacterium bovis subsp bovis AF2122/97
gguggugaccaaguagucgggu

SEQ ID NO: 3098801 - RNA, 14 nt, Mycobacterium bovis subsp bovis AF2122/97
gguggugacgucga

SEQ ID NO: 3098802 - RNA, 17 nt, Mycobacterium bovis subsp bovis AF2122/97
gguggugaguaccaauc

SEQ ID NO: 3098803 - RNA, 18 nt, Mycobacterium bovis subsp bovis AF2122/97
gguggugccaaccugggc

SEQ ID NO: 3098804 - RNA, 14 nt, Mycobacterium bovis subsp bovis AF2122/97
gguggugccggcgc

SEQ ID NO: 3098805 - RNA, 11 nt, Mycobacterium bovis subsp bovis AF2122/97
gguggugcucg

SEQ ID NO: 3098806 - RNA, 17 nt, Mycobacterium bovis subsp bovis AF2122/97
ggugguggccggggugc

SEQ ID NO: 3098807 - RNA, 12 nt, Mycobacterium bovis subsp bovis AF2122/97
ggugguggcggu

SEQ ID NO: 3098808 - RNA, 20 nt, Mycobacterium bovis subsp bovis AF2122/97
gguggugggccguggguguc

SEQ ID NO: 3098809 - RNA, 23 nt, Mycobacterium bovis subsp bovis AF2122/97
gguggugucagccaccggugagc

SEQ ID NO: 3098810 - RNA, 20 nt, Mycobacterium bovis subsp bovis AF2122/97
ggugguuagguggcuggcug

SEQ ID NO: 3098811 - RNA, 23 nt, Mycobacterium bovis subsp bovis AF2122/97
ggugguucaaccggacgaccgga

SEQ ID NO: 3098812 - RNA, 14 nt, Mycobacterium bovis subsp bovis AF2122/97
ggugguuccgcgcg

SEQ ID NO: 3098813 - RNA, 15 nt, Mycobacterium bovis subsp bovis AF2122/97
ggugguuguggcggg

SEQ ID NO: 3098814 - RNA, 17 nt, Mycobacterium bovis subsp bovis AF2122/97
gguguaauugccgacgc

SEQ ID NO: 3098815 - RNA, 16 nt, Mycobacterium bovis subsp bovis AF2122/97
gguguacaggucgccg

SEQ ID NO: 3098816 - RNA, 14 nt, Mycobacterium bovis subsp bovis AF2122/97
gguguacagucgcg

SEQ ID NO: 3098817 - RNA, 23 nt, Mycobacterium bovis subsp bovis AF2122/97
gguguacagucgcgcgcucgcgg

SEQ ID NO: 3098818 - RNA, 22 nt, Mycobacterium bovis subsp bovis AF2122/97
gguguacauaucgaagcucgcg

SEQ ID NO: 3098819 - RNA, 20 nt, Mycobacterium bovis subsp bovis AF2122/97
gguguacccgccucgggccg

SEQ ID NO: 3098820 - RNA, 20 nt, Mycobacterium bovis subsp bovis AF2122/97
gguguagaagcgggcgucgc

SEQ ID NO: 3098821 - RNA, 13 nt, Mycobacterium bovis subsp bovis AF2122/97
gguguagagagcc

SEQ ID NO: 3098822 - RNA, 18 nt, Mycobacterium bovis subsp bovis AF2122/97
gguguagagcgcaccgcg

SEQ ID NO: 3098823 - RNA, 19 nt, Mycobacterium bovis subsp bovis AF2122/97
gguguagcaagucgccgag

SEQ ID NO: 3098824 - RNA, 20 nt, Mycobacterium bovis subsp bovis AF2122/97
gguguagcaagucgccgagg

SEQ ID NO: 3098825 - RNA, 13 nt, Mycobacterium bovis subsp bovis AF2122/97
gguguagcagcgc

SEQ ID NO: 3098826 - RNA, 18 nt, Mycobacterium bovis subsp bovis AF2122/97
gguguagcccagccgggu

SEQ ID NO: 3098827 - RNA, 21 nt, Mycobacterium bovis subsp bovis AF2122/97
gguguagcccagccgggugga

SEQ ID NO: 3098828 - RNA, 13 nt, Mycobacterium bovis subsp bovis AF2122/97
gguguagccgccg

SEQ ID NO: 3098829 - RNA, 17 nt, Mycobacterium bovis subsp bovis AF2122/97
gguguagccggcgccgc

SEQ ID NO: 3098830 - RNA, 14 nt, Mycobacterium bovis subsp bovis AF2122/97
gguguagggcggcg

SEQ ID NO: 3098831 - RNA, 15 nt, Mycobacterium bovis subsp bovis AF2122/97
gguguaucgacggcg

SEQ ID NO: 3098832 - RNA, 18 nt, Mycobacterium bovis subsp bovis AF2122/97
ggugucaaugacaccggg

SEQ ID NO: 3098833 - RNA, 17 nt, Mycobacterium bovis subsp bovis AF2122/97
ggugucacagugguggg

SEQ ID NO: 3098834 - RNA, 23 nt, Mycobacterium bovis subsp bovis AF2122/97
ggugucacgcccaugaccggccg

SEQ ID NO: 3098835 - RNA, 16 nt, Mycobacterium bovis subsp bovis AF2122/97
gguguccaccaccggc

SEQ ID NO: 3098836 - RNA, 18 nt, Mycobacterium bovis subsp bovis AF2122/97
gguguccagccacgcugu

SEQ ID NO: 3098837 - RNA, 15 nt, Mycobacterium bovis subsp bovis AF2122/97
gguguccgagcggcc

SEQ ID NO: 3098838 - RNA, 20 nt, Mycobacterium bovis subsp bovis AF2122/97
gguguccucgaccgucacgc

SEQ ID NO: 3098839 - RNA, 14 nt, Mycobacterium bovis subsp bovis AF2122/97
gguguccuuggccg

SEQ ID NO: 3098840 - RNA, 15 nt, Mycobacterium bovis subsp bovis AF2122/97
ggugucgaagagcag

SEQ ID NO: 3098841 - RNA, 13 nt, Mycobacterium bovis subsp bovis AF2122/97
ggugucgacgcgg

SEQ ID NO: 3098842 - RNA, 23 nt, Mycobacterium bovis subsp bovis AF2122/97
ggugucgacggggaacguccgcg

SEQ ID NO: 3098843 - RNA, 17 nt, Mycobacterium bovis subsp bovis AF2122/97
ggugucgaucguugccg

SEQ ID NO: 3098844 - RNA, 13 nt, Mycobacterium bovis subsp bovis AF2122/97
ggugucgaugccg

SEQ ID NO: 3098845 - RNA, 16 nt, Mycobacterium bovis subsp bovis AF2122/97
ggugucgaugcgcagc

SEQ ID NO: 3098846 - RNA, 17 nt, Mycobacterium bovis subsp bovis AF2122/97
ggugucgaugcgcagcc

SEQ ID NO: 3098847 - RNA, 19 nt, Mycobacterium bovis subsp bovis AF2122/97
ggugucgaugcgcagcccg

SEQ ID NO: 3098848 - RNA, 19 nt, Mycobacterium bovis subsp bovis AF2122/97
ggugucgaugcugaacacg

SEQ ID NO: 3098849 - RNA, 18 nt, Mycobacterium bovis subsp bovis AF2122/97
ggugucgauuggcucgcc

SEQ ID NO: 3098850 - RNA, 17 nt, Mycobacterium bovis subsp bovis AF2122/97
ggugucgcgcucagccg

SEQ ID NO: 3098851 - RNA, 13 nt, Mycobacterium bovis subsp bovis AF2122/97
ggugucgcggccg

SEQ ID NO: 3098852 - RNA, 14 nt, Mycobacterium bovis subsp bovis AF2122/97
ggugucgcggccgc

SEQ ID NO: 3098853 - RNA, 17 nt, Mycobacterium bovis subsp bovis AF2122/97
ggugucggaaugggcgc

SEQ ID NO: 3098854 - RNA, 19 nt, Mycobacterium bovis subsp bovis AF2122/97
ggugucggaaugggcgcca

SEQ ID NO: 3098855 - RNA, 16 nt, Mycobacterium bovis subsp bovis AF2122/97
ggugucggccagcaac

SEQ ID NO: 3098856 - RNA, 21 nt, Mycobacterium bovis subsp bovis AF2122/97
ggugucggcgagagggcgggg

SEQ ID NO: 3098857 - RNA, 14 nt, Mycobacterium bovis subsp bovis AF2122/97
ggugucggcgccga

SEQ ID NO: 3098858 - RNA, 14 nt, Mycobacterium bovis subsp bovis AF2122/97
ggugucgggcagca

SEQ ID NO: 3098859 - RNA, 14 nt, Mycobacterium bovis subsp bovis AF2122/97
ggugucgggcgcgc

SEQ ID NO: 3098860 - RNA, 17 nt, Mycobacterium bovis subsp bovis AF2122/97
ggugucggggcccccgc

SEQ ID NO: 3098861 - RNA, 22 nt, Mycobacterium bovis subsp bovis AF2122/97
ggugucggugguaccggcggcg

SEQ ID NO: 3098862 - RNA, 21 nt, Mycobacterium bovis subsp bovis AF2122/97
ggugucgucaucggggccugc

SEQ ID NO: 3098863 - RNA, 16 nt, Mycobacterium bovis subsp bovis AF2122/97
ggugucgucgaucgcg

SEQ ID NO: 3098864 - RNA, 17 nt, Mycobacterium bovis subsp bovis AF2122/97
ggugucgucgaucgcgg

SEQ ID NO: 3098865 - RNA, 16 nt, Mycobacterium bovis subsp bovis AF2122/97
ggugucuugggcgucc

SEQ ID NO: 3098866 - RNA, 14 nt, Mycobacterium bovis subsp bovis AF2122/97
ggugugcaucgccg

SEQ ID NO: 3098867 - RNA, 15 nt, Mycobacterium bovis subsp bovis AF2122/97
ggugugcgacgacgg

SEQ ID NO: 3098868 - RNA, 17 nt, Mycobacterium bovis subsp bovis AF2122/97
ggugugcgacgacggcg

SEQ ID NO: 3098869 - RNA, 12 nt, Mycobacterium bovis subsp bovis AF2122/97
ggugugcgcgcc

SEQ ID NO: 3098870 - RNA, 13 nt, Mycobacterium bovis subsp bovis AF2122/97
ggugugcgcgcca

SEQ ID NO: 3098871 - RNA, 15 nt, Mycobacterium bovis subsp bovis AF2122/97
ggugugcggcagccc

SEQ ID NO: 3098872 - RNA, 15 nt, Mycobacterium bovis subsp bovis AF2122/97
ggugugcgggcggug

SEQ ID NO: 3098873 - RNA, 13 nt, Mycobacterium bovis subsp bovis AF2122/97
ggugugcucgccg

SEQ ID NO: 3098874 - RNA, 14 nt, Mycobacterium bovis subsp bovis AF2122/97
ggugugcucgccga

SEQ ID NO: 3098875 - RNA, 23 nt, Mycobacterium bovis subsp bovis AF2122/97
ggugugcugccaccggccggcgc

SEQ ID NO: 3098876 - RNA, 22 nt, Mycobacterium bovis subsp bovis AF2122/97
gguguggaauacgcugcugguc

SEQ ID NO: 3098877 - RNA, 16 nt, Mycobacterium bovis subsp bovis AF2122/97
gguguggacugggcca

SEQ ID NO: 3098878 - RNA, 19 nt, Mycobacterium bovis subsp bovis AF2122/97
gguguggacuucagcaggc

SEQ ID NO: 3098879 - RNA, 13 nt, Mycobacterium bovis subsp bovis AF2122/97
gguguggucacca

SEQ ID NO: 3098880 - RNA, 15 nt, Mycobacterium bovis subsp bovis AF2122/97
gguguggucaccagg

SEQ ID NO: 3098881 - RNA, 20 nt, Mycobacterium bovis subsp bovis AF2122/97
gguguggucaccaggccgaa

SEQ ID NO: 3098882 - RNA, 14 nt, Mycobacterium bovis subsp bovis AF2122/97
gguguggucggugg

SEQ ID NO: 3098883 - RNA, 16 nt, Mycobacterium bovis subsp bovis AF2122/97
gguguggucgguggcg

SEQ ID NO: 3098884 - RNA, 13 nt, Mycobacterium bovis subsp bovis AF2122/97
ggugugucccggg

SEQ ID NO: 3098885 - RNA, 17 nt, Mycobacterium bovis subsp bovis AF2122/97
ggugugucccgggguga

SEQ ID NO: 3098886 - RNA, 15 nt, Mycobacterium bovis subsp bovis AF2122/97
gguguguggcgccgg

SEQ ID NO: 3098887 - RNA, 15 nt, Mycobacterium bovis subsp bovis AF2122/97
gguguguucggcccg

SEQ ID NO: 3098888 - RNA, 22 nt, Mycobacterium bovis subsp bovis AF2122/97
gguguguuuggcauggucaggc

SEQ ID NO: 3098889 - RNA, 20 nt, Mycobacterium bovis subsp bovis AF2122/97
gguguuagugaggcccgagu

SEQ ID NO: 3098890 - RNA, 22 nt, Mycobacterium bovis subsp bovis AF2122/97
gguguuauugaugcccgacuga

SEQ ID NO: 3098891 - RNA, 19 nt, Mycobacterium bovis subsp bovis AF2122/97
gguguucaucacgccgccg

SEQ ID NO: 3098892 - RNA, 15 nt, Mycobacterium bovis subsp bovis AF2122/97
gguguuccaggucau

SEQ ID NO: 3098893 - RNA, 17 nt, Mycobacterium bovis subsp bovis AF2122/97
gguguucgaugggugca

SEQ ID NO: 3098894 - RNA, 15 nt, Mycobacterium bovis subsp bovis AF2122/97
gguguucgggcagcu

SEQ ID NO: 3098895 - RNA, 16 nt, Mycobacterium bovis subsp bovis AF2122/97
gguguugacgauccgg

SEQ ID NO: 3098896 - RNA, 16 nt, Mycobacterium bovis subsp bovis AF2122/97
gguguugagcgaaccc

SEQ ID NO: 3098897 - RNA, 20 nt, Mycobacterium bovis subsp bovis AF2122/97
gguguugagcgaacccgcgu

SEQ ID NO: 3098898 - RNA, 13 nt, Mycobacterium bovis subsp bovis AF2122/97
gguguugaggccg

SEQ ID NO: 3098899 - RNA, 17 nt, Mycobacterium bovis subsp bovis AF2122/97
gguguugaggccgguga

SEQ ID NO: 3098900 - RNA, 19 nt, Mycobacterium bovis subsp bovis AF2122/97
gguguugaugggcagccgc

SEQ ID NO: 3098901 - RNA, 13 nt, Mycobacterium bovis subsp bovis AF2122/97
gguguugcacgag

SEQ ID NO: 3098902 - RNA, 14 nt, Mycobacterium bovis subsp bovis AF2122/97
gguguugccggaga

SEQ ID NO: 3098903 - RNA, 23 nt, Mycobacterium bovis subsp bovis AF2122/97
gguguugccggagacgucgccgc

SEQ ID NO: 3098904 - RNA, 21 nt, Mycobacterium bovis subsp bovis AF2122/97
gguguugcggcugaccuccca

SEQ ID NO: 3098905 - RNA, 13 nt, Mycobacterium bovis subsp bovis AF2122/97
gguguugcggugg

SEQ ID NO: 3098906 - RNA, 15 nt, Mycobacterium bovis subsp bovis AF2122/97
gguguuggugcgggg

SEQ ID NO: 3098907 - RNA, 21 nt, Mycobacterium bovis subsp bovis AF2122/97
gguguuuauggcccugggccc

SEQ ID NO: 3098908 - RNA, 22 nt, Mycobacterium bovis subsp bovis AF2122/97
gguguuuccgaaacccgccgcg

SEQ ID NO: 3098909 - RNA, 15 nt, Mycobacterium bovis subsp bovis AF2122/97
gguguuuggccgccg

SEQ ID NO: 3098910 - RNA, 11 nt, Mycobacterium bovis subsp bovis AF2122/97
gguguuuuugu

SEQ ID NO: 3098911 - RNA, 18 nt, Mycobacterium bovis subsp bovis AF2122/97
gguuacaacuggacgggg

SEQ ID NO: 3098912 - RNA, 13 nt, Mycobacterium bovis subsp bovis AF2122/97
gguuagcgcggcc

SEQ ID NO: 3098913 - RNA, 15 nt, Mycobacterium bovis subsp bovis AF2122/97
gguuagugucguagg

SEQ ID NO: 3098914 - RNA, 16 nt, Mycobacterium bovis subsp bovis AF2122/97
gguuaucccagacugu

SEQ ID NO: 3098915 - RNA, 15 nt, Mycobacterium bovis subsp bovis AF2122/97
gguuaucggcagcag

SEQ ID NO: 3098916 - RNA, 16 nt, Mycobacterium bovis subsp bovis AF2122/97
gguuauguauccgcgc

SEQ ID NO: 3098917 - RNA, 18 nt, Mycobacterium bovis subsp bovis AF2122/97
gguuauguauccgcgccg

SEQ ID NO: 3098918 - RNA, 11 nt, Mycobacterium bovis subsp bovis AF2122/97
gguucaaagca

SEQ ID NO: 3098919 - RNA, 20 nt, Mycobacterium bovis subsp bovis AF2122/97
gguucaaagcagcgcaccaa

SEQ ID NO: 3098920 - RNA, 15 nt, Mycobacterium bovis subsp bovis AF2122/97
gguucaccacgucgu

SEQ ID NO: 3098921 - RNA, 19 nt, Mycobacterium bovis subsp bovis AF2122/97
gguucaccaugucggccac

SEQ ID NO: 3098922 - RNA, 13 nt, Mycobacterium bovis subsp bovis AF2122/97
gguucaccucccc

SEQ ID NO: 3098923 - RNA, 18 nt, Mycobacterium bovis subsp bovis AF2122/97
gguucaccucggcgacga

SEQ ID NO: 3098924 - RNA, 22 nt, Mycobacterium bovis subsp bovis AF2122/97
gguucacuuccgggcagcuggg

SEQ ID NO: 3098925 - RNA, 20 nt, Mycobacterium bovis subsp bovis AF2122/97
gguucagggguggcgcgggc

SEQ ID NO: 3098926 - RNA, 22 nt, Mycobacterium bovis subsp bovis AF2122/97
gguucaucaagguguugcggug

SEQ ID NO: 3098927 - RNA, 23 nt, Mycobacterium bovis subsp bovis AF2122/97
gguucaucaagguguugcggugg

SEQ ID NO: 3098928 - RNA, 13 nt, Mycobacterium bovis subsp bovis AF2122/97
gguucaucgccgg

SEQ ID NO: 3098929 - RNA, 16 nt, Mycobacterium bovis subsp bovis AF2122/97
gguucaucgccggcgc

SEQ ID NO: 3098930 - RNA, 19 nt, Mycobacterium bovis subsp bovis AF2122/97
gguucaucgccggcgcgcc

SEQ ID NO: 3098931 - RNA, 21 nt, Mycobacterium bovis subsp bovis AF2122/97
gguucaucgccggcgcgccga

SEQ ID NO: 3098932 - RNA, 16 nt, Mycobacterium bovis subsp bovis AF2122/97
gguucaugaacaucgg

SEQ ID NO: 3098933 - RNA, 23 nt, Mycobacterium bovis subsp bovis AF2122/97
gguucaugcaaaagccgcgaucg

SEQ ID NO: 3098934 - RNA, 16 nt, Mycobacterium bovis subsp bovis AF2122/97
gguuccacgcugccca

SEQ ID NO: 3098935 - RNA, 15 nt, Mycobacterium bovis subsp bovis AF2122/97
gguuccacggccagg

SEQ ID NO: 3098936 - RNA, 13 nt, Mycobacterium bovis subsp bovis AF2122/97
gguuccacucccc

SEQ ID NO: 3098937 - RNA, 19 nt, Mycobacterium bovis subsp bovis AF2122/97
gguuccauacagccgccga

SEQ ID NO: 3098938 - RNA, 15 nt, Mycobacterium bovis subsp bovis AF2122/97
gguucccgacaucgu

SEQ ID NO: 3098939 - RNA, 17 nt, Mycobacterium bovis subsp bovis AF2122/97
gguucccgggcagccgc

SEQ ID NO: 3098940 - RNA, 18 nt, Mycobacterium bovis subsp bovis AF2122/97
gguucccgggcagccgca

SEQ ID NO: 3098941 - RNA, 22 nt, Mycobacterium bovis subsp bovis AF2122/97
gguuccgaucgcguuagccagg

SEQ ID NO: 3098942 - RNA, 23 nt, Mycobacterium bovis subsp bovis AF2122/97
gguuccgcaaugaccuggccgcc

SEQ ID NO: 3098943 - RNA, 23 nt, Mycobacterium bovis subsp bovis AF2122/97
gguuccgccaggccgaccgcgca

SEQ ID NO: 3098944 - RNA, 15 nt, Mycobacterium bovis subsp bovis AF2122/97
gguuccgccggcccc

SEQ ID NO: 3098945 - RNA, 18 nt, Mycobacterium bovis subsp bovis AF2122/97
gguuccgcugucgagccg

SEQ ID NO: 3098946 - RNA, 20 nt, Mycobacterium bovis subsp bovis AF2122/97
gguuccgcugucgagccggu

SEQ ID NO: 3098947 - RNA, 13 nt, Mycobacterium bovis subsp bovis AF2122/97
gguuccggccggc

SEQ ID NO: 3098948 - RNA, 22 nt, Mycobacterium bovis subsp bovis AF2122/97
gguuccggcuucguccaccgcg

SEQ ID NO: 3098949 - RNA, 16 nt, Mycobacterium bovis subsp bovis AF2122/97
gguuccguugaugccg

SEQ ID NO: 3098950 - RNA, 20 nt, Mycobacterium bovis subsp bovis AF2122/97
gguucgaacgcgaucgaccu

SEQ ID NO: 3098951 - RNA, 19 nt, Mycobacterium bovis subsp bovis AF2122/97
gguucgacggacacccugg

SEQ ID NO: 3098952 - RNA, 15 nt, Mycobacterium bovis subsp bovis AF2122/97
gguucgagggugacc

SEQ ID NO: 3098953 - RNA, 15 nt, Mycobacterium bovis subsp bovis AF2122/97
gguucgaucgcggug

SEQ ID NO: 3098954 - RNA, 23 nt, Mycobacterium bovis subsp bovis AF2122/97
gguucgaucgcggugaccggcuc

SEQ ID NO: 3098955 - RNA, 20 nt, Mycobacterium bovis subsp bovis AF2122/97
gguucgcacaccuccucgac

SEQ ID NO: 3098956 - RNA, 16 nt, Mycobacterium bovis subsp bovis AF2122/97
gguucgccccugcaca

SEQ ID NO: 3098957 - RNA, 20 nt, Mycobacterium bovis subsp bovis AF2122/97
gguucgccccugcacagcag

SEQ ID NO: 3098958 - RNA, 15 nt, Mycobacterium bovis subsp bovis AF2122/97
gguucgcgguugucc

SEQ ID NO: 3098959 - RNA, 23 nt, Mycobacterium bovis subsp bovis AF2122/97
gguucgcgucugacaucgucgac

SEQ ID NO: 3098960 - RNA, 16 nt, Mycobacterium bovis subsp bovis AF2122/97
gguucgcucugguguc

SEQ ID NO: 3098961 - RNA, 16 nt, Mycobacterium bovis subsp bovis AF2122/97
gguucggacacacagg

SEQ ID NO: 3098962 - RNA, 14 nt, Mycobacterium bovis subsp bovis AF2122/97
gguucggccagaac

SEQ ID NO: 3098963 - RNA, 22 nt, Mycobacterium bovis subsp bovis AF2122/97
gguucggcgaucuccggcggau

SEQ ID NO: 3098964 - RNA, 14 nt, Mycobacterium bovis subsp bovis AF2122/97
gguucgucaggucc

SEQ ID NO: 3098965 - RNA, 16 nt, Mycobacterium bovis subsp bovis AF2122/97
gguucgucagguccgg

SEQ ID NO: 3098966 - RNA, 19 nt, Mycobacterium bovis subsp bovis AF2122/97
gguucugcgcccacccgcg

SEQ ID NO: 3098967 - RNA, 18 nt, Mycobacterium bovis subsp bovis AF2122/97
gguucugggccugcggca

SEQ ID NO: 3098968 - RNA, 17 nt, Mycobacterium bovis subsp bovis AF2122/97
gguucuuccacagcgcg

SEQ ID NO: 3098969 - RNA, 14 nt, Mycobacterium bovis subsp bovis AF2122/97
gguucuucgaauag

SEQ ID NO: 3098970 - RNA, 16 nt, Mycobacterium bovis subsp bovis AF2122/97
gguucuucgacgcggc

SEQ ID NO: 3098971 - RNA, 15 nt, Mycobacterium bovis subsp bovis AF2122/97
gguucuugaccagca

SEQ ID NO: 3098972 - RNA, 21 nt, Mycobacterium bovis subsp bovis AF2122/97
gguugaacauguccagugccg

SEQ ID NO: 3098973 - RNA, 18 nt, Mycobacterium bovis subsp bovis AF2122/97
gguugaacgaccucugca

SEQ ID NO: 3098974 - RNA, 17 nt, Mycobacterium bovis subsp bovis AF2122/97
gguugaaguugggaagu

SEQ ID NO: 3098975 - RNA, 15 nt, Mycobacterium bovis subsp bovis AF2122/97
gguugaccaccagcg

SEQ ID NO: 3098976 - RNA, 16 nt, Mycobacterium bovis subsp bovis AF2122/97
gguugacccccgggua

SEQ ID NO: 3098977 - RNA, 18 nt, Mycobacterium bovis subsp bovis AF2122/97
gguugacccggcagcccg

SEQ ID NO: 3098978 - RNA, 14 nt, Mycobacterium bovis subsp bovis AF2122/97
gguugaccgccacc

SEQ ID NO: 3098979 - RNA, 22 nt, Mycobacterium bovis subsp bovis AF2122/97
gguugaccgccaccccggucgg

SEQ ID NO: 3098980 - RNA, 22 nt, Mycobacterium bovis subsp bovis AF2122/97
gguugaccguggucggaggugg

SEQ ID NO: 3098981 - RNA, 18 nt, Mycobacterium bovis subsp bovis AF2122/97
gguugacgccgguccccg

SEQ ID NO: 3098982 - RNA, 15 nt, Mycobacterium bovis subsp bovis AF2122/97
gguugacgggcucgg

SEQ ID NO: 3098983 - RNA, 17 nt, Mycobacterium bovis subsp bovis AF2122/97
gguugacgucaggcuga

SEQ ID NO: 3098984 - RNA, 18 nt, Mycobacterium bovis subsp bovis AF2122/97
gguugagauggucaccgg

SEQ ID NO: 3098985 - RNA, 15 nt, Mycobacterium bovis subsp bovis AF2122/97
gguugagccgccgcg

SEQ ID NO: 3098986 - RNA, 12 nt, Mycobacterium bovis subsp bovis AF2122/97
gguugaucggcc

SEQ ID NO: 3098987 - RNA, 15 nt, Mycobacterium bovis subsp bovis AF2122/97
gguugaucggccacg

SEQ ID NO: 3098988 - RNA, 15 nt, Mycobacterium bovis subsp bovis AF2122/97
gguugaucuuguccu

SEQ ID NO: 3098989 - RNA, 17 nt, Mycobacterium bovis subsp bovis AF2122/97
gguugaugaaggucaac

SEQ ID NO: 3098990 - RNA, 20 nt, Mycobacterium bovis subsp bovis AF2122/97
gguugaugaaggucaacagc

SEQ ID NO: 3098991 - RNA, 18 nt, Mycobacterium bovis subsp bovis AF2122/97
gguugaugacggcgucga

SEQ ID NO: 3098992 - RNA, 18 nt, Mycobacterium bovis subsp bovis AF2122/97
gguugauggaguggcugu

SEQ ID NO: 3098993 - RNA, 16 nt, Mycobacterium bovis subsp bovis AF2122/97
gguugcaaaccgcugc

SEQ ID NO: 3098994 - RNA, 17 nt, Mycobacterium bovis subsp bovis AF2122/97
gguugcaaaccgcugcg

SEQ ID NO: 3098995 - RNA, 15 nt, Mycobacterium bovis subsp bovis AF2122/97
gguugcauaccgccg

SEQ ID NO: 3098996 - RNA, 23 nt, Mycobacterium bovis subsp bovis AF2122/97
gguugccaccugugcgaacagcg

SEQ ID NO: 3098997 - RNA, 16 nt, Mycobacterium bovis subsp bovis AF2122/97
gguugcccccagggcc

SEQ ID NO: 3098998 - RNA, 23 nt, Mycobacterium bovis subsp bovis AF2122/97
gguugccccgaagcgggcggaaa

SEQ ID NO: 3098999 - RNA, 13 nt, Mycobacterium bovis subsp bovis AF2122/97
gguugccccgacc

SEQ ID NO: 3099000 - RNA, 15 nt, Mycobacterium bovis subsp bovis AF2122/97
gguugccccggcgac

SEQ ID NO: 3099001 - RNA, 21 nt, Mycobacterium bovis subsp bovis AF2122/97
gguugccccggcgacccgguc

SEQ ID NO: 3099002 - RNA, 23 nt, Mycobacterium bovis subsp bovis AF2122/97
gguugcccgagcggcugagccgc

SEQ ID NO: 3099003 - RNA, 11 nt, Mycobacterium bovis subsp bovis AF2122/97
gguugcccuug

SEQ ID NO: 3099004 - RNA, 14 nt, Mycobacterium bovis subsp bovis AF2122/97
gguugccgaagccg

SEQ ID NO: 3099005 - RNA, 14 nt, Mycobacterium bovis subsp bovis AF2122/97
gguugccggcggcg

SEQ ID NO: 3099006 - RNA, 15 nt, Mycobacterium bovis subsp bovis AF2122/97
gguugccggcggcga

SEQ ID NO: 3099007 - RNA, 23 nt, Mycobacterium bovis subsp bovis AF2122/97
gguugccgucagggucagcuggg

SEQ ID NO: 3099008 - RNA, 16 nt, Mycobacterium bovis subsp bovis AF2122/97
gguugccgucugcggu

SEQ ID NO: 3099009 - RNA, 18 nt, Mycobacterium bovis subsp bovis AF2122/97
gguugccuuugcggcggg

SEQ ID NO: 3099010 - RNA, 12 nt, Mycobacterium bovis subsp bovis AF2122/97
gguugcgacgaa

SEQ ID NO: 3099011 - RNA, 21 nt, Mycobacterium bovis subsp bovis AF2122/97
gguugcgacgugaccggcaau

SEQ ID NO: 3099012 - RNA, 14 nt, Mycobacterium bovis subsp bovis AF2122/97
gguugcgccaggaa

SEQ ID NO: 3099013 - RNA, 19 nt, Mycobacterium bovis subsp bovis AF2122/97
gguugcgccaggaaccgca

SEQ ID NO: 3099014 - RNA, 15 nt, Mycobacterium bovis subsp bovis AF2122/97
gguugcggcagcugg

SEQ ID NO: 3099015 - RNA, 19 nt, Mycobacterium bovis subsp bovis AF2122/97
gguugcggcagcuggcgca

SEQ ID NO: 3099016 - RNA, 14 nt, Mycobacterium bovis subsp bovis AF2122/97
gguugcguccgccg

SEQ ID NO: 3099017 - RNA, 23 nt, Mycobacterium bovis subsp bovis AF2122/97
gguugcucgagcgguggcgucgu

SEQ ID NO: 3099018 - RNA, 16 nt, Mycobacterium bovis subsp bovis AF2122/97
gguugcucgcgaucgc

SEQ ID NO: 3099019 - RNA, 13 nt, Mycobacterium bovis subsp bovis AF2122/97
gguugcugcgcga

SEQ ID NO: 3099020 - RNA, 17 nt, Mycobacterium bovis subsp bovis AF2122/97
gguugcugugucguggu

SEQ ID NO: 3099021 - RNA, 23 nt, Mycobacterium bovis subsp bovis AF2122/97
gguuggagaagauuuucucggug

SEQ ID NO: 3099022 - RNA, 12 nt, Mycobacterium bovis subsp bovis AF2122/97
gguuggagcccg

SEQ ID NO: 3099023 - RNA, 20 nt, Mycobacterium bovis subsp bovis AF2122/97
gguuggagcgccagccgcug

SEQ ID NO: 3099024 - RNA, 16 nt, Mycobacterium bovis subsp bovis AF2122/97
gguuggauacggugcg

SEQ ID NO: 3099025 - RNA, 21 nt, Mycobacterium bovis subsp bovis AF2122/97
gguuggcaagcacggcgucga

SEQ ID NO: 3099026 - RNA, 23 nt, Mycobacterium bovis subsp bovis AF2122/97
gguuggcacgcaacaccgccaac

SEQ ID NO: 3099027 - RNA, 15 nt, Mycobacterium bovis subsp bovis AF2122/97
gguuggcagccacgg

SEQ ID NO: 3099028 - RNA, 23 nt, Mycobacterium bovis subsp bovis AF2122/97
gguuggcagccacggguagcugc

SEQ ID NO: 3099029 - RNA, 23 nt, Mycobacterium bovis subsp bovis AF2122/97
gguuggcauccaaaaucgccuga

SEQ ID NO: 3099030 - RNA, 14 nt, Mycobacterium bovis subsp bovis AF2122/97
gguuggccaccagc

SEQ ID NO: 3099031 - RNA, 18 nt, Mycobacterium bovis subsp bovis AF2122/97
gguuggccgaacagcugc

SEQ ID NO: 3099032 - RNA, 22 nt, Mycobacterium bovis subsp bovis AF2122/97
gguuggccgauaaaggucacuc

SEQ ID NO: 3099033 - RNA, 19 nt, Mycobacterium bovis subsp bovis AF2122/97
gguuggccguggucgaggu

SEQ ID NO: 3099034 - RNA, 15 nt, Mycobacterium bovis subsp bovis AF2122/97
gguuggcgacgauca

SEQ ID NO: 3099035 - RNA, 15 nt, Mycobacterium bovis subsp bovis AF2122/97
gguuggcggcgaugg

SEQ ID NO: 3099036 - RNA, 14 nt, Mycobacterium bovis subsp bovis AF2122/97
gguuggcucggcgc

SEQ ID NO: 3099037 - RNA, 15 nt, Mycobacterium bovis subsp bovis AF2122/97
gguuggcucggcgca

SEQ ID NO: 3099038 - RNA, 12 nt, Mycobacterium bovis subsp bovis AF2122/97
gguugggguggc

SEQ ID NO: 3099039 - RNA, 16 nt, Mycobacterium bovis subsp bovis AF2122/97
gguugggguggcggug

SEQ ID NO: 3099040 - RNA, 17 nt, Mycobacterium bovis subsp bovis AF2122/97
gguugggguggcggugc

SEQ ID NO: 3099041 - RNA, 14 nt, Mycobacterium bovis subsp bovis AF2122/97
gguuggucccgaug

SEQ ID NO: 3099042 - RNA, 15 nt, Mycobacterium bovis subsp bovis AF2122/97
gguugguccgccguc

SEQ ID NO: 3099043 - RNA, 15 nt, Mycobacterium bovis subsp bovis AF2122/97
gguuggucggugcug

SEQ ID NO: 3099044 - RNA, 15 nt, Mycobacterium bovis subsp bovis AF2122/97
gguuggucgucgcgu

SEQ ID NO: 3099045 - RNA, 16 nt, Mycobacterium bovis subsp bovis AF2122/97
gguuggucgucgcgug

SEQ ID NO: 3099046 - RNA, 17 nt, Mycobacterium bovis subsp bovis AF2122/97
gguuguagacggcaccc

SEQ ID NO: 3099047 - RNA, 19 nt, Mycobacterium bovis subsp bovis AF2122/97
gguuguagacggcaccccc

SEQ ID NO: 3099048 - RNA, 13 nt, Mycobacterium bovis subsp bovis AF2122/97
gguuguccucggc

SEQ ID NO: 3099049 - RNA, 12 nt, Mycobacterium bovis subsp bovis AF2122/97
gguugucgcggu

SEQ ID NO: 3099050 - RNA, 13 nt, Mycobacterium bovis subsp bovis AF2122/97
gguugucggcgac

SEQ ID NO: 3099051 - RNA, 17 nt, Mycobacterium bovis subsp bovis AF2122/97
gguugucggcgaccccg

SEQ ID NO: 3099052 - RNA, 13 nt, Mycobacterium bovis subsp bovis AF2122/97
gguugucggcgau

SEQ ID NO: 3099053 - RNA, 21 nt, Mycobacterium bovis subsp bovis AF2122/97
gguugucgucggugggcguga

SEQ ID NO: 3099054 - RNA, 20 nt, Mycobacterium bovis subsp bovis AF2122/97
gguugucguugcuggugugc

SEQ ID NO: 3099055 - RNA, 17 nt, Mycobacterium bovis subsp bovis AF2122/97
gguuguggaaccacggc

SEQ ID NO: 3099056 - RNA, 17 nt, Mycobacterium bovis subsp bovis AF2122/97
gguugugucggccuggc

SEQ ID NO: 3099057 - RNA, 19 nt, Mycobacterium bovis subsp bovis AF2122/97
gguuguucggcagccaugc

SEQ ID NO: 3099058 - RNA, 16 nt, Mycobacterium bovis subsp bovis AF2122/97
gguuucaccgacgacg

SEQ ID NO: 3099059 - RNA, 17 nt, Mycobacterium bovis subsp bovis AF2122/97
gguuuccggccugcacg

SEQ ID NO: 3099060 - RNA, 20 nt, Mycobacterium bovis subsp bovis AF2122/97
gguuuccggccugcacggcg

SEQ ID NO: 3099061 - RNA, 18 nt, Mycobacterium bovis subsp bovis AF2122/97
gguuuccuccggcagcag

SEQ ID NO: 3099062 - RNA, 22 nt, Mycobacterium bovis subsp bovis AF2122/97
gguuucgaauguuucggcgaua

SEQ ID NO: 3099063 - RNA, 14 nt, Mycobacterium bovis subsp bovis AF2122/97
gguuucggggacca

SEQ ID NO: 3099064 - RNA, 13 nt, Mycobacterium bovis subsp bovis AF2122/97
gguuucuuucggc

SEQ ID NO: 3099065 - RNA, 17 nt, Mycobacterium bovis subsp bovis AF2122/97
gguuugcaccgcggcca

SEQ ID NO: 3099066 - RNA, 21 nt, Mycobacterium bovis subsp bovis AF2122/97
gguuugcacggcgcgccagaa

SEQ ID NO: 3099067 - RNA, 17 nt, Mycobacterium bovis subsp bovis AF2122/97
gguuugccggcgguggc

SEQ ID NO: 3099068 - RNA, 12 nt, Mycobacterium bovis subsp bovis AF2122/97
gguuugcggugc

SEQ ID NO: 3099069 - RNA, 14 nt, Mycobacterium bovis subsp bovis AF2122/97
gguuugcguccugg

SEQ ID NO: 3099070 - RNA, 15 nt, Mycobacterium bovis subsp bovis AF2122/97
gguuuucccgucgcc

SEQ ID NO: 3099071 - RNA, 17 nt, Mycobacterium bovis subsp bovis AF2122/97
gguuuucccgucgccgc

SEQ ID NO: 3099072 - RNA, 21 nt, Mycobacterium bovis subsp bovis AF2122/97
gguuuugauagacgacccggu

SEQ ID NO: 3099073 - RNA, 14 nt, Mycobacterium bovis subsp bovis AF2122/97
guaaaagccgauga

SEQ ID NO: 3099074 - RNA, 17 nt, Mycobacterium bovis subsp bovis AF2122/97
guaaacaaacccaacac

SEQ ID NO: 3099075 - RNA, 22 nt, Mycobacterium bovis subsp bovis AF2122/97
guaaacaaacccaacaccagca

SEQ ID NO: 3099076 - RNA, 14 nt, Mycobacterium bovis subsp bovis AF2122/97
guaaacagcgcgcc

SEQ ID NO: 3099077 - RNA, 17 nt, Mycobacterium bovis subsp bovis AF2122/97
guaaacagcgcgccggc

SEQ ID NO: 3099078 - RNA, 21 nt, Mycobacterium bovis subsp bovis AF2122/97
guaaacagcgcgccggcgucg

SEQ ID NO: 3099079 - RNA, 18 nt, Mycobacterium bovis subsp bovis AF2122/97
guaaaccgauaucgcugc

SEQ ID NO: 3099080 - RNA, 15 nt, Mycobacterium bovis subsp bovis AF2122/97
guaaaccggcugacc

SEQ ID NO: 3099081 - RNA, 22 nt, Mycobacterium bovis subsp bovis AF2122/97
guaaacguugggaaaagcccgg

SEQ ID NO: 3099082 - RNA, 22 nt, Mycobacterium bovis subsp bovis AF2122/97
guaaagaucuugucgcguucgg

SEQ ID NO: 3099083 - RNA, 15 nt, Mycobacterium bovis subsp bovis AF2122/97
guaaagccaacuggu

SEQ ID NO: 3099084 - RNA, 18 nt, Mycobacterium bovis subsp bovis AF2122/97
guaaagcucaccacaucg

SEQ ID NO: 3099085 - RNA, 18 nt, Mycobacterium bovis subsp bovis AF2122/97
guaacacccggccgccga

SEQ ID NO: 3099086 - RNA, 13 nt, Mycobacterium bovis subsp bovis AF2122/97
guaaccagcgcca

SEQ ID NO: 3099087 - RNA, 21 nt, Mycobacterium bovis subsp bovis AF2122/97
guaaccccaccuggaguccag

SEQ ID NO: 3099088 - RNA, 23 nt, Mycobacterium bovis subsp bovis AF2122/97
guaacccguuaccgauuggcccg

SEQ ID NO: 3099089 - RNA, 13 nt, Mycobacterium bovis subsp bovis AF2122/97
guaaccgucgccu

SEQ ID NO: 3099090 - RNA, 21 nt, Mycobacterium bovis subsp bovis AF2122/97
guaaccgucgccugccgacga

SEQ ID NO: 3099091 - RNA, 15 nt, Mycobacterium bovis subsp bovis AF2122/97
guaacgccaacaccg

SEQ ID NO: 3099092 - RNA, 17 nt, Mycobacterium bovis subsp bovis AF2122/97
guaacgccgcucaucca

SEQ ID NO: 3099093 - RNA, 20 nt, Mycobacterium bovis subsp bovis AF2122/97
guaacgguaaccggcccgau

SEQ ID NO: 3099094 - RNA, 20 nt, Mycobacterium bovis subsp bovis AF2122/97
guaacgucgucgcgucgcca

SEQ ID NO: 3099095 - RNA, 22 nt, Mycobacterium bovis subsp bovis AF2122/97
guaacucgaguagucgcuggcc

SEQ ID NO: 3099096 - RNA, 15 nt, Mycobacterium bovis subsp bovis AF2122/97
guaacugcccgcggc

SEQ ID NO: 3099097 - RNA, 20 nt, Mycobacterium bovis subsp bovis AF2122/97
guaacugcguuggcgaccau

SEQ ID NO: 3099098 - RNA, 15 nt, Mycobacterium bovis subsp bovis AF2122/97
guaacuucaccggcu

SEQ ID NO: 3099099 - RNA, 16 nt, Mycobacterium bovis subsp bovis AF2122/97
guaacuucaccggcuc

SEQ ID NO: 3099100 - RNA, 20 nt, Mycobacterium bovis subsp bovis AF2122/97
guaagaaucgaagcggcugc

SEQ ID NO: 3099101 - RNA, 18 nt, Mycobacterium bovis subsp bovis AF2122/97
guaagaguucgcgcgccg

SEQ ID NO: 3099102 - RNA, 12 nt, Mycobacterium bovis subsp bovis AF2122/97
guaagcaugccg

SEQ ID NO: 3099103 - RNA, 17 nt, Mycobacterium bovis subsp bovis AF2122/97
guaagcgaacagcggca

SEQ ID NO: 3099104 - RNA, 14 nt, Mycobacterium bovis subsp bovis AF2122/97
guaagcgaccgacg

SEQ ID NO: 3099105 - RNA, 16 nt, Mycobacterium bovis subsp bovis AF2122/97
guaagcgagucgacga

SEQ ID NO: 3099106 - RNA, 21 nt, Mycobacterium bovis subsp bovis AF2122/97
guaagcgauucccaaccggug

SEQ ID NO: 3099107 - RNA, 22 nt, Mycobacterium bovis subsp bovis AF2122/97
guaagcgccaaggcgauggucu

SEQ ID NO: 3099108 - RNA, 18 nt, Mycobacterium bovis subsp bovis AF2122/97
guaagcgguuguccgguc

SEQ ID NO: 3099109 - RNA, 15 nt, Mycobacterium bovis subsp bovis AF2122/97
guaaggagccgggcc

SEQ ID NO: 3099110 - RNA, 16 nt, Mycobacterium bovis subsp bovis AF2122/97
guaaggagccgggccg

SEQ ID NO: 3099111 - RNA, 16 nt, Mycobacterium bovis subsp bovis AF2122/97
guaagggacaccagcu

SEQ ID NO: 3099112 - RNA, 19 nt, Mycobacterium bovis subsp bovis AF2122/97
guaagggacaccagcucga

SEQ ID NO: 3099113 - RNA, 21 nt, Mycobacterium bovis subsp bovis AF2122/97
guaaguuauccgaccacucca

SEQ ID NO: 3099114 - RNA, 21 nt, Mycobacterium bovis subsp bovis AF2122/97
guaauacgcggggccggccgg

SEQ ID NO: 3099115 - RNA, 20 nt, Mycobacterium bovis subsp bovis AF2122/97
guaaucaagcagcguggcga

SEQ ID NO: 3099116 - RNA, 20 nt, Mycobacterium bovis subsp bovis AF2122/97
guaaucaauaaucacaucgg

SEQ ID NO: 3099117 - RNA, 21 nt, Mycobacterium bovis subsp bovis AF2122/97
guaaucaccgaauaccgccgc

SEQ ID NO: 3099118 - RNA, 23 nt, Mycobacterium bovis subsp bovis AF2122/97
guaaucaccgaauaccgccgcgc

SEQ ID NO: 3099119 - RNA, 20 nt, Mycobacterium bovis subsp bovis AF2122/97
guaauccacacacagccggu

SEQ ID NO: 3099120 - RNA, 16 nt, Mycobacterium bovis subsp bovis AF2122/97
guaaucgagcgcggca

SEQ ID NO: 3099121 - RNA, 21 nt, Mycobacterium bovis subsp bovis AF2122/97
guaaucgagcgcggcaaccgu

SEQ ID NO: 3099122 - RNA, 16 nt, Mycobacterium bovis subsp bovis AF2122/97
guaaucgguggugugc

SEQ ID NO: 3099123 - RNA, 20 nt, Mycobacterium bovis subsp bovis AF2122/97
guaaucgguggugugcagcc

SEQ ID NO: 3099124 - RNA, 15 nt, Mycobacterium bovis subsp bovis AF2122/97
guaaugccagcggca

SEQ ID NO: 3099125 - RNA, 15 nt, Mycobacterium bovis subsp bovis AF2122/97
guaaugcucgacgua

SEQ ID NO: 3099126 - RNA, 11 nt, Mycobacterium bovis subsp bovis AF2122/97
guaauggccgc

SEQ ID NO: 3099127 - RNA, 22 nt, Mycobacterium bovis subsp bovis AF2122/97
guaauggccgccgguccaugga

SEQ ID NO: 3099128 - RNA, 15 nt, Mycobacterium bovis subsp bovis AF2122/97
guaauugccgaccgc

SEQ ID NO: 3099129 - RNA, 21 nt, Mycobacterium bovis subsp bovis AF2122/97
guacaaccacccacccgcacc

SEQ ID NO: 3099130 - RNA, 16 nt, Mycobacterium bovis subsp bovis AF2122/97
guacaacgacacgccg

SEQ ID NO: 3099131 - RNA, 15 nt, Mycobacterium bovis subsp bovis AF2122/97
guacaacgccgucgu

SEQ ID NO: 3099132 - RNA, 13 nt, Mycobacterium bovis subsp bovis AF2122/97
guacacagacccg

SEQ ID NO: 3099133 - RNA, 19 nt, Mycobacterium bovis subsp bovis AF2122/97
guacacaucgucacugcca

SEQ ID NO: 3099134 - RNA, 22 nt, Mycobacterium bovis subsp bovis AF2122/97
guacacccgcucgcccgccgcc

SEQ ID NO: 3099135 - RNA, 18 nt, Mycobacterium bovis subsp bovis AF2122/97
guacaccucgagcgcggc

SEQ ID NO: 3099136 - RNA, 21 nt, Mycobacterium bovis subsp bovis AF2122/97
guacacguaccgguccagugu

SEQ ID NO: 3099137 - RNA, 21 nt, Mycobacterium bovis subsp bovis AF2122/97
guacacguccaguggcagcca

SEQ ID NO: 3099138 - RNA, 24 nt, Mycobacterium bovis subsp bovis AF2122/97
guacacguccaguggcagccagcg

SEQ ID NO: 3099139 - RNA, 19 nt, Mycobacterium bovis subsp bovis AF2122/97
guacaggcugcugcgcgag

SEQ ID NO: 3099140 - RNA, 16 nt, Mycobacterium bovis subsp bovis AF2122/97
guacaggguggugauc

SEQ ID NO: 3099141 - RNA, 15 nt, Mycobacterium bovis subsp bovis AF2122/97
guacaggucgccggg

SEQ ID NO: 3099142 - RNA, 15 nt, Mycobacterium bovis subsp bovis AF2122/97
guacagucgcgcgcu

SEQ ID NO: 3099143 - RNA, 17 nt, Mycobacterium bovis subsp bovis AF2122/97
guacagugucugccaug

SEQ ID NO: 3099144 - RNA, 13 nt, Mycobacterium bovis subsp bovis AF2122/97
guacaucaccacg

SEQ ID NO: 3099145 - RNA, 16 nt, Mycobacterium bovis subsp bovis AF2122/97
guacaucgaggccacg

SEQ ID NO: 3099146 - RNA, 13 nt, Mycobacterium bovis subsp bovis AF2122/97
guacaugggcaga

SEQ ID NO: 3099147 - RNA, 18 nt, Mycobacterium bovis subsp bovis AF2122/97
guaccaaccugcgcggcg

SEQ ID NO: 3099148 - RNA, 15 nt, Mycobacterium bovis subsp bovis AF2122/97
guaccaccggcaccg

SEQ ID NO: 3099149 - RNA, 18 nt, Mycobacterium bovis subsp bovis AF2122/97
guaccaccggcaccggcc

SEQ ID NO: 3099150 - RNA, 14 nt, Mycobacterium bovis subsp bovis AF2122/97
guaccacgcuggcg

SEQ ID NO: 3099151 - RNA, 20 nt, Mycobacterium bovis subsp bovis AF2122/97
guaccagcccaccggcgccg

SEQ ID NO: 3099152 - RNA, 15 nt, Mycobacterium bovis subsp bovis AF2122/97
guaccagguggaccg

SEQ ID NO: 3099153 - RNA, 18 nt, Mycobacterium bovis subsp bovis AF2122/97
guaccagguggaccggcc

SEQ ID NO: 3099154 - RNA, 22 nt, Mycobacterium bovis subsp bovis AF2122/97
guacccaccucccgcagccggg

SEQ ID NO: 3099155 - RNA, 22 nt, Mycobacterium bovis subsp bovis AF2122/97
guacccacgcauguuggugauc

SEQ ID NO: 3099156 - RNA, 15 nt, Mycobacterium bovis subsp bovis AF2122/97
guacccaucugcuca

SEQ ID NO: 3099157 - RNA, 13 nt, Mycobacterium bovis subsp bovis AF2122/97
guaccccagcgcc

SEQ ID NO: 3099158 - RNA, 14 nt, Mycobacterium bovis subsp bovis AF2122/97
guacccccagcacc

SEQ ID NO: 3099159 - RNA, 15 nt, Mycobacterium bovis subsp bovis AF2122/97
guaccccccagcgac

SEQ ID NO: 3099160 - RNA, 16 nt, Mycobacterium bovis subsp bovis AF2122/97
guaccccccagcgacg

SEQ ID NO: 3099161 - RNA, 16 nt, Mycobacterium bovis subsp bovis AF2122/97
guacccgaucacucgg

SEQ ID NO: 3099162 - RNA, 15 nt, Mycobacterium bovis subsp bovis AF2122/97
guacccgaucagcga

SEQ ID NO: 3099163 - RNA, 13 nt, Mycobacterium bovis subsp bovis AF2122/97
guacccgccucgg

SEQ ID NO: 3099164 - RNA, 12 nt, Mycobacterium bovis subsp bovis AF2122/97
guacccgcgccg

SEQ ID NO: 3099165 - RNA, 15 nt, Mycobacterium bovis subsp bovis AF2122/97
guacccgcgccgcgc

SEQ ID NO: 3099166 - RNA, 21 nt, Mycobacterium bovis subsp bovis AF2122/97
guacccggaggcaauccgauc

SEQ ID NO: 3099167 - RNA, 15 nt, Mycobacterium bovis subsp bovis AF2122/97
guacccggccugcgu

SEQ ID NO: 3099168 - RNA, 15 nt, Mycobacterium bovis subsp bovis AF2122/97
guacccggcgacguu

SEQ ID NO: 3099169 - RNA, 17 nt, Mycobacterium bovis subsp bovis AF2122/97
guacccguagcaccaca

SEQ ID NO: 3099170 - RNA, 16 nt, Mycobacterium bovis subsp bovis AF2122/97
guaccgagaacaccac

SEQ ID NO: 3099171 - RNA, 15 nt, Mycobacterium bovis subsp bovis AF2122/97
guaccgauagccugc

SEQ ID NO: 3099172 - RNA, 21 nt, Mycobacterium bovis subsp bovis AF2122/97
guaccgauagccugcggcggc

SEQ ID NO: 3099173 - RNA, 17 nt, Mycobacterium bovis subsp bovis AF2122/97
guaccgauccaguucac

SEQ ID NO: 3099174 - RNA, 22 nt, Mycobacterium bovis subsp bovis AF2122/97
guaccgcacgcaauucaaauga

SEQ ID NO: 3099175 - RNA, 23 nt, Mycobacterium bovis subsp bovis AF2122/97
guaccgccacuggcgcugaucgc

SEQ ID NO: 3099176 - RNA, 21 nt, Mycobacterium bovis subsp bovis AF2122/97
guaccgccacuucccccgggu

SEQ ID NO: 3099177 - RNA, 22 nt, Mycobacterium bovis subsp bovis AF2122/97
guaccgcccaguugggccucag

SEQ ID NO: 3099178 - RNA, 21 nt, Mycobacterium bovis subsp bovis AF2122/97
guaccgcgcguugaagucgcc

SEQ ID NO: 3099179 - RNA, 13 nt, Mycobacterium bovis subsp bovis AF2122/97
guaccgcggaucg

SEQ ID NO: 3099180 - RNA, 18 nt, Mycobacterium bovis subsp bovis AF2122/97
guaccgcucgggcgcgag

SEQ ID NO: 3099181 - RNA, 18 nt, Mycobacterium bovis subsp bovis AF2122/97
guaccggaaucggcggcg

SEQ ID NO: 3099182 - RNA, 20 nt, Mycobacterium bovis subsp bovis AF2122/97
guaccggaaucggcggcgga

SEQ ID NO: 3099183 - RNA, 16 nt, Mycobacterium bovis subsp bovis AF2122/97
guaccggagcggugug

SEQ ID NO: 3099184 - RNA, 13 nt, Mycobacterium bovis subsp bovis AF2122/97
guaccggccagcc

SEQ ID NO: 3099185 - RNA, 16 nt, Mycobacterium bovis subsp bovis AF2122/97
guaccggccagccgcg

SEQ ID NO: 3099186 - RNA, 12 nt, Mycobacterium bovis subsp bovis AF2122/97
guaccggcggcg

SEQ ID NO: 3099187 - RNA, 13 nt, Mycobacterium bovis subsp bovis AF2122/97
guaccggcggcgc

SEQ ID NO: 3099188 - RNA, 23 nt, Mycobacterium bovis subsp bovis AF2122/97
guaccggcguucccacuggaggu

SEQ ID NO: 3099189 - RNA, 16 nt, Mycobacterium bovis subsp bovis AF2122/97
guaccggcugguugac

SEQ ID NO: 3099190 - RNA, 21 nt, Mycobacterium bovis subsp bovis AF2122/97
guaccggcuucgucggccagc

SEQ ID NO: 3099191 - RNA, 14 nt, Mycobacterium bovis subsp bovis AF2122/97
guaccgggacgaau

SEQ ID NO: 3099192 - RNA, 19 nt, Mycobacterium bovis subsp bovis AF2122/97
guaccgggcgagucccggc

SEQ ID NO: 3099193 - RNA, 20 nt, Mycobacterium bovis subsp bovis AF2122/97
guaccgggcgagucccggcg

SEQ ID NO: 3099194 - RNA, 20 nt, Mycobacterium bovis subsp bovis AF2122/97
guaccggucgacccacucau

SEQ ID NO: 3099195 - RNA, 19 nt, Mycobacterium bovis subsp bovis AF2122/97
guaccguagcucuuugagu

SEQ ID NO: 3099196 - RNA, 20 nt, Mycobacterium bovis subsp bovis AF2122/97
guaccguuccacgucguacu

SEQ ID NO: 3099197 - RNA, 16 nt, Mycobacterium bovis subsp bovis AF2122/97
guaccuaaggcucacc

SEQ ID NO: 3099198 - RNA, 15 nt, Mycobacterium bovis subsp bovis AF2122/97
guaccucaucgcaga

SEQ ID NO: 3099199 - RNA, 16 nt, Mycobacterium bovis subsp bovis AF2122/97
guaccuccaggaucgc

SEQ ID NO: 3099200 - RNA, 19 nt, Mycobacterium bovis subsp bovis AF2122/97
guaccuucgagcguaacgg

SEQ ID NO: 3099201 - RNA, 15 nt, Mycobacterium bovis subsp bovis AF2122/97
guacgacaccgcagc

SEQ ID NO: 3099202 - RNA, 23 nt, Mycobacterium bovis subsp bovis AF2122/97
guacgacccccgaucaggccgac

SEQ ID NO: 3099203 - RNA, 23 nt, Mycobacterium bovis subsp bovis AF2122/97
guacgaucgugagacgccgucga

SEQ ID NO: 3099204 - RNA, 19 nt, Mycobacterium bovis subsp bovis AF2122/97
guacgccaggugcagcacc

SEQ ID NO: 3099205 - RNA, 23 nt, Mycobacterium bovis subsp bovis AF2122/97
guacgccaggugcagcaccagcc

SEQ ID NO: 3099206 - RNA, 16 nt, Mycobacterium bovis subsp bovis AF2122/97
guacgccagucgcagg

SEQ ID NO: 3099207 - RNA, 16 nt, Mycobacterium bovis subsp bovis AF2122/97
guacgccgccgcgacg

SEQ ID NO: 3099208 - RNA, 13 nt, Mycobacterium bovis subsp bovis AF2122/97
guacgccgcgccg

SEQ ID NO: 3099209 - RNA, 19 nt, Mycobacterium bovis subsp bovis AF2122/97
guacgccggacccggucgc

SEQ ID NO: 3099210 - RNA, 21 nt, Mycobacterium bovis subsp bovis AF2122/97
guacgccguaucggggcacca

SEQ ID NO: 3099211 - RNA, 18 nt, Mycobacterium bovis subsp bovis AF2122/97
guacgcgacgggccgcga

SEQ ID NO: 3099212 - RNA, 16 nt, Mycobacterium bovis subsp bovis AF2122/97
guacgcgaucagcgcg

SEQ ID NO: 3099213 - RNA, 16 nt, Mycobacterium bovis subsp bovis AF2122/97
guacgcgucggugacc

SEQ ID NO: 3099214 - RNA, 17 nt, Mycobacterium bovis subsp bovis AF2122/97
guacggaccguggcagc

SEQ ID NO: 3099215 - RNA, 21 nt, Mycobacterium bovis subsp bovis AF2122/97
guacggaucaggcccgggcgg

SEQ ID NO: 3099216 - RNA, 14 nt, Mycobacterium bovis subsp bovis AF2122/97
guacggccaacauc

SEQ ID NO: 3099217 - RNA, 20 nt, Mycobacterium bovis subsp bovis AF2122/97
guacggcgcguacggaacca

SEQ ID NO: 3099218 - RNA, 16 nt, Mycobacterium bovis subsp bovis AF2122/97
guacggcgguccggau

SEQ ID NO: 3099219 - RNA, 13 nt, Mycobacterium bovis subsp bovis AF2122/97
guacggcucggcg

SEQ ID NO: 3099220 - RNA, 15 nt, Mycobacterium bovis subsp bovis AF2122/97
guacggcucggcgcu

SEQ ID NO: 3099221 - RNA, 18 nt, Mycobacterium bovis subsp bovis AF2122/97
guacgggagccggcuguu

SEQ ID NO: 3099222 - RNA, 16 nt, Mycobacterium bovis subsp bovis AF2122/97
guacgggcaggccgcu

SEQ ID NO: 3099223 - RNA, 20 nt, Mycobacterium bovis subsp bovis AF2122/97
guacgggcaggccgcugggc

SEQ ID NO: 3099224 - RNA, 22 nt, Mycobacterium bovis subsp bovis AF2122/97
guacgggcaggccgcugggccg

SEQ ID NO: 3099225 - RNA, 15 nt, Mycobacterium bovis subsp bovis AF2122/97
guacggggucgccgg

SEQ ID NO: 3099226 - RNA, 20 nt, Mycobacterium bovis subsp bovis AF2122/97
guacggggucgccggcaccg

SEQ ID NO: 3099227 - RNA, 23 nt, Mycobacterium bovis subsp bovis AF2122/97
guacggggucgccggcaccggau

SEQ ID NO: 3099228 - RNA, 21 nt, Mycobacterium bovis subsp bovis AF2122/97
guacggguaacgcacccaccg

SEQ ID NO: 3099229 - RNA, 14 nt, Mycobacterium bovis subsp bovis AF2122/97
guacgggucgccgg

SEQ ID NO: 3099230 - RNA, 16 nt, Mycobacterium bovis subsp bovis AF2122/97
guacgggucgccggac

SEQ ID NO: 3099231 - RNA, 23 nt, Mycobacterium bovis subsp bovis AF2122/97
guacggugguaagacgccgaacg

SEQ ID NO: 3099232 - RNA, 21 nt, Mycobacterium bovis subsp bovis AF2122/97
guacuaacaacaccaccagca

SEQ ID NO: 3099233 - RNA, 18 nt, Mycobacterium bovis subsp bovis AF2122/97
guacuagcagcgggcugc

SEQ ID NO: 3099234 - RNA, 23 nt, Mycobacterium bovis subsp bovis AF2122/97
guacucaucgacguuccagcagu

SEQ ID NO: 3099235 - RNA, 20 nt, Mycobacterium bovis subsp bovis AF2122/97
guacuccaccgcgccgucgu

SEQ ID NO: 3099236 - RNA, 18 nt, Mycobacterium bovis subsp bovis AF2122/97
guacuccagccgcaacac

SEQ ID NO: 3099237 - RNA, 17 nt, Mycobacterium bovis subsp bovis AF2122/97
guacucccgcgaucgcg

SEQ ID NO: 3099238 - RNA, 21 nt, Mycobacterium bovis subsp bovis AF2122/97
guacucccgcgaucgcgacac

SEQ ID NO: 3099239 - RNA, 17 nt, Mycobacterium bovis subsp bovis AF2122/97
guacucgcggcgcggcc

SEQ ID NO: 3099240 - RNA, 18 nt, Mycobacterium bovis subsp bovis AF2122/97
guacucgcggcgcggccg

SEQ ID NO: 3099241 - RNA, 17 nt, Mycobacterium bovis subsp bovis AF2122/97
guacucggcauccaggc

SEQ ID NO: 3099242 - RNA, 19 nt, Mycobacterium bovis subsp bovis AF2122/97
guacucggcauccaggcug

SEQ ID NO: 3099243 - RNA, 15 nt, Mycobacterium bovis subsp bovis AF2122/97
guacugcggcucgcu

SEQ ID NO: 3099244 - RNA, 19 nt, Mycobacterium bovis subsp bovis AF2122/97
guacuggcguugccaccgg

SEQ ID NO: 3099245 - RNA, 19 nt, Mycobacterium bovis subsp bovis AF2122/97
guacugguagcacucggga

SEQ ID NO: 3099246 - RNA, 19 nt, Mycobacterium bovis subsp bovis AF2122/97
guacugucgucgcccugac

SEQ ID NO: 3099247 - RNA, 18 nt, Mycobacterium bovis subsp bovis AF2122/97
guacugugccgcccccgg

SEQ ID NO: 3099248 - RNA, 19 nt, Mycobacterium bovis subsp bovis AF2122/97
guacugugggcgaucggcg

SEQ ID NO: 3099249 - RNA, 21 nt, Mycobacterium bovis subsp bovis AF2122/97
guacuucauauaccgcucgua

SEQ ID NO: 3099250 - RNA, 17 nt, Mycobacterium bovis subsp bovis AF2122/97
guacuucgcggcgguga

SEQ ID NO: 3099251 - RNA, 16 nt, Mycobacterium bovis subsp bovis AF2122/97
guacuugaccguccac

SEQ ID NO: 3099252 - RNA, 18 nt, Mycobacterium bovis subsp bovis AF2122/97
guacuugaccguccaccg

SEQ ID NO: 3099253 - RNA, 13 nt, Mycobacterium bovis subsp bovis AF2122/97
guacuugccaccc

SEQ ID NO: 3099254 - RNA, 22 nt, Mycobacterium bovis subsp bovis AF2122/97
guacuugggauugcgggccugc

SEQ ID NO: 3099255 - RNA, 15 nt, Mycobacterium bovis subsp bovis AF2122/97
guagaagcccaggac

SEQ ID NO: 3099256 - RNA, 17 nt, Mycobacterium bovis subsp bovis AF2122/97
guagaagcgggcgucgc

SEQ ID NO: 3099257 - RNA, 22 nt, Mycobacterium bovis subsp bovis AF2122/97
guagaaggaccgcucgucgccg

SEQ ID NO: 3099258 - RNA, 16 nt, Mycobacterium bovis subsp bovis AF2122/97
guagaaguaggcggcg

SEQ ID NO: 3099259 - RNA, 17 nt, Mycobacterium bovis subsp bovis AF2122/97
guagaaguaggcggcga

SEQ ID NO: 3099260 - RNA, 22 nt, Mycobacterium bovis subsp bovis AF2122/97
guagaaguaggcggcgacgccg

SEQ ID NO: 3099261 - RNA, 17 nt, Mycobacterium bovis subsp bovis AF2122/97
guagaaugcgccgucgg

SEQ ID NO: 3099262 - RNA, 20 nt, Mycobacterium bovis subsp bovis AF2122/97
guagacaaggccaagcgcca

SEQ ID NO: 3099263 - RNA, 17 nt, Mycobacterium bovis subsp bovis AF2122/97
guagacaagucggcgcu

SEQ ID NO: 3099264 - RNA, 23 nt, Mycobacterium bovis subsp bovis AF2122/97
guagacaagucggcgcuggccgu

SEQ ID NO: 3099265 - RNA, 13 nt, Mycobacterium bovis subsp bovis AF2122/97
guagacaccgcga

SEQ ID NO: 3099266 - RNA, 20 nt, Mycobacterium bovis subsp bovis AF2122/97
guagacaccgcgaucaccac

SEQ ID NO: 3099267 - RNA, 18 nt, Mycobacterium bovis subsp bovis AF2122/97
guagacaggaccgguggg

SEQ ID NO: 3099268 - RNA, 21 nt, Mycobacterium bovis subsp bovis AF2122/97
guagacagucugcgacuggau

SEQ ID NO: 3099269 - RNA, 19 nt, Mycobacterium bovis subsp bovis AF2122/97
guagacauuggcuccgaac

SEQ ID NO: 3099270 - RNA, 17 nt, Mycobacterium bovis subsp bovis AF2122/97
guagaccacgccgguga

SEQ ID NO: 3099271 - RNA, 21 nt, Mycobacterium bovis subsp bovis AF2122/97
guagaccagugaccgcagucc

SEQ ID NO: 3099272 - RNA, 22 nt, Mycobacterium bovis subsp bovis AF2122/97
guagacccacaucaggucggcg

SEQ ID NO: 3099273 - RNA, 23 nt, Mycobacterium bovis subsp bovis AF2122/97
guagacccacaucaggucggcga

SEQ ID NO: 3099274 - RNA, 14 nt, Mycobacterium bovis subsp bovis AF2122/97
guagaccucuucgg

SEQ ID NO: 3099275 - RNA, 17 nt, Mycobacterium bovis subsp bovis AF2122/97
guagaccuggccgucgc

SEQ ID NO: 3099276 - RNA, 19 nt, Mycobacterium bovis subsp bovis AF2122/97
guagaccugguugaccucg

SEQ ID NO: 3099277 - RNA, 20 nt, Mycobacterium bovis subsp bovis AF2122/97
guagaccuucucgccgccgc

SEQ ID NO: 3099278 - RNA, 16 nt, Mycobacterium bovis subsp bovis AF2122/97
guagacgacgucggcc

SEQ ID NO: 3099279 - RNA, 14 nt, Mycobacterium bovis subsp bovis AF2122/97
guagacgccgccgu

SEQ ID NO: 3099280 - RNA, 17 nt, Mycobacterium bovis subsp bovis AF2122/97
guagacggcacccccga

SEQ ID NO: 3099281 - RNA, 22 nt, Mycobacterium bovis subsp bovis AF2122/97
guagacggcacugugcguccgc

SEQ ID NO: 3099282 - RNA, 18 nt, Mycobacterium bovis subsp bovis AF2122/97
guagacgguuaccgcgaa

SEQ ID NO: 3099283 - RNA, 18 nt, Mycobacterium bovis subsp bovis AF2122/97
guagacguccgcggucgc

SEQ ID NO: 3099284 - RNA, 15 nt, Mycobacterium bovis subsp bovis AF2122/97
guagacuugcugcuc

SEQ ID NO: 3099285 - RNA, 17 nt, Mycobacterium bovis subsp bovis AF2122/97
guagagcucaccgucga

SEQ ID NO: 3099286 - RNA, 20 nt, Mycobacterium bovis subsp bovis AF2122/97
guagagcucaccgucgaggu

SEQ ID NO: 3099287 - RNA, 16 nt, Mycobacterium bovis subsp bovis AF2122/97
guagaucagcgccugg

SEQ ID NO: 3099288 - RNA, 15 nt, Mycobacterium bovis subsp bovis AF2122/97
guagaucaucagcga

SEQ ID NO: 3099289 - RNA, 18 nt, Mycobacterium bovis subsp bovis AF2122/97
guagaucgccucgacgcg

SEQ ID NO: 3099290 - RNA, 14 nt, Mycobacterium bovis subsp bovis AF2122/97
guagaucggaucga

SEQ ID NO: 3099291 - RNA, 20 nt, Mycobacterium bovis subsp bovis AF2122/97
guagaucucuucggagccga

SEQ ID NO: 3099292 - RNA, 18 nt, Mycobacterium bovis subsp bovis AF2122/97
guagaucugggcuggcag

SEQ ID NO: 3099293 - RNA, 20 nt, Mycobacterium bovis subsp bovis AF2122/97
guagaucuucggccgcacug

SEQ ID NO: 3099294 - RNA, 13 nt, Mycobacterium bovis subsp bovis AF2122/97
guagaugguggug

SEQ ID NO: 3099295 - RNA, 16 nt, Mycobacterium bovis subsp bovis AF2122/97
guagauuccugguucc

SEQ ID NO: 3099296 - RNA, 14 nt, Mycobacterium bovis subsp bovis AF2122/97
guagcaacccagga

SEQ ID NO: 3099297 - RNA, 13 nt, Mycobacterium bovis subsp bovis AF2122/97
guagcacaccgac

SEQ ID NO: 3099298 - RNA, 14 nt, Mycobacterium bovis subsp bovis AF2122/97
guagcacagcagca

SEQ ID NO: 3099299 - RNA, 19 nt, Mycobacterium bovis subsp bovis AF2122/97
guagcaccacaucggugcc

SEQ ID NO: 3099300 - RNA, 21 nt, Mycobacterium bovis subsp bovis AF2122/97
guagcacguugacguccaaca

SEQ ID NO: 3099301 - RNA, 23 nt, Mycobacterium bovis subsp bovis AF2122/97
guagcacucgggauucggcagcg

SEQ ID NO: 3099302 - RNA, 16 nt, Mycobacterium bovis subsp bovis AF2122/97
guagcagaaggccgcg

SEQ ID NO: 3099303 - RNA, 17 nt, Mycobacterium bovis subsp bovis AF2122/97
guagcagaaggccgcgg

SEQ ID NO: 3099304 - RNA, 18 nt, Mycobacterium bovis subsp bovis AF2122/97
guagcagacgcagccacg

SEQ ID NO: 3099305 - RNA, 15 nt, Mycobacterium bovis subsp bovis AF2122/97
guagcagcgccagca

SEQ ID NO: 3099306 - RNA, 18 nt, Mycobacterium bovis subsp bovis AF2122/97
guagcagcgccagcagcu

SEQ ID NO: 3099307 - RNA, 18 nt, Mycobacterium bovis subsp bovis AF2122/97
guagcagcggcucggcgg

SEQ ID NO: 3099308 - RNA, 22 nt, Mycobacterium bovis subsp bovis AF2122/97
guagccaaugcccuuggccagc

SEQ ID NO: 3099309 - RNA, 21 nt, Mycobacterium bovis subsp bovis AF2122/97
guagccacgcccacaggggca

SEQ ID NO: 3099310 - RNA, 23 nt, Mycobacterium bovis subsp bovis AF2122/97
guagccacgcccacaggggcagc

SEQ ID NO: 3099311 - RNA, 16 nt, Mycobacterium bovis subsp bovis AF2122/97
guagccagcagcggcu

SEQ ID NO: 3099312 - RNA, 15 nt, Mycobacterium bovis subsp bovis AF2122/97
guagccauucagugu

SEQ ID NO: 3099313 - RNA, 22 nt, Mycobacterium bovis subsp bovis AF2122/97
guagccauucgguguggccgug

SEQ ID NO: 3099314 - RNA, 22 nt, Mycobacterium bovis subsp bovis AF2122/97
guagcccacccgggugggccag

SEQ ID NO: 3099315 - RNA, 14 nt, Mycobacterium bovis subsp bovis AF2122/97
guagcccagccggg

SEQ ID NO: 3099316 - RNA, 17 nt, Mycobacterium bovis subsp bovis AF2122/97
guagcccaugccgaugc

SEQ ID NO: 3099317 - RNA, 15 nt, Mycobacterium bovis subsp bovis AF2122/97
guagccccgucgacc

SEQ ID NO: 3099318 - RNA, 22 nt, Mycobacterium bovis subsp bovis AF2122/97
guagccccgucgaccuccacca

SEQ ID NO: 3099319 - RNA, 22 nt, Mycobacterium bovis subsp bovis AF2122/97
guagcccgcgaucucggagcgc

SEQ ID NO: 3099320 - RNA, 17 nt, Mycobacterium bovis subsp bovis AF2122/97
guagccgacuaucggcc

SEQ ID NO: 3099321 - RNA, 21 nt, Mycobacterium bovis subsp bovis AF2122/97
guagccgacuaucggccgccg

SEQ ID NO: 3099322 - RNA, 13 nt, Mycobacterium bovis subsp bovis AF2122/97
guagccgagcucg

SEQ ID NO: 3099323 - RNA, 15 nt, Mycobacterium bovis subsp bovis AF2122/97
guagccgcccucccu

SEQ ID NO: 3099324 - RNA, 14 nt, Mycobacterium bovis subsp bovis AF2122/97
guagccgccggcag

SEQ ID NO: 3099325 - RNA, 14 nt, Mycobacterium bovis subsp bovis AF2122/97
guagccgccggcgc

SEQ ID NO: 3099326 - RNA, 15 nt, Mycobacterium bovis subsp bovis AF2122/97
guagccgccggcgcc

SEQ ID NO: 3099327 - RNA, 14 nt, Mycobacterium bovis subsp bovis AF2122/97
guagccgccgucgc

SEQ ID NO: 3099328 - RNA, 17 nt, Mycobacterium bovis subsp bovis AF2122/97
guagccgccgucgccgg

SEQ ID NO: 3099329 - RNA, 20 nt, Mycobacterium bovis subsp bovis AF2122/97
guagccgcuaggaucggaug

SEQ ID NO: 3099330 - RNA, 14 nt, Mycobacterium bovis subsp bovis AF2122/97
guagccgcugcacg

SEQ ID NO: 3099331 - RNA, 13 nt, Mycobacterium bovis subsp bovis AF2122/97
guagccggccgcu

SEQ ID NO: 3099332 - RNA, 14 nt, Mycobacterium bovis subsp bovis AF2122/97
guagccggccgcuu

SEQ ID NO: 3099333 - RNA, 13 nt, Mycobacterium bovis subsp bovis AF2122/97
guagccggcgaca

SEQ ID NO: 3099334 - RNA, 15 nt, Mycobacterium bovis subsp bovis AF2122/97
guagccggcgccgcc

SEQ ID NO: 3099335 - RNA, 17 nt, Mycobacterium bovis subsp bovis AF2122/97
guagccggcgccgccgu

SEQ ID NO: 3099336 - RNA, 19 nt, Mycobacterium bovis subsp bovis AF2122/97
guagccggcgccgccgucg

SEQ ID NO: 3099337 - RNA, 20 nt, Mycobacterium bovis subsp bovis AF2122/97
guagccgggaacgcugacgc

SEQ ID NO: 3099338 - RNA, 14 nt, Mycobacterium bovis subsp bovis AF2122/97
guagccggucggca

SEQ ID NO: 3099339 - RNA, 14 nt, Mycobacterium bovis subsp bovis AF2122/97
guagccggugaccg

SEQ ID NO: 3099340 - RNA, 16 nt, Mycobacterium bovis subsp bovis AF2122/97
guagccggugccggcg

SEQ ID NO: 3099341 - RNA, 17 nt, Mycobacterium bovis subsp bovis AF2122/97
guagccggugccggcgc

SEQ ID NO: 3099342 - RNA, 19 nt, Mycobacterium bovis subsp bovis AF2122/97
guagccgucgaucccgguc

SEQ ID NO: 3099343 - RNA, 14 nt, Mycobacterium bovis subsp bovis AF2122/97
guagccgucgucgu

SEQ ID NO: 3099344 - RNA, 21 nt, Mycobacterium bovis subsp bovis AF2122/97
guagccgugggccacgaugau

SEQ ID NO: 3099345 - RNA, 17 nt, Mycobacterium bovis subsp bovis AF2122/97
guagccguugccgccga

SEQ ID NO: 3099346 - RNA, 19 nt, Mycobacterium bovis subsp bovis AF2122/97
guagccuggcuguccgcgg

SEQ ID NO: 3099347 - RNA, 21 nt, Mycobacterium bovis subsp bovis AF2122/97
guagcgaccgcggucgcugcg

SEQ ID NO: 3099348 - RNA, 16 nt, Mycobacterium bovis subsp bovis AF2122/97
guagcgaccucgccgc

SEQ ID NO: 3099349 - RNA, 22 nt, Mycobacterium bovis subsp bovis AF2122/97
guagcgaccucgccgcggcgga

SEQ ID NO: 3099350 - RNA, 13 nt, Mycobacterium bovis subsp bovis AF2122/97
guagcgacgccau

SEQ ID NO: 3099351 - RNA, 12 nt, Mycobacterium bovis subsp bovis AF2122/97
guagcgaugccg

SEQ ID NO: 3099352 - RNA, 20 nt, Mycobacterium bovis subsp bovis AF2122/97
guagcgcaaccgcgcuugga

SEQ ID NO: 3099353 - RNA, 18 nt, Mycobacterium bovis subsp bovis AF2122/97
guagcgcaaugcggcccg

SEQ ID NO: 3099354 - RNA, 13 nt, Mycobacterium bovis subsp bovis AF2122/97
guagcgccccgau

SEQ ID NO: 3099355 - RNA, 17 nt, Mycobacterium bovis subsp bovis AF2122/97
guagcgcggccgauacg

SEQ ID NO: 3099356 - RNA, 18 nt, Mycobacterium bovis subsp bovis AF2122/97
guagcgcggguggcucgg

SEQ ID NO: 3099357 - RNA, 20 nt, Mycobacterium bovis subsp bovis AF2122/97
guagcgcucgaucagguugg

SEQ ID NO: 3099358 - RNA, 13 nt, Mycobacterium bovis subsp bovis AF2122/97
guagcgcugcggg

SEQ ID NO: 3099359 - RNA, 14 nt, Mycobacterium bovis subsp bovis AF2122/97
guagcggccgcagg

SEQ ID NO: 3099360 - RNA, 21 nt, Mycobacterium bovis subsp bovis AF2122/97
guagcggcuccgaaggccgcc

SEQ ID NO: 3099361 - RNA, 22 nt, Mycobacterium bovis subsp bovis AF2122/97
guagcgggcaaacgaacgggug

SEQ ID NO: 3099362 - RNA, 14 nt, Mycobacterium bovis subsp bovis AF2122/97
guagcgggggagcg

SEQ ID NO: 3099363 - RNA, 14 nt, Mycobacterium bovis subsp bovis AF2122/97
guagcgguccagcg

SEQ ID NO: 3099364 - RNA, 22 nt, Mycobacterium bovis subsp bovis AF2122/97
guagcggucccgcggaccgcaa

SEQ ID NO: 3099365 - RNA, 14 nt, Mycobacterium bovis subsp bovis AF2122/97
guagcggucgauga

SEQ ID NO: 3099366 - RNA, 21 nt, Mycobacterium bovis subsp bovis AF2122/97
guagcgguuagaucacccgca

SEQ ID NO: 3099367 - RNA, 16 nt, Mycobacterium bovis subsp bovis AF2122/97
guagcguccaggucau

SEQ ID NO: 3099368 - RNA, 17 nt, Mycobacterium bovis subsp bovis AF2122/97
guagcguccgcgcccga

SEQ ID NO: 3099369 - RNA, 20 nt, Mycobacterium bovis subsp bovis AF2122/97
guagcgucgaucacgucguc

SEQ ID NO: 3099370 - RNA, 13 nt, Mycobacterium bovis subsp bovis AF2122/97
guagcgucgcacc

SEQ ID NO: 3099371 - RNA, 13 nt, Mycobacterium bovis subsp bovis AF2122/97
guagcguucggcg

SEQ ID NO: 3099372 - RNA, 23 nt, Mycobacterium bovis subsp bovis AF2122/97
guagcuaaugcacgcccaggcga

SEQ ID NO: 3099373 - RNA, 18 nt, Mycobacterium bovis subsp bovis AF2122/97
guagcucccugggcgucg

SEQ ID NO: 3099374 - RNA, 22 nt, Mycobacterium bovis subsp bovis AF2122/97
guagcucccugggcgucgacca

SEQ ID NO: 3099375 - RNA, 20 nt, Mycobacterium bovis subsp bovis AF2122/97
guagcuccuugagcaaugac

SEQ ID NO: 3099376 - RNA, 16 nt, Mycobacterium bovis subsp bovis AF2122/97
guagcucgucgaggaa

SEQ ID NO: 3099377 - RNA, 20 nt, Mycobacterium bovis subsp bovis AF2122/97
guagcucuuugagugccgcg

SEQ ID NO: 3099378 - RNA, 14 nt, Mycobacterium bovis subsp bovis AF2122/97
guagcugaccaucg

SEQ ID NO: 3099379 - RNA, 15 nt, Mycobacterium bovis subsp bovis AF2122/97
guagcugacggccug

SEQ ID NO: 3099380 - RNA, 12 nt, Mycobacterium bovis subsp bovis AF2122/97
guagcugcgcag

SEQ ID NO: 3099381 - RNA, 13 nt, Mycobacterium bovis subsp bovis AF2122/97
guagcuggccagg

SEQ ID NO: 3099382 - RNA, 23 nt, Mycobacterium bovis subsp bovis AF2122/97
guagcuggccagguugccgucgg

SEQ ID NO: 3099383 - RNA, 18 nt, Mycobacterium bovis subsp bovis AF2122/97
guagcuggugcguagccc

SEQ ID NO: 3099384 - RNA, 22 nt, Mycobacterium bovis subsp bovis AF2122/97
guagcuggugcguagcccaccc

SEQ ID NO: 3099385 - RNA, 18 nt, Mycobacterium bovis subsp bovis AF2122/97
guagcuguggcccgcggu

SEQ ID NO: 3099386 - RNA, 19 nt, Mycobacterium bovis subsp bovis AF2122/97
guagcuguggcccgcggug

SEQ ID NO: 3099387 - RNA, 19 nt, Mycobacterium bovis subsp bovis AF2122/97
guagcuuccgcgacgcucg

SEQ ID NO: 3099388 - RNA, 15 nt, Mycobacterium bovis subsp bovis AF2122/97
guagcuucgaugggc

SEQ ID NO: 3099389 - RNA, 19 nt, Mycobacterium bovis subsp bovis AF2122/97
guagcuucgaugggcauca

SEQ ID NO: 3099390 - RNA, 22 nt, Mycobacterium bovis subsp bovis AF2122/97
guaggacaccaccguggccucg

SEQ ID NO: 3099391 - RNA, 14 nt, Mycobacterium bovis subsp bovis AF2122/97
guaggacugccagc

SEQ ID NO: 3099392 - RNA, 17 nt, Mycobacterium bovis subsp bovis AF2122/97
guaggcaauggcgugcg

SEQ ID NO: 3099393 - RNA, 20 nt, Mycobacterium bovis subsp bovis AF2122/97
guaggcaggaucgccugagc

SEQ ID NO: 3099394 - RNA, 20 nt, Mycobacterium bovis subsp bovis AF2122/97
guaggccaccacugcgcccg

SEQ ID NO: 3099395 - RNA, 16 nt, Mycobacterium bovis subsp bovis AF2122/97
guaggcccagcaaccg

SEQ ID NO: 3099396 - RNA, 17 nt, Mycobacterium bovis subsp bovis AF2122/97
guaggccggggcgucgc

SEQ ID NO: 3099397 - RNA, 12 nt, Mycobacterium bovis subsp bovis AF2122/97
guaggccggugc

SEQ ID NO: 3099398 - RNA, 19 nt, Mycobacterium bovis subsp bovis AF2122/97
guaggccuccgcugccgcc

SEQ ID NO: 3099399 - RNA, 13 nt, Mycobacterium bovis subsp bovis AF2122/97
guaggccucggca

SEQ ID NO: 3099400 - RNA, 19 nt, Mycobacterium bovis subsp bovis AF2122/97
guaggccugcccccggcgc

SEQ ID NO: 3099401 - RNA, 21 nt, Mycobacterium bovis subsp bovis AF2122/97
guaggccugcccccggcgcgg

SEQ ID NO: 3099402 - RNA, 23 nt, Mycobacterium bovis subsp bovis AF2122/97
guaggccugcccccggcgcggcg

SEQ ID NO: 3099403 - RNA, 15 nt, Mycobacterium bovis subsp bovis AF2122/97
guaggccuggccccg

SEQ ID NO: 3099404 - RNA, 17 nt, Mycobacterium bovis subsp bovis AF2122/97
guaggcgaaccgcucca

SEQ ID NO: 3099405 - RNA, 16 nt, Mycobacterium bovis subsp bovis AF2122/97
guaggcgaccgccauu

SEQ ID NO: 3099406 - RNA, 17 nt, Mycobacterium bovis subsp bovis AF2122/97
guaggcgauaucgcccg

SEQ ID NO: 3099407 - RNA, 18 nt, Mycobacterium bovis subsp bovis AF2122/97
guaggcgaucucacgcau

SEQ ID NO: 3099408 - RNA, 17 nt, Mycobacterium bovis subsp bovis AF2122/97
guaggcgaugagcgugc

SEQ ID NO: 3099409 - RNA, 13 nt, Mycobacterium bovis subsp bovis AF2122/97
guaggcgccgcga

SEQ ID NO: 3099410 - RNA, 15 nt, Mycobacterium bovis subsp bovis AF2122/97
guaggcggaucuugg

SEQ ID NO: 3099411 - RNA, 15 nt, Mycobacterium bovis subsp bovis AF2122/97
guaggcggccagcgc

SEQ ID NO: 3099412 - RNA, 14 nt, Mycobacterium bovis subsp bovis AF2122/97
guaggcggcgaccc

SEQ ID NO: 3099413 - RNA, 16 nt, Mycobacterium bovis subsp bovis AF2122/97
guaggcggcggcccgc

SEQ ID NO: 3099414 - RNA, 14 nt, Mycobacterium bovis subsp bovis AF2122/97
guaggcggugaccc

SEQ ID NO: 3099415 - RNA, 23 nt, Mycobacterium bovis subsp bovis AF2122/97
guaggcuggccgccuccgcggca

SEQ ID NO: 3099416 - RNA, 17 nt, Mycobacterium bovis subsp bovis AF2122/97
guaggcuuccagcucgu

SEQ ID NO: 3099417 - RNA, 20 nt, Mycobacterium bovis subsp bovis AF2122/97
guaggcuuccagcucgucgu

SEQ ID NO: 3099418 - RNA, 17 nt, Mycobacterium bovis subsp bovis AF2122/97
guagggcagcgccaggc

SEQ ID NO: 3099419 - RNA, 15 nt, Mycobacterium bovis subsp bovis AF2122/97
guagggcaucgucgc

SEQ ID NO: 3099420 - RNA, 20 nt, Mycobacterium bovis subsp bovis AF2122/97
guagggcaucgucgccgagc

SEQ ID NO: 3099421 - RNA, 22 nt, Mycobacterium bovis subsp bovis AF2122/97
guagggcaucgucgccgagcgg

SEQ ID NO: 3099422 - RNA, 18 nt, Mycobacterium bovis subsp bovis AF2122/97
guagggcggcguugagcu

SEQ ID NO: 3099423 - RNA, 14 nt, Mycobacterium bovis subsp bovis AF2122/97
guagggcugcuccu

SEQ ID NO: 3099424 - RNA, 14 nt, Mycobacterium bovis subsp bovis AF2122/97
guaggggcaggcca

SEQ ID NO: 3099425 - RNA, 13 nt, Mycobacterium bovis subsp bovis AF2122/97
guagggugggucg

SEQ ID NO: 3099426 - RNA, 23 nt, Mycobacterium bovis subsp bovis AF2122/97
guaggucagcgcgucguccaggg

SEQ ID NO: 3099427 - RNA, 21 nt, Mycobacterium bovis subsp bovis AF2122/97
guagguccacguucggcugcg

SEQ ID NO: 3099428 - RNA, 23 nt, Mycobacterium bovis subsp bovis AF2122/97
guagguccuugucggccccggcc

SEQ ID NO: 3099429 - RNA, 18 nt, Mycobacterium bovis subsp bovis AF2122/97
guaggucgccgcuuugga

SEQ ID NO: 3099430 - RNA, 14 nt, Mycobacterium bovis subsp bovis AF2122/97
guaggugacgaagg

SEQ ID NO: 3099431 - RNA, 14 nt, Mycobacterium bovis subsp bovis AF2122/97
guaggugacgacgu

SEQ ID NO: 3099432 - RNA, 13 nt, Mycobacterium bovis subsp bovis AF2122/97
guaggugggcucg

SEQ ID NO: 3099433 - RNA, 15 nt, Mycobacterium bovis subsp bovis AF2122/97
guagguugcgccccg

SEQ ID NO: 3099434 - RNA, 15 nt, Mycobacterium bovis subsp bovis AF2122/97
guagguuuucggcgg

SEQ ID NO: 3099435 - RNA, 14 nt, Mycobacterium bovis subsp bovis AF2122/97
guaguaguucagcc

SEQ ID NO: 3099436 - RNA, 15 nt, Mycobacterium bovis subsp bovis AF2122/97
guagucagaaccgac

SEQ ID NO: 3099437 - RNA, 22 nt, Mycobacterium bovis subsp bovis AF2122/97
guagucagaaccgacggccagc

SEQ ID NO: 3099438 - RNA, 13 nt, Mycobacterium bovis subsp bovis AF2122/97
guaguccgcaucc

SEQ ID NO: 3099439 - RNA, 17 nt, Mycobacterium bovis subsp bovis AF2122/97
guaguccgcgccgacgg

SEQ ID NO: 3099440 - RNA, 19 nt, Mycobacterium bovis subsp bovis AF2122/97
guaguccgcgccgacggcc

SEQ ID NO: 3099441 - RNA, 14 nt, Mycobacterium bovis subsp bovis AF2122/97
guaguccgcgcuca

SEQ ID NO: 3099442 - RNA, 14 nt, Mycobacterium bovis subsp bovis AF2122/97
guaguccugcgggc

SEQ ID NO: 3099443 - RNA, 16 nt, Mycobacterium bovis subsp bovis AF2122/97
guaguccugcgggccg

SEQ ID NO: 3099444 - RNA, 14 nt, Mycobacterium bovis subsp bovis AF2122/97
guagucgaugcuga

SEQ ID NO: 3099445 - RNA, 15 nt, Mycobacterium bovis subsp bovis AF2122/97
guagucgaugcugac

SEQ ID NO: 3099446 - RNA, 18 nt, Mycobacterium bovis subsp bovis AF2122/97
guagucggccagcucgcg

SEQ ID NO: 3099447 - RNA, 21 nt, Mycobacterium bovis subsp bovis AF2122/97
guagucggccagcucgcgggc

SEQ ID NO: 3099448 - RNA, 22 nt, Mycobacterium bovis subsp bovis AF2122/97
guagucggccagcucgcgggcc

SEQ ID NO: 3099449 - RNA, 18 nt, Mycobacterium bovis subsp bovis AF2122/97
guagucgggcaaggcggc

SEQ ID NO: 3099450 - RNA, 23 nt, Mycobacterium bovis subsp bovis AF2122/97
guagucguugucuugggucagga

SEQ ID NO: 3099451 - RNA, 17 nt, Mycobacterium bovis subsp bovis AF2122/97
guagucugcacgucggc

SEQ ID NO: 3099452 - RNA, 16 nt, Mycobacterium bovis subsp bovis AF2122/97
guagugaacggaucgu

SEQ ID NO: 3099453 - RNA, 16 nt, Mycobacterium bovis subsp bovis AF2122/97
guagugaucgaucgcg

SEQ ID NO: 3099454 - RNA, 20 nt, Mycobacterium bovis subsp bovis AF2122/97
guagugaucgaucgcggcgc

SEQ ID NO: 3099455 - RNA, 17 nt, Mycobacterium bovis subsp bovis AF2122/97
guagugcacgucggcgg

SEQ ID NO: 3099456 - RNA, 18 nt, Mycobacterium bovis subsp bovis AF2122/97
guagugcagcugcaauga

SEQ ID NO: 3099457 - RNA, 17 nt, Mycobacterium bovis subsp bovis AF2122/97
guagugcaucggcagcc

SEQ ID NO: 3099458 - RNA, 23 nt, Mycobacterium bovis subsp bovis AF2122/97
guagugcguaaggcugugccggc

SEQ ID NO: 3099459 - RNA, 20 nt, Mycobacterium bovis subsp bovis AF2122/97
guaguggaagccgaccaccg

SEQ ID NO: 3099460 - RNA, 16 nt, Mycobacterium bovis subsp bovis AF2122/97
guaguggugggcgugg

SEQ ID NO: 3099461 - RNA, 15 nt, Mycobacterium bovis subsp bovis AF2122/97
guagugucggcgucu

SEQ ID NO: 3099462 - RNA, 19 nt, Mycobacterium bovis subsp bovis AF2122/97
guauaccgagggucgggca

SEQ ID NO: 3099463 - RNA, 14 nt, Mycobacterium bovis subsp bovis AF2122/97
guauagaccaggua

SEQ ID NO: 3099464 - RNA, 21 nt, Mycobacterium bovis subsp bovis AF2122/97
guauagccgacgccggugccg

SEQ ID NO: 3099465 - RNA, 22 nt, Mycobacterium bovis subsp bovis AF2122/97
guauagccgacgccggugccgg

SEQ ID NO: 3099466 - RNA, 13 nt, Mycobacterium bovis subsp bovis AF2122/97
guauagccggcgc

SEQ ID NO: 3099467 - RNA, 18 nt, Mycobacterium bovis subsp bovis AF2122/97
guauagcgcacugccggg

SEQ ID NO: 3099468 - RNA, 17 nt, Mycobacterium bovis subsp bovis AF2122/97
guauagcucacgguggc

SEQ ID NO: 3099469 - RNA, 19 nt, Mycobacterium bovis subsp bovis AF2122/97
guauagcucacgguggccg

SEQ ID NO: 3099470 - RNA, 21 nt, Mycobacterium bovis subsp bovis AF2122/97
guaucacgguugccgcgaucg

SEQ ID NO: 3099471 - RNA, 14 nt, Mycobacterium bovis subsp bovis AF2122/97
guauccaccgcgag

SEQ ID NO: 3099472 - RNA, 18 nt, Mycobacterium bovis subsp bovis AF2122/97
guauccacggucgaccag

SEQ ID NO: 3099473 - RNA, 20 nt, Mycobacterium bovis subsp bovis AF2122/97
guauccaugucgcgccaggc

SEQ ID NO: 3099474 - RNA, 18 nt, Mycobacterium bovis subsp bovis AF2122/97
guaucccucaaggucuuu

SEQ ID NO: 3099475 - RNA, 23 nt, Mycobacterium bovis subsp bovis AF2122/97
guauccgacgucggugaccucgg

SEQ ID NO: 3099476 - RNA, 14 nt, Mycobacterium bovis subsp bovis AF2122/97
guauccgacuggcc

SEQ ID NO: 3099477 - RNA, 21 nt, Mycobacterium bovis subsp bovis AF2122/97
guauccgcgccgcaccaucgg

SEQ ID NO: 3099478 - RNA, 23 nt, Mycobacterium bovis subsp bovis AF2122/97
guaucgaagcucaauuccaugca

SEQ ID NO: 3099479 - RNA, 18 nt, Mycobacterium bovis subsp bovis AF2122/97
guaucgacccuccagcac

SEQ ID NO: 3099480 - RNA, 14 nt, Mycobacterium bovis subsp bovis AF2122/97
guaucgacggcggc

SEQ ID NO: 3099481 - RNA, 20 nt, Mycobacterium bovis subsp bovis AF2122/97
guaucgacggcggccuucgg

SEQ ID NO: 3099482 - RNA, 14 nt, Mycobacterium bovis subsp bovis AF2122/97
guaucgagaugcca

SEQ ID NO: 3099483 - RNA, 20 nt, Mycobacterium bovis subsp bovis AF2122/97
guaucgagaugccaucggug

SEQ ID NO: 3099484 - RNA, 18 nt, Mycobacterium bovis subsp bovis AF2122/97
guaucgagggcagccgcc

SEQ ID NO: 3099485 - RNA, 20 nt, Mycobacterium bovis subsp bovis AF2122/97
guaucgccagccaaccgucc

SEQ ID NO: 3099486 - RNA, 22 nt, Mycobacterium bovis subsp bovis AF2122/97
guaucgccaguggugcaccgau

SEQ ID NO: 3099487 - RNA, 19 nt, Mycobacterium bovis subsp bovis AF2122/97
guaucgccgcuacgccggc

SEQ ID NO: 3099488 - RNA, 22 nt, Mycobacterium bovis subsp bovis AF2122/97
guaucgccggaguuccgccauu

SEQ ID NO: 3099489 - RNA, 15 nt, Mycobacterium bovis subsp bovis AF2122/97
guaucggcagauggu

SEQ ID NO: 3099490 - RNA, 20 nt, Mycobacterium bovis subsp bovis AF2122/97
guaucggcgugucucgucgc

SEQ ID NO: 3099491 - RNA, 24 nt, Mycobacterium bovis subsp bovis AF2122/97
guaucggggggucuugccgagcaa

SEQ ID NO: 3099492 - RNA, 20 nt, Mycobacterium bovis subsp bovis AF2122/97
guaucggugcuggucgccgc

SEQ ID NO: 3099493 - RNA, 23 nt, Mycobacterium bovis subsp bovis AF2122/97
guaucggugcuggucgccgcggc

SEQ ID NO: 3099494 - RNA, 13 nt, Mycobacterium bovis subsp bovis AF2122/97
guaucgucccggc

SEQ ID NO: 3099495 - RNA, 23 nt, Mycobacterium bovis subsp bovis AF2122/97
guaucuguuccuugugaccccgg

SEQ ID NO: 3099496 - RNA, 23 nt, Mycobacterium bovis subsp bovis AF2122/97
guaugagcuuccgcgcgcagaug

SEQ ID NO: 3099497 - RNA, 20 nt, Mycobacterium bovis subsp bovis AF2122/97
guaugauucacgcucggcgu

SEQ ID NO: 3099498 - RNA, 20 nt, Mycobacterium bovis subsp bovis AF2122/97
guaugcccgccguagaccag

SEQ ID NO: 3099499 - RNA, 17 nt, Mycobacterium bovis subsp bovis AF2122/97
guaugcccggauuggcg

SEQ ID NO: 3099500 - RNA, 19 nt, Mycobacterium bovis subsp bovis AF2122/97
guaugccgccaaccgcgug

SEQ ID NO: 3099501 - RNA, 19 nt, Mycobacterium bovis subsp bovis AF2122/97
guaugcgccaucucgacgg

SEQ ID NO: 3099502 - RNA, 17 nt, Mycobacterium bovis subsp bovis AF2122/97
guaugcgggacugaccc

SEQ ID NO: 3099503 - RNA, 18 nt, Mycobacterium bovis subsp bovis AF2122/97
guauggacgaggagcuca

SEQ ID NO: 3099504 - RNA, 16 nt, Mycobacterium bovis subsp bovis AF2122/97
guauggccgccaccgc

SEQ ID NO: 3099505 - RNA, 22 nt, Mycobacterium bovis subsp bovis AF2122/97
guauggcggcgacggccgcucg

SEQ ID NO: 3099506 - RNA, 14 nt, Mycobacterium bovis subsp bovis AF2122/97
guauggcggucggc

SEQ ID NO: 3099507 - RNA, 22 nt, Mycobacterium bovis subsp bovis AF2122/97
guaugggggugcuuccucgcga

SEQ ID NO: 3099508 - RNA, 21 nt, Mycobacterium bovis subsp bovis AF2122/97
guauucccgcuuggcgugacc

SEQ ID NO: 3099509 - RNA, 22 nt, Mycobacterium bovis subsp bovis AF2122/97
guauucccgcuuggcgugaccu

SEQ ID NO: 3099510 - RNA, 14 nt, Mycobacterium bovis subsp bovis AF2122/97
guauucggcaucgc

SEQ ID NO: 3099511 - RNA, 16 nt, Mycobacterium bovis subsp bovis AF2122/97
guauucggccgcgaga

SEQ ID NO: 3099512 - RNA, 19 nt, Mycobacterium bovis subsp bovis AF2122/97
guauucgguggagcgcggg

SEQ ID NO: 3099513 - RNA, 13 nt, Mycobacterium bovis subsp bovis AF2122/97
guauucguggucg

SEQ ID NO: 3099514 - RNA, 14 nt, Mycobacterium bovis subsp bovis AF2122/97
guauugcaccgcca

SEQ ID NO: 3099515 - RNA, 20 nt, Mycobacterium bovis subsp bovis AF2122/97
guauugccaaagcccgacau

SEQ ID NO: 3099516 - RNA, 16 nt, Mycobacterium bovis subsp bovis AF2122/97
guauuggacgcugccg

SEQ ID NO: 3099517 - RNA, 18 nt, Mycobacterium bovis subsp bovis AF2122/97
guauugggcgcggcaggc

SEQ ID NO: 3099518 - RNA, 22 nt, Mycobacterium bovis subsp bovis AF2122/97
guauugggcgcggcaggccugg

SEQ ID NO: 3099519 - RNA, 16 nt, Mycobacterium bovis subsp bovis AF2122/97
guauugggguggcagc

SEQ ID NO: 3099520 - RNA, 14 nt, Mycobacterium bovis subsp bovis AF2122/97
guauuuuucgacca

SEQ ID NO: 3099521 - RNA, 22 nt, Mycobacterium bovis subsp bovis AF2122/97
gucaaaaucagggugccgucgg

SEQ ID NO: 3099522 - RNA, 13 nt, Mycobacterium bovis subsp bovis AF2122/97
gucaaacccagcg

SEQ ID NO: 3099523 - RNA, 22 nt, Mycobacterium bovis subsp bovis AF2122/97
gucaaacccagcgacgcggcca

SEQ ID NO: 3099524 - RNA, 14 nt, Mycobacterium bovis subsp bovis AF2122/97
gucaaacgcaaaga

SEQ ID NO: 3099525 - RNA, 22 nt, Mycobacterium bovis subsp bovis AF2122/97
gucaaacgcaaagacagcgcgg

SEQ ID NO: 3099526 - RNA, 19 nt, Mycobacterium bovis subsp bovis AF2122/97
gucaaacgccgucacggca

SEQ ID NO: 3099527 - RNA, 14 nt, Mycobacterium bovis subsp bovis AF2122/97
gucaaacgcgcgcg

SEQ ID NO: 3099528 - RNA, 19 nt, Mycobacterium bovis subsp bovis AF2122/97
gucaaagaugucgcugggu

SEQ ID NO: 3099529 - RNA, 17 nt, Mycobacterium bovis subsp bovis AF2122/97
gucaaauccagcagcca

SEQ ID NO: 3099530 - RNA, 16 nt, Mycobacterium bovis subsp bovis AF2122/97
gucaacacccgcccgg

SEQ ID NO: 3099531 - RNA, 15 nt, Mycobacterium bovis subsp bovis AF2122/97
gucaacaccgcggcc

SEQ ID NO: 3099532 - RNA, 18 nt, Mycobacterium bovis subsp bovis AF2122/97
gucaacagauaaggauca

SEQ ID NO: 3099533 - RNA, 14 nt, Mycobacterium bovis subsp bovis AF2122/97
gucaacagcgucgu

SEQ ID NO: 3099534 - RNA, 17 nt, Mycobacterium bovis subsp bovis AF2122/97
gucaacaggccguggcg

SEQ ID NO: 3099535 - RNA, 19 nt, Mycobacterium bovis subsp bovis AF2122/97
gucaacaggccguggcgga

SEQ ID NO: 3099536 - RNA, 18 nt, Mycobacterium bovis subsp bovis AF2122/97
gucaacagggccaggaca

SEQ ID NO: 3099537 - RNA, 20 nt, Mycobacterium bovis subsp bovis AF2122/97
gucaaccaagcgugccugca

SEQ ID NO: 3099538 - RNA, 18 nt, Mycobacterium bovis subsp bovis AF2122/97
gucaaccagggugccggc

SEQ ID NO: 3099539 - RNA, 20 nt, Mycobacterium bovis subsp bovis AF2122/97
gucaaccagggugccggcgg

SEQ ID NO: 3099540 - RNA, 21 nt, Mycobacterium bovis subsp bovis AF2122/97
gucaaccagggugccggcggu

SEQ ID NO: 3099541 - RNA, 19 nt, Mycobacterium bovis subsp bovis AF2122/97
gucaacccgcaccccggcc

SEQ ID NO: 3099542 - RNA, 17 nt, Mycobacterium bovis subsp bovis AF2122/97
gucaacccguaaaagcc

SEQ ID NO: 3099543 - RNA, 12 nt, Mycobacterium bovis subsp bovis AF2122/97
gucaaccgaucg

SEQ ID NO: 3099544 - RNA, 12 nt, Mycobacterium bovis subsp bovis AF2122/97
gucaaccgcgcc

SEQ ID NO: 3099545 - RNA, 13 nt, Mycobacterium bovis subsp bovis AF2122/97
gucaacgacagcc

SEQ ID NO: 3099546 - RNA, 19 nt, Mycobacterium bovis subsp bovis AF2122/97
gucaacgacauugccacgg

SEQ ID NO: 3099547 - RNA, 12 nt, Mycobacterium bovis subsp bovis AF2122/97
gucaacgauggu

SEQ ID NO: 3099548 - RNA, 13 nt, Mycobacterium bovis subsp bovis AF2122/97
gucaacgccgcgg

SEQ ID NO: 3099549 - RNA, 13 nt, Mycobacterium bovis subsp bovis AF2122/97
gucaacgcuucgg

SEQ ID NO: 3099550 - RNA, 16 nt, Mycobacterium bovis subsp bovis AF2122/97
gucaacggcacccgaa

SEQ ID NO: 3099551 - RNA, 18 nt, Mycobacterium bovis subsp bovis AF2122/97
gucaacggccgacuuggu

SEQ ID NO: 3099552 - RNA, 18 nt, Mycobacterium bovis subsp bovis AF2122/97
gucaacgggaugccggcg

SEQ ID NO: 3099553 - RNA, 20 nt, Mycobacterium bovis subsp bovis AF2122/97
gucaacgggaugccggcgaa

SEQ ID NO: 3099554 - RNA, 21 nt, Mycobacterium bovis subsp bovis AF2122/97
gucaacgggaugccggcgaag

SEQ ID NO: 3099555 - RNA, 21 nt, Mycobacterium bovis subsp bovis AF2122/97
gucaacggucucaacgcaucg

SEQ ID NO: 3099556 - RNA, 16 nt, Mycobacterium bovis subsp bovis AF2122/97
gucaacucaccgucgg

SEQ ID NO: 3099557 - RNA, 14 nt, Mycobacterium bovis subsp bovis AF2122/97
gucaacucgaacgu

SEQ ID NO: 3099558 - RNA, 17 nt, Mycobacterium bovis subsp bovis AF2122/97
gucaacuugggcccgcu

SEQ ID NO: 3099559 - RNA, 16 nt, Mycobacterium bovis subsp bovis AF2122/97
gucaagaaggagaucg

SEQ ID NO: 3099560 - RNA, 24 nt, Mycobacterium bovis subsp bovis AF2122/97
gucaagagugcucagcgcgcgccg

SEQ ID NO: 3099561 - RNA, 16 nt, Mycobacterium bovis subsp bovis AF2122/97
gucaagcaaguccacc

SEQ ID NO: 3099562 - RNA, 18 nt, Mycobacterium bovis subsp bovis AF2122/97
gucaagcacacuggccac

SEQ ID NO: 3099563 - RNA, 19 nt, Mycobacterium bovis subsp bovis AF2122/97
gucaagccacacccggcgu

SEQ ID NO: 3099564 - RNA, 12 nt, Mycobacterium bovis subsp bovis AF2122/97
gucaagccggcg

SEQ ID NO: 3099565 - RNA, 14 nt, Mycobacterium bovis subsp bovis AF2122/97
gucaagccgggcac

SEQ ID NO: 3099566 - RNA, 17 nt, Mycobacterium bovis subsp bovis AF2122/97
gucaagccgggcacggg

SEQ ID NO: 3099567 - RNA, 22 nt, Mycobacterium bovis subsp bovis AF2122/97
gucaaggugucaacgcgcggcu

SEQ ID NO: 3099568 - RNA, 15 nt, Mycobacterium bovis subsp bovis AF2122/97
gucaagucugugcuc

SEQ ID NO: 3099569 - RNA, 17 nt, Mycobacterium bovis subsp bovis AF2122/97
gucaaguggcaaccgca

SEQ ID NO: 3099570 - RNA, 20 nt, Mycobacterium bovis subsp bovis AF2122/97
gucaaguggcaaccgcaccg

SEQ ID NO: 3099571 - RNA, 17 nt, Mycobacterium bovis subsp bovis AF2122/97
gucaaguucgccagcaa

SEQ ID NO: 3099572 - RNA, 23 nt, Mycobacterium bovis subsp bovis AF2122/97
gucaaucgcaaugaccugcagcg

SEQ ID NO: 3099573 - RNA, 15 nt, Mycobacterium bovis subsp bovis AF2122/97
gucaaugacaccggg

SEQ ID NO: 3099574 - RNA, 17 nt, Mycobacterium bovis subsp bovis AF2122/97
gucaaugccggccgcgg

SEQ ID NO: 3099575 - RNA, 17 nt, Mycobacterium bovis subsp bovis AF2122/97
gucaaugcgcuggcgcc

SEQ ID NO: 3099576 - RNA, 21 nt, Mycobacterium bovis subsp bovis AF2122/97
gucaaugcgcuggcgccgccg

SEQ ID NO: 3099577 - RNA, 22 nt, Mycobacterium bovis subsp bovis AF2122/97
gucaaugcgcuggcgccgccgg

SEQ ID NO: 3099578 - RNA, 21 nt, Mycobacterium bovis subsp bovis AF2122/97
gucaauggucuuuguccacga

SEQ ID NO: 3099579 - RNA, 20 nt, Mycobacterium bovis subsp bovis AF2122/97
gucaauucggugcgcuggcg

SEQ ID NO: 3099580 - RNA, 18 nt, Mycobacterium bovis subsp bovis AF2122/97
gucacaaaaccugggaug

SEQ ID NO: 3099581 - RNA, 16 nt, Mycobacterium bovis subsp bovis AF2122/97
gucacaaacccagcau

SEQ ID NO: 3099582 - RNA, 15 nt, Mycobacterium bovis subsp bovis AF2122/97
gucacaagccugccg

SEQ ID NO: 3099583 - RNA, 16 nt, Mycobacterium bovis subsp bovis AF2122/97
gucacaagucgacacg

SEQ ID NO: 3099584 - RNA, 17 nt, Mycobacterium bovis subsp bovis AF2122/97
gucacacguuggcagcc

SEQ ID NO: 3099585 - RNA, 15 nt, Mycobacterium bovis subsp bovis AF2122/97
gucacagcucaccau

SEQ ID NO: 3099586 - RNA, 14 nt, Mycobacterium bovis subsp bovis AF2122/97
gucacagugguggg

SEQ ID NO: 3099587 - RNA, 13 nt, Mycobacterium bovis subsp bovis AF2122/97
gucacaguucugc

SEQ ID NO: 3099588 - RNA, 15 nt, Mycobacterium bovis subsp bovis AF2122/97
gucacaguucugccu

SEQ ID NO: 3099589 - RNA, 18 nt, Mycobacterium bovis subsp bovis AF2122/97
gucacauccgacagcagc

SEQ ID NO: 3099590 - RNA, 14 nt, Mycobacterium bovis subsp bovis AF2122/97
gucaccaagacacc

SEQ ID NO: 3099591 - RNA, 16 nt, Mycobacterium bovis subsp bovis AF2122/97
gucaccaagacaccgg

SEQ ID NO: 3099592 - RNA, 20 nt, Mycobacterium bovis subsp bovis AF2122/97
gucaccaccaccgccgcacg

SEQ ID NO: 3099593 - RNA, 16 nt, Mycobacterium bovis subsp bovis AF2122/97
gucaccaccgccgcca

SEQ ID NO: 3099594 - RNA, 22 nt, Mycobacterium bovis subsp bovis AF2122/97
gucaccaccgccgccaccaccg

SEQ ID NO: 3099595 - RNA, 18 nt, Mycobacterium bovis subsp bovis AF2122/97
gucaccaccuggugcaac

SEQ ID NO: 3099596 - RNA, 24 nt, Mycobacterium bovis subsp bovis AF2122/97
gucaccacgagggccacguagcag

SEQ ID NO: 3099597 - RNA, 18 nt, Mycobacterium bovis subsp bovis AF2122/97
gucaccacgaucgcagug

SEQ ID NO: 3099598 - RNA, 20 nt, Mycobacterium bovis subsp bovis AF2122/97
gucaccacgcggcggucguu

SEQ ID NO: 3099599 - RNA, 17 nt, Mycobacterium bovis subsp bovis AF2122/97
gucaccacggcggcggc

SEQ ID NO: 3099600 - RNA, 13 nt, Mycobacterium bovis subsp bovis AF2122/97
gucaccagcgcau

SEQ ID NO: 3099601 - RNA, 13 nt, Mycobacterium bovis subsp bovis AF2122/97
gucaccaggccga

SEQ ID NO: 3099602 - RNA, 17 nt, Mycobacterium bovis subsp bovis AF2122/97
gucaccaggcugcaguc

SEQ ID NO: 3099603 - RNA, 17 nt, Mycobacterium bovis subsp bovis AF2122/97
gucaccauagcucaggg

SEQ ID NO: 3099604 - RNA, 16 nt, Mycobacterium bovis subsp bovis AF2122/97
gucaccauggcgccgc

SEQ ID NO: 3099605 - RNA, 19 nt, Mycobacterium bovis subsp bovis AF2122/97
gucaccauggcgccgcgcc

SEQ ID NO: 3099606 - RNA, 20 nt, Mycobacterium bovis subsp bovis AF2122/97
gucaccauggcgccgcgccg

SEQ ID NO: 3099607 - RNA, 22 nt, Mycobacterium bovis subsp bovis AF2122/97
gucaccauggcgccgcgccgau

SEQ ID NO: 3099608 - RNA, 20 nt, Mycobacterium bovis subsp bovis AF2122/97
gucacccaauggagccgcga

SEQ ID NO: 3099609 - RNA, 21 nt, Mycobacterium bovis subsp bovis AF2122/97
gucacccacguugaugaugcc

SEQ ID NO: 3099610 - RNA, 23 nt, Mycobacterium bovis subsp bovis AF2122/97
gucacccaucaacgccggcgacg

SEQ ID NO: 3099611 - RNA, 14 nt, Mycobacterium bovis subsp bovis AF2122/97
gucacccccggcca

SEQ ID NO: 3099612 - RNA, 14 nt, Mycobacterium bovis subsp bovis AF2122/97
gucaccccggcucg

SEQ ID NO: 3099613 - RNA, 17 nt, Mycobacterium bovis subsp bovis AF2122/97
gucaccccggcucggcc

SEQ ID NO: 3099614 - RNA, 20 nt, Mycobacterium bovis subsp bovis AF2122/97
gucaccccggcucggccacc

SEQ ID NO: 3099615 - RNA, 21 nt, Mycobacterium bovis subsp bovis AF2122/97
gucaccccggcucggccaccg

SEQ ID NO: 3099616 - RNA, 22 nt, Mycobacterium bovis subsp bovis AF2122/97
gucaccccggcucggccaccga

SEQ ID NO: 3099617 - RNA, 19 nt, Mycobacterium bovis subsp bovis AF2122/97
gucaccccggucccgccga

SEQ ID NO: 3099618 - RNA, 20 nt, Mycobacterium bovis subsp bovis AF2122/97
gucaccccggucccgccgac

SEQ ID NO: 3099619 - RNA, 17 nt, Mycobacterium bovis subsp bovis AF2122/97
gucaccccuucgccagc

SEQ ID NO: 3099620 - RNA, 19 nt, Mycobacterium bovis subsp bovis AF2122/97
gucaccccuucgccagcgc

SEQ ID NO: 3099621 - RNA, 22 nt, Mycobacterium bovis subsp bovis AF2122/97
gucaccccuucgccagcgccac

SEQ ID NO: 3099622 - RNA, 18 nt, Mycobacterium bovis subsp bovis AF2122/97
gucaccgacacggugcug

SEQ ID NO: 3099623 - RNA, 17 nt, Mycobacterium bovis subsp bovis AF2122/97
gucaccgagcccgaucg

SEQ ID NO: 3099624 - RNA, 18 nt, Mycobacterium bovis subsp bovis AF2122/97
gucaccgagcccgaucgc

SEQ ID NO: 3099625 - RNA, 17 nt, Mycobacterium bovis subsp bovis AF2122/97
gucaccgauucggccag

SEQ ID NO: 3099626 - RNA, 22 nt, Mycobacterium bovis subsp bovis AF2122/97
gucaccgauucggccagcgccc

SEQ ID NO: 3099627 - RNA, 18 nt, Mycobacterium bovis subsp bovis AF2122/97
gucaccgcaaccgagcug

SEQ ID NO: 3099628 - RNA, 22 nt, Mycobacterium bovis subsp bovis AF2122/97
gucaccgcagccaacgucacca

SEQ ID NO: 3099629 - RNA, 13 nt, Mycobacterium bovis subsp bovis AF2122/97
gucaccgccgacg

SEQ ID NO: 3099630 - RNA, 12 nt, Mycobacterium bovis subsp bovis AF2122/97
gucaccgccggc

SEQ ID NO: 3099631 - RNA, 14 nt, Mycobacterium bovis subsp bovis AF2122/97
gucaccgccggcac

SEQ ID NO: 3099632 - RNA, 16 nt, Mycobacterium bovis subsp bovis AF2122/97
gucaccgccggcaccg

SEQ ID NO: 3099633 - RNA, 23 nt, Mycobacterium bovis subsp bovis AF2122/97
gucaccgccgggaagccgcaucu

SEQ ID NO: 3099634 - RNA, 14 nt, Mycobacterium bovis subsp bovis AF2122/97
gucaccgccggugc

SEQ ID NO: 3099635 - RNA, 16 nt, Mycobacterium bovis subsp bovis AF2122/97
gucaccgccguugccg

SEQ ID NO: 3099636 - RNA, 20 nt, Mycobacterium bovis subsp bovis AF2122/97
gucaccgccguugccgccgg

SEQ ID NO: 3099637 - RNA, 23 nt, Mycobacterium bovis subsp bovis AF2122/97
gucaccgccguugccgccggcgc

SEQ ID NO: 3099638 - RNA, 14 nt, Mycobacterium bovis subsp bovis AF2122/97
gucaccgcgggcau

SEQ ID NO: 3099639 - RNA, 18 nt, Mycobacterium bovis subsp bovis AF2122/97
gucaccgcggguggaugu

SEQ ID NO: 3099640 - RNA, 18 nt, Mycobacterium bovis subsp bovis AF2122/97
gucaccgcgucaccggag

SEQ ID NO: 3099641 - RNA, 17 nt, Mycobacterium bovis subsp bovis AF2122/97
gucaccggaggccgccg

SEQ ID NO: 3099642 - RNA, 21 nt, Mycobacterium bovis subsp bovis AF2122/97
gucaccggaggccgccgcgcc

SEQ ID NO: 3099643 - RNA, 17 nt, Mycobacterium bovis subsp bovis AF2122/97
gucaccggcacgucgcc

SEQ ID NO: 3099644 - RNA, 13 nt, Mycobacterium bovis subsp bovis AF2122/97
gucaccggccgcc

SEQ ID NO: 3099645 - RNA, 16 nt, Mycobacterium bovis subsp bovis AF2122/97
gucaccggccgccgac

SEQ ID NO: 3099646 - RNA, 14 nt, Mycobacterium bovis subsp bovis AF2122/97
gucaccggcgcacc

SEQ ID NO: 3099647 - RNA, 15 nt, Mycobacterium bovis subsp bovis AF2122/97
gucaccggcgcaccg

SEQ ID NO: 3099648 - RNA, 19 nt, Mycobacterium bovis subsp bovis AF2122/97
gucaccggcgcaccggagu

SEQ ID NO: 3099649 - RNA, 13 nt, Mycobacterium bovis subsp bovis AF2122/97
gucaccggcgucg

SEQ ID NO: 3099650 - RNA, 19 nt, Mycobacterium bovis subsp bovis AF2122/97
gucaccggcuucggccagc

SEQ ID NO: 3099651 - RNA, 16 nt, Mycobacterium bovis subsp bovis AF2122/97
gucaccggucaccgcg

SEQ ID NO: 3099652 - RNA, 17 nt, Mycobacterium bovis subsp bovis AF2122/97
gucaccggucaccgcgc

SEQ ID NO: 3099653 - RNA, 14 nt, Mycobacterium bovis subsp bovis AF2122/97
gucaccggucggcc

SEQ ID NO: 3099654 - RNA, 16 nt, Mycobacterium bovis subsp bovis AF2122/97
gucaccgucugcaccg

SEQ ID NO: 3099655 - RNA, 16 nt, Mycobacterium bovis subsp bovis AF2122/97
gucaccgucuugcacg

SEQ ID NO: 3099656 - RNA, 23 nt, Mycobacterium bovis subsp bovis AF2122/97
gucaccgugggccugcccggcgc

SEQ ID NO: 3099657 - RNA, 20 nt, Mycobacterium bovis subsp bovis AF2122/97
gucaccguguugcacgcggg

SEQ ID NO: 3099658 - RNA, 21 nt, Mycobacterium bovis subsp bovis AF2122/97
gucaccguucuugucgaagua

SEQ ID NO: 3099659 - RNA, 15 nt, Mycobacterium bovis subsp bovis AF2122/97
gucaccguuggccgc

SEQ ID NO: 3099660 - RNA, 17 nt, Mycobacterium bovis subsp bovis AF2122/97
gucaccguuggccgcgc

SEQ ID NO: 3099661 - RNA, 20 nt, Mycobacterium bovis subsp bovis AF2122/97
gucaccucgccggcgggacg

SEQ ID NO: 3099662 - RNA, 14 nt, Mycobacterium bovis subsp bovis AF2122/97
gucaccucgucgcc

SEQ ID NO: 3099663 - RNA, 16 nt, Mycobacterium bovis subsp bovis AF2122/97
gucaccugcgggccca

SEQ ID NO: 3099664 - RNA, 16 nt, Mycobacterium bovis subsp bovis AF2122/97
gucaccugcugcaacc

SEQ ID NO: 3099665 - RNA, 20 nt, Mycobacterium bovis subsp bovis AF2122/97
gucaccuucuuggcggguga

SEQ ID NO: 3099666 - RNA, 19 nt, Mycobacterium bovis subsp bovis AF2122/97
gucacgaagaccaggccgg

SEQ ID NO: 3099667 - RNA, 21 nt, Mycobacterium bovis subsp bovis AF2122/97
gucacgacccaagucgccgag

SEQ ID NO: 3099668 - RNA, 14 nt, Mycobacterium bovis subsp bovis AF2122/97
gucacgaccugcuc

SEQ ID NO: 3099669 - RNA, 13 nt, Mycobacterium bovis subsp bovis AF2122/97
gucacgaucacga

SEQ ID NO: 3099670 - RNA, 16 nt, Mycobacterium bovis subsp bovis AF2122/97
gucacgaucacgaugu

SEQ ID NO: 3099671 - RNA, 19 nt, Mycobacterium bovis subsp bovis AF2122/97
gucacgaucacgauguccu

SEQ ID NO: 3099672 - RNA, 16 nt, Mycobacterium bovis subsp bovis AF2122/97
gucacgaucagggcga

SEQ ID NO: 3099673 - RNA, 21 nt, Mycobacterium bovis subsp bovis AF2122/97
gucacgaucgugccgggaccg

SEQ ID NO: 3099674 - RNA, 13 nt, Mycobacterium bovis subsp bovis AF2122/97
gucacgcacccgg

SEQ ID NO: 3099675 - RNA, 13 nt, Mycobacterium bovis subsp bovis AF2122/97
gucacgcaccgcg

SEQ ID NO: 3099676 - RNA, 20 nt, Mycobacterium bovis subsp bovis AF2122/97
gucacgcacgccgcgugccg

SEQ ID NO: 3099677 - RNA, 16 nt, Mycobacterium bovis subsp bovis AF2122/97
gucacgcagcacccug

SEQ ID NO: 3099678 - RNA, 17 nt, Mycobacterium bovis subsp bovis AF2122/97
gucacgcagcacccugc

SEQ ID NO: 3099679 - RNA, 17 nt, Mycobacterium bovis subsp bovis AF2122/97
gucacgcagccgcgcgg

SEQ ID NO: 3099680 - RNA, 16 nt, Mycobacterium bovis subsp bovis AF2122/97
gucacgccccucacgu

SEQ ID NO: 3099681 - RNA, 20 nt, Mycobacterium bovis subsp bovis AF2122/97
gucacgccggauggucggcc

SEQ ID NO: 3099682 - RNA, 23 nt, Mycobacterium bovis subsp bovis AF2122/97
gucacgccggauggucggccacg

SEQ ID NO: 3099683 - RNA, 15 nt, Mycobacterium bovis subsp bovis AF2122/97
gucacgcgaccaccg

SEQ ID NO: 3099684 - RNA, 17 nt, Mycobacterium bovis subsp bovis AF2122/97
gucacgcgaccaccgcc

SEQ ID NO: 3099685 - RNA, 13 nt, Mycobacterium bovis subsp bovis AF2122/97
gucacggacccuu

SEQ ID NO: 3099686 - RNA, 23 nt, Mycobacterium bovis subsp bovis AF2122/97
gucacggacccuuccgccgccgc

SEQ ID NO: 3099687 - RNA, 16 nt, Mycobacterium bovis subsp bovis AF2122/97
gucacgggcguuguua

SEQ ID NO: 3099688 - RNA, 15 nt, Mycobacterium bovis subsp bovis AF2122/97
gucacggucguggug

SEQ ID NO: 3099689 - RNA, 19 nt, Mycobacterium bovis subsp bovis AF2122/97
gucacggucguggugcaac

SEQ ID NO: 3099690 - RNA, 12 nt, Mycobacterium bovis subsp bovis AF2122/97
gucacggugcgu

SEQ ID NO: 3099691 - RNA, 18 nt, Mycobacterium bovis subsp bovis AF2122/97
gucacggugcguucgugc

SEQ ID NO: 3099692 - RNA, 20 nt, Mycobacterium bovis subsp bovis AF2122/97
gucacggugcguucgugcug

SEQ ID NO: 3099693 - RNA, 13 nt, Mycobacterium bovis subsp bovis AF2122/97
gucacgguggugu

SEQ ID NO: 3099694 - RNA, 17 nt, Mycobacterium bovis subsp bovis AF2122/97
gucacguggucggccac

SEQ ID NO: 3099695 - RNA, 22 nt, Mycobacterium bovis subsp bovis AF2122/97
gucacguucaguuccgcggcga

SEQ ID NO: 3099696 - RNA, 13 nt, Mycobacterium bovis subsp bovis AF2122/97
gucacguucggcg

SEQ ID NO: 3099697 - RNA, 19 nt, Mycobacterium bovis subsp bovis AF2122/97
gucacuacuccggucccgc

SEQ ID NO: 3099698 - RNA, 22 nt, Mycobacterium bovis subsp bovis AF2122/97
gucacucaccccaacagggcgg

SEQ ID NO: 3099699 - RNA, 20 nt, Mycobacterium bovis subsp bovis AF2122/97
gucacucccuggccgcuucg

SEQ ID NO: 3099700 - RNA, 22 nt, Mycobacterium bovis subsp bovis AF2122/97
gucacugcccugauugaagccc

SEQ ID NO: 3099701 - RNA, 16 nt, Mycobacterium bovis subsp bovis AF2122/97
gucacugugacgccgg

SEQ ID NO: 3099702 - RNA, 19 nt, Mycobacterium bovis subsp bovis AF2122/97
gucagaaaaagccgcguag

SEQ ID NO: 3099703 - RNA, 23 nt, Mycobacterium bovis subsp bovis AF2122/97
gucagaacaccggccaggccggc

SEQ ID NO: 3099704 - RNA, 14 nt, Mycobacterium bovis subsp bovis AF2122/97
gucagaacggcggc

SEQ ID NO: 3099705 - RNA, 15 nt, Mycobacterium bovis subsp bovis AF2122/97
gucagaacggcggca

SEQ ID NO: 3099706 - RNA, 21 nt, Mycobacterium bovis subsp bovis AF2122/97
gucagaacggcggcagcggcg

SEQ ID NO: 3099707 - RNA, 19 nt, Mycobacterium bovis subsp bovis AF2122/97
gucagaaggaucagcgcac

SEQ ID NO: 3099708 - RNA, 20 nt, Mycobacterium bovis subsp bovis AF2122/97
gucagaauugugugcagcag

SEQ ID NO: 3099709 - RNA, 16 nt, Mycobacterium bovis subsp bovis AF2122/97
gucagaccgcgaacag

SEQ ID NO: 3099710 - RNA, 15 nt, Mycobacterium bovis subsp bovis AF2122/97
gucagacgacgauga

SEQ ID NO: 3099711 - RNA, 22 nt, Mycobacterium bovis subsp bovis AF2122/97
gucagaucguuaugaccucgac

SEQ ID NO: 3099712 - RNA, 16 nt, Mycobacterium bovis subsp bovis AF2122/97
gucagcaagaucggca

SEQ ID NO: 3099713 - RNA, 18 nt, Mycobacterium bovis subsp bovis AF2122/97
gucagcaauacggcggcg

SEQ ID NO: 3099714 - RNA, 19 nt, Mycobacterium bovis subsp bovis AF2122/97
gucagcaauacggcggcgc

SEQ ID NO: 3099715 - RNA, 24 nt, Mycobacterium bovis subsp bovis AF2122/97
gucagcaauacggcggcgccgccc

SEQ ID NO: 3099716 - RNA, 17 nt, Mycobacterium bovis subsp bovis AF2122/97
gucagcacaaacccagu

SEQ ID NO: 3099717 - RNA, 23 nt, Mycobacterium bovis subsp bovis AF2122/97
gucagcacaugguccaaccagca

SEQ ID NO: 3099718 - RNA, 19 nt, Mycobacterium bovis subsp bovis AF2122/97
gucagcacccaacccggcg

SEQ ID NO: 3099719 - RNA, 21 nt, Mycobacterium bovis subsp bovis AF2122/97
gucagcacccaacccggcggc

SEQ ID NO: 3099720 - RNA, 22 nt, Mycobacterium bovis subsp bovis AF2122/97
gucagcacccaacccggcggca

SEQ ID NO: 3099721 - RNA, 23 nt, Mycobacterium bovis subsp bovis AF2122/97
gucagcacccaacccggcggcag

SEQ ID NO: 3099722 - RNA, 15 nt, Mycobacterium bovis subsp bovis AF2122/97
gucagcaccggcgcg

SEQ ID NO: 3099723 - RNA, 16 nt, Mycobacterium bovis subsp bovis AF2122/97
gucagcaccggcgcgg

SEQ ID NO: 3099724 - RNA, 18 nt, Mycobacterium bovis subsp bovis AF2122/97
gucagcaccuccaccgcg

SEQ ID NO: 3099725 - RNA, 19 nt, Mycobacterium bovis subsp bovis AF2122/97
gucagcaccuccaccgcgc

SEQ ID NO: 3099726 - RNA, 20 nt, Mycobacterium bovis subsp bovis AF2122/97
gucagcaccuccaccgcgcc

SEQ ID NO: 3099727 - RNA, 22 nt, Mycobacterium bovis subsp bovis AF2122/97
gucagcaccuccaccgcgccgg

SEQ ID NO: 3099728 - RNA, 23 nt, Mycobacterium bovis subsp bovis AF2122/97
gucagcaccuccaccgcgccggc

SEQ ID NO: 3099729 - RNA, 24 nt, Mycobacterium bovis subsp bovis AF2122/97
gucagcaccuccaccgcgccggcg

SEQ ID NO: 3099730 - RNA, 22 nt, Mycobacterium bovis subsp bovis AF2122/97
gucagcacgacgacaaccggcc

SEQ ID NO: 3099731 - RNA, 16 nt, Mycobacterium bovis subsp bovis AF2122/97
gucagcagauccgcga

SEQ ID NO: 3099732 - RNA, 14 nt, Mycobacterium bovis subsp bovis AF2122/97
gucagcagaugggc

SEQ ID NO: 3099733 - RNA, 13 nt, Mycobacterium bovis subsp bovis AF2122/97
gucagcagcccau

SEQ ID NO: 3099734 - RNA, 23 nt, Mycobacterium bovis subsp bovis AF2122/97
gucagcagcccauuucgagcucg

SEQ ID NO: 3099735 - RNA, 15 nt, Mycobacterium bovis subsp bovis AF2122/97
gucagcagcgccguc

SEQ ID NO: 3099736 - RNA, 17 nt, Mycobacterium bovis subsp bovis AF2122/97
gucagcagcuccacugg

SEQ ID NO: 3099737 - RNA, 21 nt, Mycobacterium bovis subsp bovis AF2122/97
gucagcaugggaauccgcugu

SEQ ID NO: 3099738 - RNA, 18 nt, Mycobacterium bovis subsp bovis AF2122/97
gucagcaugggguagauc

SEQ ID NO: 3099739 - RNA, 19 nt, Mycobacterium bovis subsp bovis AF2122/97
gucagccaccaucuggaug

SEQ ID NO: 3099740 - RNA, 21 nt, Mycobacterium bovis subsp bovis AF2122/97
gucagccaccaucuggauggc

SEQ ID NO: 3099741 - RNA, 13 nt, Mycobacterium bovis subsp bovis AF2122/97
gucagcccagcca

SEQ ID NO: 3099742 - RNA, 17 nt, Mycobacterium bovis subsp bovis AF2122/97
gucagccccgacugcgc

SEQ ID NO: 3099743 - RNA, 20 nt, Mycobacterium bovis subsp bovis AF2122/97
gucagccccgacugcgccca

SEQ ID NO: 3099744 - RNA, 13 nt, Mycobacterium bovis subsp bovis AF2122/97
gucagcccggcgc

SEQ ID NO: 3099745 - RNA, 14 nt, Mycobacterium bovis subsp bovis AF2122/97
gucagcccggcgcg

SEQ ID NO: 3099746 - RNA, 19 nt, Mycobacterium bovis subsp bovis AF2122/97
gucagccgaccgaccuggu

SEQ ID NO: 3099747 - RNA, 12 nt, Mycobacterium bovis subsp bovis AF2122/97
gucagccgaugg

SEQ ID NO: 3099748 - RNA, 14 nt, Mycobacterium bovis subsp bovis AF2122/97
gucagccgcgcggg

SEQ ID NO: 3099749 - RNA, 23 nt, Mycobacterium bovis subsp bovis AF2122/97
gucagccgcgcgggucacgaccu

SEQ ID NO: 3099750 - RNA, 15 nt, Mycobacterium bovis subsp bovis AF2122/97
gucagccgcggggcg

SEQ ID NO: 3099751 - RNA, 10 nt, Mycobacterium bovis subsp bovis AF2122/97
gucagccggu

SEQ ID NO: 3099752 - RNA, 12 nt, Mycobacterium bovis subsp bovis AF2122/97
gucagccgguga

SEQ ID NO: 3099753 - RNA, 15 nt, Mycobacterium bovis subsp bovis AF2122/97
gucagccguacgccg

SEQ ID NO: 3099754 - RNA, 20 nt, Mycobacterium bovis subsp bovis AF2122/97
gucagccgugccguggugaa

SEQ ID NO: 3099755 - RNA, 15 nt, Mycobacterium bovis subsp bovis AF2122/97
gucagccguucggcu

SEQ ID NO: 3099756 - RNA, 17 nt, Mycobacterium bovis subsp bovis AF2122/97
gucagccugccagguac

SEQ ID NO: 3099757 - RNA, 20 nt, Mycobacterium bovis subsp bovis AF2122/97
gucagccugccagguacuca

SEQ ID NO: 3099758 - RNA, 20 nt, Mycobacterium bovis subsp bovis AF2122/97
gucagcgaacggccaggaca

SEQ ID NO: 3099759 - RNA, 14 nt, Mycobacterium bovis subsp bovis AF2122/97
gucagcgaccacgu

SEQ ID NO: 3099760 - RNA, 23 nt, Mycobacterium bovis subsp bovis AF2122/97
gucagcgaccucacugcggcgcc

SEQ ID NO: 3099761 - RNA, 12 nt, Mycobacterium bovis subsp bovis AF2122/97
gucagcgccgag

SEQ ID NO: 3099762 - RNA, 13 nt, Mycobacterium bovis subsp bovis AF2122/97
gucagcgccgaga

SEQ ID NO: 3099763 - RNA, 13 nt, Mycobacterium bovis subsp bovis AF2122/97
gucagcgccgccg

SEQ ID NO: 3099764 - RNA, 12 nt, Mycobacterium bovis subsp bovis AF2122/97
gucagcgcggca

SEQ ID NO: 3099765 - RNA, 14 nt, Mycobacterium bovis subsp bovis AF2122/97
gucagcgcggcaag

SEQ ID NO: 3099766 - RNA, 12 nt, Mycobacterium bovis subsp bovis AF2122/97
gucagcgcggcg

SEQ ID NO: 3099767 - RNA, 12 nt, Mycobacterium bovis subsp bovis AF2122/97
gucagcgcgucg

SEQ ID NO: 3099768 - RNA, 20 nt, Mycobacterium bovis subsp bovis AF2122/97
gucagcggauccaggccucg

SEQ ID NO: 3099769 - RNA, 13 nt, Mycobacterium bovis subsp bovis AF2122/97
gucagcggccgcg

SEQ ID NO: 3099770 - RNA, 15 nt, Mycobacterium bovis subsp bovis AF2122/97
gucagcggccgcgac

SEQ ID NO: 3099771 - RNA, 16 nt, Mycobacterium bovis subsp bovis AF2122/97
gucagcggccgcgacg

SEQ ID NO: 3099772 - RNA, 18 nt, Mycobacterium bovis subsp bovis AF2122/97
gucagcggccugcucggg

SEQ ID NO: 3099773 - RNA, 16 nt, Mycobacterium bovis subsp bovis AF2122/97
gucagcggcggccacg

SEQ ID NO: 3099774 - RNA, 17 nt, Mycobacterium bovis subsp bovis AF2122/97
gucagcggcggccacgg

SEQ ID NO: 3099775 - RNA, 15 nt, Mycobacterium bovis subsp bovis AF2122/97
gucagcggcucggcg

SEQ ID NO: 3099776 - RNA, 16 nt, Mycobacterium bovis subsp bovis AF2122/97
gucagcggcucggcgg

SEQ ID NO: 3099777 - RNA, 18 nt, Mycobacterium bovis subsp bovis AF2122/97
gucagcggcugggcgguc

SEQ ID NO: 3099778 - RNA, 14 nt, Mycobacterium bovis subsp bovis AF2122/97
gucagcgggcagca

SEQ ID NO: 3099779 - RNA, 20 nt, Mycobacterium bovis subsp bovis AF2122/97
gucagcgggcuugccguugg

SEQ ID NO: 3099780 - RNA, 15 nt, Mycobacterium bovis subsp bovis AF2122/97
gucagcgguugggcg

SEQ ID NO: 3099781 - RNA, 22 nt, Mycobacterium bovis subsp bovis AF2122/97
gucagcgucggcgcaucaccac

SEQ ID NO: 3099782 - RNA, 23 nt, Mycobacterium bovis subsp bovis AF2122/97
gucagcgucugagcgccggcauc

SEQ ID NO: 3099783 - RNA, 21 nt, Mycobacterium bovis subsp bovis AF2122/97
gucagcguugaccgcaucguc

SEQ ID NO: 3099784 - RNA, 22 nt, Mycobacterium bovis subsp bovis AF2122/97
gucagcuagguauugccgcaga

SEQ ID NO: 3099785 - RNA, 16 nt, Mycobacterium bovis subsp bovis AF2122/97
gucagcucccggcuuc

SEQ ID NO: 3099786 - RNA, 21 nt, Mycobacterium bovis subsp bovis AF2122/97
gucagcucgaccugaggcacc

SEQ ID NO: 3099787 - RNA, 15 nt, Mycobacterium bovis subsp bovis AF2122/97
gucagcucgaucacg

SEQ ID NO: 3099788 - RNA, 15 nt, Mycobacterium bovis subsp bovis AF2122/97
gucagcucggcagca

SEQ ID NO: 3099789 - RNA, 21 nt, Mycobacterium bovis subsp bovis AF2122/97
gucagcugauuaccgacaccg

SEQ ID NO: 3099790 - RNA, 16 nt, Mycobacterium bovis subsp bovis AF2122/97
gucagcuggccgcggc

SEQ ID NO: 3099791 - RNA, 17 nt, Mycobacterium bovis subsp bovis AF2122/97
gucaggaaaccggcgcg

SEQ ID NO: 3099792 - RNA, 17 nt, Mycobacterium bovis subsp bovis AF2122/97
gucaggcacaacgcgac

SEQ ID NO: 3099793 - RNA, 19 nt, Mycobacterium bovis subsp bovis AF2122/97
gucaggcagcuccgccgcc

SEQ ID NO: 3099794 - RNA, 18 nt, Mycobacterium bovis subsp bovis AF2122/97
gucaggcaguccaccgcg

SEQ ID NO: 3099795 - RNA, 19 nt, Mycobacterium bovis subsp bovis AF2122/97
gucaggcaguccaccgcgc

SEQ ID NO: 3099796 - RNA, 22 nt, Mycobacterium bovis subsp bovis AF2122/97
gucaggcaguccaccgcgcggc

SEQ ID NO: 3099797 - RNA, 19 nt, Mycobacterium bovis subsp bovis AF2122/97
gucaggccagagucgcccg

SEQ ID NO: 3099798 - RNA, 17 nt, Mycobacterium bovis subsp bovis AF2122/97
gucaggccagggugacc

SEQ ID NO: 3099799 - RNA, 18 nt, Mycobacterium bovis subsp bovis AF2122/97
gucaggccagggugacca

SEQ ID NO: 3099800 - RNA, 22 nt, Mycobacterium bovis subsp bovis AF2122/97
gucaggccagggugaccaggcc

SEQ ID NO: 3099801 - RNA, 14 nt, Mycobacterium bovis subsp bovis AF2122/97
gucaggcccauggc

SEQ ID NO: 3099802 - RNA, 17 nt, Mycobacterium bovis subsp bovis AF2122/97
gucaggcccauggcagc

SEQ ID NO: 3099803 - RNA, 20 nt, Mycobacterium bovis subsp bovis AF2122/97
gucaggccgacuaaccacug

SEQ ID NO: 3099804 - RNA, 15 nt, Mycobacterium bovis subsp bovis AF2122/97
gucaggccgccgcgg

SEQ ID NO: 3099805 - RNA, 16 nt, Mycobacterium bovis subsp bovis AF2122/97
gucaggccgccgcggc

SEQ ID NO: 3099806 - RNA, 17 nt, Mycobacterium bovis subsp bovis AF2122/97
gucaggccgccgcggcg

SEQ ID NO: 3099807 - RNA, 16 nt, Mycobacterium bovis subsp bovis AF2122/97
gucaggccuccaaaau

SEQ ID NO: 3099808 - RNA, 17 nt, Mycobacterium bovis subsp bovis AF2122/97
gucaggccuccaaaauc

SEQ ID NO: 3099809 - RNA, 16 nt, Mycobacterium bovis subsp bovis AF2122/97
gucaggcggccgucgu

SEQ ID NO: 3099810 - RNA, 21 nt, Mycobacterium bovis subsp bovis AF2122/97
gucaggcggccgucgucggcc

SEQ ID NO: 3099811 - RNA, 12 nt, Mycobacterium bovis subsp bovis AF2122/97
gucaggcggcgg

SEQ ID NO: 3099812 - RNA, 13 nt, Mycobacterium bovis subsp bovis AF2122/97
gucaggcggcgga

SEQ ID NO: 3099813 - RNA, 21 nt, Mycobacterium bovis subsp bovis AF2122/97
gucaggcggcggacccgcucg

SEQ ID NO: 3099814 - RNA, 14 nt, Mycobacterium bovis subsp bovis AF2122/97
gucaggcgggagcg

SEQ ID NO: 3099815 - RNA, 16 nt, Mycobacterium bovis subsp bovis AF2122/97
gucaggcguagguccu

SEQ ID NO: 3099816 - RNA, 20 nt, Mycobacterium bovis subsp bovis AF2122/97
gucaggcgugccggggauau

SEQ ID NO: 3099817 - RNA, 22 nt, Mycobacterium bovis subsp bovis AF2122/97
gucaggcucacacucggccggg

SEQ ID NO: 3099818 - RNA, 15 nt, Mycobacterium bovis subsp bovis AF2122/97
gucagguacaucccg

SEQ ID NO: 3099819 - RNA, 14 nt, Mycobacterium bovis subsp bovis AF2122/97
gucaggugauucgc

SEQ ID NO: 3099820 - RNA, 21 nt, Mycobacterium bovis subsp bovis AF2122/97
gucaggugauucgcgcagcgc

SEQ ID NO: 3099821 - RNA, 15 nt, Mycobacterium bovis subsp bovis AF2122/97
gucaggugcgcgacc

SEQ ID NO: 3099822 - RNA, 18 nt, Mycobacterium bovis subsp bovis AF2122/97
gucaggugcgcgaccagg

SEQ ID NO: 3099823 - RNA, 19 nt, Mycobacterium bovis subsp bovis AF2122/97
gucaggugcguuugcacug

SEQ ID NO: 3099824 - RNA, 16 nt, Mycobacterium bovis subsp bovis AF2122/97
gucagguggccaaugc

SEQ ID NO: 3099825 - RNA, 16 nt, Mycobacterium bovis subsp bovis AF2122/97
gucagguugucggcga

SEQ ID NO: 3099826 - RNA, 13 nt, Mycobacterium bovis subsp bovis AF2122/97
gucaguaccgcac

SEQ ID NO: 3099827 - RNA, 14 nt, Mycobacterium bovis subsp bovis AF2122/97
gucaguaccgcacg

SEQ ID NO: 3099828 - RNA, 20 nt, Mycobacterium bovis subsp bovis AF2122/97
gucaguagccacgcccacag

SEQ ID NO: 3099829 - RNA, 19 nt, Mycobacterium bovis subsp bovis AF2122/97
gucaguccgacaccacgga

SEQ ID NO: 3099830 - RNA, 19 nt, Mycobacterium bovis subsp bovis AF2122/97
gucaguccgacaccggcgg

SEQ ID NO: 3099831 - RNA, 14 nt, Mycobacterium bovis subsp bovis AF2122/97
gucaguccucaucg

SEQ ID NO: 3099832 - RNA, 21 nt, Mycobacterium bovis subsp bovis AF2122/97
gucaguccucaucgagcgcgc

SEQ ID NO: 3099833 - RNA, 17 nt, Mycobacterium bovis subsp bovis AF2122/97
gucagugaucaccaacc

SEQ ID NO: 3099834 - RNA, 18 nt, Mycobacterium bovis subsp bovis AF2122/97
gucagugcgaugcggugu

SEQ ID NO: 3099835 - RNA, 19 nt, Mycobacterium bovis subsp bovis AF2122/97
gucaguucggugugcggcg

SEQ ID NO: 3099836 - RNA, 22 nt, Mycobacterium bovis subsp bovis AF2122/97
gucaguugugcguugcgcugcg

SEQ ID NO: 3099837 - RNA, 14 nt, Mycobacterium bovis subsp bovis AF2122/97
gucauagccguugc

SEQ ID NO: 3099838 - RNA, 17 nt, Mycobacterium bovis subsp bovis AF2122/97
gucauagcgcaccaccg

SEQ ID NO: 3099839 - RNA, 24 nt, Mycobacterium bovis subsp bovis AF2122/97
gucauauaggagcgggugcauucg

SEQ ID NO: 3099840 - RNA, 20 nt, Mycobacterium bovis subsp bovis AF2122/97
gucaucaaucuucccaccuu

SEQ ID NO: 3099841 - RNA, 18 nt, Mycobacterium bovis subsp bovis AF2122/97
gucaucauggccggaucc

SEQ ID NO: 3099842 - RNA, 20 nt, Mycobacterium bovis subsp bovis AF2122/97
gucaucaugucgagguucca

SEQ ID NO: 3099843 - RNA, 19 nt, Mycobacterium bovis subsp bovis AF2122/97
gucauccaacgcacgccac

SEQ ID NO: 3099844 - RNA, 13 nt, Mycobacterium bovis subsp bovis AF2122/97
gucauccaccgca

SEQ ID NO: 3099845 - RNA, 18 nt, Mycobacterium bovis subsp bovis AF2122/97
gucauccauccgggccgc

SEQ ID NO: 3099846 - RNA, 20 nt, Mycobacterium bovis subsp bovis AF2122/97
gucauccauccgggccgcgg

SEQ ID NO: 3099847 - RNA, 22 nt, Mycobacterium bovis subsp bovis AF2122/97
gucauccauccgggccgcggcc

SEQ ID NO: 3099848 - RNA, 13 nt, Mycobacterium bovis subsp bovis AF2122/97
gucauccccgacu

SEQ ID NO: 3099849 - RNA, 21 nt, Mycobacterium bovis subsp bovis AF2122/97
gucaucccuuucgcgccgcga

SEQ ID NO: 3099850 - RNA, 16 nt, Mycobacterium bovis subsp bovis AF2122/97
gucauccgacaagcug

SEQ ID NO: 3099851 - RNA, 20 nt, Mycobacterium bovis subsp bovis AF2122/97
gucauccgacaagcugucgg

SEQ ID NO: 3099852 - RNA, 16 nt, Mycobacterium bovis subsp bovis AF2122/97
gucauccggccgucgg

SEQ ID NO: 3099853 - RNA, 22 nt, Mycobacterium bovis subsp bovis AF2122/97
gucauccggccgucggcgggca

SEQ ID NO: 3099854 - RNA, 14 nt, Mycobacterium bovis subsp bovis AF2122/97
gucaucgagcugac

SEQ ID NO: 3099855 - RNA, 16 nt, Mycobacterium bovis subsp bovis AF2122/97
gucaucgccagcggca

SEQ ID NO: 3099856 - RNA, 17 nt, Mycobacterium bovis subsp bovis AF2122/97
gucaucgccgacccgcc

SEQ ID NO: 3099857 - RNA, 18 nt, Mycobacterium bovis subsp bovis AF2122/97
gucaucuccgacucgaua

SEQ ID NO: 3099858 - RNA, 15 nt, Mycobacterium bovis subsp bovis AF2122/97
gucaucuggcgcugc

SEQ ID NO: 3099859 - RNA, 17 nt, Mycobacterium bovis subsp bovis AF2122/97
gucaucuugccaccgcu

SEQ ID NO: 3099860 - RNA, 19 nt, Mycobacterium bovis subsp bovis AF2122/97
gucaugaacgaucggacca

SEQ ID NO: 3099861 - RNA, 17 nt, Mycobacterium bovis subsp bovis AF2122/97
gucaugccagucgccga

SEQ ID NO: 3099862 - RNA, 14 nt, Mycobacterium bovis subsp bovis AF2122/97
gucaugcccaccgc

SEQ ID NO: 3099863 - RNA, 17 nt, Mycobacterium bovis subsp bovis AF2122/97
gucauggcccgaucgac

SEQ ID NO: 3099864 - RNA, 21 nt, Mycobacterium bovis subsp bovis AF2122/97
gucauggcgaguacggccugc

SEQ ID NO: 3099865 - RNA, 20 nt, Mycobacterium bovis subsp bovis AF2122/97
gucauggcgggugcggcgau

SEQ ID NO: 3099866 - RNA, 21 nt, Mycobacterium bovis subsp bovis AF2122/97
gucaugggaucaggcugggca

SEQ ID NO: 3099867 - RNA, 22 nt, Mycobacterium bovis subsp bovis AF2122/97
gucaugggaucaggcugggcag

SEQ ID NO: 3099868 - RNA, 14 nt, Mycobacterium bovis subsp bovis AF2122/97
gucaugggcgcgua

SEQ ID NO: 3099869 - RNA, 15 nt, Mycobacterium bovis subsp bovis AF2122/97
gucaugggcggcuuc

SEQ ID NO: 3099870 - RNA, 23 nt, Mycobacterium bovis subsp bovis AF2122/97
gucaugggcggcuucgaugucgu

SEQ ID NO: 3099871 - RNA, 18 nt, Mycobacterium bovis subsp bovis AF2122/97
gucauguccauagccggc

SEQ ID NO: 3099872 - RNA, 17 nt, Mycobacterium bovis subsp bovis AF2122/97
gucauguccguccgcga

SEQ ID NO: 3099873 - RNA, 19 nt, Mycobacterium bovis subsp bovis AF2122/97
gucauguccugggccgccg

SEQ ID NO: 3099874 - RNA, 20 nt, Mycobacterium bovis subsp bovis AF2122/97
gucauguccugggccgccgc

SEQ ID NO: 3099875 - RNA, 14 nt, Mycobacterium bovis subsp bovis AF2122/97
gucaugucgaucag

SEQ ID NO: 3099876 - RNA, 16 nt, Mycobacterium bovis subsp bovis AF2122/97
gucaugucgaucagcg

SEQ ID NO: 3099877 - RNA, 15 nt, Mycobacterium bovis subsp bovis AF2122/97
gucaugucggccacc

SEQ ID NO: 3099878 - RNA, 20 nt, Mycobacterium bovis subsp bovis AF2122/97
gucauguucggggcgcacca

SEQ ID NO: 3099879 - RNA, 13 nt, Mycobacterium bovis subsp bovis AF2122/97
gucauugccggcg

SEQ ID NO: 3099880 - RNA, 16 nt, Mycobacterium bovis subsp bovis AF2122/97
gucauugccggcgacg

SEQ ID NO: 3099881 - RNA, 13 nt, Mycobacterium bovis subsp bovis AF2122/97
guccaacagcgcc

SEQ ID NO: 3099882 - RNA, 17 nt, Mycobacterium bovis subsp bovis AF2122/97
guccaaccacgagcauc

SEQ ID NO: 3099883 - RNA, 15 nt, Mycobacterium bovis subsp bovis AF2122/97
guccaaccagcacca

SEQ ID NO: 3099884 - RNA, 17 nt, Mycobacterium bovis subsp bovis AF2122/97
guccaaccgggccggcu

SEQ ID NO: 3099885 - RNA, 17 nt, Mycobacterium bovis subsp bovis AF2122/97
guccaacucggcccggg

SEQ ID NO: 3099886 - RNA, 23 nt, Mycobacterium bovis subsp bovis AF2122/97
guccaacucggcccgggugacgg

SEQ ID NO: 3099887 - RNA, 20 nt, Mycobacterium bovis subsp bovis AF2122/97
guccaagacagccugcgcca

SEQ ID NO: 3099888 - RNA, 16 nt, Mycobacterium bovis subsp bovis AF2122/97
guccaagccggccacg

SEQ ID NO: 3099889 - RNA, 22 nt, Mycobacterium bovis subsp bovis AF2122/97
guccaagccggcugcauccucc

SEQ ID NO: 3099890 - RNA, 20 nt, Mycobacterium bovis subsp bovis AF2122/97
guccaagccguagaccaggc

SEQ ID NO: 3099891 - RNA, 22 nt, Mycobacterium bovis subsp bovis AF2122/97
guccaagccguagaccaggccc

SEQ ID NO: 3099892 - RNA, 17 nt, Mycobacterium bovis subsp bovis AF2122/97
guccaagugcuuccggc

SEQ ID NO: 3099893 - RNA, 17 nt, Mycobacterium bovis subsp bovis AF2122/97
guccaagugggccggcg

SEQ ID NO: 3099894 - RNA, 18 nt, Mycobacterium bovis subsp bovis AF2122/97
guccaagugggccggcgg

SEQ ID NO: 3099895 - RNA, 17 nt, Mycobacterium bovis subsp bovis AF2122/97
guccaauacucgccauc

SEQ ID NO: 3099896 - RNA, 21 nt, Mycobacterium bovis subsp bovis AF2122/97
guccaauacucgccaucgcgg

SEQ ID NO: 3099897 - RNA, 19 nt, Mycobacterium bovis subsp bovis AF2122/97
guccaauagcugacaccga

SEQ ID NO: 3099898 - RNA, 23 nt, Mycobacterium bovis subsp bovis AF2122/97
guccaaucuucucgagccgccgg

SEQ ID NO: 3099899 - RNA, 15 nt, Mycobacterium bovis subsp bovis AF2122/97
guccaaugcaccguu

SEQ ID NO: 3099900 - RNA, 22 nt, Mycobacterium bovis subsp bovis AF2122/97
guccaauuccagcucacgaugu

SEQ ID NO: 3099901 - RNA, 17 nt, Mycobacterium bovis subsp bovis AF2122/97
guccaauuccgcagaga

SEQ ID NO: 3099902 - RNA, 16 nt, Mycobacterium bovis subsp bovis AF2122/97
guccaauugucaagcc

SEQ ID NO: 3099903 - RNA, 16 nt, Mycobacterium bovis subsp bovis AF2122/97
guccaauuguucggcc

SEQ ID NO: 3099904 - RNA, 16 nt, Mycobacterium bovis subsp bovis AF2122/97
guccacaacgcccgca

SEQ ID NO: 3099905 - RNA, 19 nt, Mycobacterium bovis subsp bovis AF2122/97
guccacaacgcccgcaucg

SEQ ID NO: 3099906 - RNA, 19 nt, Mycobacterium bovis subsp bovis AF2122/97
guccacaccaugguuggcg

SEQ ID NO: 3099907 - RNA, 13 nt, Mycobacterium bovis subsp bovis AF2122/97
guccacagccggc

SEQ ID NO: 3099908 - RNA, 14 nt, Mycobacterium bovis subsp bovis AF2122/97
guccacagccggcg

SEQ ID NO: 3099909 - RNA, 23 nt, Mycobacterium bovis subsp bovis AF2122/97
guccacauccagggugccgguca

SEQ ID NO: 3099910 - RNA, 18 nt, Mycobacterium bovis subsp bovis AF2122/97
guccaccacaccugcggc

SEQ ID NO: 3099911 - RNA, 12 nt, Mycobacterium bovis subsp bovis AF2122/97
guccaccaccgg

SEQ ID NO: 3099912 - RNA, 17 nt, Mycobacterium bovis subsp bovis AF2122/97
guccaccaccggcaccc

SEQ ID NO: 3099913 - RNA, 20 nt, Mycobacterium bovis subsp bovis AF2122/97
guccaccaccuggccggcca

SEQ ID NO: 3099914 - RNA, 18 nt, Mycobacterium bovis subsp bovis AF2122/97
guccaccagccgguuggc

SEQ ID NO: 3099915 - RNA, 14 nt, Mycobacterium bovis subsp bovis AF2122/97
guccaccccgccga

SEQ ID NO: 3099916 - RNA, 15 nt, Mycobacterium bovis subsp bovis AF2122/97
guccaccccgccgau

SEQ ID NO: 3099917 - RNA, 21 nt, Mycobacterium bovis subsp bovis AF2122/97
guccaccgaccuaccgucgac

SEQ ID NO: 3099918 - RNA, 16 nt, Mycobacterium bovis subsp bovis AF2122/97
guccaccgacguggcc

SEQ ID NO: 3099919 - RNA, 23 nt, Mycobacterium bovis subsp bovis AF2122/97
guccaccgacguggccagcccgc

SEQ ID NO: 3099920 - RNA, 13 nt, Mycobacterium bovis subsp bovis AF2122/97
guccaccgauacc

SEQ ID NO: 3099921 - RNA, 20 nt, Mycobacterium bovis subsp bovis AF2122/97
guccaccgauacccccggca

SEQ ID NO: 3099922 - RNA, 19 nt, Mycobacterium bovis subsp bovis AF2122/97
guccaccgaugccacaucg

SEQ ID NO: 3099923 - RNA, 13 nt, Mycobacterium bovis subsp bovis AF2122/97
guccaccgccacc

SEQ ID NO: 3099924 - RNA, 15 nt, Mycobacterium bovis subsp bovis AF2122/97
guccaccgccaccac

SEQ ID NO: 3099925 - RNA, 20 nt, Mycobacterium bovis subsp bovis AF2122/97
guccaccgccgacauggcgg

SEQ ID NO: 3099926 - RNA, 16 nt, Mycobacterium bovis subsp bovis AF2122/97
guccaccgcugccggc

SEQ ID NO: 3099927 - RNA, 13 nt, Mycobacterium bovis subsp bovis AF2122/97
guccaccggaccg

SEQ ID NO: 3099928 - RNA, 14 nt, Mycobacterium bovis subsp bovis AF2122/97
guccaccggaucgu

SEQ ID NO: 3099929 - RNA, 15 nt, Mycobacterium bovis subsp bovis AF2122/97
guccaccggaucguc

SEQ ID NO: 3099930 - RNA, 14 nt, Mycobacterium bovis subsp bovis AF2122/97
guccaccggccagu

SEQ ID NO: 3099931 - RNA, 20 nt, Mycobacterium bovis subsp bovis AF2122/97
guccaccgucacggucgcgg

SEQ ID NO: 3099932 - RNA, 17 nt, Mycobacterium bovis subsp bovis AF2122/97
guccaccuuggucgcca

SEQ ID NO: 3099933 - RNA, 19 nt, Mycobacterium bovis subsp bovis AF2122/97
guccacgccgacggcaccg

SEQ ID NO: 3099934 - RNA, 19 nt, Mycobacterium bovis subsp bovis AF2122/97
guccacgugagugccggcg

SEQ ID NO: 3099935 - RNA, 16 nt, Mycobacterium bovis subsp bovis AF2122/97
guccacguucggcugc

SEQ ID NO: 3099936 - RNA, 18 nt, Mycobacterium bovis subsp bovis AF2122/97
guccacugaucaggccga

SEQ ID NO: 3099937 - RNA, 15 nt, Mycobacterium bovis subsp bovis AF2122/97
guccacugccaccgc

SEQ ID NO: 3099938 - RNA, 18 nt, Mycobacterium bovis subsp bovis AF2122/97
guccacugccaccgcgag

SEQ ID NO: 3099939 - RNA, 15 nt, Mycobacterium bovis subsp bovis AF2122/97
guccagaacggcgau

SEQ ID NO: 3099940 - RNA, 15 nt, Mycobacterium bovis subsp bovis AF2122/97
guccagaacgguggc

SEQ ID NO: 3099941 - RNA, 20 nt, Mycobacterium bovis subsp bovis AF2122/97
guccagaacgguggcgcggu

SEQ ID NO: 3099942 - RNA, 22 nt, Mycobacterium bovis subsp bovis AF2122/97
guccagaauccagguggucauc

SEQ ID NO: 3099943 - RNA, 17 nt, Mycobacterium bovis subsp bovis AF2122/97
guccagacccagcucgu

SEQ ID NO: 3099944 - RNA, 19 nt, Mycobacterium bovis subsp bovis AF2122/97
guccagaccguagcggccg

SEQ ID NO: 3099945 - RNA, 15 nt, Mycobacterium bovis subsp bovis AF2122/97
guccagauaucgaag

SEQ ID NO: 3099946 - RNA, 21 nt, Mycobacterium bovis subsp bovis AF2122/97
guccagcaaaugcggcgcguu

SEQ ID NO: 3099947 - RNA, 14 nt, Mycobacterium bovis subsp bovis AF2122/97
guccagcaacagcg

SEQ ID NO: 3099948 - RNA, 19 nt, Mycobacterium bovis subsp bovis AF2122/97
guccagcaccugccguucc

SEQ ID NO: 3099949 - RNA, 12 nt, Mycobacterium bovis subsp bovis AF2122/97
guccagcagcga

SEQ ID NO: 3099950 - RNA, 22 nt, Mycobacterium bovis subsp bovis AF2122/97
guccagcagcgaaaaccgucgc

SEQ ID NO: 3099951 - RNA, 15 nt, Mycobacterium bovis subsp bovis AF2122/97
guccagcagcgacgc

SEQ ID NO: 3099952 - RNA, 14 nt, Mycobacterium bovis subsp bovis AF2122/97
guccagcagcucgg

SEQ ID NO: 3099953 - RNA, 17 nt, Mycobacterium bovis subsp bovis AF2122/97
guccagccaacgggaac

SEQ ID NO: 3099954 - RNA, 15 nt, Mycobacterium bovis subsp bovis AF2122/97
guccagccacgcugu

SEQ ID NO: 3099955 - RNA, 15 nt, Mycobacterium bovis subsp bovis AF2122/97
guccagccaggcgau

SEQ ID NO: 3099956 - RNA, 14 nt, Mycobacterium bovis subsp bovis AF2122/97
guccagcccagcgc

SEQ ID NO: 3099957 - RNA, 14 nt, Mycobacterium bovis subsp bovis AF2122/97
guccagcccggaac

SEQ ID NO: 3099958 - RNA, 13 nt, Mycobacterium bovis subsp bovis AF2122/97
guccagccggcgc

SEQ ID NO: 3099959 - RNA, 14 nt, Mycobacterium bovis subsp bovis AF2122/97
guccagccggcgcg

SEQ ID NO: 3099960 - RNA, 17 nt, Mycobacterium bovis subsp bovis AF2122/97
guccagccgggugccgg

SEQ ID NO: 3099961 - RNA, 19 nt, Mycobacterium bovis subsp bovis AF2122/97
guccagccgggugccggca

SEQ ID NO: 3099962 - RNA, 21 nt, Mycobacterium bovis subsp bovis AF2122/97
guccagccgguagagcgggcc

SEQ ID NO: 3099963 - RNA, 19 nt, Mycobacterium bovis subsp bovis AF2122/97
guccagccguggcggcggg

SEQ ID NO: 3099964 - RNA, 18 nt, Mycobacterium bovis subsp bovis AF2122/97
guccagccuuuuucggcg

SEQ ID NO: 3099965 - RNA, 20 nt, Mycobacterium bovis subsp bovis AF2122/97
guccagccuuuuucggcgag

SEQ ID NO: 3099966 - RNA, 20 nt, Mycobacterium bovis subsp bovis AF2122/97
guccagcgaggagcagggcu

SEQ ID NO: 3099967 - RNA, 16 nt, Mycobacterium bovis subsp bovis AF2122/97
guccagcgaucccggu

SEQ ID NO: 3099968 - RNA, 17 nt, Mycobacterium bovis subsp bovis AF2122/97
guccagcgaucccggug

SEQ ID NO: 3099969 - RNA, 17 nt, Mycobacterium bovis subsp bovis AF2122/97
guccagcgccgcggccc

SEQ ID NO: 3099970 - RNA, 19 nt, Mycobacterium bovis subsp bovis AF2122/97
guccagcgccggaagcuuc

SEQ ID NO: 3099971 - RNA, 20 nt, Mycobacterium bovis subsp bovis AF2122/97
guccagcgcgacguccacca

SEQ ID NO: 3099972 - RNA, 21 nt, Mycobacterium bovis subsp bovis AF2122/97
guccagcgcgacguccaccag

SEQ ID NO: 3099973 - RNA, 13 nt, Mycobacterium bovis subsp bovis AF2122/97
guccagcgcggcc

SEQ ID NO: 3099974 - RNA, 16 nt, Mycobacterium bovis subsp bovis AF2122/97
guccagcgcggccuug

SEQ ID NO: 3099975 - RNA, 14 nt, Mycobacterium bovis subsp bovis AF2122/97
guccagcggccgcc

SEQ ID NO: 3099976 - RNA, 20 nt, Mycobacterium bovis subsp bovis AF2122/97
guccagcggccgccgcggcu

SEQ ID NO: 3099977 - RNA, 20 nt, Mycobacterium bovis subsp bovis AF2122/97
guccagcgggcauaacccgc

SEQ ID NO: 3099978 - RNA, 13 nt, Mycobacterium bovis subsp bovis AF2122/97
guccagcgucgcc

SEQ ID NO: 3099979 - RNA, 17 nt, Mycobacterium bovis subsp bovis AF2122/97
guccagcgucgccgcca

SEQ ID NO: 3099980 - RNA, 17 nt, Mycobacterium bovis subsp bovis AF2122/97
guccagcuggccgggug

SEQ ID NO: 3099981 - RNA, 22 nt, Mycobacterium bovis subsp bovis AF2122/97
guccaggaauuccccaccgucg

SEQ ID NO: 3099982 - RNA, 16 nt, Mycobacterium bovis subsp bovis AF2122/97
guccaggacggaucgu

SEQ ID NO: 3099983 - RNA, 18 nt, Mycobacterium bovis subsp bovis AF2122/97
guccaggacggaucgucg

SEQ ID NO: 3099984 - RNA, 18 nt, Mycobacterium bovis subsp bovis AF2122/97
guccaggagugcgggcau

SEQ ID NO: 3099985 - RNA, 20 nt, Mycobacterium bovis subsp bovis AF2122/97
guccaggcacuccagcggcg

SEQ ID NO: 3099986 - RNA, 16 nt, Mycobacterium bovis subsp bovis AF2122/97
guccaggcccuggcca

SEQ ID NO: 3099987 - RNA, 13 nt, Mycobacterium bovis subsp bovis AF2122/97
guccaggccggca

SEQ ID NO: 3099988 - RNA, 14 nt, Mycobacterium bovis subsp bovis AF2122/97
guccagggcgacga

SEQ ID NO: 3099989 - RNA, 16 nt, Mycobacterium bovis subsp bovis AF2122/97
guccaggguggucagu

SEQ ID NO: 3099990 - RNA, 21 nt, Mycobacterium bovis subsp bovis AF2122/97
guccagguccaaguccuccac

SEQ ID NO: 3099991 - RNA, 16 nt, Mycobacterium bovis subsp bovis AF2122/97
guccaggucggccgcc

SEQ ID NO: 3099992 - RNA, 13 nt, Mycobacterium bovis subsp bovis AF2122/97
guccaggugaccg

SEQ ID NO: 3099993 - RNA, 20 nt, Mycobacterium bovis subsp bovis AF2122/97
guccaggugcgccguggcau

SEQ ID NO: 3099994 - RNA, 15 nt, Mycobacterium bovis subsp bovis AF2122/97
guccagguggcgcgg

SEQ ID NO: 3099995 - RNA, 16 nt, Mycobacterium bovis subsp bovis AF2122/97
guccagguggcgcgga

SEQ ID NO: 3099996 - RNA, 15 nt, Mycobacterium bovis subsp bovis AF2122/97
guccagugcauuccc

SEQ ID NO: 3099997 - RNA, 18 nt, Mycobacterium bovis subsp bovis AF2122/97
guccaguggcagccagcg

SEQ ID NO: 3099998 - RNA, 15 nt, Mycobacterium bovis subsp bovis AF2122/97
guccauagccggcau

SEQ ID NO: 3099999 - RNA, 19 nt, Mycobacterium bovis subsp bovis AF2122/97
guccaucacauccacgcac

SEQ ID NO: 3100000 - RNA, 16 nt, Mycobacterium bovis subsp bovis AF2122/97
guccaucaccggcggc

SEQ ID NO: 3100001 - RNA, 22 nt, Mycobacterium bovis subsp bovis AF2122/97
guccaucaccggcggccccagg

SEQ ID NO: 3100002 - RNA, 14 nt, Mycobacterium bovis subsp bovis AF2122/97
guccaucccggcgc

SEQ ID NO: 3100003 - RNA, 15 nt, Mycobacterium bovis subsp bovis AF2122/97
guccaucccggcgcc

SEQ ID NO: 3100004 - RNA, 16 nt, Mycobacterium bovis subsp bovis AF2122/97
guccaucccggcgccg

SEQ ID NO: 3100005 - RNA, 19 nt, Mycobacterium bovis subsp bovis AF2122/97
guccauccgcagcagguga

SEQ ID NO: 3100006 - RNA, 15 nt, Mycobacterium bovis subsp bovis AF2122/97
guccaucgcgcggcu

SEQ ID NO: 3100007 - RNA, 21 nt, Mycobacterium bovis subsp bovis AF2122/97
guccaucgcgcggcugugccc

SEQ ID NO: 3100008 - RNA, 24 nt, Mycobacterium bovis subsp bovis AF2122/97
guccaucgcgcggcugugcccgau

SEQ ID NO: 3100009 - RNA, 16 nt, Mycobacterium bovis subsp bovis AF2122/97
guccaucgcgcugcgg

SEQ ID NO: 3100010 - RNA, 15 nt, Mycobacterium bovis subsp bovis AF2122/97
guccaucucggacca

SEQ ID NO: 3100011 - RNA, 22 nt, Mycobacterium bovis subsp bovis AF2122/97
guccaugcggguaaaccaggug

SEQ ID NO: 3100012 - RNA, 22 nt, Mycobacterium bovis subsp bovis AF2122/97
guccauguuuugcugcaugccg

SEQ ID NO: 3100013 - RNA, 23 nt, Mycobacterium bovis subsp bovis AF2122/97
guccauguuuugcugcaugccga

SEQ ID NO: 3100014 - RNA, 15 nt, Mycobacterium bovis subsp bovis AF2122/97
gucccaaggcguugg

SEQ ID NO: 3100015 - RNA, 13 nt, Mycobacterium bovis subsp bovis AF2122/97
gucccaaucggga

SEQ ID NO: 3100016 - RNA, 15 nt, Mycobacterium bovis subsp bovis AF2122/97
gucccaaucgggauc

SEQ ID NO: 3100017 - RNA, 18 nt, Mycobacterium bovis subsp bovis AF2122/97
gucccaaucgucggccag

SEQ ID NO: 3100018 - RNA, 22 nt, Mycobacterium bovis subsp bovis AF2122/97
gucccaaucgucggccagcaga

SEQ ID NO: 3100019 - RNA, 12 nt, Mycobacterium bovis subsp bovis AF2122/97
gucccaccagcc

SEQ ID NO: 3100020 - RNA, 14 nt, Mycobacterium bovis subsp bovis AF2122/97
gucccaccagccga

SEQ ID NO: 3100021 - RNA, 15 nt, Mycobacterium bovis subsp bovis AF2122/97
gucccacgccagcgc

SEQ ID NO: 3100022 - RNA, 14 nt, Mycobacterium bovis subsp bovis AF2122/97
gucccacggccggc

SEQ ID NO: 3100023 - RNA, 15 nt, Mycobacterium bovis subsp bovis AF2122/97
gucccacggccggcc

SEQ ID NO: 3100024 - RNA, 23 nt, Mycobacterium bovis subsp bovis AF2122/97
gucccacggcgguugccccgacc

SEQ ID NO: 3100025 - RNA, 21 nt, Mycobacterium bovis subsp bovis AF2122/97
gucccacguugcugaugcccu

SEQ ID NO: 3100026 - RNA, 18 nt, Mycobacterium bovis subsp bovis AF2122/97
gucccacugccggugcug

SEQ ID NO: 3100027 - RNA, 15 nt, Mycobacterium bovis subsp bovis AF2122/97
gucccacugggccgg

SEQ ID NO: 3100028 - RNA, 16 nt, Mycobacterium bovis subsp bovis AF2122/97
gucccagcccggccca

SEQ ID NO: 3100029 - RNA, 18 nt, Mycobacterium bovis subsp bovis AF2122/97
gucccagcgccgcacaga

SEQ ID NO: 3100030 - RNA, 15 nt, Mycobacterium bovis subsp bovis AF2122/97
gucccagcugaccag

SEQ ID NO: 3100031 - RNA, 17 nt, Mycobacterium bovis subsp bovis AF2122/97
gucccagcugaccagcg

SEQ ID NO: 3100032 - RNA, 18 nt, Mycobacterium bovis subsp bovis AF2122/97
gucccagcugaccagcgu

SEQ ID NO: 3100033 - RNA, 20 nt, Mycobacterium bovis subsp bovis AF2122/97
gucccaggacuccggccgca

SEQ ID NO: 3100034 - RNA, 20 nt, Mycobacterium bovis subsp bovis AF2122/97
gucccagggcacaucgggcg

SEQ ID NO: 3100035 - RNA, 13 nt, Mycobacterium bovis subsp bovis AF2122/97
gucccagggcugc

SEQ ID NO: 3100036 - RNA, 15 nt, Mycobacterium bovis subsp bovis AF2122/97
gucccagggcugccg

SEQ ID NO: 3100037 - RNA, 19 nt, Mycobacterium bovis subsp bovis AF2122/97
gucccagguuggagcccga

SEQ ID NO: 3100038 - RNA, 19 nt, Mycobacterium bovis subsp bovis AF2122/97
gucccagucccgcgucgga

SEQ ID NO: 3100039 - RNA, 16 nt, Mycobacterium bovis subsp bovis AF2122/97
gucccaucgcgucggc

SEQ ID NO: 3100040 - RNA, 19 nt, Mycobacterium bovis subsp bovis AF2122/97
guccccaggugggcagcag

SEQ ID NO: 3100041 - RNA, 23 nt, Mycobacterium bovis subsp bovis AF2122/97
guccccaggugggcagcaggccc

SEQ ID NO: 3100042 - RNA, 14 nt, Mycobacterium bovis subsp bovis AF2122/97
guccccccguugcc

SEQ ID NO: 3100043 - RNA, 12 nt, Mycobacterium bovis subsp bovis AF2122/97
gucccccgcacg

SEQ ID NO: 3100044 - RNA, 13 nt, Mycobacterium bovis subsp bovis AF2122/97
gucccccgcccac

SEQ ID NO: 3100045 - RNA, 19 nt, Mycobacterium bovis subsp bovis AF2122/97
guccccgacaacggcggca

SEQ ID NO: 3100046 - RNA, 15 nt, Mycobacterium bovis subsp bovis AF2122/97
guccccgcagcgccu

SEQ ID NO: 3100047 - RNA, 17 nt, Mycobacterium bovis subsp bovis AF2122/97
guccccgcagcucgacc

SEQ ID NO: 3100048 - RNA, 21 nt, Mycobacterium bovis subsp bovis AF2122/97
guccccgcagcucgaccagga

SEQ ID NO: 3100049 - RNA, 15 nt, Mycobacterium bovis subsp bovis AF2122/97
guccccgccgacgcc

SEQ ID NO: 3100050 - RNA, 18 nt, Mycobacterium bovis subsp bovis AF2122/97
guccccgccgacgccgau

SEQ ID NO: 3100051 - RNA, 19 nt, Mycobacterium bovis subsp bovis AF2122/97
guccccgccgacgccgaua

SEQ ID NO: 3100052 - RNA, 19 nt, Mycobacterium bovis subsp bovis AF2122/97
guccccgccggccuccucg

SEQ ID NO: 3100053 - RNA, 15 nt, Mycobacterium bovis subsp bovis AF2122/97
guccccgccgucgcc

SEQ ID NO: 3100054 - RNA, 19 nt, Mycobacterium bovis subsp bovis AF2122/97
guccccgccgucgccacca

SEQ ID NO: 3100055 - RNA, 20 nt, Mycobacterium bovis subsp bovis AF2122/97
guccccgccgucgccaccau

SEQ ID NO: 3100056 - RNA, 22 nt, Mycobacterium bovis subsp bovis AF2122/97
guccccgccgucgccaccaucg

SEQ ID NO: 3100057 - RNA, 16 nt, Mycobacterium bovis subsp bovis AF2122/97
guccccggcggcagca

SEQ ID NO: 3100058 - RNA, 16 nt, Mycobacterium bovis subsp bovis AF2122/97
guccccgucgcuggcc

SEQ ID NO: 3100059 - RNA, 20 nt, Mycobacterium bovis subsp bovis AF2122/97
guccccgucgcuggccggca

SEQ ID NO: 3100060 - RNA, 21 nt, Mycobacterium bovis subsp bovis AF2122/97
guccccguugagauaccccga

SEQ ID NO: 3100061 - RNA, 15 nt, Mycobacterium bovis subsp bovis AF2122/97
guccccucggugcca

SEQ ID NO: 3100062 - RNA, 19 nt, Mycobacterium bovis subsp bovis AF2122/97
guccccucggugccacugc

SEQ ID NO: 3100063 - RNA, 18 nt, Mycobacterium bovis subsp bovis AF2122/97
gucccgaaacgccggguu

SEQ ID NO: 3100064 - RNA, 22 nt, Mycobacterium bovis subsp bovis AF2122/97
gucccgauacggccggccguug

SEQ ID NO: 3100065 - RNA, 14 nt, Mycobacterium bovis subsp bovis AF2122/97
gucccgaucacccc

SEQ ID NO: 3100066 - RNA, 16 nt, Mycobacterium bovis subsp bovis AF2122/97
gucccgaucaccccgg

SEQ ID NO: 3100067 - RNA, 21 nt, Mycobacterium bovis subsp bovis AF2122/97
gucccgaucaccccggucggc

SEQ ID NO: 3100068 - RNA, 13 nt, Mycobacterium bovis subsp bovis AF2122/97
gucccgauggcgg

SEQ ID NO: 3100069 - RNA, 19 nt, Mycobacterium bovis subsp bovis AF2122/97
gucccgauggcgguggggc

SEQ ID NO: 3100070 - RNA, 18 nt, Mycobacterium bovis subsp bovis AF2122/97
gucccgaugguggccgcg

SEQ ID NO: 3100071 - RNA, 19 nt, Mycobacterium bovis subsp bovis AF2122/97
gucccgaugguggccgcgc

SEQ ID NO: 3100072 - RNA, 17 nt, Mycobacterium bovis subsp bovis AF2122/97
gucccgcacccggccca

SEQ ID NO: 3100073 - RNA, 22 nt, Mycobacterium bovis subsp bovis AF2122/97
gucccgcauaccuaacgagccg

SEQ ID NO: 3100074 - RNA, 19 nt, Mycobacterium bovis subsp bovis AF2122/97
gucccgccgaccgacacca

SEQ ID NO: 3100075 - RNA, 19 nt, Mycobacterium bovis subsp bovis AF2122/97
gucccgccgcaccgccgca

SEQ ID NO: 3100076 - RNA, 15 nt, Mycobacterium bovis subsp bovis AF2122/97
gucccgccggccccg

SEQ ID NO: 3100077 - RNA, 12 nt, Mycobacterium bovis subsp bovis AF2122/97
gucccgccgggu

SEQ ID NO: 3100078 - RNA, 15 nt, Mycobacterium bovis subsp bovis AF2122/97
gucccgccguugccg

SEQ ID NO: 3100079 - RNA, 19 nt, Mycobacterium bovis subsp bovis AF2122/97
gucccgccguugccgccgu

SEQ ID NO: 3100080 - RNA, 15 nt, Mycobacterium bovis subsp bovis AF2122/97
gucccgcgagcagcc

SEQ ID NO: 3100081 - RNA, 16 nt, Mycobacterium bovis subsp bovis AF2122/97
gucccgcgagcagccc

SEQ ID NO: 3100082 - RNA, 19 nt, Mycobacterium bovis subsp bovis AF2122/97
gucccgcgagcagcccggc

SEQ ID NO: 3100083 - RNA, 21 nt, Mycobacterium bovis subsp bovis AF2122/97
gucccgcgagcagcccggcga

SEQ ID NO: 3100084 - RNA, 17 nt, Mycobacterium bovis subsp bovis AF2122/97
gucccgcggcgcggaga

SEQ ID NO: 3100085 - RNA, 22 nt, Mycobacterium bovis subsp bovis AF2122/97
gucccgcgugccacucgaugcu

SEQ ID NO: 3100086 - RNA, 14 nt, Mycobacterium bovis subsp bovis AF2122/97
gucccgcucgagca

SEQ ID NO: 3100087 - RNA, 15 nt, Mycobacterium bovis subsp bovis AF2122/97
gucccgcucgagcag

SEQ ID NO: 3100088 - RNA, 15 nt, Mycobacterium bovis subsp bovis AF2122/97
gucccggaccaucgc

SEQ ID NO: 3100089 - RNA, 19 nt, Mycobacterium bovis subsp bovis AF2122/97
gucccggcggucagcggcu

SEQ ID NO: 3100090 - RNA, 14 nt, Mycobacterium bovis subsp bovis AF2122/97
gucccggcucgagc

SEQ ID NO: 3100091 - RNA, 20 nt, Mycobacterium bovis subsp bovis AF2122/97
gucccggugggcggcucguc

SEQ ID NO: 3100092 - RNA, 19 nt, Mycobacterium bovis subsp bovis AF2122/97
gucccgguguccagccacg

SEQ ID NO: 3100093 - RNA, 13 nt, Mycobacterium bovis subsp bovis AF2122/97
gucccgucacuca

SEQ ID NO: 3100094 - RNA, 20 nt, Mycobacterium bovis subsp bovis AF2122/97
gucccgucacucaccccaac

SEQ ID NO: 3100095 - RNA, 18 nt, Mycobacterium bovis subsp bovis AF2122/97
gucccgugcgcgcgcagc

SEQ ID NO: 3100096 - RNA, 20 nt, Mycobacterium bovis subsp bovis AF2122/97
gucccgugcgcgcgcagcug

SEQ ID NO: 3100097 - RNA, 22 nt, Mycobacterium bovis subsp bovis AF2122/97
gucccguggcgaauucgaccac

SEQ ID NO: 3100098 - RNA, 16 nt, Mycobacterium bovis subsp bovis AF2122/97
gucccucgccaaccag

SEQ ID NO: 3100099 - RNA, 20 nt, Mycobacterium bovis subsp bovis AF2122/97
gucccugcgccgucaacacc

SEQ ID NO: 3100100 - RNA, 16 nt, Mycobacterium bovis subsp bovis AF2122/97
guccgaaagccgccga

SEQ ID NO: 3100101 - RNA, 18 nt, Mycobacterium bovis subsp bovis AF2122/97
guccgaaagccgccgaga

SEQ ID NO: 3100102 - RNA, 16 nt, Mycobacterium bovis subsp bovis AF2122/97
guccgaacacggugaa

SEQ ID NO: 3100103 - RNA, 14 nt, Mycobacterium bovis subsp bovis AF2122/97
guccgaaccgacgu

SEQ ID NO: 3100104 - RNA, 18 nt, Mycobacterium bovis subsp bovis AF2122/97
guccgaaccgacguuccc

SEQ ID NO: 3100105 - RNA, 20 nt, Mycobacterium bovis subsp bovis AF2122/97
guccgaaggcuugucgguag

SEQ ID NO: 3100106 - RNA, 21 nt, Mycobacterium bovis subsp bovis AF2122/97
guccgaaguacuggccgccgc

SEQ ID NO: 3100107 - RNA, 14 nt, Mycobacterium bovis subsp bovis AF2122/97
guccgacaccggcg

SEQ ID NO: 3100108 - RNA, 17 nt, Mycobacterium bovis subsp bovis AF2122/97
guccgacaccggcggca

SEQ ID NO: 3100109 - RNA, 19 nt, Mycobacterium bovis subsp bovis AF2122/97
guccgacaccggcggcauc

SEQ ID NO: 3100110 - RNA, 17 nt, Mycobacterium bovis subsp bovis AF2122/97
guccgacaguccgcgcc

SEQ ID NO: 3100111 - RNA, 18 nt, Mycobacterium bovis subsp bovis AF2122/97
guccgacaguccgcgccg

SEQ ID NO: 3100112 - RNA, 20 nt, Mycobacterium bovis subsp bovis AF2122/97
guccgacaguccgcgccggc

SEQ ID NO: 3100113 - RNA, 15 nt, Mycobacterium bovis subsp bovis AF2122/97
guccgaccagcggcc

SEQ ID NO: 3100114 - RNA, 19 nt, Mycobacterium bovis subsp bovis AF2122/97
guccgaccagcggccgacc

SEQ ID NO: 3100115 - RNA, 14 nt, Mycobacterium bovis subsp bovis AF2122/97
guccgaccgguacc

SEQ ID NO: 3100116 - RNA, 21 nt, Mycobacterium bovis subsp bovis AF2122/97
guccgacgcaccaacgcgauc

SEQ ID NO: 3100117 - RNA, 12 nt, Mycobacterium bovis subsp bovis AF2122/97
guccgacgggcc

SEQ ID NO: 3100118 - RNA, 21 nt, Mycobacterium bovis subsp bovis AF2122/97
guccgacgguguagccgccgg

SEQ ID NO: 3100119 - RNA, 23 nt, Mycobacterium bovis subsp bovis AF2122/97
guccgacgguguagccgccggca

SEQ ID NO: 3100120 - RNA, 15 nt, Mycobacterium bovis subsp bovis AF2122/97
guccgacuucuccag

SEQ ID NO: 3100121 - RNA, 19 nt, Mycobacterium bovis subsp bovis AF2122/97
guccgagcuuggccgccgc

SEQ ID NO: 3100122 - RNA, 20 nt, Mycobacterium bovis subsp bovis AF2122/97
guccgagggcgucgccgccg

SEQ ID NO: 3100123 - RNA, 15 nt, Mycobacterium bovis subsp bovis AF2122/97
guccgauaccgcgau

SEQ ID NO: 3100124 - RNA, 19 nt, Mycobacterium bovis subsp bovis AF2122/97
guccgaucaugucggccgg

SEQ ID NO: 3100125 - RNA, 19 nt, Mycobacterium bovis subsp bovis AF2122/97
guccgaucggcgcgccgau

SEQ ID NO: 3100126 - RNA, 14 nt, Mycobacterium bovis subsp bovis AF2122/97
guccgaucgguguc

SEQ ID NO: 3100127 - RNA, 18 nt, Mycobacterium bovis subsp bovis AF2122/97
guccgaugcgcgcggcgc

SEQ ID NO: 3100128 - RNA, 16 nt, Mycobacterium bovis subsp bovis AF2122/97
guccgcaaccucgccg

SEQ ID NO: 3100129 - RNA, 19 nt, Mycobacterium bovis subsp bovis AF2122/97
guccgcaaccucgccgucg

SEQ ID NO: 3100130 - RNA, 13 nt, Mycobacterium bovis subsp bovis AF2122/97
guccgcacaacga

SEQ ID NO: 3100131 - RNA, 22 nt, Mycobacterium bovis subsp bovis AF2122/97
guccgcacaacgauaguucggc

SEQ ID NO: 3100132 - RNA, 23 nt, Mycobacterium bovis subsp bovis AF2122/97
guccgcacaacgauaguucggcu

SEQ ID NO: 3100133 - RNA, 21 nt, Mycobacterium bovis subsp bovis AF2122/97
guccgcacgaucugcaggccc

SEQ ID NO: 3100134 - RNA, 17 nt, Mycobacterium bovis subsp bovis AF2122/97
guccgcagcaccgucgg

SEQ ID NO: 3100135 - RNA, 22 nt, Mycobacterium bovis subsp bovis AF2122/97
guccgcagcaccgucgggccca

SEQ ID NO: 3100136 - RNA, 16 nt, Mycobacterium bovis subsp bovis AF2122/97
guccgcaguucggucg

SEQ ID NO: 3100137 - RNA, 12 nt, Mycobacterium bovis subsp bovis AF2122/97
guccgcaugguc

SEQ ID NO: 3100138 - RNA, 21 nt, Mycobacterium bovis subsp bovis AF2122/97
guccgcauggucagcuaggua

SEQ ID NO: 3100139 - RNA, 17 nt, Mycobacterium bovis subsp bovis AF2122/97
guccgccagcgcgaacc

SEQ ID NO: 3100140 - RNA, 12 nt, Mycobacterium bovis subsp bovis AF2122/97
guccgcccagca

SEQ ID NO: 3100141 - RNA, 16 nt, Mycobacterium bovis subsp bovis AF2122/97
guccgcccagccgcag

SEQ ID NO: 3100142 - RNA, 12 nt, Mycobacterium bovis subsp bovis AF2122/97
guccgccgcaga

SEQ ID NO: 3100143 - RNA, 16 nt, Mycobacterium bovis subsp bovis AF2122/97
guccgccgcagacgcc

SEQ ID NO: 3100144 - RNA, 18 nt, Mycobacterium bovis subsp bovis AF2122/97
guccgccgcagacgccga

SEQ ID NO: 3100145 - RNA, 11 nt, Mycobacterium bovis subsp bovis AF2122/97
guccgccgccu

SEQ ID NO: 3100146 - RNA, 15 nt, Mycobacterium bovis subsp bovis AF2122/97
guccgccgccugcgc

SEQ ID NO: 3100147 - RNA, 19 nt, Mycobacterium bovis subsp bovis AF2122/97
guccgccggauagcaccgg

SEQ ID NO: 3100148 - RNA, 20 nt, Mycobacterium bovis subsp bovis AF2122/97
guccgccggauagcaccggc

SEQ ID NO: 3100149 - RNA, 12 nt, Mycobacterium bovis subsp bovis AF2122/97
guccgccggcga

SEQ ID NO: 3100150 - RNA, 13 nt, Mycobacterium bovis subsp bovis AF2122/97
guccgccggcgag

SEQ ID NO: 3100151 - RNA, 16 nt, Mycobacterium bovis subsp bovis AF2122/97
guccgccgggccccgg

SEQ ID NO: 3100152 - RNA, 17 nt, Mycobacterium bovis subsp bovis AF2122/97
guccgccgggccccggg

SEQ ID NO: 3100153 - RNA, 11 nt, Mycobacterium bovis subsp bovis AF2122/97
guccgccggug

SEQ ID NO: 3100154 - RNA, 14 nt, Mycobacterium bovis subsp bovis AF2122/97
guccgccggugccg

SEQ ID NO: 3100155 - RNA, 18 nt, Mycobacterium bovis subsp bovis AF2122/97
guccgccgucgaccacga

SEQ ID NO: 3100156 - RNA, 16 nt, Mycobacterium bovis subsp bovis AF2122/97
guccgccguugccgau

SEQ ID NO: 3100157 - RNA, 21 nt, Mycobacterium bovis subsp bovis AF2122/97
guccgccuaagcauucagcgc

SEQ ID NO: 3100158 - RNA, 20 nt, Mycobacterium bovis subsp bovis AF2122/97
guccgccugcaccgccgccg

SEQ ID NO: 3100159 - RNA, 21 nt, Mycobacterium bovis subsp bovis AF2122/97
guccgccugcaccgccgccgc

SEQ ID NO: 3100160 - RNA, 17 nt, Mycobacterium bovis subsp bovis AF2122/97
guccgcgacuuccugua

SEQ ID NO: 3100161 - RNA, 20 nt, Mycobacterium bovis subsp bovis AF2122/97
guccgcgaucugcagcgcgg

SEQ ID NO: 3100162 - RNA, 23 nt, Mycobacterium bovis subsp bovis AF2122/97
guccgcgcccaccggcuagcugu

SEQ ID NO: 3100163 - RNA, 12 nt, Mycobacterium bovis subsp bovis AF2122/97
guccgcgccgac

SEQ ID NO: 3100164 - RNA, 14 nt, Mycobacterium bovis subsp bovis AF2122/97
guccgcgccgacgg

SEQ ID NO: 3100165 - RNA, 15 nt, Mycobacterium bovis subsp bovis AF2122/97
guccgcgccgacggc

SEQ ID NO: 3100166 - RNA, 16 nt, Mycobacterium bovis subsp bovis AF2122/97
guccgcgccgacggcc

SEQ ID NO: 3100167 - RNA, 17 nt, Mycobacterium bovis subsp bovis AF2122/97
guccgcgccgacggcca

SEQ ID NO: 3100168 - RNA, 13 nt, Mycobacterium bovis subsp bovis AF2122/97
guccgcgccgagc

SEQ ID NO: 3100169 - RNA, 17 nt, Mycobacterium bovis subsp bovis AF2122/97
guccgcgccgagcccgg

SEQ ID NO: 3100170 - RNA, 14 nt, Mycobacterium bovis subsp bovis AF2122/97
guccgcgccggcgg

SEQ ID NO: 3100171 - RNA, 20 nt, Mycobacterium bovis subsp bovis AF2122/97
guccgcgcgaacgucaaccg

SEQ ID NO: 3100172 - RNA, 17 nt, Mycobacterium bovis subsp bovis AF2122/97
guccgcgcgcaagucga

SEQ ID NO: 3100173 - RNA, 15 nt, Mycobacterium bovis subsp bovis AF2122/97
guccgcgcgccgacc

SEQ ID NO: 3100174 - RNA, 20 nt, Mycobacterium bovis subsp bovis AF2122/97
guccgcggacuuggcggucg

SEQ ID NO: 3100175 - RNA, 17 nt, Mycobacterium bovis subsp bovis AF2122/97
guccgcggaugcauguc

SEQ ID NO: 3100176 - RNA, 13 nt, Mycobacterium bovis subsp bovis AF2122/97
guccgcggccacc

SEQ ID NO: 3100177 - RNA, 14 nt, Mycobacterium bovis subsp bovis AF2122/97
guccgcggccacca

SEQ ID NO: 3100178 - RNA, 18 nt, Mycobacterium bovis subsp bovis AF2122/97
guccgcggguagcgguuc

SEQ ID NO: 3100179 - RNA, 15 nt, Mycobacterium bovis subsp bovis AF2122/97
guccgcuacggcguc

SEQ ID NO: 3100180 - RNA, 16 nt, Mycobacterium bovis subsp bovis AF2122/97
guccgcugagcgggca

SEQ ID NO: 3100181 - RNA, 18 nt, Mycobacterium bovis subsp bovis AF2122/97
guccgcugcagcaccgca

SEQ ID NO: 3100182 - RNA, 20 nt, Mycobacterium bovis subsp bovis AF2122/97
guccgcugccaucggcacca

SEQ ID NO: 3100183 - RNA, 13 nt, Mycobacterium bovis subsp bovis AF2122/97
guccggaaccaac

SEQ ID NO: 3100184 - RNA, 16 nt, Mycobacterium bovis subsp bovis AF2122/97
guccggaucggucggc

SEQ ID NO: 3100185 - RNA, 23 nt, Mycobacterium bovis subsp bovis AF2122/97
guccggaugcgcaaccgcggccc

SEQ ID NO: 3100186 - RNA, 13 nt, Mycobacterium bovis subsp bovis AF2122/97
guccggauggccc

SEQ ID NO: 3100187 - RNA, 21 nt, Mycobacterium bovis subsp bovis AF2122/97
guccggauugaagucgucggc

SEQ ID NO: 3100188 - RNA, 19 nt, Mycobacterium bovis subsp bovis AF2122/97
guccggcacugcggccagu

SEQ ID NO: 3100189 - RNA, 12 nt, Mycobacterium bovis subsp bovis AF2122/97
guccggccacgg

SEQ ID NO: 3100190 - RNA, 19 nt, Mycobacterium bovis subsp bovis AF2122/97
guccggcccaccagcgcag

SEQ ID NO: 3100191 - RNA, 20 nt, Mycobacterium bovis subsp bovis AF2122/97
guccggcccaccagcgcagc

SEQ ID NO: 3100192 - RNA, 21 nt, Mycobacterium bovis subsp bovis AF2122/97
guccggcccccgacuccggca

SEQ ID NO: 3100193 - RNA, 23 nt, Mycobacterium bovis subsp bovis AF2122/97
guccggcccccgaggcuggcauc

SEQ ID NO: 3100194 - RNA, 20 nt, Mycobacterium bovis subsp bovis AF2122/97
guccggccgggggaacggga

SEQ ID NO: 3100195 - RNA, 21 nt, Mycobacterium bovis subsp bovis AF2122/97
guccggcgaaaagacugcgcc

SEQ ID NO: 3100196 - RNA, 20 nt, Mycobacterium bovis subsp bovis AF2122/97
guccggcgcccacaucgucg

SEQ ID NO: 3100197 - RNA, 23 nt, Mycobacterium bovis subsp bovis AF2122/97
guccggcgcccacaucgucggcg

SEQ ID NO: 3100198 - RNA, 12 nt, Mycobacterium bovis subsp bovis AF2122/97
guccggcgccga

SEQ ID NO: 3100199 - RNA, 14 nt, Mycobacterium bovis subsp bovis AF2122/97
guccggcgccgagg

SEQ ID NO: 3100200 - RNA, 17 nt, Mycobacterium bovis subsp bovis AF2122/97
guccggcgccgaggucg

SEQ ID NO: 3100201 - RNA, 19 nt, Mycobacterium bovis subsp bovis AF2122/97
guccggcggacccucgccg

SEQ ID NO: 3100202 - RNA, 15 nt, Mycobacterium bovis subsp bovis AF2122/97
guccggcggcaggaa

SEQ ID NO: 3100203 - RNA, 12 nt, Mycobacterium bovis subsp bovis AF2122/97
guccggcggccg

SEQ ID NO: 3100204 - RNA, 14 nt, Mycobacterium bovis subsp bovis AF2122/97
guccggcggccgcc

SEQ ID NO: 3100205 - RNA, 22 nt, Mycobacterium bovis subsp bovis AF2122/97
guccggcggccgccaucagccg

SEQ ID NO: 3100206 - RNA, 20 nt, Mycobacterium bovis subsp bovis AF2122/97
guccggcguacucggugauc

SEQ ID NO: 3100207 - RNA, 13 nt, Mycobacterium bovis subsp bovis AF2122/97
guccggcgugggc

SEQ ID NO: 3100208 - RNA, 19 nt, Mycobacterium bovis subsp bovis AF2122/97
guccggcucauccgacggg

SEQ ID NO: 3100209 - RNA, 21 nt, Mycobacterium bovis subsp bovis AF2122/97
guccggcucaugcgagucguc

SEQ ID NO: 3100210 - RNA, 16 nt, Mycobacterium bovis subsp bovis AF2122/97
guccggcuuaccggcg

SEQ ID NO: 3100211 - RNA, 18 nt, Mycobacterium bovis subsp bovis AF2122/97
guccggcuuaccggcggg

SEQ ID NO: 3100212 - RNA, 17 nt, Mycobacterium bovis subsp bovis AF2122/97
guccggcuucggcgaac

SEQ ID NO: 3100213 - RNA, 18 nt, Mycobacterium bovis subsp bovis AF2122/97
guccggcuucggcgaacc

SEQ ID NO: 3100214 - RNA, 16 nt, Mycobacterium bovis subsp bovis AF2122/97
guccggcuuggcggcg

SEQ ID NO: 3100215 - RNA, 23 nt, Mycobacterium bovis subsp bovis AF2122/97
guccggcuuguccucacaugccc

SEQ ID NO: 3100216 - RNA, 19 nt, Mycobacterium bovis subsp bovis AF2122/97
guccggggaaagccgcagc

SEQ ID NO: 3100217 - RNA, 20 nt, Mycobacterium bovis subsp bovis AF2122/97
guccggggaccucggcgauc

SEQ ID NO: 3100218 - RNA, 23 nt, Mycobacterium bovis subsp bovis AF2122/97
guccggggcaacgaucagguugg

SEQ ID NO: 3100219 - RNA, 15 nt, Mycobacterium bovis subsp bovis AF2122/97
guccggggccgcggc

SEQ ID NO: 3100220 - RNA, 18 nt, Mycobacterium bovis subsp bovis AF2122/97
guccggggccgcggccca

SEQ ID NO: 3100221 - RNA, 22 nt, Mycobacterium bovis subsp bovis AF2122/97
guccgggggaagcgcguccaac

SEQ ID NO: 3100222 - RNA, 18 nt, Mycobacterium bovis subsp bovis AF2122/97
guccggguagacaugggu

SEQ ID NO: 3100223 - RNA, 15 nt, Mycobacterium bovis subsp bovis AF2122/97
guccggguagcggcg

SEQ ID NO: 3100224 - RNA, 17 nt, Mycobacterium bovis subsp bovis AF2122/97
guccggguagcggcgcc

SEQ ID NO: 3100225 - RNA, 18 nt, Mycobacterium bovis subsp bovis AF2122/97
guccggguagcggcgccg

SEQ ID NO: 3100226 - RNA, 13 nt, Mycobacterium bovis subsp bovis AF2122/97
guccgggucacca

SEQ ID NO: 3100227 - RNA, 17 nt, Mycobacterium bovis subsp bovis AF2122/97
guccgggucaccagcgc

SEQ ID NO: 3100228 - RNA, 13 nt, Mycobacterium bovis subsp bovis AF2122/97
guccgggucgaau

SEQ ID NO: 3100229 - RNA, 18 nt, Mycobacterium bovis subsp bovis AF2122/97
guccggguggcacaccau

SEQ ID NO: 3100230 - RNA, 23 nt, Mycobacterium bovis subsp bovis AF2122/97
guccggguuuugcgcggccaccu

SEQ ID NO: 3100231 - RNA, 14 nt, Mycobacterium bovis subsp bovis AF2122/97
guccgguauugauc

SEQ ID NO: 3100232 - RNA, 18 nt, Mycobacterium bovis subsp bovis AF2122/97
guccgguauugaucgaau

SEQ ID NO: 3100233 - RNA, 16 nt, Mycobacterium bovis subsp bovis AF2122/97
guccgguccgccagcg

SEQ ID NO: 3100234 - RNA, 20 nt, Mycobacterium bovis subsp bovis AF2122/97
guccggucgccaagugcagg

SEQ ID NO: 3100235 - RNA, 19 nt, Mycobacterium bovis subsp bovis AF2122/97
guccggucgccucaccggc

SEQ ID NO: 3100236 - RNA, 19 nt, Mycobacterium bovis subsp bovis AF2122/97
guccggucuuuguccgucg

SEQ ID NO: 3100237 - RNA, 23 nt, Mycobacterium bovis subsp bovis AF2122/97
guccggugauccaacuggccgcg

SEQ ID NO: 3100238 - RNA, 14 nt, Mycobacterium bovis subsp bovis AF2122/97
guccggugcaccag

SEQ ID NO: 3100239 - RNA, 18 nt, Mycobacterium bovis subsp bovis AF2122/97
guccggugcugguccagc

SEQ ID NO: 3100240 - RNA, 22 nt, Mycobacterium bovis subsp bovis AF2122/97
guccggugcugguccagccggu

SEQ ID NO: 3100241 - RNA, 20 nt, Mycobacterium bovis subsp bovis AF2122/97
guccgguggaauccaccagc

SEQ ID NO: 3100242 - RNA, 15 nt, Mycobacterium bovis subsp bovis AF2122/97
guccgguggaccgcc

SEQ ID NO: 3100243 - RNA, 22 nt, Mycobacterium bovis subsp bovis AF2122/97
guccgguggaccgccgaucggc

SEQ ID NO: 3100244 - RNA, 21 nt, Mycobacterium bovis subsp bovis AF2122/97
guccgguggacgaucuggcag

SEQ ID NO: 3100245 - RNA, 16 nt, Mycobacterium bovis subsp bovis AF2122/97
guccgguuacgcucgc

SEQ ID NO: 3100246 - RNA, 14 nt, Mycobacterium bovis subsp bovis AF2122/97
guccguagcgcggc

SEQ ID NO: 3100247 - RNA, 20 nt, Mycobacterium bovis subsp bovis AF2122/97
guccgucaccaccgccgcca

SEQ ID NO: 3100248 - RNA, 13 nt, Mycobacterium bovis subsp bovis AF2122/97
guccguccgcgac

SEQ ID NO: 3100249 - RNA, 19 nt, Mycobacterium bovis subsp bovis AF2122/97
guccgucgagucgccgagg

SEQ ID NO: 3100250 - RNA, 19 nt, Mycobacterium bovis subsp bovis AF2122/97
guccgucgcguccgcgauc

SEQ ID NO: 3100251 - RNA, 17 nt, Mycobacterium bovis subsp bovis AF2122/97
guccgucggcgcucguc

SEQ ID NO: 3100252 - RNA, 13 nt, Mycobacterium bovis subsp bovis AF2122/97
guccgucggggac

SEQ ID NO: 3100253 - RNA, 14 nt, Mycobacterium bovis subsp bovis AF2122/97
guccgucgucggcg

SEQ ID NO: 3100254 - RNA, 16 nt, Mycobacterium bovis subsp bovis AF2122/97
guccgucgucggcguc

SEQ ID NO: 3100255 - RNA, 22 nt, Mycobacterium bovis subsp bovis AF2122/97
guccguucgaugccagugcauc

SEQ ID NO: 3100256 - RNA, 19 nt, Mycobacterium bovis subsp bovis AF2122/97
guccuaauucggggccgcg

SEQ ID NO: 3100257 - RNA, 14 nt, Mycobacterium bovis subsp bovis AF2122/97
guccuauccgggcc

SEQ ID NO: 3100258 - RNA, 15 nt, Mycobacterium bovis subsp bovis AF2122/97
guccucaucgagcgc

SEQ ID NO: 3100259 - RNA, 22 nt, Mycobacterium bovis subsp bovis AF2122/97
guccuccaaggcggucaccacc

SEQ ID NO: 3100260 - RNA, 19 nt, Mycobacterium bovis subsp bovis AF2122/97
guccuccacgcuggcgccc

SEQ ID NO: 3100261 - RNA, 22 nt, Mycobacterium bovis subsp bovis AF2122/97
guccucccauucccaacacagc

SEQ ID NO: 3100262 - RNA, 19 nt, Mycobacterium bovis subsp bovis AF2122/97
guccuccgacgggggucgg

SEQ ID NO: 3100263 - RNA, 12 nt, Mycobacterium bovis subsp bovis AF2122/97
guccuccgggcu

SEQ ID NO: 3100264 - RNA, 19 nt, Mycobacterium bovis subsp bovis AF2122/97
guccuccuucggugguggg

SEQ ID NO: 3100265 - RNA, 20 nt, Mycobacterium bovis subsp bovis AF2122/97
guccucgacgaucagcacgu

SEQ ID NO: 3100266 - RNA, 17 nt, Mycobacterium bovis subsp bovis AF2122/97
guccucgagcaccgcga

SEQ ID NO: 3100267 - RNA, 21 nt, Mycobacterium bovis subsp bovis AF2122/97
guccucgagcggcagaugaau

SEQ ID NO: 3100268 - RNA, 13 nt, Mycobacterium bovis subsp bovis AF2122/97
guccucgaggucc

SEQ ID NO: 3100269 - RNA, 19 nt, Mycobacterium bovis subsp bovis AF2122/97
guccucgagguccucgucg

SEQ ID NO: 3100270 - RNA, 20 nt, Mycobacterium bovis subsp bovis AF2122/97
guccucgagguccucgucgg

SEQ ID NO: 3100271 - RNA, 22 nt, Mycobacterium bovis subsp bovis AF2122/97
guccucgagguccucgucggcg

SEQ ID NO: 3100272 - RNA, 17 nt, Mycobacterium bovis subsp bovis AF2122/97
guccucgagugccgccg

SEQ ID NO: 3100273 - RNA, 22 nt, Mycobacterium bovis subsp bovis AF2122/97
guccucgagugccgccgucgcc

SEQ ID NO: 3100274 - RNA, 13 nt, Mycobacterium bovis subsp bovis AF2122/97
guccucgaucgcg

SEQ ID NO: 3100275 - RNA, 14 nt, Mycobacterium bovis subsp bovis AF2122/97
guccucgccgcacg

SEQ ID NO: 3100276 - RNA, 19 nt, Mycobacterium bovis subsp bovis AF2122/97
guccucgccgcacgccggc

SEQ ID NO: 3100277 - RNA, 19 nt, Mycobacterium bovis subsp bovis AF2122/97
guccucgcggagccgucgc

SEQ ID NO: 3100278 - RNA, 22 nt, Mycobacterium bovis subsp bovis AF2122/97
guccucgcuauugggugcagug

SEQ ID NO: 3100279 - RNA, 18 nt, Mycobacterium bovis subsp bovis AF2122/97
guccucggcggacccggu

SEQ ID NO: 3100280 - RNA, 19 nt, Mycobacterium bovis subsp bovis AF2122/97
guccucggcggacccggug

SEQ ID NO: 3100281 - RNA, 20 nt, Mycobacterium bovis subsp bovis AF2122/97
guccucggcggacccgguga

SEQ ID NO: 3100282 - RNA, 16 nt, Mycobacterium bovis subsp bovis AF2122/97
guccucgggcaggcgg

SEQ ID NO: 3100283 - RNA, 13 nt, Mycobacterium bovis subsp bovis AF2122/97
guccucgucggcg

SEQ ID NO: 3100284 - RNA, 17 nt, Mycobacterium bovis subsp bovis AF2122/97
guccucgucggcgucga

SEQ ID NO: 3100285 - RNA, 20 nt, Mycobacterium bovis subsp bovis AF2122/97
guccucgucgucgagguccu

SEQ ID NO: 3100286 - RNA, 17 nt, Mycobacterium bovis subsp bovis AF2122/97
guccucgucuucgucgg

SEQ ID NO: 3100287 - RNA, 23 nt, Mycobacterium bovis subsp bovis AF2122/97
guccucgucuucgucgguguccu

SEQ ID NO: 3100288 - RNA, 16 nt, Mycobacterium bovis subsp bovis AF2122/97
guccugaaaacaccgc

SEQ ID NO: 3100289 - RNA, 21 nt, Mycobacterium bovis subsp bovis AF2122/97
guccugaaaacaccgcacggu

SEQ ID NO: 3100290 - RNA, 16 nt, Mycobacterium bovis subsp bovis AF2122/97
guccugcagcuggcga

SEQ ID NO: 3100291 - RNA, 15 nt, Mycobacterium bovis subsp bovis AF2122/97
guccugcagugcggc

SEQ ID NO: 3100292 - RNA, 16 nt, Mycobacterium bovis subsp bovis AF2122/97
guccugcagugcggcg

SEQ ID NO: 3100293 - RNA, 19 nt, Mycobacterium bovis subsp bovis AF2122/97
guccugccaaugcugcagg

SEQ ID NO: 3100294 - RNA, 21 nt, Mycobacterium bovis subsp bovis AF2122/97
guccugccagaagaccuggcg

SEQ ID NO: 3100295 - RNA, 13 nt, Mycobacterium bovis subsp bovis AF2122/97
guccugcccgucg

SEQ ID NO: 3100296 - RNA, 21 nt, Mycobacterium bovis subsp bovis AF2122/97
guccugcgagaggugcugcac

SEQ ID NO: 3100297 - RNA, 16 nt, Mycobacterium bovis subsp bovis AF2122/97
guccugcgccgcacgc

SEQ ID NO: 3100298 - RNA, 16 nt, Mycobacterium bovis subsp bovis AF2122/97
guccugcgggccguag

SEQ ID NO: 3100299 - RNA, 19 nt, Mycobacterium bovis subsp bovis AF2122/97
guccugcggguaggugacg

SEQ ID NO: 3100300 - RNA, 20 nt, Mycobacterium bovis subsp bovis AF2122/97
guccugcucgcacagcacca

SEQ ID NO: 3100301 - RNA, 13 nt, Mycobacterium bovis subsp bovis AF2122/97
guccugcucgcga

SEQ ID NO: 3100302 - RNA, 20 nt, Mycobacterium bovis subsp bovis AF2122/97
guccugcuuguagcgcaucg

SEQ ID NO: 3100303 - RNA, 21 nt, Mycobacterium bovis subsp bovis AF2122/97
guccuggaaccaaaccugggc

SEQ ID NO: 3100304 - RNA, 23 nt, Mycobacterium bovis subsp bovis AF2122/97
guccuggauaugcuccggccgca

SEQ ID NO: 3100305 - RNA, 15 nt, Mycobacterium bovis subsp bovis AF2122/97
guccuggaucagcca

SEQ ID NO: 3100306 - RNA, 20 nt, Mycobacterium bovis subsp bovis AF2122/97
guccuggcgaacucgcgcag

SEQ ID NO: 3100307 - RNA, 20 nt, Mycobacterium bovis subsp bovis AF2122/97
guccuggcguagugcagcug

SEQ ID NO: 3100308 - RNA, 13 nt, Mycobacterium bovis subsp bovis AF2122/97
guccugggccgcc

SEQ ID NO: 3100309 - RNA, 14 nt, Mycobacterium bovis subsp bovis AF2122/97
guccugggccgccg

SEQ ID NO: 3100310 - RNA, 22 nt, Mycobacterium bovis subsp bovis AF2122/97
guccuguccgggcugcaugcgg

SEQ ID NO: 3100311 - RNA, 15 nt, Mycobacterium bovis subsp bovis AF2122/97
guccuugcgccagcg

SEQ ID NO: 3100312 - RNA, 17 nt, Mycobacterium bovis subsp bovis AF2122/97
guccuuggacaggucga

SEQ ID NO: 3100313 - RNA, 15 nt, Mycobacterium bovis subsp bovis AF2122/97
guccuuguuggccag

SEQ ID NO: 3100314 - RNA, 16 nt, Mycobacterium bovis subsp bovis AF2122/97
guccuuguuggccagu

SEQ ID NO: 3100315 - RNA, 16 nt, Mycobacterium bovis subsp bovis AF2122/97
guccuuguuguggugg

SEQ ID NO: 3100316 - RNA, 17 nt, Mycobacterium bovis subsp bovis AF2122/97
guccuuguuguggugga

SEQ ID NO: 3100317 - RNA, 15 nt, Mycobacterium bovis subsp bovis AF2122/97
gucgaaaagccgugc

SEQ ID NO: 3100318 - RNA, 12 nt, Mycobacterium bovis subsp bovis AF2122/97
gucgaaacccac

SEQ ID NO: 3100319 - RNA, 18 nt, Mycobacterium bovis subsp bovis AF2122/97
gucgaaacgguacgccgc

SEQ ID NO: 3100320 - RNA, 13 nt, Mycobacterium bovis subsp bovis AF2122/97
gucgaaauacccg

SEQ ID NO: 3100321 - RNA, 21 nt, Mycobacterium bovis subsp bovis AF2122/97
gucgaaauggauugcggcacg

SEQ ID NO: 3100322 - RNA, 17 nt, Mycobacterium bovis subsp bovis AF2122/97
gucgaacagcaccgccg

SEQ ID NO: 3100323 - RNA, 22 nt, Mycobacterium bovis subsp bovis AF2122/97
gucgaacagcgaaccggcuggg

SEQ ID NO: 3100324 - RNA, 17 nt, Mycobacterium bovis subsp bovis AF2122/97
gucgaacagcucgaaca

SEQ ID NO: 3100325 - RNA, 19 nt, Mycobacterium bovis subsp bovis AF2122/97
gucgaacaggccggccgcg

SEQ ID NO: 3100326 - RNA, 14 nt, Mycobacterium bovis subsp bovis AF2122/97
gucgaacaucaucg

SEQ ID NO: 3100327 - RNA, 13 nt, Mycobacterium bovis subsp bovis AF2122/97
gucgaaccaggua

SEQ ID NO: 3100328 - RNA, 19 nt, Mycobacterium bovis subsp bovis AF2122/97
gucgaaccaguccucgggc

SEQ ID NO: 3100329 - RNA, 16 nt, Mycobacterium bovis subsp bovis AF2122/97
gucgaacccgcgagca

SEQ ID NO: 3100330 - RNA, 14 nt, Mycobacterium bovis subsp bovis AF2122/97
gucgaacgcgcgcg

SEQ ID NO: 3100331 - RNA, 16 nt, Mycobacterium bovis subsp bovis AF2122/97
gucgaacgcguugacc

SEQ ID NO: 3100332 - RNA, 18 nt, Mycobacterium bovis subsp bovis AF2122/97
gucgaacggcagcccggg

SEQ ID NO: 3100333 - RNA, 20 nt, Mycobacterium bovis subsp bovis AF2122/97
gucgaacggcuuggcgucgg

SEQ ID NO: 3100334 - RNA, 21 nt, Mycobacterium bovis subsp bovis AF2122/97
gucgaacugccggacuaccgc

SEQ ID NO: 3100335 - RNA, 19 nt, Mycobacterium bovis subsp bovis AF2122/97
gucgaacuugaucaccgcg

SEQ ID NO: 3100336 - RNA, 22 nt, Mycobacterium bovis subsp bovis AF2122/97
gucgaacuugaucaccgcguag

SEQ ID NO: 3100337 - RNA, 20 nt, Mycobacterium bovis subsp bovis AF2122/97
gucgaagaauaugccgauga

SEQ ID NO: 3100338 - RNA, 22 nt, Mycobacterium bovis subsp bovis AF2122/97
gucgaagaccaagagcgcgcag

SEQ ID NO: 3100339 - RNA, 15 nt, Mycobacterium bovis subsp bovis AF2122/97
gucgaagagcaggcc

SEQ ID NO: 3100340 - RNA, 20 nt, Mycobacterium bovis subsp bovis AF2122/97
gucgaagagguggggcagga

SEQ ID NO: 3100341 - RNA, 13 nt, Mycobacterium bovis subsp bovis AF2122/97
gucgaagccgggg

SEQ ID NO: 3100342 - RNA, 20 nt, Mycobacterium bovis subsp bovis AF2122/97
gucgaagcgauccggcugcg

SEQ ID NO: 3100343 - RNA, 21 nt, Mycobacterium bovis subsp bovis AF2122/97
gucgaagggaucacgaccgcg

SEQ ID NO: 3100344 - RNA, 22 nt, Mycobacterium bovis subsp bovis AF2122/97
gucgaagggaucacgaccgcgc

SEQ ID NO: 3100345 - RNA, 13 nt, Mycobacterium bovis subsp bovis AF2122/97
gucgaaggugacc

SEQ ID NO: 3100346 - RNA, 16 nt, Mycobacterium bovis subsp bovis AF2122/97
gucgaaggugaccagg

SEQ ID NO: 3100347 - RNA, 17 nt, Mycobacterium bovis subsp bovis AF2122/97
gucgaaguagccgacgu

SEQ ID NO: 3100348 - RNA, 23 nt, Mycobacterium bovis subsp bovis AF2122/97
gucgaaguagccgacgucgccgg

SEQ ID NO: 3100349 - RNA, 22 nt, Mycobacterium bovis subsp bovis AF2122/97
gucgaaguuggcgaagcccgac

SEQ ID NO: 3100350 - RNA, 23 nt, Mycobacterium bovis subsp bovis AF2122/97
gucgaauccucgcgaaaccgccg

SEQ ID NO: 3100351 - RNA, 16 nt, Mycobacterium bovis subsp bovis AF2122/97
gucgaauccugccgca

SEQ ID NO: 3100352 - RNA, 19 nt, Mycobacterium bovis subsp bovis AF2122/97
gucgaauccugccgcacgg

SEQ ID NO: 3100353 - RNA, 21 nt, Mycobacterium bovis subsp bovis AF2122/97
gucgaaucgcugccgccgauc

SEQ ID NO: 3100354 - RNA, 22 nt, Mycobacterium bovis subsp bovis AF2122/97
gucgaaucgcugccgccgaucg

SEQ ID NO: 3100355 - RNA, 16 nt, Mycobacterium bovis subsp bovis AF2122/97
gucgacaaacagcgcc

SEQ ID NO: 3100356 - RNA, 19 nt, Mycobacterium bovis subsp bovis AF2122/97
gucgacaaacagcgccauc

SEQ ID NO: 3100357 - RNA, 11 nt, Mycobacterium bovis subsp bovis AF2122/97
gucgacaaacc

SEQ ID NO: 3100358 - RNA, 23 nt, Mycobacterium bovis subsp bovis AF2122/97
gucgacaacacgccgucgaccgg

SEQ ID NO: 3100359 - RNA, 17 nt, Mycobacterium bovis subsp bovis AF2122/97
gucgacaaccgcugccg

SEQ ID NO: 3100360 - RNA, 21 nt, Mycobacterium bovis subsp bovis AF2122/97
gucgacaaccgcugccgcauc

SEQ ID NO: 3100361 - RNA, 22 nt, Mycobacterium bovis subsp bovis AF2122/97
gucgacaacgaucgcgcgagcg

SEQ ID NO: 3100362 - RNA, 21 nt, Mycobacterium bovis subsp bovis AF2122/97
gucgacaaucaguagcagcgg

SEQ ID NO: 3100363 - RNA, 15 nt, Mycobacterium bovis subsp bovis AF2122/97
gucgacacccgcacg

SEQ ID NO: 3100364 - RNA, 12 nt, Mycobacterium bovis subsp bovis AF2122/97
gucgacaccgcg

SEQ ID NO: 3100365 - RNA, 22 nt, Mycobacterium bovis subsp bovis AF2122/97
gucgacaccgcggacccgcagc

SEQ ID NO: 3100366 - RNA, 21 nt, Mycobacterium bovis subsp bovis AF2122/97
gucgacaccgcggugccccgg

SEQ ID NO: 3100367 - RNA, 15 nt, Mycobacterium bovis subsp bovis AF2122/97
gucgacacgccgaac

SEQ ID NO: 3100368 - RNA, 17 nt, Mycobacterium bovis subsp bovis AF2122/97
gucgacacgccgaacgu

SEQ ID NO: 3100369 - RNA, 14 nt, Mycobacterium bovis subsp bovis AF2122/97
gucgacacggugau

SEQ ID NO: 3100370 - RNA, 15 nt, Mycobacterium bovis subsp bovis AF2122/97
gucgacagcgaaggc

SEQ ID NO: 3100371 - RNA, 21 nt, Mycobacterium bovis subsp bovis AF2122/97
gucgacagcgaaggcgccgaa

SEQ ID NO: 3100372 - RNA, 18 nt, Mycobacterium bovis subsp bovis AF2122/97
gucgacagcgucucgccg

SEQ ID NO: 3100373 - RNA, 20 nt, Mycobacterium bovis subsp bovis AF2122/97
gucgacaggugccagaccag

SEQ ID NO: 3100374 - RNA, 23 nt, Mycobacterium bovis subsp bovis AF2122/97
gucgacaggugccagaccagggc

SEQ ID NO: 3100375 - RNA, 19 nt, Mycobacterium bovis subsp bovis AF2122/97
gucgacagucaacagggcc

SEQ ID NO: 3100376 - RNA, 20 nt, Mycobacterium bovis subsp bovis AF2122/97
gucgacaguucaacgggccu

SEQ ID NO: 3100377 - RNA, 19 nt, Mycobacterium bovis subsp bovis AF2122/97
gucgacaguuuucaccgcg

SEQ ID NO: 3100378 - RNA, 18 nt, Mycobacterium bovis subsp bovis AF2122/97
gucgacauaggccaccuc

SEQ ID NO: 3100379 - RNA, 20 nt, Mycobacterium bovis subsp bovis AF2122/97
gucgacaucggugacgguca

SEQ ID NO: 3100380 - RNA, 21 nt, Mycobacterium bovis subsp bovis AF2122/97
gucgaccaagguguccagcac

SEQ ID NO: 3100381 - RNA, 21 nt, Mycobacterium bovis subsp bovis AF2122/97
gucgaccaauuggucgagucg

SEQ ID NO: 3100382 - RNA, 12 nt, Mycobacterium bovis subsp bovis AF2122/97
gucgaccacgac

SEQ ID NO: 3100383 - RNA, 15 nt, Mycobacterium bovis subsp bovis AF2122/97
gucgaccacgaccgu

SEQ ID NO: 3100384 - RNA, 23 nt, Mycobacterium bovis subsp bovis AF2122/97
gucgaccacgacguucgacgaca

SEQ ID NO: 3100385 - RNA, 19 nt, Mycobacterium bovis subsp bovis AF2122/97
gucgaccaggacgguuggu

SEQ ID NO: 3100386 - RNA, 12 nt, Mycobacterium bovis subsp bovis AF2122/97
gucgaccaggcc

SEQ ID NO: 3100387 - RNA, 21 nt, Mycobacterium bovis subsp bovis AF2122/97
gucgaccauauuggcgcggcc

SEQ ID NO: 3100388 - RNA, 16 nt, Mycobacterium bovis subsp bovis AF2122/97
gucgaccaugagccgg

SEQ ID NO: 3100389 - RNA, 22 nt, Mycobacterium bovis subsp bovis AF2122/97
gucgaccaugagccggcgccgc

SEQ ID NO: 3100390 - RNA, 22 nt, Mycobacterium bovis subsp bovis AF2122/97
gucgaccaugcgaccggcaacg

SEQ ID NO: 3100391 - RNA, 14 nt, Mycobacterium bovis subsp bovis AF2122/97
gucgacccaccaug

SEQ ID NO: 3100392 - RNA, 21 nt, Mycobacterium bovis subsp bovis AF2122/97
gucgacccacucaucagagcg

SEQ ID NO: 3100393 - RNA, 22 nt, Mycobacterium bovis subsp bovis AF2122/97
gucgacccacucaucagagcgc

SEQ ID NO: 3100394 - RNA, 15 nt, Mycobacterium bovis subsp bovis AF2122/97
gucgacccagcugac

SEQ ID NO: 3100395 - RNA, 18 nt, Mycobacterium bovis subsp bovis AF2122/97
gucgacccccugccacag

SEQ ID NO: 3100396 - RNA, 22 nt, Mycobacterium bovis subsp bovis AF2122/97
gucgacccccugccacagcgac

SEQ ID NO: 3100397 - RNA, 21 nt, Mycobacterium bovis subsp bovis AF2122/97
gucgaccgaacccgacgucgc

SEQ ID NO: 3100398 - RNA, 13 nt, Mycobacterium bovis subsp bovis AF2122/97
gucgaccgcggcc

SEQ ID NO: 3100399 - RNA, 14 nt, Mycobacterium bovis subsp bovis AF2122/97
gucgaccgcggccc

SEQ ID NO: 3100400 - RNA, 17 nt, Mycobacterium bovis subsp bovis AF2122/97
gucgaccgcggcccgga

SEQ ID NO: 3100401 - RNA, 21 nt, Mycobacterium bovis subsp bovis AF2122/97
gucgaccgcggcccggacguc

SEQ ID NO: 3100402 - RNA, 22 nt, Mycobacterium bovis subsp bovis AF2122/97
gucgaccgcggcccggacgucg

SEQ ID NO: 3100403 - RNA, 23 nt, Mycobacterium bovis subsp bovis AF2122/97
gucgaccgggaacaggguggugg

SEQ ID NO: 3100404 - RNA, 18 nt, Mycobacterium bovis subsp bovis AF2122/97
gucgaccgugcgucgaug

SEQ ID NO: 3100405 - RNA, 19 nt, Mycobacterium bovis subsp bovis AF2122/97
gucgaccgugucaccgccg

SEQ ID NO: 3100406 - RNA, 21 nt, Mycobacterium bovis subsp bovis AF2122/97
gucgaccuguugucguggcgg

SEQ ID NO: 3100407 - RNA, 20 nt, Mycobacterium bovis subsp bovis AF2122/97
gucgaccuucucgaugcuga

SEQ ID NO: 3100408 - RNA, 17 nt, Mycobacterium bovis subsp bovis AF2122/97
gucgacgaacucgccca

SEQ ID NO: 3100409 - RNA, 22 nt, Mycobacterium bovis subsp bovis AF2122/97
gucgacgaauaacgcggucggc

SEQ ID NO: 3100410 - RNA, 14 nt, Mycobacterium bovis subsp bovis AF2122/97
gucgacgacaacga

SEQ ID NO: 3100411 - RNA, 16 nt, Mycobacterium bovis subsp bovis AF2122/97
gucgacgacaacgaug

SEQ ID NO: 3100412 - RNA, 17 nt, Mycobacterium bovis subsp bovis AF2122/97
gucgacgacaacgaugu

SEQ ID NO: 3100413 - RNA, 22 nt, Mycobacterium bovis subsp bovis AF2122/97
gucgacgacauacgagcaguga

SEQ ID NO: 3100414 - RNA, 16 nt, Mycobacterium bovis subsp bovis AF2122/97
gucgacgacgcccuca

SEQ ID NO: 3100415 - RNA, 14 nt, Mycobacterium bovis subsp bovis AF2122/97
gucgacgacgucgc

SEQ ID NO: 3100416 - RNA, 13 nt, Mycobacterium bovis subsp bovis AF2122/97
gucgacgagaucc

SEQ ID NO: 3100417 - RNA, 14 nt, Mycobacterium bovis subsp bovis AF2122/97
gucgacgagcgccu

SEQ ID NO: 3100418 - RNA, 15 nt, Mycobacterium bovis subsp bovis AF2122/97
gucgacgaggucagc

SEQ ID NO: 3100419 - RNA, 19 nt, Mycobacterium bovis subsp bovis AF2122/97
gucgacgaucucgccggcg

SEQ ID NO: 3100420 - RNA, 23 nt, Mycobacterium bovis subsp bovis AF2122/97
gucgacgaugucggcaccauagc

SEQ ID NO: 3100421 - RNA, 18 nt, Mycobacterium bovis subsp bovis AF2122/97
gucgacgauucccgcgga

SEQ ID NO: 3100422 - RNA, 19 nt, Mycobacterium bovis subsp bovis AF2122/97
gucgacgcccauggcgucg

SEQ ID NO: 3100423 - RNA, 15 nt, Mycobacterium bovis subsp bovis AF2122/97
gucgacgcccgauac

SEQ ID NO: 3100424 - RNA, 23 nt, Mycobacterium bovis subsp bovis AF2122/97
gucgacgcccgauacgccaccgg

SEQ ID NO: 3100425 - RNA, 16 nt, Mycobacterium bovis subsp bovis AF2122/97
gucgacgccgaccacc

SEQ ID NO: 3100426 - RNA, 13 nt, Mycobacterium bovis subsp bovis AF2122/97
gucgacgccgauc

SEQ ID NO: 3100427 - RNA, 21 nt, Mycobacterium bovis subsp bovis AF2122/97
gucgacgccggccagcggcca

SEQ ID NO: 3100428 - RNA, 15 nt, Mycobacterium bovis subsp bovis AF2122/97
gucgacgcgguccuc

SEQ ID NO: 3100429 - RNA, 20 nt, Mycobacterium bovis subsp bovis AF2122/97
gucgacgcgguccucgagcc

SEQ ID NO: 3100430 - RNA, 15 nt, Mycobacterium bovis subsp bovis AF2122/97
gucgacgcugugggc

SEQ ID NO: 3100431 - RNA, 14 nt, Mycobacterium bovis subsp bovis AF2122/97
gucgacggccaccc

SEQ ID NO: 3100432 - RNA, 15 nt, Mycobacterium bovis subsp bovis AF2122/97
gucgacggccacccc

SEQ ID NO: 3100433 - RNA, 16 nt, Mycobacterium bovis subsp bovis AF2122/97
gucgacggcgauggcg

SEQ ID NO: 3100434 - RNA, 18 nt, Mycobacterium bovis subsp bovis AF2122/97
gucgacggcgauggcgcg

SEQ ID NO: 3100435 - RNA, 15 nt, Mycobacterium bovis subsp bovis AF2122/97
gucgacggcggccgc

SEQ ID NO: 3100436 - RNA, 14 nt, Mycobacterium bovis subsp bovis AF2122/97
gucgacggcugcgc

SEQ ID NO: 3100437 - RNA, 17 nt, Mycobacterium bovis subsp bovis AF2122/97
gucgacgggcacgcggc

SEQ ID NO: 3100438 - RNA, 16 nt, Mycobacterium bovis subsp bovis AF2122/97
gucgacgggcucguca

SEQ ID NO: 3100439 - RNA, 22 nt, Mycobacterium bovis subsp bovis AF2122/97
gucgacggggaacguccgcgcc

SEQ ID NO: 3100440 - RNA, 23 nt, Mycobacterium bovis subsp bovis AF2122/97
gucgacggggcggucggccggcu

SEQ ID NO: 3100441 - RNA, 16 nt, Mycobacterium bovis subsp bovis AF2122/97
gucgacgggucggcgc

SEQ ID NO: 3100442 - RNA, 18 nt, Mycobacterium bovis subsp bovis AF2122/97
gucgacgggucggcgccg

SEQ ID NO: 3100443 - RNA, 20 nt, Mycobacterium bovis subsp bovis AF2122/97
gucgacgggucggcgccgag

SEQ ID NO: 3100444 - RNA, 13 nt, Mycobacterium bovis subsp bovis AF2122/97
gucgacggucacc

SEQ ID NO: 3100445 - RNA, 17 nt, Mycobacterium bovis subsp bovis AF2122/97
gucgacggucaccggcg

SEQ ID NO: 3100446 - RNA, 18 nt, Mycobacterium bovis subsp bovis AF2122/97
gucgacggucaccggcgc

SEQ ID NO: 3100447 - RNA, 14 nt, Mycobacterium bovis subsp bovis AF2122/97
gucgacggucaucc

SEQ ID NO: 3100448 - RNA, 12 nt, Mycobacterium bovis subsp bovis AF2122/97
gucgacggugcc

SEQ ID NO: 3100449 - RNA, 16 nt, Mycobacterium bovis subsp bovis AF2122/97
gucgacggugccgucg

SEQ ID NO: 3100450 - RNA, 14 nt, Mycobacterium bovis subsp bovis AF2122/97
gucgacgguggcgc

SEQ ID NO: 3100451 - RNA, 16 nt, Mycobacterium bovis subsp bovis AF2122/97
gucgacgucagcacca

SEQ ID NO: 3100452 - RNA, 14 nt, Mycobacterium bovis subsp bovis AF2122/97
gucgacgucgacgg

SEQ ID NO: 3100453 - RNA, 13 nt, Mycobacterium bovis subsp bovis AF2122/97
gucgacgucgauc

SEQ ID NO: 3100454 - RNA, 15 nt, Mycobacterium bovis subsp bovis AF2122/97
gucgacgucgauggu

SEQ ID NO: 3100455 - RNA, 16 nt, Mycobacterium bovis subsp bovis AF2122/97
gucgacgucgauggug

SEQ ID NO: 3100456 - RNA, 13 nt, Mycobacterium bovis subsp bovis AF2122/97
gucgacgucggca

SEQ ID NO: 3100457 - RNA, 16 nt, Mycobacterium bovis subsp bovis AF2122/97
gucgacgucggcaauc

SEQ ID NO: 3100458 - RNA, 14 nt, Mycobacterium bovis subsp bovis AF2122/97
gucgacgucggcga

SEQ ID NO: 3100459 - RNA, 15 nt, Mycobacterium bovis subsp bovis AF2122/97
gucgacgucggcgag

SEQ ID NO: 3100460 - RNA, 19 nt, Mycobacterium bovis subsp bovis AF2122/97
gucgacgucggcgagcucg

SEQ ID NO: 3100461 - RNA, 14 nt, Mycobacterium bovis subsp bovis AF2122/97
gucgacgucggugu

SEQ ID NO: 3100462 - RNA, 23 nt, Mycobacterium bovis subsp bovis AF2122/97
gucgacgugaucgcgguccaaca

SEQ ID NO: 3100463 - RNA, 23 nt, Mycobacterium bovis subsp bovis AF2122/97
gucgacguuggcaaagccgaaau

SEQ ID NO: 3100464 - RNA, 14 nt, Mycobacterium bovis subsp bovis AF2122/97
gucgacuccagcac

SEQ ID NO: 3100465 - RNA, 20 nt, Mycobacterium bovis subsp bovis AF2122/97
gucgacucguggcgccacgg

SEQ ID NO: 3100466 - RNA, 18 nt, Mycobacterium bovis subsp bovis AF2122/97
gucgacugcgugccgcac

SEQ ID NO: 3100467 - RNA, 23 nt, Mycobacterium bovis subsp bovis AF2122/97
gucgacuggccguuucggcgccg

SEQ ID NO: 3100468 - RNA, 18 nt, Mycobacterium bovis subsp bovis AF2122/97
gucgacugggacgacgcc

SEQ ID NO: 3100469 - RNA, 18 nt, Mycobacterium bovis subsp bovis AF2122/97
gucgacuguugucuacuc

SEQ ID NO: 3100470 - RNA, 13 nt, Mycobacterium bovis subsp bovis AF2122/97
gucgacuugcagg

SEQ ID NO: 3100471 - RNA, 16 nt, Mycobacterium bovis subsp bovis AF2122/97
gucgagaaucggcauu

SEQ ID NO: 3100472 - RNA, 22 nt, Mycobacterium bovis subsp bovis AF2122/97
gucgagacgcuuuccgccgcac

SEQ ID NO: 3100473 - RNA, 18 nt, Mycobacterium bovis subsp bovis AF2122/97
gucgagagguucgccguc

SEQ ID NO: 3100474 - RNA, 22 nt, Mycobacterium bovis subsp bovis AF2122/97
gucgagauagccgacgucgccg

SEQ ID NO: 3100475 - RNA, 18 nt, Mycobacterium bovis subsp bovis AF2122/97
gucgagauagucggccgg

SEQ ID NO: 3100476 - RNA, 20 nt, Mycobacterium bovis subsp bovis AF2122/97
gucgagauagucggccggcg

SEQ ID NO: 3100477 - RNA, 23 nt, Mycobacterium bovis subsp bovis AF2122/97
gucgagauccucgucgagguccu

SEQ ID NO: 3100478 - RNA, 20 nt, Mycobacterium bovis subsp bovis AF2122/97
gucgagcaacgugacccgga

SEQ ID NO: 3100479 - RNA, 18 nt, Mycobacterium bovis subsp bovis AF2122/97
gucgagcaccacccgggc

SEQ ID NO: 3100480 - RNA, 18 nt, Mycobacterium bovis subsp bovis AF2122/97
gucgagcaccggcugcgg

SEQ ID NO: 3100481 - RNA, 20 nt, Mycobacterium bovis subsp bovis AF2122/97
gucgagcaccucgaaggccc

SEQ ID NO: 3100482 - RNA, 16 nt, Mycobacterium bovis subsp bovis AF2122/97
gucgagcaccugccga

SEQ ID NO: 3100483 - RNA, 18 nt, Mycobacterium bovis subsp bovis AF2122/97
gucgagcaccugccgauc

SEQ ID NO: 3100484 - RNA, 19 nt, Mycobacterium bovis subsp bovis AF2122/97
gucgagcaccugccgaucg

SEQ ID NO: 3100485 - RNA, 19 nt, Mycobacterium bovis subsp bovis AF2122/97
gucgagcaccuuggggugg

SEQ ID NO: 3100486 - RNA, 22 nt, Mycobacterium bovis subsp bovis AF2122/97
gucgagcacgaugucgaugccg

SEQ ID NO: 3100487 - RNA, 16 nt, Mycobacterium bovis subsp bovis AF2122/97
gucgagcacggugagc

SEQ ID NO: 3100488 - RNA, 14 nt, Mycobacterium bovis subsp bovis AF2122/97
gucgagcagcacca

SEQ ID NO: 3100489 - RNA, 11 nt, Mycobacterium bovis subsp bovis AF2122/97
gucgagcagcc

SEQ ID NO: 3100490 - RNA, 15 nt, Mycobacterium bovis subsp bovis AF2122/97
gucgagcagccgagc

SEQ ID NO: 3100491 - RNA, 12 nt, Mycobacterium bovis subsp bovis AF2122/97
gucgagcagcgc

SEQ ID NO: 3100492 - RNA, 20 nt, Mycobacterium bovis subsp bovis AF2122/97
gucgagcagcgccacccgcg

SEQ ID NO: 3100493 - RNA, 20 nt, Mycobacterium bovis subsp bovis AF2122/97
gucgagcaggcccaacgcga

SEQ ID NO: 3100494 - RNA, 16 nt, Mycobacterium bovis subsp bovis AF2122/97
gucgagcaucccgguc

SEQ ID NO: 3100495 - RNA, 15 nt, Mycobacterium bovis subsp bovis AF2122/97
gucgagccgaccgcg

SEQ ID NO: 3100496 - RNA, 17 nt, Mycobacterium bovis subsp bovis AF2122/97
gucgagccgaccgcggg

SEQ ID NO: 3100497 - RNA, 23 nt, Mycobacterium bovis subsp bovis AF2122/97
gucgagccggacccggugcacgg

SEQ ID NO: 3100498 - RNA, 16 nt, Mycobacterium bovis subsp bovis AF2122/97
gucgagccggugccgc

SEQ ID NO: 3100499 - RNA, 21 nt, Mycobacterium bovis subsp bovis AF2122/97
gucgagcgcccacuggugauc

SEQ ID NO: 3100500 - RNA, 14 nt, Mycobacterium bovis subsp bovis AF2122/97
gucgagcgccgcgg

SEQ ID NO: 3100501 - RNA, 15 nt, Mycobacterium bovis subsp bovis AF2122/97
gucgagcgccggccg

SEQ ID NO: 3100502 - RNA, 22 nt, Mycobacterium bovis subsp bovis AF2122/97
gucgagcgccuugucgaucucg

SEQ ID NO: 3100503 - RNA, 13 nt, Mycobacterium bovis subsp bovis AF2122/97
gucgagcgcggug

SEQ ID NO: 3100504 - RNA, 23 nt, Mycobacterium bovis subsp bovis AF2122/97
gucgagcgcggugccgccaccgg

SEQ ID NO: 3100505 - RNA, 19 nt, Mycobacterium bovis subsp bovis AF2122/97
gucgagcgcgucggucacc

SEQ ID NO: 3100506 - RNA, 19 nt, Mycobacterium bovis subsp bovis AF2122/97
gucgagcgcuucgucgccg

SEQ ID NO: 3100507 - RNA, 22 nt, Mycobacterium bovis subsp bovis AF2122/97
gucgagcgcuucgucgccgaac

SEQ ID NO: 3100508 - RNA, 18 nt, Mycobacterium bovis subsp bovis AF2122/97
gucgagcguggcgacggg

SEQ ID NO: 3100509 - RNA, 19 nt, Mycobacterium bovis subsp bovis AF2122/97
gucgagcguggcgacggga

SEQ ID NO: 3100510 - RNA, 19 nt, Mycobacterium bovis subsp bovis AF2122/97
gucgagcuuuucgaccuuc

SEQ ID NO: 3100511 - RNA, 16 nt, Mycobacterium bovis subsp bovis AF2122/97
gucgaggcaggccucg

SEQ ID NO: 3100512 - RNA, 17 nt, Mycobacterium bovis subsp bovis AF2122/97
gucgaggcaggccucgg

SEQ ID NO: 3100513 - RNA, 19 nt, Mycobacterium bovis subsp bovis AF2122/97
gucgaggcugaccguggcg

SEQ ID NO: 3100514 - RNA, 23 nt, Mycobacterium bovis subsp bovis AF2122/97
gucgaggcugaccguggcgccgg

SEQ ID NO: 3100515 - RNA, 21 nt, Mycobacterium bovis subsp bovis AF2122/97
gucgagggcuuuagugucugc

SEQ ID NO: 3100516 - RNA, 17 nt, Mycobacterium bovis subsp bovis AF2122/97
gucgagguaguggucuu

SEQ ID NO: 3100517 - RNA, 16 nt, Mycobacterium bovis subsp bovis AF2122/97
gucgaggucacgcgag

SEQ ID NO: 3100518 - RNA, 16 nt, Mycobacterium bovis subsp bovis AF2122/97
gucgaggucagcuccc

SEQ ID NO: 3100519 - RNA, 17 nt, Mycobacterium bovis subsp bovis AF2122/97
gucgaggucagcucccg

SEQ ID NO: 3100520 - RNA, 14 nt, Mycobacterium bovis subsp bovis AF2122/97
gucgagguccacca

SEQ ID NO: 3100521 - RNA, 17 nt, Mycobacterium bovis subsp bovis AF2122/97
gucgagguccaccaccc

SEQ ID NO: 3100522 - RNA, 22 nt, Mycobacterium bovis subsp bovis AF2122/97
gucgagguccuugaggauccgc

SEQ ID NO: 3100523 - RNA, 14 nt, Mycobacterium bovis subsp bovis AF2122/97
gucgaggucggcga

SEQ ID NO: 3100524 - RNA, 16 nt, Mycobacterium bovis subsp bovis AF2122/97
gucgaggucggcgauc

SEQ ID NO: 3100525 - RNA, 17 nt, Mycobacterium bovis subsp bovis AF2122/97
gucgaggucggcgauca

SEQ ID NO: 3100526 - RNA, 15 nt, Mycobacterium bovis subsp bovis AF2122/97
gucgagguggggugg

SEQ ID NO: 3100527 - RNA, 18 nt, Mycobacterium bovis subsp bovis AF2122/97
gucgaggugggguggugg

SEQ ID NO: 3100528 - RNA, 22 nt, Mycobacterium bovis subsp bovis AF2122/97
gucgagguucucccgcgcuugg

SEQ ID NO: 3100529 - RNA, 16 nt, Mycobacterium bovis subsp bovis AF2122/97
gucgaguccacagcgc

SEQ ID NO: 3100530 - RNA, 19 nt, Mycobacterium bovis subsp bovis AF2122/97
gucgaguccaggccggcag

SEQ ID NO: 3100531 - RNA, 22 nt, Mycobacterium bovis subsp bovis AF2122/97
gucgaguccgacggggaugggg

SEQ ID NO: 3100532 - RNA, 15 nt, Mycobacterium bovis subsp bovis AF2122/97
gucgagucgaugacc

SEQ ID NO: 3100533 - RNA, 14 nt, Mycobacterium bovis subsp bovis AF2122/97
gucgagucgccgag

SEQ ID NO: 3100534 - RNA, 22 nt, Mycobacterium bovis subsp bovis AF2122/97
gucgagucgguccugccaaugc

SEQ ID NO: 3100535 - RNA, 15 nt, Mycobacterium bovis subsp bovis AF2122/97
gucgagugccgccac

SEQ ID NO: 3100536 - RNA, 21 nt, Mycobacterium bovis subsp bovis AF2122/97
gucgagugccgccaccgccac

SEQ ID NO: 3100537 - RNA, 17 nt, Mycobacterium bovis subsp bovis AF2122/97
gucgagugccucgaccu

SEQ ID NO: 3100538 - RNA, 22 nt, Mycobacterium bovis subsp bovis AF2122/97
gucgagugcggacuucgccgcc

SEQ ID NO: 3100539 - RNA, 20 nt, Mycobacterium bovis subsp bovis AF2122/97
gucgaguucgcagucgauga

SEQ ID NO: 3100540 - RNA, 22 nt, Mycobacterium bovis subsp bovis AF2122/97
gucgaguucgcagucgaugagu

SEQ ID NO: 3100541 - RNA, 13 nt, Mycobacterium bovis subsp bovis AF2122/97
gucgaguucgguu

SEQ ID NO: 3100542 - RNA, 14 nt, Mycobacterium bovis subsp bovis AF2122/97
gucgaguuggccau

SEQ ID NO: 3100543 - RNA, 15 nt, Mycobacterium bovis subsp bovis AF2122/97
gucgauaccggcgug

SEQ ID NO: 3100544 - RNA, 18 nt, Mycobacterium bovis subsp bovis AF2122/97
gucgauagcccgccaccc

SEQ ID NO: 3100545 - RNA, 22 nt, Mycobacterium bovis subsp bovis AF2122/97
gucgaucaacaacagccgcagc

SEQ ID NO: 3100546 - RNA, 23 nt, Mycobacterium bovis subsp bovis AF2122/97
gucgaucaacaccaacgacagcg

SEQ ID NO: 3100547 - RNA, 13 nt, Mycobacterium bovis subsp bovis AF2122/97
gucgaucaccgac

SEQ ID NO: 3100548 - RNA, 14 nt, Mycobacterium bovis subsp bovis AF2122/97
gucgaucaccgaca

SEQ ID NO: 3100549 - RNA, 18 nt, Mycobacterium bovis subsp bovis AF2122/97
gucgaucacguacgccgc

SEQ ID NO: 3100550 - RNA, 21 nt, Mycobacterium bovis subsp bovis AF2122/97
gucgaucacguacgccgccga

SEQ ID NO: 3100551 - RNA, 22 nt, Mycobacterium bovis subsp bovis AF2122/97
gucgaucagaacgugacggucc

SEQ ID NO: 3100552 - RNA, 17 nt, Mycobacterium bovis subsp bovis AF2122/97
gucgaucagccgcaucu

SEQ ID NO: 3100553 - RNA, 11 nt, Mycobacterium bovis subsp bovis AF2122/97
gucgaucagcg

SEQ ID NO: 3100554 - RNA, 13 nt, Mycobacterium bovis subsp bovis AF2122/97
gucgaucagcgcg

SEQ ID NO: 3100555 - RNA, 16 nt, Mycobacterium bovis subsp bovis AF2122/97
gucgaucagcgcgacg

SEQ ID NO: 3100556 - RNA, 20 nt, Mycobacterium bovis subsp bovis AF2122/97
gucgaucagcgcgacggucc

SEQ ID NO: 3100557 - RNA, 22 nt, Mycobacterium bovis subsp bovis AF2122/97
gucgaucagcuugggcagcagc

SEQ ID NO: 3100558 - RNA, 23 nt, Mycobacterium bovis subsp bovis AF2122/97
gucgaucagcuugggcagcagcg

SEQ ID NO: 3100559 - RNA, 14 nt, Mycobacterium bovis subsp bovis AF2122/97
gucgaucauggcgg

SEQ ID NO: 3100560 - RNA, 16 nt, Mycobacterium bovis subsp bovis AF2122/97
gucgauccgucggcgg

SEQ ID NO: 3100561 - RNA, 22 nt, Mycobacterium bovis subsp bovis AF2122/97
gucgauccgucggcggagagca

SEQ ID NO: 3100562 - RNA, 19 nt, Mycobacterium bovis subsp bovis AF2122/97
gucgaucgaauugcguucg

SEQ ID NO: 3100563 - RNA, 14 nt, Mycobacterium bovis subsp bovis AF2122/97
gucgaucgccgcga

SEQ ID NO: 3100564 - RNA, 14 nt, Mycobacterium bovis subsp bovis AF2122/97
gucgaucgccgcgc

SEQ ID NO: 3100565 - RNA, 15 nt, Mycobacterium bovis subsp bovis AF2122/97
gucgaucgcggcccg

SEQ ID NO: 3100566 - RNA, 19 nt, Mycobacterium bovis subsp bovis AF2122/97
gucgaucgcggcccgcagc

SEQ ID NO: 3100567 - RNA, 21 nt, Mycobacterium bovis subsp bovis AF2122/97
gucgaucucggcagagacgua

SEQ ID NO: 3100568 - RNA, 22 nt, Mycobacterium bovis subsp bovis AF2122/97
gucgaucugcgccaucacaucg

SEQ ID NO: 3100569 - RNA, 20 nt, Mycobacterium bovis subsp bovis AF2122/97
gucgaugaagcgucguugcu

SEQ ID NO: 3100570 - RNA, 14 nt, Mycobacterium bovis subsp bovis AF2122/97
gucgaugaccagca

SEQ ID NO: 3100571 - RNA, 15 nt, Mycobacterium bovis subsp bovis AF2122/97
gucgaugaccagcac

SEQ ID NO: 3100572 - RNA, 22 nt, Mycobacterium bovis subsp bovis AF2122/97
gucgaugaccuugggaccaccg

SEQ ID NO: 3100573 - RNA, 20 nt, Mycobacterium bovis subsp bovis AF2122/97
gucgaugacgacgccgucgg

SEQ ID NO: 3100574 - RNA, 14 nt, Mycobacterium bovis subsp bovis AF2122/97
gucgaugacgccgu

SEQ ID NO: 3100575 - RNA, 19 nt, Mycobacterium bovis subsp bovis AF2122/97
gucgaugacgccgucagcg

SEQ ID NO: 3100576 - RNA, 23 nt, Mycobacterium bovis subsp bovis AF2122/97
gucgaugagguucaucgccggcg

SEQ ID NO: 3100577 - RNA, 14 nt, Mycobacterium bovis subsp bovis AF2122/97
gucgaugagucggg

SEQ ID NO: 3100578 - RNA, 15 nt, Mycobacterium bovis subsp bovis AF2122/97
gucgaugaugccgga

SEQ ID NO: 3100579 - RNA, 14 nt, Mycobacterium bovis subsp bovis AF2122/97
gucgaugccgcgca

SEQ ID NO: 3100580 - RNA, 18 nt, Mycobacterium bovis subsp bovis AF2122/97
gucgaugccgcgcagcgc

SEQ ID NO: 3100581 - RNA, 20 nt, Mycobacterium bovis subsp bovis AF2122/97
gucgaugccgcgcagcgcgg

SEQ ID NO: 3100582 - RNA, 21 nt, Mycobacterium bovis subsp bovis AF2122/97
gucgaugccggcuggcggcgu

SEQ ID NO: 3100583 - RNA, 19 nt, Mycobacterium bovis subsp bovis AF2122/97
gucgaugcgcagcccgucg

SEQ ID NO: 3100584 - RNA, 15 nt, Mycobacterium bovis subsp bovis AF2122/97
gucgaugcgcgccgg

SEQ ID NO: 3100585 - RNA, 21 nt, Mycobacterium bovis subsp bovis AF2122/97
gucgaugcgcugcucacgcag

SEQ ID NO: 3100586 - RNA, 22 nt, Mycobacterium bovis subsp bovis AF2122/97
gucgaugcgcugcucacgcagc

SEQ ID NO: 3100587 - RNA, 23 nt, Mycobacterium bovis subsp bovis AF2122/97
gucgaugcugaacacgcagccga

SEQ ID NO: 3100588 - RNA, 17 nt, Mycobacterium bovis subsp bovis AF2122/97
gucgaugcugacggugg

SEQ ID NO: 3100589 - RNA, 15 nt, Mycobacterium bovis subsp bovis AF2122/97
gucgaugcugccagc

SEQ ID NO: 3100590 - RNA, 22 nt, Mycobacterium bovis subsp bovis AF2122/97
gucgauggagaaguuagccacc

SEQ ID NO: 3100591 - RNA, 13 nt, Mycobacterium bovis subsp bovis AF2122/97
gucgauggcgucg

SEQ ID NO: 3100592 - RNA, 18 nt, Mycobacterium bovis subsp bovis AF2122/97
gucgaugucagccaccau

SEQ ID NO: 3100593 - RNA, 19 nt, Mycobacterium bovis subsp bovis AF2122/97
gucgauguccacgccgugc

SEQ ID NO: 3100594 - RNA, 19 nt, Mycobacterium bovis subsp bovis AF2122/97
gucgauguccccggcggca

SEQ ID NO: 3100595 - RNA, 23 nt, Mycobacterium bovis subsp bovis AF2122/97
gucgauguccgcagcaccgucgg

SEQ ID NO: 3100596 - RNA, 15 nt, Mycobacterium bovis subsp bovis AF2122/97
gucgauguccgugag

SEQ ID NO: 3100597 - RNA, 15 nt, Mycobacterium bovis subsp bovis AF2122/97
gucgaugucgacguc

SEQ ID NO: 3100598 - RNA, 17 nt, Mycobacterium bovis subsp bovis AF2122/97
gucgaugucgacgucgc

SEQ ID NO: 3100599 - RNA, 19 nt, Mycobacterium bovis subsp bovis AF2122/97
gucgaugucggggccgucg

SEQ ID NO: 3100600 - RNA, 22 nt, Mycobacterium bovis subsp bovis AF2122/97
gucgaugucggggccgucgucg

SEQ ID NO: 3100601 - RNA, 15 nt, Mycobacterium bovis subsp bovis AF2122/97
gucgaugucgucgac

SEQ ID NO: 3100602 - RNA, 18 nt, Mycobacterium bovis subsp bovis AF2122/97
gucgaugucgucgacauc

SEQ ID NO: 3100603 - RNA, 17 nt, Mycobacterium bovis subsp bovis AF2122/97
gucgaugucguuggcca

SEQ ID NO: 3100604 - RNA, 14 nt, Mycobacterium bovis subsp bovis AF2122/97
gucgauguucgccg

SEQ ID NO: 3100605 - RNA, 17 nt, Mycobacterium bovis subsp bovis AF2122/97
gucgauguucgccgcgc

SEQ ID NO: 3100606 - RNA, 18 nt, Mycobacterium bovis subsp bovis AF2122/97
gucgauuagcccacccau

SEQ ID NO: 3100607 - RNA, 21 nt, Mycobacterium bovis subsp bovis AF2122/97
gucgauugcaggucggcccag

SEQ ID NO: 3100608 - RNA, 15 nt, Mycobacterium bovis subsp bovis AF2122/97
gucgauugccaccga

SEQ ID NO: 3100609 - RNA, 17 nt, Mycobacterium bovis subsp bovis AF2122/97
gucgauugccaccgaga

SEQ ID NO: 3100610 - RNA, 16 nt, Mycobacterium bovis subsp bovis AF2122/97
gucgauuggcucgccg

SEQ ID NO: 3100611 - RNA, 17 nt, Mycobacterium bovis subsp bovis AF2122/97
gucgauuggcucgccga

SEQ ID NO: 3100612 - RNA, 17 nt, Mycobacterium bovis subsp bovis AF2122/97
gucgauuggcugcgccg

SEQ ID NO: 3100613 - RNA, 15 nt, Mycobacterium bovis subsp bovis AF2122/97
gucgauuucggcgac

SEQ ID NO: 3100614 - RNA, 17 nt, Mycobacterium bovis subsp bovis AF2122/97
gucgcaaaagcccccau

SEQ ID NO: 3100615 - RNA, 19 nt, Mycobacterium bovis subsp bovis AF2122/97
gucgcaaaagcccccauuu

SEQ ID NO: 3100616 - RNA, 19 nt, Mycobacterium bovis subsp bovis AF2122/97
gucgcaaacuucgcgcacg

SEQ ID NO: 3100617 - RNA, 14 nt, Mycobacterium bovis subsp bovis AF2122/97
gucgcaaccgccgc

SEQ ID NO: 3100618 - RNA, 23 nt, Mycobacterium bovis subsp bovis AF2122/97
gucgcaacgcaucgaugcgugcc

SEQ ID NO: 3100619 - RNA, 13 nt, Mycobacterium bovis subsp bovis AF2122/97
gucgcaacgcgau

SEQ ID NO: 3100620 - RNA, 20 nt, Mycobacterium bovis subsp bovis AF2122/97
gucgcaauauccggccgagc

SEQ ID NO: 3100621 - RNA, 22 nt, Mycobacterium bovis subsp bovis AF2122/97
gucgcaauauccggccgagccg

SEQ ID NO: 3100622 - RNA, 18 nt, Mycobacterium bovis subsp bovis AF2122/97
gucgcaauaugccacaga

SEQ ID NO: 3100623 - RNA, 21 nt, Mycobacterium bovis subsp bovis AF2122/97
gucgcacauggugggucgacg

SEQ ID NO: 3100624 - RNA, 16 nt, Mycobacterium bovis subsp bovis AF2122/97
gucgcaccacagugcc

SEQ ID NO: 3100625 - RNA, 22 nt, Mycobacterium bovis subsp bovis AF2122/97
gucgcacccaacuccaucagcg

SEQ ID NO: 3100626 - RNA, 23 nt, Mycobacterium bovis subsp bovis AF2122/97
gucgcacccaacuccaucagcgc

SEQ ID NO: 3100627 - RNA, 12 nt, Mycobacterium bovis subsp bovis AF2122/97
gucgcaccccgg

SEQ ID NO: 3100628 - RNA, 14 nt, Mycobacterium bovis subsp bovis AF2122/97
gucgcaccgccggc

SEQ ID NO: 3100629 - RNA, 23 nt, Mycobacterium bovis subsp bovis AF2122/97
gucgcacgcgcgcaggccgccgc

SEQ ID NO: 3100630 - RNA, 14 nt, Mycobacterium bovis subsp bovis AF2122/97
gucgcacggugccg

SEQ ID NO: 3100631 - RNA, 15 nt, Mycobacterium bovis subsp bovis AF2122/97
gucgcacugcgccgg

SEQ ID NO: 3100632 - RNA, 19 nt, Mycobacterium bovis subsp bovis AF2122/97
gucgcacugcgccggccgg

SEQ ID NO: 3100633 - RNA, 20 nt, Mycobacterium bovis subsp bovis AF2122/97
gucgcacugcgccggccggc

SEQ ID NO: 3100634 - RNA, 22 nt, Mycobacterium bovis subsp bovis AF2122/97
gucgcacugcgccggccggcgc

SEQ ID NO: 3100635 - RNA, 20 nt, Mycobacterium bovis subsp bovis AF2122/97
gucgcagaaaccauucggcg

SEQ ID NO: 3100636 - RNA, 17 nt, Mycobacterium bovis subsp bovis AF2122/97
gucgcagaccagacugc

SEQ ID NO: 3100637 - RNA, 15 nt, Mycobacterium bovis subsp bovis AF2122/97
gucgcagcacgggug

SEQ ID NO: 3100638 - RNA, 15 nt, Mycobacterium bovis subsp bovis AF2122/97
gucgcagccagcuga

SEQ ID NO: 3100639 - RNA, 13 nt, Mycobacterium bovis subsp bovis AF2122/97
gucgcagcugccg

SEQ ID NO: 3100640 - RNA, 22 nt, Mycobacterium bovis subsp bovis AF2122/97
gucgcagcugccguuggggugg

SEQ ID NO: 3100641 - RNA, 13 nt, Mycobacterium bovis subsp bovis AF2122/97
gucgcaggaucgg

SEQ ID NO: 3100642 - RNA, 15 nt, Mycobacterium bovis subsp bovis AF2122/97
gucgcaggaucggcg

SEQ ID NO: 3100643 - RNA, 16 nt, Mycobacterium bovis subsp bovis AF2122/97
gucgcaggaucggcgg

SEQ ID NO: 3100644 - RNA, 20 nt, Mycobacterium bovis subsp bovis AF2122/97
gucgcaggaucggcggauag

SEQ ID NO: 3100645 - RNA, 20 nt, Mycobacterium bovis subsp bovis AF2122/97
gucgcaggauucccagucgc

SEQ ID NO: 3100646 - RNA, 19 nt, Mycobacterium bovis subsp bovis AF2122/97
gucgcaguauucacagucg

SEQ ID NO: 3100647 - RNA, 15 nt, Mycobacterium bovis subsp bovis AF2122/97
gucgcagugcaagcg

SEQ ID NO: 3100648 - RNA, 15 nt, Mycobacterium bovis subsp bovis AF2122/97
gucgcagugcacccg

SEQ ID NO: 3100649 - RNA, 15 nt, Mycobacterium bovis subsp bovis AF2122/97
gucgcaucaggucgg

SEQ ID NO: 3100650 - RNA, 22 nt, Mycobacterium bovis subsp bovis AF2122/97
gucgccaacgccagcaccagcg

SEQ ID NO: 3100651 - RNA, 22 nt, Mycobacterium bovis subsp bovis AF2122/97
gucgccaagaucggguggcggg

SEQ ID NO: 3100652 - RNA, 19 nt, Mycobacterium bovis subsp bovis AF2122/97
gucgccaagcccaggcgau

SEQ ID NO: 3100653 - RNA, 23 nt, Mycobacterium bovis subsp bovis AF2122/97
gucgccaaucgaguagcugaccg

SEQ ID NO: 3100654 - RNA, 16 nt, Mycobacterium bovis subsp bovis AF2122/97
gucgccacacccgcga

SEQ ID NO: 3100655 - RNA, 23 nt, Mycobacterium bovis subsp bovis AF2122/97
gucgccacaccggggcggccgac

SEQ ID NO: 3100656 - RNA, 11 nt, Mycobacterium bovis subsp bovis AF2122/97
gucgccaccau

SEQ ID NO: 3100657 - RNA, 18 nt, Mycobacterium bovis subsp bovis AF2122/97
gucgccaccaucguugcc

SEQ ID NO: 3100658 - RNA, 19 nt, Mycobacterium bovis subsp bovis AF2122/97
gucgccaccaucguugccg

SEQ ID NO: 3100659 - RNA, 18 nt, Mycobacterium bovis subsp bovis AF2122/97
gucgccacccgacaugcg

SEQ ID NO: 3100660 - RNA, 14 nt, Mycobacterium bovis subsp bovis AF2122/97
gucgccaccgccgg

SEQ ID NO: 3100661 - RNA, 18 nt, Mycobacterium bovis subsp bovis AF2122/97
gucgccaccgccggcagc

SEQ ID NO: 3100662 - RNA, 15 nt, Mycobacterium bovis subsp bovis AF2122/97
gucgccacgaugccg

SEQ ID NO: 3100663 - RNA, 18 nt, Mycobacterium bovis subsp bovis AF2122/97
gucgccacgaugccggcu

SEQ ID NO: 3100664 - RNA, 15 nt, Mycobacterium bovis subsp bovis AF2122/97
gucgccacgcccagc

SEQ ID NO: 3100665 - RNA, 15 nt, Mycobacterium bovis subsp bovis AF2122/97
gucgccagcucggca

SEQ ID NO: 3100666 - RNA, 22 nt, Mycobacterium bovis subsp bovis AF2122/97
gucgccaggcccccucggcgug

SEQ ID NO: 3100667 - RNA, 13 nt, Mycobacterium bovis subsp bovis AF2122/97
gucgccagggccg

SEQ ID NO: 3100668 - RNA, 14 nt, Mycobacterium bovis subsp bovis AF2122/97
gucgccagggccgc

SEQ ID NO: 3100669 - RNA, 16 nt, Mycobacterium bovis subsp bovis AF2122/97
gucgccagggccgccg

SEQ ID NO: 3100670 - RNA, 17 nt, Mycobacterium bovis subsp bovis AF2122/97
gucgccagggccgccga

SEQ ID NO: 3100671 - RNA, 13 nt, Mycobacterium bovis subsp bovis AF2122/97
gucgccaggucau

SEQ ID NO: 3100672 - RNA, 19 nt, Mycobacterium bovis subsp bovis AF2122/97
gucgccauccucgagcugc

SEQ ID NO: 3100673 - RNA, 22 nt, Mycobacterium bovis subsp bovis AF2122/97
gucgcccaacaccgcgccgacg

SEQ ID NO: 3100674 - RNA, 23 nt, Mycobacterium bovis subsp bovis AF2122/97
gucgcccaacaccgcgccgacga

SEQ ID NO: 3100675 - RNA, 13 nt, Mycobacterium bovis subsp bovis AF2122/97
gucgcccagccga

SEQ ID NO: 3100676 - RNA, 15 nt, Mycobacterium bovis subsp bovis AF2122/97
gucgcccagccgagc

SEQ ID NO: 3100677 - RNA, 20 nt, Mycobacterium bovis subsp bovis AF2122/97
gucgcccagccgagcguggc

SEQ ID NO: 3100678 - RNA, 22 nt, Mycobacterium bovis subsp bovis AF2122/97
gucgccccaagcgccugagcgg

SEQ ID NO: 3100679 - RNA, 20 nt, Mycobacterium bovis subsp bovis AF2122/97
gucgccccguuucggucgac

SEQ ID NO: 3100680 - RNA, 14 nt, Mycobacterium bovis subsp bovis AF2122/97
gucgcccgagucga

SEQ ID NO: 3100681 - RNA, 18 nt, Mycobacterium bovis subsp bovis AF2122/97
gucgcccggguggcgucg

SEQ ID NO: 3100682 - RNA, 19 nt, Mycobacterium bovis subsp bovis AF2122/97
gucgcccggguggcgucga

SEQ ID NO: 3100683 - RNA, 20 nt, Mycobacterium bovis subsp bovis AF2122/97
gucgcccgguccgccgcaga

SEQ ID NO: 3100684 - RNA, 24 nt, Mycobacterium bovis subsp bovis AF2122/97
gucgcccgugucguaccagccaug

SEQ ID NO: 3100685 - RNA, 17 nt, Mycobacterium bovis subsp bovis AF2122/97
gucgcccucgaucgcca

SEQ ID NO: 3100686 - RNA, 16 nt, Mycobacterium bovis subsp bovis AF2122/97
gucgcccuuagggucg

SEQ ID NO: 3100687 - RNA, 17 nt, Mycobacterium bovis subsp bovis AF2122/97
gucgcccuuagggucgc

SEQ ID NO: 3100688 - RNA, 19 nt, Mycobacterium bovis subsp bovis AF2122/97
gucgcccuuagggucgccg

SEQ ID NO: 3100689 - RNA, 16 nt, Mycobacterium bovis subsp bovis AF2122/97
gucgccgaaagggucg

SEQ ID NO: 3100690 - RNA, 20 nt, Mycobacterium bovis subsp bovis AF2122/97
gucgccgaaagggucgacgu

SEQ ID NO: 3100691 - RNA, 14 nt, Mycobacterium bovis subsp bovis AF2122/97
gucgccgaacaccg

SEQ ID NO: 3100692 - RNA, 18 nt, Mycobacterium bovis subsp bovis AF2122/97
gucgccgaaguuccagcc

SEQ ID NO: 3100693 - RNA, 21 nt, Mycobacterium bovis subsp bovis AF2122/97
gucgccgaaguuccagccgac

SEQ ID NO: 3100694 - RNA, 19 nt, Mycobacterium bovis subsp bovis AF2122/97
gucgccgaauggcugggcu

SEQ ID NO: 3100695 - RNA, 18 nt, Mycobacterium bovis subsp bovis AF2122/97
gucgccgacccgggggcg

SEQ ID NO: 3100696 - RNA, 13 nt, Mycobacterium bovis subsp bovis AF2122/97
gucgccgacgccg

SEQ ID NO: 3100697 - RNA, 15 nt, Mycobacterium bovis subsp bovis AF2122/97
gucgccgacgccggu

SEQ ID NO: 3100698 - RNA, 13 nt, Mycobacterium bovis subsp bovis AF2122/97
gucgccgacggcg

SEQ ID NO: 3100699 - RNA, 18 nt, Mycobacterium bovis subsp bovis AF2122/97
gucgccgacggcgaccac

SEQ ID NO: 3100700 - RNA, 20 nt, Mycobacterium bovis subsp bovis AF2122/97
gucgccgaggacgccggcgc

SEQ ID NO: 3100701 - RNA, 22 nt, Mycobacterium bovis subsp bovis AF2122/97
gucgccgaggacgccggcgccg

SEQ ID NO: 3100702 - RNA, 13 nt, Mycobacterium bovis subsp bovis AF2122/97
gucgccgaggucg

SEQ ID NO: 3100703 - RNA, 22 nt, Mycobacterium bovis subsp bovis AF2122/97
gucgccgaggucgaaccgccgg

SEQ ID NO: 3100704 - RNA, 14 nt, Mycobacterium bovis subsp bovis AF2122/97
gucgccgaguaccg

SEQ ID NO: 3100705 - RNA, 15 nt, Mycobacterium bovis subsp bovis AF2122/97
gucgccgaucaccgc

SEQ ID NO: 3100706 - RNA, 16 nt, Mycobacterium bovis subsp bovis AF2122/97
gucgccgaucaccgca

SEQ ID NO: 3100707 - RNA, 24 nt, Mycobacterium bovis subsp bovis AF2122/97
gucgccgaucaccgcaucggugcc

SEQ ID NO: 3100708 - RNA, 20 nt, Mycobacterium bovis subsp bovis AF2122/97
gucgccgaucgagacuucuu

SEQ ID NO: 3100709 - RNA, 16 nt, Mycobacterium bovis subsp bovis AF2122/97
gucgccgcaucggcgg

SEQ ID NO: 3100710 - RNA, 18 nt, Mycobacterium bovis subsp bovis AF2122/97
gucgccgcaucggcggug

SEQ ID NO: 3100711 - RNA, 13 nt, Mycobacterium bovis subsp bovis AF2122/97
gucgccgccacca

SEQ ID NO: 3100712 - RNA, 15 nt, Mycobacterium bovis subsp bovis AF2122/97
gucgccgccaccagc

SEQ ID NO: 3100713 - RNA, 18 nt, Mycobacterium bovis subsp bovis AF2122/97
gucgccgccaccagcgca

SEQ ID NO: 3100714 - RNA, 20 nt, Mycobacterium bovis subsp bovis AF2122/97
gucgccgccauugccgccgg

SEQ ID NO: 3100715 - RNA, 16 nt, Mycobacterium bovis subsp bovis AF2122/97
gucgccgcccgugccg

SEQ ID NO: 3100716 - RNA, 18 nt, Mycobacterium bovis subsp bovis AF2122/97
gucgccgcccgugccgcc

SEQ ID NO: 3100717 - RNA, 21 nt, Mycobacterium bovis subsp bovis AF2122/97
gucgccgcccgugccgcccuc

SEQ ID NO: 3100718 - RNA, 20 nt, Mycobacterium bovis subsp bovis AF2122/97
gucgccgcccuggccgccgg

SEQ ID NO: 3100719 - RNA, 12 nt, Mycobacterium bovis subsp bovis AF2122/97
gucgccgccggc

SEQ ID NO: 3100720 - RNA, 16 nt, Mycobacterium bovis subsp bovis AF2122/97
gucgccgccggcgccg

SEQ ID NO: 3100721 - RNA, 16 nt, Mycobacterium bovis subsp bovis AF2122/97
gucgccgccggcuccg

SEQ ID NO: 3100722 - RNA, 12 nt, Mycobacterium bovis subsp bovis AF2122/97
gucgccgccggu

SEQ ID NO: 3100723 - RNA, 13 nt, Mycobacterium bovis subsp bovis AF2122/97
gucgccgccgguc

SEQ ID NO: 3100724 - RNA, 14 nt, Mycobacterium bovis subsp bovis AF2122/97
gucgccgccggucc

SEQ ID NO: 3100725 - RNA, 16 nt, Mycobacterium bovis subsp bovis AF2122/97
gucgccgccgucaccg

SEQ ID NO: 3100726 - RNA, 13 nt, Mycobacterium bovis subsp bovis AF2122/97
gucgccgccguug

SEQ ID NO: 3100727 - RNA, 16 nt, Mycobacterium bovis subsp bovis AF2122/97
gucgccgccguugccg

SEQ ID NO: 3100728 - RNA, 22 nt, Mycobacterium bovis subsp bovis AF2122/97
gucgccgccuuccuggcgggcg

SEQ ID NO: 3100729 - RNA, 16 nt, Mycobacterium bovis subsp bovis AF2122/97
gucgccgccuucuugg

SEQ ID NO: 3100730 - RNA, 21 nt, Mycobacterium bovis subsp bovis AF2122/97
gucgccgccuucuuggcggcc

SEQ ID NO: 3100731 - RNA, 13 nt, Mycobacterium bovis subsp bovis AF2122/97
gucgccgcgcguu

SEQ ID NO: 3100732 - RNA, 14 nt, Mycobacterium bovis subsp bovis AF2122/97
gucgccgcggcagc

SEQ ID NO: 3100733 - RNA, 14 nt, Mycobacterium bovis subsp bovis AF2122/97
gucgccgcggcggc

SEQ ID NO: 3100734 - RNA, 15 nt, Mycobacterium bovis subsp bovis AF2122/97
gucgccgcggcggca

SEQ ID NO: 3100735 - RNA, 15 nt, Mycobacterium bovis subsp bovis AF2122/97
gucgccgcgggcagc

SEQ ID NO: 3100736 - RNA, 16 nt, Mycobacterium bovis subsp bovis AF2122/97
gucgccgcgggcagcg

SEQ ID NO: 3100737 - RNA, 22 nt, Mycobacterium bovis subsp bovis AF2122/97
gucgccgcucauuagcccccgc

SEQ ID NO: 3100738 - RNA, 13 nt, Mycobacterium bovis subsp bovis AF2122/97
gucgccgcucggu

SEQ ID NO: 3100739 - RNA, 17 nt, Mycobacterium bovis subsp bovis AF2122/97
gucgccgcucggucccc

SEQ ID NO: 3100740 - RNA, 14 nt, Mycobacterium bovis subsp bovis AF2122/97
gucgccgcuuggcc

SEQ ID NO: 3100741 - RNA, 15 nt, Mycobacterium bovis subsp bovis AF2122/97
gucgccggaccagag

SEQ ID NO: 3100742 - RNA, 21 nt, Mycobacterium bovis subsp bovis AF2122/97
gucgccggacgacaacaggcc

SEQ ID NO: 3100743 - RNA, 17 nt, Mycobacterium bovis subsp bovis AF2122/97
gucgccggaguucugcg

SEQ ID NO: 3100744 - RNA, 15 nt, Mycobacterium bovis subsp bovis AF2122/97
gucgccggauagcgc

SEQ ID NO: 3100745 - RNA, 18 nt, Mycobacterium bovis subsp bovis AF2122/97
gucgccggauagcgcagc

SEQ ID NO: 3100746 - RNA, 14 nt, Mycobacterium bovis subsp bovis AF2122/97
gucgccggaugcug

SEQ ID NO: 3100747 - RNA, 13 nt, Mycobacterium bovis subsp bovis AF2122/97
gucgccggcaccg

SEQ ID NO: 3100748 - RNA, 14 nt, Mycobacterium bovis subsp bovis AF2122/97
gucgccggcaccgg

SEQ ID NO: 3100749 - RNA, 18 nt, Mycobacterium bovis subsp bovis AF2122/97
gucgccggcaccggaugc

SEQ ID NO: 3100750 - RNA, 16 nt, Mycobacterium bovis subsp bovis AF2122/97
gucgccggcaccggcc

SEQ ID NO: 3100751 - RNA, 16 nt, Mycobacterium bovis subsp bovis AF2122/97
gucgccggccccgccg

SEQ ID NO: 3100752 - RNA, 13 nt, Mycobacterium bovis subsp bovis AF2122/97
gucgccggccggc

SEQ ID NO: 3100753 - RNA, 15 nt, Mycobacterium bovis subsp bovis AF2122/97
gucgccggccggccc

SEQ ID NO: 3100754 - RNA, 14 nt, Mycobacterium bovis subsp bovis AF2122/97
gucgccggcggcgg

SEQ ID NO: 3100755 - RNA, 15 nt, Mycobacterium bovis subsp bovis AF2122/97
gucgccggcggcggu

SEQ ID NO: 3100756 - RNA, 13 nt, Mycobacterium bovis subsp bovis AF2122/97
gucgccggcgucg

SEQ ID NO: 3100757 - RNA, 18 nt, Mycobacterium bovis subsp bovis AF2122/97
gucgccggucaggccgcc

SEQ ID NO: 3100758 - RNA, 14 nt, Mycobacterium bovis subsp bovis AF2122/97
gucgccggucaucg

SEQ ID NO: 3100759 - RNA, 13 nt, Mycobacterium bovis subsp bovis AF2122/97
gucgccgucgaag

SEQ ID NO: 3100760 - RNA, 16 nt, Mycobacterium bovis subsp bovis AF2122/97
gucgccgucgcggcac

SEQ ID NO: 3100761 - RNA, 16 nt, Mycobacterium bovis subsp bovis AF2122/97
gucgccgucggugccg

SEQ ID NO: 3100762 - RNA, 21 nt, Mycobacterium bovis subsp bovis AF2122/97
gucgccgucggugccgccgcc

SEQ ID NO: 3100763 - RNA, 13 nt, Mycobacterium bovis subsp bovis AF2122/97
gucgccgugggcc

SEQ ID NO: 3100764 - RNA, 15 nt, Mycobacterium bovis subsp bovis AF2122/97
gucgccucaccggcg

SEQ ID NO: 3100765 - RNA, 22 nt, Mycobacterium bovis subsp bovis AF2122/97
gucgccuccagcagguccgcgg

SEQ ID NO: 3100766 - RNA, 20 nt, Mycobacterium bovis subsp bovis AF2122/97
gucgccuccugccgccgcuc

SEQ ID NO: 3100767 - RNA, 17 nt, Mycobacterium bovis subsp bovis AF2122/97
gucgccugcccccgcgc

SEQ ID NO: 3100768 - RNA, 17 nt, Mycobacterium bovis subsp bovis AF2122/97
gucgccuucccagccga

SEQ ID NO: 3100769 - RNA, 22 nt, Mycobacterium bovis subsp bovis AF2122/97
gucgccuucuucgcggcggucg

SEQ ID NO: 3100770 - RNA, 13 nt, Mycobacterium bovis subsp bovis AF2122/97
gucgccuucuugg

SEQ ID NO: 3100771 - RNA, 19 nt, Mycobacterium bovis subsp bovis AF2122/97
gucgccuuugagggcgacg

SEQ ID NO: 3100772 - RNA, 23 nt, Mycobacterium bovis subsp bovis AF2122/97
gucgcgaaacaccagacacuggc

SEQ ID NO: 3100773 - RNA, 13 nt, Mycobacterium bovis subsp bovis AF2122/97
gucgcgacgucgg

SEQ ID NO: 3100774 - RNA, 15 nt, Mycobacterium bovis subsp bovis AF2122/97
gucgcgacgucggcc

SEQ ID NO: 3100775 - RNA, 19 nt, Mycobacterium bovis subsp bovis AF2122/97
gucgcgaggcucggucggc

SEQ ID NO: 3100776 - RNA, 22 nt, Mycobacterium bovis subsp bovis AF2122/97
gucgcgaggcucggucggcagc

SEQ ID NO: 3100777 - RNA, 15 nt, Mycobacterium bovis subsp bovis AF2122/97
gucgcgaguagcuga

SEQ ID NO: 3100778 - RNA, 21 nt, Mycobacterium bovis subsp bovis AF2122/97
gucgcgaguagcugacccgcg

SEQ ID NO: 3100779 - RNA, 22 nt, Mycobacterium bovis subsp bovis AF2122/97
gucgcgaguagcugacccgcgg

SEQ ID NO: 3100780 - RNA, 16 nt, Mycobacterium bovis subsp bovis AF2122/97
gucgcgauagccgccg

SEQ ID NO: 3100781 - RNA, 17 nt, Mycobacterium bovis subsp bovis AF2122/97
gucgcgauagccgccgc

SEQ ID NO: 3100782 - RNA, 21 nt, Mycobacterium bovis subsp bovis AF2122/97
gucgcgauccacuccggcgau

SEQ ID NO: 3100783 - RNA, 14 nt, Mycobacterium bovis subsp bovis AF2122/97
gucgcgaugacgau

SEQ ID NO: 3100784 - RNA, 23 nt, Mycobacterium bovis subsp bovis AF2122/97
gucgcgaugcuucccggaugccg

SEQ ID NO: 3100785 - RNA, 14 nt, Mycobacterium bovis subsp bovis AF2122/97
gucgcgauugccgc

SEQ ID NO: 3100786 - RNA, 17 nt, Mycobacterium bovis subsp bovis AF2122/97
gucgcgcaccggaucgc

SEQ ID NO: 3100787 - RNA, 23 nt, Mycobacterium bovis subsp bovis AF2122/97
gucgcgcaccggaucgccgucgc

SEQ ID NO: 3100788 - RNA, 19 nt, Mycobacterium bovis subsp bovis AF2122/97
gucgcgcaguuggccaugc

SEQ ID NO: 3100789 - RNA, 23 nt, Mycobacterium bovis subsp bovis AF2122/97
gucgcgcaucgccuccucgacgu

SEQ ID NO: 3100790 - RNA, 18 nt, Mycobacterium bovis subsp bovis AF2122/97
gucgcgcauugccgacgc

SEQ ID NO: 3100791 - RNA, 18 nt, Mycobacterium bovis subsp bovis AF2122/97
gucgcgcauuucguggcg

SEQ ID NO: 3100792 - RNA, 19 nt, Mycobacterium bovis subsp bovis AF2122/97
gucgcgcauuucguggcgc

SEQ ID NO: 3100793 - RNA, 21 nt, Mycobacterium bovis subsp bovis AF2122/97
gucgcgcauuucguggcgcgc

SEQ ID NO: 3100794 - RNA, 12 nt, Mycobacterium bovis subsp bovis AF2122/97
gucgcgccaccc

SEQ ID NO: 3100795 - RNA, 15 nt, Mycobacterium bovis subsp bovis AF2122/97
gucgcgccacccgcg

SEQ ID NO: 3100796 - RNA, 16 nt, Mycobacterium bovis subsp bovis AF2122/97
gucgcgccacccgcga

SEQ ID NO: 3100797 - RNA, 23 nt, Mycobacterium bovis subsp bovis AF2122/97
gucgcgccaggcgcgaucgcgcc

SEQ ID NO: 3100798 - RNA, 13 nt, Mycobacterium bovis subsp bovis AF2122/97
gucgcgccaggcu

SEQ ID NO: 3100799 - RNA, 19 nt, Mycobacterium bovis subsp bovis AF2122/97
gucgcgcccucagccgcgg

SEQ ID NO: 3100800 - RNA, 13 nt, Mycobacterium bovis subsp bovis AF2122/97
gucgcgccugccc

SEQ ID NO: 3100801 - RNA, 23 nt, Mycobacterium bovis subsp bovis AF2122/97
gucgcgcgaauggucagcgucgc

SEQ ID NO: 3100802 - RNA, 15 nt, Mycobacterium bovis subsp bovis AF2122/97
gucgcgcgaccuggu

SEQ ID NO: 3100803 - RNA, 14 nt, Mycobacterium bovis subsp bovis AF2122/97
gucgcgcggcaccg

SEQ ID NO: 3100804 - RNA, 16 nt, Mycobacterium bovis subsp bovis AF2122/97
gucgcgcggcaccgau

SEQ ID NO: 3100805 - RNA, 21 nt, Mycobacterium bovis subsp bovis AF2122/97
gucgcgcggcaccgauggcgc

SEQ ID NO: 3100806 - RNA, 14 nt, Mycobacterium bovis subsp bovis AF2122/97
gucgcgcugaaggu

SEQ ID NO: 3100807 - RNA, 16 nt, Mycobacterium bovis subsp bovis AF2122/97
gucgcgcugcugucga

SEQ ID NO: 3100808 - RNA, 22 nt, Mycobacterium bovis subsp bovis AF2122/97
gucgcgcugcugucgauuucgc

SEQ ID NO: 3100809 - RNA, 15 nt, Mycobacterium bovis subsp bovis AF2122/97
gucgcgcuggcgccg

SEQ ID NO: 3100810 - RNA, 16 nt, Mycobacterium bovis subsp bovis AF2122/97
gucgcggaaguagcgc

SEQ ID NO: 3100811 - RNA, 15 nt, Mycobacterium bovis subsp bovis AF2122/97
gucgcggacccgcgc

SEQ ID NO: 3100812 - RNA, 23 nt, Mycobacterium bovis subsp bovis AF2122/97
gucgcggacccgcgcgucgccca

SEQ ID NO: 3100813 - RNA, 14 nt, Mycobacterium bovis subsp bovis AF2122/97
gucgcggacggugc

SEQ ID NO: 3100814 - RNA, 14 nt, Mycobacterium bovis subsp bovis AF2122/97
gucgcggacgucgc

SEQ ID NO: 3100815 - RNA, 23 nt, Mycobacterium bovis subsp bovis AF2122/97
gucgcggagcgugagccaugccg

SEQ ID NO: 3100816 - RNA, 19 nt, Mycobacterium bovis subsp bovis AF2122/97
gucgcggaucagcccgcgc

SEQ ID NO: 3100817 - RNA, 22 nt, Mycobacterium bovis subsp bovis AF2122/97
gucgcggaucagcccgcgcagc

SEQ ID NO: 3100818 - RNA, 23 nt, Mycobacterium bovis subsp bovis AF2122/97
gucgcggaucagcccgcgcagca

SEQ ID NO: 3100819 - RNA, 23 nt, Mycobacterium bovis subsp bovis AF2122/97
gucgcggaucauuccgacgaacc

SEQ ID NO: 3100820 - RNA, 23 nt, Mycobacterium bovis subsp bovis AF2122/97
gucgcggaucuguuccucgguga

SEQ ID NO: 3100821 - RNA, 15 nt, Mycobacterium bovis subsp bovis AF2122/97
gucgcggauugccgc

SEQ ID NO: 3100822 - RNA, 15 nt, Mycobacterium bovis subsp bovis AF2122/97
gucgcggcacgccca

SEQ ID NO: 3100823 - RNA, 15 nt, Mycobacterium bovis subsp bovis AF2122/97
gucgcggccagcagg

SEQ ID NO: 3100824 - RNA, 12 nt, Mycobacterium bovis subsp bovis AF2122/97
gucgcggccgag

SEQ ID NO: 3100825 - RNA, 12 nt, Mycobacterium bovis subsp bovis AF2122/97
gucgcggccgcc

SEQ ID NO: 3100826 - RNA, 21 nt, Mycobacterium bovis subsp bovis AF2122/97
gucgcggccgccccaggcugg

SEQ ID NO: 3100827 - RNA, 15 nt, Mycobacterium bovis subsp bovis AF2122/97
gucgcggccggcggc

SEQ ID NO: 3100828 - RNA, 14 nt, Mycobacterium bovis subsp bovis AF2122/97
gucgcggccgucgc

SEQ ID NO: 3100829 - RNA, 22 nt, Mycobacterium bovis subsp bovis AF2122/97
gucgcggccgucgcgggacaac

SEQ ID NO: 3100830 - RNA, 12 nt, Mycobacterium bovis subsp bovis AF2122/97
gucgcggccgug

SEQ ID NO: 3100831 - RNA, 12 nt, Mycobacterium bovis subsp bovis AF2122/97
gucgcggccucg

SEQ ID NO: 3100832 - RNA, 22 nt, Mycobacterium bovis subsp bovis AF2122/97
gucgcggcgcuggcugcgguag

SEQ ID NO: 3100833 - RNA, 21 nt, Mycobacterium bovis subsp bovis AF2122/97
gucgcggcuauggcgccgcgg

SEQ ID NO: 3100834 - RNA, 21 nt, Mycobacterium bovis subsp bovis AF2122/97
gucgcgggccaccaccgagua

SEQ ID NO: 3100835 - RNA, 19 nt, Mycobacterium bovis subsp bovis AF2122/97
gucgcgggcgauggcgagc

SEQ ID NO: 3100836 - RNA, 18 nt, Mycobacterium bovis subsp bovis AF2122/97
gucgcggguccaggcguu

SEQ ID NO: 3100837 - RNA, 22 nt, Mycobacterium bovis subsp bovis AF2122/97
gucgcgggugaugacgccgucg

SEQ ID NO: 3100838 - RNA, 13 nt, Mycobacterium bovis subsp bovis AF2122/97
gucgcgggugccg

SEQ ID NO: 3100839 - RNA, 16 nt, Mycobacterium bovis subsp bovis AF2122/97
gucgcggguggcuucc

SEQ ID NO: 3100840 - RNA, 21 nt, Mycobacterium bovis subsp bovis AF2122/97
gucgcgguaccaucaccgcgc

SEQ ID NO: 3100841 - RNA, 23 nt, Mycobacterium bovis subsp bovis AF2122/97
gucgcgguagccuggcuguccgc

SEQ ID NO: 3100842 - RNA, 15 nt, Mycobacterium bovis subsp bovis AF2122/97
gucgcgguaggcggg

SEQ ID NO: 3100843 - RNA, 23 nt, Mycobacterium bovis subsp bovis AF2122/97
gucgcggucccacggccggccgc

SEQ ID NO: 3100844 - RNA, 16 nt, Mycobacterium bovis subsp bovis AF2122/97
gucgcggucgcccgcu

SEQ ID NO: 3100845 - RNA, 15 nt, Mycobacterium bovis subsp bovis AF2122/97
gucgcgguggcggcg

SEQ ID NO: 3100846 - RNA, 17 nt, Mycobacterium bovis subsp bovis AF2122/97
gucgcgguggcggcggu

SEQ ID NO: 3100847 - RNA, 13 nt, Mycobacterium bovis subsp bovis AF2122/97
gucgcgguggugg

SEQ ID NO: 3100848 - RNA, 22 nt, Mycobacterium bovis subsp bovis AF2122/97
gucgcgguucaacaccaacgcg

SEQ ID NO: 3100849 - RNA, 15 nt, Mycobacterium bovis subsp bovis AF2122/97
gucgcgguuguggcu

SEQ ID NO: 3100850 - RNA, 21 nt, Mycobacterium bovis subsp bovis AF2122/97
gucgcguaccaacaggauggu

SEQ ID NO: 3100851 - RNA, 13 nt, Mycobacterium bovis subsp bovis AF2122/97
gucgcgucgcagg

SEQ ID NO: 3100852 - RNA, 23 nt, Mycobacterium bovis subsp bovis AF2122/97
gucgcgucgcaggauucccaguc

SEQ ID NO: 3100853 - RNA, 16 nt, Mycobacterium bovis subsp bovis AF2122/97
gucgcgucggcugccg

SEQ ID NO: 3100854 - RNA, 12 nt, Mycobacterium bovis subsp bovis AF2122/97
gucgcguucggc

SEQ ID NO: 3100855 - RNA, 15 nt, Mycobacterium bovis subsp bovis AF2122/97
gucgcguucggccga

SEQ ID NO: 3100856 - RNA, 16 nt, Mycobacterium bovis subsp bovis AF2122/97
gucgcguucuccggca

SEQ ID NO: 3100857 - RNA, 17 nt, Mycobacterium bovis subsp bovis AF2122/97
gucgcguucuccggcac

SEQ ID NO: 3100858 - RNA, 17 nt, Mycobacterium bovis subsp bovis AF2122/97
gucgcguuguggcugaa

SEQ ID NO: 3100859 - RNA, 21 nt, Mycobacterium bovis subsp bovis AF2122/97
gucgcuacgcaacgggucggg

SEQ ID NO: 3100860 - RNA, 20 nt, Mycobacterium bovis subsp bovis AF2122/97
gucgcuauccggcggccagu

SEQ ID NO: 3100861 - RNA, 16 nt, Mycobacterium bovis subsp bovis AF2122/97
gucgcucaguuuggcg

SEQ ID NO: 3100862 - RNA, 22 nt, Mycobacterium bovis subsp bovis AF2122/97
gucgcugaacagacggcucagc

SEQ ID NO: 3100863 - RNA, 16 nt, Mycobacterium bovis subsp bovis AF2122/97
gucgcugaagccgucg

SEQ ID NO: 3100864 - RNA, 13 nt, Mycobacterium bovis subsp bovis AF2122/97
gucgcugaccgcg

SEQ ID NO: 3100865 - RNA, 19 nt, Mycobacterium bovis subsp bovis AF2122/97
gucgcugacgcccuccugg

SEQ ID NO: 3100866 - RNA, 20 nt, Mycobacterium bovis subsp bovis AF2122/97
gucgcugacgcccuccuggc

SEQ ID NO: 3100867 - RNA, 22 nt, Mycobacterium bovis subsp bovis AF2122/97
gucgcugacgcccuccuggcgg

SEQ ID NO: 3100868 - RNA, 17 nt, Mycobacterium bovis subsp bovis AF2122/97
gucgcugagcacggcgc

SEQ ID NO: 3100869 - RNA, 18 nt, Mycobacterium bovis subsp bovis AF2122/97
gucgcugagcacggcgcg

SEQ ID NO: 3100870 - RNA, 22 nt, Mycobacterium bovis subsp bovis AF2122/97
gucgcugagcacggcgcggcgg

SEQ ID NO: 3100871 - RNA, 20 nt, Mycobacterium bovis subsp bovis AF2122/97
gucgcugauccgggcgccga

SEQ ID NO: 3100872 - RNA, 15 nt, Mycobacterium bovis subsp bovis AF2122/97
gucgcugcaaccgcc

SEQ ID NO: 3100873 - RNA, 19 nt, Mycobacterium bovis subsp bovis AF2122/97
gucgcugcccaucacaccc

SEQ ID NO: 3100874 - RNA, 21 nt, Mycobacterium bovis subsp bovis AF2122/97
gucgcugccgccgccggcggu

SEQ ID NO: 3100875 - RNA, 23 nt, Mycobacterium bovis subsp bovis AF2122/97
gucgcugccgccgccggcggucg

SEQ ID NO: 3100876 - RNA, 16 nt, Mycobacterium bovis subsp bovis AF2122/97
gucgcugccgccgucg

SEQ ID NO: 3100877 - RNA, 15 nt, Mycobacterium bovis subsp bovis AF2122/97
gucgcugcggcgcug

SEQ ID NO: 3100878 - RNA, 21 nt, Mycobacterium bovis subsp bovis AF2122/97
gucgcugcggcgcuggccagc

SEQ ID NO: 3100879 - RNA, 14 nt, Mycobacterium bovis subsp bovis AF2122/97
gucgcugcuugcgg

SEQ ID NO: 3100880 - RNA, 13 nt, Mycobacterium bovis subsp bovis AF2122/97
gucgcuggccagg

SEQ ID NO: 3100881 - RNA, 17 nt, Mycobacterium bovis subsp bovis AF2122/97
gucgcugggaggcgcgg

SEQ ID NO: 3100882 - RNA, 14 nt, Mycobacterium bovis subsp bovis AF2122/97
gucgcugguggcgg

SEQ ID NO: 3100883 - RNA, 22 nt, Mycobacterium bovis subsp bovis AF2122/97
gucgcuggugggaucgcagcgc

SEQ ID NO: 3100884 - RNA, 23 nt, Mycobacterium bovis subsp bovis AF2122/97
gucgcuguaggcgauaucgcccg

SEQ ID NO: 3100885 - RNA, 13 nt, Mycobacterium bovis subsp bovis AF2122/97
gucgcugucggca

SEQ ID NO: 3100886 - RNA, 15 nt, Mycobacterium bovis subsp bovis AF2122/97
gucgcuucagcgcca

SEQ ID NO: 3100887 - RNA, 16 nt, Mycobacterium bovis subsp bovis AF2122/97
gucggaacugaccacg

SEQ ID NO: 3100888 - RNA, 16 nt, Mycobacterium bovis subsp bovis AF2122/97
gucggaaugcuggggc

SEQ ID NO: 3100889 - RNA, 16 nt, Mycobacterium bovis subsp bovis AF2122/97
gucggaaugggcgcca

SEQ ID NO: 3100890 - RNA, 18 nt, Mycobacterium bovis subsp bovis AF2122/97
gucggaaugggcgccaca

SEQ ID NO: 3100891 - RNA, 22 nt, Mycobacterium bovis subsp bovis AF2122/97
gucggaaugggcgccacagccg

SEQ ID NO: 3100892 - RNA, 18 nt, Mycobacterium bovis subsp bovis AF2122/97
gucggacacguggcguug

SEQ ID NO: 3100893 - RNA, 22 nt, Mycobacterium bovis subsp bovis AF2122/97
gucggacagcgucucggaggcg

SEQ ID NO: 3100894 - RNA, 18 nt, Mycobacterium bovis subsp bovis AF2122/97
gucggaccacccggcgcg

SEQ ID NO: 3100895 - RNA, 14 nt, Mycobacterium bovis subsp bovis AF2122/97
gucggaccagcugc

SEQ ID NO: 3100896 - RNA, 17 nt, Mycobacterium bovis subsp bovis AF2122/97
gucggaccagcugccgg

SEQ ID NO: 3100897 - RNA, 19 nt, Mycobacterium bovis subsp bovis AF2122/97
gucggaccagcugccggcg

SEQ ID NO: 3100898 - RNA, 17 nt, Mycobacterium bovis subsp bovis AF2122/97
gucggaccucgcccaug

SEQ ID NO: 3100899 - RNA, 11 nt, Mycobacterium bovis subsp bovis AF2122/97
gucggacgggu

SEQ ID NO: 3100900 - RNA, 17 nt, Mycobacterium bovis subsp bovis AF2122/97
gucggacuccgagagaa

SEQ ID NO: 3100901 - RNA, 19 nt, Mycobacterium bovis subsp bovis AF2122/97
gucggagaacauguagguc

SEQ ID NO: 3100902 - RNA, 13 nt, Mycobacterium bovis subsp bovis AF2122/97
gucggagaccagc

SEQ ID NO: 3100903 - RNA, 14 nt, Mycobacterium bovis subsp bovis AF2122/97
gucggagaccagcg

SEQ ID NO: 3100904 - RNA, 17 nt, Mycobacterium bovis subsp bovis AF2122/97
gucggagaccagcucgu

SEQ ID NO: 3100905 - RNA, 13 nt, Mycobacterium bovis subsp bovis AF2122/97
gucggagcgggga

SEQ ID NO: 3100906 - RNA, 16 nt, Mycobacterium bovis subsp bovis AF2122/97
gucggaguaccgcgcg

SEQ ID NO: 3100907 - RNA, 16 nt, Mycobacterium bovis subsp bovis AF2122/97
gucggauagccucggc

SEQ ID NO: 3100908 - RNA, 20 nt, Mycobacterium bovis subsp bovis AF2122/97
gucggauagccucggcggcg

SEQ ID NO: 3100909 - RNA, 21 nt, Mycobacterium bovis subsp bovis AF2122/97
gucggaucgauuccgccgcac

SEQ ID NO: 3100910 - RNA, 16 nt, Mycobacterium bovis subsp bovis AF2122/97
gucggaucggcgccgc

SEQ ID NO: 3100911 - RNA, 18 nt, Mycobacterium bovis subsp bovis AF2122/97
gucggauggaaggcggcc

SEQ ID NO: 3100912 - RNA, 15 nt, Mycobacterium bovis subsp bovis AF2122/97
gucggcaaacaacga

SEQ ID NO: 3100913 - RNA, 17 nt, Mycobacterium bovis subsp bovis AF2122/97
gucggcaaagcgcucgu

SEQ ID NO: 3100914 - RNA, 18 nt, Mycobacterium bovis subsp bovis AF2122/97
gucggcaaccaaccgcgc

SEQ ID NO: 3100915 - RNA, 16 nt, Mycobacterium bovis subsp bovis AF2122/97
gucggcaacgacccgc

SEQ ID NO: 3100916 - RNA, 21 nt, Mycobacterium bovis subsp bovis AF2122/97
gucggcaacgacccgccgccc

SEQ ID NO: 3100917 - RNA, 22 nt, Mycobacterium bovis subsp bovis AF2122/97
gucggcaauacuccgcugacga

SEQ ID NO: 3100918 - RNA, 13 nt, Mycobacterium bovis subsp bovis AF2122/97
gucggcaaucucg

SEQ ID NO: 3100919 - RNA, 19 nt, Mycobacterium bovis subsp bovis AF2122/97
gucggcaccaccacgccga

SEQ ID NO: 3100920 - RNA, 14 nt, Mycobacterium bovis subsp bovis AF2122/97
gucggcaccagcag

SEQ ID NO: 3100921 - RNA, 15 nt, Mycobacterium bovis subsp bovis AF2122/97
gucggcacgacccgg

SEQ ID NO: 3100922 - RNA, 15 nt, Mycobacterium bovis subsp bovis AF2122/97
gucggcagaccgacc

SEQ ID NO: 3100923 - RNA, 13 nt, Mycobacterium bovis subsp bovis AF2122/97
gucggcagcagcg

SEQ ID NO: 3100924 - RNA, 15 nt, Mycobacterium bovis subsp bovis AF2122/97
gucggcagcuccagc

SEQ ID NO: 3100925 - RNA, 20 nt, Mycobacterium bovis subsp bovis AF2122/97
gucggcagcuucucgccgac

SEQ ID NO: 3100926 - RNA, 22 nt, Mycobacterium bovis subsp bovis AF2122/97
gucggcagcuucucgccgacga

SEQ ID NO: 3100927 - RNA, 22 nt, Mycobacterium bovis subsp bovis AF2122/97
gucggcagguaccaccgcggug

SEQ ID NO: 3100928 - RNA, 22 nt, Mycobacterium bovis subsp bovis AF2122/97
gucggcauccucugaaccagcu

SEQ ID NO: 3100929 - RNA, 14 nt, Mycobacterium bovis subsp bovis AF2122/97
gucggcaucgcgag

SEQ ID NO: 3100930 - RNA, 15 nt, Mycobacterium bovis subsp bovis AF2122/97
gucggcaucgcgagc

SEQ ID NO: 3100931 - RNA, 16 nt, Mycobacterium bovis subsp bovis AF2122/97
gucggcaucgcgagcu

SEQ ID NO: 3100932 - RNA, 18 nt, Mycobacterium bovis subsp bovis AF2122/97
gucggcaucgcgagcugc

SEQ ID NO: 3100933 - RNA, 16 nt, Mycobacterium bovis subsp bovis AF2122/97
gucggcaucggagaua

SEQ ID NO: 3100934 - RNA, 23 nt, Mycobacterium bovis subsp bovis AF2122/97
gucggcaugacauacagcgggcg

SEQ ID NO: 3100935 - RNA, 12 nt, Mycobacterium bovis subsp bovis AF2122/97
gucggcaugggc

SEQ ID NO: 3100936 - RNA, 18 nt, Mycobacterium bovis subsp bovis AF2122/97
gucggcaugggccggcgc

SEQ ID NO: 3100937 - RNA, 20 nt, Mycobacterium bovis subsp bovis AF2122/97
gucggcaugggccggcgccg

SEQ ID NO: 3100938 - RNA, 22 nt, Mycobacterium bovis subsp bovis AF2122/97
gucggccaaagacccggcaccc

SEQ ID NO: 3100939 - RNA, 15 nt, Mycobacterium bovis subsp bovis AF2122/97
gucggccacauccag

SEQ ID NO: 3100940 - RNA, 18 nt, Mycobacterium bovis subsp bovis AF2122/97
gucggccacauccagcgc

SEQ ID NO: 3100941 - RNA, 19 nt, Mycobacterium bovis subsp bovis AF2122/97
gucggccaccccacagucg

SEQ ID NO: 3100942 - RNA, 23 nt, Mycobacterium bovis subsp bovis AF2122/97
gucggccacccggacauagccgc

SEQ ID NO: 3100943 - RNA, 13 nt, Mycobacterium bovis subsp bovis AF2122/97
gucggccaccgcg

SEQ ID NO: 3100944 - RNA, 14 nt, Mycobacterium bovis subsp bovis AF2122/97
gucggccaccggcg

SEQ ID NO: 3100945 - RNA, 12 nt, Mycobacterium bovis subsp bovis AF2122/97
gucggccaccgu

SEQ ID NO: 3100946 - RNA, 17 nt, Mycobacterium bovis subsp bovis AF2122/97
gucggccaccugcucgu

SEQ ID NO: 3100947 - RNA, 16 nt, Mycobacterium bovis subsp bovis AF2122/97
gucggccaccuggucg

SEQ ID NO: 3100948 - RNA, 14 nt, Mycobacterium bovis subsp bovis AF2122/97
gucggccagcagau

SEQ ID NO: 3100949 - RNA, 22 nt, Mycobacterium bovis subsp bovis AF2122/97
gucggccagcagcagugccacc

SEQ ID NO: 3100950 - RNA, 19 nt, Mycobacterium bovis subsp bovis AF2122/97
gucggccagcucgcgggcc

SEQ ID NO: 3100951 - RNA, 19 nt, Mycobacterium bovis subsp bovis AF2122/97
gucggccaggccgucggcg

SEQ ID NO: 3100952 - RNA, 22 nt, Mycobacterium bovis subsp bovis AF2122/97
gucggccaggccgucggcgucg

SEQ ID NO: 3100953 - RNA, 23 nt, Mycobacterium bovis subsp bovis AF2122/97
gucggccaggucgagcaccggcu

SEQ ID NO: 3100954 - RNA, 16 nt, Mycobacterium bovis subsp bovis AF2122/97
gucggccaggucggcg

SEQ ID NO: 3100955 - RNA, 17 nt, Mycobacterium bovis subsp bovis AF2122/97
gucggccaggucggcgu

SEQ ID NO: 3100956 - RNA, 19 nt, Mycobacterium bovis subsp bovis AF2122/97
gucggccauccaccgcaga

SEQ ID NO: 3100957 - RNA, 22 nt, Mycobacterium bovis subsp bovis AF2122/97
gucggccaugguguucggcagc

SEQ ID NO: 3100958 - RNA, 23 nt, Mycobacterium bovis subsp bovis AF2122/97
gucggccaugguguucggcagcg

SEQ ID NO: 3100959 - RNA, 17 nt, Mycobacterium bovis subsp bovis AF2122/97
gucggccauugcccggg

SEQ ID NO: 3100960 - RNA, 15 nt, Mycobacterium bovis subsp bovis AF2122/97
gucggcccacacuag

SEQ ID NO: 3100961 - RNA, 17 nt, Mycobacterium bovis subsp bovis AF2122/97
gucggcccacggugucc

SEQ ID NO: 3100962 - RNA, 15 nt, Mycobacterium bovis subsp bovis AF2122/97
gucggccccggccgc

SEQ ID NO: 3100963 - RNA, 18 nt, Mycobacterium bovis subsp bovis AF2122/97
gucggcccgcucaccuug

SEQ ID NO: 3100964 - RNA, 21 nt, Mycobacterium bovis subsp bovis AF2122/97
gucggcccggugcucaagcgc

SEQ ID NO: 3100965 - RNA, 18 nt, Mycobacterium bovis subsp bovis AF2122/97
gucggcccuccaccggug

SEQ ID NO: 3100966 - RNA, 13 nt, Mycobacterium bovis subsp bovis AF2122/97
gucggccgacacc

SEQ ID NO: 3100967 - RNA, 13 nt, Mycobacterium bovis subsp bovis AF2122/97
gucggccgagucg

SEQ ID NO: 3100968 - RNA, 21 nt, Mycobacterium bovis subsp bovis AF2122/97
gucggccggcaacgugcggug

SEQ ID NO: 3100969 - RNA, 13 nt, Mycobacterium bovis subsp bovis AF2122/97
gucggccggcggu

SEQ ID NO: 3100970 - RNA, 16 nt, Mycobacterium bovis subsp bovis AF2122/97
gucggccggcggucgc

SEQ ID NO: 3100971 - RNA, 14 nt, Mycobacterium bovis subsp bovis AF2122/97
gucggccggcucgu

SEQ ID NO: 3100972 - RNA, 19 nt, Mycobacterium bovis subsp bovis AF2122/97
gucggccggcucguccggg

SEQ ID NO: 3100973 - RNA, 16 nt, Mycobacterium bovis subsp bovis AF2122/97
gucggccggggccacc

SEQ ID NO: 3100974 - RNA, 19 nt, Mycobacterium bovis subsp bovis AF2122/97
gucggccggggccacccgc

SEQ ID NO: 3100975 - RNA, 17 nt, Mycobacterium bovis subsp bovis AF2122/97
gucggccucggcggucg

SEQ ID NO: 3100976 - RNA, 20 nt, Mycobacterium bovis subsp bovis AF2122/97
gucggccugaccggucaccc

SEQ ID NO: 3100977 - RNA, 19 nt, Mycobacterium bovis subsp bovis AF2122/97
gucggccugcgaacacgcg

SEQ ID NO: 3100978 - RNA, 14 nt, Mycobacterium bovis subsp bovis AF2122/97
gucggccugcggca

SEQ ID NO: 3100979 - RNA, 17 nt, Mycobacterium bovis subsp bovis AF2122/97
gucggccugcggcaccg

SEQ ID NO: 3100980 - RNA, 19 nt, Mycobacterium bovis subsp bovis AF2122/97
gucggcgaaaggccagucg

SEQ ID NO: 3100981 - RNA, 19 nt, Mycobacterium bovis subsp bovis AF2122/97
gucggcgaacaaccgccgc

SEQ ID NO: 3100982 - RNA, 19 nt, Mycobacterium bovis subsp bovis AF2122/97
gucggcgaacgcggcgucg

SEQ ID NO: 3100983 - RNA, 20 nt, Mycobacterium bovis subsp bovis AF2122/97
gucggcgaacgcguccagcg

SEQ ID NO: 3100984 - RNA, 21 nt, Mycobacterium bovis subsp bovis AF2122/97
gucggcgaagcacaccguccg

SEQ ID NO: 3100985 - RNA, 15 nt, Mycobacterium bovis subsp bovis AF2122/97
gucggcgaagcgggc

SEQ ID NO: 3100986 - RNA, 17 nt, Mycobacterium bovis subsp bovis AF2122/97
gucggcgaccaccagcg

SEQ ID NO: 3100987 - RNA, 13 nt, Mycobacterium bovis subsp bovis AF2122/97
gucggcgaccagg

SEQ ID NO: 3100988 - RNA, 22 nt, Mycobacterium bovis subsp bovis AF2122/97
gucggcgaccaggucggcuucg

SEQ ID NO: 3100989 - RNA, 17 nt, Mycobacterium bovis subsp bovis AF2122/97
gucggcgaccccgaaca

SEQ ID NO: 3100990 - RNA, 21 nt, Mycobacterium bovis subsp bovis AF2122/97
gucggcgaccgagacggcguc

SEQ ID NO: 3100991 - RNA, 22 nt, Mycobacterium bovis subsp bovis AF2122/97
gucggcgaccgagacggcgucg

SEQ ID NO: 3100992 - RNA, 23 nt, Mycobacterium bovis subsp bovis AF2122/97
gucggcgaccgagacggcgucgg

SEQ ID NO: 3100993 - RNA, 15 nt, Mycobacterium bovis subsp bovis AF2122/97
gucggcgaccgcgcu

SEQ ID NO: 3100994 - RNA, 20 nt, Mycobacterium bovis subsp bovis AF2122/97
gucggcgacguagacggucc

SEQ ID NO: 3100995 - RNA, 17 nt, Mycobacterium bovis subsp bovis AF2122/97
gucggcgacguccaguc

SEQ ID NO: 3100996 - RNA, 20 nt, Mycobacterium bovis subsp bovis AF2122/97
gucggcgagcaauuccucag

SEQ ID NO: 3100997 - RNA, 13 nt, Mycobacterium bovis subsp bovis AF2122/97
gucggcgagcucg

SEQ ID NO: 3100998 - RNA, 15 nt, Mycobacterium bovis subsp bovis AF2122/97
gucggcgagcucggc

SEQ ID NO: 3100999 - RNA, 16 nt, Mycobacterium bovis subsp bovis AF2122/97
gucggcgagggcgcgc

SEQ ID NO: 3101000 - RNA, 17 nt, Mycobacterium bovis subsp bovis AF2122/97
gucggcgaugaacagcg

SEQ ID NO: 3101001 - RNA, 21 nt, Mycobacterium bovis subsp bovis AF2122/97
gucggcgaugaacagcgacgc

SEQ ID NO: 3101002 - RNA, 20 nt, Mycobacterium bovis subsp bovis AF2122/97
gucggcgaugaugcucgaca

SEQ ID NO: 3101003 - RNA, 16 nt, Mycobacterium bovis subsp bovis AF2122/97
gucggcgaugcgcacc

SEQ ID NO: 3101004 - RNA, 17 nt, Mycobacterium bovis subsp bovis AF2122/97
gucggcgaugcgcacca

SEQ ID NO: 3101005 - RNA, 17 nt, Mycobacterium bovis subsp bovis AF2122/97
gucggcgaugcguccgc

SEQ ID NO: 3101006 - RNA, 16 nt, Mycobacterium bovis subsp bovis AF2122/97
gucggcgauggccagc

SEQ ID NO: 3101007 - RNA, 19 nt, Mycobacterium bovis subsp bovis AF2122/97
gucggcgauggccagcacg

SEQ ID NO: 3101008 - RNA, 16 nt, Mycobacterium bovis subsp bovis AF2122/97
gucggcgauggcggca

SEQ ID NO: 3101009 - RNA, 12 nt, Mycobacterium bovis subsp bovis AF2122/97
gucggcgcaggc

SEQ ID NO: 3101010 - RNA, 13 nt, Mycobacterium bovis subsp bovis AF2122/97
gucggcgccgaag

SEQ ID NO: 3101011 - RNA, 17 nt, Mycobacterium bovis subsp bovis AF2122/97
gucggcgccgagcagcc

SEQ ID NO: 3101012 - RNA, 20 nt, Mycobacterium bovis subsp bovis AF2122/97
gucggcgccgagcagcccgc

SEQ ID NO: 3101013 - RNA, 14 nt, Mycobacterium bovis subsp bovis AF2122/97
gucggcgccggcau

SEQ ID NO: 3101014 - RNA, 16 nt, Mycobacterium bovis subsp bovis AF2122/97
gucggcgccggcaucg

SEQ ID NO: 3101015 - RNA, 15 nt, Mycobacterium bovis subsp bovis AF2122/97
gucggcgccggcggc

SEQ ID NO: 3101016 - RNA, 16 nt, Mycobacterium bovis subsp bovis AF2122/97
gucggcgcgcaccucg

SEQ ID NO: 3101017 - RNA, 12 nt, Mycobacterium bovis subsp bovis AF2122/97
gucggcgcgccg

SEQ ID NO: 3101018 - RNA, 16 nt, Mycobacterium bovis subsp bovis AF2122/97
gucggcgcgccgcaca

SEQ ID NO: 3101019 - RNA, 15 nt, Mycobacterium bovis subsp bovis AF2122/97
gucggcgcggccgug

SEQ ID NO: 3101020 - RNA, 12 nt, Mycobacterium bovis subsp bovis AF2122/97
gucggcgcggcu

SEQ ID NO: 3101021 - RNA, 14 nt, Mycobacterium bovis subsp bovis AF2122/97
gucggcgcggcugu

SEQ ID NO: 3101022 - RNA, 16 nt, Mycobacterium bovis subsp bovis AF2122/97
gucggcgcggcugucg

SEQ ID NO: 3101023 - RNA, 16 nt, Mycobacterium bovis subsp bovis AF2122/97
gucggcgcucgucgcg

SEQ ID NO: 3101024 - RNA, 14 nt, Mycobacterium bovis subsp bovis AF2122/97
gucggcgcugacga

SEQ ID NO: 3101025 - RNA, 20 nt, Mycobacterium bovis subsp bovis AF2122/97
gucggcgcugacgacccucc

SEQ ID NO: 3101026 - RNA, 13 nt, Mycobacterium bovis subsp bovis AF2122/97
gucggcgcuggcc

SEQ ID NO: 3101027 - RNA, 17 nt, Mycobacterium bovis subsp bovis AF2122/97
gucggcgcuggccgucg

SEQ ID NO: 3101028 - RNA, 22 nt, Mycobacterium bovis subsp bovis AF2122/97
gucggcggccgucaccggucgg

SEQ ID NO: 3101029 - RNA, 16 nt, Mycobacterium bovis subsp bovis AF2122/97
gucggcggcgaccgcc

SEQ ID NO: 3101030 - RNA, 20 nt, Mycobacterium bovis subsp bovis AF2122/97
gucggcggcgaccgccagcg

SEQ ID NO: 3101031 - RNA, 22 nt, Mycobacterium bovis subsp bovis AF2122/97
gucggcggcuacuagcgguguc

SEQ ID NO: 3101032 - RNA, 23 nt, Mycobacterium bovis subsp bovis AF2122/97
gucggcggcuuccucgagcgaac

SEQ ID NO: 3101033 - RNA, 17 nt, Mycobacterium bovis subsp bovis AF2122/97
gucggcgggcgacaucg

SEQ ID NO: 3101034 - RNA, 22 nt, Mycobacterium bovis subsp bovis AF2122/97
gucggcgggcggcagcgagucg

SEQ ID NO: 3101035 - RNA, 15 nt, Mycobacterium bovis subsp bovis AF2122/97
gucggcggggcgccg

SEQ ID NO: 3101036 - RNA, 22 nt, Mycobacterium bovis subsp bovis AF2122/97
gucggcggguagaaccagcccg

SEQ ID NO: 3101037 - RNA, 23 nt, Mycobacterium bovis subsp bovis AF2122/97
gucggcggguagaaccagcccgg

SEQ ID NO: 3101038 - RNA, 18 nt, Mycobacterium bovis subsp bovis AF2122/97
gucggcgguagccgacca

SEQ ID NO: 3101039 - RNA, 20 nt, Mycobacterium bovis subsp bovis AF2122/97
gucggcgguagccgaccagc

SEQ ID NO: 3101040 - RNA, 21 nt, Mycobacterium bovis subsp bovis AF2122/97
gucggcgguagccgaccagcg

SEQ ID NO: 3101041 - RNA, 12 nt, Mycobacterium bovis subsp bovis AF2122/97
gucggcggugcc

SEQ ID NO: 3101042 - RNA, 13 nt, Mycobacterium bovis subsp bovis AF2122/97
gucggcggugccg

SEQ ID NO: 3101043 - RNA, 15 nt, Mycobacterium bovis subsp bovis AF2122/97
gucggcguacagcgc

SEQ ID NO: 3101044 - RNA, 15 nt, Mycobacterium bovis subsp bovis AF2122/97
gucggcgucauccac

SEQ ID NO: 3101045 - RNA, 24 nt, Mycobacterium bovis subsp bovis AF2122/97
gucggcgucgaagugggugaaccg

SEQ ID NO: 3101046 - RNA, 13 nt, Mycobacterium bovis subsp bovis AF2122/97
gucggcgugcagg

SEQ ID NO: 3101047 - RNA, 18 nt, Mycobacterium bovis subsp bovis AF2122/97
gucggcgugucgcgucgc

SEQ ID NO: 3101048 - RNA, 18 nt, Mycobacterium bovis subsp bovis AF2122/97
gucggcguugaucgacau

SEQ ID NO: 3101049 - RNA, 18 nt, Mycobacterium bovis subsp bovis AF2122/97
gucggcguuggggcucgu

SEQ ID NO: 3101050 - RNA, 16 nt, Mycobacterium bovis subsp bovis AF2122/97
gucggcuaccgccgac

SEQ ID NO: 3101051 - RNA, 19 nt, Mycobacterium bovis subsp bovis AF2122/97
gucggcuaccgccgaccgg

SEQ ID NO: 3101052 - RNA, 20 nt, Mycobacterium bovis subsp bovis AF2122/97
gucggcuaccgccgaccgga

SEQ ID NO: 3101053 - RNA, 16 nt, Mycobacterium bovis subsp bovis AF2122/97
gucggcuacggccagu

SEQ ID NO: 3101054 - RNA, 16 nt, Mycobacterium bovis subsp bovis AF2122/97
gucggcuagcaacggg

SEQ ID NO: 3101055 - RNA, 13 nt, Mycobacterium bovis subsp bovis AF2122/97
gucggcuccaggu

SEQ ID NO: 3101056 - RNA, 18 nt, Mycobacterium bovis subsp bovis AF2122/97
gucggcucgagucgcagc

SEQ ID NO: 3101057 - RNA, 19 nt, Mycobacterium bovis subsp bovis AF2122/97
gucggcugauuggcccacc

SEQ ID NO: 3101058 - RNA, 20 nt, Mycobacterium bovis subsp bovis AF2122/97
gucggcugauuggcccaccg

SEQ ID NO: 3101059 - RNA, 14 nt, Mycobacterium bovis subsp bovis AF2122/97
gucggcugccgcaa

SEQ ID NO: 3101060 - RNA, 13 nt, Mycobacterium bovis subsp bovis AF2122/97
gucggcugccgcg

SEQ ID NO: 3101061 - RNA, 16 nt, Mycobacterium bovis subsp bovis AF2122/97
gucggcugccgcggcu

SEQ ID NO: 3101062 - RNA, 18 nt, Mycobacterium bovis subsp bovis AF2122/97
gucggcugccgcggcugc

SEQ ID NO: 3101063 - RNA, 15 nt, Mycobacterium bovis subsp bovis AF2122/97
gucggcugguccucc

SEQ ID NO: 3101064 - RNA, 18 nt, Mycobacterium bovis subsp bovis AF2122/97
gucggcuggucgcugcug

SEQ ID NO: 3101065 - RNA, 21 nt, Mycobacterium bovis subsp bovis AF2122/97
gucggcugucgugccucucgg

SEQ ID NO: 3101066 - RNA, 22 nt, Mycobacterium bovis subsp bovis AF2122/97
gucggcugucgugccucucggg

SEQ ID NO: 3101067 - RNA, 14 nt, Mycobacterium bovis subsp bovis AF2122/97
gucggcuuccuccu

SEQ ID NO: 3101068 - RNA, 17 nt, Mycobacterium bovis subsp bovis AF2122/97
gucggcuuccuccucgg

SEQ ID NO: 3101069 - RNA, 16 nt, Mycobacterium bovis subsp bovis AF2122/97
gucgggaacgccgaac

SEQ ID NO: 3101070 - RNA, 22 nt, Mycobacterium bovis subsp bovis AF2122/97
gucgggaccggcuugccgccgu

SEQ ID NO: 3101071 - RNA, 17 nt, Mycobacterium bovis subsp bovis AF2122/97
gucgggacgccgccccc

SEQ ID NO: 3101072 - RNA, 17 nt, Mycobacterium bovis subsp bovis AF2122/97
gucgggaucgccaugua

SEQ ID NO: 3101073 - RNA, 14 nt, Mycobacterium bovis subsp bovis AF2122/97
gucgggaucggcgu

SEQ ID NO: 3101074 - RNA, 19 nt, Mycobacterium bovis subsp bovis AF2122/97
gucgggaucguuggccagu

SEQ ID NO: 3101075 - RNA, 19 nt, Mycobacterium bovis subsp bovis AF2122/97
gucgggaugcccgcugauc

SEQ ID NO: 3101076 - RNA, 18 nt, Mycobacterium bovis subsp bovis AF2122/97
gucgggauggacggcagc

SEQ ID NO: 3101077 - RNA, 21 nt, Mycobacterium bovis subsp bovis AF2122/97
gucgggauggacggcagccag

SEQ ID NO: 3101078 - RNA, 21 nt, Mycobacterium bovis subsp bovis AF2122/97
gucgggcaacuucagcaacgg

SEQ ID NO: 3101079 - RNA, 22 nt, Mycobacterium bovis subsp bovis AF2122/97
gucgggcaaggcggcggccagc

SEQ ID NO: 3101080 - RNA, 21 nt, Mycobacterium bovis subsp bovis AF2122/97
gucgggcacaccgacgccgcc

SEQ ID NO: 3101081 - RNA, 14 nt, Mycobacterium bovis subsp bovis AF2122/97
gucgggcaccgcgc

SEQ ID NO: 3101082 - RNA, 16 nt, Mycobacterium bovis subsp bovis AF2122/97
gucgggcauggcggcg

SEQ ID NO: 3101083 - RNA, 13 nt, Mycobacterium bovis subsp bovis AF2122/97
gucgggccaggcg

SEQ ID NO: 3101084 - RNA, 14 nt, Mycobacterium bovis subsp bovis AF2122/97
gucgggccaggcga

SEQ ID NO: 3101085 - RNA, 21 nt, Mycobacterium bovis subsp bovis AF2122/97
gucgggcccgaugucgucgac

SEQ ID NO: 3101086 - RNA, 23 nt, Mycobacterium bovis subsp bovis AF2122/97
gucgggcccgaugucgucgacga

SEQ ID NO: 3101087 - RNA, 16 nt, Mycobacterium bovis subsp bovis AF2122/97
gucgggccgcaacugc

SEQ ID NO: 3101088 - RNA, 15 nt, Mycobacterium bovis subsp bovis AF2122/97
gucgggcgcaacggg

SEQ ID NO: 3101089 - RNA, 18 nt, Mycobacterium bovis subsp bovis AF2122/97
gucgggcgcggggcggcc

SEQ ID NO: 3101090 - RNA, 12 nt, Mycobacterium bovis subsp bovis AF2122/97
gucgggcggcgu

SEQ ID NO: 3101091 - RNA, 17 nt, Mycobacterium bovis subsp bovis AF2122/97
gucgggcgucccggcgg

SEQ ID NO: 3101092 - RNA, 21 nt, Mycobacterium bovis subsp bovis AF2122/97
gucgggcgucccggcggucag

SEQ ID NO: 3101093 - RNA, 18 nt, Mycobacterium bovis subsp bovis AF2122/97
gucgggcgugucgggaac

SEQ ID NO: 3101094 - RNA, 19 nt, Mycobacterium bovis subsp bovis AF2122/97
gucgggcuaauccagcagc

SEQ ID NO: 3101095 - RNA, 17 nt, Mycobacterium bovis subsp bovis AF2122/97
gucgggcuccgugguug

SEQ ID NO: 3101096 - RNA, 14 nt, Mycobacterium bovis subsp bovis AF2122/97
gucgggcucggcga

SEQ ID NO: 3101097 - RNA, 16 nt, Mycobacterium bovis subsp bovis AF2122/97
gucgggcuggguggcc

SEQ ID NO: 3101098 - RNA, 22 nt, Mycobacterium bovis subsp bovis AF2122/97
gucgggcuugacccuugggcac

SEQ ID NO: 3101099 - RNA, 20 nt, Mycobacterium bovis subsp bovis AF2122/97
gucggggagcugcggcggcc

SEQ ID NO: 3101100 - RNA, 13 nt, Mycobacterium bovis subsp bovis AF2122/97
gucggggcccccg

SEQ ID NO: 3101101 - RNA, 15 nt, Mycobacterium bovis subsp bovis AF2122/97
gucgggggcuucggg

SEQ ID NO: 3101102 - RNA, 22 nt, Mycobacterium bovis subsp bovis AF2122/97
gucgggggcuuuuacgucugcu

SEQ ID NO: 3101103 - RNA, 21 nt, Mycobacterium bovis subsp bovis AF2122/97
gucgggguaauacgcggggcc

SEQ ID NO: 3101104 - RNA, 21 nt, Mycobacterium bovis subsp bovis AF2122/97
gucgggguacaggcugcugcg

SEQ ID NO: 3101105 - RNA, 16 nt, Mycobacterium bovis subsp bovis AF2122/97
gucgggguccgcggca

SEQ ID NO: 3101106 - RNA, 18 nt, Mycobacterium bovis subsp bovis AF2122/97
gucgggguggcgguccgg

SEQ ID NO: 3101107 - RNA, 20 nt, Mycobacterium bovis subsp bovis AF2122/97
gucggggugggacaggucgg

SEQ ID NO: 3101108 - RNA, 19 nt, Mycobacterium bovis subsp bovis AF2122/97
gucgggguguucgaugggu

SEQ ID NO: 3101109 - RNA, 23 nt, Mycobacterium bovis subsp bovis AF2122/97
gucgggguuuaguuuaucggccg

SEQ ID NO: 3101110 - RNA, 14 nt, Mycobacterium bovis subsp bovis AF2122/97
gucggguaggccgc

SEQ ID NO: 3101111 - RNA, 17 nt, Mycobacterium bovis subsp bovis AF2122/97
gucggguaggccgccgu

SEQ ID NO: 3101112 - RNA, 20 nt, Mycobacterium bovis subsp bovis AF2122/97
gucgggucaaugcuggcagc

SEQ ID NO: 3101113 - RNA, 18 nt, Mycobacterium bovis subsp bovis AF2122/97
gucgggucccagccuggc

SEQ ID NO: 3101114 - RNA, 20 nt, Mycobacterium bovis subsp bovis AF2122/97
gucgggucccuuguggucug

SEQ ID NO: 3101115 - RNA, 22 nt, Mycobacterium bovis subsp bovis AF2122/97
gucgggucgaucaccgacaccg

SEQ ID NO: 3101116 - RNA, 17 nt, Mycobacterium bovis subsp bovis AF2122/97
gucgggugcagcacggc

SEQ ID NO: 3101117 - RNA, 13 nt, Mycobacterium bovis subsp bovis AF2122/97
gucggguggcugc

SEQ ID NO: 3101118 - RNA, 20 nt, Mycobacterium bovis subsp bovis AF2122/97
gucgggugugcaggccgcgg

SEQ ID NO: 3101119 - RNA, 17 nt, Mycobacterium bovis subsp bovis AF2122/97
gucggguuccuccucgg

SEQ ID NO: 3101120 - RNA, 16 nt, Mycobacterium bovis subsp bovis AF2122/97
gucggguugguuggcu

SEQ ID NO: 3101121 - RNA, 21 nt, Mycobacterium bovis subsp bovis AF2122/97
gucggguugguuggcucgcug

SEQ ID NO: 3101122 - RNA, 23 nt, Mycobacterium bovis subsp bovis AF2122/97
gucggguugguuggcucgcuggg

SEQ ID NO: 3101123 - RNA, 17 nt, Mycobacterium bovis subsp bovis AF2122/97
gucgguaaagggcucga

SEQ ID NO: 3101124 - RNA, 16 nt, Mycobacterium bovis subsp bovis AF2122/97
gucgguaccguccucg

SEQ ID NO: 3101125 - RNA, 20 nt, Mycobacterium bovis subsp bovis AF2122/97
gucgguaccguccucgaaga

SEQ ID NO: 3101126 - RNA, 18 nt, Mycobacterium bovis subsp bovis AF2122/97
gucggucaaaccggugcc

SEQ ID NO: 3101127 - RNA, 22 nt, Mycobacterium bovis subsp bovis AF2122/97
gucggucaauucggugcgcugg

SEQ ID NO: 3101128 - RNA, 13 nt, Mycobacterium bovis subsp bovis AF2122/97
gucggucaccugg

SEQ ID NO: 3101129 - RNA, 18 nt, Mycobacterium bovis subsp bovis AF2122/97
gucggucacgacggcacg

SEQ ID NO: 3101130 - RNA, 20 nt, Mycobacterium bovis subsp bovis AF2122/97
gucggucaugucggccaccg

SEQ ID NO: 3101131 - RNA, 22 nt, Mycobacterium bovis subsp bovis AF2122/97
gucgguccacccaagcucgguc

SEQ ID NO: 3101132 - RNA, 19 nt, Mycobacterium bovis subsp bovis AF2122/97
gucggucccagguuggagc

SEQ ID NO: 3101133 - RNA, 18 nt, Mycobacterium bovis subsp bovis AF2122/97
gucggucgcuucagcgcc

SEQ ID NO: 3101134 - RNA, 19 nt, Mycobacterium bovis subsp bovis AF2122/97
gucggucggaucggcgccg

SEQ ID NO: 3101135 - RNA, 23 nt, Mycobacterium bovis subsp bovis AF2122/97
gucggucggaucggcgccgcaua

SEQ ID NO: 3101136 - RNA, 18 nt, Mycobacterium bovis subsp bovis AF2122/97
gucggucggggauccgac

SEQ ID NO: 3101137 - RNA, 15 nt, Mycobacterium bovis subsp bovis AF2122/97
gucggucgguaacgg

SEQ ID NO: 3101138 - RNA, 15 nt, Mycobacterium bovis subsp bovis AF2122/97
gucggucuggcuggu

SEQ ID NO: 3101139 - RNA, 20 nt, Mycobacterium bovis subsp bovis AF2122/97
gucggugaaaaaggcgacuc

SEQ ID NO: 3101140 - RNA, 21 nt, Mycobacterium bovis subsp bovis AF2122/97
gucggugaaaugacggcugaa

SEQ ID NO: 3101141 - RNA, 16 nt, Mycobacterium bovis subsp bovis AF2122/97
gucggugaaugccguc

SEQ ID NO: 3101142 - RNA, 19 nt, Mycobacterium bovis subsp bovis AF2122/97
gucggugaaugccgucgcc

SEQ ID NO: 3101143 - RNA, 15 nt, Mycobacterium bovis subsp bovis AF2122/97
gucggugacaccaac

SEQ ID NO: 3101144 - RNA, 17 nt, Mycobacterium bovis subsp bovis AF2122/97
gucggugaccguucggc

SEQ ID NO: 3101145 - RNA, 18 nt, Mycobacterium bovis subsp bovis AF2122/97
gucggugaccucggcgac

SEQ ID NO: 3101146 - RNA, 19 nt, Mycobacterium bovis subsp bovis AF2122/97
gucggugaccucggcgacc

SEQ ID NO: 3101147 - RNA, 12 nt, Mycobacterium bovis subsp bovis AF2122/97
gucggugaccug

SEQ ID NO: 3101148 - RNA, 15 nt, Mycobacterium bovis subsp bovis AF2122/97
gucggugaccuguuu

SEQ ID NO: 3101149 - RNA, 14 nt, Mycobacterium bovis subsp bovis AF2122/97
gucggugacgaaga

SEQ ID NO: 3101150 - RNA, 20 nt, Mycobacterium bovis subsp bovis AF2122/97
gucggugagccgugccgcca

SEQ ID NO: 3101151 - RNA, 21 nt, Mycobacterium bovis subsp bovis AF2122/97
gucggugagccgugccgccag

SEQ ID NO: 3101152 - RNA, 23 nt, Mycobacterium bovis subsp bovis AF2122/97
gucggugagccgugccgccagca

SEQ ID NO: 3101153 - RNA, 19 nt, Mycobacterium bovis subsp bovis AF2122/97
gucggugaggaagcggccg

SEQ ID NO: 3101154 - RNA, 20 nt, Mycobacterium bovis subsp bovis AF2122/97
gucggugaucaccgcggcgg

SEQ ID NO: 3101155 - RNA, 21 nt, Mycobacterium bovis subsp bovis AF2122/97
gucggugaucacggucggcgg

SEQ ID NO: 3101156 - RNA, 21 nt, Mycobacterium bovis subsp bovis AF2122/97
gucggugauggucagcuggcc

SEQ ID NO: 3101157 - RNA, 23 nt, Mycobacterium bovis subsp bovis AF2122/97
gucggugauggucagcuggccgc

SEQ ID NO: 3101158 - RNA, 22 nt, Mycobacterium bovis subsp bovis AF2122/97
gucggugcagcgcacgcagccg

SEQ ID NO: 3101159 - RNA, 14 nt, Mycobacterium bovis subsp bovis AF2122/97
gucggugccgccgc

SEQ ID NO: 3101160 - RNA, 19 nt, Mycobacterium bovis subsp bovis AF2122/97
gucggugccgccgccggcg

SEQ ID NO: 3101161 - RNA, 12 nt, Mycobacterium bovis subsp bovis AF2122/97
gucggugccggg

SEQ ID NO: 3101162 - RNA, 23 nt, Mycobacterium bovis subsp bovis AF2122/97
gucggugccggggcugccgccgu

SEQ ID NO: 3101163 - RNA, 17 nt, Mycobacterium bovis subsp bovis AF2122/97
gucggugcgcgcagacu

SEQ ID NO: 3101164 - RNA, 18 nt, Mycobacterium bovis subsp bovis AF2122/97
gucggugcgcgcggcgac

SEQ ID NO: 3101165 - RNA, 14 nt, Mycobacterium bovis subsp bovis AF2122/97
gucggugcgcggca

SEQ ID NO: 3101166 - RNA, 23 nt, Mycobacterium bovis subsp bovis AF2122/97
gucggugcguccggugcuggucc

SEQ ID NO: 3101167 - RNA, 20 nt, Mycobacterium bovis subsp bovis AF2122/97
gucggugcugaccccgccgg

SEQ ID NO: 3101168 - RNA, 15 nt, Mycobacterium bovis subsp bovis AF2122/97
gucgguggccgcggc

SEQ ID NO: 3101169 - RNA, 17 nt, Mycobacterium bovis subsp bovis AF2122/97
gucgguggccgcggcgg

SEQ ID NO: 3101170 - RNA, 18 nt, Mycobacterium bovis subsp bovis AF2122/97
gucgguggccgcggcggu

SEQ ID NO: 3101171 - RNA, 21 nt, Mycobacterium bovis subsp bovis AF2122/97
gucgguggccgcggcggucug

SEQ ID NO: 3101172 - RNA, 19 nt, Mycobacterium bovis subsp bovis AF2122/97
gucggugggugccagccgg

SEQ ID NO: 3101173 - RNA, 17 nt, Mycobacterium bovis subsp bovis AF2122/97
gucggugguaccggcgg

SEQ ID NO: 3101174 - RNA, 19 nt, Mycobacterium bovis subsp bovis AF2122/97
gucggugguaccggcggcg

SEQ ID NO: 3101175 - RNA, 17 nt, Mycobacterium bovis subsp bovis AF2122/97
gucgguggucucgacgg

SEQ ID NO: 3101176 - RNA, 20 nt, Mycobacterium bovis subsp bovis AF2122/97
gucgguggucucgacggcgc

SEQ ID NO: 3101177 - RNA, 23 nt, Mycobacterium bovis subsp bovis AF2122/97
gucggugguuuucccgucgccgc

SEQ ID NO: 3101178 - RNA, 20 nt, Mycobacterium bovis subsp bovis AF2122/97
gucggugugcaucgccggca

SEQ ID NO: 3101179 - RNA, 22 nt, Mycobacterium bovis subsp bovis AF2122/97
gucggugugcaucgccggcacg

SEQ ID NO: 3101180 - RNA, 16 nt, Mycobacterium bovis subsp bovis AF2122/97
gucggugugcgcgcca

SEQ ID NO: 3101181 - RNA, 18 nt, Mycobacterium bovis subsp bovis AF2122/97
gucgguguuccgccgcgc

SEQ ID NO: 3101182 - RNA, 20 nt, Mycobacterium bovis subsp bovis AF2122/97
gucgguguucggugguccug

SEQ ID NO: 3101183 - RNA, 17 nt, Mycobacterium bovis subsp bovis AF2122/97
gucgguguuuggccgcc

SEQ ID NO: 3101184 - RNA, 19 nt, Mycobacterium bovis subsp bovis AF2122/97
gucgguguuuggccgccga

SEQ ID NO: 3101185 - RNA, 20 nt, Mycobacterium bovis subsp bovis AF2122/97
gucgguguuuggccgccgaa

SEQ ID NO: 3101186 - RNA, 22 nt, Mycobacterium bovis subsp bovis AF2122/97
gucgguguuuggccgccgaauc

SEQ ID NO: 3101187 - RNA, 21 nt, Mycobacterium bovis subsp bovis AF2122/97
gucgguucagccacgcagcac

SEQ ID NO: 3101188 - RNA, 15 nt, Mycobacterium bovis subsp bovis AF2122/97
gucgguuccggugua

SEQ ID NO: 3101189 - RNA, 19 nt, Mycobacterium bovis subsp bovis AF2122/97
gucgguugccacgccgccg

SEQ ID NO: 3101190 - RNA, 21 nt, Mycobacterium bovis subsp bovis AF2122/97
gucgguugccacgccgccggu

SEQ ID NO: 3101191 - RNA, 20 nt, Mycobacterium bovis subsp bovis AF2122/97
gucgguuuccuccggcagca

SEQ ID NO: 3101192 - RNA, 13 nt, Mycobacterium bovis subsp bovis AF2122/97
gucguaacugccc

SEQ ID NO: 3101193 - RNA, 19 nt, Mycobacterium bovis subsp bovis AF2122/97
gucguaacugcccgcggcg

SEQ ID NO: 3101194 - RNA, 17 nt, Mycobacterium bovis subsp bovis AF2122/97
gucguacaacacgggca

SEQ ID NO: 3101195 - RNA, 18 nt, Mycobacterium bovis subsp bovis AF2122/97
gucguacaacacgggcag

SEQ ID NO: 3101196 - RNA, 20 nt, Mycobacterium bovis subsp bovis AF2122/97
gucguacaacacgggcagcu

SEQ ID NO: 3101197 - RNA, 22 nt, Mycobacterium bovis subsp bovis AF2122/97
gucguacaccucgagcgcggcg

SEQ ID NO: 3101198 - RNA, 16 nt, Mycobacterium bovis subsp bovis AF2122/97
gucguaccgcggaucg

SEQ ID NO: 3101199 - RNA, 15 nt, Mycobacterium bovis subsp bovis AF2122/97
gucguaccgcucggc

SEQ ID NO: 3101200 - RNA, 20 nt, Mycobacterium bovis subsp bovis AF2122/97
gucguaccuaaggcucacca

SEQ ID NO: 3101201 - RNA, 22 nt, Mycobacterium bovis subsp bovis AF2122/97
gucguaccuaaggcucaccagg

SEQ ID NO: 3101202 - RNA, 16 nt, Mycobacterium bovis subsp bovis AF2122/97
gucguacucgaccgcg

SEQ ID NO: 3101203 - RNA, 15 nt, Mycobacterium bovis subsp bovis AF2122/97
gucguacucggcggc

SEQ ID NO: 3101204 - RNA, 16 nt, Mycobacterium bovis subsp bovis AF2122/97
gucguacucggcggcc

SEQ ID NO: 3101205 - RNA, 18 nt, Mycobacterium bovis subsp bovis AF2122/97
gucguagaacugcaucau

SEQ ID NO: 3101206 - RNA, 15 nt, Mycobacterium bovis subsp bovis AF2122/97
gucguagacagucug

SEQ ID NO: 3101207 - RNA, 19 nt, Mycobacterium bovis subsp bovis AF2122/97
gucguagacagucugcgac

SEQ ID NO: 3101208 - RNA, 14 nt, Mycobacterium bovis subsp bovis AF2122/97
gucguagacggcga

SEQ ID NO: 3101209 - RNA, 21 nt, Mycobacterium bovis subsp bovis AF2122/97
gucguagaggacugcggucug

SEQ ID NO: 3101210 - RNA, 20 nt, Mycobacterium bovis subsp bovis AF2122/97
gucguagaggugccuuugga

SEQ ID NO: 3101211 - RNA, 16 nt, Mycobacterium bovis subsp bovis AF2122/97
gucguagcgcucguga

SEQ ID NO: 3101212 - RNA, 20 nt, Mycobacterium bovis subsp bovis AF2122/97
gucguagcuuccgguccagc

SEQ ID NO: 3101213 - RNA, 17 nt, Mycobacterium bovis subsp bovis AF2122/97
gucguaggacaccaccg

SEQ ID NO: 3101214 - RNA, 13 nt, Mycobacterium bovis subsp bovis AF2122/97
gucguaggccgca

SEQ ID NO: 3101215 - RNA, 14 nt, Mycobacterium bovis subsp bovis AF2122/97
gucguaggcgauga

SEQ ID NO: 3101216 - RNA, 19 nt, Mycobacterium bovis subsp bovis AF2122/97
gucguaguaggcgccgcga

SEQ ID NO: 3101217 - RNA, 18 nt, Mycobacterium bovis subsp bovis AF2122/97
gucguagucgguagcuga

SEQ ID NO: 3101218 - RNA, 15 nt, Mycobacterium bovis subsp bovis AF2122/97
gucguagucgucggc

SEQ ID NO: 3101219 - RNA, 19 nt, Mycobacterium bovis subsp bovis AF2122/97
gucguauugccucaccagg

SEQ ID NO: 3101220 - RNA, 20 nt, Mycobacterium bovis subsp bovis AF2122/97
gucguauugccucaccaggu

SEQ ID NO: 3101221 - RNA, 21 nt, Mycobacterium bovis subsp bovis AF2122/97
gucgucaaaucuggcuggacc

SEQ ID NO: 3101222 - RNA, 18 nt, Mycobacterium bovis subsp bovis AF2122/97
gucgucacgaucgugccg

SEQ ID NO: 3101223 - RNA, 17 nt, Mycobacterium bovis subsp bovis AF2122/97
gucgucacggaccgcca

SEQ ID NO: 3101224 - RNA, 15 nt, Mycobacterium bovis subsp bovis AF2122/97
gucgucagccaccgc

SEQ ID NO: 3101225 - RNA, 22 nt, Mycobacterium bovis subsp bovis AF2122/97
gucgucaguaauucggccaucg

SEQ ID NO: 3101226 - RNA, 15 nt, Mycobacterium bovis subsp bovis AF2122/97
gucgucaucgagcgg

SEQ ID NO: 3101227 - RNA, 21 nt, Mycobacterium bovis subsp bovis AF2122/97
gucgucaucgaguugcucggc

SEQ ID NO: 3101228 - RNA, 20 nt, Mycobacterium bovis subsp bovis AF2122/97
gucgucaucggggccugcgu

SEQ ID NO: 3101229 - RNA, 17 nt, Mycobacterium bovis subsp bovis AF2122/97
gucgucaugccagucgc

SEQ ID NO: 3101230 - RNA, 19 nt, Mycobacterium bovis subsp bovis AF2122/97
gucguccagggcgacgaga

SEQ ID NO: 3101231 - RNA, 23 nt, Mycobacterium bovis subsp bovis AF2122/97
gucguccaucgcgucgucuucuu

SEQ ID NO: 3101232 - RNA, 15 nt, Mycobacterium bovis subsp bovis AF2122/97
gucgucccagggcug

SEQ ID NO: 3101233 - RNA, 19 nt, Mycobacterium bovis subsp bovis AF2122/97
gucgucccagggcugccgg

SEQ ID NO: 3101234 - RNA, 19 nt, Mycobacterium bovis subsp bovis AF2122/97
gucgucccgauggcggugg

SEQ ID NO: 3101235 - RNA, 21 nt, Mycobacterium bovis subsp bovis AF2122/97
gucgucccgcccaucccgguu

SEQ ID NO: 3101236 - RNA, 15 nt, Mycobacterium bovis subsp bovis AF2122/97
gucguccgacgggcc

SEQ ID NO: 3101237 - RNA, 15 nt, Mycobacterium bovis subsp bovis AF2122/97
gucguccgccugcac

SEQ ID NO: 3101238 - RNA, 18 nt, Mycobacterium bovis subsp bovis AF2122/97
gucguccgcugacccgcc

SEQ ID NO: 3101239 - RNA, 13 nt, Mycobacterium bovis subsp bovis AF2122/97
gucguccggccac

SEQ ID NO: 3101240 - RNA, 16 nt, Mycobacterium bovis subsp bovis AF2122/97
gucguccucgcuggau

SEQ ID NO: 3101241 - RNA, 20 nt, Mycobacterium bovis subsp bovis AF2122/97
gucguccuguccgggcugca

SEQ ID NO: 3101242 - RNA, 21 nt, Mycobacterium bovis subsp bovis AF2122/97
gucguccuguccgggcugcau

SEQ ID NO: 3101243 - RNA, 22 nt, Mycobacterium bovis subsp bovis AF2122/97
gucgucgaaauggauugcggca

SEQ ID NO: 3101244 - RNA, 16 nt, Mycobacterium bovis subsp bovis AF2122/97
gucgucgaacggcagc

SEQ ID NO: 3101245 - RNA, 23 nt, Mycobacterium bovis subsp bovis AF2122/97
gucgucgaaguuggcgaagcccg

SEQ ID NO: 3101246 - RNA, 16 nt, Mycobacterium bovis subsp bovis AF2122/97
gucgucgacacgguga

SEQ ID NO: 3101247 - RNA, 18 nt, Mycobacterium bovis subsp bovis AF2122/97
gucgucgacacggugauc

SEQ ID NO: 3101248 - RNA, 20 nt, Mycobacterium bovis subsp bovis AF2122/97
gucgucgacaguuuucaccg

SEQ ID NO: 3101249 - RNA, 22 nt, Mycobacterium bovis subsp bovis AF2122/97
gucgucgaccacgacguucgac

SEQ ID NO: 3101250 - RNA, 13 nt, Mycobacterium bovis subsp bovis AF2122/97
gucgucgaccagg

SEQ ID NO: 3101251 - RNA, 14 nt, Mycobacterium bovis subsp bovis AF2122/97
gucgucgaccaggc

SEQ ID NO: 3101252 - RNA, 14 nt, Mycobacterium bovis subsp bovis AF2122/97
gucgucgacgaggu

SEQ ID NO: 3101253 - RNA, 16 nt, Mycobacterium bovis subsp bovis AF2122/97
gucgucgacggccugg

SEQ ID NO: 3101254 - RNA, 21 nt, Mycobacterium bovis subsp bovis AF2122/97
gucgucgacggcugcgccgaa

SEQ ID NO: 3101255 - RNA, 21 nt, Mycobacterium bovis subsp bovis AF2122/97
gucgucgacuugcaggcgucc

SEQ ID NO: 3101256 - RNA, 20 nt, Mycobacterium bovis subsp bovis AF2122/97
gucgucgagcaccacccggg

SEQ ID NO: 3101257 - RNA, 22 nt, Mycobacterium bovis subsp bovis AF2122/97
gucgucgagcaccacccgggcc

SEQ ID NO: 3101258 - RNA, 14 nt, Mycobacterium bovis subsp bovis AF2122/97
gucgucgagcgcgc

SEQ ID NO: 3101259 - RNA, 14 nt, Mycobacterium bovis subsp bovis AF2122/97
gucgucgagcugac

SEQ ID NO: 3101260 - RNA, 19 nt, Mycobacterium bovis subsp bovis AF2122/97
gucgucgaggucagugggc

SEQ ID NO: 3101261 - RNA, 16 nt, Mycobacterium bovis subsp bovis AF2122/97
gucgucgaugaugccg

SEQ ID NO: 3101262 - RNA, 16 nt, Mycobacterium bovis subsp bovis AF2122/97
gucgucgauuagccca

SEQ ID NO: 3101263 - RNA, 23 nt, Mycobacterium bovis subsp bovis AF2122/97
gucgucgauuagcccacccaugg

SEQ ID NO: 3101264 - RNA, 23 nt, Mycobacterium bovis subsp bovis AF2122/97
gucgucgccaaucgaguagcuga

SEQ ID NO: 3101265 - RNA, 14 nt, Mycobacterium bovis subsp bovis AF2122/97
gucgucgccgccgg

SEQ ID NO: 3101266 - RNA, 17 nt, Mycobacterium bovis subsp bovis AF2122/97
gucgucgccgccgguga

SEQ ID NO: 3101267 - RNA, 15 nt, Mycobacterium bovis subsp bovis AF2122/97
gucgucgcgauccac

SEQ ID NO: 3101268 - RNA, 14 nt, Mycobacterium bovis subsp bovis AF2122/97
gucgucgcggccgg

SEQ ID NO: 3101269 - RNA, 17 nt, Mycobacterium bovis subsp bovis AF2122/97
gucgucgcggccgguuc

SEQ ID NO: 3101270 - RNA, 17 nt, Mycobacterium bovis subsp bovis AF2122/97
gucgucgcugagcagcg

SEQ ID NO: 3101271 - RNA, 15 nt, Mycobacterium bovis subsp bovis AF2122/97
gucgucgcuugcugg

SEQ ID NO: 3101272 - RNA, 17 nt, Mycobacterium bovis subsp bovis AF2122/97
gucgucgcuugcugggu

SEQ ID NO: 3101273 - RNA, 21 nt, Mycobacterium bovis subsp bovis AF2122/97
gucgucggcaugggccggcgc

SEQ ID NO: 3101274 - RNA, 21 nt, Mycobacterium bovis subsp bovis AF2122/97
gucgucggccaaagacccggc

SEQ ID NO: 3101275 - RNA, 13 nt, Mycobacterium bovis subsp bovis AF2122/97
gucgucggccugc

SEQ ID NO: 3101276 - RNA, 16 nt, Mycobacterium bovis subsp bovis AF2122/97
gucgucggcggcgacg

SEQ ID NO: 3101277 - RNA, 18 nt, Mycobacterium bovis subsp bovis AF2122/97
gucgucggcgucccaggg

SEQ ID NO: 3101278 - RNA, 23 nt, Mycobacterium bovis subsp bovis AF2122/97
gucgucggcgucgguggaggcgu

SEQ ID NO: 3101279 - RNA, 14 nt, Mycobacterium bovis subsp bovis AF2122/97
gucgucggguucgc

SEQ ID NO: 3101280 - RNA, 22 nt, Mycobacterium bovis subsp bovis AF2122/97
gucgucgguaaugccgggcccu

SEQ ID NO: 3101281 - RNA, 17 nt, Mycobacterium bovis subsp bovis AF2122/97
gucgucguacggcucau

SEQ ID NO: 3101282 - RNA, 18 nt, Mycobacterium bovis subsp bovis AF2122/97
gucgucguagcuggcgau

SEQ ID NO: 3101283 - RNA, 17 nt, Mycobacterium bovis subsp bovis AF2122/97
gucgucguccgacgggc

SEQ ID NO: 3101284 - RNA, 12 nt, Mycobacterium bovis subsp bovis AF2122/97
gucgucguccuc

SEQ ID NO: 3101285 - RNA, 14 nt, Mycobacterium bovis subsp bovis AF2122/97
gucgucgugcaggc

SEQ ID NO: 3101286 - RNA, 21 nt, Mycobacterium bovis subsp bovis AF2122/97
gucgucguguuggccgggucg

SEQ ID NO: 3101287 - RNA, 21 nt, Mycobacterium bovis subsp bovis AF2122/97
gucgucguuucgccagccggc

SEQ ID NO: 3101288 - RNA, 22 nt, Mycobacterium bovis subsp bovis AF2122/97
gucgucuucgucauggccggcc

SEQ ID NO: 3101289 - RNA, 18 nt, Mycobacterium bovis subsp bovis AF2122/97
gucgucuucuucgcggau

SEQ ID NO: 3101290 - RNA, 15 nt, Mycobacterium bovis subsp bovis AF2122/97
gucgucuuggcgauc

SEQ ID NO: 3101291 - RNA, 17 nt, Mycobacterium bovis subsp bovis AF2122/97
gucgucuuuggucagcc

SEQ ID NO: 3101292 - RNA, 17 nt, Mycobacterium bovis subsp bovis AF2122/97
gucgugacaaccaucgg

SEQ ID NO: 3101293 - RNA, 22 nt, Mycobacterium bovis subsp bovis AF2122/97
gucgugagacugggcgcuggag

SEQ ID NO: 3101294 - RNA, 17 nt, Mycobacterium bovis subsp bovis AF2122/97
gucgugagccagcuugc

SEQ ID NO: 3101295 - RNA, 16 nt, Mycobacterium bovis subsp bovis AF2122/97
gucgugaggaaccccg

SEQ ID NO: 3101296 - RNA, 17 nt, Mycobacterium bovis subsp bovis AF2122/97
gucgugauacagcucgg

SEQ ID NO: 3101297 - RNA, 14 nt, Mycobacterium bovis subsp bovis AF2122/97
gucgugaucagcag

SEQ ID NO: 3101298 - RNA, 15 nt, Mycobacterium bovis subsp bovis AF2122/97
gucgugaucagcagg

SEQ ID NO: 3101299 - RNA, 20 nt, Mycobacterium bovis subsp bovis AF2122/97
gucgugaucggcgaacccac

SEQ ID NO: 3101300 - RNA, 19 nt, Mycobacterium bovis subsp bovis AF2122/97
gucgugaucuucugccuug

SEQ ID NO: 3101301 - RNA, 15 nt, Mycobacterium bovis subsp bovis AF2122/97
gucgugcacggcggc

SEQ ID NO: 3101302 - RNA, 14 nt, Mycobacterium bovis subsp bovis AF2122/97
gucgugccagcagc

SEQ ID NO: 3101303 - RNA, 12 nt, Mycobacterium bovis subsp bovis AF2122/97
gucgugccccgg

SEQ ID NO: 3101304 - RNA, 16 nt, Mycobacterium bovis subsp bovis AF2122/97
gucgugccccggcgcg

SEQ ID NO: 3101305 - RNA, 15 nt, Mycobacterium bovis subsp bovis AF2122/97
gucgugcccgggacc

SEQ ID NO: 3101306 - RNA, 15 nt, Mycobacterium bovis subsp bovis AF2122/97
gucgugcgcggccgg

SEQ ID NO: 3101307 - RNA, 16 nt, Mycobacterium bovis subsp bovis AF2122/97
gucgugcgcggccggc

SEQ ID NO: 3101308 - RNA, 20 nt, Mycobacterium bovis subsp bovis AF2122/97
gucgugcgcggccggcacga

SEQ ID NO: 3101309 - RNA, 15 nt, Mycobacterium bovis subsp bovis AF2122/97
gucgugcgggcgggc

SEQ ID NO: 3101310 - RNA, 17 nt, Mycobacterium bovis subsp bovis AF2122/97
gucgugcucucggcgaa

SEQ ID NO: 3101311 - RNA, 18 nt, Mycobacterium bovis subsp bovis AF2122/97
gucgugcucucggcgaau

SEQ ID NO: 3101312 - RNA, 14 nt, Mycobacterium bovis subsp bovis AF2122/97
gucguggagcucac

SEQ ID NO: 3101313 - RNA, 19 nt, Mycobacterium bovis subsp bovis AF2122/97
gucguggagcucacgugcu

SEQ ID NO: 3101314 - RNA, 14 nt, Mycobacterium bovis subsp bovis AF2122/97
gucguggcuuccgg

SEQ ID NO: 3101315 - RNA, 15 nt, Mycobacterium bovis subsp bovis AF2122/97
gucgugggccaccac

SEQ ID NO: 3101316 - RNA, 22 nt, Mycobacterium bovis subsp bovis AF2122/97
gucgugguccuuguuguggugg

SEQ ID NO: 3101317 - RNA, 12 nt, Mycobacterium bovis subsp bovis AF2122/97
gucguggucgau

SEQ ID NO: 3101318 - RNA, 21 nt, Mycobacterium bovis subsp bovis AF2122/97
gucguggucgauccacucggc

SEQ ID NO: 3101319 - RNA, 14 nt, Mycobacterium bovis subsp bovis AF2122/97
gucguggucggcga

SEQ ID NO: 3101320 - RNA, 16 nt, Mycobacterium bovis subsp bovis AF2122/97
gucgugguggccacgg

SEQ ID NO: 3101321 - RNA, 17 nt, Mycobacterium bovis subsp bovis AF2122/97
gucgugguggccacgga

SEQ ID NO: 3101322 - RNA, 20 nt, Mycobacterium bovis subsp bovis AF2122/97
gucgugucgccacaccgggg

SEQ ID NO: 3101323 - RNA, 15 nt, Mycobacterium bovis subsp bovis AF2122/97
gucgugucgccgccg

SEQ ID NO: 3101324 - RNA, 16 nt, Mycobacterium bovis subsp bovis AF2122/97
gucgugucgccgccgu

SEQ ID NO: 3101325 - RNA, 22 nt, Mycobacterium bovis subsp bovis AF2122/97
gucguguggguguugucgucga

SEQ ID NO: 3101326 - RNA, 17 nt, Mycobacterium bovis subsp bovis AF2122/97
gucguucccgccggcac

SEQ ID NO: 3101327 - RNA, 17 nt, Mycobacterium bovis subsp bovis AF2122/97
gucguuccgccgccucg

SEQ ID NO: 3101328 - RNA, 20 nt, Mycobacterium bovis subsp bovis AF2122/97
gucguucgcgucacaccagc

SEQ ID NO: 3101329 - RNA, 17 nt, Mycobacterium bovis subsp bovis AF2122/97
gucguugaggaagcccg

SEQ ID NO: 3101330 - RNA, 18 nt, Mycobacterium bovis subsp bovis AF2122/97
gucguugaggaagcccga

SEQ ID NO: 3101331 - RNA, 20 nt, Mycobacterium bovis subsp bovis AF2122/97
gucguugauuucggcggcga

SEQ ID NO: 3101332 - RNA, 20 nt, Mycobacterium bovis subsp bovis AF2122/97
gucguugcccgacccgccga

SEQ ID NO: 3101333 - RNA, 23 nt, Mycobacterium bovis subsp bovis AF2122/97
gucguugccgaucugcucgccga

SEQ ID NO: 3101334 - RNA, 17 nt, Mycobacterium bovis subsp bovis AF2122/97
gucguugccgcggucgg

SEQ ID NO: 3101335 - RNA, 21 nt, Mycobacterium bovis subsp bovis AF2122/97
gucguugccggacaaccuggg

SEQ ID NO: 3101336 - RNA, 15 nt, Mycobacterium bovis subsp bovis AF2122/97
gucguugccguccac

SEQ ID NO: 3101337 - RNA, 13 nt, Mycobacterium bovis subsp bovis AF2122/97
gucguugcgcggu

SEQ ID NO: 3101338 - RNA, 20 nt, Mycobacterium bovis subsp bovis AF2122/97
gucguugcuggugugcgggu

SEQ ID NO: 3101339 - RNA, 17 nt, Mycobacterium bovis subsp bovis AF2122/97
gucguuggcggcggucg

SEQ ID NO: 3101340 - RNA, 20 nt, Mycobacterium bovis subsp bovis AF2122/97
gucguuguacggggccgucu

SEQ ID NO: 3101341 - RNA, 23 nt, Mycobacterium bovis subsp bovis AF2122/97
gucguugugcagaucgucgccga

SEQ ID NO: 3101342 - RNA, 17 nt, Mycobacterium bovis subsp bovis AF2122/97
gucguugugugccagcg

SEQ ID NO: 3101343 - RNA, 17 nt, Mycobacterium bovis subsp bovis AF2122/97
gucguuguuagugacgu

SEQ ID NO: 3101344 - RNA, 14 nt, Mycobacterium bovis subsp bovis AF2122/97
gucguuucgccagc

SEQ ID NO: 3101345 - RNA, 22 nt, Mycobacterium bovis subsp bovis AF2122/97
gucguuucgccagccggccgcg

SEQ ID NO: 3101346 - RNA, 17 nt, Mycobacterium bovis subsp bovis AF2122/97
gucguuuucagagccgg

SEQ ID NO: 3101347 - RNA, 17 nt, Mycobacterium bovis subsp bovis AF2122/97
gucuaaggaugaccuuc

SEQ ID NO: 3101348 - RNA, 16 nt, Mycobacterium bovis subsp bovis AF2122/97
gucuacccggucgccg

SEQ ID NO: 3101349 - RNA, 23 nt, Mycobacterium bovis subsp bovis AF2122/97
gucuaccuuuuuggcacccacgg

SEQ ID NO: 3101350 - RNA, 21 nt, Mycobacterium bovis subsp bovis AF2122/97
gucuacgacgucgcuguaggc

SEQ ID NO: 3101351 - RNA, 16 nt, Mycobacterium bovis subsp bovis AF2122/97
gucuacgccgggaauu

SEQ ID NO: 3101352 - RNA, 20 nt, Mycobacterium bovis subsp bovis AF2122/97
gucuacgucguccagcacca

SEQ ID NO: 3101353 - RNA, 23 nt, Mycobacterium bovis subsp bovis AF2122/97
gucuagcggccuaggacgccgcc

SEQ ID NO: 3101354 - RNA, 18 nt, Mycobacterium bovis subsp bovis AF2122/97
gucuaggccaaaccccug

SEQ ID NO: 3101355 - RNA, 14 nt, Mycobacterium bovis subsp bovis AF2122/97
gucucacggcgcga

SEQ ID NO: 3101356 - RNA, 16 nt, Mycobacterium bovis subsp bovis AF2122/97
gucucagugcucgccc

SEQ ID NO: 3101357 - RNA, 15 nt, Mycobacterium bovis subsp bovis AF2122/97
gucucaugcacccgg

SEQ ID NO: 3101358 - RNA, 21 nt, Mycobacterium bovis subsp bovis AF2122/97
gucuccagacguuccaucacg

SEQ ID NO: 3101359 - RNA, 17 nt, Mycobacterium bovis subsp bovis AF2122/97
gucuccagcugggugac

SEQ ID NO: 3101360 - RNA, 20 nt, Mycobacterium bovis subsp bovis AF2122/97
gucuccaguagccggugccg

SEQ ID NO: 3101361 - RNA, 16 nt, Mycobacterium bovis subsp bovis AF2122/97
gucucccagaggucga

SEQ ID NO: 3101362 - RNA, 19 nt, Mycobacterium bovis subsp bovis AF2122/97
gucucccagaggucgagcg

SEQ ID NO: 3101363 - RNA, 21 nt, Mycobacterium bovis subsp bovis AF2122/97
gucucccagaggucgagcgcc

SEQ ID NO: 3101364 - RNA, 23 nt, Mycobacterium bovis subsp bovis AF2122/97
gucuccgcccgcgggccccaucg

SEQ ID NO: 3101365 - RNA, 14 nt, Mycobacterium bovis subsp bovis AF2122/97
gucuccgccggcuc

SEQ ID NO: 3101366 - RNA, 16 nt, Mycobacterium bovis subsp bovis AF2122/97
gucuccgccggcucgu

SEQ ID NO: 3101367 - RNA, 21 nt, Mycobacterium bovis subsp bovis AF2122/97
gucuccggacgcacgauccgc

SEQ ID NO: 3101368 - RNA, 16 nt, Mycobacterium bovis subsp bovis AF2122/97
gucuccggaucgccga

SEQ ID NO: 3101369 - RNA, 15 nt, Mycobacterium bovis subsp bovis AF2122/97
gucuccggcaacagc

SEQ ID NO: 3101370 - RNA, 12 nt, Mycobacterium bovis subsp bovis AF2122/97
gucuccggcaag

SEQ ID NO: 3101371 - RNA, 16 nt, Mycobacterium bovis subsp bovis AF2122/97
gucuccggcgccaccg

SEQ ID NO: 3101372 - RNA, 15 nt, Mycobacterium bovis subsp bovis AF2122/97
gucuccggcgucggc

SEQ ID NO: 3101373 - RNA, 21 nt, Mycobacterium bovis subsp bovis AF2122/97
gucuccggugcgcagccaggu

SEQ ID NO: 3101374 - RNA, 22 nt, Mycobacterium bovis subsp bovis AF2122/97
gucuccuccggaaagcucucgg

SEQ ID NO: 3101375 - RNA, 21 nt, Mycobacterium bovis subsp bovis AF2122/97
gucuccuucggcgacugcgca

SEQ ID NO: 3101376 - RNA, 18 nt, Mycobacterium bovis subsp bovis AF2122/97
gucuccuugagcuucucg

SEQ ID NO: 3101377 - RNA, 17 nt, Mycobacterium bovis subsp bovis AF2122/97
gucuccuugggcgacgc

SEQ ID NO: 3101378 - RNA, 18 nt, Mycobacterium bovis subsp bovis AF2122/97
gucucgaaagccgcggcc

SEQ ID NO: 3101379 - RNA, 20 nt, Mycobacterium bovis subsp bovis AF2122/97
gucucgaaagccgcggccga

SEQ ID NO: 3101380 - RNA, 16 nt, Mycobacterium bovis subsp bovis AF2122/97
gucucgaacuccaugc

SEQ ID NO: 3101381 - RNA, 18 nt, Mycobacterium bovis subsp bovis AF2122/97
gucucgacaaagcggcug

SEQ ID NO: 3101382 - RNA, 20 nt, Mycobacterium bovis subsp bovis AF2122/97
gucucgacaaagcggcugcc

SEQ ID NO: 3101383 - RNA, 20 nt, Mycobacterium bovis subsp bovis AF2122/97
gucucgacggcgccgcccac

SEQ ID NO: 3101384 - RNA, 17 nt, Mycobacterium bovis subsp bovis AF2122/97
gucucgacggcggccgc

SEQ ID NO: 3101385 - RNA, 19 nt, Mycobacterium bovis subsp bovis AF2122/97
gucucgacggcggccgcga

SEQ ID NO: 3101386 - RNA, 23 nt, Mycobacterium bovis subsp bovis AF2122/97
gucucgagcgcgccgcgcucgcc

SEQ ID NO: 3101387 - RNA, 15 nt, Mycobacterium bovis subsp bovis AF2122/97
gucucgagggugaag

SEQ ID NO: 3101388 - RNA, 19 nt, Mycobacterium bovis subsp bovis AF2122/97
gucucgagggugaaguggc

SEQ ID NO: 3101389 - RNA, 16 nt, Mycobacterium bovis subsp bovis AF2122/97
gucucgaucgcgguag

SEQ ID NO: 3101390 - RNA, 17 nt, Mycobacterium bovis subsp bovis AF2122/97
gucucgcaccgcguuga

SEQ ID NO: 3101391 - RNA, 19 nt, Mycobacterium bovis subsp bovis AF2122/97
gucucgcagcaacggcggc

SEQ ID NO: 3101392 - RNA, 21 nt, Mycobacterium bovis subsp bovis AF2122/97
gucucgcagcaacggcggcgu

SEQ ID NO: 3101393 - RNA, 16 nt, Mycobacterium bovis subsp bovis AF2122/97
gucucgcaugcucacg

SEQ ID NO: 3101394 - RNA, 17 nt, Mycobacterium bovis subsp bovis AF2122/97
gucucgccgaccuuggc

SEQ ID NO: 3101395 - RNA, 18 nt, Mycobacterium bovis subsp bovis AF2122/97
gucucgccguggauggcc

SEQ ID NO: 3101396 - RNA, 21 nt, Mycobacterium bovis subsp bovis AF2122/97
gucucgcgagcguuucaccag

SEQ ID NO: 3101397 - RNA, 14 nt, Mycobacterium bovis subsp bovis AF2122/97
gucucgcgagguga

SEQ ID NO: 3101398 - RNA, 15 nt, Mycobacterium bovis subsp bovis AF2122/97
gucucgcgcagccgg

SEQ ID NO: 3101399 - RNA, 14 nt, Mycobacterium bovis subsp bovis AF2122/97
gucucgcgcgauga

SEQ ID NO: 3101400 - RNA, 16 nt, Mycobacterium bovis subsp bovis AF2122/97
gucucgcggcccgaga

SEQ ID NO: 3101401 - RNA, 19 nt, Mycobacterium bovis subsp bovis AF2122/97
gucucgcggugcggcaaca

SEQ ID NO: 3101402 - RNA, 23 nt, Mycobacterium bovis subsp bovis AF2122/97
gucucgcggugcggcaacagcgc

SEQ ID NO: 3101403 - RNA, 20 nt, Mycobacterium bovis subsp bovis AF2122/97
gucucgcugggaaaucccga

SEQ ID NO: 3101404 - RNA, 21 nt, Mycobacterium bovis subsp bovis AF2122/97
gucucggaaacggaccuccuc

SEQ ID NO: 3101405 - RNA, 20 nt, Mycobacterium bovis subsp bovis AF2122/97
gucucggccgaggaccagag

SEQ ID NO: 3101406 - RNA, 13 nt, Mycobacterium bovis subsp bovis AF2122/97
gucucggcgaccg

SEQ ID NO: 3101407 - RNA, 17 nt, Mycobacterium bovis subsp bovis AF2122/97
gucucggcgucgaccag

SEQ ID NO: 3101408 - RNA, 22 nt, Mycobacterium bovis subsp bovis AF2122/97
gucucgggcgcgggugaccagg

SEQ ID NO: 3101409 - RNA, 17 nt, Mycobacterium bovis subsp bovis AF2122/97
gucucggggugcacgau

SEQ ID NO: 3101410 - RNA, 23 nt, Mycobacterium bovis subsp bovis AF2122/97
gucucgggguuguucggcagcca

SEQ ID NO: 3101411 - RNA, 15 nt, Mycobacterium bovis subsp bovis AF2122/97
gucucggucagcccc

SEQ ID NO: 3101412 - RNA, 18 nt, Mycobacterium bovis subsp bovis AF2122/97
gucucgguggcugcgccg

SEQ ID NO: 3101413 - RNA, 15 nt, Mycobacterium bovis subsp bovis AF2122/97
gucucuaccacggag

SEQ ID NO: 3101414 - RNA, 16 nt, Mycobacterium bovis subsp bovis AF2122/97
gucugacagaccgggc

SEQ ID NO: 3101415 - RNA, 14 nt, Mycobacterium bovis subsp bovis AF2122/97
gucugacagcaucc

SEQ ID NO: 3101416 - RNA, 23 nt, Mycobacterium bovis subsp bovis AF2122/97
gucugacccaccgccccggcggc

SEQ ID NO: 3101417 - RNA, 23 nt, Mycobacterium bovis subsp bovis AF2122/97
gucugaccccccgaccccgacgg

SEQ ID NO: 3101418 - RNA, 14 nt, Mycobacterium bovis subsp bovis AF2122/97
gucugagcgccggc

SEQ ID NO: 3101419 - RNA, 20 nt, Mycobacterium bovis subsp bovis AF2122/97
gucugaucacucacccgggc

SEQ ID NO: 3101420 - RNA, 15 nt, Mycobacterium bovis subsp bovis AF2122/97
gucugauggccucgc

SEQ ID NO: 3101421 - RNA, 15 nt, Mycobacterium bovis subsp bovis AF2122/97
gucugauggcggcuc

SEQ ID NO: 3101422 - RNA, 18 nt, Mycobacterium bovis subsp bovis AF2122/97
gucugcagugcagcgauc

SEQ ID NO: 3101423 - RNA, 19 nt, Mycobacterium bovis subsp bovis AF2122/97
gucugccaaaagggcggca

SEQ ID NO: 3101424 - RNA, 22 nt, Mycobacterium bovis subsp bovis AF2122/97
gucugccaaaagggcggcagcg

SEQ ID NO: 3101425 - RNA, 15 nt, Mycobacterium bovis subsp bovis AF2122/97
gucugccacgaggca

SEQ ID NO: 3101426 - RNA, 17 nt, Mycobacterium bovis subsp bovis AF2122/97
gucugccacgucggcga

SEQ ID NO: 3101427 - RNA, 16 nt, Mycobacterium bovis subsp bovis AF2122/97
gucugcccgacugccg

SEQ ID NO: 3101428 - RNA, 15 nt, Mycobacterium bovis subsp bovis AF2122/97
gucugcccgaggucc

SEQ ID NO: 3101429 - RNA, 19 nt, Mycobacterium bovis subsp bovis AF2122/97
gucugcccgauacccggug

SEQ ID NO: 3101430 - RNA, 12 nt, Mycobacterium bovis subsp bovis AF2122/97
gucugcccgccc

SEQ ID NO: 3101431 - RNA, 14 nt, Mycobacterium bovis subsp bovis AF2122/97
gucugcccgcccag

SEQ ID NO: 3101432 - RNA, 21 nt, Mycobacterium bovis subsp bovis AF2122/97
gucugcccgcccagcccggcg

SEQ ID NO: 3101433 - RNA, 19 nt, Mycobacterium bovis subsp bovis AF2122/97
gucugcgacccgggccgcg

SEQ ID NO: 3101434 - RNA, 12 nt, Mycobacterium bovis subsp bovis AF2122/97
gucugcgccaga

SEQ ID NO: 3101435 - RNA, 13 nt, Mycobacterium bovis subsp bovis AF2122/97
gucugcgccgccg

SEQ ID NO: 3101436 - RNA, 16 nt, Mycobacterium bovis subsp bovis AF2122/97
gucugcgccgccggcg

SEQ ID NO: 3101437 - RNA, 17 nt, Mycobacterium bovis subsp bovis AF2122/97
gucugcgccgccggcgg

SEQ ID NO: 3101438 - RNA, 19 nt, Mycobacterium bovis subsp bovis AF2122/97
gucugcgccuucgccagcg

SEQ ID NO: 3101439 - RNA, 13 nt, Mycobacterium bovis subsp bovis AF2122/97
gucugcgcggugc

SEQ ID NO: 3101440 - RNA, 14 nt, Mycobacterium bovis subsp bovis AF2122/97
gucugcgcgucgcg

SEQ ID NO: 3101441 - RNA, 17 nt, Mycobacterium bovis subsp bovis AF2122/97
gucugcggaccggcgcg

SEQ ID NO: 3101442 - RNA, 16 nt, Mycobacterium bovis subsp bovis AF2122/97
gucugcggggugagug

SEQ ID NO: 3101443 - RNA, 18 nt, Mycobacterium bovis subsp bovis AF2122/97
gucugcucagcgcggccc

SEQ ID NO: 3101444 - RNA, 16 nt, Mycobacterium bovis subsp bovis AF2122/97
gucugcucgccaggca

SEQ ID NO: 3101445 - RNA, 16 nt, Mycobacterium bovis subsp bovis AF2122/97
gucugcucgccaggcc

SEQ ID NO: 3101446 - RNA, 16 nt, Mycobacterium bovis subsp bovis AF2122/97
gucugcucgccgggca

SEQ ID NO: 3101447 - RNA, 14 nt, Mycobacterium bovis subsp bovis AF2122/97
gucugcucgccgug

SEQ ID NO: 3101448 - RNA, 16 nt, Mycobacterium bovis subsp bovis AF2122/97
gucugcucgcgcccgc

SEQ ID NO: 3101449 - RNA, 20 nt, Mycobacterium bovis subsp bovis AF2122/97
gucugcucggcgagcgucgg

SEQ ID NO: 3101450 - RNA, 13 nt, Mycobacterium bovis subsp bovis AF2122/97
gucugcucggcgg

SEQ ID NO: 3101451 - RNA, 15 nt, Mycobacterium bovis subsp bovis AF2122/97
gucugcucggcggcc

SEQ ID NO: 3101452 - RNA, 17 nt, Mycobacterium bovis subsp bovis AF2122/97
gucugcugaucgagcgg

SEQ ID NO: 3101453 - RNA, 19 nt, Mycobacterium bovis subsp bovis AF2122/97
gucugcugggcacgauggc

SEQ ID NO: 3101454 - RNA, 21 nt, Mycobacterium bovis subsp bovis AF2122/97
gucugcugggcacgauggcuc

SEQ ID NO: 3101455 - RNA, 16 nt, Mycobacterium bovis subsp bovis AF2122/97
gucuggacaucggccg

SEQ ID NO: 3101456 - RNA, 15 nt, Mycobacterium bovis subsp bovis AF2122/97
gucuggacugcagcc

SEQ ID NO: 3101457 - RNA, 19 nt, Mycobacterium bovis subsp bovis AF2122/97
gucuggaucagaucccgcc

SEQ ID NO: 3101458 - RNA, 15 nt, Mycobacterium bovis subsp bovis AF2122/97
gucuggcaggccagc

SEQ ID NO: 3101459 - RNA, 17 nt, Mycobacterium bovis subsp bovis AF2122/97
gucuggccugccccaga

SEQ ID NO: 3101460 - RNA, 15 nt, Mycobacterium bovis subsp bovis AF2122/97
gucuggcgaacagug

SEQ ID NO: 3101461 - RNA, 17 nt, Mycobacterium bovis subsp bovis AF2122/97
gucuggcgcggagcuga

SEQ ID NO: 3101462 - RNA, 15 nt, Mycobacterium bovis subsp bovis AF2122/97
gucuggcgguaucga

SEQ ID NO: 3101463 - RNA, 17 nt, Mycobacterium bovis subsp bovis AF2122/97
gucuggggacgaaacua

SEQ ID NO: 3101464 - RNA, 15 nt, Mycobacterium bovis subsp bovis AF2122/97
gucuggguugcguag

SEQ ID NO: 3101465 - RNA, 21 nt, Mycobacterium bovis subsp bovis AF2122/97
gucugguauuuguccggcgga

SEQ ID NO: 3101466 - RNA, 23 nt, Mycobacterium bovis subsp bovis AF2122/97
gucuggucagccgcggcggcagc

SEQ ID NO: 3101467 - RNA, 19 nt, Mycobacterium bovis subsp bovis AF2122/97
gucugguggucggcgacgu

SEQ ID NO: 3101468 - RNA, 17 nt, Mycobacterium bovis subsp bovis AF2122/97
gucugguguccaccgca

SEQ ID NO: 3101469 - RNA, 23 nt, Mycobacterium bovis subsp bovis AF2122/97
gucugguugucgaucucggccag

SEQ ID NO: 3101470 - RNA, 15 nt, Mycobacterium bovis subsp bovis AF2122/97
gucugucuggcccca

SEQ ID NO: 3101471 - RNA, 23 nt, Mycobacterium bovis subsp bovis AF2122/97
gucugugauugcgcgggcaucgu

SEQ ID NO: 3101472 - RNA, 15 nt, Mycobacterium bovis subsp bovis AF2122/97
gucugugcaugcaug

SEQ ID NO: 3101473 - RNA, 14 nt, Mycobacterium bovis subsp bovis AF2122/97
gucugugcucacgg

SEQ ID NO: 3101474 - RNA, 15 nt, Mycobacterium bovis subsp bovis AF2122/97
gucugugcucacggc

SEQ ID NO: 3101475 - RNA, 19 nt, Mycobacterium bovis subsp bovis AF2122/97
gucugugcucacggcggcg

SEQ ID NO: 3101476 - RNA, 20 nt, Mycobacterium bovis subsp bovis AF2122/97
gucugugcucacggcggcga

SEQ ID NO: 3101477 - RNA, 22 nt, Mycobacterium bovis subsp bovis AF2122/97
gucugugcucacggcggcgaac

SEQ ID NO: 3101478 - RNA, 15 nt, Mycobacterium bovis subsp bovis AF2122/97
gucugugcugcgcug

SEQ ID NO: 3101479 - RNA, 15 nt, Mycobacterium bovis subsp bovis AF2122/97
gucuguuggugacag

SEQ ID NO: 3101480 - RNA, 18 nt, Mycobacterium bovis subsp bovis AF2122/97
gucuuacggucggcucca

SEQ ID NO: 3101481 - RNA, 13 nt, Mycobacterium bovis subsp bovis AF2122/97
gucuuaucggcgu

SEQ ID NO: 3101482 - RNA, 16 nt, Mycobacterium bovis subsp bovis AF2122/97
gucuucaacgucgaga

SEQ ID NO: 3101483 - RNA, 18 nt, Mycobacterium bovis subsp bovis AF2122/97
gucuucaggccgcgcaug

SEQ ID NO: 3101484 - RNA, 20 nt, Mycobacterium bovis subsp bovis AF2122/97
gucuucaggccgcgcauggu

SEQ ID NO: 3101485 - RNA, 17 nt, Mycobacterium bovis subsp bovis AF2122/97
gucuucagguccaccgc

SEQ ID NO: 3101486 - RNA, 14 nt, Mycobacterium bovis subsp bovis AF2122/97
gucuuccagccagg

SEQ ID NO: 3101487 - RNA, 16 nt, Mycobacterium bovis subsp bovis AF2122/97
gucuuccagccaggcc

SEQ ID NO: 3101488 - RNA, 23 nt, Mycobacterium bovis subsp bovis AF2122/97
gucuuccaggagcgccgucaucg

SEQ ID NO: 3101489 - RNA, 14 nt, Mycobacterium bovis subsp bovis AF2122/97
gucuuccggugcgc

SEQ ID NO: 3101490 - RNA, 15 nt, Mycobacterium bovis subsp bovis AF2122/97
gucuuccucggccac

SEQ ID NO: 3101491 - RNA, 17 nt, Mycobacterium bovis subsp bovis AF2122/97
gucuuccucggccaccc

SEQ ID NO: 3101492 - RNA, 19 nt, Mycobacterium bovis subsp bovis AF2122/97
gucuuccucggccacccgc

SEQ ID NO: 3101493 - RNA, 20 nt, Mycobacterium bovis subsp bovis AF2122/97
gucuucgccgucggcgacuc

SEQ ID NO: 3101494 - RNA, 14 nt, Mycobacterium bovis subsp bovis AF2122/97
gucuucgcugucga

SEQ ID NO: 3101495 - RNA, 21 nt, Mycobacterium bovis subsp bovis AF2122/97
gucuucgguuaaggugcgauc

SEQ ID NO: 3101496 - RNA, 19 nt, Mycobacterium bovis subsp bovis AF2122/97
gucuucgucauggccggcc

SEQ ID NO: 3101497 - RNA, 20 nt, Mycobacterium bovis subsp bovis AF2122/97
gucuucgucauggccggcca

SEQ ID NO: 3101498 - RNA, 20 nt, Mycobacterium bovis subsp bovis AF2122/97
gucuucgucgguguccucgg

SEQ ID NO: 3101499 - RNA, 19 nt, Mycobacterium bovis subsp bovis AF2122/97
gucuugacggcgccaggca

SEQ ID NO: 3101500 - RNA, 13 nt, Mycobacterium bovis subsp bovis AF2122/97
gucuugauguaau

SEQ ID NO: 3101501 - RNA, 21 nt, Mycobacterium bovis subsp bovis AF2122/97
gucuugcguccauccgcagca

SEQ ID NO: 3101502 - RNA, 21 nt, Mycobacterium bovis subsp bovis AF2122/97
gucuuggaaagcccgcucgga

SEQ ID NO: 3101503 - RNA, 16 nt, Mycobacterium bovis subsp bovis AF2122/97
gucuuggaaggcgcgc

SEQ ID NO: 3101504 - RNA, 15 nt, Mycobacterium bovis subsp bovis AF2122/97
gucuuggacagcagc

SEQ ID NO: 3101505 - RNA, 15 nt, Mycobacterium bovis subsp bovis AF2122/97
gucuuggcccggcgg

SEQ ID NO: 3101506 - RNA, 21 nt, Mycobacterium bovis subsp bovis AF2122/97
gucuuggcccgguccgccauu

SEQ ID NO: 3101507 - RNA, 14 nt, Mycobacterium bovis subsp bovis AF2122/97
gucuuggccggugc

SEQ ID NO: 3101508 - RNA, 16 nt, Mycobacterium bovis subsp bovis AF2122/97
gucuuggcggcggugc

SEQ ID NO: 3101509 - RNA, 17 nt, Mycobacterium bovis subsp bovis AF2122/97
gucuuggcggcggugca

SEQ ID NO: 3101510 - RNA, 22 nt, Mycobacterium bovis subsp bovis AF2122/97
gucuuggcggcggugcagcagg

SEQ ID NO: 3101511 - RNA, 14 nt, Mycobacterium bovis subsp bovis AF2122/97
gucuuggcgguggc

SEQ ID NO: 3101512 - RNA, 21 nt, Mycobacterium bovis subsp bovis AF2122/97
gucuugggucaggaucgcaau

SEQ ID NO: 3101513 - RNA, 13 nt, Mycobacterium bovis subsp bovis AF2122/97
gucuugggucucg

SEQ ID NO: 3101514 - RNA, 21 nt, Mycobacterium bovis subsp bovis AF2122/97
gucuuggugcgcgucagccgc

SEQ ID NO: 3101515 - RNA, 15 nt, Mycobacterium bovis subsp bovis AF2122/97
gucuugugcugcaag

SEQ ID NO: 3101516 - RNA, 12 nt, Mycobacterium bovis subsp bovis AF2122/97
gucuuguggugg

SEQ ID NO: 3101517 - RNA, 22 nt, Mycobacterium bovis subsp bovis AF2122/97
gucuuugcucucggucugcaug

SEQ ID NO: 3101518 - RNA, 23 nt, Mycobacterium bovis subsp bovis AF2122/97
gucuuugcucucggucugcaugc

SEQ ID NO: 3101519 - RNA, 22 nt, Mycobacterium bovis subsp bovis AF2122/97
gucuuugguuguuggugccagc

SEQ ID NO: 3101520 - RNA, 20 nt, Mycobacterium bovis subsp bovis AF2122/97
gucuuugucacgcaccgcgg

SEQ ID NO: 3101521 - RNA, 22 nt, Mycobacterium bovis subsp bovis AF2122/97
gugaaaaacgcccgcgcugccg

SEQ ID NO: 3101522 - RNA, 23 nt, Mycobacterium bovis subsp bovis AF2122/97
gugaaaaaggcgacucggugcgg

SEQ ID NO: 3101523 - RNA, 22 nt, Mycobacterium bovis subsp bovis AF2122/97
gugaaagacaacccgcucggcg

SEQ ID NO: 3101524 - RNA, 16 nt, Mycobacterium bovis subsp bovis AF2122/97
gugaaaucgcacagcg

SEQ ID NO: 3101525 - RNA, 19 nt, Mycobacterium bovis subsp bovis AF2122/97
gugaaaucgcacagcgcga

SEQ ID NO: 3101526 - RNA, 17 nt, Mycobacterium bovis subsp bovis AF2122/97
gugaaaugacggcugaa

SEQ ID NO: 3101527 - RNA, 14 nt, Mycobacterium bovis subsp bovis AF2122/97
gugaaaugcgcgau

SEQ ID NO: 3101528 - RNA, 16 nt, Mycobacterium bovis subsp bovis AF2122/97
gugaaauucgcggcgg

SEQ ID NO: 3101529 - RNA, 17 nt, Mycobacterium bovis subsp bovis AF2122/97
gugaaauucgcggcggu

SEQ ID NO: 3101530 - RNA, 17 nt, Mycobacterium bovis subsp bovis AF2122/97
gugaacacgucgcggua

SEQ ID NO: 3101531 - RNA, 13 nt, Mycobacterium bovis subsp bovis AF2122/97
gugaacagcaggu

SEQ ID NO: 3101532 - RNA, 16 nt, Mycobacterium bovis subsp bovis AF2122/97
gugaacagcgcgucgg

SEQ ID NO: 3101533 - RNA, 21 nt, Mycobacterium bovis subsp bovis AF2122/97
gugaacaggccgaggcgaguu

SEQ ID NO: 3101534 - RNA, 15 nt, Mycobacterium bovis subsp bovis AF2122/97
gugaacauuggguac

SEQ ID NO: 3101535 - RNA, 19 nt, Mycobacterium bovis subsp bovis AF2122/97
gugaaccaccacuucggcg

SEQ ID NO: 3101536 - RNA, 22 nt, Mycobacterium bovis subsp bovis AF2122/97
gugaaccaccacuucggcgccg

SEQ ID NO: 3101537 - RNA, 16 nt, Mycobacterium bovis subsp bovis AF2122/97
gugaaccacucgguga

SEQ ID NO: 3101538 - RNA, 12 nt, Mycobacterium bovis subsp bovis AF2122/97
gugaaccgcgcg

SEQ ID NO: 3101539 - RNA, 15 nt, Mycobacterium bovis subsp bovis AF2122/97
gugaaccgcgcggcg

SEQ ID NO: 3101540 - RNA, 16 nt, Mycobacterium bovis subsp bovis AF2122/97
gugaaccgcgcggcga

SEQ ID NO: 3101541 - RNA, 17 nt, Mycobacterium bovis subsp bovis AF2122/97
gugaaccggaccugggu

SEQ ID NO: 3101542 - RNA, 15 nt, Mycobacterium bovis subsp bovis AF2122/97
gugaaccuggcgacg

SEQ ID NO: 3101543 - RNA, 20 nt, Mycobacterium bovis subsp bovis AF2122/97
gugaaccuggcgacgcgaca

SEQ ID NO: 3101544 - RNA, 23 nt, Mycobacterium bovis subsp bovis AF2122/97
gugaaccuuacgacgccguaucg

SEQ ID NO: 3101545 - RNA, 23 nt, Mycobacterium bovis subsp bovis AF2122/97
gugaacgaagggaaggacgcgca

SEQ ID NO: 3101546 - RNA, 18 nt, Mycobacterium bovis subsp bovis AF2122/97
gugaacgcggacaccgcg

SEQ ID NO: 3101547 - RNA, 14 nt, Mycobacterium bovis subsp bovis AF2122/97
gugaacggcaaggu

SEQ ID NO: 3101548 - RNA, 20 nt, Mycobacterium bovis subsp bovis AF2122/97
gugaacggcaaggucgcggc

SEQ ID NO: 3101549 - RNA, 14 nt, Mycobacterium bovis subsp bovis AF2122/97
gugaacggcagcac

SEQ ID NO: 3101550 - RNA, 16 nt, Mycobacterium bovis subsp bovis AF2122/97
gugaacggcagcacgg

SEQ ID NO: 3101551 - RNA, 14 nt, Mycobacterium bovis subsp bovis AF2122/97
gugaacggcgcggg

SEQ ID NO: 3101552 - RNA, 14 nt, Mycobacterium bovis subsp bovis AF2122/97
gugaacggcucggg

SEQ ID NO: 3101553 - RNA, 16 nt, Mycobacterium bovis subsp bovis AF2122/97
gugaacggcucgggca

SEQ ID NO: 3101554 - RNA, 22 nt, Mycobacterium bovis subsp bovis AF2122/97
gugaacggcucgggcagcguca

SEQ ID NO: 3101555 - RNA, 18 nt, Mycobacterium bovis subsp bovis AF2122/97
gugaacggugucaacggc

SEQ ID NO: 3101556 - RNA, 14 nt, Mycobacterium bovis subsp bovis AF2122/97
gugaacucacggcg

SEQ ID NO: 3101557 - RNA, 16 nt, Mycobacterium bovis subsp bovis AF2122/97
gugaacucacggcggu

SEQ ID NO: 3101558 - RNA, 22 nt, Mycobacterium bovis subsp bovis AF2122/97
gugaacugguugacgucgaugu

SEQ ID NO: 3101559 - RNA, 14 nt, Mycobacterium bovis subsp bovis AF2122/97
gugaacuguccggg

SEQ ID NO: 3101560 - RNA, 15 nt, Mycobacterium bovis subsp bovis AF2122/97
gugaacuguccgggu

SEQ ID NO: 3101561 - RNA, 19 nt, Mycobacterium bovis subsp bovis AF2122/97
gugaacuucuccaccagcg

SEQ ID NO: 3101562 - RNA, 20 nt, Mycobacterium bovis subsp bovis AF2122/97
gugaacuucuccaccagcgu

SEQ ID NO: 3101563 - RNA, 23 nt, Mycobacterium bovis subsp bovis AF2122/97
gugaagaaguucggguagccggg

SEQ ID NO: 3101564 - RNA, 15 nt, Mycobacterium bovis subsp bovis AF2122/97
gugaagacaccggcg

SEQ ID NO: 3101565 - RNA, 14 nt, Mycobacterium bovis subsp bovis AF2122/97
gugaagaccaccgc

SEQ ID NO: 3101566 - RNA, 16 nt, Mycobacterium bovis subsp bovis AF2122/97
gugaagaccaccgccc

SEQ ID NO: 3101567 - RNA, 19 nt, Mycobacterium bovis subsp bovis AF2122/97
gugaagagaagucucgcgg

SEQ ID NO: 3101568 - RNA, 19 nt, Mycobacterium bovis subsp bovis AF2122/97
gugaagcccuggccagcga

SEQ ID NO: 3101569 - RNA, 16 nt, Mycobacterium bovis subsp bovis AF2122/97
gugaagccgagcgccc

SEQ ID NO: 3101570 - RNA, 17 nt, Mycobacterium bovis subsp bovis AF2122/97
gugaaggaugcggcccc

SEQ ID NO: 3101571 - RNA, 18 nt, Mycobacterium bovis subsp bovis AF2122/97
gugaaggcaaacaccagc

SEQ ID NO: 3101572 - RNA, 22 nt, Mycobacterium bovis subsp bovis AF2122/97
gugaaggcaaacaccagcccgg

SEQ ID NO: 3101573 - RNA, 16 nt, Mycobacterium bovis subsp bovis AF2122/97
gugaaggccccgccgg

SEQ ID NO: 3101574 - RNA, 16 nt, Mycobacterium bovis subsp bovis AF2122/97
gugaagggauccggaa

SEQ ID NO: 3101575 - RNA, 23 nt, Mycobacterium bovis subsp bovis AF2122/97
gugaaguccuccacgcuggcgcc

SEQ ID NO: 3101576 - RNA, 15 nt, Mycobacterium bovis subsp bovis AF2122/97
gugaagucggugccg

SEQ ID NO: 3101577 - RNA, 17 nt, Mycobacterium bovis subsp bovis AF2122/97
gugaagucggugccgag

SEQ ID NO: 3101578 - RNA, 21 nt, Mycobacterium bovis subsp bovis AF2122/97
gugaagugggcguuggcggca

SEQ ID NO: 3101579 - RNA, 19 nt, Mycobacterium bovis subsp bovis AF2122/97
gugaaguugccggucaggc

SEQ ID NO: 3101580 - RNA, 19 nt, Mycobacterium bovis subsp bovis AF2122/97
gugaauaucucgccguaca

SEQ ID NO: 3101581 - RNA, 14 nt, Mycobacterium bovis subsp bovis AF2122/97
gugaauccgugcag

SEQ ID NO: 3101582 - RNA, 16 nt, Mycobacterium bovis subsp bovis AF2122/97
gugaauccgugcaggg

SEQ ID NO: 3101583 - RNA, 20 nt, Mycobacterium bovis subsp bovis AF2122/97
gugaaucgcacgacgcgaca

SEQ ID NO: 3101584 - RNA, 12 nt, Mycobacterium bovis subsp bovis AF2122/97
gugaaugccguc

SEQ ID NO: 3101585 - RNA, 14 nt, Mycobacterium bovis subsp bovis AF2122/97
gugaauggcagcac

SEQ ID NO: 3101586 - RNA, 22 nt, Mycobacterium bovis subsp bovis AF2122/97
gugaauguugccgccgcggcgc

SEQ ID NO: 3101587 - RNA, 13 nt, Mycobacterium bovis subsp bovis AF2122/97
gugaauucggcga

SEQ ID NO: 3101588 - RNA, 21 nt, Mycobacterium bovis subsp bovis AF2122/97
gugacaaaucggccaucauga

SEQ ID NO: 3101589 - RNA, 16 nt, Mycobacterium bovis subsp bovis AF2122/97
gugacaaauggggugu

SEQ ID NO: 3101590 - RNA, 15 nt, Mycobacterium bovis subsp bovis AF2122/97
gugacaaauucggcg

SEQ ID NO: 3101591 - RNA, 13 nt, Mycobacterium bovis subsp bovis AF2122/97
gugacaaccgcgc

SEQ ID NO: 3101592 - RNA, 22 nt, Mycobacterium bovis subsp bovis AF2122/97
gugacaaccguuguaccccagc

SEQ ID NO: 3101593 - RNA, 23 nt, Mycobacterium bovis subsp bovis AF2122/97
gugacaaccguuguaccccagca

SEQ ID NO: 3101594 - RNA, 17 nt, Mycobacterium bovis subsp bovis AF2122/97
gugacaacgcgaugccg

SEQ ID NO: 3101595 - RNA, 19 nt, Mycobacterium bovis subsp bovis AF2122/97
gugacaaggugcgcugggu

SEQ ID NO: 3101596 - RNA, 13 nt, Mycobacterium bovis subsp bovis AF2122/97
gugacaccaacac

SEQ ID NO: 3101597 - RNA, 16 nt, Mycobacterium bovis subsp bovis AF2122/97
gugacaccaacaccgg

SEQ ID NO: 3101598 - RNA, 19 nt, Mycobacterium bovis subsp bovis AF2122/97
gugacaccaacaccggugg

SEQ ID NO: 3101599 - RNA, 14 nt, Mycobacterium bovis subsp bovis AF2122/97
gugacaccacaucg

SEQ ID NO: 3101600 - RNA, 20 nt, Mycobacterium bovis subsp bovis AF2122/97
gugacaccgaggucggccag

SEQ ID NO: 3101601 - RNA, 12 nt, Mycobacterium bovis subsp bovis AF2122/97
gugacacgacgu

SEQ ID NO: 3101602 - RNA, 15 nt, Mycobacterium bovis subsp bovis AF2122/97
gugacagcccgcugg

SEQ ID NO: 3101603 - RNA, 16 nt, Mycobacterium bovis subsp bovis AF2122/97
gugacagcccgcuggc

SEQ ID NO: 3101604 - RNA, 19 nt, Mycobacterium bovis subsp bovis AF2122/97
gugacagcccgcuggccgu

SEQ ID NO: 3101605 - RNA, 16 nt, Mycobacterium bovis subsp bovis AF2122/97
gugacauagacguugc

SEQ ID NO: 3101606 - RNA, 18 nt, Mycobacterium bovis subsp bovis AF2122/97
gugacaucgggccgccga

SEQ ID NO: 3101607 - RNA, 19 nt, Mycobacterium bovis subsp bovis AF2122/97
gugacaucgggccgccgag

SEQ ID NO: 3101608 - RNA, 13 nt, Mycobacterium bovis subsp bovis AF2122/97
gugacauucugca

SEQ ID NO: 3101609 - RNA, 17 nt, Mycobacterium bovis subsp bovis AF2122/97
gugaccacgccguggcc

SEQ ID NO: 3101610 - RNA, 15 nt, Mycobacterium bovis subsp bovis AF2122/97
gugaccacgcugcug

SEQ ID NO: 3101611 - RNA, 19 nt, Mycobacterium bovis subsp bovis AF2122/97
gugaccacgcugcugguga

SEQ ID NO: 3101612 - RNA, 15 nt, Mycobacterium bovis subsp bovis AF2122/97
gugaccagcaaccac

SEQ ID NO: 3101613 - RNA, 23 nt, Mycobacterium bovis subsp bovis AF2122/97
gugaccagcaaccaccccagggc

SEQ ID NO: 3101614 - RNA, 15 nt, Mycobacterium bovis subsp bovis AF2122/97
gugaccaggcggcgc

SEQ ID NO: 3101615 - RNA, 16 nt, Mycobacterium bovis subsp bovis AF2122/97
gugaccaggugccagg

SEQ ID NO: 3101616 - RNA, 17 nt, Mycobacterium bovis subsp bovis AF2122/97
gugaccagucgcggcgu

SEQ ID NO: 3101617 - RNA, 21 nt, Mycobacterium bovis subsp bovis AF2122/97
gugacccccagcagggugugc

SEQ ID NO: 3101618 - RNA, 16 nt, Mycobacterium bovis subsp bovis AF2122/97
gugacccgacaugguc

SEQ ID NO: 3101619 - RNA, 14 nt, Mycobacterium bovis subsp bovis AF2122/97
gugacccgccggcg

SEQ ID NO: 3101620 - RNA, 23 nt, Mycobacterium bovis subsp bovis AF2122/97
gugacccgccggcgacugcagcg

SEQ ID NO: 3101621 - RNA, 14 nt, Mycobacterium bovis subsp bovis AF2122/97
gugacccgcugggc

SEQ ID NO: 3101622 - RNA, 21 nt, Mycobacterium bovis subsp bovis AF2122/97
gugacccgcugggccgcaucg

SEQ ID NO: 3101623 - RNA, 18 nt, Mycobacterium bovis subsp bovis AF2122/97
gugacccucagcaccgcu

SEQ ID NO: 3101624 - RNA, 21 nt, Mycobacterium bovis subsp bovis AF2122/97
gugacccugaugaucguccag

SEQ ID NO: 3101625 - RNA, 23 nt, Mycobacterium bovis subsp bovis AF2122/97
gugacccugggguugcaucaugc

SEQ ID NO: 3101626 - RNA, 14 nt, Mycobacterium bovis subsp bovis AF2122/97
gugacccugguggu

SEQ ID NO: 3101627 - RNA, 16 nt, Mycobacterium bovis subsp bovis AF2122/97
gugaccgaccgccaug

SEQ ID NO: 3101628 - RNA, 19 nt, Mycobacterium bovis subsp bovis AF2122/97
gugaccgacugcggguucg

SEQ ID NO: 3101629 - RNA, 20 nt, Mycobacterium bovis subsp bovis AF2122/97
gugaccgagaucgucgcgac

SEQ ID NO: 3101630 - RNA, 13 nt, Mycobacterium bovis subsp bovis AF2122/97
gugaccgccgaug

SEQ ID NO: 3101631 - RNA, 16 nt, Mycobacterium bovis subsp bovis AF2122/97
gugaccgccgcgccgg

SEQ ID NO: 3101632 - RNA, 22 nt, Mycobacterium bovis subsp bovis AF2122/97
gugaccgcuggugugucccggg

SEQ ID NO: 3101633 - RNA, 23 nt, Mycobacterium bovis subsp bovis AF2122/97
gugaccggcgaucgggcggguga

SEQ ID NO: 3101634 - RNA, 12 nt, Mycobacterium bovis subsp bovis AF2122/97
gugaccggcggg

SEQ ID NO: 3101635 - RNA, 22 nt, Mycobacterium bovis subsp bovis AF2122/97
gugaccgggucgaucaccgaca

SEQ ID NO: 3101636 - RNA, 22 nt, Mycobacterium bovis subsp bovis AF2122/97
gugaccgguguuccgcccagcg

SEQ ID NO: 3101637 - RNA, 19 nt, Mycobacterium bovis subsp bovis AF2122/97
gugaccguauuucguccac

SEQ ID NO: 3101638 - RNA, 12 nt, Mycobacterium bovis subsp bovis AF2122/97
gugaccgugccg

SEQ ID NO: 3101639 - RNA, 17 nt, Mycobacterium bovis subsp bovis AF2122/97
gugaccgugccgucggc

SEQ ID NO: 3101640 - RNA, 16 nt, Mycobacterium bovis subsp bovis AF2122/97
gugaccuaccuccucg

SEQ ID NO: 3101641 - RNA, 13 nt, Mycobacterium bovis subsp bovis AF2122/97
gugaccucgaugg

SEQ ID NO: 3101642 - RNA, 12 nt, Mycobacterium bovis subsp bovis AF2122/97
gugaccucgucg

SEQ ID NO: 3101643 - RNA, 18 nt, Mycobacterium bovis subsp bovis AF2122/97
gugaccucgucggcgacg

SEQ ID NO: 3101644 - RNA, 22 nt, Mycobacterium bovis subsp bovis AF2122/97
gugaccugacgcucggucgcca

SEQ ID NO: 3101645 - RNA, 23 nt, Mycobacterium bovis subsp bovis AF2122/97
gugaccugacgcucggucgccac

SEQ ID NO: 3101646 - RNA, 15 nt, Mycobacterium bovis subsp bovis AF2122/97
gugaccugggcgccc

SEQ ID NO: 3101647 - RNA, 16 nt, Mycobacterium bovis subsp bovis AF2122/97
gugacgaaagcgccca

SEQ ID NO: 3101648 - RNA, 19 nt, Mycobacterium bovis subsp bovis AF2122/97
gugacgaacuucgaugccg

SEQ ID NO: 3101649 - RNA, 18 nt, Mycobacterium bovis subsp bovis AF2122/97
gugacgaagagcaccgcg

SEQ ID NO: 3101650 - RNA, 15 nt, Mycobacterium bovis subsp bovis AF2122/97
gugacgagcacaugc

SEQ ID NO: 3101651 - RNA, 14 nt, Mycobacterium bovis subsp bovis AF2122/97
gugacgagccacca

SEQ ID NO: 3101652 - RNA, 17 nt, Mycobacterium bovis subsp bovis AF2122/97
gugacgaguucgcugac

SEQ ID NO: 3101653 - RNA, 16 nt, Mycobacterium bovis subsp bovis AF2122/97
gugacgaucaagcugg

SEQ ID NO: 3101654 - RNA, 17 nt, Mycobacterium bovis subsp bovis AF2122/97
gugacgaucaagcuggc

SEQ ID NO: 3101655 - RNA, 15 nt, Mycobacterium bovis subsp bovis AF2122/97
gugacgaucacaugc

SEQ ID NO: 3101656 - RNA, 19 nt, Mycobacterium bovis subsp bovis AF2122/97
gugacgaucaggccgucgc

SEQ ID NO: 3101657 - RNA, 22 nt, Mycobacterium bovis subsp bovis AF2122/97
gugacgaucaggccgucgccgg

SEQ ID NO: 3101658 - RNA, 21 nt, Mycobacterium bovis subsp bovis AF2122/97
gugacgaucaggucgccgaga

SEQ ID NO: 3101659 - RNA, 20 nt, Mycobacterium bovis subsp bovis AF2122/97
gugacgauccccauugcgcc

SEQ ID NO: 3101660 - RNA, 20 nt, Mycobacterium bovis subsp bovis AF2122/97
gugacgaucguagccguagc

SEQ ID NO: 3101661 - RNA, 16 nt, Mycobacterium bovis subsp bovis AF2122/97
gugacgauugccacca

SEQ ID NO: 3101662 - RNA, 18 nt, Mycobacterium bovis subsp bovis AF2122/97
gugacgcaacaucggaug

SEQ ID NO: 3101663 - RNA, 15 nt, Mycobacterium bovis subsp bovis AF2122/97
gugacgcacagcagc

SEQ ID NO: 3101664 - RNA, 22 nt, Mycobacterium bovis subsp bovis AF2122/97
gugacgcacagcagcaccgcga

SEQ ID NO: 3101665 - RNA, 21 nt, Mycobacterium bovis subsp bovis AF2122/97
gugacgccacgaccgccgaua

SEQ ID NO: 3101666 - RNA, 17 nt, Mycobacterium bovis subsp bovis AF2122/97
gugacgccgccagcacc

SEQ ID NO: 3101667 - RNA, 21 nt, Mycobacterium bovis subsp bovis AF2122/97
gugacgccggccagucguacu

SEQ ID NO: 3101668 - RNA, 17 nt, Mycobacterium bovis subsp bovis AF2122/97
gugacgccucgacaccc

SEQ ID NO: 3101669 - RNA, 14 nt, Mycobacterium bovis subsp bovis AF2122/97
gugacgcuuggcca

SEQ ID NO: 3101670 - RNA, 18 nt, Mycobacterium bovis subsp bovis AF2122/97
gugacggcggcaacggcg

SEQ ID NO: 3101671 - RNA, 12 nt, Mycobacterium bovis subsp bovis AF2122/97
gugacggcggcc

SEQ ID NO: 3101672 - RNA, 20 nt, Mycobacterium bovis subsp bovis AF2122/97
gugacgggaaacuccgcggc

SEQ ID NO: 3101673 - RNA, 19 nt, Mycobacterium bovis subsp bovis AF2122/97
gugacggggcugaccgcca

SEQ ID NO: 3101674 - RNA, 17 nt, Mycobacterium bovis subsp bovis AF2122/97
gugacgguccacgacgu

SEQ ID NO: 3101675 - RNA, 20 nt, Mycobacterium bovis subsp bovis AF2122/97
gugacgguccacgacgucga

SEQ ID NO: 3101676 - RNA, 19 nt, Mycobacterium bovis subsp bovis AF2122/97
gugacgguccguucgaugc

SEQ ID NO: 3101677 - RNA, 14 nt, Mycobacterium bovis subsp bovis AF2122/97
gugacggucgucga

SEQ ID NO: 3101678 - RNA, 14 nt, Mycobacterium bovis subsp bovis AF2122/97
gugacguaccacgg

SEQ ID NO: 3101679 - RNA, 16 nt, Mycobacterium bovis subsp bovis AF2122/97
gugacguagggcagcg

SEQ ID NO: 3101680 - RNA, 16 nt, Mycobacterium bovis subsp bovis AF2122/97
gugacguagugcaccg

SEQ ID NO: 3101681 - RNA, 20 nt, Mycobacterium bovis subsp bovis AF2122/97
gugacguaucgccgcgggcg

SEQ ID NO: 3101682 - RNA, 18 nt, Mycobacterium bovis subsp bovis AF2122/97
gugacgucguggcgcucg

SEQ ID NO: 3101683 - RNA, 16 nt, Mycobacterium bovis subsp bovis AF2122/97
gugacguuccgcucgc

SEQ ID NO: 3101684 - RNA, 18 nt, Mycobacterium bovis subsp bovis AF2122/97
gugacguuggcaggcagg

SEQ ID NO: 3101685 - RNA, 19 nt, Mycobacterium bovis subsp bovis AF2122/97
gugacguuggcaggcaggu

SEQ ID NO: 3101686 - RNA, 15 nt, Mycobacterium bovis subsp bovis AF2122/97
gugacguugugccuu

SEQ ID NO: 3101687 - RNA, 21 nt, Mycobacterium bovis subsp bovis AF2122/97
gugacucaccgugaaccgccc

SEQ ID NO: 3101688 - RNA, 18 nt, Mycobacterium bovis subsp bovis AF2122/97
gugacucagaacguggcc

SEQ ID NO: 3101689 - RNA, 17 nt, Mycobacterium bovis subsp bovis AF2122/97
gugacuccggcuggaag

SEQ ID NO: 3101690 - RNA, 19 nt, Mycobacterium bovis subsp bovis AF2122/97
gugacugcgcgcguugcgg

SEQ ID NO: 3101691 - RNA, 13 nt, Mycobacterium bovis subsp bovis AF2122/97
gugacuggugaac

SEQ ID NO: 3101692 - RNA, 12 nt, Mycobacterium bovis subsp bovis AF2122/97
gugacugguggc

SEQ ID NO: 3101693 - RNA, 18 nt, Mycobacterium bovis subsp bovis AF2122/97
gugacugguggcgccaac

SEQ ID NO: 3101694 - RNA, 18 nt, Mycobacterium bovis subsp bovis AF2122/97
gugacuuauccggccagu

SEQ ID NO: 3101695 - RNA, 19 nt, Mycobacterium bovis subsp bovis AF2122/97
gugacuuauccggccagug

SEQ ID NO: 3101696 - RNA, 15 nt, Mycobacterium bovis subsp bovis AF2122/97
gugacuucacucguu

SEQ ID NO: 3101697 - RNA, 17 nt, Mycobacterium bovis subsp bovis AF2122/97
gugacuucgcugcggug

SEQ ID NO: 3101698 - RNA, 15 nt, Mycobacterium bovis subsp bovis AF2122/97
gugagaagaagccca

SEQ ID NO: 3101699 - RNA, 14 nt, Mycobacterium bovis subsp bovis AF2122/97
gugagaccagguuc

SEQ ID NO: 3101700 - RNA, 23 nt, Mycobacterium bovis subsp bovis AF2122/97
gugagaccuagcagggugccggc

SEQ ID NO: 3101701 - RNA, 21 nt, Mycobacterium bovis subsp bovis AF2122/97
gugagacgaaaagccgcgucg

SEQ ID NO: 3101702 - RNA, 21 nt, Mycobacterium bovis subsp bovis AF2122/97
gugagacugggcgcuggaggc

SEQ ID NO: 3101703 - RNA, 24 nt, Mycobacterium bovis subsp bovis AF2122/97
gugagaucaugaggugagcugcgg

SEQ ID NO: 3101704 - RNA, 16 nt, Mycobacterium bovis subsp bovis AF2122/97
gugagcaauggcgcga

SEQ ID NO: 3101705 - RNA, 18 nt, Mycobacterium bovis subsp bovis AF2122/97
gugagcaauggcgcgacc

SEQ ID NO: 3101706 - RNA, 12 nt, Mycobacterium bovis subsp bovis AF2122/97
gugagcacaccg

SEQ ID NO: 3101707 - RNA, 17 nt, Mycobacterium bovis subsp bovis AF2122/97
gugagcaccagcagcac

SEQ ID NO: 3101708 - RNA, 18 nt, Mycobacterium bovis subsp bovis AF2122/97
gugagcaccggauacagc

SEQ ID NO: 3101709 - RNA, 15 nt, Mycobacterium bovis subsp bovis AF2122/97
gugagcaccugggcg

SEQ ID NO: 3101710 - RNA, 16 nt, Mycobacterium bovis subsp bovis AF2122/97
gugagcaccugggcgc

SEQ ID NO: 3101711 - RNA, 15 nt, Mycobacterium bovis subsp bovis AF2122/97
gugagcagcaagacc

SEQ ID NO: 3101712 - RNA, 21 nt, Mycobacterium bovis subsp bovis AF2122/97
gugagcagcaagaccgcgcca

SEQ ID NO: 3101713 - RNA, 19 nt, Mycobacterium bovis subsp bovis AF2122/97
gugagcaugcgacgucagg

SEQ ID NO: 3101714 - RNA, 15 nt, Mycobacterium bovis subsp bovis AF2122/97
gugagcauggcuagg

SEQ ID NO: 3101715 - RNA, 15 nt, Mycobacterium bovis subsp bovis AF2122/97
gugagccaugccgcu

SEQ ID NO: 3101716 - RNA, 12 nt, Mycobacterium bovis subsp bovis AF2122/97
gugagccgggcg

SEQ ID NO: 3101717 - RNA, 15 nt, Mycobacterium bovis subsp bovis AF2122/97
gugagccgggcggcc

SEQ ID NO: 3101718 - RNA, 19 nt, Mycobacterium bovis subsp bovis AF2122/97
gugagccucuuggucaacg

SEQ ID NO: 3101719 - RNA, 14 nt, Mycobacterium bovis subsp bovis AF2122/97
gugagcgagcgcgc

SEQ ID NO: 3101720 - RNA, 18 nt, Mycobacterium bovis subsp bovis AF2122/97
gugagcgaucgggugcac

SEQ ID NO: 3101721 - RNA, 19 nt, Mycobacterium bovis subsp bovis AF2122/97
gugagcgcagcuugauccc

SEQ ID NO: 3101722 - RNA, 15 nt, Mycobacterium bovis subsp bovis AF2122/97
gugagcgcgucgcgg

SEQ ID NO: 3101723 - RNA, 14 nt, Mycobacterium bovis subsp bovis AF2122/97
gugagcggcaugcg

SEQ ID NO: 3101724 - RNA, 11 nt, Mycobacterium bovis subsp bovis AF2122/97
gugagcgggca

SEQ ID NO: 3101725 - RNA, 15 nt, Mycobacterium bovis subsp bovis AF2122/97
gugagcuacucacgg

SEQ ID NO: 3101726 - RNA, 20 nt, Mycobacterium bovis subsp bovis AF2122/97
gugagcuacucacggugauc

SEQ ID NO: 3101727 - RNA, 18 nt, Mycobacterium bovis subsp bovis AF2122/97
gugagcuaugcuggcagc

SEQ ID NO: 3101728 - RNA, 22 nt, Mycobacterium bovis subsp bovis AF2122/97
gugagcucagcaaguucgucgg

SEQ ID NO: 3101729 - RNA, 14 nt, Mycobacterium bovis subsp bovis AF2122/97
gugagcucgcgcag

SEQ ID NO: 3101730 - RNA, 16 nt, Mycobacterium bovis subsp bovis AF2122/97
gugagcucggcugcuc

SEQ ID NO: 3101731 - RNA, 14 nt, Mycobacterium bovis subsp bovis AF2122/97
gugagcugcggggu

SEQ ID NO: 3101732 - RNA, 21 nt, Mycobacterium bovis subsp bovis AF2122/97
gugagcuuagcgcaugggccu

SEQ ID NO: 3101733 - RNA, 23 nt, Mycobacterium bovis subsp bovis AF2122/97
gugagcuuagcgcaugggccuug

SEQ ID NO: 3101734 - RNA, 20 nt, Mycobacterium bovis subsp bovis AF2122/97
gugagcuuuaucugcaugcc

SEQ ID NO: 3101735 - RNA, 15 nt, Mycobacterium bovis subsp bovis AF2122/97
gugaggccaaccaca

SEQ ID NO: 3101736 - RNA, 12 nt, Mycobacterium bovis subsp bovis AF2122/97
gugaggcccccc

SEQ ID NO: 3101737 - RNA, 16 nt, Mycobacterium bovis subsp bovis AF2122/97
gugaggccccccgcgc

SEQ ID NO: 3101738 - RNA, 17 nt, Mycobacterium bovis subsp bovis AF2122/97
gugagggucccacggcg

SEQ ID NO: 3101739 - RNA, 13 nt, Mycobacterium bovis subsp bovis AF2122/97
gugagguagucgg

SEQ ID NO: 3101740 - RNA, 17 nt, Mycobacterium bovis subsp bovis AF2122/97
gugagguagucggcgcg

SEQ ID NO: 3101741 - RNA, 20 nt, Mycobacterium bovis subsp bovis AF2122/97
gugaggugaccaacggugcu

SEQ ID NO: 3101742 - RNA, 19 nt, Mycobacterium bovis subsp bovis AF2122/97
gugaguaccaauccaggcc

SEQ ID NO: 3101743 - RNA, 15 nt, Mycobacterium bovis subsp bovis AF2122/97
gugagucacccggcc

SEQ ID NO: 3101744 - RNA, 15 nt, Mycobacterium bovis subsp bovis AF2122/97
gugagucccacgcca

SEQ ID NO: 3101745 - RNA, 16 nt, Mycobacterium bovis subsp bovis AF2122/97
gugagucccacgccag

SEQ ID NO: 3101746 - RNA, 21 nt, Mycobacterium bovis subsp bovis AF2122/97
gugaguggcucgcucugcgcg

SEQ ID NO: 3101747 - RNA, 22 nt, Mycobacterium bovis subsp bovis AF2122/97
gugauagaggauaucgccgaga

SEQ ID NO: 3101748 - RNA, 17 nt, Mycobacterium bovis subsp bovis AF2122/97
gugauagcuugcgucgc

SEQ ID NO: 3101749 - RNA, 20 nt, Mycobacterium bovis subsp bovis AF2122/97
gugauaucagagggccgcgg

SEQ ID NO: 3101750 - RNA, 16 nt, Mycobacterium bovis subsp bovis AF2122/97
gugaucaaaccggcgg

SEQ ID NO: 3101751 - RNA, 22 nt, Mycobacterium bovis subsp bovis AF2122/97
gugaucaaaccggcggcgacgg

SEQ ID NO: 3101752 - RNA, 20 nt, Mycobacterium bovis subsp bovis AF2122/97
gugaucaacuuccgcagcgc

SEQ ID NO: 3101753 - RNA, 19 nt, Mycobacterium bovis subsp bovis AF2122/97
gugaucaccaugaucagcg

SEQ ID NO: 3101754 - RNA, 16 nt, Mycobacterium bovis subsp bovis AF2122/97
gugaucacccgcaucg

SEQ ID NO: 3101755 - RNA, 13 nt, Mycobacterium bovis subsp bovis AF2122/97
gugaucaccgaca

SEQ ID NO: 3101756 - RNA, 13 nt, Mycobacterium bovis subsp bovis AF2122/97
gugaucaccggca

SEQ ID NO: 3101757 - RNA, 24 nt, Mycobacterium bovis subsp bovis AF2122/97
gugaucacgucggauccgcccgcc

SEQ ID NO: 3101758 - RNA, 13 nt, Mycobacterium bovis subsp bovis AF2122/97
gugaucagcagga

SEQ ID NO: 3101759 - RNA, 15 nt, Mycobacterium bovis subsp bovis AF2122/97
gugaucagccaccgg

SEQ ID NO: 3101760 - RNA, 12 nt, Mycobacterium bovis subsp bovis AF2122/97
gugaucagcgca

SEQ ID NO: 3101761 - RNA, 14 nt, Mycobacterium bovis subsp bovis AF2122/97
gugaucagcucgcg

SEQ ID NO: 3101762 - RNA, 17 nt, Mycobacterium bovis subsp bovis AF2122/97
gugaucagcucgcgcac

SEQ ID NO: 3101763 - RNA, 18 nt, Mycobacterium bovis subsp bovis AF2122/97
gugauccaacuggccgcg

SEQ ID NO: 3101764 - RNA, 17 nt, Mycobacterium bovis subsp bovis AF2122/97
gugaucccgauggucac

SEQ ID NO: 3101765 - RNA, 14 nt, Mycobacterium bovis subsp bovis AF2122/97
gugaucccgcccaa

SEQ ID NO: 3101766 - RNA, 17 nt, Mycobacterium bovis subsp bovis AF2122/97
gugauccgagaccaugc

SEQ ID NO: 3101767 - RNA, 14 nt, Mycobacterium bovis subsp bovis AF2122/97
gugauccgguggug

SEQ ID NO: 3101768 - RNA, 18 nt, Mycobacterium bovis subsp bovis AF2122/97
gugaucgaaaacgggggc

SEQ ID NO: 3101769 - RNA, 23 nt, Mycobacterium bovis subsp bovis AF2122/97
gugaucgaacugggggccggcac

SEQ ID NO: 3101770 - RNA, 14 nt, Mycobacterium bovis subsp bovis AF2122/97
gugaucgaggcggc

SEQ ID NO: 3101771 - RNA, 15 nt, Mycobacterium bovis subsp bovis AF2122/97
gugaucgaggcggcg

SEQ ID NO: 3101772 - RNA, 21 nt, Mycobacterium bovis subsp bovis AF2122/97
gugaucgagguugacgucagg

SEQ ID NO: 3101773 - RNA, 21 nt, Mycobacterium bovis subsp bovis AF2122/97
gugaucgaucgcggcgcccag

SEQ ID NO: 3101774 - RNA, 22 nt, Mycobacterium bovis subsp bovis AF2122/97
gugaucgaucgcggcgcccagg

SEQ ID NO: 3101775 - RNA, 12 nt, Mycobacterium bovis subsp bovis AF2122/97
gugaucgcacag

SEQ ID NO: 3101776 - RNA, 22 nt, Mycobacterium bovis subsp bovis AF2122/97
gugaucgccaccgguaccggcg

SEQ ID NO: 3101777 - RNA, 17 nt, Mycobacterium bovis subsp bovis AF2122/97
gugaucgcgguggcuuc

SEQ ID NO: 3101778 - RNA, 18 nt, Mycobacterium bovis subsp bovis AF2122/97
gugaucggcgaacccacc

SEQ ID NO: 3101779 - RNA, 20 nt, Mycobacterium bovis subsp bovis AF2122/97
gugaucggcgauccgacgac

SEQ ID NO: 3101780 - RNA, 13 nt, Mycobacterium bovis subsp bovis AF2122/97
gugaucgggcagc

SEQ ID NO: 3101781 - RNA, 16 nt, Mycobacterium bovis subsp bovis AF2122/97
gugaucgggcagcacg

SEQ ID NO: 3101782 - RNA, 23 nt, Mycobacterium bovis subsp bovis AF2122/97
gugaucggguacccaucugcuca

SEQ ID NO: 3101783 - RNA, 17 nt, Mycobacterium bovis subsp bovis AF2122/97
gugaucgugaccggcaa

SEQ ID NO: 3101784 - RNA, 18 nt, Mycobacterium bovis subsp bovis AF2122/97
gugaucugcccugcacuu

SEQ ID NO: 3101785 - RNA, 19 nt, Mycobacterium bovis subsp bovis AF2122/97
gugaucugguccggcaaca

SEQ ID NO: 3101786 - RNA, 20 nt, Mycobacterium bovis subsp bovis AF2122/97
gugaucuucugccuuggccg

SEQ ID NO: 3101787 - RNA, 20 nt, Mycobacterium bovis subsp bovis AF2122/97
gugaucuuggcgcccgccgg

SEQ ID NO: 3101788 - RNA, 17 nt, Mycobacterium bovis subsp bovis AF2122/97
gugaugaacaccggcgc

SEQ ID NO: 3101789 - RNA, 18 nt, Mycobacterium bovis subsp bovis AF2122/97
gugaugaacaccggcgcc

SEQ ID NO: 3101790 - RNA, 19 nt, Mycobacterium bovis subsp bovis AF2122/97
gugaugaauucgcuugcag

SEQ ID NO: 3101791 - RNA, 16 nt, Mycobacterium bovis subsp bovis AF2122/97
gugaugacgccgucgg

SEQ ID NO: 3101792 - RNA, 18 nt, Mycobacterium bovis subsp bovis AF2122/97
gugaugacgccgucggcg

SEQ ID NO: 3101793 - RNA, 14 nt, Mycobacterium bovis subsp bovis AF2122/97
gugaugagucaggc

SEQ ID NO: 3101794 - RNA, 12 nt, Mycobacterium bovis subsp bovis AF2122/97
gugaugccacgg

SEQ ID NO: 3101795 - RNA, 18 nt, Mycobacterium bovis subsp bovis AF2122/97
gugaugccacggcgucgc

SEQ ID NO: 3101796 - RNA, 21 nt, Mycobacterium bovis subsp bovis AF2122/97
gugaugccacggcgucgcucg

SEQ ID NO: 3101797 - RNA, 16 nt, Mycobacterium bovis subsp bovis AF2122/97
gugaugccaucaacga

SEQ ID NO: 3101798 - RNA, 17 nt, Mycobacterium bovis subsp bovis AF2122/97
gugaugcccugggggug

SEQ ID NO: 3101799 - RNA, 18 nt, Mycobacterium bovis subsp bovis AF2122/97
gugaugcccugggggugg

SEQ ID NO: 3101800 - RNA, 19 nt, Mycobacterium bovis subsp bovis AF2122/97
gugaugcccuggggguggc

SEQ ID NO: 3101801 - RNA, 12 nt, Mycobacterium bovis subsp bovis AF2122/97
gugaugcgcccc

SEQ ID NO: 3101802 - RNA, 15 nt, Mycobacterium bovis subsp bovis AF2122/97
gugaugcggucgcgg

SEQ ID NO: 3101803 - RNA, 17 nt, Mycobacterium bovis subsp bovis AF2122/97
gugauggccgaccagcc

SEQ ID NO: 3101804 - RNA, 18 nt, Mycobacterium bovis subsp bovis AF2122/97
gugauggccgaccagccg

SEQ ID NO: 3101805 - RNA, 13 nt, Mycobacterium bovis subsp bovis AF2122/97
gugauggccgcgc

SEQ ID NO: 3101806 - RNA, 14 nt, Mycobacterium bovis subsp bovis AF2122/97
gugaugggggagcc

SEQ ID NO: 3101807 - RNA, 19 nt, Mycobacterium bovis subsp bovis AF2122/97
gugaugggggagccgguga

SEQ ID NO: 3101808 - RNA, 22 nt, Mycobacterium bovis subsp bovis AF2122/97
gugaugggggagccggugacgg

SEQ ID NO: 3101809 - RNA, 18 nt, Mycobacterium bovis subsp bovis AF2122/97
gugauggucagcuggccg

SEQ ID NO: 3101810 - RNA, 15 nt, Mycobacterium bovis subsp bovis AF2122/97
gugauggugaccagc

SEQ ID NO: 3101811 - RNA, 22 nt, Mycobacterium bovis subsp bovis AF2122/97
gugauggugacuucgguggcgg

SEQ ID NO: 3101812 - RNA, 13 nt, Mycobacterium bovis subsp bovis AF2122/97
gugaugguugcuc

SEQ ID NO: 3101813 - RNA, 14 nt, Mycobacterium bovis subsp bovis AF2122/97
gugaugguugcucg

SEQ ID NO: 3101814 - RNA, 13 nt, Mycobacterium bovis subsp bovis AF2122/97
gugauguagcugc

SEQ ID NO: 3101815 - RNA, 17 nt, Mycobacterium bovis subsp bovis AF2122/97
gugauguagggcugcuc

SEQ ID NO: 3101816 - RNA, 19 nt, Mycobacterium bovis subsp bovis AF2122/97
gugauguagggcugcuccu

SEQ ID NO: 3101817 - RNA, 13 nt, Mycobacterium bovis subsp bovis AF2122/97
gugaugucaacgu

SEQ ID NO: 3101818 - RNA, 14 nt, Mycobacterium bovis subsp bovis AF2122/97
gugaugucggugcg

SEQ ID NO: 3101819 - RNA, 23 nt, Mycobacterium bovis subsp bovis AF2122/97
gugaugucuaccaacaccgcccg

SEQ ID NO: 3101820 - RNA, 22 nt, Mycobacterium bovis subsp bovis AF2122/97
gugauugagcagcaagccgccg

SEQ ID NO: 3101821 - RNA, 16 nt, Mycobacterium bovis subsp bovis AF2122/97
gugauugagcucaggu

SEQ ID NO: 3101822 - RNA, 16 nt, Mycobacterium bovis subsp bovis AF2122/97
gugauugcggccgccg

SEQ ID NO: 3101823 - RNA, 17 nt, Mycobacterium bovis subsp bovis AF2122/97
gugauugcggccgccga

SEQ ID NO: 3101824 - RNA, 18 nt, Mycobacterium bovis subsp bovis AF2122/97
gugauugcggccgccgag

SEQ ID NO: 3101825 - RNA, 23 nt, Mycobacterium bovis subsp bovis AF2122/97
gugauugcggccgccgagucaaa

SEQ ID NO: 3101826 - RNA, 18 nt, Mycobacterium bovis subsp bovis AF2122/97
gugauuucaacgucgcgu

SEQ ID NO: 3101827 - RNA, 15 nt, Mycobacterium bovis subsp bovis AF2122/97
gugcaaaggcgccgu

SEQ ID NO: 3101828 - RNA, 19 nt, Mycobacterium bovis subsp bovis AF2122/97
gugcaacaggcgcgucggu

SEQ ID NO: 3101829 - RNA, 21 nt, Mycobacterium bovis subsp bovis AF2122/97
gugcaaccauggcggcuccgc

SEQ ID NO: 3101830 - RNA, 22 nt, Mycobacterium bovis subsp bovis AF2122/97
gugcaaccauggcggcuccgcc

SEQ ID NO: 3101831 - RNA, 23 nt, Mycobacterium bovis subsp bovis AF2122/97
gugcaaccccaaguccagcagcg

SEQ ID NO: 3101832 - RNA, 17 nt, Mycobacterium bovis subsp bovis AF2122/97
gugcaaccgugccgcau

SEQ ID NO: 3101833 - RNA, 22 nt, Mycobacterium bovis subsp bovis AF2122/97
gugcaacggcguuggcgccguu

SEQ ID NO: 3101834 - RNA, 17 nt, Mycobacterium bovis subsp bovis AF2122/97
gugcaaucgcgugcugg

SEQ ID NO: 3101835 - RNA, 20 nt, Mycobacterium bovis subsp bovis AF2122/97
gugcacaacccgugcaggau

SEQ ID NO: 3101836 - RNA, 14 nt, Mycobacterium bovis subsp bovis AF2122/97
gugcacaacgccca

SEQ ID NO: 3101837 - RNA, 23 nt, Mycobacterium bovis subsp bovis AF2122/97
gugcacaacgcccaccacgcgac

SEQ ID NO: 3101838 - RNA, 16 nt, Mycobacterium bovis subsp bovis AF2122/97
gugcacaccgucgcac

SEQ ID NO: 3101839 - RNA, 20 nt, Mycobacterium bovis subsp bovis AF2122/97
gugcacaccgucgcgcucgc

SEQ ID NO: 3101840 - RNA, 19 nt, Mycobacterium bovis subsp bovis AF2122/97
gugcacacucaacccgccg

SEQ ID NO: 3101841 - RNA, 21 nt, Mycobacterium bovis subsp bovis AF2122/97
gugcacacugguggugcccgg

SEQ ID NO: 3101842 - RNA, 14 nt, Mycobacterium bovis subsp bovis AF2122/97
gugcaccagcgacc

SEQ ID NO: 3101843 - RNA, 19 nt, Mycobacterium bovis subsp bovis AF2122/97
gugcaccagcgaccagguc

SEQ ID NO: 3101844 - RNA, 16 nt, Mycobacterium bovis subsp bovis AF2122/97
gugcaccagcucaccc

SEQ ID NO: 3101845 - RNA, 18 nt, Mycobacterium bovis subsp bovis AF2122/97
gugcaccgaagauggcca

SEQ ID NO: 3101846 - RNA, 21 nt, Mycobacterium bovis subsp bovis AF2122/97
gugcaccgaagauggccagcg

SEQ ID NO: 3101847 - RNA, 16 nt, Mycobacterium bovis subsp bovis AF2122/97
gugcaccgcgaccgcg

SEQ ID NO: 3101848 - RNA, 21 nt, Mycobacterium bovis subsp bovis AF2122/97
gugcaccgcgucguagccacg

SEQ ID NO: 3101849 - RNA, 13 nt, Mycobacterium bovis subsp bovis AF2122/97
gugcaccgucggg

SEQ ID NO: 3101850 - RNA, 18 nt, Mycobacterium bovis subsp bovis AF2122/97
gugcaccucguguccggg

SEQ ID NO: 3101851 - RNA, 19 nt, Mycobacterium bovis subsp bovis AF2122/97
gugcaccuggaucagggcu

SEQ ID NO: 3101852 - RNA, 21 nt, Mycobacterium bovis subsp bovis AF2122/97
gugcacgaaguccuggcagac

SEQ ID NO: 3101853 - RNA, 14 nt, Mycobacterium bovis subsp bovis AF2122/97
gugcacgagcggac

SEQ ID NO: 3101854 - RNA, 17 nt, Mycobacterium bovis subsp bovis AF2122/97
gugcacgaucgcgguga

SEQ ID NO: 3101855 - RNA, 13 nt, Mycobacterium bovis subsp bovis AF2122/97
gugcacgcgggcg

SEQ ID NO: 3101856 - RNA, 16 nt, Mycobacterium bovis subsp bovis AF2122/97
gugcacgcucggcgcc

SEQ ID NO: 3101857 - RNA, 20 nt, Mycobacterium bovis subsp bovis AF2122/97
gugcacggcgaggccgaacu

SEQ ID NO: 3101858 - RNA, 20 nt, Mycobacterium bovis subsp bovis AF2122/97
gugcacggcgaggugcucgg

SEQ ID NO: 3101859 - RNA, 14 nt, Mycobacterium bovis subsp bovis AF2122/97
gugcacggcggcca

SEQ ID NO: 3101860 - RNA, 18 nt, Mycobacterium bovis subsp bovis AF2122/97
gugcacggcuucggcgag

SEQ ID NO: 3101861 - RNA, 22 nt, Mycobacterium bovis subsp bovis AF2122/97
gugcacuacaggguuggcagcc

SEQ ID NO: 3101862 - RNA, 23 nt, Mycobacterium bovis subsp bovis AF2122/97
gugcacuacaggguuggcagcca

SEQ ID NO: 3101863 - RNA, 14 nt, Mycobacterium bovis subsp bovis AF2122/97
gugcacugaccgcg

SEQ ID NO: 3101864 - RNA, 21 nt, Mycobacterium bovis subsp bovis AF2122/97
gugcagacaggcggcggccug

SEQ ID NO: 3101865 - RNA, 18 nt, Mycobacterium bovis subsp bovis AF2122/97
gugcagaccaccgccugg

SEQ ID NO: 3101866 - RNA, 19 nt, Mycobacterium bovis subsp bovis AF2122/97
gugcagaccaccgccugga

SEQ ID NO: 3101867 - RNA, 16 nt, Mycobacterium bovis subsp bovis AF2122/97
gugcagaucgucgccg

SEQ ID NO: 3101868 - RNA, 17 nt, Mycobacterium bovis subsp bovis AF2122/97
gugcagaucgucgccga

SEQ ID NO: 3101869 - RNA, 14 nt, Mycobacterium bovis subsp bovis AF2122/97
gugcagcaccagcc

SEQ ID NO: 3101870 - RNA, 20 nt, Mycobacterium bovis subsp bovis AF2122/97
gugcagcaccagccaaauca

SEQ ID NO: 3101871 - RNA, 19 nt, Mycobacterium bovis subsp bovis AF2122/97
gugcagcacggcgccgcca

SEQ ID NO: 3101872 - RNA, 21 nt, Mycobacterium bovis subsp bovis AF2122/97
gugcagcacguccgcggagcu

SEQ ID NO: 3101873 - RNA, 14 nt, Mycobacterium bovis subsp bovis AF2122/97
gugcagcacgugug

SEQ ID NO: 3101874 - RNA, 21 nt, Mycobacterium bovis subsp bovis AF2122/97
gugcagcagcauccggccguc

SEQ ID NO: 3101875 - RNA, 15 nt, Mycobacterium bovis subsp bovis AF2122/97
gugcagcagcgcgcg

SEQ ID NO: 3101876 - RNA, 19 nt, Mycobacterium bovis subsp bovis AF2122/97
gugcagcagcgcgcggaug

SEQ ID NO: 3101877 - RNA, 23 nt, Mycobacterium bovis subsp bovis AF2122/97
gugcagcaggaaguagccgagcc

SEQ ID NO: 3101878 - RNA, 19 nt, Mycobacterium bovis subsp bovis AF2122/97
gugcagcccaaggcgacga

SEQ ID NO: 3101879 - RNA, 14 nt, Mycobacterium bovis subsp bovis AF2122/97
gugcagcccgccgg

SEQ ID NO: 3101880 - RNA, 16 nt, Mycobacterium bovis subsp bovis AF2122/97
gugcagccgcaggugg

SEQ ID NO: 3101881 - RNA, 23 nt, Mycobacterium bovis subsp bovis AF2122/97
gugcagcgacuccguaccggguu

SEQ ID NO: 3101882 - RNA, 17 nt, Mycobacterium bovis subsp bovis AF2122/97
gugcagcgaucccggca

SEQ ID NO: 3101883 - RNA, 12 nt, Mycobacterium bovis subsp bovis AF2122/97
gugcagcgccga

SEQ ID NO: 3101884 - RNA, 23 nt, Mycobacterium bovis subsp bovis AF2122/97
gugcagcgcgucaaacaccucca

SEQ ID NO: 3101885 - RNA, 19 nt, Mycobacterium bovis subsp bovis AF2122/97
gugcagcggcgccgccaag

SEQ ID NO: 3101886 - RNA, 13 nt, Mycobacterium bovis subsp bovis AF2122/97
gugcagcggcggg

SEQ ID NO: 3101887 - RNA, 15 nt, Mycobacterium bovis subsp bovis AF2122/97
gugcagcggcgggcg

SEQ ID NO: 3101888 - RNA, 17 nt, Mycobacterium bovis subsp bovis AF2122/97
gugcagcgugcagcggc

SEQ ID NO: 3101889 - RNA, 17 nt, Mycobacterium bovis subsp bovis AF2122/97
gugcagcgugggcagcg

SEQ ID NO: 3101890 - RNA, 20 nt, Mycobacterium bovis subsp bovis AF2122/97
gugcagcgugggcagcgcga

SEQ ID NO: 3101891 - RNA, 16 nt, Mycobacterium bovis subsp bovis AF2122/97
gugcagcuccccgccg

SEQ ID NO: 3101892 - RNA, 21 nt, Mycobacterium bovis subsp bovis AF2122/97
gugcagcuccgggugcagauc

SEQ ID NO: 3101893 - RNA, 19 nt, Mycobacterium bovis subsp bovis AF2122/97
gugcagcucgauacccagg

SEQ ID NO: 3101894 - RNA, 20 nt, Mycobacterium bovis subsp bovis AF2122/97
gugcagcucggucagcguca

SEQ ID NO: 3101895 - RNA, 20 nt, Mycobacterium bovis subsp bovis AF2122/97
gugcagcugcaaugacugga

SEQ ID NO: 3101896 - RNA, 16 nt, Mycobacterium bovis subsp bovis AF2122/97
gugcaggaccagcacc

SEQ ID NO: 3101897 - RNA, 22 nt, Mycobacterium bovis subsp bovis AF2122/97
gugcaggaccagcaccgccgcg

SEQ ID NO: 3101898 - RNA, 22 nt, Mycobacterium bovis subsp bovis AF2122/97
gugcaggacguuugagacccca

SEQ ID NO: 3101899 - RNA, 19 nt, Mycobacterium bovis subsp bovis AF2122/97
gugcaggaucacgccgccg

SEQ ID NO: 3101900 - RNA, 20 nt, Mycobacterium bovis subsp bovis AF2122/97
gugcaggaucacgccgccgg

SEQ ID NO: 3101901 - RNA, 14 nt, Mycobacterium bovis subsp bovis AF2122/97
gugcaggaucggcu

SEQ ID NO: 3101902 - RNA, 20 nt, Mycobacterium bovis subsp bovis AF2122/97
gugcaggauucggcggucgc

SEQ ID NO: 3101903 - RNA, 21 nt, Mycobacterium bovis subsp bovis AF2122/97
gugcaggcgaguuaggccgcc

SEQ ID NO: 3101904 - RNA, 13 nt, Mycobacterium bovis subsp bovis AF2122/97
gugcaggcggccg

SEQ ID NO: 3101905 - RNA, 23 nt, Mycobacterium bovis subsp bovis AF2122/97
gugcaggcggccgccaguucggc

SEQ ID NO: 3101906 - RNA, 12 nt, Mycobacterium bovis subsp bovis AF2122/97
gugcaggcggga

SEQ ID NO: 3101907 - RNA, 14 nt, Mycobacterium bovis subsp bovis AF2122/97
gugcaggcuucugg

SEQ ID NO: 3101908 - RNA, 16 nt, Mycobacterium bovis subsp bovis AF2122/97
gugcagggacccggcg

SEQ ID NO: 3101909 - RNA, 19 nt, Mycobacterium bovis subsp bovis AF2122/97
gugcagggcauugcggccc

SEQ ID NO: 3101910 - RNA, 20 nt, Mycobacterium bovis subsp bovis AF2122/97
gugcagggcauugcggcccg

SEQ ID NO: 3101911 - RNA, 18 nt, Mycobacterium bovis subsp bovis AF2122/97
gugcagggugagcacgua

SEQ ID NO: 3101912 - RNA, 20 nt, Mycobacterium bovis subsp bovis AF2122/97
gugcaggucguccaucgcgu

SEQ ID NO: 3101913 - RNA, 20 nt, Mycobacterium bovis subsp bovis AF2122/97
gugcaggugacgaucagguc

SEQ ID NO: 3101914 - RNA, 20 nt, Mycobacterium bovis subsp bovis AF2122/97
gugcaggugcccggccaaaa

SEQ ID NO: 3101915 - RNA, 21 nt, Mycobacterium bovis subsp bovis AF2122/97
gugcaggugcccggccaaaau

SEQ ID NO: 3101916 - RNA, 16 nt, Mycobacterium bovis subsp bovis AF2122/97
gugcagguggccgucg

SEQ ID NO: 3101917 - RNA, 16 nt, Mycobacterium bovis subsp bovis AF2122/97
gugcaguccgaugccg

SEQ ID NO: 3101918 - RNA, 15 nt, Mycobacterium bovis subsp bovis AF2122/97
gugcagugaccucgu

SEQ ID NO: 3101919 - RNA, 21 nt, Mycobacterium bovis subsp bovis AF2122/97
gugcauaccgcaauggcggcc

SEQ ID NO: 3101920 - RNA, 23 nt, Mycobacterium bovis subsp bovis AF2122/97
gugcauaccgcaauggcggccuu

SEQ ID NO: 3101921 - RNA, 21 nt, Mycobacterium bovis subsp bovis AF2122/97
gugcauagcaauccgcacagc

SEQ ID NO: 3101922 - RNA, 22 nt, Mycobacterium bovis subsp bovis AF2122/97
gugcauagcaauccgcacagcg

SEQ ID NO: 3101923 - RNA, 23 nt, Mycobacterium bovis subsp bovis AF2122/97
gugcauagcaauccgcacagcga

SEQ ID NO: 3101924 - RNA, 15 nt, Mycobacterium bovis subsp bovis AF2122/97
gugcauaggccgcgu

SEQ ID NO: 3101925 - RNA, 12 nt, Mycobacterium bovis subsp bovis AF2122/97
gugcaucgacuc

SEQ ID NO: 3101926 - RNA, 17 nt, Mycobacterium bovis subsp bovis AF2122/97
gugcaucgccaccaccg

SEQ ID NO: 3101927 - RNA, 18 nt, Mycobacterium bovis subsp bovis AF2122/97
gugcauguauuuguugua

SEQ ID NO: 3101928 - RNA, 16 nt, Mycobacterium bovis subsp bovis AF2122/97
gugccaaacgccgccc

SEQ ID NO: 3101929 - RNA, 22 nt, Mycobacterium bovis subsp bovis AF2122/97
gugccaaacgccgcccgccggu

SEQ ID NO: 3101930 - RNA, 17 nt, Mycobacterium bovis subsp bovis AF2122/97
gugccaaaggacgacac

SEQ ID NO: 3101931 - RNA, 18 nt, Mycobacterium bovis subsp bovis AF2122/97
gugccaaaggacgacacc

SEQ ID NO: 3101932 - RNA, 19 nt, Mycobacterium bovis subsp bovis AF2122/97
gugccaaaggacgacaccg

SEQ ID NO: 3101933 - RNA, 17 nt, Mycobacterium bovis subsp bovis AF2122/97
gugccaaaugaugacga

SEQ ID NO: 3101934 - RNA, 13 nt, Mycobacterium bovis subsp bovis AF2122/97
gugccaacugcgc

SEQ ID NO: 3101935 - RNA, 18 nt, Mycobacterium bovis subsp bovis AF2122/97
gugccaacugcgccguuc

SEQ ID NO: 3101936 - RNA, 22 nt, Mycobacterium bovis subsp bovis AF2122/97
gugccaaugauucggcacgccg

SEQ ID NO: 3101937 - RNA, 21 nt, Mycobacterium bovis subsp bovis AF2122/97
gugccaccacgcuccccagcg

SEQ ID NO: 3101938 - RNA, 23 nt, Mycobacterium bovis subsp bovis AF2122/97
gugccaccacgcuccccagcgaa

SEQ ID NO: 3101939 - RNA, 13 nt, Mycobacterium bovis subsp bovis AF2122/97
gugccaccgacgc

SEQ ID NO: 3101940 - RNA, 16 nt, Mycobacterium bovis subsp bovis AF2122/97
gugccaccgcgacggc

SEQ ID NO: 3101941 - RNA, 19 nt, Mycobacterium bovis subsp bovis AF2122/97
gugccaccgcgacggcagg

SEQ ID NO: 3101942 - RNA, 20 nt, Mycobacterium bovis subsp bovis AF2122/97
gugccaccgcgacggcaggc

SEQ ID NO: 3101943 - RNA, 15 nt, Mycobacterium bovis subsp bovis AF2122/97
gugccaccggcuggu

SEQ ID NO: 3101944 - RNA, 17 nt, Mycobacterium bovis subsp bovis AF2122/97
gugccaccggcuggugc

SEQ ID NO: 3101945 - RNA, 15 nt, Mycobacterium bovis subsp bovis AF2122/97
gugccacgaggaccc

SEQ ID NO: 3101946 - RNA, 15 nt, Mycobacterium bovis subsp bovis AF2122/97
gugccacgaucggcg

SEQ ID NO: 3101947 - RNA, 13 nt, Mycobacterium bovis subsp bovis AF2122/97
gugccacguucgc

SEQ ID NO: 3101948 - RNA, 14 nt, Mycobacterium bovis subsp bovis AF2122/97
gugccacucgaugc

SEQ ID NO: 3101949 - RNA, 17 nt, Mycobacterium bovis subsp bovis AF2122/97
gugccacugccgguggg

SEQ ID NO: 3101950 - RNA, 17 nt, Mycobacterium bovis subsp bovis AF2122/97
gugccacuuccacggcg

SEQ ID NO: 3101951 - RNA, 18 nt, Mycobacterium bovis subsp bovis AF2122/97
gugccacuuccacggcgu

SEQ ID NO: 3101952 - RNA, 14 nt, Mycobacterium bovis subsp bovis AF2122/97
gugccacuucuuca

SEQ ID NO: 3101953 - RNA, 16 nt, Mycobacterium bovis subsp bovis AF2122/97
gugccacuucuucacu

SEQ ID NO: 3101954 - RNA, 20 nt, Mycobacterium bovis subsp bovis AF2122/97
gugccacuucuucacuggcg

SEQ ID NO: 3101955 - RNA, 15 nt, Mycobacterium bovis subsp bovis AF2122/97
gugccagcacuccac

SEQ ID NO: 3101956 - RNA, 22 nt, Mycobacterium bovis subsp bovis AF2122/97
gugccagcacuccaccgcuggc

SEQ ID NO: 3101957 - RNA, 21 nt, Mycobacterium bovis subsp bovis AF2122/97
gugccagcagcagcgccgcgu

SEQ ID NO: 3101958 - RNA, 11 nt, Mycobacterium bovis subsp bovis AF2122/97
gugccagcagg

SEQ ID NO: 3101959 - RNA, 19 nt, Mycobacterium bovis subsp bovis AF2122/97
gugccagcccguugcagga

SEQ ID NO: 3101960 - RNA, 12 nt, Mycobacterium bovis subsp bovis AF2122/97
gugccagccgga

SEQ ID NO: 3101961 - RNA, 12 nt, Mycobacterium bovis subsp bovis AF2122/97
gugccagcugcc

SEQ ID NO: 3101962 - RNA, 19 nt, Mycobacterium bovis subsp bovis AF2122/97
gugccaggaucgcggcgcc

SEQ ID NO: 3101963 - RNA, 17 nt, Mycobacterium bovis subsp bovis AF2122/97
gugccagugccagcguc

SEQ ID NO: 3101964 - RNA, 20 nt, Mycobacterium bovis subsp bovis AF2122/97
gugccauccuuaugcgcggu

SEQ ID NO: 3101965 - RNA, 23 nt, Mycobacterium bovis subsp bovis AF2122/97
gugccaucgccaugauggacagc

SEQ ID NO: 3101966 - RNA, 15 nt, Mycobacterium bovis subsp bovis AF2122/97
gugccaugguugaug

SEQ ID NO: 3101967 - RNA, 22 nt, Mycobacterium bovis subsp bovis AF2122/97
gugcccaacccacucgcagcag

SEQ ID NO: 3101968 - RNA, 17 nt, Mycobacterium bovis subsp bovis AF2122/97
gugcccaagcaguccac

SEQ ID NO: 3101969 - RNA, 19 nt, Mycobacterium bovis subsp bovis AF2122/97
gugcccaaggccaggaucu

SEQ ID NO: 3101970 - RNA, 22 nt, Mycobacterium bovis subsp bovis AF2122/97
gugcccaaggccaggaucuccc

SEQ ID NO: 3101971 - RNA, 22 nt, Mycobacterium bovis subsp bovis AF2122/97
gugcccaggaaggcgacgccga

SEQ ID NO: 3101972 - RNA, 18 nt, Mycobacterium bovis subsp bovis AF2122/97
gugcccauagccgguggu

SEQ ID NO: 3101973 - RNA, 19 nt, Mycobacterium bovis subsp bovis AF2122/97
gugcccauagccggugguc

SEQ ID NO: 3101974 - RNA, 16 nt, Mycobacterium bovis subsp bovis AF2122/97
gugcccaugaugguca

SEQ ID NO: 3101975 - RNA, 15 nt, Mycobacterium bovis subsp bovis AF2122/97
gugccccacucgggu

SEQ ID NO: 3101976 - RNA, 18 nt, Mycobacterium bovis subsp bovis AF2122/97
gugcccccggugccgccc

SEQ ID NO: 3101977 - RNA, 12 nt, Mycobacterium bovis subsp bovis AF2122/97
gugccccgccga

SEQ ID NO: 3101978 - RNA, 21 nt, Mycobacterium bovis subsp bovis AF2122/97
gugccccgccgagcggugccg

SEQ ID NO: 3101979 - RNA, 17 nt, Mycobacterium bovis subsp bovis AF2122/97
gugcccgacccgccgau

SEQ ID NO: 3101980 - RNA, 17 nt, Mycobacterium bovis subsp bovis AF2122/97
gugcccgcaccacaccg

SEQ ID NO: 3101981 - RNA, 20 nt, Mycobacterium bovis subsp bovis AF2122/97
gugcccgcaccguagccgcu

SEQ ID NO: 3101982 - RNA, 16 nt, Mycobacterium bovis subsp bovis AF2122/97
gugcccgcacugccgc

SEQ ID NO: 3101983 - RNA, 19 nt, Mycobacterium bovis subsp bovis AF2122/97
gugcccgcacugccgccgg

SEQ ID NO: 3101984 - RNA, 20 nt, Mycobacterium bovis subsp bovis AF2122/97
gugcccgcacugccgccggu

SEQ ID NO: 3101985 - RNA, 12 nt, Mycobacterium bovis subsp bovis AF2122/97
gugcccgccacc

SEQ ID NO: 3101986 - RNA, 13 nt, Mycobacterium bovis subsp bovis AF2122/97
gugcccgccccga

SEQ ID NO: 3101987 - RNA, 11 nt, Mycobacterium bovis subsp bovis AF2122/97
gugcccgccgg

SEQ ID NO: 3101988 - RNA, 12 nt, Mycobacterium bovis subsp bovis AF2122/97
gugcccgccggc

SEQ ID NO: 3101989 - RNA, 12 nt, Mycobacterium bovis subsp bovis AF2122/97
gugcccgccugg

SEQ ID NO: 3101990 - RNA, 19 nt, Mycobacterium bovis subsp bovis AF2122/97
gugcccgcguugccaaagc

SEQ ID NO: 3101991 - RNA, 23 nt, Mycobacterium bovis subsp bovis AF2122/97
gugcccgcguugccaaagcccac

SEQ ID NO: 3101992 - RNA, 23 nt, Mycobacterium bovis subsp bovis AF2122/97
gugcccggaauguaguccagcuc

SEQ ID NO: 3101993 - RNA, 13 nt, Mycobacterium bovis subsp bovis AF2122/97
gugcccggcggcc

SEQ ID NO: 3101994 - RNA, 15 nt, Mycobacterium bovis subsp bovis AF2122/97
gugcccggcggccaa

SEQ ID NO: 3101995 - RNA, 17 nt, Mycobacterium bovis subsp bovis AF2122/97
gugcccggcggccaacg

SEQ ID NO: 3101996 - RNA, 17 nt, Mycobacterium bovis subsp bovis AF2122/97
gugcccgggaccauagc

SEQ ID NO: 3101997 - RNA, 15 nt, Mycobacterium bovis subsp bovis AF2122/97
gugcccggugcggug

SEQ ID NO: 3101998 - RNA, 19 nt, Mycobacterium bovis subsp bovis AF2122/97
gugcccguauaaccggcca

SEQ ID NO: 3101999 - RNA, 18 nt, Mycobacterium bovis subsp bovis AF2122/97
gugcccugcauaggcgcg

SEQ ID NO: 3102000 - RNA, 21 nt, Mycobacterium bovis subsp bovis AF2122/97
gugcccugggugauggccgcg

SEQ ID NO: 3102001 - RNA, 18 nt, Mycobacterium bovis subsp bovis AF2122/97
gugcccuguccggcgccg

SEQ ID NO: 3102002 - RNA, 21 nt, Mycobacterium bovis subsp bovis AF2122/97
gugcccuguccggcgccgagg

SEQ ID NO: 3102003 - RNA, 16 nt, Mycobacterium bovis subsp bovis AF2122/97
gugccgaaaaucgcag

SEQ ID NO: 3102004 - RNA, 17 nt, Mycobacterium bovis subsp bovis AF2122/97
gugccgaaaaucgcagc

SEQ ID NO: 3102005 - RNA, 15 nt, Mycobacterium bovis subsp bovis AF2122/97
gugccgaacgccaga

SEQ ID NO: 3102006 - RNA, 16 nt, Mycobacterium bovis subsp bovis AF2122/97
gugccgaacgccagac

SEQ ID NO: 3102007 - RNA, 17 nt, Mycobacterium bovis subsp bovis AF2122/97
gugccgaacgccagacc

SEQ ID NO: 3102008 - RNA, 18 nt, Mycobacterium bovis subsp bovis AF2122/97
gugccgaacgccagaccg

SEQ ID NO: 3102009 - RNA, 20 nt, Mycobacterium bovis subsp bovis AF2122/97
gugccgaagaugaccgcucg

SEQ ID NO: 3102010 - RNA, 21 nt, Mycobacterium bovis subsp bovis AF2122/97
gugccgaagaugaccgcucgu

SEQ ID NO: 3102011 - RNA, 15 nt, Mycobacterium bovis subsp bovis AF2122/97
gugccgaaguggagc

SEQ ID NO: 3102012 - RNA, 13 nt, Mycobacterium bovis subsp bovis AF2122/97
gugccgaccagca

SEQ ID NO: 3102013 - RNA, 15 nt, Mycobacterium bovis subsp bovis AF2122/97
gugccgaccagcauc

SEQ ID NO: 3102014 - RNA, 15 nt, Mycobacterium bovis subsp bovis AF2122/97
gugccgacccgccgc

SEQ ID NO: 3102015 - RNA, 16 nt, Mycobacterium bovis subsp bovis AF2122/97
gugccgacccgccgcg

SEQ ID NO: 3102016 - RNA, 17 nt, Mycobacterium bovis subsp bovis AF2122/97
gugccgacccgccgcgc

SEQ ID NO: 3102017 - RNA, 21 nt, Mycobacterium bovis subsp bovis AF2122/97
gugccgacccgccgcgcccgg

SEQ ID NO: 3102018 - RNA, 21 nt, Mycobacterium bovis subsp bovis AF2122/97
gugccgacgccccgaucggcc

SEQ ID NO: 3102019 - RNA, 22 nt, Mycobacterium bovis subsp bovis AF2122/97
gugccgagaauuccccagccgc

SEQ ID NO: 3102020 - RNA, 18 nt, Mycobacterium bovis subsp bovis AF2122/97
gugccgagaugccggcga

SEQ ID NO: 3102021 - RNA, 21 nt, Mycobacterium bovis subsp bovis AF2122/97
gugccgagcacucggccacga

SEQ ID NO: 3102022 - RNA, 22 nt, Mycobacterium bovis subsp bovis AF2122/97
gugccgagcgugcgcugguggc

SEQ ID NO: 3102023 - RNA, 19 nt, Mycobacterium bovis subsp bovis AF2122/97
gugccgagcuucagcgcgc

SEQ ID NO: 3102024 - RNA, 16 nt, Mycobacterium bovis subsp bovis AF2122/97
gugccgaguuccugca

SEQ ID NO: 3102025 - RNA, 13 nt, Mycobacterium bovis subsp bovis AF2122/97
gugccgaucagca

SEQ ID NO: 3102026 - RNA, 16 nt, Mycobacterium bovis subsp bovis AF2122/97
gugccgaugccggcga

SEQ ID NO: 3102027 - RNA, 18 nt, Mycobacterium bovis subsp bovis AF2122/97
gugccgaugccggcgagg

SEQ ID NO: 3102028 - RNA, 22 nt, Mycobacterium bovis subsp bovis AF2122/97
gugccgaugccggcgagggcca

SEQ ID NO: 3102029 - RNA, 12 nt, Mycobacterium bovis subsp bovis AF2122/97
gugccgcaaccg

SEQ ID NO: 3102030 - RNA, 15 nt, Mycobacterium bovis subsp bovis AF2122/97
gugccgcaaccggcg

SEQ ID NO: 3102031 - RNA, 19 nt, Mycobacterium bovis subsp bovis AF2122/97
gugccgcaagccucguggu

SEQ ID NO: 3102032 - RNA, 22 nt, Mycobacterium bovis subsp bovis AF2122/97
gugccgcacccagaccgccgaa

SEQ ID NO: 3102033 - RNA, 16 nt, Mycobacterium bovis subsp bovis AF2122/97
gugccgcaccgccugc

SEQ ID NO: 3102034 - RNA, 22 nt, Mycobacterium bovis subsp bovis AF2122/97
gugccgcaccgccugcucggcg

SEQ ID NO: 3102035 - RNA, 22 nt, Mycobacterium bovis subsp bovis AF2122/97
gugccgcagcaggggacgacca

SEQ ID NO: 3102036 - RNA, 14 nt, Mycobacterium bovis subsp bovis AF2122/97
gugccgccaccacc

SEQ ID NO: 3102037 - RNA, 16 nt, Mycobacterium bovis subsp bovis AF2122/97
gugccgccaccaccgg

SEQ ID NO: 3102038 - RNA, 17 nt, Mycobacterium bovis subsp bovis AF2122/97
gugccgccaccaccggc

SEQ ID NO: 3102039 - RNA, 20 nt, Mycobacterium bovis subsp bovis AF2122/97
gugccgccaccgccaccgcg

SEQ ID NO: 3102040 - RNA, 22 nt, Mycobacterium bovis subsp bovis AF2122/97
gugccgccaccgccaccgcggc

SEQ ID NO: 3102041 - RNA, 15 nt, Mycobacterium bovis subsp bovis AF2122/97
gugccgccaccggcg

SEQ ID NO: 3102042 - RNA, 20 nt, Mycobacterium bovis subsp bovis AF2122/97
gugccgccauugacgccguu

SEQ ID NO: 3102043 - RNA, 20 nt, Mycobacterium bovis subsp bovis AF2122/97
gugccgcccaccacacagcc

SEQ ID NO: 3102044 - RNA, 15 nt, Mycobacterium bovis subsp bovis AF2122/97
gugccgcccaggagc

SEQ ID NO: 3102045 - RNA, 16 nt, Mycobacterium bovis subsp bovis AF2122/97
gugccgcccaggagca

SEQ ID NO: 3102046 - RNA, 18 nt, Mycobacterium bovis subsp bovis AF2122/97
gugccgcccgcgccgccg

SEQ ID NO: 3102047 - RNA, 19 nt, Mycobacterium bovis subsp bovis AF2122/97
gugccgcccgcgccgccgc

SEQ ID NO: 3102048 - RNA, 21 nt, Mycobacterium bovis subsp bovis AF2122/97
gugccgcccgcgccgccgcua

SEQ ID NO: 3102049 - RNA, 17 nt, Mycobacterium bovis subsp bovis AF2122/97
gugccgcccgcgccucc

SEQ ID NO: 3102050 - RNA, 18 nt, Mycobacterium bovis subsp bovis AF2122/97
gugccgcccgcgccuccg

SEQ ID NO: 3102051 - RNA, 17 nt, Mycobacterium bovis subsp bovis AF2122/97
gugccgcccucaccgcc

SEQ ID NO: 3102052 - RNA, 22 nt, Mycobacterium bovis subsp bovis AF2122/97
gugccgcccuggacgucggcga

SEQ ID NO: 3102053 - RNA, 13 nt, Mycobacterium bovis subsp bovis AF2122/97
gugccgccgacac

SEQ ID NO: 3102054 - RNA, 17 nt, Mycobacterium bovis subsp bovis AF2122/97
gugccgccgacaccacc

SEQ ID NO: 3102055 - RNA, 19 nt, Mycobacterium bovis subsp bovis AF2122/97
gugccgccgacaccaccgg

SEQ ID NO: 3102056 - RNA, 21 nt, Mycobacterium bovis subsp bovis AF2122/97
gugccgccgacaccaccggcg

SEQ ID NO: 3102057 - RNA, 22 nt, Mycobacterium bovis subsp bovis AF2122/97
gugccgccgacaccaccggcgc

SEQ ID NO: 3102058 - RNA, 19 nt, Mycobacterium bovis subsp bovis AF2122/97
gugccgccgauaccgccgg

SEQ ID NO: 3102059 - RNA, 21 nt, Mycobacterium bovis subsp bovis AF2122/97
gugccgccgauaccgccggcc

SEQ ID NO: 3102060 - RNA, 12 nt, Mycobacterium bovis subsp bovis AF2122/97
gugccgccgaug

SEQ ID NO: 3102061 - RNA, 13 nt, Mycobacterium bovis subsp bovis AF2122/97
gugccgccgcaga

SEQ ID NO: 3102062 - RNA, 18 nt, Mycobacterium bovis subsp bovis AF2122/97
gugccgccgcggccacca

SEQ ID NO: 3102063 - RNA, 13 nt, Mycobacterium bovis subsp bovis AF2122/97
gugccgccggcca

SEQ ID NO: 3102064 - RNA, 14 nt, Mycobacterium bovis subsp bovis AF2122/97
gugccgccggccag

SEQ ID NO: 3102065 - RNA, 20 nt, Mycobacterium bovis subsp bovis AF2122/97
gugccgccggccaguccgcg

SEQ ID NO: 3102066 - RNA, 13 nt, Mycobacterium bovis subsp bovis AF2122/97
gugccgccggcgc

SEQ ID NO: 3102067 - RNA, 14 nt, Mycobacterium bovis subsp bovis AF2122/97
gugccgccggcgcc

SEQ ID NO: 3102068 - RNA, 21 nt, Mycobacterium bovis subsp bovis AF2122/97
gugccgccggcgccacccgcg

SEQ ID NO: 3102069 - RNA, 20 nt, Mycobacterium bovis subsp bovis AF2122/97
gugccgccggugccgccugc

SEQ ID NO: 3102070 - RNA, 15 nt, Mycobacterium bovis subsp bovis AF2122/97
gugccgccgucgccg

SEQ ID NO: 3102071 - RNA, 17 nt, Mycobacterium bovis subsp bovis AF2122/97
gugccgccgucgccgcc

SEQ ID NO: 3102072 - RNA, 18 nt, Mycobacterium bovis subsp bovis AF2122/97
gugccgccgucgccgcca

SEQ ID NO: 3102073 - RNA, 17 nt, Mycobacterium bovis subsp bovis AF2122/97
gugccgccuccgccugc

SEQ ID NO: 3102074 - RNA, 19 nt, Mycobacterium bovis subsp bovis AF2122/97
gugccgccuccgccugccc

SEQ ID NO: 3102075 - RNA, 18 nt, Mycobacterium bovis subsp bovis AF2122/97
gugccgccugcgccgcca

SEQ ID NO: 3102076 - RNA, 19 nt, Mycobacterium bovis subsp bovis AF2122/97
gugccgccugcgccgccag

SEQ ID NO: 3102077 - RNA, 13 nt, Mycobacterium bovis subsp bovis AF2122/97
gugccgcgaucgc

SEQ ID NO: 3102078 - RNA, 12 nt, Mycobacterium bovis subsp bovis AF2122/97
gugccgcggcca

SEQ ID NO: 3102079 - RNA, 13 nt, Mycobacterium bovis subsp bovis AF2122/97
gugccgcggccac

SEQ ID NO: 3102080 - RNA, 16 nt, Mycobacterium bovis subsp bovis AF2122/97
gugccgcggccaccgc

SEQ ID NO: 3102081 - RNA, 21 nt, Mycobacterium bovis subsp bovis AF2122/97
gugccgcggccaccgccgccg

SEQ ID NO: 3102082 - RNA, 19 nt, Mycobacterium bovis subsp bovis AF2122/97
gugccgcgguaggugcaug

SEQ ID NO: 3102083 - RNA, 23 nt, Mycobacterium bovis subsp bovis AF2122/97
gugccgcgucaaccgaucggucg

SEQ ID NO: 3102084 - RNA, 21 nt, Mycobacterium bovis subsp bovis AF2122/97
gugccgcugcauccgcagcac

SEQ ID NO: 3102085 - RNA, 21 nt, Mycobacterium bovis subsp bovis AF2122/97
gugccggacuuggccugcggu

SEQ ID NO: 3102086 - RNA, 15 nt, Mycobacterium bovis subsp bovis AF2122/97
gugccggagacaccg

SEQ ID NO: 3102087 - RNA, 12 nt, Mycobacterium bovis subsp bovis AF2122/97
gugccggcaccc

SEQ ID NO: 3102088 - RNA, 13 nt, Mycobacterium bovis subsp bovis AF2122/97
gugccggcacccg

SEQ ID NO: 3102089 - RNA, 13 nt, Mycobacterium bovis subsp bovis AF2122/97
gugccggcagcgg

SEQ ID NO: 3102090 - RNA, 22 nt, Mycobacterium bovis subsp bovis AF2122/97
gugccggcagcgguggcaagcc

SEQ ID NO: 3102091 - RNA, 15 nt, Mycobacterium bovis subsp bovis AF2122/97
gugccggccagacuc

SEQ ID NO: 3102092 - RNA, 19 nt, Mycobacterium bovis subsp bovis AF2122/97
gugccggccagacucgcgg

SEQ ID NO: 3102093 - RNA, 17 nt, Mycobacterium bovis subsp bovis AF2122/97
gugccggccaucgcccg

SEQ ID NO: 3102094 - RNA, 23 nt, Mycobacterium bovis subsp bovis AF2122/97
gugccggcccugcucggccaacg

SEQ ID NO: 3102095 - RNA, 15 nt, Mycobacterium bovis subsp bovis AF2122/97
gugccggcgccgcca

SEQ ID NO: 3102096 - RNA, 16 nt, Mycobacterium bovis subsp bovis AF2122/97
gugccggcgccgccag

SEQ ID NO: 3102097 - RNA, 17 nt, Mycobacterium bovis subsp bovis AF2122/97
gugccggcgccgccagc

SEQ ID NO: 3102098 - RNA, 22 nt, Mycobacterium bovis subsp bovis AF2122/97
gugccggcggaucugaucggcg

SEQ ID NO: 3102099 - RNA, 23 nt, Mycobacterium bovis subsp bovis AF2122/97
gugccggcggaucugaucggcgc

SEQ ID NO: 3102100 - RNA, 15 nt, Mycobacterium bovis subsp bovis AF2122/97
gugccggcggugacg

SEQ ID NO: 3102101 - RNA, 18 nt, Mycobacterium bovis subsp bovis AF2122/97
gugccggcggugacggcg

SEQ ID NO: 3102102 - RNA, 13 nt, Mycobacterium bovis subsp bovis AF2122/97
gugccggcgucgc

SEQ ID NO: 3102103 - RNA, 18 nt, Mycobacterium bovis subsp bovis AF2122/97
gugccggcgucgcuggcc

SEQ ID NO: 3102104 - RNA, 20 nt, Mycobacterium bovis subsp bovis AF2122/97
gugccggcgucgcuggccag

SEQ ID NO: 3102105 - RNA, 12 nt, Mycobacterium bovis subsp bovis AF2122/97
gugccggcguua

SEQ ID NO: 3102106 - RNA, 15 nt, Mycobacterium bovis subsp bovis AF2122/97
gugccgggaucgccg

SEQ ID NO: 3102107 - RNA, 18 nt, Mycobacterium bovis subsp bovis AF2122/97
gugccgggaugccgccgc

SEQ ID NO: 3102108 - RNA, 14 nt, Mycobacterium bovis subsp bovis AF2122/97
gugccgggcaccac

SEQ ID NO: 3102109 - RNA, 16 nt, Mycobacterium bovis subsp bovis AF2122/97
gugccgggcaccacca

SEQ ID NO: 3102110 - RNA, 14 nt, Mycobacterium bovis subsp bovis AF2122/97
gugccgggcgaugc

SEQ ID NO: 3102111 - RNA, 19 nt, Mycobacterium bovis subsp bovis AF2122/97
gugccggggauaucacgac

SEQ ID NO: 3102112 - RNA, 21 nt, Mycobacterium bovis subsp bovis AF2122/97
gugccggggauaucacgacgc

SEQ ID NO: 3102113 - RNA, 16 nt, Mycobacterium bovis subsp bovis AF2122/97
gugccggggccccaug

SEQ ID NO: 3102114 - RNA, 22 nt, Mycobacterium bovis subsp bovis AF2122/97
gugccggggccccaugccgacc

SEQ ID NO: 3102115 - RNA, 15 nt, Mycobacterium bovis subsp bovis AF2122/97
gugccggggcugccg

SEQ ID NO: 3102116 - RNA, 17 nt, Mycobacterium bovis subsp bovis AF2122/97
gugccgggguggcgcgc

SEQ ID NO: 3102117 - RNA, 23 nt, Mycobacterium bovis subsp bovis AF2122/97
gugccgguaugcgccaucucgac

SEQ ID NO: 3102118 - RNA, 12 nt, Mycobacterium bovis subsp bovis AF2122/97
gugccggucacc

SEQ ID NO: 3102119 - RNA, 19 nt, Mycobacterium bovis subsp bovis AF2122/97
gugccggucaccucgccgg

SEQ ID NO: 3102120 - RNA, 20 nt, Mycobacterium bovis subsp bovis AF2122/97
gugccggucaccucgccggc

SEQ ID NO: 3102121 - RNA, 17 nt, Mycobacterium bovis subsp bovis AF2122/97
gugccggugcuccucgg

SEQ ID NO: 3102122 - RNA, 15 nt, Mycobacterium bovis subsp bovis AF2122/97
gugccgguggugacg

SEQ ID NO: 3102123 - RNA, 20 nt, Mycobacterium bovis subsp bovis AF2122/97
gugccgguggugacggcggu

SEQ ID NO: 3102124 - RNA, 13 nt, Mycobacterium bovis subsp bovis AF2122/97
gugccgucaacga

SEQ ID NO: 3102125 - RNA, 21 nt, Mycobacterium bovis subsp bovis AF2122/97
gugccgucaacgaugguggcg

SEQ ID NO: 3102126 - RNA, 21 nt, Mycobacterium bovis subsp bovis AF2122/97
gugccgucagcggcggccacg

SEQ ID NO: 3102127 - RNA, 21 nt, Mycobacterium bovis subsp bovis AF2122/97
gugccgucgaguccaggccgg

SEQ ID NO: 3102128 - RNA, 15 nt, Mycobacterium bovis subsp bovis AF2122/97
gugccgucgccgccc

SEQ ID NO: 3102129 - RNA, 16 nt, Mycobacterium bovis subsp bovis AF2122/97
gugccgucgccgcccu

SEQ ID NO: 3102130 - RNA, 15 nt, Mycobacterium bovis subsp bovis AF2122/97
gugccgucggcgugc

SEQ ID NO: 3102131 - RNA, 18 nt, Mycobacterium bovis subsp bovis AF2122/97
gugccgucggcgugcagc

SEQ ID NO: 3102132 - RNA, 17 nt, Mycobacterium bovis subsp bovis AF2122/97
gugccgucggugccgcg

SEQ ID NO: 3102133 - RNA, 18 nt, Mycobacterium bovis subsp bovis AF2122/97
gugccgugaucgcuggcg

SEQ ID NO: 3102134 - RNA, 21 nt, Mycobacterium bovis subsp bovis AF2122/97
gugccgugcgaucaccuccgc

SEQ ID NO: 3102135 - RNA, 13 nt, Mycobacterium bovis subsp bovis AF2122/97
gugccgugcucac

SEQ ID NO: 3102136 - RNA, 15 nt, Mycobacterium bovis subsp bovis AF2122/97
gugccgugcucacgg

SEQ ID NO: 3102137 - RNA, 21 nt, Mycobacterium bovis subsp bovis AF2122/97
gugccgugcucacggcaggcg

SEQ ID NO: 3102138 - RNA, 22 nt, Mycobacterium bovis subsp bovis AF2122/97
gugccgugcugaacuccgccgc

SEQ ID NO: 3102139 - RNA, 13 nt, Mycobacterium bovis subsp bovis AF2122/97
gugccguggugaa

SEQ ID NO: 3102140 - RNA, 22 nt, Mycobacterium bovis subsp bovis AF2122/97
gugccguggugaaaugccgaga

SEQ ID NO: 3102141 - RNA, 13 nt, Mycobacterium bovis subsp bovis AF2122/97
gugccguggugga

SEQ ID NO: 3102142 - RNA, 17 nt, Mycobacterium bovis subsp bovis AF2122/97
gugccguguccagcaug

SEQ ID NO: 3102143 - RNA, 16 nt, Mycobacterium bovis subsp bovis AF2122/97
gugccguuccagcauc

SEQ ID NO: 3102144 - RNA, 19 nt, Mycobacterium bovis subsp bovis AF2122/97
gugccguuccagcaucgag

SEQ ID NO: 3102145 - RNA, 22 nt, Mycobacterium bovis subsp bovis AF2122/97
gugccguuccagcaucgagcag

SEQ ID NO: 3102146 - RNA, 18 nt, Mycobacterium bovis subsp bovis AF2122/97
gugccguugcgucugcuc

SEQ ID NO: 3102147 - RNA, 15 nt, Mycobacterium bovis subsp bovis AF2122/97
gugccuacuugcucg

SEQ ID NO: 3102148 - RNA, 17 nt, Mycobacterium bovis subsp bovis AF2122/97
gugccucgaggacggcg

SEQ ID NO: 3102149 - RNA, 20 nt, Mycobacterium bovis subsp bovis AF2122/97
gugccucgauuguggccagc

SEQ ID NO: 3102150 - RNA, 23 nt, Mycobacterium bovis subsp bovis AF2122/97
gugccucgauuguggccagcgcu

SEQ ID NO: 3102151 - RNA, 13 nt, Mycobacterium bovis subsp bovis AF2122/97
gugccucgcagcc

SEQ ID NO: 3102152 - RNA, 22 nt, Mycobacterium bovis subsp bovis AF2122/97
gugccucgcguucgcugguccu

SEQ ID NO: 3102153 - RNA, 21 nt, Mycobacterium bovis subsp bovis AF2122/97
gugccucggcgaugggccggu

SEQ ID NO: 3102154 - RNA, 22 nt, Mycobacterium bovis subsp bovis AF2122/97
gugccucucgggggccgagccg

SEQ ID NO: 3102155 - RNA, 21 nt, Mycobacterium bovis subsp bovis AF2122/97
gugccucucuccgcgcucguc

SEQ ID NO: 3102156 - RNA, 17 nt, Mycobacterium bovis subsp bovis AF2122/97
gugccugcuuggccacu

SEQ ID NO: 3102157 - RNA, 16 nt, Mycobacterium bovis subsp bovis AF2122/97
gugccuggccggugcg

SEQ ID NO: 3102158 - RNA, 19 nt, Mycobacterium bovis subsp bovis AF2122/97
gugccuucaccgaggauca

SEQ ID NO: 3102159 - RNA, 17 nt, Mycobacterium bovis subsp bovis AF2122/97
gugccuuucggcagacc

SEQ ID NO: 3102160 - RNA, 16 nt, Mycobacterium bovis subsp bovis AF2122/97
gugcgaaaaucgcgcg

SEQ ID NO: 3102161 - RNA, 15 nt, Mycobacterium bovis subsp bovis AF2122/97
gugcgaagguaacga

SEQ ID NO: 3102162 - RNA, 19 nt, Mycobacterium bovis subsp bovis AF2122/97
gugcgacaacacgaccucu

SEQ ID NO: 3102163 - RNA, 21 nt, Mycobacterium bovis subsp bovis AF2122/97
gugcgacguaaagggcgucgu

SEQ ID NO: 3102164 - RNA, 19 nt, Mycobacterium bovis subsp bovis AF2122/97
gugcgacucugcgucugcu

SEQ ID NO: 3102165 - RNA, 21 nt, Mycobacterium bovis subsp bovis AF2122/97
gugcgacugcgaaugcugggc

SEQ ID NO: 3102166 - RNA, 16 nt, Mycobacterium bovis subsp bovis AF2122/97
gugcgagaagcaggga

SEQ ID NO: 3102167 - RNA, 18 nt, Mycobacterium bovis subsp bovis AF2122/97
gugcgagcugcgggucgc

SEQ ID NO: 3102168 - RNA, 18 nt, Mycobacterium bovis subsp bovis AF2122/97
gugcgagggcacggcggu

SEQ ID NO: 3102169 - RNA, 17 nt, Mycobacterium bovis subsp bovis AF2122/97
gugcgauaccuagcccc

SEQ ID NO: 3102170 - RNA, 19 nt, Mycobacterium bovis subsp bovis AF2122/97
gugcgaucaccuccgcgac

SEQ ID NO: 3102171 - RNA, 21 nt, Mycobacterium bovis subsp bovis AF2122/97
gugcgaucgaauaacggccug

SEQ ID NO: 3102172 - RNA, 19 nt, Mycobacterium bovis subsp bovis AF2122/97
gugcgaucgcaacaccggu

SEQ ID NO: 3102173 - RNA, 13 nt, Mycobacterium bovis subsp bovis AF2122/97
gugcgaucggugc

SEQ ID NO: 3102174 - RNA, 22 nt, Mycobacterium bovis subsp bovis AF2122/97
gugcgaucgucaacgacgacga

SEQ ID NO: 3102175 - RNA, 16 nt, Mycobacterium bovis subsp bovis AF2122/97
gugcgaugcagcgcgc

SEQ ID NO: 3102176 - RNA, 20 nt, Mycobacterium bovis subsp bovis AF2122/97
gugcgauuccgcgucugcuc

SEQ ID NO: 3102177 - RNA, 17 nt, Mycobacterium bovis subsp bovis AF2122/97
gugcgauucugcgucug

SEQ ID NO: 3102178 - RNA, 19 nt, Mycobacterium bovis subsp bovis AF2122/97
gugcgauucugugucugcu

SEQ ID NO: 3102179 - RNA, 20 nt, Mycobacterium bovis subsp bovis AF2122/97
gugcgauucugugucugcuc

SEQ ID NO: 3102180 - RNA, 19 nt, Mycobacterium bovis subsp bovis AF2122/97
gugcgauuuugugucugcu

SEQ ID NO: 3102181 - RNA, 21 nt, Mycobacterium bovis subsp bovis AF2122/97
gugcgauuuugugucugcucg

SEQ ID NO: 3102182 - RNA, 17 nt, Mycobacterium bovis subsp bovis AF2122/97
gugcgcaacccagccgc

SEQ ID NO: 3102183 - RNA, 22 nt, Mycobacterium bovis subsp bovis AF2122/97
gugcgcaacccagccgcgccag

SEQ ID NO: 3102184 - RNA, 14 nt, Mycobacterium bovis subsp bovis AF2122/97
gugcgcaaggccgc

SEQ ID NO: 3102185 - RNA, 15 nt, Mycobacterium bovis subsp bovis AF2122/97
gugcgcaaggccgcg

SEQ ID NO: 3102186 - RNA, 15 nt, Mycobacterium bovis subsp bovis AF2122/97
gugcgcaaucgacac

SEQ ID NO: 3102187 - RNA, 15 nt, Mycobacterium bovis subsp bovis AF2122/97
gugcgcaccaccgag

SEQ ID NO: 3102188 - RNA, 12 nt, Mycobacterium bovis subsp bovis AF2122/97
gugcgcaccagc

SEQ ID NO: 3102189 - RNA, 15 nt, Mycobacterium bovis subsp bovis AF2122/97
gugcgcaccagcaca

SEQ ID NO: 3102190 - RNA, 19 nt, Mycobacterium bovis subsp bovis AF2122/97
gugcgcaccagcacacccg

SEQ ID NO: 3102191 - RNA, 19 nt, Mycobacterium bovis subsp bovis AF2122/97
gugcgcacggcgccgaccc

SEQ ID NO: 3102192 - RNA, 13 nt, Mycobacterium bovis subsp bovis AF2122/97
gugcgcacggcgg

SEQ ID NO: 3102193 - RNA, 14 nt, Mycobacterium bovis subsp bovis AF2122/97
gugcgcacggcggc

SEQ ID NO: 3102194 - RNA, 20 nt, Mycobacterium bovis subsp bovis AF2122/97
gugcgcacugaggcucaggu

SEQ ID NO: 3102195 - RNA, 13 nt, Mycobacterium bovis subsp bovis AF2122/97
gugcgcagggccu

SEQ ID NO: 3102196 - RNA, 19 nt, Mycobacterium bovis subsp bovis AF2122/97
gugcgcagguacgccucga

SEQ ID NO: 3102197 - RNA, 17 nt, Mycobacterium bovis subsp bovis AF2122/97
gugcgccaccucgacgc

SEQ ID NO: 3102198 - RNA, 22 nt, Mycobacterium bovis subsp bovis AF2122/97
gugcgccagcgauaucggcggc

SEQ ID NO: 3102199 - RNA, 20 nt, Mycobacterium bovis subsp bovis AF2122/97
gugcgcccaauccaccgauu

SEQ ID NO: 3102200 - RNA, 13 nt, Mycobacterium bovis subsp bovis AF2122/97
gugcgcccaucau

SEQ ID NO: 3102201 - RNA, 13 nt, Mycobacterium bovis subsp bovis AF2122/97
gugcgcccgacgg

SEQ ID NO: 3102202 - RNA, 20 nt, Mycobacterium bovis subsp bovis AF2122/97
gugcgcccgacggaguucga

SEQ ID NO: 3102203 - RNA, 13 nt, Mycobacterium bovis subsp bovis AF2122/97
gugcgcccgccgg

SEQ ID NO: 3102204 - RNA, 24 nt, Mycobacterium bovis subsp bovis AF2122/97
gugcgccgaauggcggugggcuug

SEQ ID NO: 3102205 - RNA, 12 nt, Mycobacterium bovis subsp bovis AF2122/97
gugcgccgacgg

SEQ ID NO: 3102206 - RNA, 17 nt, Mycobacterium bovis subsp bovis AF2122/97
gugcgccgaucccgccc

SEQ ID NO: 3102207 - RNA, 13 nt, Mycobacterium bovis subsp bovis AF2122/97
gugcgccgcagca

SEQ ID NO: 3102208 - RNA, 15 nt, Mycobacterium bovis subsp bovis AF2122/97
gugcgccgcagccug

SEQ ID NO: 3102209 - RNA, 19 nt, Mycobacterium bovis subsp bovis AF2122/97
gugcgccgguccucgucgg

SEQ ID NO: 3102210 - RNA, 14 nt, Mycobacterium bovis subsp bovis AF2122/97
gugcgccgugcgau

SEQ ID NO: 3102211 - RNA, 16 nt, Mycobacterium bovis subsp bovis AF2122/97
gugcgccguugccgcc

SEQ ID NO: 3102212 - RNA, 20 nt, Mycobacterium bovis subsp bovis AF2122/97
gugcgccuugaccacagcgg

SEQ ID NO: 3102213 - RNA, 23 nt, Mycobacterium bovis subsp bovis AF2122/97
gugcgcgaaguuugcgacgacgc

SEQ ID NO: 3102214 - RNA, 20 nt, Mycobacterium bovis subsp bovis AF2122/97
gugcgcgaccacccgccgca

SEQ ID NO: 3102215 - RNA, 18 nt, Mycobacterium bovis subsp bovis AF2122/97
gugcgcgaggucggcggc

SEQ ID NO: 3102216 - RNA, 19 nt, Mycobacterium bovis subsp bovis AF2122/97
gugcgcgaggucggcggcg

SEQ ID NO: 3102217 - RNA, 18 nt, Mycobacterium bovis subsp bovis AF2122/97
gugcgcgcaauccugcgg

SEQ ID NO: 3102218 - RNA, 14 nt, Mycobacterium bovis subsp bovis AF2122/97
gugcgcgcgcccga

SEQ ID NO: 3102219 - RNA, 15 nt, Mycobacterium bovis subsp bovis AF2122/97
gugcgcgcgcccgaa

SEQ ID NO: 3102220 - RNA, 16 nt, Mycobacterium bovis subsp bovis AF2122/97
gugcgcgcggcgacca

SEQ ID NO: 3102221 - RNA, 13 nt, Mycobacterium bovis subsp bovis AF2122/97
gugcgcggugacg

SEQ ID NO: 3102222 - RNA, 17 nt, Mycobacterium bovis subsp bovis AF2122/97
gugcgcggugacgagcc

SEQ ID NO: 3102223 - RNA, 22 nt, Mycobacterium bovis subsp bovis AF2122/97
gugcgcgucagccgcaccccgc

SEQ ID NO: 3102224 - RNA, 14 nt, Mycobacterium bovis subsp bovis AF2122/97
gugcgcgucggugu

SEQ ID NO: 3102225 - RNA, 15 nt, Mycobacterium bovis subsp bovis AF2122/97
gugcgcgucgguguc

SEQ ID NO: 3102226 - RNA, 13 nt, Mycobacterium bovis subsp bovis AF2122/97
gugcgcuggaugu

SEQ ID NO: 3102227 - RNA, 23 nt, Mycobacterium bovis subsp bovis AF2122/97
gugcgcuggaugugggcgcucgc

SEQ ID NO: 3102228 - RNA, 14 nt, Mycobacterium bovis subsp bovis AF2122/97
gugcgcuggcggcg

SEQ ID NO: 3102229 - RNA, 15 nt, Mycobacterium bovis subsp bovis AF2122/97
gugcgcuggcggcgc

SEQ ID NO: 3102230 - RNA, 20 nt, Mycobacterium bovis subsp bovis AF2122/97
gugcgcugguggcggcgaca

SEQ ID NO: 3102231 - RNA, 17 nt, Mycobacterium bovis subsp bovis AF2122/97
gugcggaacaccgcccg

SEQ ID NO: 3102232 - RNA, 18 nt, Mycobacterium bovis subsp bovis AF2122/97
gugcggaacacgaugcgc

SEQ ID NO: 3102233 - RNA, 14 nt, Mycobacterium bovis subsp bovis AF2122/97
gugcggacaguucc

SEQ ID NO: 3102234 - RNA, 20 nt, Mycobacterium bovis subsp bovis AF2122/97
gugcggacuucgccgcccgc

SEQ ID NO: 3102235 - RNA, 20 nt, Mycobacterium bovis subsp bovis AF2122/97
gugcggcagauacucggcga

SEQ ID NO: 3102236 - RNA, 13 nt, Mycobacterium bovis subsp bovis AF2122/97
gugcggcagcccc

SEQ ID NO: 3102237 - RNA, 15 nt, Mycobacterium bovis subsp bovis AF2122/97
gugcggcagcccgcu

SEQ ID NO: 3102238 - RNA, 15 nt, Mycobacterium bovis subsp bovis AF2122/97
gugcggcagcggugg

SEQ ID NO: 3102239 - RNA, 19 nt, Mycobacterium bovis subsp bovis AF2122/97
gugcggcagcgguggcuug

SEQ ID NO: 3102240 - RNA, 23 nt, Mycobacterium bovis subsp bovis AF2122/97
gugcggccacucgcccgauccgg

SEQ ID NO: 3102241 - RNA, 22 nt, Mycobacterium bovis subsp bovis AF2122/97
gugcggcccaaccggucguggu

SEQ ID NO: 3102242 - RNA, 22 nt, Mycobacterium bovis subsp bovis AF2122/97
gugcggccccgacauacgucgg

SEQ ID NO: 3102243 - RNA, 14 nt, Mycobacterium bovis subsp bovis AF2122/97
gugcggccgacggg

SEQ ID NO: 3102244 - RNA, 15 nt, Mycobacterium bovis subsp bovis AF2122/97
gugcggccgcggcga

SEQ ID NO: 3102245 - RNA, 14 nt, Mycobacterium bovis subsp bovis AF2122/97
gugcggccguggcg

SEQ ID NO: 3102246 - RNA, 13 nt, Mycobacterium bovis subsp bovis AF2122/97
gugcggcgcggcg

SEQ ID NO: 3102247 - RNA, 16 nt, Mycobacterium bovis subsp bovis AF2122/97
gugcggcggccucggg

SEQ ID NO: 3102248 - RNA, 13 nt, Mycobacterium bovis subsp bovis AF2122/97
gugcggcggcguc

SEQ ID NO: 3102249 - RNA, 21 nt, Mycobacterium bovis subsp bovis AF2122/97
gugcggcguauugcggccugu

SEQ ID NO: 3102250 - RNA, 24 nt, Mycobacterium bovis subsp bovis AF2122/97
gugcggcguuaucgucggcuugcu

SEQ ID NO: 3102251 - RNA, 13 nt, Mycobacterium bovis subsp bovis AF2122/97
gugcggcucgccg

SEQ ID NO: 3102252 - RNA, 16 nt, Mycobacterium bovis subsp bovis AF2122/97
gugcggcucgccggcg

SEQ ID NO: 3102253 - RNA, 17 nt, Mycobacterium bovis subsp bovis AF2122/97
gugcggcucgccggcgg

SEQ ID NO: 3102254 - RNA, 13 nt, Mycobacterium bovis subsp bovis AF2122/97
gugcggcugcaac

SEQ ID NO: 3102255 - RNA, 17 nt, Mycobacterium bovis subsp bovis AF2122/97
gugcggcugcaccggcu

SEQ ID NO: 3102256 - RNA, 14 nt, Mycobacterium bovis subsp bovis AF2122/97
gugcgggccggucg

SEQ ID NO: 3102257 - RNA, 18 nt, Mycobacterium bovis subsp bovis AF2122/97
gugcgggccggucgugcc

SEQ ID NO: 3102258 - RNA, 21 nt, Mycobacterium bovis subsp bovis AF2122/97
gugcgggccggucgugccggg

SEQ ID NO: 3102259 - RNA, 13 nt, Mycobacterium bovis subsp bovis AF2122/97
gugcgggcgcacc

SEQ ID NO: 3102260 - RNA, 19 nt, Mycobacterium bovis subsp bovis AF2122/97
gugcgggcggcgucugcgc

SEQ ID NO: 3102261 - RNA, 15 nt, Mycobacterium bovis subsp bovis AF2122/97
gugcgggcgggcguc

SEQ ID NO: 3102262 - RNA, 16 nt, Mycobacterium bovis subsp bovis AF2122/97
gugcgggcuaggcggc

SEQ ID NO: 3102263 - RNA, 17 nt, Mycobacterium bovis subsp bovis AF2122/97
gugcgggcuucaacaca

SEQ ID NO: 3102264 - RNA, 19 nt, Mycobacterium bovis subsp bovis AF2122/97
gugcgggcuucaacacacu

SEQ ID NO: 3102265 - RNA, 16 nt, Mycobacterium bovis subsp bovis AF2122/97
gugcgggguuggccgu

SEQ ID NO: 3102266 - RNA, 17 nt, Mycobacterium bovis subsp bovis AF2122/97
gugcgggguuggccgug

SEQ ID NO: 3102267 - RNA, 19 nt, Mycobacterium bovis subsp bovis AF2122/97
gugcggguaauacggcgcc

SEQ ID NO: 3102268 - RNA, 22 nt, Mycobacterium bovis subsp bovis AF2122/97
gugcgggucguccgccugcacc

SEQ ID NO: 3102269 - RNA, 19 nt, Mycobacterium bovis subsp bovis AF2122/97
gugcgggugggcacaccgg

SEQ ID NO: 3102270 - RNA, 17 nt, Mycobacterium bovis subsp bovis AF2122/97
gugcggguggugccggc

SEQ ID NO: 3102271 - RNA, 18 nt, Mycobacterium bovis subsp bovis AF2122/97
gugcggguggugccggcg

SEQ ID NO: 3102272 - RNA, 19 nt, Mycobacterium bovis subsp bovis AF2122/97
gugcggguggugccggcgg

SEQ ID NO: 3102273 - RNA, 15 nt, Mycobacterium bovis subsp bovis AF2122/97
gugcgguaucgguca

SEQ ID NO: 3102274 - RNA, 23 nt, Mycobacterium bovis subsp bovis AF2122/97
gugcgguauuugaacgcccgcuu

SEQ ID NO: 3102275 - RNA, 12 nt, Mycobacterium bovis subsp bovis AF2122/97
gugcggucaucg

SEQ ID NO: 3102276 - RNA, 24 nt, Mycobacterium bovis subsp bovis AF2122/97
gugcggugaccgugaacggcucgg

SEQ ID NO: 3102277 - RNA, 18 nt, Mycobacterium bovis subsp bovis AF2122/97
gugcggugagauggcggu

SEQ ID NO: 3102278 - RNA, 23 nt, Mycobacterium bovis subsp bovis AF2122/97
gugcggugccgugguggacgaug

SEQ ID NO: 3102279 - RNA, 13 nt, Mycobacterium bovis subsp bovis AF2122/97
gugcgguggugcg

SEQ ID NO: 3102280 - RNA, 16 nt, Mycobacterium bovis subsp bovis AF2122/97
gugcgguucgcugcgg

SEQ ID NO: 3102281 - RNA, 13 nt, Mycobacterium bovis subsp bovis AF2122/97
gugcgguugcgcg

SEQ ID NO: 3102282 - RNA, 18 nt, Mycobacterium bovis subsp bovis AF2122/97
gugcgguuucaccgacga

SEQ ID NO: 3102283 - RNA, 21 nt, Mycobacterium bovis subsp bovis AF2122/97
gugcgguuucaccgacgacgc

SEQ ID NO: 3102284 - RNA, 20 nt, Mycobacterium bovis subsp bovis AF2122/97
gugcguagcccacccgggug

SEQ ID NO: 3102285 - RNA, 14 nt, Mycobacterium bovis subsp bovis AF2122/97
gugcguccgcaaca

SEQ ID NO: 3102286 - RNA, 16 nt, Mycobacterium bovis subsp bovis AF2122/97
gugcguccggugcugg

SEQ ID NO: 3102287 - RNA, 17 nt, Mycobacterium bovis subsp bovis AF2122/97
gugcguccggugcuggu

SEQ ID NO: 3102288 - RNA, 18 nt, Mycobacterium bovis subsp bovis AF2122/97
gugcgucgauggcgucgg

SEQ ID NO: 3102289 - RNA, 19 nt, Mycobacterium bovis subsp bovis AF2122/97
gugcgucgauggcgucggu

SEQ ID NO: 3102290 - RNA, 14 nt, Mycobacterium bovis subsp bovis AF2122/97
gugcgucucggugg

SEQ ID NO: 3102291 - RNA, 15 nt, Mycobacterium bovis subsp bovis AF2122/97
gugcgucugcggcgg

SEQ ID NO: 3102292 - RNA, 21 nt, Mycobacterium bovis subsp bovis AF2122/97
gugcgugaacaagauucgcuc

SEQ ID NO: 3102293 - RNA, 16 nt, Mycobacterium bovis subsp bovis AF2122/97
gugcgugcgcgucggu

SEQ ID NO: 3102294 - RNA, 18 nt, Mycobacterium bovis subsp bovis AF2122/97
gugcgugggcgcggcgcc

SEQ ID NO: 3102295 - RNA, 18 nt, Mycobacterium bovis subsp bovis AF2122/97
gugcguguaccugcccag

SEQ ID NO: 3102296 - RNA, 16 nt, Mycobacterium bovis subsp bovis AF2122/97
gugcguuggaugaagu

SEQ ID NO: 3102297 - RNA, 20 nt, Mycobacterium bovis subsp bovis AF2122/97
gugcguugucggcuggacgg

SEQ ID NO: 3102298 - RNA, 21 nt, Mycobacterium bovis subsp bovis AF2122/97
gugcguuugcacuguucgcgg

SEQ ID NO: 3102299 - RNA, 14 nt, Mycobacterium bovis subsp bovis AF2122/97
gugcuaaccgacgc

SEQ ID NO: 3102300 - RNA, 17 nt, Mycobacterium bovis subsp bovis AF2122/97
gugcuaugcaacaccgc

SEQ ID NO: 3102301 - RNA, 24 nt, Mycobacterium bovis subsp bovis AF2122/97
gugcucaacggcgacaucggcccg

SEQ ID NO: 3102302 - RNA, 17 nt, Mycobacterium bovis subsp bovis AF2122/97
gugcucacauccgguca

SEQ ID NO: 3102303 - RNA, 20 nt, Mycobacterium bovis subsp bovis AF2122/97
gugcucacggcaggcgguga

SEQ ID NO: 3102304 - RNA, 14 nt, Mycobacterium bovis subsp bovis AF2122/97
gugcucacggcggc

SEQ ID NO: 3102305 - RNA, 22 nt, Mycobacterium bovis subsp bovis AF2122/97
gugcucagcgcgcgccgcuggg

SEQ ID NO: 3102306 - RNA, 17 nt, Mycobacterium bovis subsp bovis AF2122/97
gugcucaggucgcagac

SEQ ID NO: 3102307 - RNA, 13 nt, Mycobacterium bovis subsp bovis AF2122/97
gugcuccagcgac

SEQ ID NO: 3102308 - RNA, 23 nt, Mycobacterium bovis subsp bovis AF2122/97
gugcucccacgugaaggcgaugg

SEQ ID NO: 3102309 - RNA, 22 nt, Mycobacterium bovis subsp bovis AF2122/97
gugcuccugcccgaacuucugg

SEQ ID NO: 3102310 - RNA, 14 nt, Mycobacterium bovis subsp bovis AF2122/97
gugcucgacgaaga

SEQ ID NO: 3102311 - RNA, 15 nt, Mycobacterium bovis subsp bovis AF2122/97
gugcucgacgcgcau

SEQ ID NO: 3102312 - RNA, 22 nt, Mycobacterium bovis subsp bovis AF2122/97
gugcucgagcaccucggccucg

SEQ ID NO: 3102313 - RNA, 20 nt, Mycobacterium bovis subsp bovis AF2122/97
gugcucgaugcgaucgacga

SEQ ID NO: 3102314 - RNA, 17 nt, Mycobacterium bovis subsp bovis AF2122/97
gugcucgccgaccagcu

SEQ ID NO: 3102315 - RNA, 12 nt, Mycobacterium bovis subsp bovis AF2122/97
gugcucgccgau

SEQ ID NO: 3102316 - RNA, 12 nt, Mycobacterium bovis subsp bovis AF2122/97
gugcucgccgga

SEQ ID NO: 3102317 - RNA, 14 nt, Mycobacterium bovis subsp bovis AF2122/97
gugcucgccggcac

SEQ ID NO: 3102318 - RNA, 18 nt, Mycobacterium bovis subsp bovis AF2122/97
gugcucgccgggucagcc

SEQ ID NO: 3102319 - RNA, 20 nt, Mycobacterium bovis subsp bovis AF2122/97
gugcucgccguaagcaccag

SEQ ID NO: 3102320 - RNA, 19 nt, Mycobacterium bovis subsp bovis AF2122/97
gugcucgcgaucugcucgu

SEQ ID NO: 3102321 - RNA, 22 nt, Mycobacterium bovis subsp bovis AF2122/97
gugcucggaucggcucgccacc

SEQ ID NO: 3102322 - RNA, 20 nt, Mycobacterium bovis subsp bovis AF2122/97
gugcucggucgaugcucagu

SEQ ID NO: 3102323 - RNA, 14 nt, Mycobacterium bovis subsp bovis AF2122/97
gugcucggugacgu

SEQ ID NO: 3102324 - RNA, 18 nt, Mycobacterium bovis subsp bovis AF2122/97
gugcucuucggcaccacc

SEQ ID NO: 3102325 - RNA, 22 nt, Mycobacterium bovis subsp bovis AF2122/97
gugcucuucggcaccaccgcga

SEQ ID NO: 3102326 - RNA, 17 nt, Mycobacterium bovis subsp bovis AF2122/97
gugcucuugcgccacgg

SEQ ID NO: 3102327 - RNA, 17 nt, Mycobacterium bovis subsp bovis AF2122/97
gugcugaccccgccggc

SEQ ID NO: 3102328 - RNA, 16 nt, Mycobacterium bovis subsp bovis AF2122/97
gugcugaccgcgccgg

SEQ ID NO: 3102329 - RNA, 23 nt, Mycobacterium bovis subsp bovis AF2122/97
gugcugaugggucaggccgacgu

SEQ ID NO: 3102330 - RNA, 20 nt, Mycobacterium bovis subsp bovis AF2122/97
gugcugcaaggaauuccggc

SEQ ID NO: 3102331 - RNA, 14 nt, Mycobacterium bovis subsp bovis AF2122/97
gugcugcaccgauu

SEQ ID NO: 3102332 - RNA, 19 nt, Mycobacterium bovis subsp bovis AF2122/97
gugcugcaccguuuccggc

SEQ ID NO: 3102333 - RNA, 18 nt, Mycobacterium bovis subsp bovis AF2122/97
gugcugcaccuggcgcag

SEQ ID NO: 3102334 - RNA, 19 nt, Mycobacterium bovis subsp bovis AF2122/97
gugcugccaccggccggcg

SEQ ID NO: 3102335 - RNA, 15 nt, Mycobacterium bovis subsp bovis AF2122/97
gugcugccgccuugg

SEQ ID NO: 3102336 - RNA, 23 nt, Mycobacterium bovis subsp bovis AF2122/97
gugcugccggagacacccgccag

SEQ ID NO: 3102337 - RNA, 14 nt, Mycobacterium bovis subsp bovis AF2122/97
gugcugccuuggga

SEQ ID NO: 3102338 - RNA, 14 nt, Mycobacterium bovis subsp bovis AF2122/97
gugcugcgcgcggc

SEQ ID NO: 3102339 - RNA, 22 nt, Mycobacterium bovis subsp bovis AF2122/97
gugcugcgcggguguggcuacg

SEQ ID NO: 3102340 - RNA, 17 nt, Mycobacterium bovis subsp bovis AF2122/97
gugcugcgcugucuugc

SEQ ID NO: 3102341 - RNA, 12 nt, Mycobacterium bovis subsp bovis AF2122/97
gugcugcggcug

SEQ ID NO: 3102342 - RNA, 14 nt, Mycobacterium bovis subsp bovis AF2122/97
gugcugcuagccag

SEQ ID NO: 3102343 - RNA, 21 nt, Mycobacterium bovis subsp bovis AF2122/97
gugcugcuagccagucggcca

SEQ ID NO: 3102344 - RNA, 21 nt, Mycobacterium bovis subsp bovis AF2122/97
gugcuggaaguaguccccaac

SEQ ID NO: 3102345 - RNA, 24 nt, Mycobacterium bovis subsp bovis AF2122/97
gugcuggcgaucucuaccagccgc

SEQ ID NO: 3102346 - RNA, 20 nt, Mycobacterium bovis subsp bovis AF2122/97
gugcugggcaucaccgacgc

SEQ ID NO: 3102347 - RNA, 14 nt, Mycobacterium bovis subsp bovis AF2122/97
gugcugggccgacg

SEQ ID NO: 3102348 - RNA, 14 nt, Mycobacterium bovis subsp bovis AF2122/97
gugcugguaaccaa

SEQ ID NO: 3102349 - RNA, 18 nt, Mycobacterium bovis subsp bovis AF2122/97
gugcugguauagccggcg

SEQ ID NO: 3102350 - RNA, 16 nt, Mycobacterium bovis subsp bovis AF2122/97
gugcuggucaacagcg

SEQ ID NO: 3102351 - RNA, 18 nt, Mycobacterium bovis subsp bovis AF2122/97
gugcuggucgccgcggca

SEQ ID NO: 3102352 - RNA, 14 nt, Mycobacterium bovis subsp bovis AF2122/97
gugcugguggcggc

SEQ ID NO: 3102353 - RNA, 15 nt, Mycobacterium bovis subsp bovis AF2122/97
gugcuggugggccgg

SEQ ID NO: 3102354 - RNA, 17 nt, Mycobacterium bovis subsp bovis AF2122/97
gugcugugcucacgagc

SEQ ID NO: 3102355 - RNA, 21 nt, Mycobacterium bovis subsp bovis AF2122/97
gugcuguggucggugccagca

SEQ ID NO: 3102356 - RNA, 22 nt, Mycobacterium bovis subsp bovis AF2122/97
gugcuguuugguugcgccagga

SEQ ID NO: 3102357 - RNA, 18 nt, Mycobacterium bovis subsp bovis AF2122/97
gugcuuccauucgcgguc

SEQ ID NO: 3102358 - RNA, 19 nt, Mycobacterium bovis subsp bovis AF2122/97
gugcuuccauucgcggucc

SEQ ID NO: 3102359 - RNA, 17 nt, Mycobacterium bovis subsp bovis AF2122/97
gugcuugcccgguugug

SEQ ID NO: 3102360 - RNA, 23 nt, Mycobacterium bovis subsp bovis AF2122/97
gugcuuguugcgcgacgccgcgg

SEQ ID NO: 3102361 - RNA, 17 nt, Mycobacterium bovis subsp bovis AF2122/97
gugcuuuccuugcgcgc

SEQ ID NO: 3102362 - RNA, 19 nt, Mycobacterium bovis subsp bovis AF2122/97
gugcuuucgcgucugcucg

SEQ ID NO: 3102363 - RNA, 16 nt, Mycobacterium bovis subsp bovis AF2122/97
guggaaaaaggcggcg

SEQ ID NO: 3102364 - RNA, 18 nt, Mycobacterium bovis subsp bovis AF2122/97
guggaaaaaggcggcguu

SEQ ID NO: 3102365 - RNA, 19 nt, Mycobacterium bovis subsp bovis AF2122/97
guggaaaaaggcggcguug

SEQ ID NO: 3102366 - RNA, 17 nt, Mycobacterium bovis subsp bovis AF2122/97
guggaaacccgccgaac

SEQ ID NO: 3102367 - RNA, 14 nt, Mycobacterium bovis subsp bovis AF2122/97
guggaacaccgcgg

SEQ ID NO: 3102368 - RNA, 13 nt, Mycobacterium bovis subsp bovis AF2122/97
guggaaccuggcg

SEQ ID NO: 3102369 - RNA, 19 nt, Mycobacterium bovis subsp bovis AF2122/97
guggaaccuggcgauagca

SEQ ID NO: 3102370 - RNA, 15 nt, Mycobacterium bovis subsp bovis AF2122/97
guggaagcccgucgc

SEQ ID NO: 3102371 - RNA, 16 nt, Mycobacterium bovis subsp bovis AF2122/97
guggaagcccgucgcg

SEQ ID NO: 3102372 - RNA, 21 nt, Mycobacterium bovis subsp bovis AF2122/97
guggaagcccgucgcggccgg

SEQ ID NO: 3102373 - RNA, 23 nt, Mycobacterium bovis subsp bovis AF2122/97
guggaagcccgucgcggccggcg

SEQ ID NO: 3102374 - RNA, 20 nt, Mycobacterium bovis subsp bovis AF2122/97
guggaagccgaccaccgccg

SEQ ID NO: 3102375 - RNA, 21 nt, Mycobacterium bovis subsp bovis AF2122/97
guggaaguacuucgcggcggu

SEQ ID NO: 3102376 - RNA, 15 nt, Mycobacterium bovis subsp bovis AF2122/97
guggaauggcgccgg

SEQ ID NO: 3102377 - RNA, 15 nt, Mycobacterium bovis subsp bovis AF2122/97
guggacaacgccaua

SEQ ID NO: 3102378 - RNA, 16 nt, Mycobacterium bovis subsp bovis AF2122/97
guggacaagcacagcg

SEQ ID NO: 3102379 - RNA, 17 nt, Mycobacterium bovis subsp bovis AF2122/97
guggacagaaucgaccg

SEQ ID NO: 3102380 - RNA, 22 nt, Mycobacterium bovis subsp bovis AF2122/97
guggacagaaucgaccgccgcu

SEQ ID NO: 3102381 - RNA, 19 nt, Mycobacterium bovis subsp bovis AF2122/97
guggacagaugcauccagc

SEQ ID NO: 3102382 - RNA, 14 nt, Mycobacterium bovis subsp bovis AF2122/97
guggacaggucggg

SEQ ID NO: 3102383 - RNA, 12 nt, Mycobacterium bovis subsp bovis AF2122/97
guggaccgccga

SEQ ID NO: 3102384 - RNA, 16 nt, Mycobacterium bovis subsp bovis AF2122/97
guggaccgccgaucgg

SEQ ID NO: 3102385 - RNA, 19 nt, Mycobacterium bovis subsp bovis AF2122/97
guggaccggucgacagcga

SEQ ID NO: 3102386 - RNA, 13 nt, Mycobacterium bovis subsp bovis AF2122/97
guggacgaccgcg

SEQ ID NO: 3102387 - RNA, 17 nt, Mycobacterium bovis subsp bovis AF2122/97
guggacgaccgcgcggc

SEQ ID NO: 3102388 - RNA, 15 nt, Mycobacterium bovis subsp bovis AF2122/97
guggacgaggcgguc

SEQ ID NO: 3102389 - RNA, 19 nt, Mycobacterium bovis subsp bovis AF2122/97
guggacgauacgcgcaccg

SEQ ID NO: 3102390 - RNA, 19 nt, Mycobacterium bovis subsp bovis AF2122/97
guggacgcagagucaacag

SEQ ID NO: 3102391 - RNA, 19 nt, Mycobacterium bovis subsp bovis AF2122/97
guggacgcagagucaacga

SEQ ID NO: 3102392 - RNA, 23 nt, Mycobacterium bovis subsp bovis AF2122/97
guggacgcccgcccgcacgacga

SEQ ID NO: 3102393 - RNA, 18 nt, Mycobacterium bovis subsp bovis AF2122/97
guggacggcaggcggccg

SEQ ID NO: 3102394 - RNA, 22 nt, Mycobacterium bovis subsp bovis AF2122/97
guggacggcaggcggccgccgg

SEQ ID NO: 3102395 - RNA, 17 nt, Mycobacterium bovis subsp bovis AF2122/97
guggacucgggcgcuga

SEQ ID NO: 3102396 - RNA, 21 nt, Mycobacterium bovis subsp bovis AF2122/97
guggacuucagcaggcccagc

SEQ ID NO: 3102397 - RNA, 23 nt, Mycobacterium bovis subsp bovis AF2122/97
guggagacguuuugcggcccggg

SEQ ID NO: 3102398 - RNA, 19 nt, Mycobacterium bovis subsp bovis AF2122/97
guggagaucacgugccggc

SEQ ID NO: 3102399 - RNA, 14 nt, Mycobacterium bovis subsp bovis AF2122/97
guggagaucuccuc

SEQ ID NO: 3102400 - RNA, 13 nt, Mycobacterium bovis subsp bovis AF2122/97
guggagcggcgcg

SEQ ID NO: 3102401 - RNA, 15 nt, Mycobacterium bovis subsp bovis AF2122/97
guggagcucgcggcg

SEQ ID NO: 3102402 - RNA, 16 nt, Mycobacterium bovis subsp bovis AF2122/97
guggagcucgcggcgc

SEQ ID NO: 3102403 - RNA, 15 nt, Mycobacterium bovis subsp bovis AF2122/97
guggaggcccgucac

SEQ ID NO: 3102404 - RNA, 19 nt, Mycobacterium bovis subsp bovis AF2122/97
guggaggcccgucacaaug

SEQ ID NO: 3102405 - RNA, 16 nt, Mycobacterium bovis subsp bovis AF2122/97
guggaggucaaaucaa

SEQ ID NO: 3102406 - RNA, 20 nt, Mycobacterium bovis subsp bovis AF2122/97
guggaguuggcugccggaga

SEQ ID NO: 3102407 - RNA, 15 nt, Mycobacterium bovis subsp bovis AF2122/97
guggaucauguucgg

SEQ ID NO: 3102408 - RNA, 19 nt, Mycobacterium bovis subsp bovis AF2122/97
guggaucauguucggccac

SEQ ID NO: 3102409 - RNA, 15 nt, Mycobacterium bovis subsp bovis AF2122/97
guggauccggcagca

SEQ ID NO: 3102410 - RNA, 20 nt, Mycobacterium bovis subsp bovis AF2122/97
guggauccggcagcagccgg

SEQ ID NO: 3102411 - RNA, 13 nt, Mycobacterium bovis subsp bovis AF2122/97
guggaucugaaga

SEQ ID NO: 3102412 - RNA, 16 nt, Mycobacterium bovis subsp bovis AF2122/97
guggaucuggcgcagc

SEQ ID NO: 3102413 - RNA, 16 nt, Mycobacterium bovis subsp bovis AF2122/97
guggaucuuggccagc

SEQ ID NO: 3102414 - RNA, 17 nt, Mycobacterium bovis subsp bovis AF2122/97
guggaucuuggccagca

SEQ ID NO: 3102415 - RNA, 17 nt, Mycobacterium bovis subsp bovis AF2122/97
guggaugccgacggcgg

SEQ ID NO: 3102416 - RNA, 17 nt, Mycobacterium bovis subsp bovis AF2122/97
guggaugcgccgcacgg

SEQ ID NO: 3102417 - RNA, 15 nt, Mycobacterium bovis subsp bovis AF2122/97
guggauggccgccag

SEQ ID NO: 3102418 - RNA, 19 nt, Mycobacterium bovis subsp bovis AF2122/97
guggauggccgccaggcgc

SEQ ID NO: 3102419 - RNA, 18 nt, Mycobacterium bovis subsp bovis AF2122/97
guggauucgaucaggccu

SEQ ID NO: 3102420 - RNA, 23 nt, Mycobacterium bovis subsp bovis AF2122/97
guggauugugucccauggugagc

SEQ ID NO: 3102421 - RNA, 22 nt, Mycobacterium bovis subsp bovis AF2122/97
guggcaacggaggugccggcgc

SEQ ID NO: 3102422 - RNA, 17 nt, Mycobacterium bovis subsp bovis AF2122/97
guggcaacggguccgac

SEQ ID NO: 3102423 - RNA, 13 nt, Mycobacterium bovis subsp bovis AF2122/97
guggcaacgguac

SEQ ID NO: 3102424 - RNA, 21 nt, Mycobacterium bovis subsp bovis AF2122/97
guggcaagccuaaaaccccga

SEQ ID NO: 3102425 - RNA, 18 nt, Mycobacterium bovis subsp bovis AF2122/97
guggcaagcugucgucgc

SEQ ID NO: 3102426 - RNA, 16 nt, Mycobacterium bovis subsp bovis AF2122/97
guggcaaucccgccau

SEQ ID NO: 3102427 - RNA, 15 nt, Mycobacterium bovis subsp bovis AF2122/97
guggcacacccgcac

SEQ ID NO: 3102428 - RNA, 16 nt, Mycobacterium bovis subsp bovis AF2122/97
guggcacacccgcacc

SEQ ID NO: 3102429 - RNA, 14 nt, Mycobacterium bovis subsp bovis AF2122/97
guggcacccgcagu

SEQ ID NO: 3102430 - RNA, 12 nt, Mycobacterium bovis subsp bovis AF2122/97
guggcaccgguu

SEQ ID NO: 3102431 - RNA, 18 nt, Mycobacterium bovis subsp bovis AF2122/97
guggcacgcaugagggca

SEQ ID NO: 3102432 - RNA, 15 nt, Mycobacterium bovis subsp bovis AF2122/97
guggcacguggcgac

SEQ ID NO: 3102433 - RNA, 17 nt, Mycobacterium bovis subsp bovis AF2122/97
guggcacugacgcgccc

SEQ ID NO: 3102434 - RNA, 21 nt, Mycobacterium bovis subsp bovis AF2122/97
guggcacugacgcgcccgacg

SEQ ID NO: 3102435 - RNA, 14 nt, Mycobacterium bovis subsp bovis AF2122/97
guggcagagccgcc

SEQ ID NO: 3102436 - RNA, 15 nt, Mycobacterium bovis subsp bovis AF2122/97
guggcagagccgccg

SEQ ID NO: 3102437 - RNA, 16 nt, Mycobacterium bovis subsp bovis AF2122/97
guggcagagccgccgu

SEQ ID NO: 3102438 - RNA, 17 nt, Mycobacterium bovis subsp bovis AF2122/97
guggcagagccgccguu

SEQ ID NO: 3102439 - RNA, 16 nt, Mycobacterium bovis subsp bovis AF2122/97
guggcagcgcggccgg

SEQ ID NO: 3102440 - RNA, 17 nt, Mycobacterium bovis subsp bovis AF2122/97
guggcagcgcggccggg

SEQ ID NO: 3102441 - RNA, 19 nt, Mycobacterium bovis subsp bovis AF2122/97
guggcagcgcggccgggcg

SEQ ID NO: 3102442 - RNA, 23 nt, Mycobacterium bovis subsp bovis AF2122/97
guggcaggugaucccgaugguca

SEQ ID NO: 3102443 - RNA, 20 nt, Mycobacterium bovis subsp bovis AF2122/97
guggcaguacaccggcgugc

SEQ ID NO: 3102444 - RNA, 22 nt, Mycobacterium bovis subsp bovis AF2122/97
guggcaguacaccggcgugcug

SEQ ID NO: 3102445 - RNA, 19 nt, Mycobacterium bovis subsp bovis AF2122/97
guggcagucgcacggugcc

SEQ ID NO: 3102446 - RNA, 22 nt, Mycobacterium bovis subsp bovis AF2122/97
guggcagugaaauugccgccgc

SEQ ID NO: 3102447 - RNA, 15 nt, Mycobacterium bovis subsp bovis AF2122/97
guggcauccagcagc

SEQ ID NO: 3102448 - RNA, 23 nt, Mycobacterium bovis subsp bovis AF2122/97
guggcauccuugccaaucgccgu

SEQ ID NO: 3102449 - RNA, 16 nt, Mycobacterium bovis subsp bovis AF2122/97
guggcaucgccuccag

SEQ ID NO: 3102450 - RNA, 21 nt, Mycobacterium bovis subsp bovis AF2122/97
guggcaugcgacagaugccgg

SEQ ID NO: 3102451 - RNA, 16 nt, Mycobacterium bovis subsp bovis AF2122/97
guggccaacaccgcca

SEQ ID NO: 3102452 - RNA, 18 nt, Mycobacterium bovis subsp bovis AF2122/97
guggccaauccggcggcg

SEQ ID NO: 3102453 - RNA, 15 nt, Mycobacterium bovis subsp bovis AF2122/97
guggccaccaaacgc

SEQ ID NO: 3102454 - RNA, 20 nt, Mycobacterium bovis subsp bovis AF2122/97
guggccaccaaacgcugcug

SEQ ID NO: 3102455 - RNA, 21 nt, Mycobacterium bovis subsp bovis AF2122/97
guggccaccaaacgcugcugg

SEQ ID NO: 3102456 - RNA, 12 nt, Mycobacterium bovis subsp bovis AF2122/97
guggccaccagc

SEQ ID NO: 3102457 - RNA, 13 nt, Mycobacterium bovis subsp bovis AF2122/97
guggccaccagcg

SEQ ID NO: 3102458 - RNA, 23 nt, Mycobacterium bovis subsp bovis AF2122/97
guggccagaucgaacgcagccag

SEQ ID NO: 3102459 - RNA, 14 nt, Mycobacterium bovis subsp bovis AF2122/97
guggccagcaggcg

SEQ ID NO: 3102460 - RNA, 13 nt, Mycobacterium bovis subsp bovis AF2122/97
guggccagccagc

SEQ ID NO: 3102461 - RNA, 14 nt, Mycobacterium bovis subsp bovis AF2122/97
guggccagcccgcc

SEQ ID NO: 3102462 - RNA, 13 nt, Mycobacterium bovis subsp bovis AF2122/97
guggccagcgcgg

SEQ ID NO: 3102463 - RNA, 24 nt, Mycobacterium bovis subsp bovis AF2122/97
guggccagcggagcgcccuugauc

SEQ ID NO: 3102464 - RNA, 16 nt, Mycobacterium bovis subsp bovis AF2122/97
guggccccaagcgugc

SEQ ID NO: 3102465 - RNA, 22 nt, Mycobacterium bovis subsp bovis AF2122/97
guggccccaagcgugcugccgc

SEQ ID NO: 3102466 - RNA, 16 nt, Mycobacterium bovis subsp bovis AF2122/97
guggcccccgccggcc

SEQ ID NO: 3102467 - RNA, 19 nt, Mycobacterium bovis subsp bovis AF2122/97
guggcccccgccggccacg

SEQ ID NO: 3102468 - RNA, 18 nt, Mycobacterium bovis subsp bovis AF2122/97
guggcccgccggcaguga

SEQ ID NO: 3102469 - RNA, 22 nt, Mycobacterium bovis subsp bovis AF2122/97
guggcccggaacaccgacguca

SEQ ID NO: 3102470 - RNA, 22 nt, Mycobacterium bovis subsp bovis AF2122/97
guggcccggcgaaagcuugggc

SEQ ID NO: 3102471 - RNA, 22 nt, Mycobacterium bovis subsp bovis AF2122/97
guggcccggggacgggucggca

SEQ ID NO: 3102472 - RNA, 14 nt, Mycobacterium bovis subsp bovis AF2122/97
guggcccucggcga

SEQ ID NO: 3102473 - RNA, 21 nt, Mycobacterium bovis subsp bovis AF2122/97
guggccgaacgggucggcgac

SEQ ID NO: 3102474 - RNA, 22 nt, Mycobacterium bovis subsp bovis AF2122/97
guggccgaacgggucggcgacc

SEQ ID NO: 3102475 - RNA, 19 nt, Mycobacterium bovis subsp bovis AF2122/97
guggccgacaagucaagau

SEQ ID NO: 3102476 - RNA, 21 nt, Mycobacterium bovis subsp bovis AF2122/97
guggccgacgauagcggcccg

SEQ ID NO: 3102477 - RNA, 15 nt, Mycobacterium bovis subsp bovis AF2122/97
guggccgagccgcgg

SEQ ID NO: 3102478 - RNA, 21 nt, Mycobacterium bovis subsp bovis AF2122/97
guggccgagccgcggucaccc

SEQ ID NO: 3102479 - RNA, 13 nt, Mycobacterium bovis subsp bovis AF2122/97
guggccgccaccc

SEQ ID NO: 3102480 - RNA, 16 nt, Mycobacterium bovis subsp bovis AF2122/97
guggccgccacccgca

SEQ ID NO: 3102481 - RNA, 13 nt, Mycobacterium bovis subsp bovis AF2122/97
guggccgccaccu

SEQ ID NO: 3102482 - RNA, 16 nt, Mycobacterium bovis subsp bovis AF2122/97
guggccgccggcgcug

SEQ ID NO: 3102483 - RNA, 19 nt, Mycobacterium bovis subsp bovis AF2122/97
guggccgccggcgcuggcg

SEQ ID NO: 3102484 - RNA, 16 nt, Mycobacterium bovis subsp bovis AF2122/97
guggccgcgcaggggc

SEQ ID NO: 3102485 - RNA, 16 nt, Mycobacterium bovis subsp bovis AF2122/97
guggccgcgcugguca

SEQ ID NO: 3102486 - RNA, 14 nt, Mycobacterium bovis subsp bovis AF2122/97
guggccggacccau

SEQ ID NO: 3102487 - RNA, 19 nt, Mycobacterium bovis subsp bovis AF2122/97
guggccgggaugguuucga

SEQ ID NO: 3102488 - RNA, 18 nt, Mycobacterium bovis subsp bovis AF2122/97
guggccgggucgaucacc

SEQ ID NO: 3102489 - RNA, 22 nt, Mycobacterium bovis subsp bovis AF2122/97
guggccggucguuugcgccagg

SEQ ID NO: 3102490 - RNA, 14 nt, Mycobacterium bovis subsp bovis AF2122/97
guggccgucgccga

SEQ ID NO: 3102491 - RNA, 14 nt, Mycobacterium bovis subsp bovis AF2122/97
guggccgugggugu

SEQ ID NO: 3102492 - RNA, 19 nt, Mycobacterium bovis subsp bovis AF2122/97
guggccguuuaggccggaa

SEQ ID NO: 3102493 - RNA, 14 nt, Mycobacterium bovis subsp bovis AF2122/97
guggccucauccac

SEQ ID NO: 3102494 - RNA, 19 nt, Mycobacterium bovis subsp bovis AF2122/97
guggccucauccaccgaug

SEQ ID NO: 3102495 - RNA, 17 nt, Mycobacterium bovis subsp bovis AF2122/97
guggccucgauguccug

SEQ ID NO: 3102496 - RNA, 17 nt, Mycobacterium bovis subsp bovis AF2122/97
guggccucgucccggac

SEQ ID NO: 3102497 - RNA, 13 nt, Mycobacterium bovis subsp bovis AF2122/97
guggccuucuggu

SEQ ID NO: 3102498 - RNA, 21 nt, Mycobacterium bovis subsp bovis AF2122/97
guggccuugacagcuuucuug

SEQ ID NO: 3102499 - RNA, 22 nt, Mycobacterium bovis subsp bovis AF2122/97
guggcgaaucuuugguagucug

SEQ ID NO: 3102500 - RNA, 19 nt, Mycobacterium bovis subsp bovis AF2122/97
guggcgaaugacggccagu

SEQ ID NO: 3102501 - RNA, 12 nt, Mycobacterium bovis subsp bovis AF2122/97
guggcgaccacg

SEQ ID NO: 3102502 - RNA, 13 nt, Mycobacterium bovis subsp bovis AF2122/97
guggcgaccacga

SEQ ID NO: 3102503 - RNA, 12 nt, Mycobacterium bovis subsp bovis AF2122/97
guggcgacggcg

SEQ ID NO: 3102504 - RNA, 14 nt, Mycobacterium bovis subsp bovis AF2122/97
guggcgacggcguc

SEQ ID NO: 3102505 - RNA, 13 nt, Mycobacterium bovis subsp bovis AF2122/97
guggcgagcgccu

SEQ ID NO: 3102506 - RNA, 18 nt, Mycobacterium bovis subsp bovis AF2122/97
guggcgagcgccuuucgg

SEQ ID NO: 3102507 - RNA, 20 nt, Mycobacterium bovis subsp bovis AF2122/97
guggcgaggcagcacccgca

SEQ ID NO: 3102508 - RNA, 21 nt, Mycobacterium bovis subsp bovis AF2122/97
guggcgaggcagcacccgcac

SEQ ID NO: 3102509 - RNA, 18 nt, Mycobacterium bovis subsp bovis AF2122/97
guggcgauuucggcgccu

SEQ ID NO: 3102510 - RNA, 22 nt, Mycobacterium bovis subsp bovis AF2122/97
guggcgauuucggcgccuggcg

SEQ ID NO: 3102511 - RNA, 17 nt, Mycobacterium bovis subsp bovis AF2122/97
guggcgcaccaccgccc

SEQ ID NO: 3102512 - RNA, 15 nt, Mycobacterium bovis subsp bovis AF2122/97
guggcgccaacgcaa

SEQ ID NO: 3102513 - RNA, 22 nt, Mycobacterium bovis subsp bovis AF2122/97
guggcgccaacgcaacggugau

SEQ ID NO: 3102514 - RNA, 21 nt, Mycobacterium bovis subsp bovis AF2122/97
guggcgccauccccgccggcg

SEQ ID NO: 3102515 - RNA, 21 nt, Mycobacterium bovis subsp bovis AF2122/97
guggcgccaugaagccgggcg

SEQ ID NO: 3102516 - RNA, 22 nt, Mycobacterium bovis subsp bovis AF2122/97
guggcgcccgucuccagcacca

SEQ ID NO: 3102517 - RNA, 18 nt, Mycobacterium bovis subsp bovis AF2122/97
guggcgcccgugccgccc

SEQ ID NO: 3102518 - RNA, 19 nt, Mycobacterium bovis subsp bovis AF2122/97
guggcgcccgugccgcccg

SEQ ID NO: 3102519 - RNA, 16 nt, Mycobacterium bovis subsp bovis AF2122/97
guggcgccgaacgcaa

SEQ ID NO: 3102520 - RNA, 15 nt, Mycobacterium bovis subsp bovis AF2122/97
guggcgccggccacg

SEQ ID NO: 3102521 - RNA, 14 nt, Mycobacterium bovis subsp bovis AF2122/97
guggcgccggucgc

SEQ ID NO: 3102522 - RNA, 13 nt, Mycobacterium bovis subsp bovis AF2122/97
guggcgccgucgg

SEQ ID NO: 3102523 - RNA, 15 nt, Mycobacterium bovis subsp bovis AF2122/97
guggcgcgccaacac

SEQ ID NO: 3102524 - RNA, 17 nt, Mycobacterium bovis subsp bovis AF2122/97
guggcgcggacccgccg

SEQ ID NO: 3102525 - RNA, 17 nt, Mycobacterium bovis subsp bovis AF2122/97
guggcgcgggccggcga

SEQ ID NO: 3102526 - RNA, 15 nt, Mycobacterium bovis subsp bovis AF2122/97
guggcgcggggccgc

SEQ ID NO: 3102527 - RNA, 17 nt, Mycobacterium bovis subsp bovis AF2122/97
guggcgcggggccgccg

SEQ ID NO: 3102528 - RNA, 18 nt, Mycobacterium bovis subsp bovis AF2122/97
guggcgcggggccgccgc

SEQ ID NO: 3102529 - RNA, 19 nt, Mycobacterium bovis subsp bovis AF2122/97
guggcgcugaagccgacga

SEQ ID NO: 3102530 - RNA, 13 nt, Mycobacterium bovis subsp bovis AF2122/97
guggcgcugcguc

SEQ ID NO: 3102531 - RNA, 20 nt, Mycobacterium bovis subsp bovis AF2122/97
guggcgcugcgucguggaga

SEQ ID NO: 3102532 - RNA, 14 nt, Mycobacterium bovis subsp bovis AF2122/97
guggcggacggcgu

SEQ ID NO: 3102533 - RNA, 17 nt, Mycobacterium bovis subsp bovis AF2122/97
guggcggacggcgucga

SEQ ID NO: 3102534 - RNA, 12 nt, Mycobacterium bovis subsp bovis AF2122/97
guggcggcagca

SEQ ID NO: 3102535 - RNA, 20 nt, Mycobacterium bovis subsp bovis AF2122/97
guggcggcagcagcgccgua

SEQ ID NO: 3102536 - RNA, 20 nt, Mycobacterium bovis subsp bovis AF2122/97
guggcggccaguucggcggc

SEQ ID NO: 3102537 - RNA, 14 nt, Mycobacterium bovis subsp bovis AF2122/97
guggcggcgcgcgc

SEQ ID NO: 3102538 - RNA, 12 nt, Mycobacterium bovis subsp bovis AF2122/97
guggcggcgcug

SEQ ID NO: 3102539 - RNA, 18 nt, Mycobacterium bovis subsp bovis AF2122/97
guggcgggagaucgucgc

SEQ ID NO: 3102540 - RNA, 19 nt, Mycobacterium bovis subsp bovis AF2122/97
guggcgggagaucgucgcc

SEQ ID NO: 3102541 - RNA, 16 nt, Mycobacterium bovis subsp bovis AF2122/97
guggcgggaucaccau

SEQ ID NO: 3102542 - RNA, 14 nt, Mycobacterium bovis subsp bovis AF2122/97
guggcgggccggau

SEQ ID NO: 3102543 - RNA, 13 nt, Mycobacterium bovis subsp bovis AF2122/97
guggcgggcuugc

SEQ ID NO: 3102544 - RNA, 19 nt, Mycobacterium bovis subsp bovis AF2122/97
guggcgggguugaucaccg

SEQ ID NO: 3102545 - RNA, 24 nt, Mycobacterium bovis subsp bovis AF2122/97
guggcggucuugccgcaggccugu

SEQ ID NO: 3102546 - RNA, 12 nt, Mycobacterium bovis subsp bovis AF2122/97
guggcggugcgg

SEQ ID NO: 3102547 - RNA, 17 nt, Mycobacterium bovis subsp bovis AF2122/97
guggcguaauugucgau

SEQ ID NO: 3102548 - RNA, 15 nt, Mycobacterium bovis subsp bovis AF2122/97
guggcgucgcucguc

SEQ ID NO: 3102549 - RNA, 10 nt, Mycobacterium bovis subsp bovis AF2122/97
guggcgucgu

SEQ ID NO: 3102550 - RNA, 23 nt, Mycobacterium bovis subsp bovis AF2122/97
guggcgucgugcgcggccggcac

SEQ ID NO: 3102551 - RNA, 15 nt, Mycobacterium bovis subsp bovis AF2122/97
guggcguggcccucg

SEQ ID NO: 3102552 - RNA, 14 nt, Mycobacterium bovis subsp bovis AF2122/97
guggcguggucucg

SEQ ID NO: 3102553 - RNA, 13 nt, Mycobacterium bovis subsp bovis AF2122/97
guggcguguggcu

SEQ ID NO: 3102554 - RNA, 17 nt, Mycobacterium bovis subsp bovis AF2122/97
guggcguugguggucug

SEQ ID NO: 3102555 - RNA, 19 nt, Mycobacterium bovis subsp bovis AF2122/97
guggcguuugaugcgggcg

SEQ ID NO: 3102556 - RNA, 16 nt, Mycobacterium bovis subsp bovis AF2122/97
guggcuaccgcaggug

SEQ ID NO: 3102557 - RNA, 19 nt, Mycobacterium bovis subsp bovis AF2122/97
guggcuacgcgaucagcug

SEQ ID NO: 3102558 - RNA, 19 nt, Mycobacterium bovis subsp bovis AF2122/97
guggcuccaucgucuggug

SEQ ID NO: 3102559 - RNA, 20 nt, Mycobacterium bovis subsp bovis AF2122/97
guggcucgacgaugcgguca

SEQ ID NO: 3102560 - RNA, 23 nt, Mycobacterium bovis subsp bovis AF2122/97
guggcucggcggguauauggugc

SEQ ID NO: 3102561 - RNA, 19 nt, Mycobacterium bovis subsp bovis AF2122/97
guggcugaucccggccagg

SEQ ID NO: 3102562 - RNA, 22 nt, Mycobacterium bovis subsp bovis AF2122/97
guggcugcgauuuucggcacgg

SEQ ID NO: 3102563 - RNA, 23 nt, Mycobacterium bovis subsp bovis AF2122/97
guggcugcgccggaaccccucga

SEQ ID NO: 3102564 - RNA, 14 nt, Mycobacterium bovis subsp bovis AF2122/97
guggcugcgcucgc

SEQ ID NO: 3102565 - RNA, 13 nt, Mycobacterium bovis subsp bovis AF2122/97
guggcuggcugug

SEQ ID NO: 3102566 - RNA, 20 nt, Mycobacterium bovis subsp bovis AF2122/97
guggcuguacccgaccagca

SEQ ID NO: 3102567 - RNA, 14 nt, Mycobacterium bovis subsp bovis AF2122/97
guggcuucacccaa

SEQ ID NO: 3102568 - RNA, 16 nt, Mycobacterium bovis subsp bovis AF2122/97
guggcuucgacggcgg

SEQ ID NO: 3102569 - RNA, 19 nt, Mycobacterium bovis subsp bovis AF2122/97
guggcuucgacggcggcca

SEQ ID NO: 3102570 - RNA, 23 nt, Mycobacterium bovis subsp bovis AF2122/97
guggcuuguucggacucacucgg

SEQ ID NO: 3102571 - RNA, 16 nt, Mycobacterium bovis subsp bovis AF2122/97
guggcuuugacugcug

SEQ ID NO: 3102572 - RNA, 20 nt, Mycobacterium bovis subsp bovis AF2122/97
guggcuuugacugcuggggg

SEQ ID NO: 3102573 - RNA, 21 nt, Mycobacterium bovis subsp bovis AF2122/97
guggcuuugacugcugggggu

SEQ ID NO: 3102574 - RNA, 17 nt, Mycobacterium bovis subsp bovis AF2122/97
gugggaaccaccagcac

SEQ ID NO: 3102575 - RNA, 18 nt, Mycobacterium bovis subsp bovis AF2122/97
gugggaaccaccagcacg

SEQ ID NO: 3102576 - RNA, 20 nt, Mycobacterium bovis subsp bovis AF2122/97
gugggaagagccgggcucgu

SEQ ID NO: 3102577 - RNA, 14 nt, Mycobacterium bovis subsp bovis AF2122/97
gugggacaccaucu

SEQ ID NO: 3102578 - RNA, 13 nt, Mycobacterium bovis subsp bovis AF2122/97
gugggacaggucg

SEQ ID NO: 3102579 - RNA, 15 nt, Mycobacterium bovis subsp bovis AF2122/97
gugggacaggucggc

SEQ ID NO: 3102580 - RNA, 12 nt, Mycobacterium bovis subsp bovis AF2122/97
gugggacgcggc

SEQ ID NO: 3102581 - RNA, 16 nt, Mycobacterium bovis subsp bovis AF2122/97
gugggacgggcgcguc

SEQ ID NO: 3102582 - RNA, 16 nt, Mycobacterium bovis subsp bovis AF2122/97
gugggacuggcgugaa

SEQ ID NO: 3102583 - RNA, 14 nt, Mycobacterium bovis subsp bovis AF2122/97
gugggagcagccga

SEQ ID NO: 3102584 - RNA, 22 nt, Mycobacterium bovis subsp bovis AF2122/97
gugggagcagccgaaccggcac

SEQ ID NO: 3102585 - RNA, 17 nt, Mycobacterium bovis subsp bovis AF2122/97
gugggaguucgcacccg

SEQ ID NO: 3102586 - RNA, 16 nt, Mycobacterium bovis subsp bovis AF2122/97
gugggaucgcagcgcc

SEQ ID NO: 3102587 - RNA, 19 nt, Mycobacterium bovis subsp bovis AF2122/97
gugggauucugacgaccgg

SEQ ID NO: 3102588 - RNA, 20 nt, Mycobacterium bovis subsp bovis AF2122/97
gugggauugaagcuggccac

SEQ ID NO: 3102589 - RNA, 22 nt, Mycobacterium bovis subsp bovis AF2122/97
gugggauugaagcuggccaccg

SEQ ID NO: 3102590 - RNA, 19 nt, Mycobacterium bovis subsp bovis AF2122/97
gugggcaagcugaccgcca

SEQ ID NO: 3102591 - RNA, 22 nt, Mycobacterium bovis subsp bovis AF2122/97
gugggcaagcugaccgccagcg

SEQ ID NO: 3102592 - RNA, 21 nt, Mycobacterium bovis subsp bovis AF2122/97
gugggcaauccggucagcgcg

SEQ ID NO: 3102593 - RNA, 12 nt, Mycobacterium bovis subsp bovis AF2122/97
gugggcacaccg

SEQ ID NO: 3102594 - RNA, 19 nt, Mycobacterium bovis subsp bovis AF2122/97
gugggcaccuuggccggcc

SEQ ID NO: 3102595 - RNA, 12 nt, Mycobacterium bovis subsp bovis AF2122/97
gugggcagcagc

SEQ ID NO: 3102596 - RNA, 14 nt, Mycobacterium bovis subsp bovis AF2122/97
gugggcagcagcug

SEQ ID NO: 3102597 - RNA, 13 nt, Mycobacterium bovis subsp bovis AF2122/97
gugggcagcaggc

SEQ ID NO: 3102598 - RNA, 14 nt, Mycobacterium bovis subsp bovis AF2122/97
gugggcagcaggcc

SEQ ID NO: 3102599 - RNA, 18 nt, Mycobacterium bovis subsp bovis AF2122/97
gugggcagcgcgaucacc

SEQ ID NO: 3102600 - RNA, 20 nt, Mycobacterium bovis subsp bovis AF2122/97
gugggcagcgcgaucaccga

SEQ ID NO: 3102601 - RNA, 20 nt, Mycobacterium bovis subsp bovis AF2122/97
gugggcagcgcgcccgacac

SEQ ID NO: 3102602 - RNA, 15 nt, Mycobacterium bovis subsp bovis AF2122/97
gugggccagcagcaa

SEQ ID NO: 3102603 - RNA, 14 nt, Mycobacterium bovis subsp bovis AF2122/97
gugggccccgccga

SEQ ID NO: 3102604 - RNA, 12 nt, Mycobacterium bovis subsp bovis AF2122/97
gugggccgacgu

SEQ ID NO: 3102605 - RNA, 18 nt, Mycobacterium bovis subsp bovis AF2122/97
gugggccgcccaaagaaa

SEQ ID NO: 3102606 - RNA, 20 nt, Mycobacterium bovis subsp bovis AF2122/97
gugggccucgaucagcgccg

SEQ ID NO: 3102607 - RNA, 12 nt, Mycobacterium bovis subsp bovis AF2122/97
gugggccugcgc

SEQ ID NO: 3102608 - RNA, 16 nt, Mycobacterium bovis subsp bovis AF2122/97
gugggccuguugcugc

SEQ ID NO: 3102609 - RNA, 15 nt, Mycobacterium bovis subsp bovis AF2122/97
gugggcgacgaggca

SEQ ID NO: 3102610 - RNA, 14 nt, Mycobacterium bovis subsp bovis AF2122/97
gugggcgacggcca

SEQ ID NO: 3102611 - RNA, 14 nt, Mycobacterium bovis subsp bovis AF2122/97
gugggcgacggcga

SEQ ID NO: 3102612 - RNA, 17 nt, Mycobacterium bovis subsp bovis AF2122/97
gugggcgacggcggcgu

SEQ ID NO: 3102613 - RNA, 18 nt, Mycobacterium bovis subsp bovis AF2122/97
gugggcgacggcggcguc

SEQ ID NO: 3102614 - RNA, 16 nt, Mycobacterium bovis subsp bovis AF2122/97
gugggcgacgucaucg

SEQ ID NO: 3102615 - RNA, 14 nt, Mycobacterium bovis subsp bovis AF2122/97
gugggcgaucggcg

SEQ ID NO: 3102616 - RNA, 21 nt, Mycobacterium bovis subsp bovis AF2122/97
gugggcgccgacaccggcuga

SEQ ID NO: 3102617 - RNA, 19 nt, Mycobacterium bovis subsp bovis AF2122/97
gugggcgccgucgccguug

SEQ ID NO: 3102618 - RNA, 13 nt, Mycobacterium bovis subsp bovis AF2122/97
gugggcgcggcgc

SEQ ID NO: 3102619 - RNA, 19 nt, Mycobacterium bovis subsp bovis AF2122/97
gugggcgugacguagugca

SEQ ID NO: 3102620 - RNA, 13 nt, Mycobacterium bovis subsp bovis AF2122/97
gugggcguggcug

SEQ ID NO: 3102621 - RNA, 17 nt, Mycobacterium bovis subsp bovis AF2122/97
gugggcguggcugguca

SEQ ID NO: 3102622 - RNA, 13 nt, Mycobacterium bovis subsp bovis AF2122/97
gugggcguucccc

SEQ ID NO: 3102623 - RNA, 15 nt, Mycobacterium bovis subsp bovis AF2122/97
gugggcuuggcugug

SEQ ID NO: 3102624 - RNA, 16 nt, Mycobacterium bovis subsp bovis AF2122/97
gugggcuuggugccca

SEQ ID NO: 3102625 - RNA, 20 nt, Mycobacterium bovis subsp bovis AF2122/97
gugggcuuuugcgucugcuc

SEQ ID NO: 3102626 - RNA, 21 nt, Mycobacterium bovis subsp bovis AF2122/97
gugggcuuuugcgucugcucg

SEQ ID NO: 3102627 - RNA, 13 nt, Mycobacterium bovis subsp bovis AF2122/97
guggggaucacga

SEQ ID NO: 3102628 - RNA, 23 nt, Mycobacterium bovis subsp bovis AF2122/97
guggggcacuuccagcccggcaa

SEQ ID NO: 3102629 - RNA, 15 nt, Mycobacterium bovis subsp bovis AF2122/97
guggggccgccacca

SEQ ID NO: 3102630 - RNA, 14 nt, Mycobacterium bovis subsp bovis AF2122/97
guggggccggcggu

SEQ ID NO: 3102631 - RNA, 21 nt, Mycobacterium bovis subsp bovis AF2122/97
gugggggugguaccggcggcg

SEQ ID NO: 3102632 - RNA, 22 nt, Mycobacterium bovis subsp bovis AF2122/97
guggggucagugcgggcggcgu

SEQ ID NO: 3102633 - RNA, 16 nt, Mycobacterium bovis subsp bovis AF2122/97
guggggucgccgucga

SEQ ID NO: 3102634 - RNA, 14 nt, Mycobacterium bovis subsp bovis AF2122/97
gugggguggggagc

SEQ ID NO: 3102635 - RNA, 17 nt, Mycobacterium bovis subsp bovis AF2122/97
guggguagccagcgcgc

SEQ ID NO: 3102636 - RNA, 20 nt, Mycobacterium bovis subsp bovis AF2122/97
guggguaucgagaugccauc

SEQ ID NO: 3102637 - RNA, 21 nt, Mycobacterium bovis subsp bovis AF2122/97
gugggucugcucagcgcggcc

SEQ ID NO: 3102638 - RNA, 20 nt, Mycobacterium bovis subsp bovis AF2122/97
gugggugaaccggaccuggg

SEQ ID NO: 3102639 - RNA, 17 nt, Mycobacterium bovis subsp bovis AF2122/97
gugggugaagagaaguc

SEQ ID NO: 3102640 - RNA, 13 nt, Mycobacterium bovis subsp bovis AF2122/97
gugggugaggcca

SEQ ID NO: 3102641 - RNA, 22 nt, Mycobacterium bovis subsp bovis AF2122/97
gugggugaugguaccgccacug

SEQ ID NO: 3102642 - RNA, 12 nt, Mycobacterium bovis subsp bovis AF2122/97
gugggugccagc

SEQ ID NO: 3102643 - RNA, 22 nt, Mycobacterium bovis subsp bovis AF2122/97
gugggugccggcucaacaccga

SEQ ID NO: 3102644 - RNA, 23 nt, Mycobacterium bovis subsp bovis AF2122/97
guggguggaggucaaaucaacgg

SEQ ID NO: 3102645 - RNA, 19 nt, Mycobacterium bovis subsp bovis AF2122/97
guggguguugaugggcagc

SEQ ID NO: 3102646 - RNA, 16 nt, Mycobacterium bovis subsp bovis AF2122/97
gugguaaccagggcag

SEQ ID NO: 3102647 - RNA, 21 nt, Mycobacterium bovis subsp bovis AF2122/97
gugguaaccauauggcccgcg

SEQ ID NO: 3102648 - RNA, 15 nt, Mycobacterium bovis subsp bovis AF2122/97
gugguaacggcggcc

SEQ ID NO: 3102649 - RNA, 16 nt, Mycobacterium bovis subsp bovis AF2122/97
gugguaacggggcugc

SEQ ID NO: 3102650 - RNA, 23 nt, Mycobacterium bovis subsp bovis AF2122/97
gugguaccaacgcuucugccugc

SEQ ID NO: 3102651 - RNA, 15 nt, Mycobacterium bovis subsp bovis AF2122/97
gugguaccggcggcg

SEQ ID NO: 3102652 - RNA, 16 nt, Mycobacterium bovis subsp bovis AF2122/97
gugguaccggcggcgc

SEQ ID NO: 3102653 - RNA, 17 nt, Mycobacterium bovis subsp bovis AF2122/97
gugguaccggcggcgcc

SEQ ID NO: 3102654 - RNA, 16 nt, Mycobacterium bovis subsp bovis AF2122/97
gugguacggcucggcg

SEQ ID NO: 3102655 - RNA, 19 nt, Mycobacterium bovis subsp bovis AF2122/97
gugguacggcucggcgcug

SEQ ID NO: 3102656 - RNA, 16 nt, Mycobacterium bovis subsp bovis AF2122/97
gugguacgugcgagcc

SEQ ID NO: 3102657 - RNA, 20 nt, Mycobacterium bovis subsp bovis AF2122/97
gugguacgugcgagcccacc

SEQ ID NO: 3102658 - RNA, 20 nt, Mycobacterium bovis subsp bovis AF2122/97
gugguacuuucacgcucguu

SEQ ID NO: 3102659 - RNA, 16 nt, Mycobacterium bovis subsp bovis AF2122/97
gugguagaggaacaga

SEQ ID NO: 3102660 - RNA, 18 nt, Mycobacterium bovis subsp bovis AF2122/97
gugguaggacgccagcaa

SEQ ID NO: 3102661 - RNA, 13 nt, Mycobacterium bovis subsp bovis AF2122/97
gugguaggccgcc

SEQ ID NO: 3102662 - RNA, 14 nt, Mycobacterium bovis subsp bovis AF2122/97
gugguaggccgccg

SEQ ID NO: 3102663 - RNA, 13 nt, Mycobacterium bovis subsp bovis AF2122/97
gugguaggccggg

SEQ ID NO: 3102664 - RNA, 13 nt, Mycobacterium bovis subsp bovis AF2122/97
gugguaucgccgg

SEQ ID NO: 3102665 - RNA, 15 nt, Mycobacterium bovis subsp bovis AF2122/97
guggucaccaggccg

SEQ ID NO: 3102666 - RNA, 22 nt, Mycobacterium bovis subsp bovis AF2122/97
guggucaccccuucgccagcgc

SEQ ID NO: 3102667 - RNA, 22 nt, Mycobacterium bovis subsp bovis AF2122/97
guggucagucaccaaccacaug

SEQ ID NO: 3102668 - RNA, 14 nt, Mycobacterium bovis subsp bovis AF2122/97
gugguccaaccggg

SEQ ID NO: 3102669 - RNA, 16 nt, Mycobacterium bovis subsp bovis AF2122/97
gugguccaaccgggcc

SEQ ID NO: 3102670 - RNA, 17 nt, Mycobacterium bovis subsp bovis AF2122/97
gugguccaaccgggccg

SEQ ID NO: 3102671 - RNA, 20 nt, Mycobacterium bovis subsp bovis AF2122/97
gugguccaaccgggccggcu

SEQ ID NO: 3102672 - RNA, 23 nt, Mycobacterium bovis subsp bovis AF2122/97
gugguccaucgcgcugcggccca

SEQ ID NO: 3102673 - RNA, 15 nt, Mycobacterium bovis subsp bovis AF2122/97
guggucccccgcagc

SEQ ID NO: 3102674 - RNA, 16 nt, Mycobacterium bovis subsp bovis AF2122/97
guggucccccgcagcc

SEQ ID NO: 3102675 - RNA, 22 nt, Mycobacterium bovis subsp bovis AF2122/97
guggucccguucgcccgcccgu

SEQ ID NO: 3102676 - RNA, 15 nt, Mycobacterium bovis subsp bovis AF2122/97
gugguccucgaucag

SEQ ID NO: 3102677 - RNA, 17 nt, Mycobacterium bovis subsp bovis AF2122/97
guggucgaucagguacu

SEQ ID NO: 3102678 - RNA, 18 nt, Mycobacterium bovis subsp bovis AF2122/97
guggucgauuucggcgcg

SEQ ID NO: 3102679 - RNA, 14 nt, Mycobacterium bovis subsp bovis AF2122/97
guggucggacagcg

SEQ ID NO: 3102680 - RNA, 12 nt, Mycobacterium bovis subsp bovis AF2122/97
guggucggcccg

SEQ ID NO: 3102681 - RNA, 17 nt, Mycobacterium bovis subsp bovis AF2122/97
guggucggcugugguga

SEQ ID NO: 3102682 - RNA, 18 nt, Mycobacterium bovis subsp bovis AF2122/97
guggucgggucgaucacc

SEQ ID NO: 3102683 - RNA, 21 nt, Mycobacterium bovis subsp bovis AF2122/97
guggucgguggcuacgcccca

SEQ ID NO: 3102684 - RNA, 21 nt, Mycobacterium bovis subsp bovis AF2122/97
guggucgucccgauggcggug

SEQ ID NO: 3102685 - RNA, 23 nt, Mycobacterium bovis subsp bovis AF2122/97
guggucgugggugagcgaccugg

SEQ ID NO: 3102686 - RNA, 17 nt, Mycobacterium bovis subsp bovis AF2122/97
guggucuccggcaccga

SEQ ID NO: 3102687 - RNA, 13 nt, Mycobacterium bovis subsp bovis AF2122/97
guggucucgacgg

SEQ ID NO: 3102688 - RNA, 21 nt, Mycobacterium bovis subsp bovis AF2122/97
guggucucgacggcgccgccc

SEQ ID NO: 3102689 - RNA, 15 nt, Mycobacterium bovis subsp bovis AF2122/97
guggucucggucagc

SEQ ID NO: 3102690 - RNA, 22 nt, Mycobacterium bovis subsp bovis AF2122/97
guggucugccaaaagggcggca

SEQ ID NO: 3102691 - RNA, 13 nt, Mycobacterium bovis subsp bovis AF2122/97
guggucugcgcgg

SEQ ID NO: 3102692 - RNA, 14 nt, Mycobacterium bovis subsp bovis AF2122/97
guggucuuggcccg

SEQ ID NO: 3102693 - RNA, 18 nt, Mycobacterium bovis subsp bovis AF2122/97
guggucuuggcccggcgg

SEQ ID NO: 3102694 - RNA, 13 nt, Mycobacterium bovis subsp bovis AF2122/97
guggucuuggcgg

SEQ ID NO: 3102695 - RNA, 20 nt, Mycobacterium bovis subsp bovis AF2122/97
guggucuuggcgguggcccg

SEQ ID NO: 3102696 - RNA, 21 nt, Mycobacterium bovis subsp bovis AF2122/97
guggucuuggcgguggcccga

SEQ ID NO: 3102697 - RNA, 19 nt, Mycobacterium bovis subsp bovis AF2122/97
guggugaaguagucggcgc

SEQ ID NO: 3102698 - RNA, 19 nt, Mycobacterium bovis subsp bovis AF2122/97
guggugacagauccgcccc

SEQ ID NO: 3102699 - RNA, 19 nt, Mycobacterium bovis subsp bovis AF2122/97
guggugagugcgucucggu

SEQ ID NO: 3102700 - RNA, 18 nt, Mycobacterium bovis subsp bovis AF2122/97
guggugauccagccgucg

SEQ ID NO: 3102701 - RNA, 23 nt, Mycobacterium bovis subsp bovis AF2122/97
guggugcaccgauuccagcggaa

SEQ ID NO: 3102702 - RNA, 17 nt, Mycobacterium bovis subsp bovis AF2122/97
guggugccgcggccacc

SEQ ID NO: 3102703 - RNA, 15 nt, Mycobacterium bovis subsp bovis AF2122/97
guggugccggcgccg

SEQ ID NO: 3102704 - RNA, 14 nt, Mycobacterium bovis subsp bovis AF2122/97
guggugcgcaaucg

SEQ ID NO: 3102705 - RNA, 14 nt, Mycobacterium bovis subsp bovis AF2122/97
guggugcgcuggcc

SEQ ID NO: 3102706 - RNA, 14 nt, Mycobacterium bovis subsp bovis AF2122/97
guggugcucgucgg

SEQ ID NO: 3102707 - RNA, 15 nt, Mycobacterium bovis subsp bovis AF2122/97
gugguggacgaugcg

SEQ ID NO: 3102708 - RNA, 16 nt, Mycobacterium bovis subsp bovis AF2122/97
gugguggacgaugcgg

SEQ ID NO: 3102709 - RNA, 16 nt, Mycobacterium bovis subsp bovis AF2122/97
gugguggacgccaugg

SEQ ID NO: 3102710 - RNA, 23 nt, Mycobacterium bovis subsp bovis AF2122/97
gugguggaguuuccgaagcccgg

SEQ ID NO: 3102711 - RNA, 19 nt, Mycobacterium bovis subsp bovis AF2122/97
gugguggcauaaccgcuga

SEQ ID NO: 3102712 - RNA, 13 nt, Mycobacterium bovis subsp bovis AF2122/97
guggugggcggga

SEQ ID NO: 3102713 - RNA, 13 nt, Mycobacterium bovis subsp bovis AF2122/97
guggugggcgugg

SEQ ID NO: 3102714 - RNA, 15 nt, Mycobacterium bovis subsp bovis AF2122/97
guggugggcguggcu

SEQ ID NO: 3102715 - RNA, 20 nt, Mycobacterium bovis subsp bovis AF2122/97
guggugggcuaggucgcgcu

SEQ ID NO: 3102716 - RNA, 18 nt, Mycobacterium bovis subsp bovis AF2122/97
gugguggguugaucgcgc

SEQ ID NO: 3102717 - RNA, 19 nt, Mycobacterium bovis subsp bovis AF2122/97
guggugucagccaccggug

SEQ ID NO: 3102718 - RNA, 20 nt, Mycobacterium bovis subsp bovis AF2122/97
gugguguccaccgcaucggu

SEQ ID NO: 3102719 - RNA, 12 nt, Mycobacterium bovis subsp bovis AF2122/97
guggugucgcuc

SEQ ID NO: 3102720 - RNA, 15 nt, Mycobacterium bovis subsp bovis AF2122/97
guggugucggcgaga

SEQ ID NO: 3102721 - RNA, 18 nt, Mycobacterium bovis subsp bovis AF2122/97
guggugucgguucgucgg

SEQ ID NO: 3102722 - RNA, 15 nt, Mycobacterium bovis subsp bovis AF2122/97
gugguguucuccugc

SEQ ID NO: 3102723 - RNA, 18 nt, Mycobacterium bovis subsp bovis AF2122/97
gugguuauucuucggugg

SEQ ID NO: 3102724 - RNA, 20 nt, Mycobacterium bovis subsp bovis AF2122/97
gugguucaccucggcgacga

SEQ ID NO: 3102725 - RNA, 18 nt, Mycobacterium bovis subsp bovis AF2122/97
gugguuccggcugguggg

SEQ ID NO: 3102726 - RNA, 13 nt, Mycobacterium bovis subsp bovis AF2122/97
gugguucgaaccg

SEQ ID NO: 3102727 - RNA, 14 nt, Mycobacterium bovis subsp bovis AF2122/97
gugguucggcgucg

SEQ ID NO: 3102728 - RNA, 16 nt, Mycobacterium bovis subsp bovis AF2122/97
gugguugcggccgucg

SEQ ID NO: 3102729 - RNA, 18 nt, Mycobacterium bovis subsp bovis AF2122/97
gugguuguaccagccgaa

SEQ ID NO: 3102730 - RNA, 13 nt, Mycobacterium bovis subsp bovis AF2122/97
gugguuguggcgg

SEQ ID NO: 3102731 - RNA, 18 nt, Mycobacterium bovis subsp bovis AF2122/97
gugguuguucggccaucg

SEQ ID NO: 3102732 - RNA, 18 nt, Mycobacterium bovis subsp bovis AF2122/97
gugguuugcgcccugagc

SEQ ID NO: 3102733 - RNA, 12 nt, Mycobacterium bovis subsp bovis AF2122/97
gugguuuugggc

SEQ ID NO: 3102734 - RNA, 16 nt, Mycobacterium bovis subsp bovis AF2122/97
guguaauugccgacgc

SEQ ID NO: 3102735 - RNA, 22 nt, Mycobacterium bovis subsp bovis AF2122/97
guguacaccgcgcccgccgauc

SEQ ID NO: 3102736 - RNA, 16 nt, Mycobacterium bovis subsp bovis AF2122/97
guguacgcccgcucgg

SEQ ID NO: 3102737 - RNA, 17 nt, Mycobacterium bovis subsp bovis AF2122/97
guguacgcccgcucgga

SEQ ID NO: 3102738 - RNA, 17 nt, Mycobacterium bovis subsp bovis AF2122/97
guguacgugcucguaga

SEQ ID NO: 3102739 - RNA, 19 nt, Mycobacterium bovis subsp bovis AF2122/97
guguagaagcgggcgucgc

SEQ ID NO: 3102740 - RNA, 20 nt, Mycobacterium bovis subsp bovis AF2122/97
guguagaagcgggcgucgcg

SEQ ID NO: 3102741 - RNA, 18 nt, Mycobacterium bovis subsp bovis AF2122/97
guguagacgugcgucagg

SEQ ID NO: 3102742 - RNA, 14 nt, Mycobacterium bovis subsp bovis AF2122/97
guguagcagcgcca

SEQ ID NO: 3102743 - RNA, 16 nt, Mycobacterium bovis subsp bovis AF2122/97
guguagcagcgccagc

SEQ ID NO: 3102744 - RNA, 20 nt, Mycobacterium bovis subsp bovis AF2122/97
guguagcagcgccagcagcu

SEQ ID NO: 3102745 - RNA, 12 nt, Mycobacterium bovis subsp bovis AF2122/97
guguagcccagc

SEQ ID NO: 3102746 - RNA, 16 nt, Mycobacterium bovis subsp bovis AF2122/97
guguagccgagcacgg

SEQ ID NO: 3102747 - RNA, 19 nt, Mycobacterium bovis subsp bovis AF2122/97
guguagccggcgccgccgu

SEQ ID NO: 3102748 - RNA, 18 nt, Mycobacterium bovis subsp bovis AF2122/97
guguagcgaugccguuga

SEQ ID NO: 3102749 - RNA, 20 nt, Mycobacterium bovis subsp bovis AF2122/97
guguagcuucgaugggcauc

SEQ ID NO: 3102750 - RNA, 20 nt, Mycobacterium bovis subsp bovis AF2122/97
guguaggcaaccuuuggccg

SEQ ID NO: 3102751 - RNA, 20 nt, Mycobacterium bovis subsp bovis AF2122/97
guguaggccucggcagcaaa

SEQ ID NO: 3102752 - RNA, 14 nt, Mycobacterium bovis subsp bovis AF2122/97
guguagggcggcgu

SEQ ID NO: 3102753 - RNA, 19 nt, Mycobacterium bovis subsp bovis AF2122/97
guguaguggcccgcgggca

SEQ ID NO: 3102754 - RNA, 15 nt, Mycobacterium bovis subsp bovis AF2122/97
guguaucgacggcgg

SEQ ID NO: 3102755 - RNA, 20 nt, Mycobacterium bovis subsp bovis AF2122/97
guguaugcauccacugcggc

SEQ ID NO: 3102756 - RNA, 14 nt, Mycobacterium bovis subsp bovis AF2122/97
guguauuggggugg

SEQ ID NO: 3102757 - RNA, 14 nt, Mycobacterium bovis subsp bovis AF2122/97
gugucaacgcgcgg

SEQ ID NO: 3102758 - RNA, 14 nt, Mycobacterium bovis subsp bovis AF2122/97
gugucaacggcacc

SEQ ID NO: 3102759 - RNA, 14 nt, Mycobacterium bovis subsp bovis AF2122/97
gugucaaugacacc

SEQ ID NO: 3102760 - RNA, 17 nt, Mycobacterium bovis subsp bovis AF2122/97
gugucaaugacaccggg

SEQ ID NO: 3102761 - RNA, 22 nt, Mycobacterium bovis subsp bovis AF2122/97
gugucacccaauggagccgcga

SEQ ID NO: 3102762 - RNA, 13 nt, Mycobacterium bovis subsp bovis AF2122/97
gugucaccgccgg

SEQ ID NO: 3102763 - RNA, 15 nt, Mycobacterium bovis subsp bovis AF2122/97
gugucaccgccggga

SEQ ID NO: 3102764 - RNA, 22 nt, Mycobacterium bovis subsp bovis AF2122/97
gugucacgacccaagucgccga

SEQ ID NO: 3102765 - RNA, 16 nt, Mycobacterium bovis subsp bovis AF2122/97
gugucacgcgaccacc

SEQ ID NO: 3102766 - RNA, 20 nt, Mycobacterium bovis subsp bovis AF2122/97
gugucagcaagaucggcagc

SEQ ID NO: 3102767 - RNA, 22 nt, Mycobacterium bovis subsp bovis AF2122/97
gugucagcaagaucggcagcgu

SEQ ID NO: 3102768 - RNA, 22 nt, Mycobacterium bovis subsp bovis AF2122/97
gugucagcugauuaccgacacc

SEQ ID NO: 3102769 - RNA, 20 nt, Mycobacterium bovis subsp bovis AF2122/97
guguccaccaccggcacccg

SEQ ID NO: 3102770 - RNA, 12 nt, Mycobacterium bovis subsp bovis AF2122/97
guguccagcaug

SEQ ID NO: 3102771 - RNA, 17 nt, Mycobacterium bovis subsp bovis AF2122/97
guguccagccaggcgau

SEQ ID NO: 3102772 - RNA, 18 nt, Mycobacterium bovis subsp bovis AF2122/97
gugucccaagccugccga

SEQ ID NO: 3102773 - RNA, 16 nt, Mycobacterium bovis subsp bovis AF2122/97
gugucccauggugagc

SEQ ID NO: 3102774 - RNA, 18 nt, Mycobacterium bovis subsp bovis AF2122/97
guguccccggcugccagc

SEQ ID NO: 3102775 - RNA, 12 nt, Mycobacterium bovis subsp bovis AF2122/97
gugucccgcgag

SEQ ID NO: 3102776 - RNA, 21 nt, Mycobacterium bovis subsp bovis AF2122/97
gugucccggaccaucgccugc

SEQ ID NO: 3102777 - RNA, 13 nt, Mycobacterium bovis subsp bovis AF2122/97
guguccgagcggc

SEQ ID NO: 3102778 - RNA, 12 nt, Mycobacterium bovis subsp bovis AF2122/97
guguccgccgga

SEQ ID NO: 3102779 - RNA, 16 nt, Mycobacterium bovis subsp bovis AF2122/97
guguccgccgucaccc

SEQ ID NO: 3102780 - RNA, 17 nt, Mycobacterium bovis subsp bovis AF2122/97
guguccggggaccucgg

SEQ ID NO: 3102781 - RNA, 13 nt, Mycobacterium bovis subsp bovis AF2122/97
guguccucgaccg

SEQ ID NO: 3102782 - RNA, 16 nt, Mycobacterium bovis subsp bovis AF2122/97
guguccucgguguccu

SEQ ID NO: 3102783 - RNA, 18 nt, Mycobacterium bovis subsp bovis AF2122/97
guguccucgucgagguca

SEQ ID NO: 3102784 - RNA, 15 nt, Mycobacterium bovis subsp bovis AF2122/97
gugucgaagagcagg

SEQ ID NO: 3102785 - RNA, 20 nt, Mycobacterium bovis subsp bovis AF2122/97
gugucgacaaccgcugccgc

SEQ ID NO: 3102786 - RNA, 23 nt, Mycobacterium bovis subsp bovis AF2122/97
gugucgaccuucucgaugcugac

SEQ ID NO: 3102787 - RNA, 22 nt, Mycobacterium bovis subsp bovis AF2122/97
gugucgacgcgggcguugacga

SEQ ID NO: 3102788 - RNA, 17 nt, Mycobacterium bovis subsp bovis AF2122/97
gugucgacggucauccc

SEQ ID NO: 3102789 - RNA, 22 nt, Mycobacterium bovis subsp bovis AF2122/97
gugucgacuugugacggucguc

SEQ ID NO: 3102790 - RNA, 22 nt, Mycobacterium bovis subsp bovis AF2122/97
gugucgccacaccggggcggcc

SEQ ID NO: 3102791 - RNA, 22 nt, Mycobacterium bovis subsp bovis AF2122/97
gugucgccgccguugccgccgg

SEQ ID NO: 3102792 - RNA, 15 nt, Mycobacterium bovis subsp bovis AF2122/97
gugucgccgcucggu

SEQ ID NO: 3102793 - RNA, 13 nt, Mycobacterium bovis subsp bovis AF2122/97
gugucgccgucgc

SEQ ID NO: 3102794 - RNA, 16 nt, Mycobacterium bovis subsp bovis AF2122/97
gugucgccgucgcggc

SEQ ID NO: 3102795 - RNA, 16 nt, Mycobacterium bovis subsp bovis AF2122/97
gugucgcggccgcccc

SEQ ID NO: 3102796 - RNA, 19 nt, Mycobacterium bovis subsp bovis AF2122/97
gugucgcugcaaccgccgg

SEQ ID NO: 3102797 - RNA, 12 nt, Mycobacterium bovis subsp bovis AF2122/97
gugucggccagc

SEQ ID NO: 3102798 - RNA, 15 nt, Mycobacterium bovis subsp bovis AF2122/97
gugucggccagcaac

SEQ ID NO: 3102799 - RNA, 17 nt, Mycobacterium bovis subsp bovis AF2122/97
gugucggcgagagggcg

SEQ ID NO: 3102800 - RNA, 16 nt, Mycobacterium bovis subsp bovis AF2122/97
gugucggcgagggcgc

SEQ ID NO: 3102801 - RNA, 14 nt, Mycobacterium bovis subsp bovis AF2122/97
gugucggcucgagu

SEQ ID NO: 3102802 - RNA, 17 nt, Mycobacterium bovis subsp bovis AF2122/97
gugucgggcgcgcugcc

SEQ ID NO: 3102803 - RNA, 16 nt, Mycobacterium bovis subsp bovis AF2122/97
gugucgggcugucagg

SEQ ID NO: 3102804 - RNA, 16 nt, Mycobacterium bovis subsp bovis AF2122/97
gugucgggugugcagg

SEQ ID NO: 3102805 - RNA, 22 nt, Mycobacterium bovis subsp bovis AF2122/97
gugucgggugugcaggccgcgg

SEQ ID NO: 3102806 - RNA, 12 nt, Mycobacterium bovis subsp bovis AF2122/97
gugucggugcgc

SEQ ID NO: 3102807 - RNA, 14 nt, Mycobacterium bovis subsp bovis AF2122/97
gugucggugcgcgc

SEQ ID NO: 3102808 - RNA, 21 nt, Mycobacterium bovis subsp bovis AF2122/97
gugucgguucggucggccugc

SEQ ID NO: 3102809 - RNA, 15 nt, Mycobacterium bovis subsp bovis AF2122/97
gugucguaccagcca

SEQ ID NO: 3102810 - RNA, 16 nt, Mycobacterium bovis subsp bovis AF2122/97
gugucguacccggcaa

SEQ ID NO: 3102811 - RNA, 17 nt, Mycobacterium bovis subsp bovis AF2122/97
gugucgucgaggucagu

SEQ ID NO: 3102812 - RNA, 22 nt, Mycobacterium bovis subsp bovis AF2122/97
gugucgucgguguuccgccgcg

SEQ ID NO: 3102813 - RNA, 15 nt, Mycobacterium bovis subsp bovis AF2122/97
gugucgugggcaccu

SEQ ID NO: 3102814 - RNA, 18 nt, Mycobacterium bovis subsp bovis AF2122/97
gugucguggucgugggug

SEQ ID NO: 3102815 - RNA, 15 nt, Mycobacterium bovis subsp bovis AF2122/97
gugucuacgccggga

SEQ ID NO: 3102816 - RNA, 22 nt, Mycobacterium bovis subsp bovis AF2122/97
gugucugccaugugucccggac

SEQ ID NO: 3102817 - RNA, 14 nt, Mycobacterium bovis subsp bovis AF2122/97
gugucugcccgagg

SEQ ID NO: 3102818 - RNA, 15 nt, Mycobacterium bovis subsp bovis AF2122/97
gugucugcccgaggu

SEQ ID NO: 3102819 - RNA, 13 nt, Mycobacterium bovis subsp bovis AF2122/97
gugucugcucgcg

SEQ ID NO: 3102820 - RNA, 22 nt, Mycobacterium bovis subsp bovis AF2122/97
gugucugggaccccgcugcgac

SEQ ID NO: 3102821 - RNA, 21 nt, Mycobacterium bovis subsp bovis AF2122/97
gugugaacuggucgacgucgg

SEQ ID NO: 3102822 - RNA, 18 nt, Mycobacterium bovis subsp bovis AF2122/97
gugugacagcccgcuggc

SEQ ID NO: 3102823 - RNA, 22 nt, Mycobacterium bovis subsp bovis AF2122/97
gugugagcagacccaguccggu

SEQ ID NO: 3102824 - RNA, 14 nt, Mycobacterium bovis subsp bovis AF2122/97
gugugaggccuucg

SEQ ID NO: 3102825 - RNA, 19 nt, Mycobacterium bovis subsp bovis AF2122/97
gugugagucccacgccagc

SEQ ID NO: 3102826 - RNA, 20 nt, Mycobacterium bovis subsp bovis AF2122/97
gugugagucccacgccagcg

SEQ ID NO: 3102827 - RNA, 14 nt, Mycobacterium bovis subsp bovis AF2122/97
gugugauacagcgc

SEQ ID NO: 3102828 - RNA, 24 nt, Mycobacterium bovis subsp bovis AF2122/97
gugugauuccgggucggcgaacgc

SEQ ID NO: 3102829 - RNA, 16 nt, Mycobacterium bovis subsp bovis AF2122/97
gugugcaagccgaaca

SEQ ID NO: 3102830 - RNA, 15 nt, Mycobacterium bovis subsp bovis AF2122/97
gugugcacgcgggcg

SEQ ID NO: 3102831 - RNA, 18 nt, Mycobacterium bovis subsp bovis AF2122/97
gugugcaggccgcggaga

SEQ ID NO: 3102832 - RNA, 16 nt, Mycobacterium bovis subsp bovis AF2122/97
gugugccccgcucucg

SEQ ID NO: 3102833 - RNA, 15 nt, Mycobacterium bovis subsp bovis AF2122/97
gugugcccgcaccgu

SEQ ID NO: 3102834 - RNA, 19 nt, Mycobacterium bovis subsp bovis AF2122/97
gugugcggacaguucccgg

SEQ ID NO: 3102835 - RNA, 13 nt, Mycobacterium bovis subsp bovis AF2122/97
gugugcggcagcc

SEQ ID NO: 3102836 - RNA, 20 nt, Mycobacterium bovis subsp bovis AF2122/97
gugugcggcauugguaccgg

SEQ ID NO: 3102837 - RNA, 16 nt, Mycobacterium bovis subsp bovis AF2122/97
gugugcgugcggucga

SEQ ID NO: 3102838 - RNA, 13 nt, Mycobacterium bovis subsp bovis AF2122/97
gugugcucgucgc

SEQ ID NO: 3102839 - RNA, 15 nt, Mycobacterium bovis subsp bovis AF2122/97
gugugcugccaccgg

SEQ ID NO: 3102840 - RNA, 15 nt, Mycobacterium bovis subsp bovis AF2122/97
gugugcuucgagcac

SEQ ID NO: 3102841 - RNA, 19 nt, Mycobacterium bovis subsp bovis AF2122/97
guguggaauacgcugcugg

SEQ ID NO: 3102842 - RNA, 20 nt, Mycobacterium bovis subsp bovis AF2122/97
guguggaauggaccagcgcc

SEQ ID NO: 3102843 - RNA, 18 nt, Mycobacterium bovis subsp bovis AF2122/97
guguggacuucagcaggc

SEQ ID NO: 3102844 - RNA, 23 nt, Mycobacterium bovis subsp bovis AF2122/97
guguggacuucagcaggcccagc

SEQ ID NO: 3102845 - RNA, 22 nt, Mycobacterium bovis subsp bovis AF2122/97
guguggagcucgcggcgcaggu

SEQ ID NO: 3102846 - RNA, 17 nt, Mycobacterium bovis subsp bovis AF2122/97
guguggcacguggcgac

SEQ ID NO: 3102847 - RNA, 22 nt, Mycobacterium bovis subsp bovis AF2122/97
guguggcacguggcgaccggcg

SEQ ID NO: 3102848 - RNA, 12 nt, Mycobacterium bovis subsp bovis AF2122/97
guguggcagccc

SEQ ID NO: 3102849 - RNA, 13 nt, Mycobacterium bovis subsp bovis AF2122/97
guguggcagcccc

SEQ ID NO: 3102850 - RNA, 21 nt, Mycobacterium bovis subsp bovis AF2122/97
guguggcccaaccgcauucgg

SEQ ID NO: 3102851 - RNA, 23 nt, Mycobacterium bovis subsp bovis AF2122/97
guguggccuugcgucaucggcuc

SEQ ID NO: 3102852 - RNA, 18 nt, Mycobacterium bovis subsp bovis AF2122/97
guguggcgaugaccacgc

SEQ ID NO: 3102853 - RNA, 13 nt, Mycobacterium bovis subsp bovis AF2122/97
guguggcggcggg

SEQ ID NO: 3102854 - RNA, 23 nt, Mycobacterium bovis subsp bovis AF2122/97
guguggcuugacgcccgggcacc

SEQ ID NO: 3102855 - RNA, 21 nt, Mycobacterium bovis subsp bovis AF2122/97
guguggcuugcgucgcggacg

SEQ ID NO: 3102856 - RNA, 19 nt, Mycobacterium bovis subsp bovis AF2122/97
guguggcuuugacugcugg

SEQ ID NO: 3102857 - RNA, 22 nt, Mycobacterium bovis subsp bovis AF2122/97
guguggcuuugacugcuggggg

SEQ ID NO: 3102858 - RNA, 14 nt, Mycobacterium bovis subsp bovis AF2122/97
gugugggccccgcc

SEQ ID NO: 3102859 - RNA, 16 nt, Mycobacterium bovis subsp bovis AF2122/97
gugugggccccgccga

SEQ ID NO: 3102860 - RNA, 15 nt, Mycobacterium bovis subsp bovis AF2122/97
gugugggggucaggg

SEQ ID NO: 3102861 - RNA, 12 nt, Mycobacterium bovis subsp bovis AF2122/97
guguggucacca

SEQ ID NO: 3102862 - RNA, 17 nt, Mycobacterium bovis subsp bovis AF2122/97
guguggucauuggggug

SEQ ID NO: 3102863 - RNA, 18 nt, Mycobacterium bovis subsp bovis AF2122/97
guguggucauuggggugg

SEQ ID NO: 3102864 - RNA, 22 nt, Mycobacterium bovis subsp bovis AF2122/97
guguggucccggcacgaccacc

SEQ ID NO: 3102865 - RNA, 23 nt, Mycobacterium bovis subsp bovis AF2122/97
guguggucccggcacgaccaccg

SEQ ID NO: 3102866 - RNA, 18 nt, Mycobacterium bovis subsp bovis AF2122/97
guguggucggcuguggug

SEQ ID NO: 3102867 - RNA, 16 nt, Mycobacterium bovis subsp bovis AF2122/97
guguggugacagagcg

SEQ ID NO: 3102868 - RNA, 20 nt, Mycobacterium bovis subsp bovis AF2122/97
guguguacacacgaugacgu

SEQ ID NO: 3102869 - RNA, 22 nt, Mycobacterium bovis subsp bovis AF2122/97
gugugugcaagccgaacaccgu

SEQ ID NO: 3102870 - RNA, 20 nt, Mycobacterium bovis subsp bovis AF2122/97
guguguggcgccggggacca

SEQ ID NO: 3102871 - RNA, 22 nt, Mycobacterium bovis subsp bovis AF2122/97
guguguuccaacuccugcagcc

SEQ ID NO: 3102872 - RNA, 15 nt, Mycobacterium bovis subsp bovis AF2122/97
guguguuuggugguu

SEQ ID NO: 3102873 - RNA, 14 nt, Mycobacterium bovis subsp bovis AF2122/97
guguuaaagaagcc

SEQ ID NO: 3102874 - RNA, 16 nt, Mycobacterium bovis subsp bovis AF2122/97
guguuacgguucgacc

SEQ ID NO: 3102875 - RNA, 15 nt, Mycobacterium bovis subsp bovis AF2122/97
guguuaggcccgcac

SEQ ID NO: 3102876 - RNA, 17 nt, Mycobacterium bovis subsp bovis AF2122/97
guguuauugaugcccga

SEQ ID NO: 3102877 - RNA, 19 nt, Mycobacterium bovis subsp bovis AF2122/97
guguucaucacgccgccgg

SEQ ID NO: 3102878 - RNA, 17 nt, Mycobacterium bovis subsp bovis AF2122/97
guguucggagcugggcu

SEQ ID NO: 3102879 - RNA, 16 nt, Mycobacterium bovis subsp bovis AF2122/97
guguucggcccgcacc

SEQ ID NO: 3102880 - RNA, 20 nt, Mycobacterium bovis subsp bovis AF2122/97
guguucgggucgaucaccga

SEQ ID NO: 3102881 - RNA, 20 nt, Mycobacterium bovis subsp bovis AF2122/97
guguucgucgaccaugcgac

SEQ ID NO: 3102882 - RNA, 16 nt, Mycobacterium bovis subsp bovis AF2122/97
guguucguggccgaca

SEQ ID NO: 3102883 - RNA, 20 nt, Mycobacterium bovis subsp bovis AF2122/97
guguucuaccugcacccagg

SEQ ID NO: 3102884 - RNA, 19 nt, Mycobacterium bovis subsp bovis AF2122/97
guguucuggcaacccccgc

SEQ ID NO: 3102885 - RNA, 15 nt, Mycobacterium bovis subsp bovis AF2122/97
guguucuggucgcgu

SEQ ID NO: 3102886 - RNA, 19 nt, Mycobacterium bovis subsp bovis AF2122/97
guguugaagaagcccgagu

SEQ ID NO: 3102887 - RNA, 12 nt, Mycobacterium bovis subsp bovis AF2122/97
guguugaccagg

SEQ ID NO: 3102888 - RNA, 14 nt, Mycobacterium bovis subsp bovis AF2122/97
guguugaccggguc

SEQ ID NO: 3102889 - RNA, 20 nt, Mycobacterium bovis subsp bovis AF2122/97
guguugaggcguaccagcug

SEQ ID NO: 3102890 - RNA, 19 nt, Mycobacterium bovis subsp bovis AF2122/97
guguugagggugcccgagu

SEQ ID NO: 3102891 - RNA, 18 nt, Mycobacterium bovis subsp bovis AF2122/97
guguugaugggcagccgc

SEQ ID NO: 3102892 - RNA, 23 nt, Mycobacterium bovis subsp bovis AF2122/97
guguugaugggcagccgcccgcc

SEQ ID NO: 3102893 - RNA, 15 nt, Mycobacterium bovis subsp bovis AF2122/97
guguugcacccgaau

SEQ ID NO: 3102894 - RNA, 23 nt, Mycobacterium bovis subsp bovis AF2122/97
guguugcacguacgggcaguggu

SEQ ID NO: 3102895 - RNA, 19 nt, Mycobacterium bovis subsp bovis AF2122/97
guguugccagaucagcacc

SEQ ID NO: 3102896 - RNA, 16 nt, Mycobacterium bovis subsp bovis AF2122/97
guguugccgaagcccg

SEQ ID NO: 3102897 - RNA, 13 nt, Mycobacterium bovis subsp bovis AF2122/97
guguugcgguggg

SEQ ID NO: 3102898 - RNA, 17 nt, Mycobacterium bovis subsp bovis AF2122/97
guguugcucgccgucgu

SEQ ID NO: 3102899 - RNA, 22 nt, Mycobacterium bovis subsp bovis AF2122/97
guguuggaagucccgccguugc

SEQ ID NO: 3102900 - RNA, 16 nt, Mycobacterium bovis subsp bovis AF2122/97
guguuguaggccgggc

SEQ ID NO: 3102901 - RNA, 20 nt, Mycobacterium bovis subsp bovis AF2122/97
guguuuauggcccugggccc

SEQ ID NO: 3102902 - RNA, 15 nt, Mycobacterium bovis subsp bovis AF2122/97
guguuuaugguugug

SEQ ID NO: 3102903 - RNA, 24 nt, Mycobacterium bovis subsp bovis AF2122/97
guguuugcggcuucggcagaccgg

SEQ ID NO: 3102904 - RNA, 15 nt, Mycobacterium bovis subsp bovis AF2122/97
guguuuggccgccga

SEQ ID NO: 3102905 - RNA, 16 nt, Mycobacterium bovis subsp bovis AF2122/97
guguuuggguuuuguu

SEQ ID NO: 3102906 - RNA, 14 nt, Mycobacterium bovis subsp bovis AF2122/97
guguuugucgcggu

SEQ ID NO: 3102907 - RNA, 17 nt, Mycobacterium bovis subsp bovis AF2122/97
guuaacacccugggcaa

SEQ ID NO: 3102908 - RNA, 18 nt, Mycobacterium bovis subsp bovis AF2122/97
guuaacacccugggcaaa

SEQ ID NO: 3102909 - RNA, 22 nt, Mycobacterium bovis subsp bovis AF2122/97
guuaacugcgccuaaccccggc

SEQ ID NO: 3102910 - RNA, 23 nt, Mycobacterium bovis subsp bovis AF2122/97
guuaaucaaggugaucagcagga

SEQ ID NO: 3102911 - RNA, 18 nt, Mycobacterium bovis subsp bovis AF2122/97
guuaaugaccgcguccac

SEQ ID NO: 3102912 - RNA, 20 nt, Mycobacterium bovis subsp bovis AF2122/97
guuaccaccgucaccgccgg

SEQ ID NO: 3102913 - RNA, 13 nt, Mycobacterium bovis subsp bovis AF2122/97
guuacccgcagcg

SEQ ID NO: 3102914 - RNA, 17 nt, Mycobacterium bovis subsp bovis AF2122/97
guuacccggaccgucgu

SEQ ID NO: 3102915 - RNA, 19 nt, Mycobacterium bovis subsp bovis AF2122/97
guuaccgauuggcccgagu

SEQ ID NO: 3102916 - RNA, 16 nt, Mycobacterium bovis subsp bovis AF2122/97
guuaccgccggcgccg

SEQ ID NO: 3102917 - RNA, 16 nt, Mycobacterium bovis subsp bovis AF2122/97
guuaccgccgucgcca

SEQ ID NO: 3102918 - RNA, 22 nt, Mycobacterium bovis subsp bovis AF2122/97
guuaccgccguuaccgacgccg

SEQ ID NO: 3102919 - RNA, 18 nt, Mycobacterium bovis subsp bovis AF2122/97
guuacgcaucgucagcga

SEQ ID NO: 3102920 - RNA, 22 nt, Mycobacterium bovis subsp bovis AF2122/97
guuacgcaucgucagcgaccac

SEQ ID NO: 3102921 - RNA, 16 nt, Mycobacterium bovis subsp bovis AF2122/97
guuacuccgacggccc

SEQ ID NO: 3102922 - RNA, 15 nt, Mycobacterium bovis subsp bovis AF2122/97
guuacuggagauacc

SEQ ID NO: 3102923 - RNA, 20 nt, Mycobacterium bovis subsp bovis AF2122/97
guuagcagccgcugaucugc

SEQ ID NO: 3102924 - RNA, 19 nt, Mycobacterium bovis subsp bovis AF2122/97
guuagcauugaguucggcc

SEQ ID NO: 3102925 - RNA, 22 nt, Mycobacterium bovis subsp bovis AF2122/97
guuagcauugaguucggccacc

SEQ ID NO: 3102926 - RNA, 18 nt, Mycobacterium bovis subsp bovis AF2122/97
guuagccccgaagccggu

SEQ ID NO: 3102927 - RNA, 17 nt, Mycobacterium bovis subsp bovis AF2122/97
guuagccccgcaggggg

SEQ ID NO: 3102928 - RNA, 13 nt, Mycobacterium bovis subsp bovis AF2122/97
guuagccgcggcc

SEQ ID NO: 3102929 - RNA, 19 nt, Mycobacterium bovis subsp bovis AF2122/97
guuagccggguuggccggg

SEQ ID NO: 3102930 - RNA, 23 nt, Mycobacterium bovis subsp bovis AF2122/97
guuagccuccagauucgccgccc

SEQ ID NO: 3102931 - RNA, 19 nt, Mycobacterium bovis subsp bovis AF2122/97
guuagcgcggccagcagca

SEQ ID NO: 3102932 - RNA, 23 nt, Mycobacterium bovis subsp bovis AF2122/97
guuagcgcggccagcagcagaug

SEQ ID NO: 3102933 - RNA, 14 nt, Mycobacterium bovis subsp bovis AF2122/97
guuagcggcgggca

SEQ ID NO: 3102934 - RNA, 22 nt, Mycobacterium bovis subsp bovis AF2122/97
guuagcggugaugggggugcac

SEQ ID NO: 3102935 - RNA, 22 nt, Mycobacterium bovis subsp bovis AF2122/97
guuagcguagcccgaguuguug

SEQ ID NO: 3102936 - RNA, 20 nt, Mycobacterium bovis subsp bovis AF2122/97
guuagcuuagcugccgucgg

SEQ ID NO: 3102937 - RNA, 18 nt, Mycobacterium bovis subsp bovis AF2122/97
guuaggaguggccgggcg

SEQ ID NO: 3102938 - RNA, 19 nt, Mycobacterium bovis subsp bovis AF2122/97
guuaggaguggccgggcgg

SEQ ID NO: 3102939 - RNA, 22 nt, Mycobacterium bovis subsp bovis AF2122/97
guuaggcgauaucgcacaugga

SEQ ID NO: 3102940 - RNA, 21 nt, Mycobacterium bovis subsp bovis AF2122/97
guuaucccagacugucgagcg

SEQ ID NO: 3102941 - RNA, 24 nt, Mycobacterium bovis subsp bovis AF2122/97
guuaucccagacugucgagcgacg

SEQ ID NO: 3102942 - RNA, 20 nt, Mycobacterium bovis subsp bovis AF2122/97
guuauccgaccacuccacgc

SEQ ID NO: 3102943 - RNA, 14 nt, Mycobacterium bovis subsp bovis AF2122/97
guuaucgaagcccg

SEQ ID NO: 3102944 - RNA, 20 nt, Mycobacterium bovis subsp bovis AF2122/97
guuaucgacaccaccauucc

SEQ ID NO: 3102945 - RNA, 22 nt, Mycobacterium bovis subsp bovis AF2122/97
guuaucgucggcuugcugcccc

SEQ ID NO: 3102946 - RNA, 22 nt, Mycobacterium bovis subsp bovis AF2122/97
guuaugacgugaguuucaccac

SEQ ID NO: 3102947 - RNA, 16 nt, Mycobacterium bovis subsp bovis AF2122/97
guuaugagcgcucggg

SEQ ID NO: 3102948 - RNA, 17 nt, Mycobacterium bovis subsp bovis AF2122/97
guuauguauccgcgccg

SEQ ID NO: 3102949 - RNA, 16 nt, Mycobacterium bovis subsp bovis AF2122/97
guucaacaccgguaac

SEQ ID NO: 3102950 - RNA, 22 nt, Mycobacterium bovis subsp bovis AF2122/97
guucaacuccggcaccggcaac

SEQ ID NO: 3102951 - RNA, 17 nt, Mycobacterium bovis subsp bovis AF2122/97
guucaacucgggcagcu

SEQ ID NO: 3102952 - RNA, 21 nt, Mycobacterium bovis subsp bovis AF2122/97
guucaccaccgcacaucgucc

SEQ ID NO: 3102953 - RNA, 19 nt, Mycobacterium bovis subsp bovis AF2122/97
guucaccaugucggccacc

SEQ ID NO: 3102954 - RNA, 18 nt, Mycobacterium bovis subsp bovis AF2122/97
guucacccacuccgccga

SEQ ID NO: 3102955 - RNA, 19 nt, Mycobacterium bovis subsp bovis AF2122/97
guucacccacuccgccgau

SEQ ID NO: 3102956 - RNA, 14 nt, Mycobacterium bovis subsp bovis AF2122/97
guucaccgacgcga

SEQ ID NO: 3102957 - RNA, 23 nt, Mycobacterium bovis subsp bovis AF2122/97
guucaccgacgcgaacgcggcca

SEQ ID NO: 3102958 - RNA, 16 nt, Mycobacterium bovis subsp bovis AF2122/97
guucaccgcgcgcucg

SEQ ID NO: 3102959 - RNA, 21 nt, Mycobacterium bovis subsp bovis AF2122/97
guucacgccagucccacuggg

SEQ ID NO: 3102960 - RNA, 13 nt, Mycobacterium bovis subsp bovis AF2122/97
guucacgccgccg

SEQ ID NO: 3102961 - RNA, 14 nt, Mycobacterium bovis subsp bovis AF2122/97
guucacgccgccgg

SEQ ID NO: 3102962 - RNA, 18 nt, Mycobacterium bovis subsp bovis AF2122/97
guucacgccgccggagau

SEQ ID NO: 3102963 - RNA, 21 nt, Mycobacterium bovis subsp bovis AF2122/97
guucacgcgcggaucggcggc

SEQ ID NO: 3102964 - RNA, 20 nt, Mycobacterium bovis subsp bovis AF2122/97
guucacgcucgacgacgggc

SEQ ID NO: 3102965 - RNA, 15 nt, Mycobacterium bovis subsp bovis AF2122/97
guucacgcucguaga

SEQ ID NO: 3102966 - RNA, 13 nt, Mycobacterium bovis subsp bovis AF2122/97
guucacggccgca

SEQ ID NO: 3102967 - RNA, 16 nt, Mycobacterium bovis subsp bovis AF2122/97
guucacguucagccca

SEQ ID NO: 3102968 - RNA, 14 nt, Mycobacterium bovis subsp bovis AF2122/97
guucacguucggcg

SEQ ID NO: 3102969 - RNA, 17 nt, Mycobacterium bovis subsp bovis AF2122/97
guucacguucggcgacg

SEQ ID NO: 3102970 - RNA, 16 nt, Mycobacterium bovis subsp bovis AF2122/97
guucagcacgugggcc

SEQ ID NO: 3102971 - RNA, 13 nt, Mycobacterium bovis subsp bovis AF2122/97
guucagcaggccc

SEQ ID NO: 3102972 - RNA, 19 nt, Mycobacterium bovis subsp bovis AF2122/97
guucagcaggcccuucagu

SEQ ID NO: 3102973 - RNA, 20 nt, Mycobacterium bovis subsp bovis AF2122/97
guucagccacgcagcacggc

SEQ ID NO: 3102974 - RNA, 17 nt, Mycobacterium bovis subsp bovis AF2122/97
guucagccaggccgcaa

SEQ ID NO: 3102975 - RNA, 19 nt, Mycobacterium bovis subsp bovis AF2122/97
guucagcccaugcccggcg

SEQ ID NO: 3102976 - RNA, 17 nt, Mycobacterium bovis subsp bovis AF2122/97
guucagcgaccaaugca

SEQ ID NO: 3102977 - RNA, 15 nt, Mycobacterium bovis subsp bovis AF2122/97
guucagcgacggccg

SEQ ID NO: 3102978 - RNA, 16 nt, Mycobacterium bovis subsp bovis AF2122/97
guucagcgccagcgcc

SEQ ID NO: 3102979 - RNA, 19 nt, Mycobacterium bovis subsp bovis AF2122/97
guucagcgcuggcaggccg

SEQ ID NO: 3102980 - RNA, 20 nt, Mycobacterium bovis subsp bovis AF2122/97
guucagcgcuggcaggccgg

SEQ ID NO: 3102981 - RNA, 21 nt, Mycobacterium bovis subsp bovis AF2122/97
guucagcgcuggcaggccggg

SEQ ID NO: 3102982 - RNA, 17 nt, Mycobacterium bovis subsp bovis AF2122/97
guucagcggccagcagu

SEQ ID NO: 3102983 - RNA, 15 nt, Mycobacterium bovis subsp bovis AF2122/97
guucagcgucgacug

SEQ ID NO: 3102984 - RNA, 18 nt, Mycobacterium bovis subsp bovis AF2122/97
guucagggguggcgcggg

SEQ ID NO: 3102985 - RNA, 23 nt, Mycobacterium bovis subsp bovis AF2122/97
guucauaaagguccaaccaccgg

SEQ ID NO: 3102986 - RNA, 18 nt, Mycobacterium bovis subsp bovis AF2122/97
guucaucacgccgccgga

SEQ ID NO: 3102987 - RNA, 23 nt, Mycobacterium bovis subsp bovis AF2122/97
guucaucacgccgccggagguga

SEQ ID NO: 3102988 - RNA, 18 nt, Mycobacterium bovis subsp bovis AF2122/97
guucauccgcaguccggg

SEQ ID NO: 3102989 - RNA, 21 nt, Mycobacterium bovis subsp bovis AF2122/97
guucaucgcagucauguccau

SEQ ID NO: 3102990 - RNA, 20 nt, Mycobacterium bovis subsp bovis AF2122/97
guucaucgccggcgcgccga

SEQ ID NO: 3102991 - RNA, 18 nt, Mycobacterium bovis subsp bovis AF2122/97
guucaucgggcaccaacc

SEQ ID NO: 3102992 - RNA, 11 nt, Mycobacterium bovis subsp bovis AF2122/97
guucaugaucg

SEQ ID NO: 3102993 - RNA, 14 nt, Mycobacterium bovis subsp bovis AF2122/97
guucaugcggcggc

SEQ ID NO: 3102994 - RNA, 15 nt, Mycobacterium bovis subsp bovis AF2122/97
guucaugcggcggcg

SEQ ID NO: 3102995 - RNA, 19 nt, Mycobacterium bovis subsp bovis AF2122/97
guucaugcggcggcgcucg

SEQ ID NO: 3102996 - RNA, 20 nt, Mycobacterium bovis subsp bovis AF2122/97
guuccaacuccugcagcccg

SEQ ID NO: 3102997 - RNA, 14 nt, Mycobacterium bovis subsp bovis AF2122/97
guuccacaccaggc

SEQ ID NO: 3102998 - RNA, 19 nt, Mycobacterium bovis subsp bovis AF2122/97
guuccacaccaggccgagc

SEQ ID NO: 3102999 - RNA, 16 nt, Mycobacterium bovis subsp bovis AF2122/97
guuccacacccaguug

SEQ ID NO: 3103000 - RNA, 23 nt, Mycobacterium bovis subsp bovis AF2122/97
guuccacaucaaaacggcggugg

SEQ ID NO: 3103001 - RNA, 17 nt, Mycobacterium bovis subsp bovis AF2122/97
guuccaccagcgcccgu

SEQ ID NO: 3103002 - RNA, 20 nt, Mycobacterium bovis subsp bovis AF2122/97
guuccacccggugccgcagc

SEQ ID NO: 3103003 - RNA, 15 nt, Mycobacterium bovis subsp bovis AF2122/97
guuccacgcugccca

SEQ ID NO: 3103004 - RNA, 14 nt, Mycobacterium bovis subsp bovis AF2122/97
guuccacggccagg

SEQ ID NO: 3103005 - RNA, 18 nt, Mycobacterium bovis subsp bovis AF2122/97
guuccagaaggccgcacc

SEQ ID NO: 3103006 - RNA, 22 nt, Mycobacterium bovis subsp bovis AF2122/97
guuccagccgacggcagugcug

SEQ ID NO: 3103007 - RNA, 14 nt, Mycobacterium bovis subsp bovis AF2122/97
guuccagcggcacc

SEQ ID NO: 3103008 - RNA, 15 nt, Mycobacterium bovis subsp bovis AF2122/97
guuccagcggcaccg

SEQ ID NO: 3103009 - RNA, 19 nt, Mycobacterium bovis subsp bovis AF2122/97
guuccagggucacggucgg

SEQ ID NO: 3103010 - RNA, 18 nt, Mycobacterium bovis subsp bovis AF2122/97
guuccaguccccgccggc

SEQ ID NO: 3103011 - RNA, 21 nt, Mycobacterium bovis subsp bovis AF2122/97
guuccaguuggaacugaugaa

SEQ ID NO: 3103012 - RNA, 15 nt, Mycobacterium bovis subsp bovis AF2122/97
guuccauacagccgc

SEQ ID NO: 3103013 - RNA, 18 nt, Mycobacterium bovis subsp bovis AF2122/97
guuccauacagccgccga

SEQ ID NO: 3103014 - RNA, 16 nt, Mycobacterium bovis subsp bovis AF2122/97
guuccaucgccgacgc

SEQ ID NO: 3103015 - RNA, 14 nt, Mycobacterium bovis subsp bovis AF2122/97
guuccauggcccgc

SEQ ID NO: 3103016 - RNA, 16 nt, Mycobacterium bovis subsp bovis AF2122/97
guucccaccaccaccg

SEQ ID NO: 3103017 - RNA, 20 nt, Mycobacterium bovis subsp bovis AF2122/97
guucccaccaccaccgccgg

SEQ ID NO: 3103018 - RNA, 22 nt, Mycobacterium bovis subsp bovis AF2122/97
guucccaccaccaccgccggug

SEQ ID NO: 3103019 - RNA, 15 nt, Mycobacterium bovis subsp bovis AF2122/97
guucccacccacgcc

SEQ ID NO: 3103020 - RNA, 20 nt, Mycobacterium bovis subsp bovis AF2122/97
guuccccgagaacggcgggc

SEQ ID NO: 3103021 - RNA, 15 nt, Mycobacterium bovis subsp bovis AF2122/97
guuccccgucgccag

SEQ ID NO: 3103022 - RNA, 16 nt, Mycobacterium bovis subsp bovis AF2122/97
guuccccgucgccagg

SEQ ID NO: 3103023 - RNA, 20 nt, Mycobacterium bovis subsp bovis AF2122/97
guuccccgucgccagggccu

SEQ ID NO: 3103024 - RNA, 15 nt, Mycobacterium bovis subsp bovis AF2122/97
guucccgaaccccga

SEQ ID NO: 3103025 - RNA, 22 nt, Mycobacterium bovis subsp bovis AF2122/97
guucccgacaucgugauccccg

SEQ ID NO: 3103026 - RNA, 15 nt, Mycobacterium bovis subsp bovis AF2122/97
guucccgccggcgcc

SEQ ID NO: 3103027 - RNA, 16 nt, Mycobacterium bovis subsp bovis AF2122/97
guucccgcucgggcaa

SEQ ID NO: 3103028 - RNA, 14 nt, Mycobacterium bovis subsp bovis AF2122/97
guucccgcuugauc

SEQ ID NO: 3103029 - RNA, 16 nt, Mycobacterium bovis subsp bovis AF2122/97
guucccgggcagccgc

SEQ ID NO: 3103030 - RNA, 22 nt, Mycobacterium bovis subsp bovis AF2122/97
guucccggugaccacuugcagc

SEQ ID NO: 3103031 - RNA, 19 nt, Mycobacterium bovis subsp bovis AF2122/97
guuccgaucgcguuagcca

SEQ ID NO: 3103032 - RNA, 18 nt, Mycobacterium bovis subsp bovis AF2122/97
guuccgaucggcaaucga

SEQ ID NO: 3103033 - RNA, 20 nt, Mycobacterium bovis subsp bovis AF2122/97
guuccgcaaugaccuggccg

SEQ ID NO: 3103034 - RNA, 16 nt, Mycobacterium bovis subsp bovis AF2122/97
guuccgcaucggcccc

SEQ ID NO: 3103035 - RNA, 15 nt, Mycobacterium bovis subsp bovis AF2122/97
guuccgcccagcgag

SEQ ID NO: 3103036 - RNA, 16 nt, Mycobacterium bovis subsp bovis AF2122/97
guuccgccggccccac

SEQ ID NO: 3103037 - RNA, 23 nt, Mycobacterium bovis subsp bovis AF2122/97
guuccgccggccccaccgguacc

SEQ ID NO: 3103038 - RNA, 19 nt, Mycobacterium bovis subsp bovis AF2122/97
guuccgcugcggugccggc

SEQ ID NO: 3103039 - RNA, 21 nt, Mycobacterium bovis subsp bovis AF2122/97
guuccgcugcggugccggccc

SEQ ID NO: 3103040 - RNA, 17 nt, Mycobacterium bovis subsp bovis AF2122/97
guuccgcugucgagccg

SEQ ID NO: 3103041 - RNA, 18 nt, Mycobacterium bovis subsp bovis AF2122/97
guuccggauccgaugaca

SEQ ID NO: 3103042 - RNA, 12 nt, Mycobacterium bovis subsp bovis AF2122/97
guuccggcuggu

SEQ ID NO: 3103043 - RNA, 18 nt, Mycobacterium bovis subsp bovis AF2122/97
guuccgggguggacggcg

SEQ ID NO: 3103044 - RNA, 19 nt, Mycobacterium bovis subsp bovis AF2122/97
guuccgggguggacggcga

SEQ ID NO: 3103045 - RNA, 22 nt, Mycobacterium bovis subsp bovis AF2122/97
guuccgugcagaaaccaggacc

SEQ ID NO: 3103046 - RNA, 19 nt, Mycobacterium bovis subsp bovis AF2122/97
guuccgugcgggucguccg

SEQ ID NO: 3103047 - RNA, 15 nt, Mycobacterium bovis subsp bovis AF2122/97
guuccuccagcagcg

SEQ ID NO: 3103048 - RNA, 12 nt, Mycobacterium bovis subsp bovis AF2122/97
guuccucgaccg

SEQ ID NO: 3103049 - RNA, 16 nt, Mycobacterium bovis subsp bovis AF2122/97
guuccucgaguucggg

SEQ ID NO: 3103050 - RNA, 15 nt, Mycobacterium bovis subsp bovis AF2122/97
guuccugcacgguca

SEQ ID NO: 3103051 - RNA, 21 nt, Mycobacterium bovis subsp bovis AF2122/97
guuccuugagacgccggggaa

SEQ ID NO: 3103052 - RNA, 18 nt, Mycobacterium bovis subsp bovis AF2122/97
guuccuugaugcggccgc

SEQ ID NO: 3103053 - RNA, 16 nt, Mycobacterium bovis subsp bovis AF2122/97
guucgaaagcaccgau

SEQ ID NO: 3103054 - RNA, 14 nt, Mycobacterium bovis subsp bovis AF2122/97
guucgaacgcgauc

SEQ ID NO: 3103055 - RNA, 14 nt, Mycobacterium bovis subsp bovis AF2122/97
guucgaaggccacc

SEQ ID NO: 3103056 - RNA, 23 nt, Mycobacterium bovis subsp bovis AF2122/97
guucgaaggccacccgcgaagcc

SEQ ID NO: 3103057 - RNA, 17 nt, Mycobacterium bovis subsp bovis AF2122/97
guucgaaguucucggug

SEQ ID NO: 3103058 - RNA, 21 nt, Mycobacterium bovis subsp bovis AF2122/97
guucgaccaucaucucggugg

SEQ ID NO: 3103059 - RNA, 13 nt, Mycobacterium bovis subsp bovis AF2122/97
guucgacccccgc

SEQ ID NO: 3103060 - RNA, 20 nt, Mycobacterium bovis subsp bovis AF2122/97
guucgaccguguaaccaucg

SEQ ID NO: 3103061 - RNA, 15 nt, Mycobacterium bovis subsp bovis AF2122/97
guucgacggacaccc

SEQ ID NO: 3103062 - RNA, 15 nt, Mycobacterium bovis subsp bovis AF2122/97
guucgacggcgucaa

SEQ ID NO: 3103063 - RNA, 17 nt, Mycobacterium bovis subsp bovis AF2122/97
guucgacgggccggacc

SEQ ID NO: 3103064 - RNA, 20 nt, Mycobacterium bovis subsp bovis AF2122/97
guucgacggugccgucugcg

SEQ ID NO: 3103065 - RNA, 16 nt, Mycobacterium bovis subsp bovis AF2122/97
guucgacugaaucaug

SEQ ID NO: 3103066 - RNA, 21 nt, Mycobacterium bovis subsp bovis AF2122/97
guucgagaccccgacgaugcg

SEQ ID NO: 3103067 - RNA, 14 nt, Mycobacterium bovis subsp bovis AF2122/97
guucgagggugacc

SEQ ID NO: 3103068 - RNA, 21 nt, Mycobacterium bovis subsp bovis AF2122/97
guucgaguccccuuagcucca

SEQ ID NO: 3103069 - RNA, 20 nt, Mycobacterium bovis subsp bovis AF2122/97
guucgaguccugguacccca

SEQ ID NO: 3103070 - RNA, 14 nt, Mycobacterium bovis subsp bovis AF2122/97
guucgaguucggcc

SEQ ID NO: 3103071 - RNA, 14 nt, Mycobacterium bovis subsp bovis AF2122/97
guucgauagcggcg

SEQ ID NO: 3103072 - RNA, 15 nt, Mycobacterium bovis subsp bovis AF2122/97
guucgaugaaaaugc

SEQ ID NO: 3103073 - RNA, 13 nt, Mycobacterium bovis subsp bovis AF2122/97
guucgaugacuga

SEQ ID NO: 3103074 - RNA, 15 nt, Mycobacterium bovis subsp bovis AF2122/97
guucgauggcaucgg

SEQ ID NO: 3103075 - RNA, 19 nt, Mycobacterium bovis subsp bovis AF2122/97
guucgaugggugcaccgaa

SEQ ID NO: 3103076 - RNA, 19 nt, Mycobacterium bovis subsp bovis AF2122/97
guucgcaccggagucggcg

SEQ ID NO: 3103077 - RNA, 20 nt, Mycobacterium bovis subsp bovis AF2122/97
guucgcccacagcuugcccg

SEQ ID NO: 3103078 - RNA, 23 nt, Mycobacterium bovis subsp bovis AF2122/97
guucgcccgcccgucuuccagcc

SEQ ID NO: 3103079 - RNA, 21 nt, Mycobacterium bovis subsp bovis AF2122/97
guucgcccgucgccaaucugc

SEQ ID NO: 3103080 - RNA, 14 nt, Mycobacterium bovis subsp bovis AF2122/97
guucgccgaagccg

SEQ ID NO: 3103081 - RNA, 16 nt, Mycobacterium bovis subsp bovis AF2122/97
guucgccgcccggcgu

SEQ ID NO: 3103082 - RNA, 20 nt, Mycobacterium bovis subsp bovis AF2122/97
guucgccuggucaccgaaga

SEQ ID NO: 3103083 - RNA, 17 nt, Mycobacterium bovis subsp bovis AF2122/97
guucgcgaagcugugcc

SEQ ID NO: 3103084 - RNA, 19 nt, Mycobacterium bovis subsp bovis AF2122/97
guucgcgccguggcgucgg

SEQ ID NO: 3103085 - RNA, 19 nt, Mycobacterium bovis subsp bovis AF2122/97
guucgcgggcgucccgcau

SEQ ID NO: 3103086 - RNA, 15 nt, Mycobacterium bovis subsp bovis AF2122/97
guucgcgucacacca

SEQ ID NO: 3103087 - RNA, 23 nt, Mycobacterium bovis subsp bovis AF2122/97
guucgcgucugacaucgucgacg

SEQ ID NO: 3103088 - RNA, 12 nt, Mycobacterium bovis subsp bovis AF2122/97
guucgcuccccc

SEQ ID NO: 3103089 - RNA, 13 nt, Mycobacterium bovis subsp bovis AF2122/97
guucgcucccccg

SEQ ID NO: 3103090 - RNA, 14 nt, Mycobacterium bovis subsp bovis AF2122/97
guucgcucccccgc

SEQ ID NO: 3103091 - RNA, 15 nt, Mycobacterium bovis subsp bovis AF2122/97
guucgcucccccgcu

SEQ ID NO: 3103092 - RNA, 22 nt, Mycobacterium bovis subsp bovis AF2122/97
guucgcucggggacucauggcc

SEQ ID NO: 3103093 - RNA, 17 nt, Mycobacterium bovis subsp bovis AF2122/97
guucgcugaccgcuacc

SEQ ID NO: 3103094 - RNA, 15 nt, Mycobacterium bovis subsp bovis AF2122/97
guucgcugacggcca

SEQ ID NO: 3103095 - RNA, 15 nt, Mycobacterium bovis subsp bovis AF2122/97
guucggaaucggagc

SEQ ID NO: 3103096 - RNA, 17 nt, Mycobacterium bovis subsp bovis AF2122/97
guucggacggcugguag

SEQ ID NO: 3103097 - RNA, 15 nt, Mycobacterium bovis subsp bovis AF2122/97
guucggacucacucg

SEQ ID NO: 3103098 - RNA, 17 nt, Mycobacterium bovis subsp bovis AF2122/97
guucggcaaugacggcc

SEQ ID NO: 3103099 - RNA, 21 nt, Mycobacterium bovis subsp bovis AF2122/97
guucggcacaaccaacgacag

SEQ ID NO: 3103100 - RNA, 16 nt, Mycobacterium bovis subsp bovis AF2122/97
guucggcagcgcggca

SEQ ID NO: 3103101 - RNA, 15 nt, Mycobacterium bovis subsp bovis AF2122/97
guucggcagcgggcu

SEQ ID NO: 3103102 - RNA, 15 nt, Mycobacterium bovis subsp bovis AF2122/97
guucggccaacccgg

SEQ ID NO: 3103103 - RNA, 13 nt, Mycobacterium bovis subsp bovis AF2122/97
guucggccaccaa

SEQ ID NO: 3103104 - RNA, 15 nt, Mycobacterium bovis subsp bovis AF2122/97
guucggccaccaacc

SEQ ID NO: 3103105 - RNA, 23 nt, Mycobacterium bovis subsp bovis AF2122/97
guucggccaccaaccucaucgcg

SEQ ID NO: 3103106 - RNA, 21 nt, Mycobacterium bovis subsp bovis AF2122/97
guucggccaccagaaccagcg

SEQ ID NO: 3103107 - RNA, 17 nt, Mycobacterium bovis subsp bovis AF2122/97
guucggccauggcggcg

SEQ ID NO: 3103108 - RNA, 20 nt, Mycobacterium bovis subsp bovis AF2122/97
guucggcccgcacccguccg

SEQ ID NO: 3103109 - RNA, 15 nt, Mycobacterium bovis subsp bovis AF2122/97
guucggccgcggugu

SEQ ID NO: 3103110 - RNA, 21 nt, Mycobacterium bovis subsp bovis AF2122/97
guucggccggagccgccggcc

SEQ ID NO: 3103111 - RNA, 12 nt, Mycobacterium bovis subsp bovis AF2122/97
guucggccguca

SEQ ID NO: 3103112 - RNA, 20 nt, Mycobacterium bovis subsp bovis AF2122/97
guucggcgagcacaugcugc

SEQ ID NO: 3103113 - RNA, 15 nt, Mycobacterium bovis subsp bovis AF2122/97
guucggcgcccgcuc

SEQ ID NO: 3103114 - RNA, 12 nt, Mycobacterium bovis subsp bovis AF2122/97
guucggcgcuga

SEQ ID NO: 3103115 - RNA, 18 nt, Mycobacterium bovis subsp bovis AF2122/97
guucggcgcugaucgcgc

SEQ ID NO: 3103116 - RNA, 15 nt, Mycobacterium bovis subsp bovis AF2122/97
guucggcgcugccag

SEQ ID NO: 3103117 - RNA, 16 nt, Mycobacterium bovis subsp bovis AF2122/97
guucggcggcugccag

SEQ ID NO: 3103118 - RNA, 18 nt, Mycobacterium bovis subsp bovis AF2122/97
guucggcguagaugcgcc

SEQ ID NO: 3103119 - RNA, 15 nt, Mycobacterium bovis subsp bovis AF2122/97
guucggcgucgaccc

SEQ ID NO: 3103120 - RNA, 12 nt, Mycobacterium bovis subsp bovis AF2122/97
guucggcgucgu

SEQ ID NO: 3103121 - RNA, 14 nt, Mycobacterium bovis subsp bovis AF2122/97
guucggcugcgcuu

SEQ ID NO: 3103122 - RNA, 11 nt, Mycobacterium bovis subsp bovis AF2122/97
guucggcuggc

SEQ ID NO: 3103123 - RNA, 16 nt, Mycobacterium bovis subsp bovis AF2122/97
guucggcuggcgucga

SEQ ID NO: 3103124 - RNA, 12 nt, Mycobacterium bovis subsp bovis AF2122/97
guucgggacgcg

SEQ ID NO: 3103125 - RNA, 14 nt, Mycobacterium bovis subsp bovis AF2122/97
guucgggacgcgag

SEQ ID NO: 3103126 - RNA, 16 nt, Mycobacterium bovis subsp bovis AF2122/97
guucgggcagcuggcg

SEQ ID NO: 3103127 - RNA, 17 nt, Mycobacterium bovis subsp bovis AF2122/97
guucggggcgcgguacc

SEQ ID NO: 3103128 - RNA, 14 nt, Mycobacterium bovis subsp bovis AF2122/97
guucggguacccgg

SEQ ID NO: 3103129 - RNA, 20 nt, Mycobacterium bovis subsp bovis AF2122/97
guucgggucgaucaccgaca

SEQ ID NO: 3103130 - RNA, 23 nt, Mycobacterium bovis subsp bovis AF2122/97
guucgggucgaucaccgacaccg

SEQ ID NO: 3103131 - RNA, 14 nt, Mycobacterium bovis subsp bovis AF2122/97
guucggucggggag

SEQ ID NO: 3103132 - RNA, 14 nt, Mycobacterium bovis subsp bovis AF2122/97
guucggucuugccg

SEQ ID NO: 3103133 - RNA, 15 nt, Mycobacterium bovis subsp bovis AF2122/97
guucggugagguccu

SEQ ID NO: 3103134 - RNA, 18 nt, Mycobacterium bovis subsp bovis AF2122/97
guucggugagguccucgg

SEQ ID NO: 3103135 - RNA, 14 nt, Mycobacterium bovis subsp bovis AF2122/97
guucguagcgggca

SEQ ID NO: 3103136 - RNA, 16 nt, Mycobacterium bovis subsp bovis AF2122/97
guucgucgacgucggc

SEQ ID NO: 3103137 - RNA, 19 nt, Mycobacterium bovis subsp bovis AF2122/97
guucgucgggacgccgccc

SEQ ID NO: 3103138 - RNA, 14 nt, Mycobacterium bovis subsp bovis AF2122/97
guucgucgggcaug

SEQ ID NO: 3103139 - RNA, 15 nt, Mycobacterium bovis subsp bovis AF2122/97
guucgucgggcaugc

SEQ ID NO: 3103140 - RNA, 22 nt, Mycobacterium bovis subsp bovis AF2122/97
guucgucgguugccacgccgcc

SEQ ID NO: 3103141 - RNA, 17 nt, Mycobacterium bovis subsp bovis AF2122/97
guucgucgucgcugaau

SEQ ID NO: 3103142 - RNA, 16 nt, Mycobacterium bovis subsp bovis AF2122/97
guucgugacgugcaug

SEQ ID NO: 3103143 - RNA, 15 nt, Mycobacterium bovis subsp bovis AF2122/97
guucgugagcggcca

SEQ ID NO: 3103144 - RNA, 14 nt, Mycobacterium bovis subsp bovis AF2122/97
guucgugccggcgu

SEQ ID NO: 3103145 - RNA, 22 nt, Mycobacterium bovis subsp bovis AF2122/97
guucguggcuggcaugccggcg

SEQ ID NO: 3103146 - RNA, 17 nt, Mycobacterium bovis subsp bovis AF2122/97
guucguucccgcucggg

SEQ ID NO: 3103147 - RNA, 14 nt, Mycobacterium bovis subsp bovis AF2122/97
guucucaucgccaa

SEQ ID NO: 3103148 - RNA, 22 nt, Mycobacterium bovis subsp bovis AF2122/97
guucucgccgaagcccggccac

SEQ ID NO: 3103149 - RNA, 23 nt, Mycobacterium bovis subsp bovis AF2122/97
guucucgcuguugaagccgcccg

SEQ ID NO: 3103150 - RNA, 18 nt, Mycobacterium bovis subsp bovis AF2122/97
guucucggucccgccggu

SEQ ID NO: 3103151 - RNA, 16 nt, Mycobacterium bovis subsp bovis AF2122/97
guucugcaccagcucg

SEQ ID NO: 3103152 - RNA, 18 nt, Mycobacterium bovis subsp bovis AF2122/97
guucugccuuaccaaccg

SEQ ID NO: 3103153 - RNA, 15 nt, Mycobacterium bovis subsp bovis AF2122/97
guucugcgaucacga

SEQ ID NO: 3103154 - RNA, 13 nt, Mycobacterium bovis subsp bovis AF2122/97
guucugcgcccac

SEQ ID NO: 3103155 - RNA, 15 nt, Mycobacterium bovis subsp bovis AF2122/97
guucugcggucgguc

SEQ ID NO: 3103156 - RNA, 15 nt, Mycobacterium bovis subsp bovis AF2122/97
guucuggaaccccga

SEQ ID NO: 3103157 - RNA, 21 nt, Mycobacterium bovis subsp bovis AF2122/97
guucuggcaacccccgccggc

SEQ ID NO: 3103158 - RNA, 18 nt, Mycobacterium bovis subsp bovis AF2122/97
guucugggccugcggcau

SEQ ID NO: 3103159 - RNA, 19 nt, Mycobacterium bovis subsp bovis AF2122/97
guucuucucucgggccagu

SEQ ID NO: 3103160 - RNA, 16 nt, Mycobacterium bovis subsp bovis AF2122/97
guucuugucgaaguaa

SEQ ID NO: 3103161 - RNA, 17 nt, Mycobacterium bovis subsp bovis AF2122/97
guugaaaacgcccggca

SEQ ID NO: 3103162 - RNA, 15 nt, Mycobacterium bovis subsp bovis AF2122/97
guugaacauguccag

SEQ ID NO: 3103163 - RNA, 12 nt, Mycobacterium bovis subsp bovis AF2122/97
guugaaccggua

SEQ ID NO: 3103164 - RNA, 14 nt, Mycobacterium bovis subsp bovis AF2122/97
guugaacgccgcca

SEQ ID NO: 3103165 - RNA, 14 nt, Mycobacterium bovis subsp bovis AF2122/97
guugaacgcgugcu

SEQ ID NO: 3103166 - RNA, 13 nt, Mycobacterium bovis subsp bovis AF2122/97
guugaacguuccc

SEQ ID NO: 3103167 - RNA, 21 nt, Mycobacterium bovis subsp bovis AF2122/97
guugaacucgaccaccgccgg

SEQ ID NO: 3103168 - RNA, 22 nt, Mycobacterium bovis subsp bovis AF2122/97
guugaacucgaguugcucgaca

SEQ ID NO: 3103169 - RNA, 22 nt, Mycobacterium bovis subsp bovis AF2122/97
guugaagaagccgguguugaug

SEQ ID NO: 3103170 - RNA, 23 nt, Mycobacterium bovis subsp bovis AF2122/97
guugaagccgauguccgacgcca

SEQ ID NO: 3103171 - RNA, 17 nt, Mycobacterium bovis subsp bovis AF2122/97
guugaagccgcccgagu

SEQ ID NO: 3103172 - RNA, 13 nt, Mycobacterium bovis subsp bovis AF2122/97
guugaaggcuugu

SEQ ID NO: 3103173 - RNA, 20 nt, Mycobacterium bovis subsp bovis AF2122/97
guugaaggcuugugccagau

SEQ ID NO: 3103174 - RNA, 20 nt, Mycobacterium bovis subsp bovis AF2122/97
guugaaggugccggcguuag

SEQ ID NO: 3103175 - RNA, 17 nt, Mycobacterium bovis subsp bovis AF2122/97
guugacacaacgacgaa

SEQ ID NO: 3103176 - RNA, 14 nt, Mycobacterium bovis subsp bovis AF2122/97
guugaccaccaccg

SEQ ID NO: 3103177 - RNA, 20 nt, Mycobacterium bovis subsp bovis AF2122/97
guugaccagaaccuggagcc

SEQ ID NO: 3103178 - RNA, 13 nt, Mycobacterium bovis subsp bovis AF2122/97
guugaccagcacg

SEQ ID NO: 3103179 - RNA, 12 nt, Mycobacterium bovis subsp bovis AF2122/97
guugaccaggcu

SEQ ID NO: 3103180 - RNA, 22 nt, Mycobacterium bovis subsp bovis AF2122/97
guugacccaucaugguccgggc

SEQ ID NO: 3103181 - RNA, 19 nt, Mycobacterium bovis subsp bovis AF2122/97
guugacccaucucgucguc

SEQ ID NO: 3103182 - RNA, 20 nt, Mycobacterium bovis subsp bovis AF2122/97
guugacccggcagcccggcg

SEQ ID NO: 3103183 - RNA, 18 nt, Mycobacterium bovis subsp bovis AF2122/97
guugacccucgggucguc

SEQ ID NO: 3103184 - RNA, 15 nt, Mycobacterium bovis subsp bovis AF2122/97
guugaccggccggac

SEQ ID NO: 3103185 - RNA, 22 nt, Mycobacterium bovis subsp bovis AF2122/97
guugaccucuucgggcagcgcg

SEQ ID NO: 3103186 - RNA, 13 nt, Mycobacterium bovis subsp bovis AF2122/97
guugaccugcgca

SEQ ID NO: 3103187 - RNA, 17 nt, Mycobacterium bovis subsp bovis AF2122/97
guugacgaucaccccgc

SEQ ID NO: 3103188 - RNA, 21 nt, Mycobacterium bovis subsp bovis AF2122/97
guugacgaucaccccgccaug

SEQ ID NO: 3103189 - RNA, 14 nt, Mycobacterium bovis subsp bovis AF2122/97
guugacgaucaguc

SEQ ID NO: 3103190 - RNA, 18 nt, Mycobacterium bovis subsp bovis AF2122/97
guugacgauccggucggc

SEQ ID NO: 3103191 - RNA, 23 nt, Mycobacterium bovis subsp bovis AF2122/97
guugacgauccggucggcgggca

SEQ ID NO: 3103192 - RNA, 21 nt, Mycobacterium bovis subsp bovis AF2122/97
guugacgaucuccgccaaccg

SEQ ID NO: 3103193 - RNA, 16 nt, Mycobacterium bovis subsp bovis AF2122/97
guugacgaugugcccg

SEQ ID NO: 3103194 - RNA, 12 nt, Mycobacterium bovis subsp bovis AF2122/97
guugacgcagcc

SEQ ID NO: 3103195 - RNA, 18 nt, Mycobacterium bovis subsp bovis AF2122/97
guugacgccgguccccgc

SEQ ID NO: 3103196 - RNA, 19 nt, Mycobacterium bovis subsp bovis AF2122/97
guugacgccgguccccgcc

SEQ ID NO: 3103197 - RNA, 12 nt, Mycobacterium bovis subsp bovis AF2122/97
guugacggcggg

SEQ ID NO: 3103198 - RNA, 23 nt, Mycobacterium bovis subsp bovis AF2122/97
guugacggcggggcggcgguggg

SEQ ID NO: 3103199 - RNA, 14 nt, Mycobacterium bovis subsp bovis AF2122/97
guugacgggcucgg

SEQ ID NO: 3103200 - RNA, 18 nt, Mycobacterium bovis subsp bovis AF2122/97
guugacggucagccgcgg

SEQ ID NO: 3103201 - RNA, 19 nt, Mycobacterium bovis subsp bovis AF2122/97
guugacgguugccccggcg

SEQ ID NO: 3103202 - RNA, 20 nt, Mycobacterium bovis subsp bovis AF2122/97
guugacgguugccccggcga

SEQ ID NO: 3103203 - RNA, 21 nt, Mycobacterium bovis subsp bovis AF2122/97
guugacgguugccccggcgac

SEQ ID NO: 3103204 - RNA, 14 nt, Mycobacterium bovis subsp bovis AF2122/97
guugacguccaaca

SEQ ID NO: 3103205 - RNA, 19 nt, Mycobacterium bovis subsp bovis AF2122/97
guugacgucgagcagcgcc

SEQ ID NO: 3103206 - RNA, 13 nt, Mycobacterium bovis subsp bovis AF2122/97
guugacgucgaug

SEQ ID NO: 3103207 - RNA, 17 nt, Mycobacterium bovis subsp bovis AF2122/97
guugacucugcguccac

SEQ ID NO: 3103208 - RNA, 19 nt, Mycobacterium bovis subsp bovis AF2122/97
guugacucugcguccacca

SEQ ID NO: 3103209 - RNA, 21 nt, Mycobacterium bovis subsp bovis AF2122/97
guugacucugcguccaccacg

SEQ ID NO: 3103210 - RNA, 19 nt, Mycobacterium bovis subsp bovis AF2122/97
guugacuggccgcccggcg

SEQ ID NO: 3103211 - RNA, 20 nt, Mycobacterium bovis subsp bovis AF2122/97
guugacuggccgcccggcga

SEQ ID NO: 3103212 - RNA, 20 nt, Mycobacterium bovis subsp bovis AF2122/97
guugagaacaacgcgucgau

SEQ ID NO: 3103213 - RNA, 21 nt, Mycobacterium bovis subsp bovis AF2122/97
guugagaaccggcucaccacg

SEQ ID NO: 3103214 - RNA, 13 nt, Mycobacterium bovis subsp bovis AF2122/97
guugagcagcacc

SEQ ID NO: 3103215 - RNA, 18 nt, Mycobacterium bovis subsp bovis AF2122/97
guugagcaggugcccgag

SEQ ID NO: 3103216 - RNA, 16 nt, Mycobacterium bovis subsp bovis AF2122/97
guugagcaugucgucg

SEQ ID NO: 3103217 - RNA, 13 nt, Mycobacterium bovis subsp bovis AF2122/97
guugagccgccgc

SEQ ID NO: 3103218 - RNA, 17 nt, Mycobacterium bovis subsp bovis AF2122/97
guugagccgccgcgacg

SEQ ID NO: 3103219 - RNA, 17 nt, Mycobacterium bovis subsp bovis AF2122/97
guugagcugucgcaacg

SEQ ID NO: 3103220 - RNA, 23 nt, Mycobacterium bovis subsp bovis AF2122/97
guugaggacgagguucugccgcg

SEQ ID NO: 3103221 - RNA, 18 nt, Mycobacterium bovis subsp bovis AF2122/97
guugaggaugacgacggu

SEQ ID NO: 3103222 - RNA, 14 nt, Mycobacterium bovis subsp bovis AF2122/97
guugaggccgguga

SEQ ID NO: 3103223 - RNA, 17 nt, Mycobacterium bovis subsp bovis AF2122/97
guugaggccgucgaacg

SEQ ID NO: 3103224 - RNA, 14 nt, Mycobacterium bovis subsp bovis AF2122/97
guugagguagguga

SEQ ID NO: 3103225 - RNA, 20 nt, Mycobacterium bovis subsp bovis AF2122/97
guugaguggaugcgccgcac

SEQ ID NO: 3103226 - RNA, 12 nt, Mycobacterium bovis subsp bovis AF2122/97
guugaucaccga

SEQ ID NO: 3103227 - RNA, 12 nt, Mycobacterium bovis subsp bovis AF2122/97
guugaucagcca

SEQ ID NO: 3103228 - RNA, 15 nt, Mycobacterium bovis subsp bovis AF2122/97
guugaucagccagac

SEQ ID NO: 3103229 - RNA, 16 nt, Mycobacterium bovis subsp bovis AF2122/97
guugaucagugccagg

SEQ ID NO: 3103230 - RNA, 19 nt, Mycobacterium bovis subsp bovis AF2122/97
guugaucgacaccgagcca

SEQ ID NO: 3103231 - RNA, 13 nt, Mycobacterium bovis subsp bovis AF2122/97
guugaucgcgcug

SEQ ID NO: 3103232 - RNA, 14 nt, Mycobacterium bovis subsp bovis AF2122/97
guugaucgcggaca

SEQ ID NO: 3103233 - RNA, 13 nt, Mycobacterium bovis subsp bovis AF2122/97
guugaucggccac

SEQ ID NO: 3103234 - RNA, 13 nt, Mycobacterium bovis subsp bovis AF2122/97
guugaugaagguc

SEQ ID NO: 3103235 - RNA, 17 nt, Mycobacterium bovis subsp bovis AF2122/97
guugaugaccgccgccg

SEQ ID NO: 3103236 - RNA, 16 nt, Mycobacterium bovis subsp bovis AF2122/97
guugaugacggcgucg

SEQ ID NO: 3103237 - RNA, 20 nt, Mycobacterium bovis subsp bovis AF2122/97
guugaugacguugcagccgg

SEQ ID NO: 3103238 - RNA, 15 nt, Mycobacterium bovis subsp bovis AF2122/97
guugaugccgccgga

SEQ ID NO: 3103239 - RNA, 17 nt, Mycobacterium bovis subsp bovis AF2122/97
guugaugcggaugucgu

SEQ ID NO: 3103240 - RNA, 15 nt, Mycobacterium bovis subsp bovis AF2122/97
guugaugcggccgcg

SEQ ID NO: 3103241 - RNA, 23 nt, Mycobacterium bovis subsp bovis AF2122/97
guugaugcguagugcggcgugga

SEQ ID NO: 3103242 - RNA, 14 nt, Mycobacterium bovis subsp bovis AF2122/97
guugauggccccgg

SEQ ID NO: 3103243 - RNA, 19 nt, Mycobacterium bovis subsp bovis AF2122/97
guugaugggcagccgcccg

SEQ ID NO: 3103244 - RNA, 19 nt, Mycobacterium bovis subsp bovis AF2122/97
guugauguugccggaguug

SEQ ID NO: 3103245 - RNA, 15 nt, Mycobacterium bovis subsp bovis AF2122/97
guugauucgugcgau

SEQ ID NO: 3103246 - RNA, 18 nt, Mycobacterium bovis subsp bovis AF2122/97
guugauuucggcggcgau

SEQ ID NO: 3103247 - RNA, 23 nt, Mycobacterium bovis subsp bovis AF2122/97
guugcaacggguacacccgcucg

SEQ ID NO: 3103248 - RNA, 18 nt, Mycobacterium bovis subsp bovis AF2122/97
guugcacaccgaucggca

SEQ ID NO: 3103249 - RNA, 15 nt, Mycobacterium bovis subsp bovis AF2122/97
guugcacagcagcgg

SEQ ID NO: 3103250 - RNA, 15 nt, Mycobacterium bovis subsp bovis AF2122/97
guugcacggccggga

SEQ ID NO: 3103251 - RNA, 17 nt, Mycobacterium bovis subsp bovis AF2122/97
guugcacggccgggacg

SEQ ID NO: 3103252 - RNA, 15 nt, Mycobacterium bovis subsp bovis AF2122/97
guugcacguucggcg

SEQ ID NO: 3103253 - RNA, 18 nt, Mycobacterium bovis subsp bovis AF2122/97
guugcacguucggcgugu

SEQ ID NO: 3103254 - RNA, 13 nt, Mycobacterium bovis subsp bovis AF2122/97
guugcacugcugg

SEQ ID NO: 3103255 - RNA, 15 nt, Mycobacterium bovis subsp bovis AF2122/97
guugcagaccgggug

SEQ ID NO: 3103256 - RNA, 23 nt, Mycobacterium bovis subsp bovis AF2122/97
guugcagccggcauagcggccca

SEQ ID NO: 3103257 - RNA, 16 nt, Mycobacterium bovis subsp bovis AF2122/97
guugcaggacgcccac

SEQ ID NO: 3103258 - RNA, 18 nt, Mycobacterium bovis subsp bovis AF2122/97
guugcaggagccggcaac

SEQ ID NO: 3103259 - RNA, 19 nt, Mycobacterium bovis subsp bovis AF2122/97
guugcaguacuagcagcgg

SEQ ID NO: 3103260 - RNA, 14 nt, Mycobacterium bovis subsp bovis AF2122/97
guugcagucgcgag

SEQ ID NO: 3103261 - RNA, 15 nt, Mycobacterium bovis subsp bovis AF2122/97
guugcauaccgccgg

SEQ ID NO: 3103262 - RNA, 18 nt, Mycobacterium bovis subsp bovis AF2122/97
guugcaucagcacgucgc

SEQ ID NO: 3103263 - RNA, 23 nt, Mycobacterium bovis subsp bovis AF2122/97
guugcaucaugccgcccaucacc

SEQ ID NO: 3103264 - RNA, 16 nt, Mycobacterium bovis subsp bovis AF2122/97
guugccaccggugccg

SEQ ID NO: 3103265 - RNA, 22 nt, Mycobacterium bovis subsp bovis AF2122/97
guugccaccggugccggcgacg

SEQ ID NO: 3103266 - RNA, 20 nt, Mycobacterium bovis subsp bovis AF2122/97
guugccaccguugccgccgu

SEQ ID NO: 3103267 - RNA, 19 nt, Mycobacterium bovis subsp bovis AF2122/97
guugccagcgacgcgguca

SEQ ID NO: 3103268 - RNA, 14 nt, Mycobacterium bovis subsp bovis AF2122/97
guugccaggugcug

SEQ ID NO: 3103269 - RNA, 17 nt, Mycobacterium bovis subsp bovis AF2122/97
guugccagucgaucgcg

SEQ ID NO: 3103270 - RNA, 17 nt, Mycobacterium bovis subsp bovis AF2122/97
guugccaucaaggccac

SEQ ID NO: 3103271 - RNA, 20 nt, Mycobacterium bovis subsp bovis AF2122/97
guugccaucaaggccaccuc

SEQ ID NO: 3103272 - RNA, 20 nt, Mycobacterium bovis subsp bovis AF2122/97
guugcccccauugccgccgu

SEQ ID NO: 3103273 - RNA, 23 nt, Mycobacterium bovis subsp bovis AF2122/97
guugcccccauugccgccgucgc

SEQ ID NO: 3103274 - RNA, 15 nt, Mycobacterium bovis subsp bovis AF2122/97
guugccccgaccgcc

SEQ ID NO: 3103275 - RNA, 17 nt, Mycobacterium bovis subsp bovis AF2122/97
guugccccgaccgccgu

SEQ ID NO: 3103276 - RNA, 16 nt, Mycobacterium bovis subsp bovis AF2122/97
guugccccggcgaccc

SEQ ID NO: 3103277 - RNA, 19 nt, Mycobacterium bovis subsp bovis AF2122/97
guugcccgacccgccgacg

SEQ ID NO: 3103278 - RNA, 17 nt, Mycobacterium bovis subsp bovis AF2122/97
guugcccgagcggcuga

SEQ ID NO: 3103279 - RNA, 17 nt, Mycobacterium bovis subsp bovis AF2122/97
guugcccguucaugcgg

SEQ ID NO: 3103280 - RNA, 17 nt, Mycobacterium bovis subsp bovis AF2122/97
guugccgaaacccgagu

SEQ ID NO: 3103281 - RNA, 19 nt, Mycobacterium bovis subsp bovis AF2122/97
guugccgaaccacgcgccc

SEQ ID NO: 3103282 - RNA, 21 nt, Mycobacterium bovis subsp bovis AF2122/97
guugccgaaccacgcgcccgc

SEQ ID NO: 3103283 - RNA, 14 nt, Mycobacterium bovis subsp bovis AF2122/97
guugccgaagccgg

SEQ ID NO: 3103284 - RNA, 17 nt, Mycobacterium bovis subsp bovis AF2122/97
guugccgaagccggaga

SEQ ID NO: 3103285 - RNA, 23 nt, Mycobacterium bovis subsp bovis AF2122/97
guugccgaagccggaugcgcuuc

SEQ ID NO: 3103286 - RNA, 23 nt, Mycobacterium bovis subsp bovis AF2122/97
guugccgaccgauacaccgacgg

SEQ ID NO: 3103287 - RNA, 17 nt, Mycobacterium bovis subsp bovis AF2122/97
guugccgacgagacggc

SEQ ID NO: 3103288 - RNA, 18 nt, Mycobacterium bovis subsp bovis AF2122/97
guugccgacgaucgacgc

SEQ ID NO: 3103289 - RNA, 20 nt, Mycobacterium bovis subsp bovis AF2122/97
guugccgacgaucgacgccg

SEQ ID NO: 3103290 - RNA, 22 nt, Mycobacterium bovis subsp bovis AF2122/97
guugccgaucaaccccccgggc

SEQ ID NO: 3103291 - RNA, 15 nt, Mycobacterium bovis subsp bovis AF2122/97
guugccgaucaccac

SEQ ID NO: 3103292 - RNA, 19 nt, Mycobacterium bovis subsp bovis AF2122/97
guugccgaucaccacggcg

SEQ ID NO: 3103293 - RNA, 17 nt, Mycobacterium bovis subsp bovis AF2122/97
guugccgaucccggcga

SEQ ID NO: 3103294 - RNA, 22 nt, Mycobacterium bovis subsp bovis AF2122/97
guugccgaucccggcgagcacc

SEQ ID NO: 3103295 - RNA, 20 nt, Mycobacterium bovis subsp bovis AF2122/97
guugccgaucucgcccagcg

SEQ ID NO: 3103296 - RNA, 16 nt, Mycobacterium bovis subsp bovis AF2122/97
guugccgccacgggcg

SEQ ID NO: 3103297 - RNA, 19 nt, Mycobacterium bovis subsp bovis AF2122/97
guugccgccauuggcaggc

SEQ ID NO: 3103298 - RNA, 14 nt, Mycobacterium bovis subsp bovis AF2122/97
guugccgcccacgc

SEQ ID NO: 3103299 - RNA, 19 nt, Mycobacterium bovis subsp bovis AF2122/97
guugccgcccacgcugccc

SEQ ID NO: 3103300 - RNA, 11 nt, Mycobacterium bovis subsp bovis AF2122/97
guugccgccga

SEQ ID NO: 3103301 - RNA, 14 nt, Mycobacterium bovis subsp bovis AF2122/97
guugccgccgacgc

SEQ ID NO: 3103302 - RNA, 19 nt, Mycobacterium bovis subsp bovis AF2122/97
guugccgccgacgccgccg

SEQ ID NO: 3103303 - RNA, 21 nt, Mycobacterium bovis subsp bovis AF2122/97
guugccgccgacgccgccggc

SEQ ID NO: 3103304 - RNA, 13 nt, Mycobacterium bovis subsp bovis AF2122/97
guugccgccgccu

SEQ ID NO: 3103305 - RNA, 14 nt, Mycobacterium bovis subsp bovis AF2122/97
guugccgccgccuc

SEQ ID NO: 3103306 - RNA, 16 nt, Mycobacterium bovis subsp bovis AF2122/97
guugccgccgccuccg

SEQ ID NO: 3103307 - RNA, 18 nt, Mycobacterium bovis subsp bovis AF2122/97
guugccgccgcggcgccc

SEQ ID NO: 3103308 - RNA, 11 nt, Mycobacterium bovis subsp bovis AF2122/97
guugccgccgg

SEQ ID NO: 3103309 - RNA, 13 nt, Mycobacterium bovis subsp bovis AF2122/97
guugccgccggcg

SEQ ID NO: 3103310 - RNA, 14 nt, Mycobacterium bovis subsp bovis AF2122/97
guugccgccggcgc

SEQ ID NO: 3103311 - RNA, 18 nt, Mycobacterium bovis subsp bovis AF2122/97
guugccgccggcgccgcc

SEQ ID NO: 3103312 - RNA, 16 nt, Mycobacterium bovis subsp bovis AF2122/97
guugccgccggucauc

SEQ ID NO: 3103313 - RNA, 16 nt, Mycobacterium bovis subsp bovis AF2122/97
guugccgccggugccg

SEQ ID NO: 3103314 - RNA, 16 nt, Mycobacterium bovis subsp bovis AF2122/97
guugccgccgucaccg

SEQ ID NO: 3103315 - RNA, 20 nt, Mycobacterium bovis subsp bovis AF2122/97
guugccgccgucaccgccgu

SEQ ID NO: 3103316 - RNA, 18 nt, Mycobacterium bovis subsp bovis AF2122/97
guugccgccgucgccgcc

SEQ ID NO: 3103317 - RNA, 20 nt, Mycobacterium bovis subsp bovis AF2122/97
guugccgccgucguugcccg

SEQ ID NO: 3103318 - RNA, 20 nt, Mycobacterium bovis subsp bovis AF2122/97
guugccgccguuaccgccgc

SEQ ID NO: 3103319 - RNA, 13 nt, Mycobacterium bovis subsp bovis AF2122/97
guugccgccguug

SEQ ID NO: 3103320 - RNA, 16 nt, Mycobacterium bovis subsp bovis AF2122/97
guugccgccguugccg

SEQ ID NO: 3103321 - RNA, 22 nt, Mycobacterium bovis subsp bovis AF2122/97
guugccgccugucccgccggcc

SEQ ID NO: 3103322 - RNA, 22 nt, Mycobacterium bovis subsp bovis AF2122/97
guugccgcgaucgggcccagca

SEQ ID NO: 3103323 - RNA, 15 nt, Mycobacterium bovis subsp bovis AF2122/97
guugccgcgccacug

SEQ ID NO: 3103324 - RNA, 21 nt, Mycobacterium bovis subsp bovis AF2122/97
guugccgcgccacuguagggc

SEQ ID NO: 3103325 - RNA, 17 nt, Mycobacterium bovis subsp bovis AF2122/97
guugccgcggucggcga

SEQ ID NO: 3103326 - RNA, 18 nt, Mycobacterium bovis subsp bovis AF2122/97
guugccgcggucggcgac

SEQ ID NO: 3103327 - RNA, 19 nt, Mycobacterium bovis subsp bovis AF2122/97
guugccgcugaauuggcgc

SEQ ID NO: 3103328 - RNA, 19 nt, Mycobacterium bovis subsp bovis AF2122/97
guugccggacaaccugggg

SEQ ID NO: 3103329 - RNA, 17 nt, Mycobacterium bovis subsp bovis AF2122/97
guugccggagacgucgc

SEQ ID NO: 3103330 - RNA, 19 nt, Mycobacterium bovis subsp bovis AF2122/97
guugccggagacgucgccg

SEQ ID NO: 3103331 - RNA, 21 nt, Mycobacterium bovis subsp bovis AF2122/97
guugccggagacgucgccgca

SEQ ID NO: 3103332 - RNA, 14 nt, Mycobacterium bovis subsp bovis AF2122/97
guugccggaucgac

SEQ ID NO: 3103333 - RNA, 14 nt, Mycobacterium bovis subsp bovis AF2122/97
guugccggcggcga

SEQ ID NO: 3103334 - RNA, 18 nt, Mycobacterium bovis subsp bovis AF2122/97
guugccggcuucggcgag

SEQ ID NO: 3103335 - RNA, 19 nt, Mycobacterium bovis subsp bovis AF2122/97
guugccgggguuggucguc

SEQ ID NO: 3103336 - RNA, 20 nt, Mycobacterium bovis subsp bovis AF2122/97
guugccgggguuggucgucg

SEQ ID NO: 3103337 - RNA, 22 nt, Mycobacterium bovis subsp bovis AF2122/97
guugccggucgcauggucgacg

SEQ ID NO: 3103338 - RNA, 20 nt, Mycobacterium bovis subsp bovis AF2122/97
guugccggugccgccgcggc

SEQ ID NO: 3103339 - RNA, 23 nt, Mycobacterium bovis subsp bovis AF2122/97
guugccggugccgccgcggccac

SEQ ID NO: 3103340 - RNA, 18 nt, Mycobacterium bovis subsp bovis AF2122/97
guugccgucagggucagc

SEQ ID NO: 3103341 - RNA, 20 nt, Mycobacterium bovis subsp bovis AF2122/97
guugccgucgucgccgucgg

SEQ ID NO: 3103342 - RNA, 23 nt, Mycobacterium bovis subsp bovis AF2122/97
guugccguuaccgccaaacgcug

SEQ ID NO: 3103343 - RNA, 19 nt, Mycobacterium bovis subsp bovis AF2122/97
guugccguuggugccgccu

SEQ ID NO: 3103344 - RNA, 19 nt, Mycobacterium bovis subsp bovis AF2122/97
guugccugcgcgagugcca

SEQ ID NO: 3103345 - RNA, 22 nt, Mycobacterium bovis subsp bovis AF2122/97
guugcgacaccuccgucagcgc

SEQ ID NO: 3103346 - RNA, 13 nt, Mycobacterium bovis subsp bovis AF2122/97
guugcgacgaacc

SEQ ID NO: 3103347 - RNA, 15 nt, Mycobacterium bovis subsp bovis AF2122/97
guugcgacggcguug

SEQ ID NO: 3103348 - RNA, 16 nt, Mycobacterium bovis subsp bovis AF2122/97
guugcgaggccgcacg

SEQ ID NO: 3103349 - RNA, 17 nt, Mycobacterium bovis subsp bovis AF2122/97
guugcgaucugcggcgc

SEQ ID NO: 3103350 - RNA, 21 nt, Mycobacterium bovis subsp bovis AF2122/97
guugcgcacccgcgggucguc

SEQ ID NO: 3103351 - RNA, 20 nt, Mycobacterium bovis subsp bovis AF2122/97
guugcgccauaacaccgggu

SEQ ID NO: 3103352 - RNA, 21 nt, Mycobacterium bovis subsp bovis AF2122/97
guugcgccauaacaccgggua

SEQ ID NO: 3103353 - RNA, 13 nt, Mycobacterium bovis subsp bovis AF2122/97
guugcgcggauga

SEQ ID NO: 3103354 - RNA, 16 nt, Mycobacterium bovis subsp bovis AF2122/97
guugcgcggcaguggc

SEQ ID NO: 3103355 - RNA, 16 nt, Mycobacterium bovis subsp bovis AF2122/97
guugcgcugcgcgacg

SEQ ID NO: 3103356 - RNA, 22 nt, Mycobacterium bovis subsp bovis AF2122/97
guugcggaguuuuucggggugg

SEQ ID NO: 3103357 - RNA, 13 nt, Mycobacterium bovis subsp bovis AF2122/97
guugcggcggcgc

SEQ ID NO: 3103358 - RNA, 14 nt, Mycobacterium bovis subsp bovis AF2122/97
guugcggcugaccu

SEQ ID NO: 3103359 - RNA, 15 nt, Mycobacterium bovis subsp bovis AF2122/97
guugcggcuggcgcc

SEQ ID NO: 3103360 - RNA, 16 nt, Mycobacterium bovis subsp bovis AF2122/97
guugcgggccaggccc

SEQ ID NO: 3103361 - RNA, 19 nt, Mycobacterium bovis subsp bovis AF2122/97
guugcgggccaggcccucg

SEQ ID NO: 3103362 - RNA, 13 nt, Mycobacterium bovis subsp bovis AF2122/97
guugcgggcgugg

SEQ ID NO: 3103363 - RNA, 20 nt, Mycobacterium bovis subsp bovis AF2122/97
guugcggggugcucagcgac

SEQ ID NO: 3103364 - RNA, 16 nt, Mycobacterium bovis subsp bovis AF2122/97
guugcguuccaguccc

SEQ ID NO: 3103365 - RNA, 15 nt, Mycobacterium bovis subsp bovis AF2122/97
guugcguugcaggaa

SEQ ID NO: 3103366 - RNA, 18 nt, Mycobacterium bovis subsp bovis AF2122/97
guugcguuggcgccacca

SEQ ID NO: 3103367 - RNA, 17 nt, Mycobacterium bovis subsp bovis AF2122/97
guugcuaaacuccgugc

SEQ ID NO: 3103368 - RNA, 22 nt, Mycobacterium bovis subsp bovis AF2122/97
guugcuaaacuccgugccgagc

SEQ ID NO: 3103369 - RNA, 17 nt, Mycobacterium bovis subsp bovis AF2122/97
guugcucccggccgccg

SEQ ID NO: 3103370 - RNA, 11 nt, Mycobacterium bovis subsp bovis AF2122/97
guugcucggcu

SEQ ID NO: 3103371 - RNA, 14 nt, Mycobacterium bovis subsp bovis AF2122/97
guugcugacgacug

SEQ ID NO: 3103372 - RNA, 19 nt, Mycobacterium bovis subsp bovis AF2122/97
guugcugaucagagcguuc

SEQ ID NO: 3103373 - RNA, 21 nt, Mycobacterium bovis subsp bovis AF2122/97
guugcugaugucgccgguguc

SEQ ID NO: 3103374 - RNA, 21 nt, Mycobacterium bovis subsp bovis AF2122/97
guugcugcccgacacccgcau

SEQ ID NO: 3103375 - RNA, 13 nt, Mycobacterium bovis subsp bovis AF2122/97
guugcugccggcg

SEQ ID NO: 3103376 - RNA, 18 nt, Mycobacterium bovis subsp bovis AF2122/97
guugcuggcgcccccgcc

SEQ ID NO: 3103377 - RNA, 17 nt, Mycobacterium bovis subsp bovis AF2122/97
guugcuggcuggguggc

SEQ ID NO: 3103378 - RNA, 15 nt, Mycobacterium bovis subsp bovis AF2122/97
guugcuggucgccgu

SEQ ID NO: 3103379 - RNA, 16 nt, Mycobacterium bovis subsp bovis AF2122/97
guugcuuugcuggcgc

SEQ ID NO: 3103380 - RNA, 16 nt, Mycobacterium bovis subsp bovis AF2122/97
guuggaagucccgccg

SEQ ID NO: 3103381 - RNA, 19 nt, Mycobacterium bovis subsp bovis AF2122/97
guuggaagucccgccguug

SEQ ID NO: 3103382 - RNA, 18 nt, Mycobacterium bovis subsp bovis AF2122/97
guuggagcccgagcucgc

SEQ ID NO: 3103383 - RNA, 20 nt, Mycobacterium bovis subsp bovis AF2122/97
guuggagcccgagcucgccg

SEQ ID NO: 3103384 - RNA, 22 nt, Mycobacterium bovis subsp bovis AF2122/97
guuggcaaagacgcuggccacg

SEQ ID NO: 3103385 - RNA, 20 nt, Mycobacterium bovis subsp bovis AF2122/97
guuggcaaugaccccggcgu

SEQ ID NO: 3103386 - RNA, 23 nt, Mycobacterium bovis subsp bovis AF2122/97
guuggcaaugaccccggcguugc

SEQ ID NO: 3103387 - RNA, 13 nt, Mycobacterium bovis subsp bovis AF2122/97
guuggcaccagcc

SEQ ID NO: 3103388 - RNA, 18 nt, Mycobacterium bovis subsp bovis AF2122/97
guuggcaccagccgguga

SEQ ID NO: 3103389 - RNA, 20 nt, Mycobacterium bovis subsp bovis AF2122/97
guuggcacgcaacaccgcca

SEQ ID NO: 3103390 - RNA, 23 nt, Mycobacterium bovis subsp bovis AF2122/97
guuggcagcacaggcuggcgaug

SEQ ID NO: 3103391 - RNA, 22 nt, Mycobacterium bovis subsp bovis AF2122/97
guuggcagcccucugguggcgc

SEQ ID NO: 3103392 - RNA, 22 nt, Mycobacterium bovis subsp bovis AF2122/97
guuggcagcgggacugcggaag

SEQ ID NO: 3103393 - RNA, 15 nt, Mycobacterium bovis subsp bovis AF2122/97
guuggcaugccgccc

SEQ ID NO: 3103394 - RNA, 21 nt, Mycobacterium bovis subsp bovis AF2122/97
guuggccaagaaugugggcga

SEQ ID NO: 3103395 - RNA, 14 nt, Mycobacterium bovis subsp bovis AF2122/97
guuggccaccagcu

SEQ ID NO: 3103396 - RNA, 19 nt, Mycobacterium bovis subsp bovis AF2122/97
guuggccaccagcuggcga

SEQ ID NO: 3103397 - RNA, 14 nt, Mycobacterium bovis subsp bovis AF2122/97
guuggccaccgccc

SEQ ID NO: 3103398 - RNA, 18 nt, Mycobacterium bovis subsp bovis AF2122/97
guuggccaccgcccagug

SEQ ID NO: 3103399 - RNA, 14 nt, Mycobacterium bovis subsp bovis AF2122/97
guuggccagaccgc

SEQ ID NO: 3103400 - RNA, 19 nt, Mycobacterium bovis subsp bovis AF2122/97
guuggccagucccucgcca

SEQ ID NO: 3103401 - RNA, 13 nt, Mycobacterium bovis subsp bovis AF2122/97
guuggccccggcc

SEQ ID NO: 3103402 - RNA, 23 nt, Mycobacterium bovis subsp bovis AF2122/97
guuggccgaacagcugcccgcca

SEQ ID NO: 3103403 - RNA, 17 nt, Mycobacterium bovis subsp bovis AF2122/97
guuggccgagcagggcc

SEQ ID NO: 3103404 - RNA, 18 nt, Mycobacterium bovis subsp bovis AF2122/97
guuggccgagcagggccg

SEQ ID NO: 3103405 - RNA, 22 nt, Mycobacterium bovis subsp bovis AF2122/97
guuggccgagcagggccggcac

SEQ ID NO: 3103406 - RNA, 19 nt, Mycobacterium bovis subsp bovis AF2122/97
guuggccgccacaccgccg

SEQ ID NO: 3103407 - RNA, 22 nt, Mycobacterium bovis subsp bovis AF2122/97
guuggccgcccgaaugcgguga

SEQ ID NO: 3103408 - RNA, 14 nt, Mycobacterium bovis subsp bovis AF2122/97
guuggccgcgcuca

SEQ ID NO: 3103409 - RNA, 19 nt, Mycobacterium bovis subsp bovis AF2122/97
guuggccggaucgaagacc

SEQ ID NO: 3103410 - RNA, 15 nt, Mycobacterium bovis subsp bovis AF2122/97
guuggccgggucguc

SEQ ID NO: 3103411 - RNA, 23 nt, Mycobacterium bovis subsp bovis AF2122/97
guuggccguggucgagguggggu

SEQ ID NO: 3103412 - RNA, 14 nt, Mycobacterium bovis subsp bovis AF2122/97
guuggccucgagcg

SEQ ID NO: 3103413 - RNA, 19 nt, Mycobacterium bovis subsp bovis AF2122/97
guuggccucgagcgcugug

SEQ ID NO: 3103414 - RNA, 14 nt, Mycobacterium bovis subsp bovis AF2122/97
guuggcgaagcccg

SEQ ID NO: 3103415 - RNA, 17 nt, Mycobacterium bovis subsp bovis AF2122/97
guuggcgaagcccgaga

SEQ ID NO: 3103416 - RNA, 21 nt, Mycobacterium bovis subsp bovis AF2122/97
guuggcgagcuuggcuuggcc

SEQ ID NO: 3103417 - RNA, 16 nt, Mycobacterium bovis subsp bovis AF2122/97
guuggcgaucaucagg

SEQ ID NO: 3103418 - RNA, 14 nt, Mycobacterium bovis subsp bovis AF2122/97
guuggcgccaccag

SEQ ID NO: 3103419 - RNA, 21 nt, Mycobacterium bovis subsp bovis AF2122/97
guuggcgcccgaagccgggcc

SEQ ID NO: 3103420 - RNA, 22 nt, Mycobacterium bovis subsp bovis AF2122/97
guuggcggccucgggcucaaac

SEQ ID NO: 3103421 - RNA, 18 nt, Mycobacterium bovis subsp bovis AF2122/97
guuggcggcugcacgcug

SEQ ID NO: 3103422 - RNA, 19 nt, Mycobacterium bovis subsp bovis AF2122/97
guuggcggcuucgccccga

SEQ ID NO: 3103423 - RNA, 18 nt, Mycobacterium bovis subsp bovis AF2122/97
guuggcgggagcaccgac

SEQ ID NO: 3103424 - RNA, 13 nt, Mycobacterium bovis subsp bovis AF2122/97
guuggcggugguc

SEQ ID NO: 3103425 - RNA, 21 nt, Mycobacterium bovis subsp bovis AF2122/97
guuggcgguggucccgauggc

SEQ ID NO: 3103426 - RNA, 20 nt, Mycobacterium bovis subsp bovis AF2122/97
guuggcgucgcuacgcaacg

SEQ ID NO: 3103427 - RNA, 22 nt, Mycobacterium bovis subsp bovis AF2122/97
guuggcguugucgguuggcagc

SEQ ID NO: 3103428 - RNA, 16 nt, Mycobacterium bovis subsp bovis AF2122/97
guuggcucgagccgcc

SEQ ID NO: 3103429 - RNA, 17 nt, Mycobacterium bovis subsp bovis AF2122/97
guuggcucgagccgccc

SEQ ID NO: 3103430 - RNA, 16 nt, Mycobacterium bovis subsp bovis AF2122/97
guuggcucgcugggac

SEQ ID NO: 3103431 - RNA, 22 nt, Mycobacterium bovis subsp bovis AF2122/97
guuggcugagcagcgcggccag

SEQ ID NO: 3103432 - RNA, 15 nt, Mycobacterium bovis subsp bovis AF2122/97
guuggcuugcgcgca

SEQ ID NO: 3103433 - RNA, 18 nt, Mycobacterium bovis subsp bovis AF2122/97
guuggcuugcgcgcaggu

SEQ ID NO: 3103434 - RNA, 16 nt, Mycobacterium bovis subsp bovis AF2122/97
guugggaagugcggug

SEQ ID NO: 3103435 - RNA, 17 nt, Mycobacterium bovis subsp bovis AF2122/97
guugggaagugcgguga

SEQ ID NO: 3103436 - RNA, 21 nt, Mycobacterium bovis subsp bovis AF2122/97
guugggagccaccggcgucga

SEQ ID NO: 3103437 - RNA, 20 nt, Mycobacterium bovis subsp bovis AF2122/97
guugggaugacacgucuauc

SEQ ID NO: 3103438 - RNA, 19 nt, Mycobacterium bovis subsp bovis AF2122/97
guugggcaccuuggccagg

SEQ ID NO: 3103439 - RNA, 18 nt, Mycobacterium bovis subsp bovis AF2122/97
guugggccgacugggcgc

SEQ ID NO: 3103440 - RNA, 14 nt, Mycobacterium bovis subsp bovis AF2122/97
guugggccgcgccc

SEQ ID NO: 3103441 - RNA, 12 nt, Mycobacterium bovis subsp bovis AF2122/97
guugggcggggu

SEQ ID NO: 3103442 - RNA, 15 nt, Mycobacterium bovis subsp bovis AF2122/97
guuggggcacgacgc

SEQ ID NO: 3103443 - RNA, 14 nt, Mycobacterium bovis subsp bovis AF2122/97
guugggguggcggu

SEQ ID NO: 3103444 - RNA, 16 nt, Mycobacterium bovis subsp bovis AF2122/97
guugggguggcggugc

SEQ ID NO: 3103445 - RNA, 19 nt, Mycobacterium bovis subsp bovis AF2122/97
guugguacccaccagggug

SEQ ID NO: 3103446 - RNA, 21 nt, Mycobacterium bovis subsp bovis AF2122/97
guugguagagcaccagguugu

SEQ ID NO: 3103447 - RNA, 16 nt, Mycobacterium bovis subsp bovis AF2122/97
guuggucccgaucacc

SEQ ID NO: 3103448 - RNA, 13 nt, Mycobacterium bovis subsp bovis AF2122/97
guuggucgcgguc

SEQ ID NO: 3103449 - RNA, 13 nt, Mycobacterium bovis subsp bovis AF2122/97
guuggucggugcu

SEQ ID NO: 3103450 - RNA, 14 nt, Mycobacterium bovis subsp bovis AF2122/97
guuggucggugcug

SEQ ID NO: 3103451 - RNA, 22 nt, Mycobacterium bovis subsp bovis AF2122/97
guuggugaacaugugaccggcg

SEQ ID NO: 3103452 - RNA, 22 nt, Mycobacterium bovis subsp bovis AF2122/97
guuggugaacgagaugccgcga

SEQ ID NO: 3103453 - RNA, 21 nt, Mycobacterium bovis subsp bovis AF2122/97
guuggugacauagaccucgcc

SEQ ID NO: 3103454 - RNA, 13 nt, Mycobacterium bovis subsp bovis AF2122/97
guuggugaugccg

SEQ ID NO: 3103455 - RNA, 21 nt, Mycobacterium bovis subsp bovis AF2122/97
guuggugauugcggccgccga

SEQ ID NO: 3103456 - RNA, 15 nt, Mycobacterium bovis subsp bovis AF2122/97
guuggugccagccgg

SEQ ID NO: 3103457 - RNA, 17 nt, Mycobacterium bovis subsp bovis AF2122/97
guuggugcgggguuggc

SEQ ID NO: 3103458 - RNA, 12 nt, Mycobacterium bovis subsp bovis AF2122/97
guuggugcuggc

SEQ ID NO: 3103459 - RNA, 16 nt, Mycobacterium bovis subsp bovis AF2122/97
guuggugcuggccuug

SEQ ID NO: 3103460 - RNA, 20 nt, Mycobacterium bovis subsp bovis AF2122/97
guugguggccgggucgauca

SEQ ID NO: 3103461 - RNA, 20 nt, Mycobacterium bovis subsp bovis AF2122/97
guugguggucggcccuccac

SEQ ID NO: 3103462 - RNA, 21 nt, Mycobacterium bovis subsp bovis AF2122/97
guugguucagcucgaggacca

SEQ ID NO: 3103463 - RNA, 20 nt, Mycobacterium bovis subsp bovis AF2122/97
guugguuugccggcgguggc

SEQ ID NO: 3103464 - RNA, 21 nt, Mycobacterium bovis subsp bovis AF2122/97
guuguacaggaagucgcggac

SEQ ID NO: 3103465 - RNA, 15 nt, Mycobacterium bovis subsp bovis AF2122/97
guuguagaucugcgc

SEQ ID NO: 3103466 - RNA, 15 nt, Mycobacterium bovis subsp bovis AF2122/97
guuguaucgcagcau

SEQ ID NO: 3103467 - RNA, 22 nt, Mycobacterium bovis subsp bovis AF2122/97
guugucagcgaacggccaggac

SEQ ID NO: 3103468 - RNA, 16 nt, Mycobacterium bovis subsp bovis AF2122/97
guuguccaccgccacc

SEQ ID NO: 3103469 - RNA, 19 nt, Mycobacterium bovis subsp bovis AF2122/97
guuguccaccgccaccacg

SEQ ID NO: 3103470 - RNA, 13 nt, Mycobacterium bovis subsp bovis AF2122/97
guuguccagaacg

SEQ ID NO: 3103471 - RNA, 20 nt, Mycobacterium bovis subsp bovis AF2122/97
guugucccuauaccgcuggg

SEQ ID NO: 3103472 - RNA, 22 nt, Mycobacterium bovis subsp bovis AF2122/97
guugucccuauaccgcuggggc

SEQ ID NO: 3103473 - RNA, 16 nt, Mycobacterium bovis subsp bovis AF2122/97
guuguccgcggccaac

SEQ ID NO: 3103474 - RNA, 21 nt, Mycobacterium bovis subsp bovis AF2122/97
guugucgacgaagguggcgaa

SEQ ID NO: 3103475 - RNA, 15 nt, Mycobacterium bovis subsp bovis AF2122/97
guugucgacggccac

SEQ ID NO: 3103476 - RNA, 17 nt, Mycobacterium bovis subsp bovis AF2122/97
guugucgggggcguggc

SEQ ID NO: 3103477 - RNA, 16 nt, Mycobacterium bovis subsp bovis AF2122/97
guugucguugcuggug

SEQ ID NO: 3103478 - RNA, 17 nt, Mycobacterium bovis subsp bovis AF2122/97
guugucguugcuggugu

SEQ ID NO: 3103479 - RNA, 15 nt, Mycobacterium bovis subsp bovis AF2122/97
guugucuuucacaug

SEQ ID NO: 3103480 - RNA, 18 nt, Mycobacterium bovis subsp bovis AF2122/97
guugugauccgguggugg

SEQ ID NO: 3103481 - RNA, 23 nt, Mycobacterium bovis subsp bovis AF2122/97
guugugccgcaagccucguggug

SEQ ID NO: 3103482 - RNA, 23 nt, Mycobacterium bovis subsp bovis AF2122/97
guugugcgcacucuuuccuuccg

SEQ ID NO: 3103483 - RNA, 16 nt, Mycobacterium bovis subsp bovis AF2122/97
guugugcgcgcgcccg

SEQ ID NO: 3103484 - RNA, 14 nt, Mycobacterium bovis subsp bovis AF2122/97
guugugcggccagg

SEQ ID NO: 3103485 - RNA, 16 nt, Mycobacterium bovis subsp bovis AF2122/97
guugugcucggugacg

SEQ ID NO: 3103486 - RNA, 16 nt, Mycobacterium bovis subsp bovis AF2122/97
guuguggcacccggcu

SEQ ID NO: 3103487 - RNA, 15 nt, Mycobacterium bovis subsp bovis AF2122/97
guuguggucgaguug

SEQ ID NO: 3103488 - RNA, 19 nt, Mycobacterium bovis subsp bovis AF2122/97
guugugucaccggcgucgc

SEQ ID NO: 3103489 - RNA, 15 nt, Mycobacterium bovis subsp bovis AF2122/97
guugugucggccugg

SEQ ID NO: 3103490 - RNA, 18 nt, Mycobacterium bovis subsp bovis AF2122/97
guugugucggccuggcag

SEQ ID NO: 3103491 - RNA, 18 nt, Mycobacterium bovis subsp bovis AF2122/97
guuguuauuuuuggccau

SEQ ID NO: 3103492 - RNA, 20 nt, Mycobacterium bovis subsp bovis AF2122/97
guuguucaacucgggcagcu

SEQ ID NO: 3103493 - RNA, 19 nt, Mycobacterium bovis subsp bovis AF2122/97
guuguucccauagccagcc

SEQ ID NO: 3103494 - RNA, 15 nt, Mycobacterium bovis subsp bovis AF2122/97
guuguucgccaccgc

SEQ ID NO: 3103495 - RNA, 17 nt, Mycobacterium bovis subsp bovis AF2122/97
guuguugaagcccgaga

SEQ ID NO: 3103496 - RNA, 17 nt, Mycobacterium bovis subsp bovis AF2122/97
guuguugacgcccgagu

SEQ ID NO: 3103497 - RNA, 14 nt, Mycobacterium bovis subsp bovis AF2122/97
guuguugcugcccc

SEQ ID NO: 3103498 - RNA, 22 nt, Mycobacterium bovis subsp bovis AF2122/97
guuguugggcgagggugaagac

SEQ ID NO: 3103499 - RNA, 16 nt, Mycobacterium bovis subsp bovis AF2122/97
guuguuggugccagcc

SEQ ID NO: 3103500 - RNA, 20 nt, Mycobacterium bovis subsp bovis AF2122/97
guuuacauagaccaccggca

SEQ ID NO: 3103501 - RNA, 17 nt, Mycobacterium bovis subsp bovis AF2122/97
guuuacggcccggcacc

SEQ ID NO: 3103502 - RNA, 18 nt, Mycobacterium bovis subsp bovis AF2122/97
guuuacggcccggcaccc

SEQ ID NO: 3103503 - RNA, 23 nt, Mycobacterium bovis subsp bovis AF2122/97
guuuauaccucgccgcccugucc

SEQ ID NO: 3103504 - RNA, 16 nt, Mycobacterium bovis subsp bovis AF2122/97
guuuaugcccggcaaa

SEQ ID NO: 3103505 - RNA, 16 nt, Mycobacterium bovis subsp bovis AF2122/97
guuucaccgacgacgc

SEQ ID NO: 3103506 - RNA, 17 nt, Mycobacterium bovis subsp bovis AF2122/97
guuucccuggccgccgc

SEQ ID NO: 3103507 - RNA, 19 nt, Mycobacterium bovis subsp bovis AF2122/97
guuucccuggccgccgccg

SEQ ID NO: 3103508 - RNA, 14 nt, Mycobacterium bovis subsp bovis AF2122/97
guuuccgaagcccg

SEQ ID NO: 3103509 - RNA, 16 nt, Mycobacterium bovis subsp bovis AF2122/97
guuuccgccgccgccg

SEQ ID NO: 3103510 - RNA, 16 nt, Mycobacterium bovis subsp bovis AF2122/97
guuuccucagcugcuc

SEQ ID NO: 3103511 - RNA, 19 nt, Mycobacterium bovis subsp bovis AF2122/97
guuucgaccugcgggaucg

SEQ ID NO: 3103512 - RNA, 14 nt, Mycobacterium bovis subsp bovis AF2122/97
guuucgaucucgag

SEQ ID NO: 3103513 - RNA, 13 nt, Mycobacterium bovis subsp bovis AF2122/97
guuucggcgccgu

SEQ ID NO: 3103514 - RNA, 18 nt, Mycobacterium bovis subsp bovis AF2122/97
guuucggcgccgucgccc

SEQ ID NO: 3103515 - RNA, 21 nt, Mycobacterium bovis subsp bovis AF2122/97
guuucgggccgauugcucggg

SEQ ID NO: 3103516 - RNA, 18 nt, Mycobacterium bovis subsp bovis AF2122/97
guuucgugccaugguuga

SEQ ID NO: 3103517 - RNA, 15 nt, Mycobacterium bovis subsp bovis AF2122/97
guuucuccgccgccc

SEQ ID NO: 3103518 - RNA, 14 nt, Mycobacterium bovis subsp bovis AF2122/97
guuucugaagcccg

SEQ ID NO: 3103519 - RNA, 15 nt, Mycobacterium bovis subsp bovis AF2122/97
guuucugaagcccga

SEQ ID NO: 3103520 - RNA, 13 nt, Mycobacterium bovis subsp bovis AF2122/97
guuugaacgcaug

SEQ ID NO: 3103521 - RNA, 16 nt, Mycobacterium bovis subsp bovis AF2122/97
guuugaacgcaugcga

SEQ ID NO: 3103522 - RNA, 12 nt, Mycobacterium bovis subsp bovis AF2122/97
guuugaccagcc

SEQ ID NO: 3103523 - RNA, 14 nt, Mycobacterium bovis subsp bovis AF2122/97
guuugacgccgaug

SEQ ID NO: 3103524 - RNA, 14 nt, Mycobacterium bovis subsp bovis AF2122/97
guuugacgcgcucg

SEQ ID NO: 3103525 - RNA, 21 nt, Mycobacterium bovis subsp bovis AF2122/97
guuugacugcgaccgguucgg

SEQ ID NO: 3103526 - RNA, 15 nt, Mycobacterium bovis subsp bovis AF2122/97
guuugagaccccaac

SEQ ID NO: 3103527 - RNA, 20 nt, Mycobacterium bovis subsp bovis AF2122/97
guuugagcgcacucaccuug

SEQ ID NO: 3103528 - RNA, 23 nt, Mycobacterium bovis subsp bovis AF2122/97
guuugaggcagcguagugcugcg

SEQ ID NO: 3103529 - RNA, 16 nt, Mycobacterium bovis subsp bovis AF2122/97
guuugaucgcaacgau

SEQ ID NO: 3103530 - RNA, 23 nt, Mycobacterium bovis subsp bovis AF2122/97
guuugaucuccaccuucuggucc

SEQ ID NO: 3103531 - RNA, 18 nt, Mycobacterium bovis subsp bovis AF2122/97
guuugaugcgggcggcaa

SEQ ID NO: 3103532 - RNA, 19 nt, Mycobacterium bovis subsp bovis AF2122/97
guuugcccggucuauuugc

SEQ ID NO: 3103533 - RNA, 16 nt, Mycobacterium bovis subsp bovis AF2122/97
guuugccgggcgcugg

SEQ ID NO: 3103534 - RNA, 15 nt, Mycobacterium bovis subsp bovis AF2122/97
guuugccggugcggu

SEQ ID NO: 3103535 - RNA, 14 nt, Mycobacterium bovis subsp bovis AF2122/97
guuugccgguucgg

SEQ ID NO: 3103536 - RNA, 16 nt, Mycobacterium bovis subsp bovis AF2122/97
guuugccgguucggcg

SEQ ID NO: 3103537 - RNA, 15 nt, Mycobacterium bovis subsp bovis AF2122/97
guuugcgaagcccac

SEQ ID NO: 3103538 - RNA, 14 nt, Mycobacterium bovis subsp bovis AF2122/97
guuugcgaugccca

SEQ ID NO: 3103539 - RNA, 13 nt, Mycobacterium bovis subsp bovis AF2122/97
guuugcgccgcgc

SEQ ID NO: 3103540 - RNA, 20 nt, Mycobacterium bovis subsp bovis AF2122/97
guuugcguccugguggcggg

SEQ ID NO: 3103541 - RNA, 19 nt, Mycobacterium bovis subsp bovis AF2122/97
guuuggaccgcugaugacc

SEQ ID NO: 3103542 - RNA, 22 nt, Mycobacterium bovis subsp bovis AF2122/97
guuuggaccgcugaugaccgua

SEQ ID NO: 3103543 - RNA, 21 nt, Mycobacterium bovis subsp bovis AF2122/97
guuuggacgggcgugcugccg

SEQ ID NO: 3103544 - RNA, 24 nt, Mycobacterium bovis subsp bovis AF2122/97
guuuggauggcuggccagcacgcc

SEQ ID NO: 3103545 - RNA, 20 nt, Mycobacterium bovis subsp bovis AF2122/97
guuuggcauggucaggcggc

SEQ ID NO: 3103546 - RNA, 17 nt, Mycobacterium bovis subsp bovis AF2122/97
guuuggccaguucggug

SEQ ID NO: 3103547 - RNA, 12 nt, Mycobacterium bovis subsp bovis AF2122/97
guuuggcggcag

SEQ ID NO: 3103548 - RNA, 12 nt, Mycobacterium bovis subsp bovis AF2122/97
guuuggcugccg

SEQ ID NO: 3103549 - RNA, 20 nt, Mycobacterium bovis subsp bovis AF2122/97
guuugggcaucaucgcugug

SEQ ID NO: 3103550 - RNA, 15 nt, Mycobacterium bovis subsp bovis AF2122/97
guuuggugcagccgc

SEQ ID NO: 3103551 - RNA, 18 nt, Mycobacterium bovis subsp bovis AF2122/97
guuuggugcagccgcggu

SEQ ID NO: 3103552 - RNA, 22 nt, Mycobacterium bovis subsp bovis AF2122/97
guuuguagucacggucguggug

SEQ ID NO: 3103553 - RNA, 17 nt, Mycobacterium bovis subsp bovis AF2122/97
guuuguaucugcugccg

SEQ ID NO: 3103554 - RNA, 13 nt, Mycobacterium bovis subsp bovis AF2122/97
guuugucgcggug

SEQ ID NO: 3103555 - RNA, 15 nt, Mycobacterium bovis subsp bovis AF2122/97
guuugucgcgguggu

SEQ ID NO: 3103556 - RNA, 16 nt, Mycobacterium bovis subsp bovis AF2122/97
guuugucgcgguggug

SEQ ID NO: 3103557 - RNA, 15 nt, Mycobacterium bovis subsp bovis AF2122/97
guuuguuccgugcgg

SEQ ID NO: 3103558 - RNA, 12 nt, Mycobacterium bovis subsp bovis AF2122/97
guuuguuuuguc

SEQ ID NO: 3103559 - RNA, 17 nt, Mycobacterium bovis subsp bovis AF2122/97
guuuguuuuugccuccc

SEQ ID NO: 3103560 - RNA, 18 nt, Mycobacterium bovis subsp bovis AF2122/97
guuuuaccucggccgcca

SEQ ID NO: 3103561 - RNA, 16 nt, Mycobacterium bovis subsp bovis AF2122/97
guuuuccagccgacgu

SEQ ID NO: 3103562 - RNA, 16 nt, Mycobacterium bovis subsp bovis AF2122/97
guuuucccgucgccgc

SEQ ID NO: 3103563 - RNA, 18 nt, Mycobacterium bovis subsp bovis AF2122/97
guuuucccgucgccgccc

SEQ ID NO: 3103564 - RNA, 20 nt, Mycobacterium bovis subsp bovis AF2122/97
guuuucgcgcuugaaacuga

SEQ ID NO: 3103565 - RNA, 21 nt, Mycobacterium bovis subsp bovis AF2122/97
guuuucggguugggcaucagg

SEQ ID NO: 3103566 - RNA, 14 nt, Mycobacterium bovis subsp bovis AF2122/97
guuuucucgccguu

SEQ ID NO: 3103567 - RNA, 17 nt, Mycobacterium bovis subsp bovis AF2122/97
guuuugauagacgaccc

SEQ ID NO: 3103568 - RNA, 14 nt, Mycobacterium bovis subsp bovis AF2122/97
guuuugcugcaugc

SEQ ID NO: 3103569 - RNA, 14 nt, Mycobacterium bovis subsp bovis AF2122/97
guuuuggaagcccg

SEQ ID NO: 3103570 - RNA, 19 nt, Mycobacterium bovis subsp bovis AF2122/97
guuuuggugcggaccugcg

SEQ ID NO: 3103571 - RNA, 21 nt, Mycobacterium bovis subsp bovis AF2122/97
guuuugucgacguucgguggc

SEQ ID NO: 3103572 - RNA, 15 nt, Mycobacterium bovis subsp bovis AF2122/97
uaaaaaccaccccca

SEQ ID NO: 3103573 - RNA, 19 nt, Mycobacterium bovis subsp bovis AF2122/97
uaaaaaccacccccaccga

SEQ ID NO: 3103574 - RNA, 21 nt, Mycobacterium bovis subsp bovis AF2122/97
uaaacaaacccaacaccagca

SEQ ID NO: 3103575 - RNA, 12 nt, Mycobacterium bovis subsp bovis AF2122/97
uaaacaccgcga

SEQ ID NO: 3103576 - RNA, 15 nt, Mycobacterium bovis subsp bovis AF2122/97
uaaacagcgcgccgg

SEQ ID NO: 3103577 - RNA, 16 nt, Mycobacterium bovis subsp bovis AF2122/97
uaaacagcgcgccggc

SEQ ID NO: 3103578 - RNA, 15 nt, Mycobacterium bovis subsp bovis AF2122/97
uaaaccagccaccac

SEQ ID NO: 3103579 - RNA, 12 nt, Mycobacterium bovis subsp bovis AF2122/97
uaaaccaggugg

SEQ ID NO: 3103580 - RNA, 12 nt, Mycobacterium bovis subsp bovis AF2122/97
uaaaccccuggc

SEQ ID NO: 3103581 - RNA, 20 nt, Mycobacterium bovis subsp bovis AF2122/97
uaaaccgauaucgcugcgga

SEQ ID NO: 3103582 - RNA, 11 nt, Mycobacterium bovis subsp bovis AF2122/97
uaaagaagccu

SEQ ID NO: 3103583 - RNA, 22 nt, Mycobacterium bovis subsp bovis AF2122/97
uaaagaucguugccucgucgcc

SEQ ID NO: 3103584 - RNA, 15 nt, Mycobacterium bovis subsp bovis AF2122/97
uaaagcucaccacau

SEQ ID NO: 3103585 - RNA, 23 nt, Mycobacterium bovis subsp bovis AF2122/97
uaaagguggucgucccgauggcg

SEQ ID NO: 3103586 - RNA, 20 nt, Mycobacterium bovis subsp bovis AF2122/97
uaaaugccugcccaccuucg

SEQ ID NO: 3103587 - RNA, 21 nt, Mycobacterium bovis subsp bovis AF2122/97
uaaaugccugcccaccuucga

SEQ ID NO: 3103588 - RNA, 18 nt, Mycobacterium bovis subsp bovis AF2122/97
uaaaugcuucgaccgccg

SEQ ID NO: 3103589 - RNA, 22 nt, Mycobacterium bovis subsp bovis AF2122/97
uaacacccgagcaacggcggca

SEQ ID NO: 3103590 - RNA, 19 nt, Mycobacterium bovis subsp bovis AF2122/97
uaacacucgaagucgccca

SEQ ID NO: 3103591 - RNA, 14 nt, Mycobacterium bovis subsp bovis AF2122/97
uaacagccggccgg

SEQ ID NO: 3103592 - RNA, 18 nt, Mycobacterium bovis subsp bovis AF2122/97
uaacagccggccggaucc

SEQ ID NO: 3103593 - RNA, 16 nt, Mycobacterium bovis subsp bovis AF2122/97
uaaccacgacgacgac

SEQ ID NO: 3103594 - RNA, 14 nt, Mycobacterium bovis subsp bovis AF2122/97
uaacccagcaccac

SEQ ID NO: 3103595 - RNA, 16 nt, Mycobacterium bovis subsp bovis AF2122/97
uaacccagcaccacaa

SEQ ID NO: 3103596 - RNA, 13 nt, Mycobacterium bovis subsp bovis AF2122/97
uaacccagcggcg

SEQ ID NO: 3103597 - RNA, 13 nt, Mycobacterium bovis subsp bovis AF2122/97
uaacccgcaccgg

SEQ ID NO: 3103598 - RNA, 22 nt, Mycobacterium bovis subsp bovis AF2122/97
uaacccugcccuagcccgauuc

SEQ ID NO: 3103599 - RNA, 21 nt, Mycobacterium bovis subsp bovis AF2122/97
uaacccuggcggaacagcuuc

SEQ ID NO: 3103600 - RNA, 15 nt, Mycobacterium bovis subsp bovis AF2122/97
uaaccgcgucgaccg

SEQ ID NO: 3103601 - RNA, 20 nt, Mycobacterium bovis subsp bovis AF2122/97
uaaccgcgucgaccggaacc

SEQ ID NO: 3103602 - RNA, 17 nt, Mycobacterium bovis subsp bovis AF2122/97
uaaccgcuuggugugau

SEQ ID NO: 3103603 - RNA, 15 nt, Mycobacterium bovis subsp bovis AF2122/97
uaaccggccaugucu

SEQ ID NO: 3103604 - RNA, 12 nt, Mycobacterium bovis subsp bovis AF2122/97
uaaccggcccga

SEQ ID NO: 3103605 - RNA, 14 nt, Mycobacterium bovis subsp bovis AF2122/97
uaaccggcgcgccc

SEQ ID NO: 3103606 - RNA, 21 nt, Mycobacterium bovis subsp bovis AF2122/97
uaaccgguggggacccgcucc

SEQ ID NO: 3103607 - RNA, 17 nt, Mycobacterium bovis subsp bovis AF2122/97
uaaccgucgccugccga

SEQ ID NO: 3103608 - RNA, 22 nt, Mycobacterium bovis subsp bovis AF2122/97
uaaccguugaccucuucgggca

SEQ ID NO: 3103609 - RNA, 17 nt, Mycobacterium bovis subsp bovis AF2122/97
uaaccguuggagucagg

SEQ ID NO: 3103610 - RNA, 12 nt, Mycobacterium bovis subsp bovis AF2122/97
uaaccuggcggu

SEQ ID NO: 3103611 - RNA, 21 nt, Mycobacterium bovis subsp bovis AF2122/97
uaacgacugacaacggccaca

SEQ ID NO: 3103612 - RNA, 18 nt, Mycobacterium bovis subsp bovis AF2122/97
uaacgccaacaccggcau

SEQ ID NO: 3103613 - RNA, 21 nt, Mycobacterium bovis subsp bovis AF2122/97
uaacgccaagcucggcccagc

SEQ ID NO: 3103614 - RNA, 16 nt, Mycobacterium bovis subsp bovis AF2122/97
uaacgcggaucgggca

SEQ ID NO: 3103615 - RNA, 19 nt, Mycobacterium bovis subsp bovis AF2122/97
uaacgcggcaccacgucga

SEQ ID NO: 3103616 - RNA, 15 nt, Mycobacterium bovis subsp bovis AF2122/97
uaacggagcggccua

SEQ ID NO: 3103617 - RNA, 14 nt, Mycobacterium bovis subsp bovis AF2122/97
uaacggcgaccgcc

SEQ ID NO: 3103618 - RNA, 16 nt, Mycobacterium bovis subsp bovis AF2122/97
uaacggcggccauggc

SEQ ID NO: 3103619 - RNA, 17 nt, Mycobacterium bovis subsp bovis AF2122/97
uaacggucgcugucggc

SEQ ID NO: 3103620 - RNA, 14 nt, Mycobacterium bovis subsp bovis AF2122/97
uaacuggcccggac

SEQ ID NO: 3103621 - RNA, 13 nt, Mycobacterium bovis subsp bovis AF2122/97
uaagcccggucgc

SEQ ID NO: 3103622 - RNA, 19 nt, Mycobacterium bovis subsp bovis AF2122/97
uaagcccggucgcugaucc

SEQ ID NO: 3103623 - RNA, 18 nt, Mycobacterium bovis subsp bovis AF2122/97
uaagcgaacccgagccgc

SEQ ID NO: 3103624 - RNA, 22 nt, Mycobacterium bovis subsp bovis AF2122/97
uaagcgaacggguagucgggca

SEQ ID NO: 3103625 - RNA, 15 nt, Mycobacterium bovis subsp bovis AF2122/97
uaagcgauucccaac

SEQ ID NO: 3103626 - RNA, 18 nt, Mycobacterium bovis subsp bovis AF2122/97
uaagcggauguccccgac

SEQ ID NO: 3103627 - RNA, 22 nt, Mycobacterium bovis subsp bovis AF2122/97
uaagcgguuguccggucgccaa

SEQ ID NO: 3103628 - RNA, 17 nt, Mycobacterium bovis subsp bovis AF2122/97
uaaggagaaccaaaccg

SEQ ID NO: 3103629 - RNA, 21 nt, Mycobacterium bovis subsp bovis AF2122/97
uaaggaucagaacgcggccuc

SEQ ID NO: 3103630 - RNA, 13 nt, Mycobacterium bovis subsp bovis AF2122/97
uaaggccggccgg

SEQ ID NO: 3103631 - RNA, 19 nt, Mycobacterium bovis subsp bovis AF2122/97
uaaggcugcagugccgcac

SEQ ID NO: 3103632 - RNA, 15 nt, Mycobacterium bovis subsp bovis AF2122/97
uaagggacaccagcu

SEQ ID NO: 3103633 - RNA, 22 nt, Mycobacterium bovis subsp bovis AF2122/97
uaagggcgggcuuggggucccg

SEQ ID NO: 3103634 - RNA, 21 nt, Mycobacterium bovis subsp bovis AF2122/97
uaaggugcgauccggcgcacg

SEQ ID NO: 3103635 - RNA, 15 nt, Mycobacterium bovis subsp bovis AF2122/97
uaaguacuagccggu

SEQ ID NO: 3103636 - RNA, 15 nt, Mycobacterium bovis subsp bovis AF2122/97
uaagucuggagugag

SEQ ID NO: 3103637 - RNA, 19 nt, Mycobacterium bovis subsp bovis AF2122/97
uaauagcuguuggccagcc

SEQ ID NO: 3103638 - RNA, 22 nt, Mycobacterium bovis subsp bovis AF2122/97
uaauauugccgccuccggugca

SEQ ID NO: 3103639 - RNA, 22 nt, Mycobacterium bovis subsp bovis AF2122/97
uaaucaaggugaucagcaggau

SEQ ID NO: 3103640 - RNA, 15 nt, Mycobacterium bovis subsp bovis AF2122/97
uaauccagcgccgac

SEQ ID NO: 3103641 - RNA, 17 nt, Mycobacterium bovis subsp bovis AF2122/97
uaauccgggcaaucaca

SEQ ID NO: 3103642 - RNA, 22 nt, Mycobacterium bovis subsp bovis AF2122/97
uaauccgggcaaucacaucaaa

SEQ ID NO: 3103643 - RNA, 22 nt, Mycobacterium bovis subsp bovis AF2122/97
uaauccuuugggguugcuggug

SEQ ID NO: 3103644 - RNA, 17 nt, Mycobacterium bovis subsp bovis AF2122/97
uaaucguuuguguugaa

SEQ ID NO: 3103645 - RNA, 19 nt, Mycobacterium bovis subsp bovis AF2122/97
uaaugaucucggcaaggac

SEQ ID NO: 3103646 - RNA, 14 nt, Mycobacterium bovis subsp bovis AF2122/97
uaaugccagcggca

SEQ ID NO: 3103647 - RNA, 16 nt, Mycobacterium bovis subsp bovis AF2122/97
uaaugccagcggcaca

SEQ ID NO: 3103648 - RNA, 16 nt, Mycobacterium bovis subsp bovis AF2122/97
uaaugcugcugcagca

SEQ ID NO: 3103649 - RNA, 17 nt, Mycobacterium bovis subsp bovis AF2122/97
uaauggcgugcagaccc

SEQ ID NO: 3103650 - RNA, 21 nt, Mycobacterium bovis subsp bovis AF2122/97
uaauucaacagcaccgcgacg

SEQ ID NO: 3103651 - RNA, 13 nt, Mycobacterium bovis subsp bovis AF2122/97
uaauugccagccu

SEQ ID NO: 3103652 - RNA, 19 nt, Mycobacterium bovis subsp bovis AF2122/97
uaauuggcaacacagcuga

SEQ ID NO: 3103653 - RNA, 20 nt, Mycobacterium bovis subsp bovis AF2122/97
uacaacacagaacucaccga

SEQ ID NO: 3103654 - RNA, 23 nt, Mycobacterium bovis subsp bovis AF2122/97
uacaacagcugggucaugccgua

SEQ ID NO: 3103655 - RNA, 18 nt, Mycobacterium bovis subsp bovis AF2122/97
uacaaccacccacccgca

SEQ ID NO: 3103656 - RNA, 15 nt, Mycobacterium bovis subsp bovis AF2122/97
uacaacgccgucguc

SEQ ID NO: 3103657 - RNA, 24 nt, Mycobacterium bovis subsp bovis AF2122/97
uacacagcaugguuagcggugaug

SEQ ID NO: 3103658 - RNA, 19 nt, Mycobacterium bovis subsp bovis AF2122/97
uacacauaggugcggggcc

SEQ ID NO: 3103659 - RNA, 17 nt, Mycobacterium bovis subsp bovis AF2122/97
uacacauucauccaccc

SEQ ID NO: 3103660 - RNA, 17 nt, Mycobacterium bovis subsp bovis AF2122/97
uacaccuccugccuuua

SEQ ID NO: 3103661 - RNA, 22 nt, Mycobacterium bovis subsp bovis AF2122/97
uacaccuuguggacccgccagg

SEQ ID NO: 3103662 - RNA, 13 nt, Mycobacterium bovis subsp bovis AF2122/97
uacacggcggcga

SEQ ID NO: 3103663 - RNA, 20 nt, Mycobacterium bovis subsp bovis AF2122/97
uacacguugagugucccgau

SEQ ID NO: 3103664 - RNA, 14 nt, Mycobacterium bovis subsp bovis AF2122/97
uacacguugccgau

SEQ ID NO: 3103665 - RNA, 14 nt, Mycobacterium bovis subsp bovis AF2122/97
uacacuuugcccgc

SEQ ID NO: 3103666 - RNA, 14 nt, Mycobacterium bovis subsp bovis AF2122/97
uacagcaucaaccg

SEQ ID NO: 3103667 - RNA, 20 nt, Mycobacterium bovis subsp bovis AF2122/97
uacagcaucaaccguccccg

SEQ ID NO: 3103668 - RNA, 16 nt, Mycobacterium bovis subsp bovis AF2122/97
uacagcgccuggguga

SEQ ID NO: 3103669 - RNA, 23 nt, Mycobacterium bovis subsp bovis AF2122/97
uacagcgcggcguguacgucgau

SEQ ID NO: 3103670 - RNA, 19 nt, Mycobacterium bovis subsp bovis AF2122/97
uacagcgcuucacgggccg

SEQ ID NO: 3103671 - RNA, 13 nt, Mycobacterium bovis subsp bovis AF2122/97
uacagcggcggcg

SEQ ID NO: 3103672 - RNA, 18 nt, Mycobacterium bovis subsp bovis AF2122/97
uacagcggcggcgucgac

SEQ ID NO: 3103673 - RNA, 20 nt, Mycobacterium bovis subsp bovis AF2122/97
uacagcuugaucgccgaggc

SEQ ID NO: 3103674 - RNA, 15 nt, Mycobacterium bovis subsp bovis AF2122/97
uacaggccacgcacc

SEQ ID NO: 3103675 - RNA, 17 nt, Mycobacterium bovis subsp bovis AF2122/97
uacaggccacgcaccgg

SEQ ID NO: 3103676 - RNA, 18 nt, Mycobacterium bovis subsp bovis AF2122/97
uacaggucggcccacggu

SEQ ID NO: 3103677 - RNA, 12 nt, Mycobacterium bovis subsp bovis AF2122/97
uacaggugcagg

SEQ ID NO: 3103678 - RNA, 20 nt, Mycobacterium bovis subsp bovis AF2122/97
uacaguccacgcguagcggu

SEQ ID NO: 3103679 - RNA, 22 nt, Mycobacterium bovis subsp bovis AF2122/97
uacagucgaccggacacuccug

SEQ ID NO: 3103680 - RNA, 19 nt, Mycobacterium bovis subsp bovis AF2122/97
uacauagccggucauuuca

SEQ ID NO: 3103681 - RNA, 12 nt, Mycobacterium bovis subsp bovis AF2122/97
uacaucagcgcg

SEQ ID NO: 3103682 - RNA, 16 nt, Mycobacterium bovis subsp bovis AF2122/97
uacaugucacacccac

SEQ ID NO: 3103683 - RNA, 13 nt, Mycobacterium bovis subsp bovis AF2122/97
uacauuucccagu

SEQ ID NO: 3103684 - RNA, 16 nt, Mycobacterium bovis subsp bovis AF2122/97
uaccaauccaggccac

SEQ ID NO: 3103685 - RNA, 20 nt, Mycobacterium bovis subsp bovis AF2122/97
uaccaauucccgcgcggcgu

SEQ ID NO: 3103686 - RNA, 15 nt, Mycobacterium bovis subsp bovis AF2122/97
uaccaccacguggcc

SEQ ID NO: 3103687 - RNA, 12 nt, Mycobacterium bovis subsp bovis AF2122/97
uaccaccgccgc

SEQ ID NO: 3103688 - RNA, 14 nt, Mycobacterium bovis subsp bovis AF2122/97
uaccaccggcaccg

SEQ ID NO: 3103689 - RNA, 17 nt, Mycobacterium bovis subsp bovis AF2122/97
uaccaccgucaccgccg

SEQ ID NO: 3103690 - RNA, 18 nt, Mycobacterium bovis subsp bovis AF2122/97
uaccaccgucaccgccgg

SEQ ID NO: 3103691 - RNA, 20 nt, Mycobacterium bovis subsp bovis AF2122/97
uaccaccgucaccgccggca

SEQ ID NO: 3103692 - RNA, 23 nt, Mycobacterium bovis subsp bovis AF2122/97
uaccacggaggguugccgccgac

SEQ ID NO: 3103693 - RNA, 15 nt, Mycobacterium bovis subsp bovis AF2122/97
uaccacggcgauccg

SEQ ID NO: 3103694 - RNA, 21 nt, Mycobacterium bovis subsp bovis AF2122/97
uaccacggcgauccggucggc

SEQ ID NO: 3103695 - RNA, 22 nt, Mycobacterium bovis subsp bovis AF2122/97
uaccacggcgauccggucggcc

SEQ ID NO: 3103696 - RNA, 19 nt, Mycobacterium bovis subsp bovis AF2122/97
uaccacgguggucccccgc

SEQ ID NO: 3103697 - RNA, 22 nt, Mycobacterium bovis subsp bovis AF2122/97
uaccacuguuacggccacaccg

SEQ ID NO: 3103698 - RNA, 21 nt, Mycobacterium bovis subsp bovis AF2122/97
uaccacuuugcguucccaucc

SEQ ID NO: 3103699 - RNA, 19 nt, Mycobacterium bovis subsp bovis AF2122/97
uaccagccgaagaaccggu

SEQ ID NO: 3103700 - RNA, 18 nt, Mycobacterium bovis subsp bovis AF2122/97
uaccagccgccccggcuu

SEQ ID NO: 3103701 - RNA, 15 nt, Mycobacterium bovis subsp bovis AF2122/97
uaccagcugggcgac

SEQ ID NO: 3103702 - RNA, 13 nt, Mycobacterium bovis subsp bovis AF2122/97
uaccaggcgccgu

SEQ ID NO: 3103703 - RNA, 21 nt, Mycobacterium bovis subsp bovis AF2122/97
uaccaggucggaacuagccag

SEQ ID NO: 3103704 - RNA, 14 nt, Mycobacterium bovis subsp bovis AF2122/97
uacccaccggccgg

SEQ ID NO: 3103705 - RNA, 16 nt, Mycobacterium bovis subsp bovis AF2122/97
uacccagccagccgcg

SEQ ID NO: 3103706 - RNA, 17 nt, Mycobacterium bovis subsp bovis AF2122/97
uacccagcgcagcagcg

SEQ ID NO: 3103707 - RNA, 17 nt, Mycobacterium bovis subsp bovis AF2122/97
uacccaucaacaucggc

SEQ ID NO: 3103708 - RNA, 19 nt, Mycobacterium bovis subsp bovis AF2122/97
uacccaucaacaucggccc

SEQ ID NO: 3103709 - RNA, 17 nt, Mycobacterium bovis subsp bovis AF2122/97
uacccaucgccacaccc

SEQ ID NO: 3103710 - RNA, 14 nt, Mycobacterium bovis subsp bovis AF2122/97
uacccauggcccgu

SEQ ID NO: 3103711 - RNA, 20 nt, Mycobacterium bovis subsp bovis AF2122/97
uaccccagaccgccacacgg

SEQ ID NO: 3103712 - RNA, 13 nt, Mycobacterium bovis subsp bovis AF2122/97
uaccccagcacaa

SEQ ID NO: 3103713 - RNA, 17 nt, Mycobacterium bovis subsp bovis AF2122/97
uaccccagccggcagca

SEQ ID NO: 3103714 - RNA, 15 nt, Mycobacterium bovis subsp bovis AF2122/97
uaccccagcgcuguc

SEQ ID NO: 3103715 - RNA, 19 nt, Mycobacterium bovis subsp bovis AF2122/97
uaccccagggagugccgca

SEQ ID NO: 3103716 - RNA, 16 nt, Mycobacterium bovis subsp bovis AF2122/97
uacccccgauggcguc

SEQ ID NO: 3103717 - RNA, 18 nt, Mycobacterium bovis subsp bovis AF2122/97
uaccccgcagcucaccuc

SEQ ID NO: 3103718 - RNA, 21 nt, Mycobacterium bovis subsp bovis AF2122/97
uacccgaccagcaccagaacc

SEQ ID NO: 3103719 - RNA, 13 nt, Mycobacterium bovis subsp bovis AF2122/97
uacccgcagcgug

SEQ ID NO: 3103720 - RNA, 13 nt, Mycobacterium bovis subsp bovis AF2122/97
uacccgccgcgau

SEQ ID NO: 3103721 - RNA, 16 nt, Mycobacterium bovis subsp bovis AF2122/97
uacccgccucgggccg

SEQ ID NO: 3103722 - RNA, 12 nt, Mycobacterium bovis subsp bovis AF2122/97
uacccgcuggcc

SEQ ID NO: 3103723 - RNA, 21 nt, Mycobacterium bovis subsp bovis AF2122/97
uacccggacagggcggcgagg

SEQ ID NO: 3103724 - RNA, 21 nt, Mycobacterium bovis subsp bovis AF2122/97
uacccggaccgucguggcggu

SEQ ID NO: 3103725 - RNA, 14 nt, Mycobacterium bovis subsp bovis AF2122/97
uacccgggccaggc

SEQ ID NO: 3103726 - RNA, 16 nt, Mycobacterium bovis subsp bovis AF2122/97
uacccgggccaggcug

SEQ ID NO: 3103727 - RNA, 16 nt, Mycobacterium bovis subsp bovis AF2122/97
uacccgggcggcggcg

SEQ ID NO: 3103728 - RNA, 15 nt, Mycobacterium bovis subsp bovis AF2122/97
uacccguagcaccac

SEQ ID NO: 3103729 - RNA, 21 nt, Mycobacterium bovis subsp bovis AF2122/97
uacccguagcaccacaucggu

SEQ ID NO: 3103730 - RNA, 15 nt, Mycobacterium bovis subsp bovis AF2122/97
uaccgaaaucaccuc

SEQ ID NO: 3103731 - RNA, 15 nt, Mycobacterium bovis subsp bovis AF2122/97
uaccgaacagcaccu

SEQ ID NO: 3103732 - RNA, 17 nt, Mycobacterium bovis subsp bovis AF2122/97
uaccgaaccgguguagc

SEQ ID NO: 3103733 - RNA, 14 nt, Mycobacterium bovis subsp bovis AF2122/97
uaccgacgcaccuc

SEQ ID NO: 3103734 - RNA, 19 nt, Mycobacterium bovis subsp bovis AF2122/97
uaccgagauugggcuggga

SEQ ID NO: 3103735 - RNA, 20 nt, Mycobacterium bovis subsp bovis AF2122/97
uaccgauagccugcggcggc

SEQ ID NO: 3103736 - RNA, 14 nt, Mycobacterium bovis subsp bovis AF2122/97
uaccgaucagcagg

SEQ ID NO: 3103737 - RNA, 16 nt, Mycobacterium bovis subsp bovis AF2122/97
uaccgaugaaccaggc

SEQ ID NO: 3103738 - RNA, 19 nt, Mycobacterium bovis subsp bovis AF2122/97
uaccgaugguggugccaac

SEQ ID NO: 3103739 - RNA, 13 nt, Mycobacterium bovis subsp bovis AF2122/97
uaccgcacccgcu

SEQ ID NO: 3103740 - RNA, 14 nt, Mycobacterium bovis subsp bovis AF2122/97
uaccgcacccuggg

SEQ ID NO: 3103741 - RNA, 16 nt, Mycobacterium bovis subsp bovis AF2122/97
uaccgccagcgccacc

SEQ ID NO: 3103742 - RNA, 14 nt, Mycobacterium bovis subsp bovis AF2122/97
uaccgcccgcgcca

SEQ ID NO: 3103743 - RNA, 14 nt, Mycobacterium bovis subsp bovis AF2122/97
uaccgccgcgaccg

SEQ ID NO: 3103744 - RNA, 21 nt, Mycobacterium bovis subsp bovis AF2122/97
uaccgccgcgcagccgcucga

SEQ ID NO: 3103745 - RNA, 14 nt, Mycobacterium bovis subsp bovis AF2122/97
uaccgccgcugccg

SEQ ID NO: 3103746 - RNA, 18 nt, Mycobacterium bovis subsp bovis AF2122/97
uaccgccggccccaccgg

SEQ ID NO: 3103747 - RNA, 17 nt, Mycobacterium bovis subsp bovis AF2122/97
uaccgccggcgccggug

SEQ ID NO: 3103748 - RNA, 12 nt, Mycobacterium bovis subsp bovis AF2122/97
uaccgccggcgg

SEQ ID NO: 3103749 - RNA, 19 nt, Mycobacterium bovis subsp bovis AF2122/97
uaccgccggcuccgccguu

SEQ ID NO: 3103750 - RNA, 19 nt, Mycobacterium bovis subsp bovis AF2122/97
uaccgccguuaccgacgcc

SEQ ID NO: 3103751 - RNA, 14 nt, Mycobacterium bovis subsp bovis AF2122/97
uaccgcgaagcugc

SEQ ID NO: 3103752 - RNA, 17 nt, Mycobacterium bovis subsp bovis AF2122/97
uaccgcgaagcugcggg

SEQ ID NO: 3103753 - RNA, 20 nt, Mycobacterium bovis subsp bovis AF2122/97
uaccgcgcguuguggcgaug

SEQ ID NO: 3103754 - RNA, 15 nt, Mycobacterium bovis subsp bovis AF2122/97
uaccgcgcucccggc

SEQ ID NO: 3103755 - RNA, 17 nt, Mycobacterium bovis subsp bovis AF2122/97
uaccgcucagggugcgc

SEQ ID NO: 3103756 - RNA, 16 nt, Mycobacterium bovis subsp bovis AF2122/97
uaccgcucgggcgcga

SEQ ID NO: 3103757 - RNA, 12 nt, Mycobacterium bovis subsp bovis AF2122/97
uaccgcuggggc

SEQ ID NO: 3103758 - RNA, 17 nt, Mycobacterium bovis subsp bovis AF2122/97
uaccggcacgccggcgg

SEQ ID NO: 3103759 - RNA, 18 nt, Mycobacterium bovis subsp bovis AF2122/97
uaccggccagccgcggcc

SEQ ID NO: 3103760 - RNA, 18 nt, Mycobacterium bovis subsp bovis AF2122/97
uaccggccgccaucaucg

SEQ ID NO: 3103761 - RNA, 19 nt, Mycobacterium bovis subsp bovis AF2122/97
uaccggcgcauaccggcgu

SEQ ID NO: 3103762 - RNA, 20 nt, Mycobacterium bovis subsp bovis AF2122/97
uaccggcgccgcgcggcuug

SEQ ID NO: 3103763 - RNA, 11 nt, Mycobacterium bovis subsp bovis AF2122/97
uaccggcggcg

SEQ ID NO: 3103764 - RNA, 13 nt, Mycobacterium bovis subsp bovis AF2122/97
uaccggcggcgcc

SEQ ID NO: 3103765 - RNA, 15 nt, Mycobacterium bovis subsp bovis AF2122/97
uaccggcuggccagg

SEQ ID NO: 3103766 - RNA, 16 nt, Mycobacterium bovis subsp bovis AF2122/97
uaccggcuggccaggu

SEQ ID NO: 3103767 - RNA, 19 nt, Mycobacterium bovis subsp bovis AF2122/97
uaccgggaucccacggcgg

SEQ ID NO: 3103768 - RNA, 20 nt, Mycobacterium bovis subsp bovis AF2122/97
uaccggucagcaccuccacc

SEQ ID NO: 3103769 - RNA, 21 nt, Mycobacterium bovis subsp bovis AF2122/97
uaccgguccgucaccaccgcc

SEQ ID NO: 3103770 - RNA, 23 nt, Mycobacterium bovis subsp bovis AF2122/97
uaccgguccgucaccaccgccgc

SEQ ID NO: 3103771 - RNA, 19 nt, Mycobacterium bovis subsp bovis AF2122/97
uaccgguugacgggcucgg

SEQ ID NO: 3103772 - RNA, 23 nt, Mycobacterium bovis subsp bovis AF2122/97
uaccgucaguagccacgcccaca

SEQ ID NO: 3103773 - RNA, 13 nt, Mycobacterium bovis subsp bovis AF2122/97
uaccgucgaccac

SEQ ID NO: 3103774 - RNA, 22 nt, Mycobacterium bovis subsp bovis AF2122/97
uaccgucgaccacuagcccagu

SEQ ID NO: 3103775 - RNA, 18 nt, Mycobacterium bovis subsp bovis AF2122/97
uaccgucgugcgugcggc

SEQ ID NO: 3103776 - RNA, 16 nt, Mycobacterium bovis subsp bovis AF2122/97
uaccgugcauaccgca

SEQ ID NO: 3103777 - RNA, 16 nt, Mycobacterium bovis subsp bovis AF2122/97
uaccgugccgcccggu

SEQ ID NO: 3103778 - RNA, 19 nt, Mycobacterium bovis subsp bovis AF2122/97
uaccgugccgcccggucgg

SEQ ID NO: 3103779 - RNA, 19 nt, Mycobacterium bovis subsp bovis AF2122/97
uaccgugcuggcaccagca

SEQ ID NO: 3103780 - RNA, 19 nt, Mycobacterium bovis subsp bovis AF2122/97
uaccguguaugcauccacu

SEQ ID NO: 3103781 - RNA, 15 nt, Mycobacterium bovis subsp bovis AF2122/97
uaccguuccacgucg

SEQ ID NO: 3103782 - RNA, 11 nt, Mycobacterium bovis subsp bovis AF2122/97
uaccucccgcg

SEQ ID NO: 3103783 - RNA, 19 nt, Mycobacterium bovis subsp bovis AF2122/97
uaccucggccgccagcccc

SEQ ID NO: 3103784 - RNA, 13 nt, Mycobacterium bovis subsp bovis AF2122/97
uaccucggcgacc

SEQ ID NO: 3103785 - RNA, 14 nt, Mycobacterium bovis subsp bovis AF2122/97
uaccugaagccgcg

SEQ ID NO: 3103786 - RNA, 20 nt, Mycobacterium bovis subsp bovis AF2122/97
uaccugggacaggacgacug

SEQ ID NO: 3103787 - RNA, 13 nt, Mycobacterium bovis subsp bovis AF2122/97
uacgaagccgccg

SEQ ID NO: 3103788 - RNA, 11 nt, Mycobacterium bovis subsp bovis AF2122/97
uacgaccaaua

SEQ ID NO: 3103789 - RNA, 23 nt, Mycobacterium bovis subsp bovis AF2122/97
uacgacccccgaucaggccgacg

SEQ ID NO: 3103790 - RNA, 16 nt, Mycobacterium bovis subsp bovis AF2122/97
uacgaccgucgcgcug

SEQ ID NO: 3103791 - RNA, 19 nt, Mycobacterium bovis subsp bovis AF2122/97
uacgaccgucgcgcugccg

SEQ ID NO: 3103792 - RNA, 22 nt, Mycobacterium bovis subsp bovis AF2122/97
uacgacgucgcuguaggccagc

SEQ ID NO: 3103793 - RNA, 16 nt, Mycobacterium bovis subsp bovis AF2122/97
uacgacuuggugcagc

SEQ ID NO: 3103794 - RNA, 21 nt, Mycobacterium bovis subsp bovis AF2122/97
uacgacuuggugcagcgcagg

SEQ ID NO: 3103795 - RNA, 14 nt, Mycobacterium bovis subsp bovis AF2122/97
uacgaggacgacga

SEQ ID NO: 3103796 - RNA, 14 nt, Mycobacterium bovis subsp bovis AF2122/97
uacgaggcgggcag

SEQ ID NO: 3103797 - RNA, 19 nt, Mycobacterium bovis subsp bovis AF2122/97
uacgcaccgaggccgccga

SEQ ID NO: 3103798 - RNA, 20 nt, Mycobacterium bovis subsp bovis AF2122/97
uacgcaccgaggccgccgag

SEQ ID NO: 3103799 - RNA, 23 nt, Mycobacterium bovis subsp bovis AF2122/97
uacgccaccggcaaucggcggca

SEQ ID NO: 3103800 - RNA, 20 nt, Mycobacterium bovis subsp bovis AF2122/97
uacgccccacugccgugccg

SEQ ID NO: 3103801 - RNA, 19 nt, Mycobacterium bovis subsp bovis AF2122/97
uacgccgagaugcugcacc

SEQ ID NO: 3103802 - RNA, 18 nt, Mycobacterium bovis subsp bovis AF2122/97
uacgccgccgaucaccag

SEQ ID NO: 3103803 - RNA, 15 nt, Mycobacterium bovis subsp bovis AF2122/97
uacgccggccgcgcu

SEQ ID NO: 3103804 - RNA, 20 nt, Mycobacterium bovis subsp bovis AF2122/97
uacgccggccgcgcugguga

SEQ ID NO: 3103805 - RNA, 14 nt, Mycobacterium bovis subsp bovis AF2122/97
uacgcgacgggccg

SEQ ID NO: 3103806 - RNA, 22 nt, Mycobacterium bovis subsp bovis AF2122/97
uacgcgaucagcgcgcacacgg

SEQ ID NO: 3103807 - RNA, 23 nt, Mycobacterium bovis subsp bovis AF2122/97
uacgcgcgcucgcucaccggcug

SEQ ID NO: 3103808 - RNA, 17 nt, Mycobacterium bovis subsp bovis AF2122/97
uacgcggggccggccgg

SEQ ID NO: 3103809 - RNA, 14 nt, Mycobacterium bovis subsp bovis AF2122/97
uacgcgggugacca

SEQ ID NO: 3103810 - RNA, 18 nt, Mycobacterium bovis subsp bovis AF2122/97
uacgcguugugcccgccg

SEQ ID NO: 3103811 - RNA, 21 nt, Mycobacterium bovis subsp bovis AF2122/97
uacgcuccgaugaccaggguc

SEQ ID NO: 3103812 - RNA, 13 nt, Mycobacterium bovis subsp bovis AF2122/97
uacgcucggcgaa

SEQ ID NO: 3103813 - RNA, 18 nt, Mycobacterium bovis subsp bovis AF2122/97
uacggaccguggcagcug

SEQ ID NO: 3103814 - RNA, 21 nt, Mycobacterium bovis subsp bovis AF2122/97
uacggcaauacccgccgcgau

SEQ ID NO: 3103815 - RNA, 13 nt, Mycobacterium bovis subsp bovis AF2122/97
uacggccacaccg

SEQ ID NO: 3103816 - RNA, 15 nt, Mycobacterium bovis subsp bovis AF2122/97
uacggccaccaggug

SEQ ID NO: 3103817 - RNA, 17 nt, Mycobacterium bovis subsp bovis AF2122/97
uacggcccggcacccgg

SEQ ID NO: 3103818 - RNA, 19 nt, Mycobacterium bovis subsp bovis AF2122/97
uacggccugccgcucgccg

SEQ ID NO: 3103819 - RNA, 13 nt, Mycobacterium bovis subsp bovis AF2122/97
uacggcgacaccc

SEQ ID NO: 3103820 - RNA, 18 nt, Mycobacterium bovis subsp bovis AF2122/97
uacggcgaugcggucggc

SEQ ID NO: 3103821 - RNA, 19 nt, Mycobacterium bovis subsp bovis AF2122/97
uacggcgaugcggucggcc

SEQ ID NO: 3103822 - RNA, 22 nt, Mycobacterium bovis subsp bovis AF2122/97
uacggcgaugcggucggccaca

SEQ ID NO: 3103823 - RNA, 14 nt, Mycobacterium bovis subsp bovis AF2122/97
uacggcgggcggcc

SEQ ID NO: 3103824 - RNA, 16 nt, Mycobacterium bovis subsp bovis AF2122/97
uacggcucggcgcuga

SEQ ID NO: 3103825 - RNA, 12 nt, Mycobacterium bovis subsp bovis AF2122/97
uacgggcaggcc

SEQ ID NO: 3103826 - RNA, 20 nt, Mycobacterium bovis subsp bovis AF2122/97
uacgggcaggccgcugggcc

SEQ ID NO: 3103827 - RNA, 12 nt, Mycobacterium bovis subsp bovis AF2122/97
uacgggcaguga

SEQ ID NO: 3103828 - RNA, 15 nt, Mycobacterium bovis subsp bovis AF2122/97
uacgggcagugaaca

SEQ ID NO: 3103829 - RNA, 22 nt, Mycobacterium bovis subsp bovis AF2122/97
uacgggcugacgaucuccaccc

SEQ ID NO: 3103830 - RNA, 18 nt, Mycobacterium bovis subsp bovis AF2122/97
uacggggccgucucgccg

SEQ ID NO: 3103831 - RNA, 13 nt, Mycobacterium bovis subsp bovis AF2122/97
uacgggugaucuu

SEQ ID NO: 3103832 - RNA, 21 nt, Mycobacterium bovis subsp bovis AF2122/97
uacgguagacguugccaacac

SEQ ID NO: 3103833 - RNA, 17 nt, Mycobacterium bovis subsp bovis AF2122/97
uacggugcccugcauag

SEQ ID NO: 3103834 - RNA, 21 nt, Mycobacterium bovis subsp bovis AF2122/97
uacggugguaagacgccgaac

SEQ ID NO: 3103835 - RNA, 16 nt, Mycobacterium bovis subsp bovis AF2122/97
uacgguugaugcaucc

SEQ ID NO: 3103836 - RNA, 21 nt, Mycobacterium bovis subsp bovis AF2122/97
uacgucgaccgacgggucgua

SEQ ID NO: 3103837 - RNA, 16 nt, Mycobacterium bovis subsp bovis AF2122/97
uacgucugcucgcgca

SEQ ID NO: 3103838 - RNA, 17 nt, Mycobacterium bovis subsp bovis AF2122/97
uacgugcgagcccaccu

SEQ ID NO: 3103839 - RNA, 17 nt, Mycobacterium bovis subsp bovis AF2122/97
uacguuguacucgugcg

SEQ ID NO: 3103840 - RNA, 21 nt, Mycobacterium bovis subsp bovis AF2122/97
uacuaggcccagcacggucaa

SEQ ID NO: 3103841 - RNA, 22 nt, Mycobacterium bovis subsp bovis AF2122/97
uacuaggcccagcacggucaac

SEQ ID NO: 3103842 - RNA, 17 nt, Mycobacterium bovis subsp bovis AF2122/97
uacuaggccccuggccg

SEQ ID NO: 3103843 - RNA, 13 nt, Mycobacterium bovis subsp bovis AF2122/97
uacuaugccaacg

SEQ ID NO: 3103844 - RNA, 15 nt, Mycobacterium bovis subsp bovis AF2122/97
uacuccaccgcgccg

SEQ ID NO: 3103845 - RNA, 20 nt, Mycobacterium bovis subsp bovis AF2122/97
uacuccaccgcgccgucguc

SEQ ID NO: 3103846 - RNA, 14 nt, Mycobacterium bovis subsp bovis AF2122/97
uacucccccgcgaa

SEQ ID NO: 3103847 - RNA, 22 nt, Mycobacterium bovis subsp bovis AF2122/97
uacuccgcgagcccggccucgg

SEQ ID NO: 3103848 - RNA, 16 nt, Mycobacterium bovis subsp bovis AF2122/97
uacucgaaacccaugu

SEQ ID NO: 3103849 - RNA, 17 nt, Mycobacterium bovis subsp bovis AF2122/97
uacucgcggcgcggccg

SEQ ID NO: 3103850 - RNA, 22 nt, Mycobacterium bovis subsp bovis AF2122/97
uacucgcggcgcggccgcagcc

SEQ ID NO: 3103851 - RNA, 18 nt, Mycobacterium bovis subsp bovis AF2122/97
uacucggcgacugcgucg

SEQ ID NO: 3103852 - RNA, 12 nt, Mycobacterium bovis subsp bovis AF2122/97
uacucggcggcu

SEQ ID NO: 3103853 - RNA, 14 nt, Mycobacterium bovis subsp bovis AF2122/97
uacucgugaugaau

SEQ ID NO: 3103854 - RNA, 13 nt, Mycobacterium bovis subsp bovis AF2122/97
uacugagcuucca

SEQ ID NO: 3103855 - RNA, 21 nt, Mycobacterium bovis subsp bovis AF2122/97
uacugaggaaagucaccgucc

SEQ ID NO: 3103856 - RNA, 19 nt, Mycobacterium bovis subsp bovis AF2122/97
uacugcgaccaagucaugc

SEQ ID NO: 3103857 - RNA, 14 nt, Mycobacterium bovis subsp bovis AF2122/97
uacugcgcagcgcc

SEQ ID NO: 3103858 - RNA, 22 nt, Mycobacterium bovis subsp bovis AF2122/97
uacugcggugccacggugaccc

SEQ ID NO: 3103859 - RNA, 11 nt, Mycobacterium bovis subsp bovis AF2122/97
uacugcugcuu

SEQ ID NO: 3103860 - RNA, 18 nt, Mycobacterium bovis subsp bovis AF2122/97
uacuggcguugccaccgg

SEQ ID NO: 3103861 - RNA, 16 nt, Mycobacterium bovis subsp bovis AF2122/97
uacugguuagagacuu

SEQ ID NO: 3103862 - RNA, 22 nt, Mycobacterium bovis subsp bovis AF2122/97
uacugucgucgcccugacacaa

SEQ ID NO: 3103863 - RNA, 19 nt, Mycobacterium bovis subsp bovis AF2122/97
uacuucaucggcacaggcg

SEQ ID NO: 3103864 - RNA, 22 nt, Mycobacterium bovis subsp bovis AF2122/97
uacuuccauccacaucgauguc

SEQ ID NO: 3103865 - RNA, 14 nt, Mycobacterium bovis subsp bovis AF2122/97
uacuucgcggcggu

SEQ ID NO: 3103866 - RNA, 13 nt, Mycobacterium bovis subsp bovis AF2122/97
gcccacaccagcg

SEQ ID NO: 3103867 - RNA, 14 nt, Mycobacterium bovis subsp bovis AF2122/97
gcccacaccagcgc

SEQ ID NO: 3103868 - RNA, 17 nt, Mycobacterium bovis subsp bovis AF2122/97
gcccacaccagcgcagc

SEQ ID NO: 3103869 - RNA, 15 nt, Mycobacterium bovis subsp bovis AF2122/97
gcccacacggucguc

SEQ ID NO: 3103870 - RNA, 16 nt, Mycobacterium bovis subsp bovis AF2122/97
gcccacacggucgucg

SEQ ID NO: 3103871 - RNA, 18 nt, Mycobacterium bovis subsp bovis AF2122/97
gcccacacggucgucgcg

SEQ ID NO: 3103872 - RNA, 21 nt, Mycobacterium bovis subsp bovis AF2122/97
gcccacacggucgucgcgagc

SEQ ID NO: 3103873 - RNA, 24 nt, Mycobacterium bovis subsp bovis AF2122/97
gcccacacggucgucgcgagcgga

SEQ ID NO: 3103874 - RNA, 14 nt, Mycobacterium bovis subsp bovis AF2122/97
gcccacacuaggcc

SEQ ID NO: 3103875 - RNA, 17 nt, Mycobacterium bovis subsp bovis AF2122/97
gcccacagcaacgacau

SEQ ID NO: 3103876 - RNA, 15 nt, Mycobacterium bovis subsp bovis AF2122/97
gcccacaggcggcgc

SEQ ID NO: 3103877 - RNA, 15 nt, Mycobacterium bovis subsp bovis AF2122/97
gcccacaggggcagc

SEQ ID NO: 3103878 - RNA, 20 nt, Mycobacterium bovis subsp bovis AF2122/97
gcccacaggggcagcgcggc

SEQ ID NO: 3103879 - RNA, 21 nt, Mycobacterium bovis subsp bovis AF2122/97
gcccacaggggcagcgcggcc

SEQ ID NO: 3103880 - RNA, 22 nt, Mycobacterium bovis subsp bovis AF2122/97
gcccacaggggcagcgcggcca

SEQ ID NO: 3103881 - RNA, 16 nt, Mycobacterium bovis subsp bovis AF2122/97
gcccacaucgucggcg

SEQ ID NO: 3103882 - RNA, 17 nt, Mycobacterium bovis subsp bovis AF2122/97
gcccacaucgucggcgg

SEQ ID NO: 3103883 - RNA, 23 nt, Mycobacterium bovis subsp bovis AF2122/97
gcccacaucgucggcgggcggca

SEQ ID NO: 3103884 - RNA, 16 nt, Mycobacterium bovis subsp bovis AF2122/97
gcccacaugcgcucgc

SEQ ID NO: 3103885 - RNA, 17 nt, Mycobacterium bovis subsp bovis AF2122/97
gcccacaugcucagggc

SEQ ID NO: 3103886 - RNA, 20 nt, Mycobacterium bovis subsp bovis AF2122/97
gcccacaugcucagggcagu

SEQ ID NO: 3103887 - RNA, 22 nt, Mycobacterium bovis subsp bovis AF2122/97
gcccacauguccagcguccugg

SEQ ID NO: 3103888 - RNA, 15 nt, Mycobacterium bovis subsp bovis AF2122/97
gcccaccacacagcc

SEQ ID NO: 3103889 - RNA, 23 nt, Mycobacterium bovis subsp bovis AF2122/97
gcccaccaccgacagcacccggc

SEQ ID NO: 3103890 - RNA, 15 nt, Mycobacterium bovis subsp bovis AF2122/97
gcccaccacgcgacg

SEQ ID NO: 3103891 - RNA, 17 nt, Mycobacterium bovis subsp bovis AF2122/97
gcccaccacgcgacgcg

SEQ ID NO: 3103892 - RNA, 23 nt, Mycobacterium bovis subsp bovis AF2122/97
gcccaccacugugacacccgagg

SEQ ID NO: 3103893 - RNA, 18 nt, Mycobacterium bovis subsp bovis AF2122/97
gcccaccagcggcggcaa

SEQ ID NO: 3103894 - RNA, 19 nt, Mycobacterium bovis subsp bovis AF2122/97
gcccaccagcggcggcaac

SEQ ID NO: 3103895 - RNA, 20 nt, Mycobacterium bovis subsp bovis AF2122/97
gcccaccagcggcggcaacg

SEQ ID NO: 3103896 - RNA, 17 nt, Mycobacterium bovis subsp bovis AF2122/97
gcccaccaggcccaucu

SEQ ID NO: 3103897 - RNA, 19 nt, Mycobacterium bovis subsp bovis AF2122/97
gcccaccaguuccggggug

SEQ ID NO: 3103898 - RNA, 11 nt, Mycobacterium bovis subsp bovis AF2122/97
gcccaccaucc

SEQ ID NO: 3103899 - RNA, 15 nt, Mycobacterium bovis subsp bovis AF2122/97
gcccaccaucccgcu

SEQ ID NO: 3103900 - RNA, 20 nt, Mycobacterium bovis subsp bovis AF2122/97
gcccaccaugaucacaccga

SEQ ID NO: 3103901 - RNA, 23 nt, Mycobacterium bovis subsp bovis AF2122/97
gcccaccaugaucacaccgagcg

SEQ ID NO: 3103902 - RNA, 15 nt, Mycobacterium bovis subsp bovis AF2122/97
gcccacccacuggcg

SEQ ID NO: 3103903 - RNA, 15 nt, Mycobacterium bovis subsp bovis AF2122/97
gcccaccccggccgc

SEQ ID NO: 3103904 - RNA, 16 nt, Mycobacterium bovis subsp bovis AF2122/97
gcccaccccggccgca

SEQ ID NO: 3103905 - RNA, 20 nt, Mycobacterium bovis subsp bovis AF2122/97
gcccacccgggugggccagu

SEQ ID NO: 3103906 - RNA, 15 nt, Mycobacterium bovis subsp bovis AF2122/97
gcccaccgaaaccgg

SEQ ID NO: 3103907 - RNA, 19 nt, Mycobacterium bovis subsp bovis AF2122/97
gcccaccgccugggcggcc

SEQ ID NO: 3103908 - RNA, 20 nt, Mycobacterium bovis subsp bovis AF2122/97
gcccaccgccugggcggcca

SEQ ID NO: 3103909 - RNA, 22 nt, Mycobacterium bovis subsp bovis AF2122/97
gcccaccgccugggcggccagc

SEQ ID NO: 3103910 - RNA, 23 nt, Mycobacterium bovis subsp bovis AF2122/97
gcccaccgccugggcggccagca

SEQ ID NO: 3103911 - RNA, 12 nt, Mycobacterium bovis subsp bovis AF2122/97
gcccaccggcgc

SEQ ID NO: 3103912 - RNA, 14 nt, Mycobacterium bovis subsp bovis AF2122/97
gcccaccggcgccg

SEQ ID NO: 3103913 - RNA, 17 nt, Mycobacterium bovis subsp bovis AF2122/97
gcccaccggcgccgccg

SEQ ID NO: 3103914 - RNA, 18 nt, Mycobacterium bovis subsp bovis AF2122/97
gcccaccggcgccgccgg

SEQ ID NO: 3103915 - RNA, 19 nt, Mycobacterium bovis subsp bovis AF2122/97
gcccaccggcgccgccggc

SEQ ID NO: 3103916 - RNA, 23 nt, Mycobacterium bovis subsp bovis AF2122/97
gcccaccggcgccgccggcaccc

SEQ ID NO: 3103917 - RNA, 17 nt, Mycobacterium bovis subsp bovis AF2122/97
gcccaccggcuagcugu

SEQ ID NO: 3103918 - RNA, 18 nt, Mycobacterium bovis subsp bovis AF2122/97
gcccaccgggcggcggcg

SEQ ID NO: 3103919 - RNA, 13 nt, Mycobacterium bovis subsp bovis AF2122/97
gcccaccggucgc

SEQ ID NO: 3103920 - RNA, 15 nt, Mycobacterium bovis subsp bovis AF2122/97
gcccaccggucgccg

SEQ ID NO: 3103921 - RNA, 16 nt, Mycobacterium bovis subsp bovis AF2122/97
gcccaccggucgccgc

SEQ ID NO: 3103922 - RNA, 11 nt, Mycobacterium bovis subsp bovis AF2122/97
gcccaccggug

SEQ ID NO: 3103923 - RNA, 17 nt, Mycobacterium bovis subsp bovis AF2122/97
gcccaccggugccgccc

SEQ ID NO: 3103924 - RNA, 19 nt, Mycobacterium bovis subsp bovis AF2122/97
gcccaccggugccgcccgc

SEQ ID NO: 3103925 - RNA, 15 nt, Mycobacterium bovis subsp bovis AF2122/97
gcccaccgucugcug

SEQ ID NO: 3103926 - RNA, 18 nt, Mycobacterium bovis subsp bovis AF2122/97
gcccaccuccucgccgga

SEQ ID NO: 3103927 - RNA, 17 nt, Mycobacterium bovis subsp bovis AF2122/97
gcccaccuccugguuga

SEQ ID NO: 3103928 - RNA, 23 nt, Mycobacterium bovis subsp bovis AF2122/97
gcccaccucgaucgcgccgucgg

SEQ ID NO: 3103929 - RNA, 15 nt, Mycobacterium bovis subsp bovis AF2122/97
gcccaccuggggccg

SEQ ID NO: 3103930 - RNA, 23 nt, Mycobacterium bovis subsp bovis AF2122/97
gcccaccuucaucaacgacacca

SEQ ID NO: 3103931 - RNA, 14 nt, Mycobacterium bovis subsp bovis AF2122/97
gcccacgccgcauc

SEQ ID NO: 3103932 - RNA, 12 nt, Mycobacterium bovis subsp bovis AF2122/97
gcccacgcgcag

SEQ ID NO: 3103933 - RNA, 13 nt, Mycobacterium bovis subsp bovis AF2122/97
gcccacgcugccc

SEQ ID NO: 3103934 - RNA, 20 nt, Mycobacterium bovis subsp bovis AF2122/97
gcccacggagggcaggagaa

SEQ ID NO: 3103935 - RNA, 13 nt, Mycobacterium bovis subsp bovis AF2122/97
gcccacggcagcg

SEQ ID NO: 3103936 - RNA, 17 nt, Mycobacterium bovis subsp bovis AF2122/97
gcccacggcagcgccgg

SEQ ID NO: 3103937 - RNA, 13 nt, Mycobacterium bovis subsp bovis AF2122/97
gcccacggcgacc

SEQ ID NO: 3103938 - RNA, 23 nt, Mycobacterium bovis subsp bovis AF2122/97
gcccacggcgaccacgccgccgg

SEQ ID NO: 3103939 - RNA, 16 nt, Mycobacterium bovis subsp bovis AF2122/97
gcccacggcgaccagg

SEQ ID NO: 3103940 - RNA, 17 nt, Mycobacterium bovis subsp bovis AF2122/97
gcccacggcgaccagga

SEQ ID NO: 3103941 - RNA, 19 nt, Mycobacterium bovis subsp bovis AF2122/97
gcccacggcgaccaggagc

SEQ ID NO: 3103942 - RNA, 20 nt, Mycobacterium bovis subsp bovis AF2122/97
gcccacggcgaccaggagcc

SEQ ID NO: 3103943 - RNA, 18 nt, Mycobacterium bovis subsp bovis AF2122/97
gcccacgggccggccgag

SEQ ID NO: 3103944 - RNA, 19 nt, Mycobacterium bovis subsp bovis AF2122/97
gcccacgggccggccgagc

SEQ ID NO: 3103945 - RNA, 21 nt, Mycobacterium bovis subsp bovis AF2122/97
gcccacgggccggccgagcgc

SEQ ID NO: 3103946 - RNA, 22 nt, Mycobacterium bovis subsp bovis AF2122/97
gcccacggugccggcacccgag

SEQ ID NO: 3103947 - RNA, 14 nt, Mycobacterium bovis subsp bovis AF2122/97
gcccacgguguccc

SEQ ID NO: 3103948 - RNA, 19 nt, Mycobacterium bovis subsp bovis AF2122/97
gcccacggugucccgcgag

SEQ ID NO: 3103949 - RNA, 17 nt, Mycobacterium bovis subsp bovis AF2122/97
gcccacguugacggcga

SEQ ID NO: 3103950 - RNA, 23 nt, Mycobacterium bovis subsp bovis AF2122/97
gcccacguuggccaggcccgagu

SEQ ID NO: 3103951 - RNA, 16 nt, Mycobacterium bovis subsp bovis AF2122/97
gcccacguuggccccg

SEQ ID NO: 3103952 - RNA, 17 nt, Mycobacterium bovis subsp bovis AF2122/97
gcccacguuggccccgc

SEQ ID NO: 3103953 - RNA, 18 nt, Mycobacterium bovis subsp bovis AF2122/97
gcccacguuuagggugcc

SEQ ID NO: 3103954 - RNA, 22 nt, Mycobacterium bovis subsp bovis AF2122/97
gcccacuagcagggggacccgg

SEQ ID NO: 3103955 - RNA, 23 nt, Mycobacterium bovis subsp bovis AF2122/97
gcccacuagcagggggacccgga

SEQ ID NO: 3103956 - RNA, 16 nt, Mycobacterium bovis subsp bovis AF2122/97
gcccacuccagcagcu

SEQ ID NO: 3103957 - RNA, 21 nt, Mycobacterium bovis subsp bovis AF2122/97
gcccacucucgccacgccgug

SEQ ID NO: 3103958 - RNA, 17 nt, Mycobacterium bovis subsp bovis AF2122/97
gcccagaaaaccgccgc

SEQ ID NO: 3103959 - RNA, 18 nt, Mycobacterium bovis subsp bovis AF2122/97
gcccagaaaaccgccgca

SEQ ID NO: 3103960 - RNA, 20 nt, Mycobacterium bovis subsp bovis AF2122/97
gcccagaaaaccgccgcaac

SEQ ID NO: 3103961 - RNA, 23 nt, Mycobacterium bovis subsp bovis AF2122/97
gcccagaaaaccgccgcaaccgc

SEQ ID NO: 3103962 - RNA, 16 nt, Mycobacterium bovis subsp bovis AF2122/97
gcccagaccgacccgc

SEQ ID NO: 3103963 - RNA, 15 nt, Mycobacterium bovis subsp bovis AF2122/97
gcccagagccgcugc

SEQ ID NO: 3103964 - RNA, 22 nt, Mycobacterium bovis subsp bovis AF2122/97
gcccagagccgcugcggcaccg

SEQ ID NO: 3103965 - RNA, 18 nt, Mycobacterium bovis subsp bovis AF2122/97
gcccagauagagcuggug

SEQ ID NO: 3103966 - RNA, 19 nt, Mycobacterium bovis subsp bovis AF2122/97
gcccagauagagcuggugc

SEQ ID NO: 3103967 - RNA, 17 nt, Mycobacterium bovis subsp bovis AF2122/97
gcccagauccagcaacg

SEQ ID NO: 3103968 - RNA, 18 nt, Mycobacterium bovis subsp bovis AF2122/97
gcccagauugcccaacac

SEQ ID NO: 3103969 - RNA, 17 nt, Mycobacterium bovis subsp bovis AF2122/97
gcccagcaaccgcucgg

SEQ ID NO: 3103970 - RNA, 19 nt, Mycobacterium bovis subsp bovis AF2122/97
gcccagcaaccgcucggcg

SEQ ID NO: 3103971 - RNA, 20 nt, Mycobacterium bovis subsp bovis AF2122/97
gcccagcaaccgcucggcga

SEQ ID NO: 3103972 - RNA, 19 nt, Mycobacterium bovis subsp bovis AF2122/97
gcccagcaccaccacccga

SEQ ID NO: 3103973 - RNA, 20 nt, Mycobacterium bovis subsp bovis AF2122/97
gcccagcacccucaggcaau

SEQ ID NO: 3103974 - RNA, 15 nt, Mycobacterium bovis subsp bovis AF2122/97
gcccagcacgcuggc

SEQ ID NO: 3103975 - RNA, 16 nt, Mycobacterium bovis subsp bovis AF2122/97
gcccagcacgcuggcg

SEQ ID NO: 3103976 - RNA, 15 nt, Mycobacterium bovis subsp bovis AF2122/97
gcccagcacggucaa

SEQ ID NO: 3103977 - RNA, 18 nt, Mycobacterium bovis subsp bovis AF2122/97
gcccagcacguaacccag

SEQ ID NO: 3103978 - RNA, 21 nt, Mycobacterium bovis subsp bovis AF2122/97
gcccagcacguaacccagucc

SEQ ID NO: 3103979 - RNA, 16 nt, Mycobacterium bovis subsp bovis AF2122/97
gcccagcagaccaagu

SEQ ID NO: 3103980 - RNA, 12 nt, Mycobacterium bovis subsp bovis AF2122/97
gcccagcagcac

SEQ ID NO: 3103981 - RNA, 16 nt, Mycobacterium bovis subsp bovis AF2122/97
gcccagcagcaccugc

SEQ ID NO: 3103982 - RNA, 19 nt, Mycobacterium bovis subsp bovis AF2122/97
gcccagcagcaccugcacc

SEQ ID NO: 3103983 - RNA, 20 nt, Mycobacterium bovis subsp bovis AF2122/97
gcccagcagcaccugcaccg

SEQ ID NO: 3103984 - RNA, 15 nt, Mycobacterium bovis subsp bovis AF2122/97
gcccagcagcgcgac

SEQ ID NO: 3103985 - RNA, 18 nt, Mycobacterium bovis subsp bovis AF2122/97
gcccagcaggucgucggc

SEQ ID NO: 3103986 - RNA, 19 nt, Mycobacterium bovis subsp bovis AF2122/97
gcccagcaggucgucggcg

SEQ ID NO: 3103987 - RNA, 19 nt, Mycobacterium bovis subsp bovis AF2122/97
gcccagcagguuccacggc

SEQ ID NO: 3103988 - RNA, 21 nt, Mycobacterium bovis subsp bovis AF2122/97
gcccagcagguuccacggcca

SEQ ID NO: 3103989 - RNA, 22 nt, Mycobacterium bovis subsp bovis AF2122/97
gcccagcagguuccacggccag

SEQ ID NO: 3103990 - RNA, 19 nt, Mycobacterium bovis subsp bovis AF2122/97
gcccagcaucucggcggcc

SEQ ID NO: 3103991 - RNA, 21 nt, Mycobacterium bovis subsp bovis AF2122/97
gcccagcaucucggcggccaa

SEQ ID NO: 3103992 - RNA, 17 nt, Mycobacterium bovis subsp bovis AF2122/97
gcccagcauggcggaac

SEQ ID NO: 3103993 - RNA, 13 nt, Mycobacterium bovis subsp bovis AF2122/97
gcccagccaacuc

SEQ ID NO: 3103994 - RNA, 12 nt, Mycobacterium bovis subsp bovis AF2122/97
gcccagcccgac

SEQ ID NO: 3103995 - RNA, 12 nt, Mycobacterium bovis subsp bovis AF2122/97
gcccagcccggc

SEQ ID NO: 3103996 - RNA, 13 nt, Mycobacterium bovis subsp bovis AF2122/97
gcccagcccggcg

SEQ ID NO: 3103997 - RNA, 16 nt, Mycobacterium bovis subsp bovis AF2122/97
gcccagccgagcggcg

SEQ ID NO: 3103998 - RNA, 18 nt, Mycobacterium bovis subsp bovis AF2122/97
gcccagccgagcggcggc

SEQ ID NO: 3103999 - RNA, 19 nt, Mycobacterium bovis subsp bovis AF2122/97
gcccagccgagcguggcgu

SEQ ID NO: 3104000 - RNA, 20 nt, Mycobacterium bovis subsp bovis AF2122/97
gcccagccgagcguggcguu

SEQ ID NO: 3104001 - RNA, 13 nt, Mycobacterium bovis subsp bovis AF2122/97
gcccagccgccag

SEQ ID NO: 3104002 - RNA, 17 nt, Mycobacterium bovis subsp bovis AF2122/97
gcccagccgccagcccg

SEQ ID NO: 3104003 - RNA, 22 nt, Mycobacterium bovis subsp bovis AF2122/97
cacgaucgcggugauggugaau

SEQ ID NO: 3104004 - RNA, 14 nt, Mycobacterium bovis subsp bovis AF2122/97
cacgaucgcgucgg

SEQ ID NO: 3104005 - RNA, 22 nt, Mycobacterium bovis subsp bovis AF2122/97
cacgaucggcagucccagcgcc

SEQ ID NO: 3104006 - RNA, 23 nt, Mycobacterium bovis subsp bovis AF2122/97
cacgaucggcagucccagcgccg

SEQ ID NO: 3104007 - RNA, 23 nt, Mycobacterium bovis subsp bovis AF2122/97
cacgaucggcggggguggaauca

SEQ ID NO: 3104008 - RNA, 15 nt, Mycobacterium bovis subsp bovis AF2122/97
cacgaucggcucacg

SEQ ID NO: 3104009 - RNA, 14 nt, Mycobacterium bovis subsp bovis AF2122/97
cacgaucgugccgg

SEQ ID NO: 3104010 - RNA, 21 nt, Mycobacterium bovis subsp bovis AF2122/97
cacgaucgugccgggaccggu

SEQ ID NO: 3104011 - RNA, 23 nt, Mycobacterium bovis subsp bovis AF2122/97
cacgaucugcaggcccaggcugu

SEQ ID NO: 3104012 - RNA, 16 nt, Mycobacterium bovis subsp bovis AF2122/97
cacgaucugcgcguca

SEQ ID NO: 3104013 - RNA, 15 nt, Mycobacterium bovis subsp bovis AF2122/97
cacgaugaccgggga

SEQ ID NO: 3104014 - RNA, 18 nt, Mycobacterium bovis subsp bovis AF2122/97
cacgaugacguugacguc

SEQ ID NO: 3104015 - RNA, 19 nt, Mycobacterium bovis subsp bovis AF2122/97
cacgaugaucuugccgcgg

SEQ ID NO: 3104016 - RNA, 21 nt, Mycobacterium bovis subsp bovis AF2122/97
cacgaugcccaagcccucgac

SEQ ID NO: 3104017 - RNA, 17 nt, Mycobacterium bovis subsp bovis AF2122/97
cacgaugcccggcaucg

SEQ ID NO: 3104018 - RNA, 23 nt, Mycobacterium bovis subsp bovis AF2122/97
cacgaugcgguucucgagcucgg

SEQ ID NO: 3104019 - RNA, 17 nt, Mycobacterium bovis subsp bovis AF2122/97
cacgauguccucgaugc

SEQ ID NO: 3104020 - RNA, 14 nt, Mycobacterium bovis subsp bovis AF2122/97
cacgaugucgaugc

SEQ ID NO: 3104021 - RNA, 19 nt, Mycobacterium bovis subsp bovis AF2122/97
cagcacguaacccaguccc

SEQ ID NO: 3104022 - RNA, 18 nt, Mycobacterium bovis subsp bovis AF2122/97
cagcacguacugcuccuc

SEQ ID NO: 3104023 - RNA, 15 nt, Mycobacterium bovis subsp bovis AF2122/97
cagcacgucacgcaa

SEQ ID NO: 3104024 - RNA, 14 nt, Mycobacterium bovis subsp bovis AF2122/97
cagcacguccgcgg

SEQ ID NO: 3104025 - RNA, 13 nt, Mycobacterium bovis subsp bovis AF2122/97
cagcacgucgcgg

SEQ ID NO: 3104026 - RNA, 15 nt, Mycobacterium bovis subsp bovis AF2122/97
cagcacgucgcggcc

SEQ ID NO: 3104027 - RNA, 13 nt, Mycobacterium bovis subsp bovis AF2122/97
cagcacgucguug

SEQ ID NO: 3104028 - RNA, 20 nt, Mycobacterium bovis subsp bovis AF2122/97
cagcacgucuugcugcacgc

SEQ ID NO: 3104029 - RNA, 23 nt, Mycobacterium bovis subsp bovis AF2122/97
cagcacgugccaaaugaugacga

SEQ ID NO: 3104030 - RNA, 18 nt, Mycobacterium bovis subsp bovis AF2122/97
cagcacgugccccaugcg

SEQ ID NO: 3104031 - RNA, 14 nt, Mycobacterium bovis subsp bovis AF2122/97
cagcacgugggcca

SEQ ID NO: 3104032 - RNA, 14 nt, Mycobacterium bovis subsp bovis AF2122/97
cagcacgugugcgg

SEQ ID NO: 3104033 - RNA, 15 nt, Mycobacterium bovis subsp bovis AF2122/97
cagcacgugugcggg

SEQ ID NO: 3104034 - RNA, 16 nt, Mycobacterium bovis subsp bovis AF2122/97
cagcacuccaccgcug

SEQ ID NO: 3104035 - RNA, 19 nt, Mycobacterium bovis subsp bovis AF2122/97
cagcacucggugucggccg

SEQ ID NO: 3104036 - RNA, 21 nt, Mycobacterium bovis subsp bovis AF2122/97
cagcacucggugucggccgcg

SEQ ID NO: 3104037 - RNA, 22 nt, Mycobacterium bovis subsp bovis AF2122/97
cagcacucggugucggccgcgu

SEQ ID NO: 3104038 - RNA, 19 nt, Mycobacterium bovis subsp bovis AF2122/97
cagcacugccaucgcggcg

SEQ ID NO: 3104039 - RNA, 20 nt, Mycobacterium bovis subsp bovis AF2122/97
cagcacugccaucgcggcgu

SEQ ID NO: 3104040 - RNA, 18 nt, Mycobacterium bovis subsp bovis AF2122/97
cagcacuuccaagccgac

SEQ ID NO: 3104041 - RNA, 18 nt, Mycobacterium bovis subsp bovis AF2122/97
cagcacuuggacccggcc

SEQ ID NO: 3104042 - RNA, 20 nt, Mycobacterium bovis subsp bovis AF2122/97
cagcacuuggacccggccgg

SEQ ID NO: 3104043 - RNA, 16 nt, Mycobacterium bovis subsp bovis AF2122/97
cagcacuuggccagcu

SEQ ID NO: 3104044 - RNA, 19 nt, Mycobacterium bovis subsp bovis AF2122/97
cagcacuuggccagcuugg

SEQ ID NO: 3104045 - RNA, 19 nt, Mycobacterium bovis subsp bovis AF2122/97
cagcagaaacaucgacagc

SEQ ID NO: 3104046 - RNA, 22 nt, Mycobacterium bovis subsp bovis AF2122/97
cagcagaauccugcgcugcacc

SEQ ID NO: 3104047 - RNA, 20 nt, Mycobacterium bovis subsp bovis AF2122/97
cagcagacccgguggcgugg

SEQ ID NO: 3104048 - RNA, 13 nt, Mycobacterium bovis subsp bovis AF2122/97
cagcagacgacga

SEQ ID NO: 3104049 - RNA, 13 nt, Mycobacterium bovis subsp bovis AF2122/97
cagcagagcggca

SEQ ID NO: 3104050 - RNA, 15 nt, Mycobacterium bovis subsp bovis AF2122/97
cagcagagcggcacg

SEQ ID NO: 3104051 - RNA, 20 nt, Mycobacterium bovis subsp bovis AF2122/97
cagcagaguggugaucuugg

SEQ ID NO: 3104052 - RNA, 13 nt, Mycobacterium bovis subsp bovis AF2122/97
cagcagaucaggu

SEQ ID NO: 3104053 - RNA, 17 nt, Mycobacterium bovis subsp bovis AF2122/97
cagcagauccaggcguc

SEQ ID NO: 3104054 - RNA, 22 nt, Mycobacterium bovis subsp bovis AF2122/97
cagcagauccaggcgucgguga

SEQ ID NO: 3104055 - RNA, 18 nt, Mycobacterium bovis subsp bovis AF2122/97
cagcagauccuggccggu

SEQ ID NO: 3104056 - RNA, 22 nt, Mycobacterium bovis subsp bovis AF2122/97
cagcagauugucgacggucacc

SEQ ID NO: 3104057 - RNA, 23 nt, Mycobacterium bovis subsp bovis AF2122/97
cagcagauugucgacggucaccg

SEQ ID NO: 3104058 - RNA, 22 nt, Mycobacterium bovis subsp bovis AF2122/97
cagcagcaaaacccgagccugg

SEQ ID NO: 3104059 - RNA, 23 nt, Mycobacterium bovis subsp bovis AF2122/97
cagcagcaaacaucgcaggcacc

SEQ ID NO: 3104060 - RNA, 13 nt, Mycobacterium bovis subsp bovis AF2122/97
cagcagcaacgcg

SEQ ID NO: 3104061 - RNA, 16 nt, Mycobacterium bovis subsp bovis AF2122/97
cagcagcaacgcggug

SEQ ID NO: 3104062 - RNA, 13 nt, Mycobacterium bovis subsp bovis AF2122/97
cagcagcaccgcg

SEQ ID NO: 3104063 - RNA, 16 nt, Mycobacterium bovis subsp bovis AF2122/97
cagcagcaccgcgacc

SEQ ID NO: 3104064 - RNA, 12 nt, Mycobacterium bovis subsp bovis AF2122/97
cagcagcaccug

SEQ ID NO: 3104065 - RNA, 13 nt, Mycobacterium bovis subsp bovis AF2122/97
cagcagcaccugc

SEQ ID NO: 3104066 - RNA, 14 nt, Mycobacterium bovis subsp bovis AF2122/97
cagcagcaccugca

SEQ ID NO: 3104067 - RNA, 18 nt, Mycobacterium bovis subsp bovis AF2122/97
cagcagcacuccggcgac

SEQ ID NO: 3104068 - RNA, 16 nt, Mycobacterium bovis subsp bovis AF2122/97
cagcagcagauccugg

SEQ ID NO: 3104069 - RNA, 20 nt, Mycobacterium bovis subsp bovis AF2122/97
cagcagcagauccuggccgg

SEQ ID NO: 3104070 - RNA, 13 nt, Mycobacterium bovis subsp bovis AF2122/97
cagcagcagaugc

SEQ ID NO: 3104071 - RNA, 13 nt, Mycobacterium bovis subsp bovis AF2122/97
cagcagcagcgug

SEQ ID NO: 3104072 - RNA, 14 nt, Mycobacterium bovis subsp bovis AF2122/97
cagcagcagguugu

SEQ ID NO: 3104073 - RNA, 12 nt, Mycobacterium bovis subsp bovis AF2122/97
cagcagcagugc

SEQ ID NO: 3104074 - RNA, 16 nt, Mycobacterium bovis subsp bovis AF2122/97
cagcagcauccggccg

SEQ ID NO: 3104075 - RNA, 21 nt, Mycobacterium bovis subsp bovis AF2122/97
cagcagcauccggccgucauc

SEQ ID NO: 3104076 - RNA, 13 nt, Mycobacterium bovis subsp bovis AF2122/97
cagcagccagccc

SEQ ID NO: 3104077 - RNA, 13 nt, Mycobacterium bovis subsp bovis AF2122/97
cagcagcccccgc

SEQ ID NO: 3104078 - RNA, 14 nt, Mycobacterium bovis subsp bovis AF2122/97
cagcagcccgggca

SEQ ID NO: 3104079 - RNA, 15 nt, Mycobacterium bovis subsp bovis AF2122/97
cagcagcccgguggu

SEQ ID NO: 3104080 - RNA, 16 nt, Mycobacterium bovis subsp bovis AF2122/97
cagcagcccgguggug

SEQ ID NO: 3104081 - RNA, 18 nt, Mycobacterium bovis subsp bovis AF2122/97
cagcagcccgguggugcu

SEQ ID NO: 3104082 - RNA, 13 nt, Mycobacterium bovis subsp bovis AF2122/97
cagcagccgccga

SEQ ID NO: 3104083 - RNA, 17 nt, Mycobacterium bovis subsp bovis AF2122/97
cagcagccgccgaugau

SEQ ID NO: 3104084 - RNA, 20 nt, Mycobacterium bovis subsp bovis AF2122/97
cagcagccgccggccggcau

SEQ ID NO: 3104085 - RNA, 12 nt, Mycobacterium bovis subsp bovis AF2122/97
cagcagccgcga

SEQ ID NO: 3104086 - RNA, 14 nt, Mycobacterium bovis subsp bovis AF2122/97
cagcagccgcgaca

SEQ ID NO: 3104087 - RNA, 14 nt, Mycobacterium bovis subsp bovis AF2122/97
cagcagccgcgacg

SEQ ID NO: 3104088 - RNA, 17 nt, Mycobacterium bovis subsp bovis AF2122/97
cagcagccgcgacgcgg

SEQ ID NO: 3104089 - RNA, 13 nt, Mycobacterium bovis subsp bovis AF2122/97
cagcagccggcgu

SEQ ID NO: 3104090 - RNA, 17 nt, Mycobacterium bovis subsp bovis AF2122/97
cagcagccggugccggu

SEQ ID NO: 3104091 - RNA, 14 nt, Mycobacterium bovis subsp bovis AF2122/97
cagcagccugcgcc

SEQ ID NO: 3104092 - RNA, 17 nt, Mycobacterium bovis subsp bovis AF2122/97
cagcagcgacgcugccg

SEQ ID NO: 3104093 - RNA, 20 nt, Mycobacterium bovis subsp bovis AF2122/97
cagcagcgacgcugccgcca

SEQ ID NO: 3104094 - RNA, 18 nt, Mycobacterium bovis subsp bovis AF2122/97
cagcagcgacggucaggu

SEQ ID NO: 3104095 - RNA, 17 nt, Mycobacterium bovis subsp bovis AF2122/97
cagcagcgacuccagcg

SEQ ID NO: 3104096 - RNA, 20 nt, Mycobacterium bovis subsp bovis AF2122/97
cagcagcgacuccagcgccc

SEQ ID NO: 3104097 - RNA, 15 nt, Mycobacterium bovis subsp bovis AF2122/97
cagcagcgcacugcc

SEQ ID NO: 3104098 - RNA, 19 nt, Mycobacterium bovis subsp bovis AF2122/97
cagcagcgcacugcccggg

SEQ ID NO: 3104099 - RNA, 14 nt, Mycobacterium bovis subsp bovis AF2122/97
cagcagcgccaccc

SEQ ID NO: 3104100 - RNA, 15 nt, Mycobacterium bovis subsp bovis AF2122/97
cagcagcgccacccg

SEQ ID NO: 3104101 - RNA, 16 nt, Mycobacterium bovis subsp bovis AF2122/97
cagcagcgccacccgg

SEQ ID NO: 3104102 - RNA, 22 nt, Mycobacterium bovis subsp bovis AF2122/97
cagcagcgccacccgguccggc

SEQ ID NO: 3104103 - RNA, 23 nt, Mycobacterium bovis subsp bovis AF2122/97
cagcagcgccacccgguccggcc

SEQ ID NO: 3104104 - RNA, 16 nt, Mycobacterium bovis subsp bovis AF2122/97
cagcagcgccgcgcgg

SEQ ID NO: 3104105 - RNA, 14 nt, Mycobacterium bovis subsp bovis AF2122/97
cagcagcgccgcgu

SEQ ID NO: 3104106 - RNA, 21 nt, Mycobacterium bovis subsp bovis AF2122/97
cagcagcgccgcguggcuggc

SEQ ID NO: 3104107 - RNA, 13 nt, Mycobacterium bovis subsp bovis AF2122/97
cagcagcgcgaca

SEQ ID NO: 3104108 - RNA, 14 nt, Mycobacterium bovis subsp bovis AF2122/97
cagcaguacaccgc

SEQ ID NO: 3104109 - RNA, 16 nt, Mycobacterium bovis subsp bovis AF2122/97
cagcaguacaccgccc

SEQ ID NO: 3104110 - RNA, 17 nt, Mycobacterium bovis subsp bovis AF2122/97
cagcaguacaccgcccg

SEQ ID NO: 3104111 - RNA, 20 nt, Mycobacterium bovis subsp bovis AF2122/97
cagcaguacuaacaacacca

SEQ ID NO: 3104112 - RNA, 22 nt, Mycobacterium bovis subsp bovis AF2122/97
cagcaguagaucggaucgaagu

SEQ ID NO: 3104113 - RNA, 15 nt, Mycobacterium bovis subsp bovis AF2122/97
cagcagugccgugcu

SEQ ID NO: 3104114 - RNA, 16 nt, Mycobacterium bovis subsp bovis AF2122/97
cagcagugccgugcug

SEQ ID NO: 3104115 - RNA, 14 nt, Mycobacterium bovis subsp bovis AF2122/97
cagcaguucggcga

SEQ ID NO: 3104116 - RNA, 21 nt, Mycobacterium bovis subsp bovis AF2122/97
cagcaguucggcgaugcgcgg

SEQ ID NO: 3104117 - RNA, 23 nt, Mycobacterium bovis subsp bovis AF2122/97
cagcaguucggcgaugcgcgggu

SEQ ID NO: 3104118 - RNA, 19 nt, Mycobacterium bovis subsp bovis AF2122/97
cagcaguuggucgcggucc

SEQ ID NO: 3104119 - RNA, 18 nt, Mycobacterium bovis subsp bovis AF2122/97
cagcauauccgccggcga

SEQ ID NO: 3104120 - RNA, 20 nt, Mycobacterium bovis subsp bovis AF2122/97
cagcauaucgauucgggcgu

SEQ ID NO: 3104121 - RNA, 16 nt, Mycobacterium bovis subsp bovis AF2122/97
cagcaucacgcccacg

SEQ ID NO: 3104122 - RNA, 20 nt, Mycobacterium bovis subsp bovis AF2122/97
cagcaucacguccgcggugu

SEQ ID NO: 3104123 - RNA, 20 nt, Mycobacterium bovis subsp bovis AF2122/97
cagcaucagcgccagcgagc

SEQ ID NO: 3104124 - RNA, 19 nt, Mycobacterium bovis subsp bovis AF2122/97
cagcaucaguuugacgccg

SEQ ID NO: 3104125 - RNA, 14 nt, Mycobacterium bovis subsp bovis AF2122/97
cagcauccggccgu

SEQ ID NO: 3104126 - RNA, 13 nt, Mycobacterium bovis subsp bovis AF2122/97
cagcauccuucgc

SEQ ID NO: 3104127 - RNA, 21 nt, Mycobacterium bovis subsp bovis AF2122/97
cagcaucgagcaguggccgcc

SEQ ID NO: 3104128 - RNA, 23 nt, Mycobacterium bovis subsp bovis AF2122/97
cagcaucgcggugguuggggcug

SEQ ID NO: 3104129 - RNA, 15 nt, Mycobacterium bovis subsp bovis AF2122/97
cagcaucggcacccc

SEQ ID NO: 3104130 - RNA, 20 nt, Mycobacterium bovis subsp bovis AF2122/97
cagcaucgucgaauccucgc

SEQ ID NO: 3104131 - RNA, 17 nt, Mycobacterium bovis subsp bovis AF2122/97
cagcaucgucgccacga

SEQ ID NO: 3104132 - RNA, 15 nt, Mycobacterium bovis subsp bovis AF2122/97
cagcaucuccgucgg

SEQ ID NO: 3104133 - RNA, 20 nt, Mycobacterium bovis subsp bovis AF2122/97
cagcaucuccgucggccagg

SEQ ID NO: 3104134 - RNA, 24 nt, Mycobacterium bovis subsp bovis AF2122/97
cagcaucucggccuugacgcacga

SEQ ID NO: 3104135 - RNA, 14 nt, Mycobacterium bovis subsp bovis AF2122/97
cagcaucucggcgg

SEQ ID NO: 3104136 - RNA, 20 nt, Mycobacterium bovis subsp bovis AF2122/97
cagcaucucgucgaucucgc

SEQ ID NO: 3104137 - RNA, 22 nt, Mycobacterium bovis subsp bovis AF2122/97
cagcaucugcgggucggcaucg

SEQ ID NO: 3104138 - RNA, 18 nt, Mycobacterium bovis subsp bovis AF2122/97
cagcaucuuuggcggccg

SEQ ID NO: 3104139 - RNA, 19 nt, Mycobacterium bovis subsp bovis AF2122/97
cagcaucuuuggcggccgc

SEQ ID NO: 3104140 - RNA, 17 nt, Mycobacterium bovis subsp bovis AF2122/97
cagcaugacaccggcca

SEQ ID NO: 3104141 - RNA, 19 nt, Mycobacterium bovis subsp bovis AF2122/97
cagcaugacaccggccacc

SEQ ID NO: 3104142 - RNA, 20 nt, Mycobacterium bovis subsp bovis AF2122/97
cagcaugacaccggccacca

SEQ ID NO: 3104143 - RNA, 22 nt, Mycobacterium bovis subsp bovis AF2122/97
cagcaugacaccggccaccagc

SEQ ID NO: 3104144 - RNA, 16 nt, Mycobacterium bovis subsp bovis AF2122/97
cagcaugcccgccauc

SEQ ID NO: 3104145 - RNA, 14 nt, Mycobacterium bovis subsp bovis AF2122/97
cagcaugccugcga

SEQ ID NO: 3104146 - RNA, 13 nt, Mycobacterium bovis subsp bovis AF2122/97
cagcaugcggcca

SEQ ID NO: 3104147 - RNA, 13 nt, Mycobacterium bovis subsp bovis AF2122/97
cagcauggcccug

SEQ ID NO: 3104148 - RNA, 17 nt, Mycobacterium bovis subsp bovis AF2122/97
cagcauggcccuggcga

SEQ ID NO: 3104149 - RNA, 22 nt, Mycobacterium bovis subsp bovis AF2122/97
cagcauggcccuggcgaccagc

SEQ ID NO: 3104150 - RNA, 20 nt, Mycobacterium bovis subsp bovis AF2122/97
cagcauggcuuuugcgccga

SEQ ID NO: 3104151 - RNA, 21 nt, Mycobacterium bovis subsp bovis AF2122/97
cagcauggcuuuugcgccgaa

SEQ ID NO: 3104152 - RNA, 20 nt, Mycobacterium bovis subsp bovis AF2122/97
cagcaugggcgagaaguccg

SEQ ID NO: 3104153 - RNA, 18 nt, Mycobacterium bovis subsp bovis AF2122/97
cagcaugguccacagccg

SEQ ID NO: 3104154 - RNA, 22 nt, Mycobacterium bovis subsp bovis AF2122/97
cagcaugguccacagccggcgg

SEQ ID NO: 3104155 - RNA, 18 nt, Mycobacterium bovis subsp bovis AF2122/97
cagcauggugcggcggcg

SEQ ID NO: 3104156 - RNA, 21 nt, Mycobacterium bovis subsp bovis AF2122/97
cagcaugguuagcggugaugg

SEQ ID NO: 3104157 - RNA, 22 nt, Mycobacterium bovis subsp bovis AF2122/97
cagcaugguuagcggugauggg

SEQ ID NO: 3104158 - RNA, 17 nt, Mycobacterium bovis subsp bovis AF2122/97
cagcaugucgcggaccc

SEQ ID NO: 3104159 - RNA, 19 nt, Mycobacterium bovis subsp bovis AF2122/97
cagcaugucucgggcgcgg

SEQ ID NO: 3104160 - RNA, 15 nt, Mycobacterium bovis subsp bovis AF2122/97
cagcauguggccgcc

SEQ ID NO: 3104161 - RNA, 17 nt, Mycobacterium bovis subsp bovis AF2122/97
cagcauguggccgccgu

SEQ ID NO: 3104162 - RNA, 18 nt, Mycobacterium bovis subsp bovis AF2122/97
cagcauguggccgccguc

SEQ ID NO: 3104163 - RNA, 19 nt, Mycobacterium bovis subsp bovis AF2122/97
cagcauguggccgccgucg

SEQ ID NO: 3104164 - RNA, 22 nt, Mycobacterium bovis subsp bovis AF2122/97
cagcauguggccgccgucgacg

SEQ ID NO: 3104165 - RNA, 17 nt, Mycobacterium bovis subsp bovis AF2122/97
cagcauucaccaaaccg

SEQ ID NO: 3104166 - RNA, 14 nt, Mycobacterium bovis subsp bovis AF2122/97
cagcauugaagaag

SEQ ID NO: 3104167 - RNA, 17 nt, Mycobacterium bovis subsp bovis AF2122/97
cagcauugacccgacga

SEQ ID NO: 3104168 - RNA, 18 nt, Mycobacterium bovis subsp bovis AF2122/97
cagccaaaaacgcugccg

SEQ ID NO: 3104169 - RNA, 20 nt, Mycobacterium bovis subsp bovis AF2122/97
cagccaaaaacgcugccgcc

SEQ ID NO: 3104170 - RNA, 22 nt, Mycobacterium bovis subsp bovis AF2122/97
cagccaaaaacgcugccgccgu

SEQ ID NO: 3104171 - RNA, 21 nt, Mycobacterium bovis subsp bovis AF2122/97
cagccaaaacgagcagauggu

SEQ ID NO: 3104172 - RNA, 14 nt, Mycobacterium bovis subsp bovis AF2122/97
cagccaacccgucu

SEQ ID NO: 3104173 - RNA, 22 nt, Mycobacterium bovis subsp bovis AF2122/97
cagccaaccggcgcaguagccg

SEQ ID NO: 3104174 - RNA, 17 nt, Mycobacterium bovis subsp bovis AF2122/97
cagccaacgggaacaac

SEQ ID NO: 3104175 - RNA, 19 nt, Mycobacterium bovis subsp bovis AF2122/97
cagccaacgucaccaaguu

SEQ ID NO: 3104176 - RNA, 21 nt, Mycobacterium bovis subsp bovis AF2122/97
cagccaacucaggccgguacc

SEQ ID NO: 3104177 - RNA, 19 nt, Mycobacterium bovis subsp bovis AF2122/97
cagccaaugccggaucggg

SEQ ID NO: 3104178 - RNA, 15 nt, Mycobacterium bovis subsp bovis AF2122/97
cagccacagcccggc

SEQ ID NO: 3104179 - RNA, 18 nt, Mycobacterium bovis subsp bovis AF2122/97
cagccacagcccggcggc

SEQ ID NO: 3104180 - RNA, 15 nt, Mycobacterium bovis subsp bovis AF2122/97
cagccacagccgacc

SEQ ID NO: 3104181 - RNA, 19 nt, Mycobacterium bovis subsp bovis AF2122/97
cagccacagccgaccucga

SEQ ID NO: 3104182 - RNA, 21 nt, Mycobacterium bovis subsp bovis AF2122/97
cagccacauacaggcccgcca

SEQ ID NO: 3104183 - RNA, 22 nt, Mycobacterium bovis subsp bovis AF2122/97
cagccacauacaggcccgccag

SEQ ID NO: 3104184 - RNA, 12 nt, Mycobacterium bovis subsp bovis AF2122/97
cagccaccacca

SEQ ID NO: 3104185 - RNA, 19 nt, Mycobacterium bovis subsp bovis AF2122/97
cagccaccagcgacgacca

SEQ ID NO: 3104186 - RNA, 21 nt, Mycobacterium bovis subsp bovis AF2122/97
cagccaccagcgacgaccaca

SEQ ID NO: 3104187 - RNA, 18 nt, Mycobacterium bovis subsp bovis AF2122/97
cagccaccaucuggaugg

SEQ ID NO: 3104188 - RNA, 12 nt, Mycobacterium bovis subsp bovis AF2122/97
cagccaccccug

SEQ ID NO: 3104189 - RNA, 15 nt, Mycobacterium bovis subsp bovis AF2122/97
cagccaccccugcgg

SEQ ID NO: 3104190 - RNA, 17 nt, Mycobacterium bovis subsp bovis AF2122/97
cagccacccgacaacgc

SEQ ID NO: 3104191 - RNA, 18 nt, Mycobacterium bovis subsp bovis AF2122/97
cagccaccgggcgugcgg

SEQ ID NO: 3104192 - RNA, 23 nt, Mycobacterium bovis subsp bovis AF2122/97
cagccaccgggcgugcggcggcc

SEQ ID NO: 3104193 - RNA, 12 nt, Mycobacterium bovis subsp bovis AF2122/97
cagccaccggug

SEQ ID NO: 3104194 - RNA, 12 nt, Mycobacterium bovis subsp bovis AF2122/97
cagcccaugggg

SEQ ID NO: 3104195 - RNA, 15 nt, Mycobacterium bovis subsp bovis AF2122/97
cagcccaugucgagc

SEQ ID NO: 3104196 - RNA, 19 nt, Mycobacterium bovis subsp bovis AF2122/97
cagcccaugucgagcacgc

SEQ ID NO: 3104197 - RNA, 13 nt, Mycobacterium bovis subsp bovis AF2122/97
cagccccaacccu

SEQ ID NO: 3104198 - RNA, 15 nt, Mycobacterium bovis subsp bovis AF2122/97
cagccccacccgccg

SEQ ID NO: 3104199 - RNA, 18 nt, Mycobacterium bovis subsp bovis AF2122/97
cagccccacccgccgccg

SEQ ID NO: 3104200 - RNA, 19 nt, Mycobacterium bovis subsp bovis AF2122/97
cagccccacuucgggcgga

SEQ ID NO: 3104201 - RNA, 20 nt, Mycobacterium bovis subsp bovis AF2122/97
cagccccagcuugcggugau

SEQ ID NO: 3104202 - RNA, 18 nt, Mycobacterium bovis subsp bovis AF2122/97
cagccccaugaucuggug

SEQ ID NO: 3104203 - RNA, 18 nt, Mycobacterium bovis subsp bovis AF2122/97
cagccccauugccgucgc

SEQ ID NO: 3104204 - RNA, 20 nt, Mycobacterium bovis subsp bovis AF2122/97
cagccccauugccgucgcgg

SEQ ID NO: 3104205 - RNA, 23 nt, Mycobacterium bovis subsp bovis AF2122/97
cagccccauugccgucgcgguca

SEQ ID NO: 3104206 - RNA, 18 nt, Mycobacterium bovis subsp bovis AF2122/97
cagccccccggcgacggc

SEQ ID NO: 3104207 - RNA, 20 nt, Mycobacterium bovis subsp bovis AF2122/97
cagccccccggcgacggcgu

SEQ ID NO: 3104208 - RNA, 16 nt, Mycobacterium bovis subsp bovis AF2122/97
cagcccccgcugaccg

SEQ ID NO: 3104209 - RNA, 17 nt, Mycobacterium bovis subsp bovis AF2122/97
cagccccgacugcgccc

SEQ ID NO: 3104210 - RNA, 19 nt, Mycobacterium bovis subsp bovis AF2122/97
cagccccgacugcgcccau

SEQ ID NO: 3104211 - RNA, 14 nt, Mycobacterium bovis subsp bovis AF2122/97
cagccccgcgccca

SEQ ID NO: 3104212 - RNA, 22 nt, Mycobacterium bovis subsp bovis AF2122/97
cagccccgcgcccaccccggcc

SEQ ID NO: 3104213 - RNA, 14 nt, Mycobacterium bovis subsp bovis AF2122/97
cagccccgcggcca

SEQ ID NO: 3104214 - RNA, 15 nt, Mycobacterium bovis subsp bovis AF2122/97
cagccccgcggccag

SEQ ID NO: 3104215 - RNA, 13 nt, Mycobacterium bovis subsp bovis AF2122/97
cagccccuccgcg

SEQ ID NO: 3104216 - RNA, 16 nt, Mycobacterium bovis subsp bovis AF2122/97
cagccccuccgcgccg

SEQ ID NO: 3104217 - RNA, 17 nt, Mycobacterium bovis subsp bovis AF2122/97
cagccccuccgcgccga

SEQ ID NO: 3104218 - RNA, 13 nt, Mycobacterium bovis subsp bovis AF2122/97
cagccccugccga

SEQ ID NO: 3104219 - RNA, 16 nt, Mycobacterium bovis subsp bovis AF2122/97
cagccccugccgaucc

SEQ ID NO: 3104220 - RNA, 17 nt, Mycobacterium bovis subsp bovis AF2122/97
cagcccgaacucguugg

SEQ ID NO: 3104221 - RNA, 20 nt, Mycobacterium bovis subsp bovis AF2122/97
cagcccgaacucguuggcga

SEQ ID NO: 3104222 - RNA, 17 nt, Mycobacterium bovis subsp bovis AF2122/97
cagcccgacaccgaucg

SEQ ID NO: 3104223 - RNA, 15 nt, Mycobacterium bovis subsp bovis AF2122/97
cagcccgacgcccga

SEQ ID NO: 3104224 - RNA, 16 nt, Mycobacterium bovis subsp bovis AF2122/97
cagcccgacgcccgac

SEQ ID NO: 3104225 - RNA, 14 nt, Mycobacterium bovis subsp bovis AF2122/97
cagcccgacguugc

SEQ ID NO: 3104226 - RNA, 17 nt, Mycobacterium bovis subsp bovis AF2122/97
cagcccgacguugcgua

SEQ ID NO: 3104227 - RNA, 15 nt, Mycobacterium bovis subsp bovis AF2122/97
cagcccgagcucggg

SEQ ID NO: 3104228 - RNA, 20 nt, Mycobacterium bovis subsp bovis AF2122/97
cagcccgaugaucccgccac

SEQ ID NO: 3104229 - RNA, 21 nt, Mycobacterium bovis subsp bovis AF2122/97
cagcccgaugaucccgccacc

SEQ ID NO: 3104230 - RNA, 13 nt, Mycobacterium bovis subsp bovis AF2122/97
cagcccgcccaau

SEQ ID NO: 3104231 - RNA, 17 nt, Mycobacterium bovis subsp bovis AF2122/97
cagcccgcccggugugu

SEQ ID NO: 3104232 - RNA, 13 nt, Mycobacterium bovis subsp bovis AF2122/97
cagcccgccgcug

SEQ ID NO: 3104233 - RNA, 16 nt, Mycobacterium bovis subsp bovis AF2122/97
cagcccgccgcugaac

SEQ ID NO: 3104234 - RNA, 15 nt, Mycobacterium bovis subsp bovis AF2122/97
cagcccgccggaccc

SEQ ID NO: 3104235 - RNA, 19 nt, Mycobacterium bovis subsp bovis AF2122/97
cagcccgccggacccgccc

SEQ ID NO: 3104236 - RNA, 13 nt, Mycobacterium bovis subsp bovis AF2122/97
cagcccgccggcg

SEQ ID NO: 3104237 - RNA, 13 nt, Mycobacterium bovis subsp bovis AF2122/97
cagcccgccgggc

SEQ ID NO: 3104238 - RNA, 17 nt, Mycobacterium bovis subsp bovis AF2122/97
cagcccgcgcagcgguc

SEQ ID NO: 3104239 - RNA, 14 nt, Mycobacterium bovis subsp bovis AF2122/97
cagcccgcuggccg

SEQ ID NO: 3104240 - RNA, 15 nt, Mycobacterium bovis subsp bovis AF2122/97
cagcccggaacccga

SEQ ID NO: 3104241 - RNA, 14 nt, Mycobacterium bovis subsp bovis AF2122/97
cagcccggacgcgc

SEQ ID NO: 3104242 - RNA, 17 nt, Mycobacterium bovis subsp bovis AF2122/97
cagcccggcacugaccg

SEQ ID NO: 3104243 - RNA, 21 nt, Mycobacterium bovis subsp bovis AF2122/97
cagcccggcacugaccgcgau

SEQ ID NO: 3104244 - RNA, 22 nt, Mycobacterium bovis subsp bovis AF2122/97
cagcccggcacugaccgcgaug

SEQ ID NO: 3104245 - RNA, 14 nt, Mycobacterium bovis subsp bovis AF2122/97
cagcccggccagcc

SEQ ID NO: 3104246 - RNA, 19 nt, Mycobacterium bovis subsp bovis AF2122/97
cagcccggccagccgcacg

SEQ ID NO: 3104247 - RNA, 20 nt, Mycobacterium bovis subsp bovis AF2122/97
cagcccggccagccgcacgg

SEQ ID NO: 3104248 - RNA, 15 nt, Mycobacterium bovis subsp bovis AF2122/97
cagcccggccgccga

SEQ ID NO: 3104249 - RNA, 16 nt, Mycobacterium bovis subsp bovis AF2122/97
cagcccggccgccgag

SEQ ID NO: 3104250 - RNA, 16 nt, Mycobacterium bovis subsp bovis AF2122/97
cagcccggccggucga

SEQ ID NO: 3104251 - RNA, 13 nt, Mycobacterium bovis subsp bovis AF2122/97
cagcccggccuug

SEQ ID NO: 3104252 - RNA, 18 nt, Mycobacterium bovis subsp bovis AF2122/97
cagcccggccuugccgcc

SEQ ID NO: 3104253 - RNA, 21 nt, Mycobacterium bovis subsp bovis AF2122/97
cagcccggccuugccgccggc

SEQ ID NO: 3104254 - RNA, 23 nt, Mycobacterium bovis subsp bovis AF2122/97
cagcccggccuugccgccggcgc

SEQ ID NO: 3104255 - RNA, 12 nt, Mycobacterium bovis subsp bovis AF2122/97
cagcccggcgaa

SEQ ID NO: 3104256 - RNA, 17 nt, Mycobacterium bovis subsp bovis AF2122/97
cagcccggcgacgaccc

SEQ ID NO: 3104257 - RNA, 21 nt, Mycobacterium bovis subsp bovis AF2122/97
cagcccggcgacgacccgggu

SEQ ID NO: 3104258 - RNA, 15 nt, Mycobacterium bovis subsp bovis AF2122/97
cagcccggcgcgccg

SEQ ID NO: 3104259 - RNA, 16 nt, Mycobacterium bovis subsp bovis AF2122/97
cagcccggcgcgccga

SEQ ID NO: 3104260 - RNA, 17 nt, Mycobacterium bovis subsp bovis AF2122/97
cagcccggcgcgccgag

SEQ ID NO: 3104261 - RNA, 12 nt, Mycobacterium bovis subsp bovis AF2122/97
cagcccggcgcu

SEQ ID NO: 3104262 - RNA, 15 nt, Mycobacterium bovis subsp bovis AF2122/97
cagcccggcggccgc

SEQ ID NO: 3104263 - RNA, 16 nt, Mycobacterium bovis subsp bovis AF2122/97
cagcccggcggccgcu

SEQ ID NO: 3104264 - RNA, 14 nt, Mycobacterium bovis subsp bovis AF2122/97
cagcccggcggcgg

SEQ ID NO: 3104265 - RNA, 13 nt, Mycobacterium bovis subsp bovis AF2122/97
cagcccggcguug

SEQ ID NO: 3104266 - RNA, 15 nt, Mycobacterium bovis subsp bovis AF2122/97
cagcccggcguuguu

SEQ ID NO: 3104267 - RNA, 13 nt, Mycobacterium bovis subsp bovis AF2122/97
cagcccgggcagc

SEQ ID NO: 3104268 - RNA, 17 nt, Mycobacterium bovis subsp bovis AF2122/97
cagcccgggcagcacca

SEQ ID NO: 3104269 - RNA, 16 nt, Mycobacterium bovis subsp bovis AF2122/97
cagcccgggcagcccc

SEQ ID NO: 3104270 - RNA, 17 nt, Mycobacterium bovis subsp bovis AF2122/97
cagcccgggcagccccu

SEQ ID NO: 3104271 - RNA, 18 nt, Mycobacterium bovis subsp bovis AF2122/97
cagcccgggcagccccuc

SEQ ID NO: 3104272 - RNA, 20 nt, Mycobacterium bovis subsp bovis AF2122/97
cagcccgggcagccccuccg

SEQ ID NO: 3104273 - RNA, 18 nt, Mycobacterium bovis subsp bovis AF2122/97
cagcccggucauggucag

SEQ ID NO: 3104274 - RNA, 15 nt, Mycobacterium bovis subsp bovis AF2122/97
cagcccggugauggu

SEQ ID NO: 3104275 - RNA, 17 nt, Mycobacterium bovis subsp bovis AF2122/97
cagcccguagcacaccg

SEQ ID NO: 3104276 - RNA, 16 nt, Mycobacterium bovis subsp bovis AF2122/97
cagcccguccaggcgc

SEQ ID NO: 3104277 - RNA, 23 nt, Mycobacterium bovis subsp bovis AF2122/97
cagcccguccaggcgcugcagca

SEQ ID NO: 3104278 - RNA, 13 nt, Mycobacterium bovis subsp bovis AF2122/97
cagcccguccggc

SEQ ID NO: 3104279 - RNA, 16 nt, Mycobacterium bovis subsp bovis AF2122/97
cagcccguccggcccc

SEQ ID NO: 3104280 - RNA, 14 nt, Mycobacterium bovis subsp bovis AF2122/97
cagcccgucggcgc

SEQ ID NO: 3104281 - RNA, 14 nt, Mycobacterium bovis subsp bovis AF2122/97
cagccgcggggcga

SEQ ID NO: 3104282 - RNA, 13 nt, Mycobacterium bovis subsp bovis AF2122/97
cagccgcuccacg

SEQ ID NO: 3104283 - RNA, 22 nt, Mycobacterium bovis subsp bovis AF2122/97
cagccgcuccacguacgcggcu

SEQ ID NO: 3104284 - RNA, 18 nt, Mycobacterium bovis subsp bovis AF2122/97
cagccgcucgcacagccg

SEQ ID NO: 3104285 - RNA, 16 nt, Mycobacterium bovis subsp bovis AF2122/97
cagccgcucggggugg

SEQ ID NO: 3104286 - RNA, 22 nt, Mycobacterium bovis subsp bovis AF2122/97
cagccgcugaucugccgccgcg

SEQ ID NO: 3104287 - RNA, 16 nt, Mycobacterium bovis subsp bovis AF2122/97
cagccgcugcguagug

SEQ ID NO: 3104288 - RNA, 17 nt, Mycobacterium bovis subsp bovis AF2122/97
cagccgcuuggcgcggc

SEQ ID NO: 3104289 - RNA, 15 nt, Mycobacterium bovis subsp bovis AF2122/97
cagccggaccgcgac

SEQ ID NO: 3104290 - RNA, 20 nt, Mycobacterium bovis subsp bovis AF2122/97
cagccggaccgcgacggcgc

SEQ ID NO: 3104291 - RNA, 15 nt, Mycobacterium bovis subsp bovis AF2122/97
cagccggcagcagcg

SEQ ID NO: 3104292 - RNA, 15 nt, Mycobacterium bovis subsp bovis AF2122/97
cagccggcagcgaga

SEQ ID NO: 3104293 - RNA, 19 nt, Mycobacterium bovis subsp bovis AF2122/97
cagccggcauagcggccca

SEQ ID NO: 3104294 - RNA, 13 nt, Mycobacterium bovis subsp bovis AF2122/97
cagccggcccguc

SEQ ID NO: 3104295 - RNA, 18 nt, Mycobacterium bovis subsp bovis AF2122/97
cagccggcccugcggcca

SEQ ID NO: 3104296 - RNA, 20 nt, Mycobacterium bovis subsp bovis AF2122/97
cagccggcccugcggccaau

SEQ ID NO: 3104297 - RNA, 12 nt, Mycobacterium bovis subsp bovis AF2122/97
cagccggccgcg

SEQ ID NO: 3104298 - RNA, 15 nt, Mycobacterium bovis subsp bovis AF2122/97
cagccggccgcgacc

SEQ ID NO: 3104299 - RNA, 16 nt, Mycobacterium bovis subsp bovis AF2122/97
cagccggccgcgaccg

SEQ ID NO: 3104300 - RNA, 18 nt, Mycobacterium bovis subsp bovis AF2122/97
cagccggccgcgaccgcg

SEQ ID NO: 3104301 - RNA, 16 nt, Mycobacterium bovis subsp bovis AF2122/97
cagccggccugucccg

SEQ ID NO: 3104302 - RNA, 23 nt, Mycobacterium bovis subsp bovis AF2122/97
cagccggcgaaugcgguccucga

SEQ ID NO: 3104303 - RNA, 14 nt, Mycobacterium bovis subsp bovis AF2122/97
cagccggcuugggc

SEQ ID NO: 3104304 - RNA, 16 nt, Mycobacterium bovis subsp bovis AF2122/97
cagccggcuugggcgg

SEQ ID NO: 3104305 - RNA, 21 nt, Mycobacterium bovis subsp bovis AF2122/97
cagccgggagucgucggcaug

SEQ ID NO: 3104306 - RNA, 18 nt, Mycobacterium bovis subsp bovis AF2122/97
cagccgggcaccacccuu

SEQ ID NO: 3104307 - RNA, 14 nt, Mycobacterium bovis subsp bovis AF2122/97
cagccgggcacccu

SEQ ID NO: 3104308 - RNA, 17 nt, Mycobacterium bovis subsp bovis AF2122/97
cagccgggcacccuugc

SEQ ID NO: 3104309 - RNA, 19 nt, Mycobacterium bovis subsp bovis AF2122/97
cagccgggccaaccggucg

SEQ ID NO: 3104310 - RNA, 14 nt, Mycobacterium bovis subsp bovis AF2122/97
cagccgggcgucgc

SEQ ID NO: 3104311 - RNA, 20 nt, Mycobacterium bovis subsp bovis AF2122/97
cagccgggcgucgcuggugg

SEQ ID NO: 3104312 - RNA, 20 nt, Mycobacterium bovis subsp bovis AF2122/97
cagccgggugccacaacccg

SEQ ID NO: 3104313 - RNA, 19 nt, Mycobacterium bovis subsp bovis AF2122/97
cagccgggugccggcauag

SEQ ID NO: 3104314 - RNA, 20 nt, Mycobacterium bovis subsp bovis AF2122/97
cagccgggugccggcauaga

SEQ ID NO: 3104315 - RNA, 18 nt, Mycobacterium bovis subsp bovis AF2122/97
cagccgggugcgcacccg

SEQ ID NO: 3104316 - RNA, 15 nt, Mycobacterium bovis subsp bovis AF2122/97
cagccggguggacac

SEQ ID NO: 3104317 - RNA, 17 nt, Mycobacterium bovis subsp bovis AF2122/97
cagccgguagccgggca

SEQ ID NO: 3104318 - RNA, 14 nt, Mycobacterium bovis subsp bovis AF2122/97
cagccgguccagac

SEQ ID NO: 3104319 - RNA, 15 nt, Mycobacterium bovis subsp bovis AF2122/97
cagccgguccagacc

SEQ ID NO: 3104320 - RNA, 18 nt, Mycobacterium bovis subsp bovis AF2122/97
cagccgguccagacccag

SEQ ID NO: 3104321 - RNA, 17 nt, Mycobacterium bovis subsp bovis AF2122/97
cagccgguccagcagcu

SEQ ID NO: 3104322 - RNA, 19 nt, Mycobacterium bovis subsp bovis AF2122/97
cagccggucgaugccgaug

SEQ ID NO: 3104323 - RNA, 14 nt, Mycobacterium bovis subsp bovis AF2122/97
cagccggucgucgc

SEQ ID NO: 3104324 - RNA, 17 nt, Mycobacterium bovis subsp bovis AF2122/97
cagccggucgucgcgca

SEQ ID NO: 3104325 - RNA, 22 nt, Mycobacterium bovis subsp bovis AF2122/97
cagccggucuuggacagcagca

SEQ ID NO: 3104326 - RNA, 15 nt, Mycobacterium bovis subsp bovis AF2122/97
cagccggugccgccg

SEQ ID NO: 3104327 - RNA, 19 nt, Mycobacterium bovis subsp bovis AF2122/97
cagccgguuggcugccggc

SEQ ID NO: 3104328 - RNA, 15 nt, Mycobacterium bovis subsp bovis AF2122/97
cagccguacgccgua

SEQ ID NO: 3104329 - RNA, 21 nt, Mycobacterium bovis subsp bovis AF2122/97
cagccguagcugggcaccccg

SEQ ID NO: 3104330 - RNA, 23 nt, Mycobacterium bovis subsp bovis AF2122/97
cagccguagcugggcaccccguu

SEQ ID NO: 3104331 - RNA, 15 nt, Mycobacterium bovis subsp bovis AF2122/97
cagccgucaccgcga

SEQ ID NO: 3104332 - RNA, 16 nt, Mycobacterium bovis subsp bovis AF2122/97
cagccguccgggcggc

SEQ ID NO: 3104333 - RNA, 20 nt, Mycobacterium bovis subsp bovis AF2122/97
cagccguccgggcggccucc

SEQ ID NO: 3104334 - RNA, 20 nt, Mycobacterium bovis subsp bovis AF2122/97
cagccgucggcgcugcgcgc

SEQ ID NO: 3104335 - RNA, 18 nt, Mycobacterium bovis subsp bovis AF2122/97
cagccgucgucagguggc

SEQ ID NO: 3104336 - RNA, 21 nt, Mycobacterium bovis subsp bovis AF2122/97
cagccgucguccgcugacccg

SEQ ID NO: 3104337 - RNA, 24 nt, Mycobacterium bovis subsp bovis AF2122/97
cagccgucguccgcugacccgcca

SEQ ID NO: 3104338 - RNA, 14 nt, Mycobacterium bovis subsp bovis AF2122/97
cagccgugcccagg

SEQ ID NO: 3104339 - RNA, 17 nt, Mycobacterium bovis subsp bovis AF2122/97
cagccgugcccaggcca

SEQ ID NO: 3104340 - RNA, 13 nt, Mycobacterium bovis subsp bovis AF2122/97
cagccgugccggu

SEQ ID NO: 3104341 - RNA, 21 nt, Mycobacterium bovis subsp bovis AF2122/97
cagccgugccgguuuggccga

SEQ ID NO: 3104342 - RNA, 12 nt, Mycobacterium bovis subsp bovis AF2122/97
cagccgugccgu

SEQ ID NO: 3104343 - RNA, 16 nt, Mycobacterium bovis subsp bovis AF2122/97
cagccgugcgggccgg

SEQ ID NO: 3104344 - RNA, 19 nt, Mycobacterium bovis subsp bovis AF2122/97
cagccgugcgggccggucg

SEQ ID NO: 3104345 - RNA, 20 nt, Mycobacterium bovis subsp bovis AF2122/97
cagccgugcgggccggucgu

SEQ ID NO: 3104346 - RNA, 23 nt, Mycobacterium bovis subsp bovis AF2122/97
cagccgugcgggccggucgugcc

SEQ ID NO: 3104347 - RNA, 21 nt, Mycobacterium bovis subsp bovis AF2122/97
cagccgugcuuguugcgcgac

SEQ ID NO: 3104348 - RNA, 22 nt, Mycobacterium bovis subsp bovis AF2122/97
cagccgugcuuguugcgcgacg

SEQ ID NO: 3104349 - RNA, 19 nt, Mycobacterium bovis subsp bovis AF2122/97
cagccguggcagucgcacg

SEQ ID NO: 3104350 - RNA, 16 nt, Mycobacterium bovis subsp bovis AF2122/97
cagccguggcgcgacg

SEQ ID NO: 3104351 - RNA, 17 nt, Mycobacterium bovis subsp bovis AF2122/97
cagccguggcgcgacgu

SEQ ID NO: 3104352 - RNA, 13 nt, Mycobacterium bovis subsp bovis AF2122/97
cagccguggcggc

SEQ ID NO: 3104353 - RNA, 16 nt, Mycobacterium bovis subsp bovis AF2122/97
cagccguggcggcggg

SEQ ID NO: 3104354 - RNA, 17 nt, Mycobacterium bovis subsp bovis AF2122/97
cagccguggcggcgggc

SEQ ID NO: 3104355 - RNA, 15 nt, Mycobacterium bovis subsp bovis AF2122/97
cagccguucgcagcu

SEQ ID NO: 3104356 - RNA, 13 nt, Mycobacterium bovis subsp bovis AF2122/97
cagccguucucgc

SEQ ID NO: 3104357 - RNA, 19 nt, Mycobacterium bovis subsp bovis AF2122/97
cagccguucucgcccaccc

SEQ ID NO: 3104358 - RNA, 18 nt, Mycobacterium bovis subsp bovis AF2122/97
cagccuaccggcuacggc

SEQ ID NO: 3104359 - RNA, 18 nt, Mycobacterium bovis subsp bovis AF2122/97
cagccucauuuauggaca

SEQ ID NO: 3104360 - RNA, 13 nt, Mycobacterium bovis subsp bovis AF2122/97
cagccuccaccag

SEQ ID NO: 3104361 - RNA, 14 nt, Mycobacterium bovis subsp bovis AF2122/97
cagccucgcgggca

SEQ ID NO: 3104362 - RNA, 17 nt, Mycobacterium bovis subsp bovis AF2122/97
cagccucgcgggcaggg

SEQ ID NO: 3104363 - RNA, 21 nt, Mycobacterium bovis subsp bovis AF2122/97
cagccucucgcuuagcgucgc

SEQ ID NO: 3104364 - RNA, 20 nt, Mycobacterium bovis subsp bovis AF2122/97
cagccugcaacgucuugcug

SEQ ID NO: 3104365 - RNA, 22 nt, Mycobacterium bovis subsp bovis AF2122/97
cagccugcagcgaaacaccggc

SEQ ID NO: 3104366 - RNA, 23 nt, Mycobacterium bovis subsp bovis AF2122/97
cagccugcagcgaaacaccggcc

SEQ ID NO: 3104367 - RNA, 15 nt, Mycobacterium bovis subsp bovis AF2122/97
cagcgagcccagcug

SEQ ID NO: 3104368 - RNA, 19 nt, Mycobacterium bovis subsp bovis AF2122/97
cagcgagcgguugaucgcg

SEQ ID NO: 3104369 - RNA, 14 nt, Mycobacterium bovis subsp bovis AF2122/97
cagcgaggccaugu

SEQ ID NO: 3104370 - RNA, 21 nt, Mycobacterium bovis subsp bovis AF2122/97
cagcgaggugggcgucaucga

SEQ ID NO: 3104371 - RNA, 16 nt, Mycobacterium bovis subsp bovis AF2122/97
cagcgaguaccaggac

SEQ ID NO: 3104372 - RNA, 22 nt, Mycobacterium bovis subsp bovis AF2122/97
cagcgaguccucgagugccgcc

SEQ ID NO: 3104373 - RNA, 23 nt, Mycobacterium bovis subsp bovis AF2122/97
cagcgaguccucgagugccgccg

SEQ ID NO: 3104374 - RNA, 15 nt, Mycobacterium bovis subsp bovis AF2122/97
cagcgagucgacguc

SEQ ID NO: 3104375 - RNA, 17 nt, Mycobacterium bovis subsp bovis AF2122/97
cagcgagucgacgucga

SEQ ID NO: 3104376 - RNA, 23 nt, Mycobacterium bovis subsp bovis AF2122/97
cagcgagucgggguacaggcugc

SEQ ID NO: 3104377 - RNA, 22 nt, Mycobacterium bovis subsp bovis AF2122/97
cagcgaguucuggaauccggcc

SEQ ID NO: 3104378 - RNA, 15 nt, Mycobacterium bovis subsp bovis AF2122/97
cagcgauauccacaa

SEQ ID NO: 3104379 - RNA, 17 nt, Mycobacterium bovis subsp bovis AF2122/97
cagcgauauccacaauc

SEQ ID NO: 3104380 - RNA, 19 nt, Mycobacterium bovis subsp bovis AF2122/97
cagcgauauccacaauccg

SEQ ID NO: 3104381 - RNA, 14 nt, Mycobacterium bovis subsp bovis AF2122/97
cagcgauaucggcg

SEQ ID NO: 3104382 - RNA, 23 nt, Mycobacterium bovis subsp bovis AF2122/97
cagcgauauugagggugagccga

SEQ ID NO: 3104383 - RNA, 13 nt, Mycobacterium bovis subsp bovis AF2122/97
cagcgaugacgac

SEQ ID NO: 3104384 - RNA, 14 nt, Mycobacterium bovis subsp bovis AF2122/97
cagcgaugacgacc

SEQ ID NO: 3104385 - RNA, 18 nt, Mycobacterium bovis subsp bovis AF2122/97
cagcgaugcgcucacugc

SEQ ID NO: 3104386 - RNA, 18 nt, Mycobacterium bovis subsp bovis AF2122/97
cagcgaugcggcccucga

SEQ ID NO: 3104387 - RNA, 15 nt, Mycobacterium bovis subsp bovis AF2122/97
cagcgaugcggcguu

SEQ ID NO: 3104388 - RNA, 22 nt, Mycobacterium bovis subsp bovis AF2122/97
cagcgaugcggugucgggcugg

SEQ ID NO: 3104389 - RNA, 19 nt, Mycobacterium bovis subsp bovis AF2122/97
cagcgauggguguugcugg

SEQ ID NO: 3104390 - RNA, 21 nt, Mycobacterium bovis subsp bovis AF2122/97
cagcgauggguguugcuggcc

SEQ ID NO: 3104391 - RNA, 18 nt, Mycobacterium bovis subsp bovis AF2122/97
cagcgaugugaaccgggc

SEQ ID NO: 3104392 - RNA, 20 nt, Mycobacterium bovis subsp bovis AF2122/97
cagcgcaaagcccuccucga

SEQ ID NO: 3104393 - RNA, 21 nt, Mycobacterium bovis subsp bovis AF2122/97
cagcgcaacaucgaaaaccga

SEQ ID NO: 3104394 - RNA, 16 nt, Mycobacterium bovis subsp bovis AF2122/97
cagcgcaacggccagc

SEQ ID NO: 3104395 - RNA, 22 nt, Mycobacterium bovis subsp bovis AF2122/97
cagcgcaacggccagcgcugcu

SEQ ID NO: 3104396 - RNA, 20 nt, Mycobacterium bovis subsp bovis AF2122/97
cagcgcaagguugccaacgc

SEQ ID NO: 3104397 - RNA, 22 nt, Mycobacterium bovis subsp bovis AF2122/97
cagcgcaccaacucucgcggga

SEQ ID NO: 3104398 - RNA, 12 nt, Mycobacterium bovis subsp bovis AF2122/97
cagcgcacccgg

SEQ ID NO: 3104399 - RNA, 14 nt, Mycobacterium bovis subsp bovis AF2122/97
cagcgcaccgccga

SEQ ID NO: 3104400 - RNA, 21 nt, Mycobacterium bovis subsp bovis AF2122/97
cagcgcaccggugauggugac

SEQ ID NO: 3104401 - RNA, 20 nt, Mycobacterium bovis subsp bovis AF2122/97
cagcgcacgauagccaccga

SEQ ID NO: 3104402 - RNA, 15 nt, Mycobacterium bovis subsp bovis AF2122/97
cagcgcacgauuucg

SEQ ID NO: 3104403 - RNA, 21 nt, Mycobacterium bovis subsp bovis AF2122/97
cagcgcacgauuucgagcgcu

SEQ ID NO: 3104404 - RNA, 19 nt, Mycobacterium bovis subsp bovis AF2122/97
cagcgcacggaccaucgcc

SEQ ID NO: 3104405 - RNA, 23 nt, Mycobacterium bovis subsp bovis AF2122/97
cagcgcacggaccaucgccaggc

SEQ ID NO: 3104406 - RNA, 15 nt, Mycobacterium bovis subsp bovis AF2122/97
cagcgcacuacucga

SEQ ID NO: 3104407 - RNA, 14 nt, Mycobacterium bovis subsp bovis AF2122/97
cagcgcacugcccg

SEQ ID NO: 3104408 - RNA, 18 nt, Mycobacterium bovis subsp bovis AF2122/97
cagcgcagcaacugggcg

SEQ ID NO: 3104409 - RNA, 20 nt, Mycobacterium bovis subsp bovis AF2122/97
cagcgcagcaacugggcggc

SEQ ID NO: 3104410 - RNA, 11 nt, Mycobacterium bovis subsp bovis AF2122/97
cagcgcagcag

SEQ ID NO: 3104411 - RNA, 13 nt, Mycobacterium bovis subsp bovis AF2122/97
cagcgcagcagcg

SEQ ID NO: 3104412 - RNA, 15 nt, Mycobacterium bovis subsp bovis AF2122/97
cagcgcagcagcggc

SEQ ID NO: 3104413 - RNA, 18 nt, Mycobacterium bovis subsp bovis AF2122/97
cagcgcagcagcggcauc

SEQ ID NO: 3104414 - RNA, 17 nt, Mycobacterium bovis subsp bovis AF2122/97
cagcgcagccaggcugc

SEQ ID NO: 3104415 - RNA, 21 nt, Mycobacterium bovis subsp bovis AF2122/97
cagcgcagccgaucgucucgg

SEQ ID NO: 3104416 - RNA, 16 nt, Mycobacterium bovis subsp bovis AF2122/97
cagcgcagccugcagc

SEQ ID NO: 3104417 - RNA, 20 nt, Mycobacterium bovis subsp bovis AF2122/97
cagcgcaggauucugcugac

SEQ ID NO: 3104418 - RNA, 17 nt, Mycobacterium bovis subsp bovis AF2122/97
cagcgcagugccuccga

SEQ ID NO: 3104419 - RNA, 13 nt, Mycobacterium bovis subsp bovis AF2122/97
cagcgcaucgccg

SEQ ID NO: 3104420 - RNA, 16 nt, Mycobacterium bovis subsp bovis AF2122/97
cagcgcaucgccgcug

SEQ ID NO: 3104421 - RNA, 17 nt, Mycobacterium bovis subsp bovis AF2122/97
cagcgcaucgccgcugg

SEQ ID NO: 3104422 - RNA, 15 nt, Mycobacterium bovis subsp bovis AF2122/97
cagcgcaucggccag

SEQ ID NO: 3104423 - RNA, 21 nt, Mycobacterium bovis subsp bovis AF2122/97
cagcgcaucuuugaacgccau

SEQ ID NO: 3104424 - RNA, 20 nt, Mycobacterium bovis subsp bovis AF2122/97
cagcgcauuucggaucucga

SEQ ID NO: 3104425 - RNA, 19 nt, Mycobacterium bovis subsp bovis AF2122/97
cagcgcauuuuccacaucc

SEQ ID NO: 3104426 - RNA, 22 nt, Mycobacterium bovis subsp bovis AF2122/97
cagcgccaacucgagaguggcc

SEQ ID NO: 3104427 - RNA, 17 nt, Mycobacterium bovis subsp bovis AF2122/97
cagcgccaagacgucgg

SEQ ID NO: 3104428 - RNA, 18 nt, Mycobacterium bovis subsp bovis AF2122/97
cagcgccaagacgucggc

SEQ ID NO: 3104429 - RNA, 21 nt, Mycobacterium bovis subsp bovis AF2122/97
cagcgccaagacgucggcgug

SEQ ID NO: 3104430 - RNA, 13 nt, Mycobacterium bovis subsp bovis AF2122/97
cagcgccaauguc

SEQ ID NO: 3104431 - RNA, 20 nt, Mycobacterium bovis subsp bovis AF2122/97
cagcgccacauacaccggcc

SEQ ID NO: 3104432 - RNA, 12 nt, Mycobacterium bovis subsp bovis AF2122/97
cagcgccacccg

SEQ ID NO: 3104433 - RNA, 21 nt, Mycobacterium bovis subsp bovis AF2122/97
cagcgccacccgaucgggcgu

SEQ ID NO: 3104434 - RNA, 20 nt, Mycobacterium bovis subsp bovis AF2122/97
cagcgccacccgguccggcc

SEQ ID NO: 3104435 - RNA, 22 nt, Mycobacterium bovis subsp bovis AF2122/97
cagcgccacccgguccggcccg

SEQ ID NO: 3104436 - RNA, 12 nt, Mycobacterium bovis subsp bovis AF2122/97
cagcgccaccgu

SEQ ID NO: 3104437 - RNA, 20 nt, Mycobacterium bovis subsp bovis AF2122/97
cagcgccaccguuaccgccg

SEQ ID NO: 3104438 - RNA, 14 nt, Mycobacterium bovis subsp bovis AF2122/97
cagcgccagcagcu

SEQ ID NO: 3104439 - RNA, 12 nt, Mycobacterium bovis subsp bovis AF2122/97
cagcgccagcgg

SEQ ID NO: 3104440 - RNA, 13 nt, Mycobacterium bovis subsp bovis AF2122/97
cagcgccaggccg

SEQ ID NO: 3104441 - RNA, 14 nt, Mycobacterium bovis subsp bovis AF2122/97
cagcgccaggccgu

SEQ ID NO: 3104442 - RNA, 19 nt, Mycobacterium bovis subsp bovis AF2122/97
cagcgccagugccucgcgg

SEQ ID NO: 3104443 - RNA, 22 nt, Mycobacterium bovis subsp bovis AF2122/97
cagcgccagugccucgcggggu

SEQ ID NO: 3104444 - RNA, 23 nt, Mycobacterium bovis subsp bovis AF2122/97
cagcgccauauugauuccgaccc

SEQ ID NO: 3104445 - RNA, 18 nt, Mycobacterium bovis subsp bovis AF2122/97
cagcgccaucgaugcggu

SEQ ID NO: 3104446 - RNA, 15 nt, Mycobacterium bovis subsp bovis AF2122/97
cagcgccaugcuguc

SEQ ID NO: 3104447 - RNA, 22 nt, Mycobacterium bovis subsp bovis AF2122/97
cagcgccauuccaagacguugc

SEQ ID NO: 3104448 - RNA, 17 nt, Mycobacterium bovis subsp bovis AF2122/97
cagcgcccagaucgccg

SEQ ID NO: 3104449 - RNA, 21 nt, Mycobacterium bovis subsp bovis AF2122/97
cagcgcccagaucgccgagau

SEQ ID NO: 3104450 - RNA, 21 nt, Mycobacterium bovis subsp bovis AF2122/97
cagcgccccaugcaacacacc

SEQ ID NO: 3104451 - RNA, 12 nt, Mycobacterium bovis subsp bovis AF2122/97
cagcgcccccag

SEQ ID NO: 3104452 - RNA, 21 nt, Mycobacterium bovis subsp bovis AF2122/97
cagcgcccccagcagcugcga

SEQ ID NO: 3104453 - RNA, 22 nt, Mycobacterium bovis subsp bovis AF2122/97
cagcgcgaggcucguggcgacg

SEQ ID NO: 3104454 - RNA, 23 nt, Mycobacterium bovis subsp bovis AF2122/97
cagcgcgaggcucguggcgacgg

SEQ ID NO: 3104455 - RNA, 16 nt, Mycobacterium bovis subsp bovis AF2122/97
cagcgcgaucaacgcg

SEQ ID NO: 3104456 - RNA, 23 nt, Mycobacterium bovis subsp bovis AF2122/97
cagcgcgaucaccgagucgacgg

SEQ ID NO: 3104457 - RNA, 13 nt, Mycobacterium bovis subsp bovis AF2122/97
cagcgcgaucgau

SEQ ID NO: 3104458 - RNA, 18 nt, Mycobacterium bovis subsp bovis AF2122/97
cagcgcgaugucgccggc

SEQ ID NO: 3104459 - RNA, 19 nt, Mycobacterium bovis subsp bovis AF2122/97
cagcgcgcaaagacaccga

SEQ ID NO: 3104460 - RNA, 13 nt, Mycobacterium bovis subsp bovis AF2122/97
cagcgcgccaccc

SEQ ID NO: 3104461 - RNA, 15 nt, Mycobacterium bovis subsp bovis AF2122/97
cagcgcgccacccag

SEQ ID NO: 3104462 - RNA, 16 nt, Mycobacterium bovis subsp bovis AF2122/97
cagcgcgccacccagc

SEQ ID NO: 3104463 - RNA, 17 nt, Mycobacterium bovis subsp bovis AF2122/97
cagcgcgccacccagca

SEQ ID NO: 3104464 - RNA, 19 nt, Mycobacterium bovis subsp bovis AF2122/97
cagcgcgccagcuugucgg

SEQ ID NO: 3104465 - RNA, 15 nt, Mycobacterium bovis subsp bovis AF2122/97
cagcgcgcccgacac

SEQ ID NO: 3104466 - RNA, 19 nt, Mycobacterium bovis subsp bovis AF2122/97
cagcgcgcccgacacccgu

SEQ ID NO: 3104467 - RNA, 12 nt, Mycobacterium bovis subsp bovis AF2122/97
cagcgcgccgcg

SEQ ID NO: 3104468 - RNA, 13 nt, Mycobacterium bovis subsp bovis AF2122/97
cagcgcgccgcgu

SEQ ID NO: 3104469 - RNA, 14 nt, Mycobacterium bovis subsp bovis AF2122/97
cagcgcgccgcguu

SEQ ID NO: 3104470 - RNA, 12 nt, Mycobacterium bovis subsp bovis AF2122/97
cagcgcgccggc

SEQ ID NO: 3104471 - RNA, 14 nt, Mycobacterium bovis subsp bovis AF2122/97
cagcgcgccgucgg

SEQ ID NO: 3104472 - RNA, 14 nt, Mycobacterium bovis subsp bovis AF2122/97
cagcgcgcgccgag

SEQ ID NO: 3104473 - RNA, 14 nt, Mycobacterium bovis subsp bovis AF2122/97
cagcgcgcgccgca

SEQ ID NO: 3104474 - RNA, 14 nt, Mycobacterium bovis subsp bovis AF2122/97
cagcgcgcgccgcu

SEQ ID NO: 3104475 - RNA, 16 nt, Mycobacterium bovis subsp bovis AF2122/97
cagcgcgcgccgcugg

SEQ ID NO: 3104476 - RNA, 20 nt, Mycobacterium bovis subsp bovis AF2122/97
cagcgcgcgccgcuggguga

SEQ ID NO: 3104477 - RNA, 14 nt, Mycobacterium bovis subsp bovis AF2122/97
cagcgcgcgcgggu

SEQ ID NO: 3104478 - RNA, 13 nt, Mycobacterium bovis subsp bovis AF2122/97
cagcgcgcggguu

SEQ ID NO: 3104479 - RNA, 18 nt, Mycobacterium bovis subsp bovis AF2122/97
cagcgcgcugggaagcuc

SEQ ID NO: 3104480 - RNA, 22 nt, Mycobacterium bovis subsp bovis AF2122/97
cagcgcggcaaaguuggccgcc

SEQ ID NO: 3104481 - RNA, 19 nt, Mycobacterium bovis subsp bovis AF2122/97
cagcgcggcaacuccgguc

SEQ ID NO: 3104482 - RNA, 19 nt, Mycobacterium bovis subsp bovis AF2122/97
cagcgcggcacccaaccag

SEQ ID NO: 3104483 - RNA, 12 nt, Mycobacterium bovis subsp bovis AF2122/97
cagcgcggcacg

SEQ ID NO: 3104484 - RNA, 23 nt, Mycobacterium bovis subsp bovis AF2122/97
cagcgcggcacggugugcggcau

SEQ ID NO: 3104485 - RNA, 14 nt, Mycobacterium bovis subsp bovis AF2122/97
cagcgcggccaccc

SEQ ID NO: 3104486 - RNA, 15 nt, Mycobacterium bovis subsp bovis AF2122/97
cagcgcggccacccg

SEQ ID NO: 3104487 - RNA, 20 nt, Mycobacterium bovis subsp bovis AF2122/97
cagcgcggccacccgcgacg

SEQ ID NO: 3104488 - RNA, 16 nt, Mycobacterium bovis subsp bovis AF2122/97
cagcgcggccacgccg

SEQ ID NO: 3104489 - RNA, 13 nt, Mycobacterium bovis subsp bovis AF2122/97
cagcgcggccaga

SEQ ID NO: 3104490 - RNA, 16 nt, Mycobacterium bovis subsp bovis AF2122/97
cagcgcggccagugcu

SEQ ID NO: 3104491 - RNA, 23 nt, Mycobacterium bovis subsp bovis AF2122/97
cagcgcggccauuagcagcaccc

SEQ ID NO: 3104492 - RNA, 12 nt, Mycobacterium bovis subsp bovis AF2122/97
cagcgcggcccc

SEQ ID NO: 3104493 - RNA, 13 nt, Mycobacterium bovis subsp bovis AF2122/97
cagcgcggccggg

SEQ ID NO: 3104494 - RNA, 16 nt, Mycobacterium bovis subsp bovis AF2122/97
cagcgcggccgggcgc

SEQ ID NO: 3104495 - RNA, 20 nt, Mycobacterium bovis subsp bovis AF2122/97
cagcgcggccgggcgcccuu

SEQ ID NO: 3104496 - RNA, 22 nt, Mycobacterium bovis subsp bovis AF2122/97
cagcgcggccuuggugggcaga

SEQ ID NO: 3104497 - RNA, 12 nt, Mycobacterium bovis subsp bovis AF2122/97
cagcgcggcgac

SEQ ID NO: 3104498 - RNA, 12 nt, Mycobacterium bovis subsp bovis AF2122/97
cagcgcggcgca

SEQ ID NO: 3104499 - RNA, 14 nt, Mycobacterium bovis subsp bovis AF2122/97
cagcgcggcgcccu

SEQ ID NO: 3104500 - RNA, 15 nt, Mycobacterium bovis subsp bovis AF2122/97
cagcgcggcgcccug

SEQ ID NO: 3104501 - RNA, 20 nt, Mycobacterium bovis subsp bovis AF2122/97
cagcgcggcgcccuggccgc

SEQ ID NO: 3104502 - RNA, 22 nt, Mycobacterium bovis subsp bovis AF2122/97
cagcgcggcgcccuggccgccc

SEQ ID NO: 3104503 - RNA, 12 nt, Mycobacterium bovis subsp bovis AF2122/97
cagcgcggcgcg

SEQ ID NO: 3104504 - RNA, 13 nt, Mycobacterium bovis subsp bovis AF2122/97
cagcgcggcgcga

SEQ ID NO: 3104505 - RNA, 15 nt, Mycobacterium bovis subsp bovis AF2122/97
cagcgcggcgcgaca

SEQ ID NO: 3104506 - RNA, 14 nt, Mycobacterium bovis subsp bovis AF2122/97
cagcgcggcgcgca

SEQ ID NO: 3104507 - RNA, 19 nt, Mycobacterium bovis subsp bovis AF2122/97
cagcgcggcgcgcaggacc

SEQ ID NO: 3104508 - RNA, 14 nt, Mycobacterium bovis subsp bovis AF2122/97
cagcgcggcgcgcg

SEQ ID NO: 3104509 - RNA, 13 nt, Mycobacterium bovis subsp bovis AF2122/97
cagcgcggcggca

SEQ ID NO: 3104510 - RNA, 16 nt, Mycobacterium bovis subsp bovis AF2122/97
cagcgcggcggcaucu

SEQ ID NO: 3104511 - RNA, 16 nt, Mycobacterium bovis subsp bovis AF2122/97
cagcgcggcuggggcc

SEQ ID NO: 3104512 - RNA, 19 nt, Mycobacterium bovis subsp bovis AF2122/97
cagcgcgggacacgucgcg

SEQ ID NO: 3104513 - RNA, 14 nt, Mycobacterium bovis subsp bovis AF2122/97
cagcgcgggaucug

SEQ ID NO: 3104514 - RNA, 20 nt, Mycobacterium bovis subsp bovis AF2122/97
cagcgcguacuugguggugg

SEQ ID NO: 3104515 - RNA, 19 nt, Mycobacterium bovis subsp bovis AF2122/97
cagcgcguagccaaugccc

SEQ ID NO: 3104516 - RNA, 17 nt, Mycobacterium bovis subsp bovis AF2122/97
cagcgcguaguccgcau

SEQ ID NO: 3104517 - RNA, 22 nt, Mycobacterium bovis subsp bovis AF2122/97
cagcgcgucggagccgggcagu

SEQ ID NO: 3104518 - RNA, 15 nt, Mycobacterium bovis subsp bovis AF2122/97
cagcgcguuggcgag

SEQ ID NO: 3104519 - RNA, 14 nt, Mycobacterium bovis subsp bovis AF2122/97
cagcgcucaccggc

SEQ ID NO: 3104520 - RNA, 15 nt, Mycobacterium bovis subsp bovis AF2122/97
cagcgcucaccggcg

SEQ ID NO: 3104521 - RNA, 17 nt, Mycobacterium bovis subsp bovis AF2122/97
cagcgcuccagcacccg

SEQ ID NO: 3104522 - RNA, 22 nt, Mycobacterium bovis subsp bovis AF2122/97
cagcgcuccagcacccgcgcga

SEQ ID NO: 3104523 - RNA, 13 nt, Mycobacterium bovis subsp bovis AF2122/97
cagcgcuccagcc

SEQ ID NO: 3104524 - RNA, 15 nt, Mycobacterium bovis subsp bovis AF2122/97
cagcgcuccagccgc

SEQ ID NO: 3104525 - RNA, 18 nt, Mycobacterium bovis subsp bovis AF2122/97
cagcgcuccagccgcgcg

SEQ ID NO: 3104526 - RNA, 19 nt, Mycobacterium bovis subsp bovis AF2122/97
cagcgcucguuccggcggu

SEQ ID NO: 3104527 - RNA, 19 nt, Mycobacterium bovis subsp bovis AF2122/97
cagcgcucucauagcgacg

SEQ ID NO: 3104528 - RNA, 15 nt, Mycobacterium bovis subsp bovis AF2122/97
cagcgcugaccggcu

SEQ ID NO: 3104529 - RNA, 13 nt, Mycobacterium bovis subsp bovis AF2122/97
cagcgcugagccg

SEQ ID NO: 3104530 - RNA, 15 nt, Mycobacterium bovis subsp bovis AF2122/97
cagcgcugagccgcu

SEQ ID NO: 3104531 - RNA, 12 nt, Mycobacterium bovis subsp bovis AF2122/97
cagcgcugccac

SEQ ID NO: 3104532 - RNA, 15 nt, Mycobacterium bovis subsp bovis AF2122/97
cagcgcugccaccgc

SEQ ID NO: 3104533 - RNA, 16 nt, Mycobacterium bovis subsp bovis AF2122/97
cagcgcugccaccgcg

SEQ ID NO: 3104534 - RNA, 13 nt, Mycobacterium bovis subsp bovis AF2122/97
cagcgcugcgaug

SEQ ID NO: 3104535 - RNA, 14 nt, Mycobacterium bovis subsp bovis AF2122/97
cagcgcuggcaggc

SEQ ID NO: 3104536 - RNA, 16 nt, Mycobacterium bovis subsp bovis AF2122/97
cagcgcuggcaggccg

SEQ ID NO: 3104537 - RNA, 18 nt, Mycobacterium bovis subsp bovis AF2122/97
cagcgcuggcaggccggg

SEQ ID NO: 3104538 - RNA, 20 nt, Mycobacterium bovis subsp bovis AF2122/97
cagcgcuggcaggccgggca

SEQ ID NO: 3104539 - RNA, 17 nt, Mycobacterium bovis subsp bovis AF2122/97
cagcgcuggcuacgccu

SEQ ID NO: 3104540 - RNA, 17 nt, Mycobacterium bovis subsp bovis AF2122/97
cagcgcugucguaccgc

SEQ ID NO: 3104541 - RNA, 19 nt, Mycobacterium bovis subsp bovis AF2122/97
uucccaugcgggucugaca

SEQ ID NO: 3104542 - RNA, 18 nt, Mycobacterium bovis subsp bovis AF2122/97
uuccccgcccuugccgcc

SEQ ID NO: 3104543 - RNA, 22 nt, Mycobacterium bovis subsp bovis AF2122/97
uuccccgguagccccgucgacc

SEQ ID NO: 3104544 - RNA, 22 nt, Mycobacterium bovis subsp bovis AF2122/97
uuccccgguagcguucggcgag

SEQ ID NO: 3104545 - RNA, 14 nt, Mycobacterium bovis subsp bovis AF2122/97
uucccgaaacccga

SEQ ID NO: 3104546 - RNA, 13 nt, Mycobacterium bovis subsp bovis AF2122/97
uucccgaaccccg

SEQ ID NO: 3104547 - RNA, 13 nt, Mycobacterium bovis subsp bovis AF2122/97
uucccgacaucgu

SEQ ID NO: 3104548 - RNA, 19 nt, Mycobacterium bovis subsp bovis AF2122/97
uucccgaguugcccucugg

SEQ ID NO: 3104549 - RNA, 22 nt, Mycobacterium bovis subsp bovis AF2122/97
uucccgcaggcucaccgagccg

SEQ ID NO: 3104550 - RNA, 17 nt, Mycobacterium bovis subsp bovis AF2122/97
uucccgccauugccgcc

SEQ ID NO: 3104551 - RNA, 17 nt, Mycobacterium bovis subsp bovis AF2122/97
uucccgcggacagcccg

SEQ ID NO: 3104552 - RNA, 14 nt, Mycobacterium bovis subsp bovis AF2122/97
uucccgcucgcagg

SEQ ID NO: 3104553 - RNA, 18 nt, Mycobacterium bovis subsp bovis AF2122/97
uucccggaagcgccggcc

SEQ ID NO: 3104554 - RNA, 12 nt, Mycobacterium bovis subsp bovis AF2122/97
uucccggcucga

SEQ ID NO: 3104555 - RNA, 15 nt, Mycobacterium bovis subsp bovis AF2122/97
uucccgguagcggcg

SEQ ID NO: 3104556 - RNA, 13 nt, Mycobacterium bovis subsp bovis AF2122/97
uucccggugacca

SEQ ID NO: 3104557 - RNA, 12 nt, Mycobacterium bovis subsp bovis AF2122/97
uucccgucggcg

SEQ ID NO: 3104558 - RNA, 15 nt, Mycobacterium bovis subsp bovis AF2122/97
uucccuacgccgcca

SEQ ID NO: 3104559 - RNA, 23 nt, Mycobacterium bovis subsp bovis AF2122/97
uuccgaaacccgccgcgaugacg

SEQ ID NO: 3104560 - RNA, 23 nt, Mycobacterium bovis subsp bovis AF2122/97
uuccgaacaacaucacugccuug

SEQ ID NO: 3104561 - RNA, 23 nt, Mycobacterium bovis subsp bovis AF2122/97
uuccgaagagugugacggcggcc

SEQ ID NO: 3104562 - RNA, 13 nt, Mycobacterium bovis subsp bovis AF2122/97
uuccgaagcccgg

SEQ ID NO: 3104563 - RNA, 19 nt, Mycobacterium bovis subsp bovis AF2122/97
uuccgacccaacgaccacc

SEQ ID NO: 3104564 - RNA, 16 nt, Mycobacterium bovis subsp bovis AF2122/97
uuccgacgaacccgac

SEQ ID NO: 3104565 - RNA, 18 nt, Mycobacterium bovis subsp bovis AF2122/97
uuccgcaaugaccuggcc

SEQ ID NO: 3104566 - RNA, 17 nt, Mycobacterium bovis subsp bovis AF2122/97
uuccgcacccccgucga

SEQ ID NO: 3104567 - RNA, 14 nt, Mycobacterium bovis subsp bovis AF2122/97
uuccgcagcgccac

SEQ ID NO: 3104568 - RNA, 18 nt, Mycobacterium bovis subsp bovis AF2122/97
uuccgcagcgccacccga

SEQ ID NO: 3104569 - RNA, 22 nt, Mycobacterium bovis subsp bovis AF2122/97
uuccgcagucccgaacaauuca

SEQ ID NO: 3104570 - RNA, 17 nt, Mycobacterium bovis subsp bovis AF2122/97
uuccgcaucggccccca

SEQ ID NO: 3104571 - RNA, 23 nt, Mycobacterium bovis subsp bovis AF2122/97
uuccgccaggccgaccgcgcaca

SEQ ID NO: 3104572 - RNA, 15 nt, Mycobacterium bovis subsp bovis AF2122/97
uuccgcccggugcua

SEQ ID NO: 3104573 - RNA, 19 nt, Mycobacterium bovis subsp bovis AF2122/97
uuccgccgccgccgggucg

SEQ ID NO: 3104574 - RNA, 19 nt, Mycobacterium bovis subsp bovis AF2122/97
uuccgccggccccaccggu

SEQ ID NO: 3104575 - RNA, 19 nt, Mycobacterium bovis subsp bovis AF2122/97
uuccgccuguacggcggcu

SEQ ID NO: 3104576 - RNA, 20 nt, Mycobacterium bovis subsp bovis AF2122/97
uuccgcgaaucaacaggacc

SEQ ID NO: 3104577 - RNA, 18 nt, Mycobacterium bovis subsp bovis AF2122/97
uuccgcgcggcagguugc

SEQ ID NO: 3104578 - RNA, 23 nt, Mycobacterium bovis subsp bovis AF2122/97
uuccgcgugcgauucugcgucug

SEQ ID NO: 3104579 - RNA, 16 nt, Mycobacterium bovis subsp bovis AF2122/97
uuccgcuaccgcacag

SEQ ID NO: 3104580 - RNA, 16 nt, Mycobacterium bovis subsp bovis AF2122/97
uuccgcucgagggaug

SEQ ID NO: 3104581 - RNA, 16 nt, Mycobacterium bovis subsp bovis AF2122/97
uuccgcugcggugccg

SEQ ID NO: 3104582 - RNA, 16 nt, Mycobacterium bovis subsp bovis AF2122/97
uuccgcugucgagccg

SEQ ID NO: 3104583 - RNA, 14 nt, Mycobacterium bovis subsp bovis AF2122/97
uuccggccgaugcg

SEQ ID NO: 3104584 - RNA, 14 nt, Mycobacterium bovis subsp bovis AF2122/97
uuccggccgccugc

SEQ ID NO: 3104585 - RNA, 16 nt, Mycobacterium bovis subsp bovis AF2122/97
uuccggcggccacgcc

SEQ ID NO: 3104586 - RNA, 22 nt, Mycobacterium bovis subsp bovis AF2122/97
uuccggcuggugggacgcggcc

SEQ ID NO: 3104587 - RNA, 19 nt, Mycobacterium bovis subsp bovis AF2122/97
uuccgggucggcgaacgcc

SEQ ID NO: 3104588 - RNA, 22 nt, Mycobacterium bovis subsp bovis AF2122/97
uuccggucgacuccagcaccag

SEQ ID NO: 3104589 - RNA, 21 nt, Mycobacterium bovis subsp bovis AF2122/97
uuccgguggugucgguucguc

SEQ ID NO: 3104590 - RNA, 20 nt, Mycobacterium bovis subsp bovis AF2122/97
uuccgugcgggucguccgcc

SEQ ID NO: 3104591 - RNA, 19 nt, Mycobacterium bovis subsp bovis AF2122/97
uuccucaaggucggccagg

SEQ ID NO: 3104592 - RNA, 22 nt, Mycobacterium bovis subsp bovis AF2122/97
uuccucaaggucggccaggcug

SEQ ID NO: 3104593 - RNA, 14 nt, Mycobacterium bovis subsp bovis AF2122/97
uuccuccggcagca

SEQ ID NO: 3104594 - RNA, 15 nt, Mycobacterium bovis subsp bovis AF2122/97
uuccuccggcagcag

SEQ ID NO: 3104595 - RNA, 16 nt, Mycobacterium bovis subsp bovis AF2122/97
uuccucggccacccgc

SEQ ID NO: 3104596 - RNA, 15 nt, Mycobacterium bovis subsp bovis AF2122/97
uuccucuucaggccc

SEQ ID NO: 3104597 - RNA, 18 nt, Mycobacterium bovis subsp bovis AF2122/97
uuccugacgccauucauc

SEQ ID NO: 3104598 - RNA, 18 nt, Mycobacterium bovis subsp bovis AF2122/97
uuccuggcgggcgccuug

SEQ ID NO: 3104599 - RNA, 16 nt, Mycobacterium bovis subsp bovis AF2122/97
uuccuggguugugccg

SEQ ID NO: 3104600 - RNA, 18 nt, Mycobacterium bovis subsp bovis AF2122/97
uuccuggguugugccgcc

SEQ ID NO: 3104601 - RNA, 19 nt, Mycobacterium bovis subsp bovis AF2122/97
uucgaaagcaccgaugcug

SEQ ID NO: 3104602 - RNA, 21 nt, Mycobacterium bovis subsp bovis AF2122/97
uucgaagcgaucgccggccgc

SEQ ID NO: 3104603 - RNA, 19 nt, Mycobacterium bovis subsp bovis AF2122/97
uucgaagggguacccgccc

SEQ ID NO: 3104604 - RNA, 21 nt, Mycobacterium bovis subsp bovis AF2122/97
uucgaagggguacccgcccuc

SEQ ID NO: 3104605 - RNA, 17 nt, Mycobacterium bovis subsp bovis AF2122/97
uucgacaggccaccgca

SEQ ID NO: 3104606 - RNA, 19 nt, Mycobacterium bovis subsp bovis AF2122/97
uucgacaucacucgcgcca

SEQ ID NO: 3104607 - RNA, 13 nt, Mycobacterium bovis subsp bovis AF2122/97
uucgacccagcgg

SEQ ID NO: 3104608 - RNA, 16 nt, Mycobacterium bovis subsp bovis AF2122/97
uucgaccgccguggcc

SEQ ID NO: 3104609 - RNA, 11 nt, Mycobacterium bovis subsp bovis AF2122/97
uucgacgacac

SEQ ID NO: 3104610 - RNA, 13 nt, Mycobacterium bovis subsp bovis AF2122/97
uucgacggcggcc

SEQ ID NO: 3104611 - RNA, 16 nt, Mycobacterium bovis subsp bovis AF2122/97
uucgacggcggccaag

SEQ ID NO: 3104612 - RNA, 21 nt, Mycobacterium bovis subsp bovis AF2122/97
uucgacggcggccaaggucga

SEQ ID NO: 3104613 - RNA, 20 nt, Mycobacterium bovis subsp bovis AF2122/97
uucgacguaaugcgcugccg

SEQ ID NO: 3104614 - RNA, 16 nt, Mycobacterium bovis subsp bovis AF2122/97
uucgacucgaccgcga

SEQ ID NO: 3104615 - RNA, 23 nt, Mycobacterium bovis subsp bovis AF2122/97
uucgacucggccucuagcuugac

SEQ ID NO: 3104616 - RNA, 23 nt, Mycobacterium bovis subsp bovis AF2122/97
uucgagcaacugcucgacgaggc

SEQ ID NO: 3104617 - RNA, 13 nt, Mycobacterium bovis subsp bovis AF2122/97
uucgagcaccgac

SEQ ID NO: 3104618 - RNA, 20 nt, Mycobacterium bovis subsp bovis AF2122/97
uucgagcaccgacaccggcc

SEQ ID NO: 3104619 - RNA, 22 nt, Mycobacterium bovis subsp bovis AF2122/97
uucgagcaccgacaccggccgc

SEQ ID NO: 3104620 - RNA, 15 nt, Mycobacterium bovis subsp bovis AF2122/97
uucgagcugccaggc

SEQ ID NO: 3104621 - RNA, 14 nt, Mycobacterium bovis subsp bovis AF2122/97
uucgagggugaccc

SEQ ID NO: 3104622 - RNA, 16 nt, Mycobacterium bovis subsp bovis AF2122/97
uucgagguacagcggg

SEQ ID NO: 3104623 - RNA, 14 nt, Mycobacterium bovis subsp bovis AF2122/97
uucgauaccgcacc

SEQ ID NO: 3104624 - RNA, 21 nt, Mycobacterium bovis subsp bovis AF2122/97
uucgaucaacugcagauagga

SEQ ID NO: 3104625 - RNA, 17 nt, Mycobacterium bovis subsp bovis AF2122/97
uucgaucgcggcaauga

SEQ ID NO: 3104626 - RNA, 15 nt, Mycobacterium bovis subsp bovis AF2122/97
uucgaugccagugca

SEQ ID NO: 3104627 - RNA, 13 nt, Mycobacterium bovis subsp bovis AF2122/97
uucgaugggugca

SEQ ID NO: 3104628 - RNA, 14 nt, Mycobacterium bovis subsp bovis AF2122/97
uucgcagccgcacc

SEQ ID NO: 3104629 - RNA, 17 nt, Mycobacterium bovis subsp bovis AF2122/97
uucgcagccgcaccggg

SEQ ID NO: 3104630 - RNA, 21 nt, Mycobacterium bovis subsp bovis AF2122/97
uucgccaccgcaagaaucagc

SEQ ID NO: 3104631 - RNA, 11 nt, Mycobacterium bovis subsp bovis AF2122/97
uucgccagcgc

SEQ ID NO: 3104632 - RNA, 18 nt, Mycobacterium bovis subsp bovis AF2122/97
uucgcccacagcuugccc

SEQ ID NO: 3104633 - RNA, 15 nt, Mycobacterium bovis subsp bovis AF2122/97
uucgcccacaugccg

SEQ ID NO: 3104634 - RNA, 14 nt, Mycobacterium bovis subsp bovis AF2122/97
uucgccccacccga

SEQ ID NO: 3104635 - RNA, 18 nt, Mycobacterium bovis subsp bovis AF2122/97
uucgccccugcacagcag

SEQ ID NO: 3104636 - RNA, 22 nt, Mycobacterium bovis subsp bovis AF2122/97
uucgccccugcacagcaggcuc

SEQ ID NO: 3104637 - RNA, 16 nt, Mycobacterium bovis subsp bovis AF2122/97
uucgcccgucgccaau

SEQ ID NO: 3104638 - RNA, 18 nt, Mycobacterium bovis subsp bovis AF2122/97
uucgccgauaucgcagau

SEQ ID NO: 3104639 - RNA, 12 nt, Mycobacterium bovis subsp bovis AF2122/97
uucgccgcccgc

SEQ ID NO: 3104640 - RNA, 23 nt, Mycobacterium bovis subsp bovis AF2122/97
uucgccgccguuggcucgagccg

SEQ ID NO: 3104641 - RNA, 21 nt, Mycobacterium bovis subsp bovis AF2122/97
uucgccgcgaaugucgccgcc

SEQ ID NO: 3104642 - RNA, 22 nt, Mycobacterium bovis subsp bovis AF2122/97
uucgccgcgcuugcgaucgccg

SEQ ID NO: 3104643 - RNA, 21 nt, Mycobacterium bovis subsp bovis AF2122/97
uucgcgaagaacgacgccacc

SEQ ID NO: 3104644 - RNA, 18 nt, Mycobacterium bovis subsp bovis AF2122/97
uucgcgaugugcgccacc

SEQ ID NO: 3104645 - RNA, 16 nt, Mycobacterium bovis subsp bovis AF2122/97
uucgcgcagccgccgc

SEQ ID NO: 3104646 - RNA, 20 nt, Mycobacterium bovis subsp bovis AF2122/97
uucgcgccacgcacccggca

SEQ ID NO: 3104647 - RNA, 22 nt, Mycobacterium bovis subsp bovis AF2122/97
uucgcgcgccgcgacgaugccu

SEQ ID NO: 3104648 - RNA, 19 nt, Mycobacterium bovis subsp bovis AF2122/97
uucgcgggagaacgugccg

SEQ ID NO: 3104649 - RNA, 20 nt, Mycobacterium bovis subsp bovis AF2122/97
uucgcgggauccaggcccag

SEQ ID NO: 3104650 - RNA, 16 nt, Mycobacterium bovis subsp bovis AF2122/97
uucgcgggccgaggcc

SEQ ID NO: 3104651 - RNA, 17 nt, Mycobacterium bovis subsp bovis AF2122/97
uucgcgggccgaggccg

SEQ ID NO: 3104652 - RNA, 15 nt, Mycobacterium bovis subsp bovis AF2122/97
uucgcgggugcgcug

SEQ ID NO: 3104653 - RNA, 18 nt, Mycobacterium bovis subsp bovis AF2122/97
uucgcgguagccgcggcc

SEQ ID NO: 3104654 - RNA, 17 nt, Mycobacterium bovis subsp bovis AF2122/97
uucgcgugccagcgccc

SEQ ID NO: 3104655 - RNA, 13 nt, Mycobacterium bovis subsp bovis AF2122/97
uucgcucaucugu

SEQ ID NO: 3104656 - RNA, 15 nt, Mycobacterium bovis subsp bovis AF2122/97
uucgcucgcaccgcc

SEQ ID NO: 3104657 - RNA, 18 nt, Mycobacterium bovis subsp bovis AF2122/97
uucgcucgcaccgcccgc

SEQ ID NO: 3104658 - RNA, 16 nt, Mycobacterium bovis subsp bovis AF2122/97
uucggaccggcucuuu

SEQ ID NO: 3104659 - RNA, 22 nt, Mycobacterium bovis subsp bovis AF2122/97
uucggacucacucgguguuucg

SEQ ID NO: 3104660 - RNA, 14 nt, Mycobacterium bovis subsp bovis AF2122/97
uucggacucgccga

SEQ ID NO: 3104661 - RNA, 14 nt, Mycobacterium bovis subsp bovis AF2122/97
uucggagucacgca

SEQ ID NO: 3104662 - RNA, 12 nt, Mycobacterium bovis subsp bovis AF2122/97
uucggaugccgc

SEQ ID NO: 3104663 - RNA, 21 nt, Mycobacterium bovis subsp bovis AF2122/97
uucggccacugauucgcaggc

SEQ ID NO: 3104664 - RNA, 16 nt, Mycobacterium bovis subsp bovis AF2122/97
uucggccagcgcccgc

SEQ ID NO: 3104665 - RNA, 22 nt, Mycobacterium bovis subsp bovis AF2122/97
uucggccauguagccguugccg

SEQ ID NO: 3104666 - RNA, 14 nt, Mycobacterium bovis subsp bovis AF2122/97
uucggcccgguggu

SEQ ID NO: 3104667 - RNA, 17 nt, Mycobacterium bovis subsp bovis AF2122/97
uucggccgaccgggcuc

SEQ ID NO: 3104668 - RNA, 22 nt, Mycobacterium bovis subsp bovis AF2122/97
uucggccguaucgucgagcacc

SEQ ID NO: 3104669 - RNA, 18 nt, Mycobacterium bovis subsp bovis AF2122/97
uucggcgaaguugcgcga

SEQ ID NO: 3104670 - RNA, 21 nt, Mycobacterium bovis subsp bovis AF2122/97
uucggcgacagcgcggcgguc

SEQ ID NO: 3104671 - RNA, 13 nt, Mycobacterium bovis subsp bovis AF2122/97
uucggcgaccggc

SEQ ID NO: 3104672 - RNA, 13 nt, Mycobacterium bovis subsp bovis AF2122/97
uucggcgccgcgc

SEQ ID NO: 3104673 - RNA, 19 nt, Mycobacterium bovis subsp bovis AF2122/97
uucggcgccggcgucggcg

SEQ ID NO: 3104674 - RNA, 21 nt, Mycobacterium bovis subsp bovis AF2122/97
uucggcgccggcgucggcgcc

SEQ ID NO: 3104675 - RNA, 17 nt, Mycobacterium bovis subsp bovis AF2122/97
uucggcgccucguugcc

SEQ ID NO: 3104676 - RNA, 18 nt, Mycobacterium bovis subsp bovis AF2122/97
uucggcgccucguugccg

SEQ ID NO: 3104677 - RNA, 19 nt, Mycobacterium bovis subsp bovis AF2122/97
uucggcgccuggcggcgcc

SEQ ID NO: 3104678 - RNA, 17 nt, Mycobacterium bovis subsp bovis AF2122/97
uucggcgcugaucgcgc

SEQ ID NO: 3104679 - RNA, 17 nt, Mycobacterium bovis subsp bovis AF2122/97
uucggcgcugccaggcc

SEQ ID NO: 3104680 - RNA, 20 nt, Mycobacterium bovis subsp bovis AF2122/97
uucggcgcugcggcgugccg

SEQ ID NO: 3104681 - RNA, 20 nt, Mycobacterium bovis subsp bovis AF2122/97
uucggcggcauguucaucgc

SEQ ID NO: 3104682 - RNA, 18 nt, Mycobacterium bovis subsp bovis AF2122/97
uucggcggccgugucggg

SEQ ID NO: 3104683 - RNA, 22 nt, Mycobacterium bovis subsp bovis AF2122/97
uucggcggccgugucgggcgcg

SEQ ID NO: 3104684 - RNA, 10 nt, Mycobacterium bovis subsp bovis AF2122/97
uucggcggcg

SEQ ID NO: 3104685 - RNA, 14 nt, Mycobacterium bovis subsp bovis AF2122/97
uucggcggcgauga

SEQ ID NO: 3104686 - RNA, 18 nt, Mycobacterium bovis subsp bovis AF2122/97
uucggcggcgguggcgaa

SEQ ID NO: 3104687 - RNA, 15 nt, Mycobacterium bovis subsp bovis AF2122/97
uucggcggucagcgg

SEQ ID NO: 3104688 - RNA, 14 nt, Mycobacterium bovis subsp bovis AF2122/97
uucggcgucaccgu

SEQ ID NO: 3104689 - RNA, 13 nt, Mycobacterium bovis subsp bovis AF2122/97
uucggcugccacc

SEQ ID NO: 3104690 - RNA, 16 nt, Mycobacterium bovis subsp bovis AF2122/97
uucggcugccaccgca

SEQ ID NO: 3104691 - RNA, 19 nt, Mycobacterium bovis subsp bovis AF2122/97
uucgggacaaagccgaacg

SEQ ID NO: 3104692 - RNA, 18 nt, Mycobacterium bovis subsp bovis AF2122/97
uucgggacgcgagugcgu

SEQ ID NO: 3104693 - RNA, 19 nt, Mycobacterium bovis subsp bovis AF2122/97
uucgggagucuucggcgac

SEQ ID NO: 3104694 - RNA, 17 nt, Mycobacterium bovis subsp bovis AF2122/97
uucgggcaacggcagcc

SEQ ID NO: 3104695 - RNA, 17 nt, Mycobacterium bovis subsp bovis AF2122/97
uucgggcagcacccgcg

SEQ ID NO: 3104696 - RNA, 18 nt, Mycobacterium bovis subsp bovis AF2122/97
uucgggcucguccagcaa

SEQ ID NO: 3104697 - RNA, 14 nt, Mycobacterium bovis subsp bovis AF2122/97
uucgggugcagcca

SEQ ID NO: 3104698 - RNA, 13 nt, Mycobacterium bovis subsp bovis AF2122/97
uucggucagcgcc

SEQ ID NO: 3104699 - RNA, 20 nt, Mycobacterium bovis subsp bovis AF2122/97
uucggucgggggcagcgccu

SEQ ID NO: 3104700 - RNA, 16 nt, Mycobacterium bovis subsp bovis AF2122/97
uucggucucgaccgcg

SEQ ID NO: 3104701 - RNA, 13 nt, Mycobacterium bovis subsp bovis AF2122/97
uucggucuugccg

SEQ ID NO: 3104702 - RNA, 17 nt, Mycobacterium bovis subsp bovis AF2122/97
uucggugagcgggagga

SEQ ID NO: 3104703 - RNA, 20 nt, Mycobacterium bovis subsp bovis AF2122/97
uucggugccgugaucggcgc

SEQ ID NO: 3104704 - RNA, 16 nt, Mycobacterium bovis subsp bovis AF2122/97
uucggugcuguugucg

SEQ ID NO: 3104705 - RNA, 16 nt, Mycobacterium bovis subsp bovis AF2122/97
uucgguggagggcgag

SEQ ID NO: 3104706 - RNA, 14 nt, Mycobacterium bovis subsp bovis AF2122/97
uucgguggcggcag

SEQ ID NO: 3104707 - RNA, 19 nt, Mycobacterium bovis subsp bovis AF2122/97
uucgguggggucgcugccg

SEQ ID NO: 3104708 - RNA, 21 nt, Mycobacterium bovis subsp bovis AF2122/97
uucguagggauagcagugcag

SEQ ID NO: 3104709 - RNA, 21 nt, Mycobacterium bovis subsp bovis AF2122/97
uucgucagucaacucaccguc

SEQ ID NO: 3104710 - RNA, 14 nt, Mycobacterium bovis subsp bovis AF2122/97
uucguccaccgcga

SEQ ID NO: 3104711 - RNA, 12 nt, Mycobacterium bovis subsp bovis AF2122/97
uucguccccaga

SEQ ID NO: 3104712 - RNA, 20 nt, Mycobacterium bovis subsp bovis AF2122/97
uucgucgacacccgcacgaa

SEQ ID NO: 3104713 - RNA, 18 nt, Mycobacterium bovis subsp bovis AF2122/97
uucgucgaccgcgccaua

SEQ ID NO: 3104714 - RNA, 20 nt, Mycobacterium bovis subsp bovis AF2122/97
uucgucgcggaucagcccgc

SEQ ID NO: 3104715 - RNA, 22 nt, Mycobacterium bovis subsp bovis AF2122/97
uucgucgcggguguuccacacc

SEQ ID NO: 3104716 - RNA, 19 nt, Mycobacterium bovis subsp bovis AF2122/97
uucgucggagaacgcccgc

SEQ ID NO: 3104717 - RNA, 19 nt, Mycobacterium bovis subsp bovis AF2122/97
uucgucgggacgccgcccc

SEQ ID NO: 3104718 - RNA, 22 nt, Mycobacterium bovis subsp bovis AF2122/97
uucgugaagcgggugccaucgg

SEQ ID NO: 3104719 - RNA, 23 nt, Mycobacterium bovis subsp bovis AF2122/97
uucgugcaccacauuggcgauca

SEQ ID NO: 3104720 - RNA, 22 nt, Mycobacterium bovis subsp bovis AF2122/97
uucgugcagcccaaggcgacga

SEQ ID NO: 3104721 - RNA, 15 nt, Mycobacterium bovis subsp bovis AF2122/97
uucuccaccagcgug

SEQ ID NO: 3104722 - RNA, 17 nt, Mycobacterium bovis subsp bovis AF2122/97
uucuccagauccacgcc

SEQ ID NO: 3104723 - RNA, 12 nt, Mycobacterium bovis subsp bovis AF2122/97
uucuccaggcug

SEQ ID NO: 3104724 - RNA, 13 nt, Mycobacterium bovis subsp bovis AF2122/97
uucuccaggcuga

SEQ ID NO: 3104725 - RNA, 14 nt, Mycobacterium bovis subsp bovis AF2122/97
uucuccugaguugc

SEQ ID NO: 3104726 - RNA, 13 nt, Mycobacterium bovis subsp bovis AF2122/97
uucucgccgccgc

SEQ ID NO: 3104727 - RNA, 17 nt, Mycobacterium bovis subsp bovis AF2122/97
uucucgguaccaccggc

SEQ ID NO: 3104728 - RNA, 18 nt, Mycobacterium bovis subsp bovis AF2122/97
uucucguagucaaccaag

SEQ ID NO: 3104729 - RNA, 13 nt, Mycobacterium bovis subsp bovis AF2122/97
uucugaagcccga

SEQ ID NO: 3104730 - RNA, 21 nt, Mycobacterium bovis subsp bovis AF2122/97
uucugacuaucucgcucgacg

SEQ ID NO: 3104731 - RNA, 14 nt, Mycobacterium bovis subsp bovis AF2122/97
uucugcaccagcuc

SEQ ID NO: 3104732 - RNA, 20 nt, Mycobacterium bovis subsp bovis AF2122/97
uucugccuuaccaaccggga

SEQ ID NO: 3104733 - RNA, 13 nt, Mycobacterium bovis subsp bovis AF2122/97
uucugccuuggcc

SEQ ID NO: 3104734 - RNA, 17 nt, Mycobacterium bovis subsp bovis AF2122/97
uucugcgcccacccgcg

SEQ ID NO: 3104735 - RNA, 23 nt, Mycobacterium bovis subsp bovis AF2122/97
uucugcggccgcgugccgcccgc

SEQ ID NO: 3104736 - RNA, 18 nt, Mycobacterium bovis subsp bovis AF2122/97
uucugcgucugcucgcca

SEQ ID NO: 3104737 - RNA, 21 nt, Mycobacterium bovis subsp bovis AF2122/97
uucuggaaccccgagcugcca

SEQ ID NO: 3104738 - RNA, 13 nt, Mycobacterium bovis subsp bovis AF2122/97
uucuggcccgcag

SEQ ID NO: 3104739 - RNA, 22 nt, Mycobacterium bovis subsp bovis AF2122/97
uucuggucgaaauugggugccg

SEQ ID NO: 3104740 - RNA, 19 nt, Mycobacterium bovis subsp bovis AF2122/97
uucugugucugcucggcga

SEQ ID NO: 3104741 - RNA, 12 nt, Mycobacterium bovis subsp bovis AF2122/97
uucuucaacucc

SEQ ID NO: 3104742 - RNA, 18 nt, Mycobacterium bovis subsp bovis AF2122/97
uucuucaccgccuugguc

SEQ ID NO: 3104743 - RNA, 15 nt, Mycobacterium bovis subsp bovis AF2122/97
uucuucgcgaagaac

SEQ ID NO: 3104744 - RNA, 17 nt, Mycobacterium bovis subsp bovis AF2122/97
uucuucgcuaccuucuu

SEQ ID NO: 3104745 - RNA, 14 nt, Mycobacterium bovis subsp bovis AF2122/97
uucuucggacagca

SEQ ID NO: 3104746 - RNA, 23 nt, Mycobacterium bovis subsp bovis AF2122/97
uucuucggugaagaacaugcuca

SEQ ID NO: 3104747 - RNA, 22 nt, Mycobacterium bovis subsp bovis AF2122/97
uucuuggcaggugccuucuucg

SEQ ID NO: 3104748 - RNA, 16 nt, Mycobacterium bovis subsp bovis AF2122/97
uucuuguuggucccga

SEQ ID NO: 3104749 - RNA, 21 nt, Mycobacterium bovis subsp bovis AF2122/97
uucuuugccggcgccuugguc

SEQ ID NO: 3104750 - RNA, 17 nt, Mycobacterium bovis subsp bovis AF2122/97
uugaaaacgcccggcac

SEQ ID NO: 3104751 - RNA, 20 nt, Mycobacterium bovis subsp bovis AF2122/97
uugaaauugaugaucugcag

SEQ ID NO: 3104752 - RNA, 17 nt, Mycobacterium bovis subsp bovis AF2122/97
uugaacgaguagccggu

SEQ ID NO: 3104753 - RNA, 14 nt, Mycobacterium bovis subsp bovis AF2122/97
uugaacguucccuc

SEQ ID NO: 3104754 - RNA, 12 nt, Mycobacterium bovis subsp bovis AF2122/97
uugaacugugcg

SEQ ID NO: 3104755 - RNA, 21 nt, Mycobacterium bovis subsp bovis AF2122/97
uugaagaugucuuccugcgcc

SEQ ID NO: 3104756 - RNA, 16 nt, Mycobacterium bovis subsp bovis AF2122/97
uugaagccgauguccg

SEQ ID NO: 3104757 - RNA, 14 nt, Mycobacterium bovis subsp bovis AF2122/97
uugaaggcgccggu

SEQ ID NO: 3104758 - RNA, 15 nt, Mycobacterium bovis subsp bovis AF2122/97
uugaaggcgccggug

SEQ ID NO: 3104759 - RNA, 14 nt, Mycobacterium bovis subsp bovis AF2122/97
uugaaggugccggc

SEQ ID NO: 3104760 - RNA, 13 nt, Mycobacterium bovis subsp bovis AF2122/97
uugacagacacag

SEQ ID NO: 3104761 - RNA, 15 nt, Mycobacterium bovis subsp bovis AF2122/97
uugacagcuuucuug

SEQ ID NO: 3104762 - RNA, 16 nt, Mycobacterium bovis subsp bovis AF2122/97
uugaccaacccucgcc

SEQ ID NO: 3104763 - RNA, 18 nt, Mycobacterium bovis subsp bovis AF2122/97
uugaccaccaccgagccg

SEQ ID NO: 3104764 - RNA, 19 nt, Mycobacterium bovis subsp bovis AF2122/97
uugaccaccacgaugaccg

SEQ ID NO: 3104765 - RNA, 11 nt, Mycobacterium bovis subsp bovis AF2122/97
uugaccaccag

SEQ ID NO: 3104766 - RNA, 13 nt, Mycobacterium bovis subsp bovis AF2122/97
uugaccagcagcu

SEQ ID NO: 3104767 - RNA, 21 nt, Mycobacterium bovis subsp bovis AF2122/97
uugaccaggcuccggccggcc

SEQ ID NO: 3104768 - RNA, 13 nt, Mycobacterium bovis subsp bovis AF2122/97
uugacccacagca

SEQ ID NO: 3104769 - RNA, 23 nt, Mycobacterium bovis subsp bovis AF2122/97
uugacccacgagagcgcuguccc

SEQ ID NO: 3104770 - RNA, 24 nt, Mycobacterium bovis subsp bovis AF2122/97
uugacccccucguccugcgagagg

SEQ ID NO: 3104771 - RNA, 20 nt, Mycobacterium bovis subsp bovis AF2122/97
uugaccgaaaacacaugccg

SEQ ID NO: 3104772 - RNA, 22 nt, Mycobacterium bovis subsp bovis AF2122/97
uugaccgcggucugcgcgucgc

SEQ ID NO: 3104773 - RNA, 14 nt, Mycobacterium bovis subsp bovis AF2122/97
uugaccgcggugac

SEQ ID NO: 3104774 - RNA, 21 nt, Mycobacterium bovis subsp bovis AF2122/97
uugaccgggucgccgaugacg

SEQ ID NO: 3104775 - RNA, 11 nt, Mycobacterium bovis subsp bovis AF2122/97
uugaccucuuc

SEQ ID NO: 3104776 - RNA, 20 nt, Mycobacterium bovis subsp bovis AF2122/97
uugacgaacccaccgugccg

SEQ ID NO: 3104777 - RNA, 18 nt, Mycobacterium bovis subsp bovis AF2122/97
uugacgaggcgagcggcc

SEQ ID NO: 3104778 - RNA, 15 nt, Mycobacterium bovis subsp bovis AF2122/97
uugacgccguugccg

SEQ ID NO: 3104779 - RNA, 16 nt, Mycobacterium bovis subsp bovis AF2122/97
uugacgcgacgagccg

SEQ ID NO: 3104780 - RNA, 22 nt, Mycobacterium bovis subsp bovis AF2122/97
uugacggcgaagucgagugccg

SEQ ID NO: 3104781 - RNA, 18 nt, Mycobacterium bovis subsp bovis AF2122/97
uugacggcuucggcagcc

SEQ ID NO: 3104782 - RNA, 19 nt, Mycobacterium bovis subsp bovis AF2122/97
uugacgggcucggcaggcc

SEQ ID NO: 3104783 - RNA, 21 nt, Mycobacterium bovis subsp bovis AF2122/97
uugacgggcucggcaggcccg

SEQ ID NO: 3104784 - RNA, 16 nt, Mycobacterium bovis subsp bovis AF2122/97
uugacggucagccgcg

SEQ ID NO: 3104785 - RNA, 21 nt, Mycobacterium bovis subsp bovis AF2122/97
uugacgguugccccggcgacc

SEQ ID NO: 3104786 - RNA, 15 nt, Mycobacterium bovis subsp bovis AF2122/97
uugacguaggcggcg

SEQ ID NO: 3104787 - RNA, 17 nt, Mycobacterium bovis subsp bovis AF2122/97
uugacguaggcggcggc

SEQ ID NO: 3104788 - RNA, 13 nt, Mycobacterium bovis subsp bovis AF2122/97
uugacguccaaca

SEQ ID NO: 3104789 - RNA, 15 nt, Mycobacterium bovis subsp bovis AF2122/97
uugacguccagggcc

SEQ ID NO: 3104790 - RNA, 18 nt, Mycobacterium bovis subsp bovis AF2122/97
uugacucugcguccacca

SEQ ID NO: 3104791 - RNA, 21 nt, Mycobacterium bovis subsp bovis AF2122/97
uugacugcacaccaccgccga

SEQ ID NO: 3104792 - RNA, 18 nt, Mycobacterium bovis subsp bovis AF2122/97
uugagaacaacgcgucga

SEQ ID NO: 3104793 - RNA, 21 nt, Mycobacterium bovis subsp bovis AF2122/97
uugagcagcaagccgccggug

SEQ ID NO: 3104794 - RNA, 19 nt, Mycobacterium bovis subsp bovis AF2122/97
uugagccacguucgcggcc

SEQ ID NO: 3104795 - RNA, 22 nt, Mycobacterium bovis subsp bovis AF2122/97
uugagccgggcaaccagcagca

SEQ ID NO: 3104796 - RNA, 22 nt, Mycobacterium bovis subsp bovis AF2122/97
uugagcgaguugcagucgcgag

SEQ ID NO: 3104797 - RNA, 13 nt, Mycobacterium bovis subsp bovis AF2122/97
uugaggaagcccg

SEQ ID NO: 3104798 - RNA, 15 nt, Mycobacterium bovis subsp bovis AF2122/97
uugaggauccgcacc

SEQ ID NO: 3104799 - RNA, 21 nt, Mycobacterium bovis subsp bovis AF2122/97
uugaggauccgcaccacgccc

SEQ ID NO: 3104800 - RNA, 11 nt, Mycobacterium bovis subsp bovis AF2122/97
uugaggccggu

SEQ ID NO: 3104801 - RNA, 23 nt, Mycobacterium bovis subsp bovis AF2122/97
uugaggcuggucugcaggcggcc

SEQ ID NO: 3104802 - RNA, 20 nt, Mycobacterium bovis subsp bovis AF2122/97
uugagugcccauagccggug

SEQ ID NO: 3104803 - RNA, 19 nt, Mycobacterium bovis subsp bovis AF2122/97
uugaucaagaaggccagcg

SEQ ID NO: 3104804 - RNA, 21 nt, Mycobacterium bovis subsp bovis AF2122/97
uugaucaaggugucgacggug

SEQ ID NO: 3104805 - RNA, 14 nt, Mycobacterium bovis subsp bovis AF2122/97
uugauccccagcuc

SEQ ID NO: 3104806 - RNA, 14 nt, Mycobacterium bovis subsp bovis AF2122/97
uugauccuggcuca

SEQ ID NO: 3104807 - RNA, 21 nt, Mycobacterium bovis subsp bovis AF2122/97
uugaucgacaacgcggcaccu

SEQ ID NO: 3104808 - RNA, 16 nt, Mycobacterium bovis subsp bovis AF2122/97
uugaucgccggccugc

SEQ ID NO: 3104809 - RNA, 20 nt, Mycobacterium bovis subsp bovis AF2122/97
uugaucgcgcugaaggccgg

SEQ ID NO: 3104810 - RNA, 12 nt, Mycobacterium bovis subsp bovis AF2122/97
uugaucggcgag

SEQ ID NO: 3104811 - RNA, 16 nt, Mycobacterium bovis subsp bovis AF2122/97
uugaucuccaccuucu

SEQ ID NO: 3104812 - RNA, 22 nt, Mycobacterium bovis subsp bovis AF2122/97
uugaucuccaccuucuggucca

SEQ ID NO: 3104813 - RNA, 15 nt, Mycobacterium bovis subsp bovis AF2122/97
uugaucugcccuguu

SEQ ID NO: 3104814 - RNA, 15 nt, Mycobacterium bovis subsp bovis AF2122/97
uugaugccgccggag

SEQ ID NO: 3104815 - RNA, 15 nt, Mycobacterium bovis subsp bovis AF2122/97
uugaugcucgaugcg

SEQ ID NO: 3104816 - RNA, 16 nt, Mycobacterium bovis subsp bovis AF2122/97
uugauggucuccacca

SEQ ID NO: 3104817 - RNA, 14 nt, Mycobacterium bovis subsp bovis AF2122/97
uugauugaccugcu

SEQ ID NO: 3104818 - RNA, 14 nt, Mycobacterium bovis subsp bovis AF2122/97
uugcacaccgaucg

SEQ ID NO: 3104819 - RNA, 19 nt, Mycobacterium bovis subsp bovis AF2122/97
uugcacaccggcacugccc

SEQ ID NO: 3104820 - RNA, 20 nt, Mycobacterium bovis subsp bovis AF2122/97
uugcacaccggcacugccca

SEQ ID NO: 3104821 - RNA, 23 nt, Mycobacterium bovis subsp bovis AF2122/97
uugcagccggcauagcggcccau

SEQ ID NO: 3104822 - RNA, 15 nt, Mycobacterium bovis subsp bovis AF2122/97
uugcagcucgauccg

SEQ ID NO: 3104823 - RNA, 14 nt, Mycobacterium bovis subsp bovis AF2122/97
uugcagcuucggcc

SEQ ID NO: 3104824 - RNA, 24 nt, Mycobacterium bovis subsp bovis AF2122/97
uugcaggcgucccagccgaucacg

SEQ ID NO: 3104825 - RNA, 19 nt, Mycobacterium bovis subsp bovis AF2122/97
uugcaguggcgacgagcaa

SEQ ID NO: 3104826 - RNA, 21 nt, Mycobacterium bovis subsp bovis AF2122/97
uugcaucaaaaacgaacccag

SEQ ID NO: 3104827 - RNA, 13 nt, Mycobacterium bovis subsp bovis AF2122/97
uugcaucaugccg

SEQ ID NO: 3104828 - RNA, 14 nt, Mycobacterium bovis subsp bovis AF2122/97
uugccaaagcccac

SEQ ID NO: 3104829 - RNA, 20 nt, Mycobacterium bovis subsp bovis AF2122/97
uugccaacgaaccgcucagc

SEQ ID NO: 3104830 - RNA, 15 nt, Mycobacterium bovis subsp bovis AF2122/97
uugccaccagaaaca

SEQ ID NO: 3104831 - RNA, 23 nt, Mycobacterium bovis subsp bovis AF2122/97
uugccaccgagaucaugccggcg

SEQ ID NO: 3104832 - RNA, 17 nt, Mycobacterium bovis subsp bovis AF2122/97
uugccaccgguaccgcc

SEQ ID NO: 3104833 - RNA, 18 nt, Mycobacterium bovis subsp bovis AF2122/97
uugccaccgguaccgccg

SEQ ID NO: 3104834 - RNA, 16 nt, Mycobacterium bovis subsp bovis AF2122/97
uugccaccguugccgc

SEQ ID NO: 3104835 - RNA, 23 nt, Mycobacterium bovis subsp bovis AF2122/97
uugccaggugcuguuugguugcg

SEQ ID NO: 3104836 - RNA, 19 nt, Mycobacterium bovis subsp bovis AF2122/97
uugccagucgaucgcggcc

SEQ ID NO: 3104837 - RNA, 19 nt, Mycobacterium bovis subsp bovis AF2122/97
uugccaucaaggccaccuc

SEQ ID NO: 3104838 - RNA, 19 nt, Mycobacterium bovis subsp bovis AF2122/97
uugcccaagcgcguuguug

SEQ ID NO: 3104839 - RNA, 12 nt, Mycobacterium bovis subsp bovis AF2122/97
uugcccagguga

SEQ ID NO: 3104840 - RNA, 13 nt, Mycobacterium bovis subsp bovis AF2122/97
uugcccccagggc

SEQ ID NO: 3104841 - RNA, 13 nt, Mycobacterium bovis subsp bovis AF2122/97
uugccccgccuug

SEQ ID NO: 3104842 - RNA, 18 nt, Mycobacterium bovis subsp bovis AF2122/97
uugccccguugagcagca

SEQ ID NO: 3104843 - RNA, 22 nt, Mycobacterium bovis subsp bovis AF2122/97
uugccccguugagcagcaccca

SEQ ID NO: 3104844 - RNA, 15 nt, Mycobacterium bovis subsp bovis AF2122/97
uugcccgccgcguca

SEQ ID NO: 3104845 - RNA, 15 nt, Mycobacterium bovis subsp bovis AF2122/97
uugcccgucggcgcc

SEQ ID NO: 3104846 - RNA, 21 nt, Mycobacterium bovis subsp bovis AF2122/97
uugcccguguuaaagaagccu

SEQ ID NO: 3104847 - RNA, 20 nt, Mycobacterium bovis subsp bovis AF2122/97
uugcccguucaugcggcggc

SEQ ID NO: 3104848 - RNA, 18 nt, Mycobacterium bovis subsp bovis AF2122/97
uugccgaaccacgcgccc

SEQ ID NO: 3104849 - RNA, 20 nt, Mycobacterium bovis subsp bovis AF2122/97
uugccgaaccacgcgcccgc

SEQ ID NO: 3104850 - RNA, 13 nt, Mycobacterium bovis subsp bovis AF2122/97
uugccgaagccgg

SEQ ID NO: 3104851 - RNA, 13 nt, Mycobacterium bovis subsp bovis AF2122/97
uugccgaucaacc

SEQ ID NO: 3104852 - RNA, 22 nt, Mycobacterium bovis subsp bovis AF2122/97
uugccgaucaaccccccgggcc

SEQ ID NO: 3104853 - RNA, 15 nt, Mycobacterium bovis subsp bovis AF2122/97
uugccgauccccagg

SEQ ID NO: 3104854 - RNA, 21 nt, Mycobacterium bovis subsp bovis AF2122/97
uugccgcaccagucgcgcagc

SEQ ID NO: 3104855 - RNA, 20 nt, Mycobacterium bovis subsp bovis AF2122/97
uugccgcaggccuguuccau

SEQ ID NO: 3104856 - RNA, 17 nt, Mycobacterium bovis subsp bovis AF2122/97
uugccgccaucaccgcc

SEQ ID NO: 3104857 - RNA, 18 nt, Mycobacterium bovis subsp bovis AF2122/97
uugccgccaucaccgccg

SEQ ID NO: 3104858 - RNA, 23 nt, Mycobacterium bovis subsp bovis AF2122/97
uugccgcccgcuccgccgucgcc

SEQ ID NO: 3104859 - RNA, 10 nt, Mycobacterium bovis subsp bovis AF2122/97
uugccgccga

SEQ ID NO: 3104860 - RNA, 22 nt, Mycobacterium bovis subsp bovis AF2122/97
uugccgccgaacgccucugcga

SEQ ID NO: 3104861 - RNA, 13 nt, Mycobacterium bovis subsp bovis AF2122/97
uugccgccgacgc

SEQ ID NO: 3104862 - RNA, 20 nt, Mycobacterium bovis subsp bovis AF2122/97
uugccgccgacgccgccggc

SEQ ID NO: 3104863 - RNA, 20 nt, Mycobacterium bovis subsp bovis AF2122/97
uugccgccgagggcgccggg

SEQ ID NO: 3104864 - RNA, 10 nt, Mycobacterium bovis subsp bovis AF2122/97
uugccgccgg

SEQ ID NO: 3104865 - RNA, 13 nt, Mycobacterium bovis subsp bovis AF2122/97
uugccgccggccc

SEQ ID NO: 3104866 - RNA, 20 nt, Mycobacterium bovis subsp bovis AF2122/97
uugccgccggccccgccggc

SEQ ID NO: 3104867 - RNA, 21 nt, Mycobacterium bovis subsp bovis AF2122/97
uugccgccggccccgccggcg

SEQ ID NO: 3104868 - RNA, 14 nt, Mycobacterium bovis subsp bovis AF2122/97
uugccgccggcgcc

SEQ ID NO: 3104869 - RNA, 19 nt, Mycobacterium bovis subsp bovis AF2122/97
uugccgccggucaucccaa

SEQ ID NO: 3104870 - RNA, 23 nt, Mycobacterium bovis subsp bovis AF2122/97
uugccgccgucaccgccguugcc

SEQ ID NO: 3104871 - RNA, 13 nt, Mycobacterium bovis subsp bovis AF2122/97
uugccgccgucgc

SEQ ID NO: 3104872 - RNA, 21 nt, Mycobacterium bovis subsp bovis AF2122/97
uugccgccgucgccgccguug

SEQ ID NO: 3104873 - RNA, 21 nt, Mycobacterium bovis subsp bovis AF2122/97
uugccgccguuaccgccgcug

SEQ ID NO: 3104874 - RNA, 15 nt, Mycobacterium bovis subsp bovis AF2122/97
uugccgccuccggug

SEQ ID NO: 3104875 - RNA, 21 nt, Mycobacterium bovis subsp bovis AF2122/97
uugccgccuggguugaccgcc

SEQ ID NO: 3104876 - RNA, 14 nt, Mycobacterium bovis subsp bovis AF2122/97
uugccgccuuggcc

SEQ ID NO: 3104877 - RNA, 19 nt, Mycobacterium bovis subsp bovis AF2122/97
uugccgcgguugugcuggg

SEQ ID NO: 3104878 - RNA, 23 nt, Mycobacterium bovis subsp bovis AF2122/97
uugccggaguugucgacggccac

SEQ ID NO: 3104879 - RNA, 19 nt, Mycobacterium bovis subsp bovis AF2122/97
uugccggccaccagccugg

SEQ ID NO: 3104880 - RNA, 14 nt, Mycobacterium bovis subsp bovis AF2122/97
uugccggcgccuug

SEQ ID NO: 3104881 - RNA, 22 nt, Mycobacterium bovis subsp bovis AF2122/97
uugccggcgccuuggucgccgc

SEQ ID NO: 3104882 - RNA, 20 nt, Mycobacterium bovis subsp bovis AF2122/97
uugccggcggcgacgucugc

SEQ ID NO: 3104883 - RNA, 17 nt, Mycobacterium bovis subsp bovis AF2122/97
uugccggcgguggccga

SEQ ID NO: 3104884 - RNA, 15 nt, Mycobacterium bovis subsp bovis AF2122/97
uugccggcguugccg

SEQ ID NO: 3104885 - RNA, 17 nt, Mycobacterium bovis subsp bovis AF2122/97
uugccggcguugccgcc

SEQ ID NO: 3104886 - RNA, 19 nt, Mycobacterium bovis subsp bovis AF2122/97
uugccggcguugccgccgu

SEQ ID NO: 3104887 - RNA, 15 nt, Mycobacterium bovis subsp bovis AF2122/97
uugccggcuuggccu

SEQ ID NO: 3104888 - RNA, 12 nt, Mycobacterium bovis subsp bovis AF2122/97
uugccgggcgcu

SEQ ID NO: 3104889 - RNA, 12 nt, Mycobacterium bovis subsp bovis AF2122/97
uugccggugcgc

SEQ ID NO: 3104890 - RNA, 20 nt, Mycobacterium bovis subsp bovis AF2122/97
uugccgucgugaucggcgaa

SEQ ID NO: 3104891 - RNA, 20 nt, Mycobacterium bovis subsp bovis AF2122/97
uugccgugcucaccggcgcc

SEQ ID NO: 3104892 - RNA, 17 nt, Mycobacterium bovis subsp bovis AF2122/97
uugccucccuuuuccaa

SEQ ID NO: 3104893 - RNA, 14 nt, Mycobacterium bovis subsp bovis AF2122/97
uugccuuccgaccc

SEQ ID NO: 3104894 - RNA, 19 nt, Mycobacterium bovis subsp bovis AF2122/97
uugcgagugagcucagcaa

SEQ ID NO: 3104895 - RNA, 13 nt, Mycobacterium bovis subsp bovis AF2122/97
uugcgcacccgcg

SEQ ID NO: 3104896 - RNA, 14 nt, Mycobacterium bovis subsp bovis AF2122/97
uugcgcagcaccag

SEQ ID NO: 3104897 - RNA, 13 nt, Mycobacterium bovis subsp bovis AF2122/97
uugcgcagccgca

SEQ ID NO: 3104898 - RNA, 12 nt, Mycobacterium bovis subsp bovis AF2122/97
uugcgccagcgg

SEQ ID NO: 3104899 - RNA, 12 nt, Mycobacterium bovis subsp bovis AF2122/97
uugcgccgccaa

SEQ ID NO: 3104900 - RNA, 14 nt, Mycobacterium bovis subsp bovis AF2122/97
uugcgcgcaggugc

SEQ ID NO: 3104901 - RNA, 23 nt, Mycobacterium bovis subsp bovis AF2122/97
uugcgcgcgcagaucguccaccg

SEQ ID NO: 3104902 - RNA, 15 nt, Mycobacterium bovis subsp bovis AF2122/97
uugcgcggucucgag

SEQ ID NO: 3104903 - RNA, 13 nt, Mycobacterium bovis subsp bovis AF2122/97
uugcgcugcggcc

SEQ ID NO: 3104904 - RNA, 13 nt, Mycobacterium bovis subsp bovis AF2122/97
uugcggaucgagc

SEQ ID NO: 3104905 - RNA, 18 nt, Mycobacterium bovis subsp bovis AF2122/97
uugcggccgaauuccuca

SEQ ID NO: 3104906 - RNA, 22 nt, Mycobacterium bovis subsp bovis AF2122/97
uugcggccgccgagucaaacaa

SEQ ID NO: 3104907 - RNA, 18 nt, Mycobacterium bovis subsp bovis AF2122/97
uugcgggcagccgcccgc

SEQ ID NO: 3104908 - RNA, 18 nt, Mycobacterium bovis subsp bovis AF2122/97
uugcgggcucucggcguc

SEQ ID NO: 3104909 - RNA, 18 nt, Mycobacterium bovis subsp bovis AF2122/97
uugcggggugcucagcga

SEQ ID NO: 3104910 - RNA, 16 nt, Mycobacterium bovis subsp bovis AF2122/97
uugcgggugguccagc

SEQ ID NO: 3104911 - RNA, 18 nt, Mycobacterium bovis subsp bovis AF2122/97
uugcgguaagccggcgug

SEQ ID NO: 3104912 - RNA, 23 nt, Mycobacterium bovis subsp bovis AF2122/97
uugcguccauccgcagcagguga

SEQ ID NO: 3104913 - RNA, 18 nt, Mycobacterium bovis subsp bovis AF2122/97
uugcgucgcgccugcccg

SEQ ID NO: 3104914 - RNA, 18 nt, Mycobacterium bovis subsp bovis AF2122/97
uugcgucugcucggcgua

SEQ ID NO: 3104915 - RNA, 22 nt, Mycobacterium bovis subsp bovis AF2122/97
uugcguggcguugguggucugc

SEQ ID NO: 3104916 - RNA, 22 nt, Mycobacterium bovis subsp bovis AF2122/97
uugcguuccaguccccgccggc

SEQ ID NO: 3104917 - RNA, 17 nt, Mycobacterium bovis subsp bovis AF2122/97
uugcuagguucgcgacg

SEQ ID NO: 3104918 - RNA, 16 nt, Mycobacterium bovis subsp bovis AF2122/97
uugcuccacaucggcu

SEQ ID NO: 3104919 - RNA, 22 nt, Mycobacterium bovis subsp bovis AF2122/97
uugcucgagcgguggcgucguc

SEQ ID NO: 3104920 - RNA, 22 nt, Mycobacterium bovis subsp bovis AF2122/97
uugcuggcggaacuugccggug

SEQ ID NO: 3104921 - RNA, 15 nt, Mycobacterium bovis subsp bovis AF2122/97
uugcuugcagggcca

SEQ ID NO: 3104922 - RNA, 14 nt, Mycobacterium bovis subsp bovis AF2122/97
uuggaaggcgcgcg

SEQ ID NO: 3104923 - RNA, 12 nt, Mycobacterium bovis subsp bovis AF2122/97
uuggacagcagc

SEQ ID NO: 3104924 - RNA, 14 nt, Mycobacterium bovis subsp bovis AF2122/97
uuggaccguugccg

SEQ ID NO: 3104925 - RNA, 14 nt, Mycobacterium bovis subsp bovis AF2122/97
uuggagaucgccgc

SEQ ID NO: 3104926 - RNA, 21 nt, Mycobacterium bovis subsp bovis AF2122/97
uuggagcucaucgacgagccg

SEQ ID NO: 3104927 - RNA, 14 nt, Mycobacterium bovis subsp bovis AF2122/97
uuggaucacccgcc

SEQ ID NO: 3104928 - RNA, 17 nt, Mycobacterium bovis subsp bovis AF2122/97
uuggaucacccgccgcg

SEQ ID NO: 3104929 - RNA, 13 nt, Mycobacterium bovis subsp bovis AF2122/97
uuggaucacgcga

SEQ ID NO: 3104930 - RNA, 15 nt, Mycobacterium bovis subsp bovis AF2122/97
uuggaucccagcccg

SEQ ID NO: 3104931 - RNA, 21 nt, Mycobacterium bovis subsp bovis AF2122/97
uuggaugaagucgucggcacc

SEQ ID NO: 3104932 - RNA, 23 nt, Mycobacterium bovis subsp bovis AF2122/97
uuggcaaagccgaaaucacugag

SEQ ID NO: 3104933 - RNA, 16 nt, Mycobacterium bovis subsp bovis AF2122/97
uuggcaacacagcuga

SEQ ID NO: 3104934 - RNA, 14 nt, Mycobacterium bovis subsp bovis AF2122/97
uuggcaagcacgcg

SEQ ID NO: 3104935 - RNA, 15 nt, Mycobacterium bovis subsp bovis AF2122/97
uuggcaagcacggcg

SEQ ID NO: 3104936 - RNA, 22 nt, Mycobacterium bovis subsp bovis AF2122/97
uuggcaaugaccccggcguugc

SEQ ID NO: 3104937 - RNA, 12 nt, Mycobacterium bovis subsp bovis AF2122/97
uuggcaccagcc

SEQ ID NO: 3104938 - RNA, 16 nt, Mycobacterium bovis subsp bovis AF2122/97
uuggcaccagccggug

SEQ ID NO: 3104939 - RNA, 18 nt, Mycobacterium bovis subsp bovis AF2122/97
uuggcacgcaacaccgcc

SEQ ID NO: 3104940 - RNA, 15 nt, Mycobacterium bovis subsp bovis AF2122/97
uuggcagagccgacu

SEQ ID NO: 3104941 - RNA, 12 nt, Mycobacterium bovis subsp bovis AF2122/97
uuggcagcacag

SEQ ID NO: 3104942 - RNA, 16 nt, Mycobacterium bovis subsp bovis AF2122/97
uuggcagggccagcgg

SEQ ID NO: 3104943 - RNA, 18 nt, Mycobacterium bovis subsp bovis AF2122/97
uuggcagggccagcggca

SEQ ID NO: 3104944 - RNA, 22 nt, Mycobacterium bovis subsp bovis AF2122/97
uuggcauugccgccagcccagc

SEQ ID NO: 3104945 - RNA, 13 nt, Mycobacterium bovis subsp bovis AF2122/97
uuggccaccgccg

SEQ ID NO: 3104946 - RNA, 16 nt, Mycobacterium bovis subsp bovis AF2122/97
uuggccagaccgcgcg

SEQ ID NO: 3104947 - RNA, 15 nt, Mycobacterium bovis subsp bovis AF2122/97
uuggccaggaagucc

SEQ ID NO: 3104948 - RNA, 21 nt, Mycobacterium bovis subsp bovis AF2122/97
uuggccaggucggccaccgug

SEQ ID NO: 3104949 - RNA, 22 nt, Mycobacterium bovis subsp bovis AF2122/97
uuggccaggucggccaccgugg

SEQ ID NO: 3104950 - RNA, 14 nt, Mycobacterium bovis subsp bovis AF2122/97
uuggcccaccgccg

SEQ ID NO: 3104951 - RNA, 14 nt, Mycobacterium bovis subsp bovis AF2122/97
uuggcccagcgugu

SEQ ID NO: 3104952 - RNA, 18 nt, Mycobacterium bovis subsp bovis AF2122/97
uuggccccgcggagcgca

SEQ ID NO: 3104953 - RNA, 15 nt, Mycobacterium bovis subsp bovis AF2122/97
uuggcccgaguuggc

SEQ ID NO: 3104954 - RNA, 21 nt, Mycobacterium bovis subsp bovis AF2122/97
uuggccgaacagcugcccgcc

SEQ ID NO: 3104955 - RNA, 16 nt, Mycobacterium bovis subsp bovis AF2122/97
uuggccgauguuguug

SEQ ID NO: 3104956 - RNA, 16 nt, Mycobacterium bovis subsp bovis AF2122/97
uuggccgcaaggcgug

SEQ ID NO: 3104957 - RNA, 18 nt, Mycobacterium bovis subsp bovis AF2122/97
uuggccgccacaccgccg

SEQ ID NO: 3104958 - RNA, 19 nt, Mycobacterium bovis subsp bovis AF2122/97
uuggccgccacaccgccgc

SEQ ID NO: 3104959 - RNA, 12 nt, Mycobacterium bovis subsp bovis AF2122/97
uuggccgcccga

SEQ ID NO: 3104960 - RNA, 12 nt, Mycobacterium bovis subsp bovis AF2122/97
uuggccgccgug

SEQ ID NO: 3104961 - RNA, 19 nt, Mycobacterium bovis subsp bovis AF2122/97
uuggccgcgcaggcuucca

SEQ ID NO: 3104962 - RNA, 13 nt, Mycobacterium bovis subsp bovis AF2122/97
uuggccgcgccgg

SEQ ID NO: 3104963 - RNA, 21 nt, Mycobacterium bovis subsp bovis AF2122/97
uuggccggaucgaagaccagc

SEQ ID NO: 3104964 - RNA, 15 nt, Mycobacterium bovis subsp bovis AF2122/97
uuggccggccccgcc

SEQ ID NO: 3104965 - RNA, 18 nt, Mycobacterium bovis subsp bovis AF2122/97
uuggccggccccgcccgc

SEQ ID NO: 3104966 - RNA, 15 nt, Mycobacterium bovis subsp bovis AF2122/97
uuggccggcuugucg

SEQ ID NO: 3104967 - RNA, 19 nt, Mycobacterium bovis subsp bovis AF2122/97
uuggccggcuugucgacca

SEQ ID NO: 3104968 - RNA, 13 nt, Mycobacterium bovis subsp bovis AF2122/97
uuggccgggucga

SEQ ID NO: 3104969 - RNA, 17 nt, Mycobacterium bovis subsp bovis AF2122/97
uuggccguaccggugau

SEQ ID NO: 3104970 - RNA, 21 nt, Mycobacterium bovis subsp bovis AF2122/97
uuggccuagccgcggcaccgc

SEQ ID NO: 3104971 - RNA, 21 nt, Mycobacterium bovis subsp bovis AF2122/97
uuggccucgagcgcuguggcc

SEQ ID NO: 3104972 - RNA, 12 nt, Mycobacterium bovis subsp bovis AF2122/97
uuggccugccgu

SEQ ID NO: 3104973 - RNA, 16 nt, Mycobacterium bovis subsp bovis AF2122/97
uuggccuugugcagau

SEQ ID NO: 3104974 - RNA, 13 nt, Mycobacterium bovis subsp bovis AF2122/97
uuggcgaagcccg

SEQ ID NO: 3104975 - RNA, 14 nt, Mycobacterium bovis subsp bovis AF2122/97
uuggcgaagcccga

SEQ ID NO: 3104976 - RNA, 13 nt, Mycobacterium bovis subsp bovis AF2122/97
uuggcgaccaugc

SEQ ID NO: 3104977 - RNA, 20 nt, Mycobacterium bovis subsp bovis AF2122/97
uuggcgacgaagaagaacuc

SEQ ID NO: 3104978 - RNA, 15 nt, Mycobacterium bovis subsp bovis AF2122/97
uuggcgacgaggcga

SEQ ID NO: 3104979 - RNA, 20 nt, Mycobacterium bovis subsp bovis AF2122/97
uuggcgacgucggcggugac

SEQ ID NO: 3104980 - RNA, 23 nt, Mycobacterium bovis subsp bovis AF2122/97
uuggcgacuucuucgcgcaacca

SEQ ID NO: 3104981 - RNA, 20 nt, Mycobacterium bovis subsp bovis AF2122/97
uuggcgaucaaugcgaugcg

SEQ ID NO: 3104982 - RNA, 13 nt, Mycobacterium bovis subsp bovis AF2122/97
uuggcgaucagca

SEQ ID NO: 3104983 - RNA, 16 nt, Mycobacterium bovis subsp bovis AF2122/97
uuggcgaucagcagcc

SEQ ID NO: 3104984 - RNA, 20 nt, Mycobacterium bovis subsp bovis AF2122/97
uuggcgaucccgccggggcc

SEQ ID NO: 3104985 - RNA, 13 nt, Mycobacterium bovis subsp bovis AF2122/97
uuggcgaucucga

SEQ ID NO: 3104986 - RNA, 16 nt, Mycobacterium bovis subsp bovis AF2122/97
uuggcgcccgaagccg

SEQ ID NO: 3104987 - RNA, 20 nt, Mycobacterium bovis subsp bovis AF2122/97
uuggcgcccgccggcaaccg

SEQ ID NO: 3104988 - RNA, 11 nt, Mycobacterium bovis subsp bovis AF2122/97
uuggcgccgau

SEQ ID NO: 3104989 - RNA, 16 nt, Mycobacterium bovis subsp bovis AF2122/97
uuggcgccgaugaccg

SEQ ID NO: 3104990 - RNA, 15 nt, Mycobacterium bovis subsp bovis AF2122/97
uuggcgcgcagguag

SEQ ID NO: 3104991 - RNA, 22 nt, Mycobacterium bovis subsp bovis AF2122/97
uuggcgcggcacccggucggcc

SEQ ID NO: 3104992 - RNA, 14 nt, Mycobacterium bovis subsp bovis AF2122/97
uuggcggccagcgu

SEQ ID NO: 3104993 - RNA, 13 nt, Mycobacterium bovis subsp bovis AF2122/97
uuggcggcgcgca

SEQ ID NO: 3104994 - RNA, 12 nt, Mycobacterium bovis subsp bovis AF2122/97
uuggcggcggca

SEQ ID NO: 3104995 - RNA, 23 nt, Mycobacterium bovis subsp bovis AF2122/97
uuggcggcggcauagugcgacug

SEQ ID NO: 3104996 - RNA, 22 nt, Mycobacterium bovis subsp bovis AF2122/97
uuggcggcggugcagcagggcg

SEQ ID NO: 3104997 - RNA, 16 nt, Mycobacterium bovis subsp bovis AF2122/97
uuggcgggaccgugac

SEQ ID NO: 3104998 - RNA, 23 nt, Mycobacterium bovis subsp bovis AF2122/97
uuggcgggcgccuuggucgccgc

SEQ ID NO: 3104999 - RNA, 19 nt, Mycobacterium bovis subsp bovis AF2122/97
uuggcgguaaaccacucgc

SEQ ID NO: 3105000 - RNA, 18 nt, Mycobacterium bovis subsp bovis AF2122/97
uuggcggucugcgccaaa

SEQ ID NO: 3105001 - RNA, 19 nt, Mycobacterium bovis subsp bovis AF2122/97
uuggcguagcaacccagga

SEQ ID NO: 3105002 - RNA, 18 nt, Mycobacterium bovis subsp bovis AF2122/97
uuggcguaguuccgcacc

SEQ ID NO: 3105003 - RNA, 19 nt, Mycobacterium bovis subsp bovis AF2122/97
uuggcguaguuccgcaccg

SEQ ID NO: 3105004 - RNA, 15 nt, Mycobacterium bovis subsp bovis AF2122/97
uuggcgucagcagca

SEQ ID NO: 3105005 - RNA, 21 nt, Mycobacterium bovis subsp bovis AF2122/97
uuggcgucgacaacacgccgu

SEQ ID NO: 3105006 - RNA, 15 nt, Mycobacterium bovis subsp bovis AF2122/97
uuggcgugcaccgca

SEQ ID NO: 3105007 - RNA, 15 nt, Mycobacterium bovis subsp bovis AF2122/97
uuggcucgcugggac

SEQ ID NO: 3105008 - RNA, 15 nt, Mycobacterium bovis subsp bovis AF2122/97
uuggcucggcgcagc

SEQ ID NO: 3105009 - RNA, 19 nt, Mycobacterium bovis subsp bovis AF2122/97
uuggcugagcagcgcggcc

SEQ ID NO: 3105010 - RNA, 10 nt, Mycobacterium bovis subsp bovis AF2122/97
uuggcugccg

SEQ ID NO: 3105011 - RNA, 17 nt, Mycobacterium bovis subsp bovis AF2122/97
uuggcugccuccaucaa

SEQ ID NO: 3105012 - RNA, 20 nt, Mycobacterium bovis subsp bovis AF2122/97
uuggcugcgagagcaccgac

SEQ ID NO: 3105013 - RNA, 16 nt, Mycobacterium bovis subsp bovis AF2122/97
uuggcugggcccgccg

SEQ ID NO: 3105014 - RNA, 14 nt, Mycobacterium bovis subsp bovis AF2122/97
uugggaaaagcccg

SEQ ID NO: 3105015 - RNA, 14 nt, Mycobacterium bovis subsp bovis AF2122/97
uugggagccaccgg

SEQ ID NO: 3105016 - RNA, 15 nt, Mycobacterium bovis subsp bovis AF2122/97
uugggcaccacccga

SEQ ID NO: 3105017 - RNA, 12 nt, Mycobacterium bovis subsp bovis AF2122/97
uugggccagcgc

SEQ ID NO: 3105018 - RNA, 18 nt, Mycobacterium bovis subsp bovis AF2122/97
uugggcgauuuugcgucu

SEQ ID NO: 3105019 - RNA, 19 nt, Mycobacterium bovis subsp bovis AF2122/97
uugggcgauuuugcgucuc

SEQ ID NO: 3105020 - RNA, 13 nt, Mycobacterium bovis subsp bovis AF2122/97
uugggcgccgacc

SEQ ID NO: 3105021 - RNA, 13 nt, Mycobacterium bovis subsp bovis AF2122/97
uugggcgccggug

SEQ ID NO: 3105022 - RNA, 22 nt, Mycobacterium bovis subsp bovis AF2122/97
uugggcuuagggcgcccgcccc

SEQ ID NO: 3105023 - RNA, 16 nt, Mycobacterium bovis subsp bovis AF2122/97
uuggggauggucccgc

SEQ ID NO: 3105024 - RNA, 22 nt, Mycobacterium bovis subsp bovis AF2122/97
uuggggcgcgugggcgugcagg

SEQ ID NO: 3105025 - RNA, 15 nt, Mycobacterium bovis subsp bovis AF2122/97
uuggggcugugcagg

SEQ ID NO: 3105026 - RNA, 20 nt, Mycobacterium bovis subsp bovis AF2122/97
uugggggcuucugcgucugc

SEQ ID NO: 3105027 - RNA, 19 nt, Mycobacterium bovis subsp bovis AF2122/97
uuggguagccugaccagcc

SEQ ID NO: 3105028 - RNA, 13 nt, Mycobacterium bovis subsp bovis AF2122/97
uuggguagcggau

SEQ ID NO: 3105029 - RNA, 21 nt, Mycobacterium bovis subsp bovis AF2122/97
uugggugcgccgucagcccag

SEQ ID NO: 3105030 - RNA, 17 nt, Mycobacterium bovis subsp bovis AF2122/97
uugggugggugcagcac

SEQ ID NO: 3105031 - RNA, 13 nt, Mycobacterium bovis subsp bovis AF2122/97
uuggguuucgaca

SEQ ID NO: 3105032 - RNA, 15 nt, Mycobacterium bovis subsp bovis AF2122/97
uugguagccagggcg

SEQ ID NO: 3105033 - RNA, 22 nt, Mycobacterium bovis subsp bovis AF2122/97
uugguagccggccgcuuggccg

SEQ ID NO: 3105034 - RNA, 14 nt, Mycobacterium bovis subsp bovis AF2122/97
uugguaguccugcu

SEQ ID NO: 3105035 - RNA, 14 nt, Mycobacterium bovis subsp bovis AF2122/97
uugguccgccgucg

SEQ ID NO: 3105036 - RNA, 11 nt, Mycobacterium bovis subsp bovis AF2122/97
uuggucgccau

SEQ ID NO: 3105037 - RNA, 15 nt, Mycobacterium bovis subsp bovis AF2122/97
uuggucgcgaugacg

SEQ ID NO: 3105038 - RNA, 14 nt, Mycobacterium bovis subsp bovis AF2122/97
uuggucuugaaccc

SEQ ID NO: 3105039 - RNA, 14 nt, Mycobacterium bovis subsp bovis AF2122/97
uuggugaacggugc

SEQ ID NO: 3105040 - RNA, 15 nt, Mycobacterium bovis subsp bovis AF2122/97
uuggugaggugguca

SEQ ID NO: 3105041 - RNA, 22 nt, Mycobacterium bovis subsp bovis AF2122/97
uuggugagguggucagccggug

SEQ ID NO: 3105042 - RNA, 18 nt, Mycobacterium bovis subsp bovis AF2122/97
uuggugaguagauugcug

SEQ ID NO: 3105043 - RNA, 16 nt, Mycobacterium bovis subsp bovis AF2122/97
uuggugauggccgacg

SEQ ID NO: 3105044 - RNA, 18 nt, Mycobacterium bovis subsp bovis AF2122/97
uuggugcagaccaccgcc

SEQ ID NO: 3105045 - RNA, 15 nt, Mycobacterium bovis subsp bovis AF2122/97
uuggugccgccugug

SEQ ID NO: 3105046 - RNA, 22 nt, Mycobacterium bovis subsp bovis AF2122/97
uugguggauucgaucaggccuu

SEQ ID NO: 3105047 - RNA, 17 nt, Mycobacterium bovis subsp bovis AF2122/97
uuggugggccagcagca

SEQ ID NO: 3105048 - RNA, 18 nt, Mycobacterium bovis subsp bovis AF2122/97
uuggugggccagcagcaa

SEQ ID NO: 3105049 - RNA, 15 nt, Mycobacterium bovis subsp bovis AF2122/97
uugguggucgccacc

SEQ ID NO: 3105050 - RNA, 13 nt, Mycobacterium bovis subsp bovis AF2122/97
uugguguccacca

SEQ ID NO: 3105051 - RNA, 16 nt, Mycobacterium bovis subsp bovis AF2122/97
uugguguucgggucga

SEQ ID NO: 3105052 - RNA, 18 nt, Mycobacterium bovis subsp bovis AF2122/97
uugguugcgccaggaacc

SEQ ID NO: 3105053 - RNA, 17 nt, Mycobacterium bovis subsp bovis AF2122/97
uuguagcgggcaagaug

SEQ ID NO: 3105054 - RNA, 16 nt, Mycobacterium bovis subsp bovis AF2122/97
uuguaugcugcgcgcc

SEQ ID NO: 3105055 - RNA, 18 nt, Mycobacterium bovis subsp bovis AF2122/97
uugucaccggcuucggcc

SEQ ID NO: 3105056 - RNA, 18 nt, Mycobacterium bovis subsp bovis AF2122/97
uugucacgcaccgcggug

SEQ ID NO: 3105057 - RNA, 13 nt, Mycobacterium bovis subsp bovis AF2122/97
uugucacugcggc

SEQ ID NO: 3105058 - RNA, 23 nt, Mycobacterium bovis subsp bovis AF2122/97
uugucagcgaacggccaggacaa

SEQ ID NO: 3105059 - RNA, 19 nt, Mycobacterium bovis subsp bovis AF2122/97
uugucaggauauuucuaaa

SEQ ID NO: 3105060 - RNA, 19 nt, Mycobacterium bovis subsp bovis AF2122/97
uuguccacgaggcaaccag

SEQ ID NO: 3105061 - RNA, 12 nt, Mycobacterium bovis subsp bovis AF2122/97
uuguccggugag

SEQ ID NO: 3105062 - RNA, 24 nt, Mycobacterium bovis subsp bovis AF2122/97
uuguccugaaaacaccgcacggug

SEQ ID NO: 3105063 - RNA, 17 nt, Mycobacterium bovis subsp bovis AF2122/97
uuguccuucagccaguc

SEQ ID NO: 3105064 - RNA, 22 nt, Mycobacterium bovis subsp bovis AF2122/97
uugucgaucagaaucugccucu

SEQ ID NO: 3105065 - RNA, 13 nt, Mycobacterium bovis subsp bovis AF2122/97
uugucgcagcgca

SEQ ID NO: 3105066 - RNA, 17 nt, Mycobacterium bovis subsp bovis AF2122/97
uugucgccggaguucug

SEQ ID NO: 3105067 - RNA, 15 nt, Mycobacterium bovis subsp bovis AF2122/97
uugucgcggagucug

SEQ ID NO: 3105068 - RNA, 16 nt, Mycobacterium bovis subsp bovis AF2122/97
uugucgcggagucugc

SEQ ID NO: 3105069 - RNA, 15 nt, Mycobacterium bovis subsp bovis AF2122/97
uugucgcggucagga

SEQ ID NO: 3105070 - RNA, 21 nt, Mycobacterium bovis subsp bovis AF2122/97
uugucggcaacgacccgccgc

SEQ ID NO: 3105071 - RNA, 11 nt, Mycobacterium bovis subsp bovis AF2122/97
uugucggcgau

SEQ ID NO: 3105072 - RNA, 19 nt, Mycobacterium bovis subsp bovis AF2122/97
uugucggcuggacggcgcc

SEQ ID NO: 3105073 - RNA, 14 nt, Mycobacterium bovis subsp bovis AF2122/97
uugucgggauuggc

SEQ ID NO: 3105074 - RNA, 20 nt, Mycobacterium bovis subsp bovis AF2122/97
uugucgguaggugucaauga

SEQ ID NO: 3105075 - RNA, 17 nt, Mycobacterium bovis subsp bovis AF2122/97
uugucguagcgacgcca

SEQ ID NO: 3105076 - RNA, 18 nt, Mycobacterium bovis subsp bovis AF2122/97
uugucgucgccggcggcg

SEQ ID NO: 3105077 - RNA, 21 nt, Mycobacterium bovis subsp bovis AF2122/97
uugucuagcggucgcuugcug

SEQ ID NO: 3105078 - RNA, 21 nt, Mycobacterium bovis subsp bovis AF2122/97
uugucugcccgauacccggug

SEQ ID NO: 3105079 - RNA, 17 nt, Mycobacterium bovis subsp bovis AF2122/97
uugugacggugaauuca

SEQ ID NO: 3105080 - RNA, 14 nt, Mycobacterium bovis subsp bovis AF2122/97
uugugcccgccggc

SEQ ID NO: 3105081 - RNA, 18 nt, Mycobacterium bovis subsp bovis AF2122/97
uugugcgcacucuuuccu

SEQ ID NO: 3105082 - RNA, 14 nt, Mycobacterium bovis subsp bovis AF2122/97
uugugcggccccgu

SEQ ID NO: 3105083 - RNA, 22 nt, Mycobacterium bovis subsp bovis AF2122/97
uugugcucgccgauuuggccgu

SEQ ID NO: 3105084 - RNA, 14 nt, Mycobacterium bovis subsp bovis AF2122/97
uugugcugggugcc

SEQ ID NO: 3105085 - RNA, 15 nt, Mycobacterium bovis subsp bovis AF2122/97
uuguggcguguggcu

SEQ ID NO: 3105086 - RNA, 21 nt, Mycobacterium bovis subsp bovis AF2122/97
uugugggugcgacggcaggua

SEQ ID NO: 3105087 - RNA, 17 nt, Mycobacterium bovis subsp bovis AF2122/97
uuguggucgaguugaag

SEQ ID NO: 3105088 - RNA, 16 nt, Mycobacterium bovis subsp bovis AF2122/97
uuguuaucgaagcccg

SEQ ID NO: 3105089 - RNA, 12 nt, Mycobacterium bovis subsp bovis AF2122/97
uuguucaacucg

SEQ ID NO: 3105090 - RNA, 23 nt, Mycobacterium bovis subsp bovis AF2122/97
uuguucgugaagcgggugccauc

SEQ ID NO: 3105091 - RNA, 14 nt, Mycobacterium bovis subsp bovis AF2122/97
uuguucgugccggc

SEQ ID NO: 3105092 - RNA, 14 nt, Mycobacterium bovis subsp bovis AF2122/97
uuguugaagccgau

SEQ ID NO: 3105093 - RNA, 21 nt, Mycobacterium bovis subsp bovis AF2122/97
uuguugccccggucggcgacg

SEQ ID NO: 3105094 - RNA, 23 nt, Mycobacterium bovis subsp bovis AF2122/97
uuguugccgacgaucgacgccgc

SEQ ID NO: 3105095 - RNA, 14 nt, Mycobacterium bovis subsp bovis AF2122/97
uuguugccgccggc

SEQ ID NO: 3105096 - RNA, 17 nt, Mycobacterium bovis subsp bovis AF2122/97
uuguugcgcgacgccgc

SEQ ID NO: 3105097 - RNA, 15 nt, Mycobacterium bovis subsp bovis AF2122/97
uuguugcugcugccg

SEQ ID NO: 3105098 - RNA, 20 nt, Mycobacterium bovis subsp bovis AF2122/97
uuguuggccagaccgcgcgc

SEQ ID NO: 3105099 - RNA, 12 nt, Mycobacterium bovis subsp bovis AF2122/97
uuguuggccagu

SEQ ID NO: 3105100 - RNA, 16 nt, Mycobacterium bovis subsp bovis AF2122/97
uuguuuuugcacugaa

SEQ ID NO: 3105101 - RNA, 19 nt, Mycobacterium bovis subsp bovis AF2122/97
uuuagccgcuugggccugg

SEQ ID NO: 3105102 - RNA, 12 nt, Mycobacterium bovis subsp bovis AF2122/97
uuuaggcagccc

SEQ ID NO: 3105103 - RNA, 23 nt, Mycobacterium bovis subsp bovis AF2122/97
uuuagggugcccgcguugccaaa

SEQ ID NO: 3105104 - RNA, 14 nt, Mycobacterium bovis subsp bovis AF2122/97
uuucauucagugcc

SEQ ID NO: 3105105 - RNA, 19 nt, Mycobacterium bovis subsp bovis AF2122/97
uuuccacaccagcuuguag

SEQ ID NO: 3105106 - RNA, 17 nt, Mycobacterium bovis subsp bovis AF2122/97
uuuccaccguuagccag

SEQ ID NO: 3105107 - RNA, 15 nt, Mycobacterium bovis subsp bovis AF2122/97
uuuccaucgcgaccu

SEQ ID NO: 3105108 - RNA, 14 nt, Mycobacterium bovis subsp bovis AF2122/97
uuucccuggccgcc

SEQ ID NO: 3105109 - RNA, 16 nt, Mycobacterium bovis subsp bovis AF2122/97
uuucgauauagccgcc

SEQ ID NO: 3105110 - RNA, 22 nt, Mycobacterium bovis subsp bovis AF2122/97
uuucgauauagccgccggugcc

SEQ ID NO: 3105111 - RNA, 19 nt, Mycobacterium bovis subsp bovis AF2122/97
uuucgcgugcggcugccag

SEQ ID NO: 3105112 - RNA, 17 nt, Mycobacterium bovis subsp bovis AF2122/97
uuucggcgccgucgccc

SEQ ID NO: 3105113 - RNA, 12 nt, Mycobacterium bovis subsp bovis AF2122/97
uuucggcugccg

SEQ ID NO: 3105114 - RNA, 18 nt, Mycobacterium bovis subsp bovis AF2122/97
uuucgucggccauggugu

SEQ ID NO: 3105115 - RNA, 15 nt, Mycobacterium bovis subsp bovis AF2122/97
uuucgucgucgcagu

SEQ ID NO: 3105116 - RNA, 23 nt, Mycobacterium bovis subsp bovis AF2122/97
uuucguugggagaguguugaucu

SEQ ID NO: 3105117 - RNA, 22 nt, Mycobacterium bovis subsp bovis AF2122/97
uuugacgacaaacggcgaccca

SEQ ID NO: 3105118 - RNA, 18 nt, Mycobacterium bovis subsp bovis AF2122/97
uuugacgcccucggcgac

SEQ ID NO: 3105119 - RNA, 20 nt, Mycobacterium bovis subsp bovis AF2122/97
uuugacguccagggccacga

SEQ ID NO: 3105120 - RNA, 19 nt, Mycobacterium bovis subsp bovis AF2122/97
uuugagcagguaggcgcga

SEQ ID NO: 3105121 - RNA, 21 nt, Mycobacterium bovis subsp bovis AF2122/97
uuugcacgcaccacaauccac

SEQ ID NO: 3105122 - RNA, 14 nt, Mycobacterium bovis subsp bovis AF2122/97
uuugcagccuucga

SEQ ID NO: 3105123 - RNA, 20 nt, Mycobacterium bovis subsp bovis AF2122/97
uuugccccguugagcagcac

SEQ ID NO: 3105124 - RNA, 11 nt, Mycobacterium bovis subsp bovis AF2122/97
uuugccgccgg

SEQ ID NO: 3105125 - RNA, 22 nt, Mycobacterium bovis subsp bovis AF2122/97
uuugccgccggcaccgccggug

SEQ ID NO: 3105126 - RNA, 17 nt, Mycobacterium bovis subsp bovis AF2122/97
uuugccgguucggcgau

SEQ ID NO: 3105127 - RNA, 13 nt, Mycobacterium bovis subsp bovis AF2122/97
uuugcgaagccca

SEQ ID NO: 3105128 - RNA, 20 nt, Mycobacterium bovis subsp bovis AF2122/97
uuugcgaaucggcccgugcc

SEQ ID NO: 3105129 - RNA, 21 nt, Mycobacterium bovis subsp bovis AF2122/97
uuugcgccaggaguggccacg

SEQ ID NO: 3105130 - RNA, 20 nt, Mycobacterium bovis subsp bovis AF2122/97
uuugcguucccaucccucag

SEQ ID NO: 3105131 - RNA, 15 nt, Mycobacterium bovis subsp bovis AF2122/97
uuuggccgccguggc

SEQ ID NO: 3105132 - RNA, 19 nt, Mycobacterium bovis subsp bovis AF2122/97
uuugggcgauuuugcgucu

SEQ ID NO: 3105133 - RNA, 20 nt, Mycobacterium bovis subsp bovis AF2122/97
uuugucgcggagucugcuga

SEQ ID NO: 3105134 - RNA, 15 nt, Mycobacterium bovis subsp bovis AF2122/97
uuuuacgucugcucg

SEQ ID NO: 3105135 - RNA, 20 nt, Mycobacterium bovis subsp bovis AF2122/97
uuuucgaucgcuugccccgc

SEQ ID NO: 3105136 - RNA, 15 nt, Mycobacterium bovis subsp bovis AF2122/97
uuuucggcggcucua

SEQ ID NO: 3105137 - RNA, 19 nt, Mycobacterium bovis subsp bovis AF2122/97
uuuugcgucugcucgccag

SEQ ID NO: 3105138 - RNA, 23 nt, Mycobacterium bovis subsp bovis AF2122/97
uuuugcgucugcucgcgccggug

SEQ ID NO: 3105139 - RNA, 20 nt, Mycobacterium bovis subsp bovis AF2122/97
uuuugcgucugcucggcgca

SEQ ID NO: 3105140 - RNA, 13 nt, Mycobacterium bovis subsp bovis AF2122/97
uuuugcugcaugc

SEQ ID NO: 3105141 - RNA, 21 nt, Mycobacterium bovis subsp bovis AF2122/97
uuuugggaucgugccggcgaa

SEQ ID NO: 3105142 - RNA, 14 nt, Mycobacterium bovis subsp bovis AF2122/97
uuuugucaggauau

SEQ ID NO: 3105143 - RNA, 17 nt, Mycobacterium bovis subsp bovis AF2122/97
ugcgcgugacgaccagc

SEQ ID NO: 3105144 - RNA, 16 nt, Mycobacterium bovis subsp bovis AF2122/97
ugcgcguggcagugca

SEQ ID NO: 3105145 - RNA, 18 nt, Mycobacterium bovis subsp bovis AF2122/97
ugcgcguuacccaucgcc

SEQ ID NO: 3105146 - RNA, 13 nt, Mycobacterium bovis subsp bovis AF2122/97
ugcgcuaggugcg

SEQ ID NO: 3105147 - RNA, 14 nt, Mycobacterium bovis subsp bovis AF2122/97
ugcgcucacugcag

SEQ ID NO: 3105148 - RNA, 23 nt, Mycobacterium bovis subsp bovis AF2122/97
ugcgcucacugcagcgccucgau

SEQ ID NO: 3105149 - RNA, 14 nt, Mycobacterium bovis subsp bovis AF2122/97
ugcgcucacuggcg

SEQ ID NO: 3105150 - RNA, 15 nt, Mycobacterium bovis subsp bovis AF2122/97
ugcgcucacuggcga

SEQ ID NO: 3105151 - RNA, 13 nt, Mycobacterium bovis subsp bovis AF2122/97
ugcgcucgcggau

SEQ ID NO: 3105152 - RNA, 21 nt, Mycobacterium bovis subsp bovis AF2122/97
ugcgcucguugguucagcucg

SEQ ID NO: 3105153 - RNA, 14 nt, Mycobacterium bovis subsp bovis AF2122/97
ugcgcugcaccggg

SEQ ID NO: 3105154 - RNA, 14 nt, Mycobacterium bovis subsp bovis AF2122/97
ugcgcugcagcuga

SEQ ID NO: 3105155 - RNA, 16 nt, Mycobacterium bovis subsp bovis AF2122/97
ugcgcugcggccagcg

SEQ ID NO: 3105156 - RNA, 18 nt, Mycobacterium bovis subsp bovis AF2122/97
ugcgcugcucacgcagca

SEQ ID NO: 3105157 - RNA, 11 nt, Mycobacterium bovis subsp bovis AF2122/97
ugcgcuggagg

SEQ ID NO: 3105158 - RNA, 22 nt, Mycobacterium bovis subsp bovis AF2122/97
ugcgcuggaggcuccuggucgc

SEQ ID NO: 3105159 - RNA, 16 nt, Mycobacterium bovis subsp bovis AF2122/97
ugcgcuggcgccgccg

SEQ ID NO: 3105160 - RNA, 12 nt, Mycobacterium bovis subsp bovis AF2122/97
ugcgcuggcggc

SEQ ID NO: 3105161 - RNA, 14 nt, Mycobacterium bovis subsp bovis AF2122/97
ugcgcugggccagg

SEQ ID NO: 3105162 - RNA, 19 nt, Mycobacterium bovis subsp bovis AF2122/97
ugcgcugguggcggcgaca

SEQ ID NO: 3105163 - RNA, 17 nt, Mycobacterium bovis subsp bovis AF2122/97
ugcgcuguugcuggcgc

SEQ ID NO: 3105164 - RNA, 20 nt, Mycobacterium bovis subsp bovis AF2122/97
ugcgcuucauagguucggua

SEQ ID NO: 3105165 - RNA, 14 nt, Mycobacterium bovis subsp bovis AF2122/97
ugcgcuuccaucgc

SEQ ID NO: 3105166 - RNA, 16 nt, Mycobacterium bovis subsp bovis AF2122/97
ugcgcuugcggccgcg

SEQ ID NO: 3105167 - RNA, 16 nt, Mycobacterium bovis subsp bovis AF2122/97
ugcgcuuggucgaccg

SEQ ID NO: 3105168 - RNA, 20 nt, Mycobacterium bovis subsp bovis AF2122/97
ugcgcuuggucgaccgccga

SEQ ID NO: 3105169 - RNA, 16 nt, Mycobacterium bovis subsp bovis AF2122/97
ugcggaaacccggccg

SEQ ID NO: 3105170 - RNA, 17 nt, Mycobacterium bovis subsp bovis AF2122/97
ugcggaaacccggccgc

SEQ ID NO: 3105171 - RNA, 13 nt, Mycobacterium bovis subsp bovis AF2122/97
ugcggaaaucgga

SEQ ID NO: 3105172 - RNA, 18 nt, Mycobacterium bovis subsp bovis AF2122/97
ugcggaacaccaccaggc

SEQ ID NO: 3105173 - RNA, 20 nt, Mycobacterium bovis subsp bovis AF2122/97
ugcggaacaccaccaggcug

SEQ ID NO: 3105174 - RNA, 22 nt, Mycobacterium bovis subsp bovis AF2122/97
ugcggaacaccaccaggcuguc

SEQ ID NO: 3105175 - RNA, 18 nt, Mycobacterium bovis subsp bovis AF2122/97
ugcggaacaccagcaggc

SEQ ID NO: 3105176 - RNA, 17 nt, Mycobacterium bovis subsp bovis AF2122/97
ugcggaacaccgcccgg

SEQ ID NO: 3105177 - RNA, 23 nt, Mycobacterium bovis subsp bovis AF2122/97
ugcggaacaccgcccggcccggc

SEQ ID NO: 3105178 - RNA, 19 nt, Mycobacterium bovis subsp bovis AF2122/97
ugcggaaccugcucggccg

SEQ ID NO: 3105179 - RNA, 17 nt, Mycobacterium bovis subsp bovis AF2122/97
ugcggaagcaucggcug

SEQ ID NO: 3105180 - RNA, 14 nt, Mycobacterium bovis subsp bovis AF2122/97
ugcggaagccaccg

SEQ ID NO: 3105181 - RNA, 14 nt, Mycobacterium bovis subsp bovis AF2122/97
ugcggaaucagcac

SEQ ID NO: 3105182 - RNA, 15 nt, Mycobacterium bovis subsp bovis AF2122/97
ugcggaaucagcacc

SEQ ID NO: 3105183 - RNA, 19 nt, Mycobacterium bovis subsp bovis AF2122/97
ugcggaaucagcaccccau

SEQ ID NO: 3105184 - RNA, 17 nt, Mycobacterium bovis subsp bovis AF2122/97
ugcggacaagucggcac

SEQ ID NO: 3105185 - RNA, 18 nt, Mycobacterium bovis subsp bovis AF2122/97
ugcggacaguucccggcc

SEQ ID NO: 3105186 - RNA, 16 nt, Mycobacterium bovis subsp bovis AF2122/97
ugcggacaucaccggc

SEQ ID NO: 3105187 - RNA, 18 nt, Mycobacterium bovis subsp bovis AF2122/97
ugcggaccugcgccggug

SEQ ID NO: 3105188 - RNA, 18 nt, Mycobacterium bovis subsp bovis AF2122/97
ugcggaccuggcggcggu

SEQ ID NO: 3105189 - RNA, 19 nt, Mycobacterium bovis subsp bovis AF2122/97
ugcggacgguguacagguc

SEQ ID NO: 3105190 - RNA, 19 nt, Mycobacterium bovis subsp bovis AF2122/97
ugcggacuggcauccgccc

SEQ ID NO: 3105191 - RNA, 17 nt, Mycobacterium bovis subsp bovis AF2122/97
ugcggacuucgccgccc

SEQ ID NO: 3105192 - RNA, 18 nt, Mycobacterium bovis subsp bovis AF2122/97
ugcggacuucgccgcccg

SEQ ID NO: 3105193 - RNA, 14 nt, Mycobacterium bovis subsp bovis AF2122/97
ugcggagccgccgc

SEQ ID NO: 3105194 - RNA, 16 nt, Mycobacterium bovis subsp bovis AF2122/97
ugcggaggcgaccccg

SEQ ID NO: 3105195 - RNA, 21 nt, Mycobacterium bovis subsp bovis AF2122/97
ugcggauagugguugcggccg

SEQ ID NO: 3105196 - RNA, 24 nt, Mycobacterium bovis subsp bovis AF2122/97
ugcggauauuccuuuaacgcaggc

SEQ ID NO: 3105197 - RNA, 20 nt, Mycobacterium bovis subsp bovis AF2122/97
ugcggaucacucccccacac

SEQ ID NO: 3105198 - RNA, 23 nt, Mycobacterium bovis subsp bovis AF2122/97
ugcggaucacucccccacacacc

SEQ ID NO: 3105199 - RNA, 23 nt, Mycobacterium bovis subsp bovis AF2122/97
ugcggaucgauucgucgcggauc

SEQ ID NO: 3105200 - RNA, 15 nt, Mycobacterium bovis subsp bovis AF2122/97
ugcggaucggcggac

SEQ ID NO: 3105201 - RNA, 23 nt, Mycobacterium bovis subsp bovis AF2122/97
ugcggauuucgugucgcugcggc

SEQ ID NO: 3105202 - RNA, 17 nt, Mycobacterium bovis subsp bovis AF2122/97
ugcggcaacagcggggu

SEQ ID NO: 3105203 - RNA, 22 nt, Mycobacterium bovis subsp bovis AF2122/97
ugcggcaacgaggucugcggcc

SEQ ID NO: 3105204 - RNA, 23 nt, Mycobacterium bovis subsp bovis AF2122/97
ugcggcaacgaggucugcggccg

SEQ ID NO: 3105205 - RNA, 14 nt, Mycobacterium bovis subsp bovis AF2122/97
ugcggcaagcgcac

SEQ ID NO: 3105206 - RNA, 16 nt, Mycobacterium bovis subsp bovis AF2122/97
ugcggcacucccuggg

SEQ ID NO: 3105207 - RNA, 19 nt, Mycobacterium bovis subsp bovis AF2122/97
ugcggcacucccuggggua

SEQ ID NO: 3105208 - RNA, 15 nt, Mycobacterium bovis subsp bovis AF2122/97
ugcggcagaccaagc

SEQ ID NO: 3105209 - RNA, 14 nt, Mycobacterium bovis subsp bovis AF2122/97
ugcggcagcccccg

SEQ ID NO: 3105210 - RNA, 17 nt, Mycobacterium bovis subsp bovis AF2122/97
ugcggcagcccccggau

SEQ ID NO: 3105211 - RNA, 13 nt, Mycobacterium bovis subsp bovis AF2122/97
ugcggcagcgcgg

SEQ ID NO: 3105212 - RNA, 16 nt, Mycobacterium bovis subsp bovis AF2122/97
ugcggcagcgcggcca

SEQ ID NO: 3105213 - RNA, 22 nt, Mycobacterium bovis subsp bovis AF2122/97
ugcggcagcggguuugccgggc

SEQ ID NO: 3105214 - RNA, 12 nt, Mycobacterium bovis subsp bovis AF2122/97
ugcggcagcggu

SEQ ID NO: 3105215 - RNA, 15 nt, Mycobacterium bovis subsp bovis AF2122/97
ugcggcagcgguggc

SEQ ID NO: 3105216 - RNA, 16 nt, Mycobacterium bovis subsp bovis AF2122/97
ugcggcagcuggcgca

SEQ ID NO: 3105217 - RNA, 18 nt, Mycobacterium bovis subsp bovis AF2122/97
ugcggcagcuggcgcagc

SEQ ID NO: 3105218 - RNA, 19 nt, Mycobacterium bovis subsp bovis AF2122/97
ugcggcagcuggcgcagcc

SEQ ID NO: 3105219 - RNA, 23 nt, Mycobacterium bovis subsp bovis AF2122/97
ugcggcaggucgaugcugccagc

SEQ ID NO: 3105220 - RNA, 17 nt, Mycobacterium bovis subsp bovis AF2122/97
ugcggcaguaccccucg

SEQ ID NO: 3105221 - RNA, 18 nt, Mycobacterium bovis subsp bovis AF2122/97
ugcggccacucgcccgau

SEQ ID NO: 3105222 - RNA, 12 nt, Mycobacterium bovis subsp bovis AF2122/97
ugcggccagcgc

SEQ ID NO: 3105223 - RNA, 21 nt, Mycobacterium bovis subsp bovis AF2122/97
ugcggccagcgcggcgcgcgg

SEQ ID NO: 3105224 - RNA, 23 nt, Mycobacterium bovis subsp bovis AF2122/97
ugcggccaggcgguacgggucgc

SEQ ID NO: 3105225 - RNA, 24 nt, Mycobacterium bovis subsp bovis AF2122/97
ugcggccauggucggucaagucug

SEQ ID NO: 3105226 - RNA, 16 nt, Mycobacterium bovis subsp bovis AF2122/97
ugcggcccaaccgguc

SEQ ID NO: 3105227 - RNA, 20 nt, Mycobacterium bovis subsp bovis AF2122/97
ugcggcccacaccagcgcag

SEQ ID NO: 3105228 - RNA, 23 nt, Mycobacterium bovis subsp bovis AF2122/97
ugcggccccgacacagcggcggg

SEQ ID NO: 3105229 - RNA, 20 nt, Mycobacterium bovis subsp bovis AF2122/97
ugcggccccgacauacgucg

SEQ ID NO: 3105230 - RNA, 12 nt, Mycobacterium bovis subsp bovis AF2122/97
ugcggccccguc

SEQ ID NO: 3105231 - RNA, 15 nt, Mycobacterium bovis subsp bovis AF2122/97
ugcggcccgggcucg

SEQ ID NO: 3105232 - RNA, 20 nt, Mycobacterium bovis subsp bovis AF2122/97
ugcggcccgggcucggcgaa

SEQ ID NO: 3105233 - RNA, 19 nt, Mycobacterium bovis subsp bovis AF2122/97
ugcggcccggguggcccgg

SEQ ID NO: 3105234 - RNA, 23 nt, Mycobacterium bovis subsp bovis AF2122/97
ugcggcccucgagcagugccgug

SEQ ID NO: 3105235 - RNA, 19 nt, Mycobacterium bovis subsp bovis AF2122/97
ugcggccgaauuccucaag

SEQ ID NO: 3105236 - RNA, 12 nt, Mycobacterium bovis subsp bovis AF2122/97
ugcggccgcgcg

SEQ ID NO: 3105237 - RNA, 15 nt, Mycobacterium bovis subsp bovis AF2122/97
ugcggccgcgcgccg

SEQ ID NO: 3105238 - RNA, 18 nt, Mycobacterium bovis subsp bovis AF2122/97
ugcggccgcugaucaaca

SEQ ID NO: 3105239 - RNA, 14 nt, Mycobacterium bovis subsp bovis AF2122/97
ugcggccgggucgc

SEQ ID NO: 3105240 - RNA, 15 nt, Mycobacterium bovis subsp bovis AF2122/97
ugcggccgucgaugg

SEQ ID NO: 3105241 - RNA, 14 nt, Mycobacterium bovis subsp bovis AF2122/97
ugcggccuagggcg

SEQ ID NO: 3105242 - RNA, 22 nt, Mycobacterium bovis subsp bovis AF2122/97
ugcggccuuggcgacgucgcgg

SEQ ID NO: 3105243 - RNA, 14 nt, Mycobacterium bovis subsp bovis AF2122/97
ugcggcgaccaggu

SEQ ID NO: 3105244 - RNA, 23 nt, Mycobacterium bovis subsp bovis AF2122/97
ugcggcgaccgucaaccugcugc

SEQ ID NO: 3105245 - RNA, 19 nt, Mycobacterium bovis subsp bovis AF2122/97
ugcggcgaggacgcgcccg

SEQ ID NO: 3105246 - RNA, 17 nt, Mycobacterium bovis subsp bovis AF2122/97
ugcggcgcagcgacgcg

SEQ ID NO: 3105247 - RNA, 13 nt, Mycobacterium bovis subsp bovis AF2122/97
ugcggcgcgucgc

SEQ ID NO: 3105248 - RNA, 16 nt, Mycobacterium bovis subsp bovis AF2122/97
ugcggcgcuggccagc

SEQ ID NO: 3105249 - RNA, 18 nt, Mycobacterium bovis subsp bovis AF2122/97
ugcggcgcuggccagcag

SEQ ID NO: 3105250 - RNA, 20 nt, Mycobacterium bovis subsp bovis AF2122/97
ugcggcggcgcucgucgauc

SEQ ID NO: 3105251 - RNA, 23 nt, Mycobacterium bovis subsp bovis AF2122/97
ugcggcggcgcucgucgaucucc

SEQ ID NO: 3105252 - RNA, 13 nt, Mycobacterium bovis subsp bovis AF2122/97
ugcggcggcugcc

SEQ ID NO: 3105253 - RNA, 19 nt, Mycobacterium bovis subsp bovis AF2122/97
ugcggcguauugcggccug

SEQ ID NO: 3105254 - RNA, 20 nt, Mycobacterium bovis subsp bovis AF2122/97
ugcggcgucgaacugccgga

SEQ ID NO: 3105255 - RNA, 22 nt, Mycobacterium bovis subsp bovis AF2122/97
ugcggcgucguugaggaagccc

SEQ ID NO: 3105256 - RNA, 14 nt, Mycobacterium bovis subsp bovis AF2122/97
ugcggcguggauca

SEQ ID NO: 3105257 - RNA, 23 nt, Mycobacterium bovis subsp bovis AF2122/97
ugcggcguuggugcagucggugc

SEQ ID NO: 3105258 - RNA, 16 nt, Mycobacterium bovis subsp bovis AF2122/97
ugcggcuauuggccug

SEQ ID NO: 3105259 - RNA, 17 nt, Mycobacterium bovis subsp bovis AF2122/97
ugcggcucgcugaucug

SEQ ID NO: 3105260 - RNA, 23 nt, Mycobacterium bovis subsp bovis AF2122/97
ugcggcugaauucggcgagcgcc

SEQ ID NO: 3105261 - RNA, 16 nt, Mycobacterium bovis subsp bovis AF2122/97
ugcggcugcguuggcu

SEQ ID NO: 3105262 - RNA, 13 nt, Mycobacterium bovis subsp bovis AF2122/97
ugcggcuggcgcc

SEQ ID NO: 3105263 - RNA, 18 nt, Mycobacterium bovis subsp bovis AF2122/97
ugcggcugguguccagcc

SEQ ID NO: 3105264 - RNA, 22 nt, Mycobacterium bovis subsp bovis AF2122/97
ugcggcugguguccagccaggc

SEQ ID NO: 3105265 - RNA, 14 nt, Mycobacterium bovis subsp bovis AF2122/97
ugcgggaaccccag

SEQ ID NO: 3105266 - RNA, 18 nt, Mycobacterium bovis subsp bovis AF2122/97
ugcgggaaguugcccagg

SEQ ID NO: 3105267 - RNA, 15 nt, Mycobacterium bovis subsp bovis AF2122/97
ugcgggacgccgaau

SEQ ID NO: 3105268 - RNA, 15 nt, Mycobacterium bovis subsp bovis AF2122/97
ugcgggacuugucgg

SEQ ID NO: 3105269 - RNA, 19 nt, Mycobacterium bovis subsp bovis AF2122/97
ugcgggacuugucggggug

SEQ ID NO: 3105270 - RNA, 15 nt, Mycobacterium bovis subsp bovis AF2122/97
ugcgggcaugccggc

SEQ ID NO: 3105271 - RNA, 13 nt, Mycobacterium bovis subsp bovis AF2122/97
ugcgggccaggcc

SEQ ID NO: 3105272 - RNA, 21 nt, Mycobacterium bovis subsp bovis AF2122/97
ugcgggccaggcccucgacgg

SEQ ID NO: 3105273 - RNA, 15 nt, Mycobacterium bovis subsp bovis AF2122/97
ugcgggcccacgccc

SEQ ID NO: 3105274 - RNA, 23 nt, Mycobacterium bovis subsp bovis AF2122/97
ugcgggcccucuaugcgggcagc

SEQ ID NO: 3105275 - RNA, 15 nt, Mycobacterium bovis subsp bovis AF2122/97
ugcgggccgccaggc

SEQ ID NO: 3105276 - RNA, 19 nt, Mycobacterium bovis subsp bovis AF2122/97
ugcgggccgugacccucag

SEQ ID NO: 3105277 - RNA, 23 nt, Mycobacterium bovis subsp bovis AF2122/97
ugcgggccuccugcuggcccugc

SEQ ID NO: 3105278 - RNA, 19 nt, Mycobacterium bovis subsp bovis AF2122/97
ugcgggcgggaaccccggc

SEQ ID NO: 3105279 - RNA, 11 nt, Mycobacterium bovis subsp bovis AF2122/97
ugcgggcuagg

SEQ ID NO: 3105280 - RNA, 20 nt, Mycobacterium bovis subsp bovis AF2122/97
ugcgggcucguguccgccgu

SEQ ID NO: 3105281 - RNA, 14 nt, Mycobacterium bovis subsp bovis AF2122/97
ugcggggccgggcg

SEQ ID NO: 3105282 - RNA, 20 nt, Mycobacterium bovis subsp bovis AF2122/97
ugcggggccgggcgaucgcc

SEQ ID NO: 3105283 - RNA, 17 nt, Mycobacterium bovis subsp bovis AF2122/97
ugcggggcgccugaugc

SEQ ID NO: 3105284 - RNA, 23 nt, Mycobacterium bovis subsp bovis AF2122/97
ugcggggcgccugaugcggccgg

SEQ ID NO: 3105285 - RNA, 17 nt, Mycobacterium bovis subsp bovis AF2122/97
ugcgggggacacgucgu

SEQ ID NO: 3105286 - RNA, 17 nt, Mycobacterium bovis subsp bovis AF2122/97
ugcgggggacgggucgc

SEQ ID NO: 3105287 - RNA, 20 nt, Mycobacterium bovis subsp bovis AF2122/97
ugcgggggcuuaugcgucug

SEQ ID NO: 3105288 - RNA, 21 nt, Mycobacterium bovis subsp bovis AF2122/97
ugcggggggccuuaucccacc

SEQ ID NO: 3105289 - RNA, 24 nt, Mycobacterium bovis subsp bovis AF2122/97
ugcggggguacgucaccggguccg

SEQ ID NO: 3105290 - RNA, 17 nt, Mycobacterium bovis subsp bovis AF2122/97
ugcgggguugaccgugg

SEQ ID NO: 3105291 - RNA, 22 nt, Mycobacterium bovis subsp bovis AF2122/97
ugcgggguugaccguggucgga

SEQ ID NO: 3105292 - RNA, 17 nt, Mycobacterium bovis subsp bovis AF2122/97
ugcggguaaaccaggug

SEQ ID NO: 3105293 - RNA, 20 nt, Mycobacterium bovis subsp bovis AF2122/97
ugcggguagccgucgauccc

SEQ ID NO: 3105294 - RNA, 23 nt, Mycobacterium bovis subsp bovis AF2122/97
ugcggguagccgucgaucccggu

SEQ ID NO: 3105295 - RNA, 20 nt, Mycobacterium bovis subsp bovis AF2122/97
ugcggguaggugacgacguc

SEQ ID NO: 3105296 - RNA, 14 nt, Mycobacterium bovis subsp bovis AF2122/97
ugcgggucagcgcc

SEQ ID NO: 3105297 - RNA, 15 nt, Mycobacterium bovis subsp bovis AF2122/97
ugcgggucagcgccg

SEQ ID NO: 3105298 - RNA, 21 nt, Mycobacterium bovis subsp bovis AF2122/97
ugcgggucccaaucgucggcc

SEQ ID NO: 3105299 - RNA, 21 nt, Mycobacterium bovis subsp bovis AF2122/97
ugcgggucguccgccugcacc

SEQ ID NO: 3105300 - RNA, 16 nt, Mycobacterium bovis subsp bovis AF2122/97
ugcgggucucgccgac

SEQ ID NO: 3105301 - RNA, 17 nt, Mycobacterium bovis subsp bovis AF2122/97
ugcgggugcgucgauga

SEQ ID NO: 3105302 - RNA, 16 nt, Mycobacterium bovis subsp bovis AF2122/97
ugcgggugggcacacc

SEQ ID NO: 3105303 - RNA, 17 nt, Mycobacterium bovis subsp bovis AF2122/97
ugcgggugucgggcagc

SEQ ID NO: 3105304 - RNA, 19 nt, Mycobacterium bovis subsp bovis AF2122/97
ugcgggugucgggcagcaa

SEQ ID NO: 3105305 - RNA, 15 nt, Mycobacterium bovis subsp bovis AF2122/97
ugcggguucgccgau

SEQ ID NO: 3105306 - RNA, 20 nt, Mycobacterium bovis subsp bovis AF2122/97
ugcgguaagaaucgaagcgg

SEQ ID NO: 3105307 - RNA, 17 nt, Mycobacterium bovis subsp bovis AF2122/97
ugcgguaaucgccaccg

SEQ ID NO: 3105308 - RNA, 21 nt, Mycobacterium bovis subsp bovis AF2122/97
ugcgguaaucgccaccgcaag

SEQ ID NO: 3105309 - RNA, 15 nt, Mycobacterium bovis subsp bovis AF2122/97
ugcgguaggcgguga

SEQ ID NO: 3105310 - RNA, 14 nt, Mycobacterium bovis subsp bovis AF2122/97
ugcgguaucgguca

SEQ ID NO: 3105311 - RNA, 16 nt, Mycobacterium bovis subsp bovis AF2122/97
ugcggucaacgacagc

SEQ ID NO: 3105312 - RNA, 19 nt, Mycobacterium bovis subsp bovis AF2122/97
ugcggucagauucggcgau

SEQ ID NO: 3105313 - RNA, 22 nt, Mycobacterium bovis subsp bovis AF2122/97
ugcggucauauaggagcgggug

SEQ ID NO: 3105314 - RNA, 17 nt, Mycobacterium bovis subsp bovis AF2122/97
ugcggucaucgcgucca

SEQ ID NO: 3105315 - RNA, 14 nt, Mycobacterium bovis subsp bovis AF2122/97
ugcgguccaggccg

SEQ ID NO: 3105316 - RNA, 16 nt, Mycobacterium bovis subsp bovis AF2122/97
ugcgguccaggccggc

SEQ ID NO: 3105317 - RNA, 19 nt, Mycobacterium bovis subsp bovis AF2122/97
ugcgguccaggccggcacc

SEQ ID NO: 3105318 - RNA, 13 nt, Mycobacterium bovis subsp bovis AF2122/97
ugcgguccggcuu

SEQ ID NO: 3105319 - RNA, 13 nt, Mycobacterium bovis subsp bovis AF2122/97
ugcgguccucgau

SEQ ID NO: 3105320 - RNA, 16 nt, Mycobacterium bovis subsp bovis AF2122/97
ugcgguccucgaucgg

SEQ ID NO: 3105321 - RNA, 16 nt, Mycobacterium bovis subsp bovis AF2122/97
ugcggucgcccaggcc

SEQ ID NO: 3105322 - RNA, 18 nt, Mycobacterium bovis subsp bovis AF2122/97
ugcggucgcggcugacaa

SEQ ID NO: 3105323 - RNA, 15 nt, Mycobacterium bovis subsp bovis AF2122/97
ugcggucggccacau

SEQ ID NO: 3105324 - RNA, 18 nt, Mycobacterium bovis subsp bovis AF2122/97
ugcggucucacucaucgg

SEQ ID NO: 3105325 - RNA, 17 nt, Mycobacterium bovis subsp bovis AF2122/97
ugcggugacaaccgcgc

SEQ ID NO: 3105326 - RNA, 20 nt, Mycobacterium bovis subsp bovis AF2122/97
ugcggugauggacugaucgc

SEQ ID NO: 3105327 - RNA, 22 nt, Mycobacterium bovis subsp bovis AF2122/97
ugcggugcacaaaauacuccgc

SEQ ID NO: 3105328 - RNA, 22 nt, Mycobacterium bovis subsp bovis AF2122/97
ugcggugcaggauucggcgguc

SEQ ID NO: 3105329 - RNA, 23 nt, Mycobacterium bovis subsp bovis AF2122/97
ugcggugccacggugacccuggu

SEQ ID NO: 3105330 - RNA, 16 nt, Mycobacterium bovis subsp bovis AF2122/97
ugcggugccguggugg

SEQ ID NO: 3105331 - RNA, 15 nt, Mycobacterium bovis subsp bovis AF2122/97
ugcgguggccagugc

SEQ ID NO: 3105332 - RNA, 16 nt, Mycobacterium bovis subsp bovis AF2122/97
ugcggugggccagguu

SEQ ID NO: 3105333 - RNA, 14 nt, Mycobacterium bovis subsp bovis AF2122/97
ugcgguggugcgca

SEQ ID NO: 3105334 - RNA, 16 nt, Mycobacterium bovis subsp bovis AF2122/97
ugcgguguagggcggc

SEQ ID NO: 3105335 - RNA, 17 nt, Mycobacterium bovis subsp bovis AF2122/97
ugcggugucgggcuggg

SEQ ID NO: 3105336 - RNA, 18 nt, Mycobacterium bovis subsp bovis AF2122/97
ugcggugugugcaagccg

SEQ ID NO: 3105337 - RNA, 21 nt, Mycobacterium bovis subsp bovis AF2122/97
ugcgguucggacacacaggcg

SEQ ID NO: 3105338 - RNA, 21 nt, Mycobacterium bovis subsp bovis AF2122/97
ugcgguucucguagucaacca

SEQ ID NO: 3105339 - RNA, 23 nt, Mycobacterium bovis subsp bovis AF2122/97
ugcgguugcauaccgccgggccc

SEQ ID NO: 3105340 - RNA, 14 nt, Mycobacterium bovis subsp bovis AF2122/97
ugcgguuguucgug

SEQ ID NO: 3105341 - RNA, 22 nt, Mycobacterium bovis subsp bovis AF2122/97
ugcgguuguucgugaagcgggu

SEQ ID NO: 3105342 - RNA, 17 nt, Mycobacterium bovis subsp bovis AF2122/97
ugcgguuucaccgacga

SEQ ID NO: 3105343 - RNA, 20 nt, Mycobacterium bovis subsp bovis AF2122/97
ugcgguuucaccgacgacgc

SEQ ID NO: 3105344 - RNA, 21 nt, Mycobacterium bovis subsp bovis AF2122/97
ugcgguuucaccgacgacgcg

SEQ ID NO: 3105345 - RNA, 20 nt, Mycobacterium bovis subsp bovis AF2122/97
ugcguagacauuggcuccga

SEQ ID NO: 3105346 - RNA, 18 nt, Mycobacterium bovis subsp bovis AF2122/97
ugcguagcaggucgacgg

SEQ ID NO: 3105347 - RNA, 14 nt, Mycobacterium bovis subsp bovis AF2122/97
ugcguagcggguca

SEQ ID NO: 3105348 - RNA, 17 nt, Mycobacterium bovis subsp bovis AF2122/97
ugcguagcucacguuug

SEQ ID NO: 3105349 - RNA, 14 nt, Mycobacterium bovis subsp bovis AF2122/97
ugcgucacagccgg

SEQ ID NO: 3105350 - RNA, 22 nt, Mycobacterium bovis subsp bovis AF2122/97
ugcguccacgugagugccggcg

SEQ ID NO: 3105351 - RNA, 13 nt, Mycobacterium bovis subsp bovis AF2122/97
ugcguccagcaaa

SEQ ID NO: 3105352 - RNA, 20 nt, Mycobacterium bovis subsp bovis AF2122/97
ugcguccagcaaaugcggcg

SEQ ID NO: 3105353 - RNA, 19 nt, Mycobacterium bovis subsp bovis AF2122/97
ugcguccaggccagggcgg

SEQ ID NO: 3105354 - RNA, 15 nt, Mycobacterium bovis subsp bovis AF2122/97
ugcguccgcaacagg

SEQ ID NO: 3105355 - RNA, 20 nt, Mycobacterium bovis subsp bovis AF2122/97
ugcguccggaaccaaccucg

SEQ ID NO: 3105356 - RNA, 23 nt, Mycobacterium bovis subsp bovis AF2122/97
ugcguccggugcugguccagccg

SEQ ID NO: 3105357 - RNA, 14 nt, Mycobacterium bovis subsp bovis AF2122/97
ugcguccugcucgc

SEQ ID NO: 3105358 - RNA, 15 nt, Mycobacterium bovis subsp bovis AF2122/97
ugcguccugcucgcg

SEQ ID NO: 3105359 - RNA, 17 nt, Mycobacterium bovis subsp bovis AF2122/97
ugcguccugguggcggg

SEQ ID NO: 3105360 - RNA, 17 nt, Mycobacterium bovis subsp bovis AF2122/97
ugcgucgaaauccacaa

SEQ ID NO: 3105361 - RNA, 17 nt, Mycobacterium bovis subsp bovis AF2122/97
ugcgucgaugcgcugcu

SEQ ID NO: 3105362 - RNA, 21 nt, Mycobacterium bovis subsp bovis AF2122/97
ugcgucgaugcgcugcucacg

SEQ ID NO: 3105363 - RNA, 17 nt, Mycobacterium bovis subsp bovis AF2122/97
ugcgucgauggcgucgg

SEQ ID NO: 3105364 - RNA, 19 nt, Mycobacterium bovis subsp bovis AF2122/97
ugcgucgcacgagccaaca

SEQ ID NO: 3105365 - RNA, 20 nt, Mycobacterium bovis subsp bovis AF2122/97
ugcgucgcggacggugcggu

SEQ ID NO: 3105366 - RNA, 15 nt, Mycobacterium bovis subsp bovis AF2122/97
ugcgucggcccggug

SEQ ID NO: 3105367 - RNA, 13 nt, Mycobacterium bovis subsp bovis AF2122/97
ugcgucggcggcu

SEQ ID NO: 3105368 - RNA, 18 nt, Mycobacterium bovis subsp bovis AF2122/97
ugcgucguggggaccggc

SEQ ID NO: 3105369 - RNA, 20 nt, Mycobacterium bovis subsp bovis AF2122/97
ugcgucucgcgcagccgggu

SEQ ID NO: 3105370 - RNA, 15 nt, Mycobacterium bovis subsp bovis AF2122/97
ugcgucucgcgcgau

SEQ ID NO: 3105371 - RNA, 17 nt, Mycobacterium bovis subsp bovis AF2122/97
ugcgucucgguggcugc

SEQ ID NO: 3105372 - RNA, 16 nt, Mycobacterium bovis subsp bovis AF2122/97
ugcgucugcucgcccu

SEQ ID NO: 3105373 - RNA, 16 nt, Mycobacterium bovis subsp bovis AF2122/97
ugcgucugcucgccgu

SEQ ID NO: 3105374 - RNA, 21 nt, Mycobacterium bovis subsp bovis AF2122/97
ugcgucugcucgccguggugg

SEQ ID NO: 3105375 - RNA, 15 nt, Mycobacterium bovis subsp bovis AF2122/97
ugcgucugcucggca

SEQ ID NO: 3105376 - RNA, 23 nt, Mycobacterium bovis subsp bovis AF2122/97
ugcgucugggcaucaucgacgcg

SEQ ID NO: 3105377 - RNA, 23 nt, Mycobacterium bovis subsp bovis AF2122/97
ugcgugaucuggccgaagcccga

SEQ ID NO: 3105378 - RNA, 17 nt, Mycobacterium bovis subsp bovis AF2122/97
ugcgugaugguugcucg

SEQ ID NO: 3105379 - RNA, 16 nt, Mycobacterium bovis subsp bovis AF2122/97
ugcgugcauaggccgc

SEQ ID NO: 3105380 - RNA, 18 nt, Mycobacterium bovis subsp bovis AF2122/97
ugcgugcauaggccgcgu

SEQ ID NO: 3105381 - RNA, 20 nt, Mycobacterium bovis subsp bovis AF2122/97
ugcgugcccguugguguugc

SEQ ID NO: 3105382 - RNA, 15 nt, Mycobacterium bovis subsp bovis AF2122/97
ugcgugccgcaccgc

SEQ ID NO: 3105383 - RNA, 20 nt, Mycobacterium bovis subsp bovis AF2122/97
ugcgugccgcaccgccugcu

SEQ ID NO: 3105384 - RNA, 14 nt, Mycobacterium bovis subsp bovis AF2122/97
ugcgugccggcagc

SEQ ID NO: 3105385 - RNA, 13 nt, Mycobacterium bovis subsp bovis AF2122/97
ugcgugcggcgaa

SEQ ID NO: 3105386 - RNA, 19 nt, Mycobacterium bovis subsp bovis AF2122/97
ugcguggaauggcgccggc

SEQ ID NO: 3105387 - RNA, 15 nt, Mycobacterium bovis subsp bovis AF2122/97
ugcguggcgggcugc

SEQ ID NO: 3105388 - RNA, 16 nt, Mycobacterium bovis subsp bovis AF2122/97
ugcguggcgggcugca

SEQ ID NO: 3105389 - RNA, 20 nt, Mycobacterium bovis subsp bovis AF2122/97
ugcguggcgggcugcagccg

SEQ ID NO: 3105390 - RNA, 20 nt, Mycobacterium bovis subsp bovis AF2122/97
ugcguggcguugguggucug

SEQ ID NO: 3105391 - RNA, 22 nt, Mycobacterium bovis subsp bovis AF2122/97
ugcguggcguugguggucugcc

SEQ ID NO: 3105392 - RNA, 18 nt, Mycobacterium bovis subsp bovis AF2122/97
ugcgugggcgcggcgcca

SEQ ID NO: 3105393 - RNA, 12 nt, Mycobacterium bovis subsp bovis AF2122/97
ugcguuacgccg

SEQ ID NO: 3105394 - RNA, 22 nt, Mycobacterium bovis subsp bovis AF2122/97
ugcguuccaguccccgccggcc

SEQ ID NO: 3105395 - RNA, 16 nt, Mycobacterium bovis subsp bovis AF2122/97
ugcguuccaucgccga

SEQ ID NO: 3105396 - RNA, 17 nt, Mycobacterium bovis subsp bovis AF2122/97
ugcguuccaucgccgac

SEQ ID NO: 3105397 - RNA, 19 nt, Mycobacterium bovis subsp bovis AF2122/97
ugcguuccaucgccgacgc

SEQ ID NO: 3105398 - RNA, 16 nt, Mycobacterium bovis subsp bovis AF2122/97
ugcguuccgaucggca

SEQ ID NO: 3105399 - RNA, 14 nt, Mycobacterium bovis subsp bovis AF2122/97
ugcguucgccgccc

SEQ ID NO: 3105400 - RNA, 16 nt, Mycobacterium bovis subsp bovis AF2122/97
ugcguucgccgcccgg

SEQ ID NO: 3105401 - RNA, 14 nt, Mycobacterium bovis subsp bovis AF2122/97
ugcguucggccggg

SEQ ID NO: 3105402 - RNA, 17 nt, Mycobacterium bovis subsp bovis AF2122/97
ugcguucggccgggccg

SEQ ID NO: 3105403 - RNA, 18 nt, Mycobacterium bovis subsp bovis AF2122/97
ugcguucggugaucucgu

SEQ ID NO: 3105404 - RNA, 14 nt, Mycobacterium bovis subsp bovis AF2122/97
ugcguuggaugaag

SEQ ID NO: 3105405 - RNA, 21 nt, Mycobacterium bovis subsp bovis AF2122/97
ugcguugggaucccagcgcag

SEQ ID NO: 3105406 - RNA, 16 nt, Mycobacterium bovis subsp bovis AF2122/97
ugcguuguccaccauc

SEQ ID NO: 3105407 - RNA, 17 nt, Mycobacterium bovis subsp bovis AF2122/97
ugcuaaacuccgugccg

SEQ ID NO: 3105408 - RNA, 19 nt, Mycobacterium bovis subsp bovis AF2122/97
ugcuacacccguagaccuu

SEQ ID NO: 3105409 - RNA, 18 nt, Mycobacterium bovis subsp bovis AF2122/97
ugcuaccagagccgcgau

SEQ ID NO: 3105410 - RNA, 21 nt, Mycobacterium bovis subsp bovis AF2122/97
ugcuacccauucggcggcggu

SEQ ID NO: 3105411 - RNA, 19 nt, Mycobacterium bovis subsp bovis AF2122/97
ugcuacccgagccggcacg

SEQ ID NO: 3105412 - RNA, 13 nt, Mycobacterium bovis subsp bovis AF2122/97
ugcuacucugcaa

SEQ ID NO: 3105413 - RNA, 14 nt, Mycobacterium bovis subsp bovis AF2122/97
ugcuagcagcagcc

SEQ ID NO: 3105414 - RNA, 22 nt, Mycobacterium bovis subsp bovis AF2122/97
ugcuagccagucggccaccugg

SEQ ID NO: 3105415 - RNA, 19 nt, Mycobacterium bovis subsp bovis AF2122/97
ugcuaggaccaccagcgcu

SEQ ID NO: 3105416 - RNA, 17 nt, Mycobacterium bovis subsp bovis AF2122/97
ugcuaggccaccggcga

SEQ ID NO: 3105417 - RNA, 17 nt, Mycobacterium bovis subsp bovis AF2122/97
ugcuauucgccagcgcc

SEQ ID NO: 3105418 - RNA, 21 nt, Mycobacterium bovis subsp bovis AF2122/97
ugcucaccaaucugcgggccg

SEQ ID NO: 3105419 - RNA, 13 nt, Mycobacterium bovis subsp bovis AF2122/97
ugcucaccaucuc

SEQ ID NO: 3105420 - RNA, 19 nt, Mycobacterium bovis subsp bovis AF2122/97
ugcucacgagcaaaccaga

SEQ ID NO: 3105421 - RNA, 19 nt, Mycobacterium bovis subsp bovis AF2122/97
ugcucacgaucacccgcac

SEQ ID NO: 3105422 - RNA, 22 nt, Mycobacterium bovis subsp bovis AF2122/97
ugcucacgaucugcgcgucagg

SEQ ID NO: 3105423 - RNA, 24 nt, Mycobacterium bovis subsp bovis AF2122/97
ugcucacgaucugcgcgucaggcc

SEQ ID NO: 3105424 - RNA, 13 nt, Mycobacterium bovis subsp bovis AF2122/97
ugcucacgcagca

SEQ ID NO: 3105425 - RNA, 16 nt, Mycobacterium bovis subsp bovis AF2122/97
ugcucacggcaggcgg

SEQ ID NO: 3105426 - RNA, 15 nt, Mycobacterium bovis subsp bovis AF2122/97
ugcucagcaacggcg

SEQ ID NO: 3105427 - RNA, 13 nt, Mycobacterium bovis subsp bovis AF2122/97
ugcucagccggcc

SEQ ID NO: 3105428 - RNA, 12 nt, Mycobacterium bovis subsp bovis AF2122/97
ugcucagcgcgc

SEQ ID NO: 3105429 - RNA, 15 nt, Mycobacterium bovis subsp bovis AF2122/97
ugcucagcgcggccc

SEQ ID NO: 3105430 - RNA, 19 nt, Mycobacterium bovis subsp bovis AF2122/97
ugcuccaaaucggcaucgg

SEQ ID NO: 3105431 - RNA, 15 nt, Mycobacterium bovis subsp bovis AF2122/97
ugcuccaggcgcgcc

SEQ ID NO: 3105432 - RNA, 16 nt, Mycobacterium bovis subsp bovis AF2122/97
ugcuccaggcgcgccg

SEQ ID NO: 3105433 - RNA, 18 nt, Mycobacterium bovis subsp bovis AF2122/97
ugcuccaggcgcgccgca

SEQ ID NO: 3105434 - RNA, 21 nt, Mycobacterium bovis subsp bovis AF2122/97
ugcuccaggcgcgccgcaccc

SEQ ID NO: 3105435 - RNA, 17 nt, Mycobacterium bovis subsp bovis AF2122/97
ugcucccuauugcugcg

SEQ ID NO: 3105436 - RNA, 19 nt, Mycobacterium bovis subsp bovis AF2122/97
ugcucccuauugcugcggu

SEQ ID NO: 3105437 - RNA, 21 nt, Mycobacterium bovis subsp bovis AF2122/97
ugcuccgcagcagacuccguu

SEQ ID NO: 3105438 - RNA, 16 nt, Mycobacterium bovis subsp bovis AF2122/97
ugcuccgguuggcgcg

SEQ ID NO: 3105439 - RNA, 17 nt, Mycobacterium bovis subsp bovis AF2122/97
ugcuccgguuggcgcgg

SEQ ID NO: 3105440 - RNA, 13 nt, Mycobacterium bovis subsp bovis AF2122/97
ugcuccucgguca

SEQ ID NO: 3105441 - RNA, 18 nt, Mycobacterium bovis subsp bovis AF2122/97
ugcuccucggucagcggg

SEQ ID NO: 3105442 - RNA, 17 nt, Mycobacterium bovis subsp bovis AF2122/97
ugcuccugguggcagaa

SEQ ID NO: 3105443 - RNA, 22 nt, Mycobacterium bovis subsp bovis AF2122/97
ugcucgaaaucgcacagcgcag

SEQ ID NO: 3105444 - RNA, 17 nt, Mycobacterium bovis subsp bovis AF2122/97
ugcucgacgaggccacg

SEQ ID NO: 3105445 - RNA, 14 nt, Mycobacterium bovis subsp bovis AF2122/97
ugcucgacgcccgc

SEQ ID NO: 3105446 - RNA, 16 nt, Mycobacterium bovis subsp bovis AF2122/97
ugcucgacggcuccga

SEQ ID NO: 3105447 - RNA, 16 nt, Mycobacterium bovis subsp bovis AF2122/97
ugcucgagcaccucgg

SEQ ID NO: 3105448 - RNA, 19 nt, Mycobacterium bovis subsp bovis AF2122/97
ugcucgagcaccucggccu

SEQ ID NO: 3105449 - RNA, 20 nt, Mycobacterium bovis subsp bovis AF2122/97
ugcucgagcagaucagcacg

SEQ ID NO: 3105450 - RNA, 22 nt, Mycobacterium bovis subsp bovis AF2122/97
ugcucgagugggugaggccaac

SEQ ID NO: 3105451 - RNA, 20 nt, Mycobacterium bovis subsp bovis AF2122/97
ugcucgauaucguuggcgac

SEQ ID NO: 3105452 - RNA, 15 nt, Mycobacterium bovis subsp bovis AF2122/97
ugcucgaucugucgc

SEQ ID NO: 3105453 - RNA, 19 nt, Mycobacterium bovis subsp bovis AF2122/97
ugcucgaucugucgcgccg

SEQ ID NO: 3105454 - RNA, 22 nt, Mycobacterium bovis subsp bovis AF2122/97
ugcucgaugcgacgaaccucgg

SEQ ID NO: 3105455 - RNA, 23 nt, Mycobacterium bovis subsp bovis AF2122/97
ugcucgcaaucguuggccaugcc

SEQ ID NO: 3105456 - RNA, 23 nt, Mycobacterium bovis subsp bovis AF2122/97
ugcucgcacagcaccacgugcga

SEQ ID NO: 3105457 - RNA, 21 nt, Mycobacterium bovis subsp bovis AF2122/97
ugcucgccaggcaagccagca

SEQ ID NO: 3105458 - RNA, 22 nt, Mycobacterium bovis subsp bovis AF2122/97
ugcucgccaggcaagccagcac

SEQ ID NO: 3105459 - RNA, 13 nt, Mycobacterium bovis subsp bovis AF2122/97
ugcucgccaggcc

SEQ ID NO: 3105460 - RNA, 13 nt, Mycobacterium bovis subsp bovis AF2122/97
ugcucgccgacca

SEQ ID NO: 3105461 - RNA, 19 nt, Mycobacterium bovis subsp bovis AF2122/97
ugcucgccgaccagcuuga

SEQ ID NO: 3105462 - RNA, 19 nt, Mycobacterium bovis subsp bovis AF2122/97
ugcucgccggaucuugccg

SEQ ID NO: 3105463 - RNA, 12 nt, Mycobacterium bovis subsp bovis AF2122/97
ugcucgccggcc

SEQ ID NO: 3105464 - RNA, 15 nt, Mycobacterium bovis subsp bovis AF2122/97
ugcucgccgucucgg

SEQ ID NO: 3105465 - RNA, 14 nt, Mycobacterium bovis subsp bovis AF2122/97
ugcucgccguggug

SEQ ID NO: 3105466 - RNA, 16 nt, Mycobacterium bovis subsp bovis AF2122/97
ugcucgccguggugga

SEQ ID NO: 3105467 - RNA, 23 nt, Mycobacterium bovis subsp bovis AF2122/97
ugcucgcgaggcucgcguggccg

SEQ ID NO: 3105468 - RNA, 14 nt, Mycobacterium bovis subsp bovis AF2122/97
ugcucgcgcccgcu

SEQ ID NO: 3105469 - RNA, 14 nt, Mycobacterium bovis subsp bovis AF2122/97
ugcucgcgcucguu

SEQ ID NO: 3105470 - RNA, 15 nt, Mycobacterium bovis subsp bovis AF2122/97
ugcucgcggguaccu

SEQ ID NO: 3105471 - RNA, 15 nt, Mycobacterium bovis subsp bovis AF2122/97
ugcucgcuggcgcug

SEQ ID NO: 3105472 - RNA, 18 nt, Mycobacterium bovis subsp bovis AF2122/97
ugcucgcuggcgcugaug

SEQ ID NO: 3105473 - RNA, 11 nt, Mycobacterium bovis subsp bovis AF2122/97
ugcucggcgac

SEQ ID NO: 3105474 - RNA, 19 nt, Mycobacterium bovis subsp bovis AF2122/97
ugcucggggaggaaaucca

SEQ ID NO: 3105475 - RNA, 15 nt, Mycobacterium bovis subsp bovis AF2122/97
ugcucgggggccgac

SEQ ID NO: 3105476 - RNA, 20 nt, Mycobacterium bovis subsp bovis AF2122/97
ugcucgggggccgaccaguc

SEQ ID NO: 3105477 - RNA, 18 nt, Mycobacterium bovis subsp bovis AF2122/97
ugcucgggucgugcgugc

SEQ ID NO: 3105478 - RNA, 16 nt, Mycobacterium bovis subsp bovis AF2122/97
ugcucggugacguaga

SEQ ID NO: 3105479 - RNA, 21 nt, Mycobacterium bovis subsp bovis AF2122/97
ugcucguagacuugcugcucc

SEQ ID NO: 3105480 - RNA, 22 nt, Mycobacterium bovis subsp bovis AF2122/97
ugcucguagacuugcugcuccu

SEQ ID NO: 3105481 - RNA, 19 nt, Mycobacterium bovis subsp bovis AF2122/97
ugcucguagcccaggucga

SEQ ID NO: 3105482 - RNA, 22 nt, Mycobacterium bovis subsp bovis AF2122/97
ugcucguaggugccgaagauga

SEQ ID NO: 3105483 - RNA, 22 nt, Mycobacterium bovis subsp bovis AF2122/97
ugcucgucauccauccgggccg

SEQ ID NO: 3105484 - RNA, 23 nt, Mycobacterium bovis subsp bovis AF2122/97
ugcucgucauccauccgggccgc

SEQ ID NO: 3105485 - RNA, 14 nt, Mycobacterium bovis subsp bovis AF2122/97
ugcucguccacccc

SEQ ID NO: 3105486 - RNA, 16 nt, Mycobacterium bovis subsp bovis AF2122/97
ugcucguccaccccga

SEQ ID NO: 3105487 - RNA, 20 nt, Mycobacterium bovis subsp bovis AF2122/97
ugcucguccaggucggccgc

SEQ ID NO: 3105488 - RNA, 20 nt, Mycobacterium bovis subsp bovis AF2122/97
ugcucgucccagaaccggcu

SEQ ID NO: 3105489 - RNA, 16 nt, Mycobacterium bovis subsp bovis AF2122/97
ugcucgucgagcaugc

SEQ ID NO: 3105490 - RNA, 15 nt, Mycobacterium bovis subsp bovis AF2122/97
ugcucgucggcgccg

SEQ ID NO: 3105491 - RNA, 16 nt, Mycobacterium bovis subsp bovis AF2122/97
ugcucgucggcgccgg

SEQ ID NO: 3105492 - RNA, 22 nt, Mycobacterium bovis subsp bovis AF2122/97
ugcucgucggcgccggcggccg

SEQ ID NO: 3105493 - RNA, 13 nt, Mycobacterium bovis subsp bovis AF2122/97
ugcucgucgucga

SEQ ID NO: 3105494 - RNA, 18 nt, Mycobacterium bovis subsp bovis AF2122/97
ugcucgucuuggcggcgg

SEQ ID NO: 3105495 - RNA, 14 nt, Mycobacterium bovis subsp bovis AF2122/97
ugcucguguuguug

SEQ ID NO: 3105496 - RNA, 14 nt, Mycobacterium bovis subsp bovis AF2122/97
ugcucucgcagcau

SEQ ID NO: 3105497 - RNA, 16 nt, Mycobacterium bovis subsp bovis AF2122/97
ugcugaacuccgccgc

SEQ ID NO: 3105498 - RNA, 18 nt, Mycobacterium bovis subsp bovis AF2122/97
ugcugacauuuccaccac

SEQ ID NO: 3105499 - RNA, 20 nt, Mycobacterium bovis subsp bovis AF2122/97
ugcugacauuuccaccacgc

SEQ ID NO: 3105500 - RNA, 18 nt, Mycobacterium bovis subsp bovis AF2122/97
ugcugaccaugaccgggc

SEQ ID NO: 3105501 - RNA, 18 nt, Mycobacterium bovis subsp bovis AF2122/97
ugcugaccgcgccggaca

SEQ ID NO: 3105502 - RNA, 15 nt, Mycobacterium bovis subsp bovis AF2122/97
ugcugaccggaguuc

SEQ ID NO: 3105503 - RNA, 20 nt, Mycobacterium bovis subsp bovis AF2122/97
ugcugacgacgagggccagc

SEQ ID NO: 3105504 - RNA, 21 nt, Mycobacterium bovis subsp bovis AF2122/97
ugcugacgaugcggucgacgg

SEQ ID NO: 3105505 - RNA, 12 nt, Mycobacterium bovis subsp bovis AF2122/97
ugcugacggugc

SEQ ID NO: 3105506 - RNA, 23 nt, Mycobacterium bovis subsp bovis AF2122/97
ugcugagcaaguccugcagcugg

SEQ ID NO: 3105507 - RNA, 18 nt, Mycobacterium bovis subsp bovis AF2122/97
ugcugagcguaggccagc

SEQ ID NO: 3105508 - RNA, 19 nt, Mycobacterium bovis subsp bovis AF2122/97
ugcugaugaaacgccgucg

SEQ ID NO: 3105509 - RNA, 12 nt, Mycobacterium bovis subsp bovis AF2122/97
ugcugaugguga

SEQ ID NO: 3105510 - RNA, 16 nt, Mycobacterium bovis subsp bovis AF2122/97
ugcugaugucgccggu

SEQ ID NO: 3105511 - RNA, 17 nt, Mycobacterium bovis subsp bovis AF2122/97
ugcugaugucgccggug

SEQ ID NO: 3105512 - RNA, 19 nt, Mycobacterium bovis subsp bovis AF2122/97
ugcugcaaggaauuccggc

SEQ ID NO: 3105513 - RNA, 15 nt, Mycobacterium bovis subsp bovis AF2122/97
ugcugcacccggaga

SEQ ID NO: 3105514 - RNA, 21 nt, Mycobacterium bovis subsp bovis AF2122/97
ugcugcaccguuuccggcgcu

SEQ ID NO: 3105515 - RNA, 12 nt, Mycobacterium bovis subsp bovis AF2122/97
ugcugcaccugg

SEQ ID NO: 3105516 - RNA, 19 nt, Mycobacterium bovis subsp bovis AF2122/97
ugcugcaccuggcgcagca

SEQ ID NO: 3105517 - RNA, 23 nt, Mycobacterium bovis subsp bovis AF2122/97
ugcugcagacccguucgccgucg

SEQ ID NO: 3105518 - RNA, 17 nt, Mycobacterium bovis subsp bovis AF2122/97
ugcugcagaucggccgg

SEQ ID NO: 3105519 - RNA, 19 nt, Mycobacterium bovis subsp bovis AF2122/97
ugcugcagcaauugcaccu

SEQ ID NO: 3105520 - RNA, 17 nt, Mycobacterium bovis subsp bovis AF2122/97
ugcugcagcgucaaggg

SEQ ID NO: 3105521 - RNA, 16 nt, Mycobacterium bovis subsp bovis AF2122/97
ugcugcagggccuggc

SEQ ID NO: 3105522 - RNA, 18 nt, Mycobacterium bovis subsp bovis AF2122/97
ugcugcagggccuggcca

SEQ ID NO: 3105523 - RNA, 14 nt, Mycobacterium bovis subsp bovis AF2122/97
ugcugcaugccgac

SEQ ID NO: 3105524 - RNA, 20 nt, Mycobacterium bovis subsp bovis AF2122/97
ugcugccaacgggccauggg

SEQ ID NO: 3105525 - RNA, 15 nt, Mycobacterium bovis subsp bovis AF2122/97
ugcugccagccaugg

SEQ ID NO: 3105526 - RNA, 16 nt, Mycobacterium bovis subsp bovis AF2122/97
ugcugccagccauggc

SEQ ID NO: 3105527 - RNA, 19 nt, Mycobacterium bovis subsp bovis AF2122/97
ugcugccauugccgcaugc

SEQ ID NO: 3105528 - RNA, 16 nt, Mycobacterium bovis subsp bovis AF2122/97
ugcugcccaucccggc

SEQ ID NO: 3105529 - RNA, 21 nt, Mycobacterium bovis subsp bovis AF2122/97
ugcugccccauaaacucugug

SEQ ID NO: 3105530 - RNA, 15 nt, Mycobacterium bovis subsp bovis AF2122/97
ugcugcccgacaccc

SEQ ID NO: 3105531 - RNA, 18 nt, Mycobacterium bovis subsp bovis AF2122/97
ugcugcccgacacccgca

SEQ ID NO: 3105532 - RNA, 21 nt, Mycobacterium bovis subsp bovis AF2122/97
ugcugcccugguuggugacgu

SEQ ID NO: 3105533 - RNA, 22 nt, Mycobacterium bovis subsp bovis AF2122/97
ugcugccggagacacccgccag

SEQ ID NO: 3105534 - RNA, 17 nt, Mycobacterium bovis subsp bovis AF2122/97
ugcugccgggggcccga

SEQ ID NO: 3105535 - RNA, 22 nt, Mycobacterium bovis subsp bovis AF2122/97
ugcugcgcaacaccaucagcga

SEQ ID NO: 3105536 - RNA, 20 nt, Mycobacterium bovis subsp bovis AF2122/97
ugcugcgcaauagcgacagc

SEQ ID NO: 3105537 - RNA, 21 nt, Mycobacterium bovis subsp bovis AF2122/97
ugcugcgcaccaaggccguga

SEQ ID NO: 3105538 - RNA, 21 nt, Mycobacterium bovis subsp bovis AF2122/97
ugcugcgcgcggcggccgcgg

SEQ ID NO: 3105539 - RNA, 15 nt, Mycobacterium bovis subsp bovis AF2122/97
ugcugcgcggugccg

SEQ ID NO: 3105540 - RNA, 16 nt, Mycobacterium bovis subsp bovis AF2122/97
ugcugcggcagcgcgg

SEQ ID NO: 3105541 - RNA, 16 nt, Mycobacterium bovis subsp bovis AF2122/97
ugcugcggcuuucagc

SEQ ID NO: 3105542 - RNA, 14 nt, Mycobacterium bovis subsp bovis AF2122/97
ugcugcggugcggg

SEQ ID NO: 3105543 - RNA, 13 nt, Mycobacterium bovis subsp bovis AF2122/97
ugcugcugcagca

SEQ ID NO: 3105544 - RNA, 16 nt, Mycobacterium bovis subsp bovis AF2122/97
ugcugcuugacuccgc

SEQ ID NO: 3105545 - RNA, 17 nt, Mycobacterium bovis subsp bovis AF2122/97
ugcuggaacagguugaa

SEQ ID NO: 3105546 - RNA, 21 nt, Mycobacterium bovis subsp bovis AF2122/97
ugcuggcaccagcacacucuc

SEQ ID NO: 3105547 - RNA, 15 nt, Mycobacterium bovis subsp bovis AF2122/97
ugcuggcagaccaac

SEQ ID NO: 3105548 - RNA, 17 nt, Mycobacterium bovis subsp bovis AF2122/97
ugcuggcagcggccucc

SEQ ID NO: 3105549 - RNA, 13 nt, Mycobacterium bovis subsp bovis AF2122/97
ugcuggcccgcac

SEQ ID NO: 3105550 - RNA, 14 nt, Mycobacterium bovis subsp bovis AF2122/97
ugcuggccgcggcc

SEQ ID NO: 3105551 - RNA, 14 nt, Mycobacterium bovis subsp bovis AF2122/97
ugcuggccuuguug

SEQ ID NO: 3105552 - RNA, 13 nt, Mycobacterium bovis subsp bovis AF2122/97
ugcuggcgaucgc

SEQ ID NO: 3105553 - RNA, 16 nt, Mycobacterium bovis subsp bovis AF2122/97
ugcuggcgcaaccaau

SEQ ID NO: 3105554 - RNA, 12 nt, Mycobacterium bovis subsp bovis AF2122/97
ugcuggcgccga

SEQ ID NO: 3105555 - RNA, 22 nt, Mycobacterium bovis subsp bovis AF2122/97
ugcuggcgccgaaguagccgac

SEQ ID NO: 3105556 - RNA, 19 nt, Mycobacterium bovis subsp bovis AF2122/97
ugcuggcgcgccugugcca

SEQ ID NO: 3105557 - RNA, 14 nt, Mycobacterium bovis subsp bovis AF2122/97
ugcuggcggccagc

SEQ ID NO: 3105558 - RNA, 22 nt, Mycobacterium bovis subsp bovis AF2122/97
ugcuggcggccucgccggcgcg

SEQ ID NO: 3105559 - RNA, 14 nt, Mycobacterium bovis subsp bovis AF2122/97
ugcuggcggcgcga

SEQ ID NO: 3105560 - RNA, 17 nt, Mycobacterium bovis subsp bovis AF2122/97
ugcugggcccgccagcc

SEQ ID NO: 3105561 - RNA, 22 nt, Mycobacterium bovis subsp bovis AF2122/97
ugcugggccgacgggacaaccc

SEQ ID NO: 3105562 - RNA, 21 nt, Mycobacterium bovis subsp bovis AF2122/97
ugcuggggccuggucccaccg

SEQ ID NO: 3105563 - RNA, 20 nt, Mycobacterium bovis subsp bovis AF2122/97
ugcuggguaguucaccgcgu

SEQ ID NO: 3105564 - RNA, 19 nt, Mycobacterium bovis subsp bovis AF2122/97
ugcugguaccgggcuccaa

SEQ ID NO: 3105565 - RNA, 16 nt, Mycobacterium bovis subsp bovis AF2122/97
ugcugguauagccggc

SEQ ID NO: 3105566 - RNA, 21 nt, Mycobacterium bovis subsp bovis AF2122/97
ugcugguauagccggcgcagc

SEQ ID NO: 3105567 - RNA, 16 nt, Mycobacterium bovis subsp bovis AF2122/97
ugcuggucagcggcgc

SEQ ID NO: 3105568 - RNA, 17 nt, Mycobacterium bovis subsp bovis AF2122/97
ugcuggucagcggcgcg

SEQ ID NO: 3105569 - RNA, 18 nt, Mycobacterium bovis subsp bovis AF2122/97
ugcuggucagcggcgcga

SEQ ID NO: 3105570 - RNA, 13 nt, Mycobacterium bovis subsp bovis AF2122/97
ugcuggucgaugg

SEQ ID NO: 3105571 - RNA, 14 nt, Mycobacterium bovis subsp bovis AF2122/97
ugcuggucggcgau

SEQ ID NO: 3105572 - RNA, 21 nt, Mycobacterium bovis subsp bovis AF2122/97
ugcuggugacgaaagcgccca

SEQ ID NO: 3105573 - RNA, 23 nt, Mycobacterium bovis subsp bovis AF2122/97
ugcuggugggccggaccuuguug

SEQ ID NO: 3105574 - RNA, 22 nt, Mycobacterium bovis subsp bovis AF2122/97
ugcugguugccuuugcggcggg

SEQ ID NO: 3105575 - RNA, 13 nt, Mycobacterium bovis subsp bovis AF2122/97
ugcugucaccgca

SEQ ID NO: 3105576 - RNA, 14 nt, Mycobacterium bovis subsp bovis AF2122/97
ugcugucaccgcaa

SEQ ID NO: 3105577 - RNA, 17 nt, Mycobacterium bovis subsp bovis AF2122/97
ugcugucgaagugguag

SEQ ID NO: 3105578 - RNA, 18 nt, Mycobacterium bovis subsp bovis AF2122/97
ugcugucggugccgucga

SEQ ID NO: 3105579 - RNA, 20 nt, Mycobacterium bovis subsp bovis AF2122/97
ugcuguggucggugccagca

SEQ ID NO: 3105580 - RNA, 17 nt, Mycobacterium bovis subsp bovis AF2122/97
ugcuguguugcacccga

SEQ ID NO: 3105581 - RNA, 22 nt, Mycobacterium bovis subsp bovis AF2122/97
ugcuguuccaucaaggucauca

SEQ ID NO: 3105582 - RNA, 16 nt, Mycobacterium bovis subsp bovis AF2122/97
ugcuguugcgcggucg

SEQ ID NO: 3105583 - RNA, 12 nt, Mycobacterium bovis subsp bovis AF2122/97
ugcuuacgugau

SEQ ID NO: 3105584 - RNA, 14 nt, Mycobacterium bovis subsp bovis AF2122/97
ugcuuagcgcgaaa

SEQ ID NO: 3105585 - RNA, 12 nt, Mycobacterium bovis subsp bovis AF2122/97
ugcuuccagcau

SEQ ID NO: 3105586 - RNA, 16 nt, Mycobacterium bovis subsp bovis AF2122/97
ugcuucgcgucgaccc

SEQ ID NO: 3105587 - RNA, 20 nt, Mycobacterium bovis subsp bovis AF2122/97
ugcuugaaacccaggccgua

SEQ ID NO: 3105588 - RNA, 14 nt, Mycobacterium bovis subsp bovis AF2122/97
ugcuugcagggcca

SEQ ID NO: 3105589 - RNA, 15 nt, Mycobacterium bovis subsp bovis AF2122/97
ugcuugcagggccac

SEQ ID NO: 3105590 - RNA, 22 nt, Mycobacterium bovis subsp bovis AF2122/97
ugcuugcagggccacuggccgg

SEQ ID NO: 3105591 - RNA, 14 nt, Mycobacterium bovis subsp bovis AF2122/97
ugcuugcgcaucgc

SEQ ID NO: 3105592 - RNA, 19 nt, Mycobacterium bovis subsp bovis AF2122/97
ugcuugcgcaucgccgaca

SEQ ID NO: 3105593 - RNA, 16 nt, Mycobacterium bovis subsp bovis AF2122/97
ugcuugcgcccggccu

SEQ ID NO: 3105594 - RNA, 17 nt, Mycobacterium bovis subsp bovis AF2122/97
ugcuuggccacuugcuc

SEQ ID NO: 3105595 - RNA, 13 nt, Mycobacterium bovis subsp bovis AF2122/97
ugcuuggccgcaa

SEQ ID NO: 3105596 - RNA, 15 nt, Mycobacterium bovis subsp bovis AF2122/97
ugcuuggucgcccag

SEQ ID NO: 3105597 - RNA, 18 nt, Mycobacterium bovis subsp bovis AF2122/97
ugcuuggucgcccagcca

SEQ ID NO: 3105598 - RNA, 19 nt, Mycobacterium bovis subsp bovis AF2122/97
ugcuuguugcgcgacgccg

SEQ ID NO: 3105599 - RNA, 14 nt, Mycobacterium bovis subsp bovis AF2122/97
ugcuuugcuggcgc

SEQ ID NO: 3105600 - RNA, 23 nt, Mycobacterium bovis subsp bovis AF2122/97
ugcuuuugggcaauuccgccgag

SEQ ID NO: 3105601 - RNA, 22 nt, Mycobacterium bovis subsp bovis AF2122/97
uggaaaagccacggcugcccau

SEQ ID NO: 3105602 - RNA, 20 nt, Mycobacterium bovis subsp bovis AF2122/97
uggaaaaucgggucacacuc

SEQ ID NO: 3105603 - RNA, 22 nt, Mycobacterium bovis subsp bovis AF2122/97
uggaaagcgcuuuagcggugug

SEQ ID NO: 3105604 - RNA, 17 nt, Mycobacterium bovis subsp bovis AF2122/97
uggaaccaaaccugggc

SEQ ID NO: 3105605 - RNA, 15 nt, Mycobacterium bovis subsp bovis AF2122/97
uggaacucacccuau

SEQ ID NO: 3105606 - RNA, 20 nt, Mycobacterium bovis subsp bovis AF2122/97
uggaacuccguccgccguau

SEQ ID NO: 3105607 - RNA, 17 nt, Mycobacterium bovis subsp bovis AF2122/97
uggaacuggacaccgug

SEQ ID NO: 3105608 - RNA, 17 nt, Mycobacterium bovis subsp bovis AF2122/97
uggaacuuggcgucgac

SEQ ID NO: 3105609 - RNA, 20 nt, Mycobacterium bovis subsp bovis AF2122/97
uggaagaagagguuggcggc

SEQ ID NO: 3105610 - RNA, 15 nt, Mycobacterium bovis subsp bovis AF2122/97
uggaagaucacgcgu

SEQ ID NO: 3105611 - RNA, 22 nt, Mycobacterium bovis subsp bovis AF2122/97
uggaagauguugccgccgguca

SEQ ID NO: 3105612 - RNA, 18 nt, Mycobacterium bovis subsp bovis AF2122/97
uggaagcagacuccggug

SEQ ID NO: 3105613 - RNA, 21 nt, Mycobacterium bovis subsp bovis AF2122/97
uggaagcccgucgcggccggc

SEQ ID NO: 3105614 - RNA, 16 nt, Mycobacterium bovis subsp bovis AF2122/97
uggaagccgaccaccg

SEQ ID NO: 3105615 - RNA, 19 nt, Mycobacterium bovis subsp bovis AF2122/97
uggaagccgaccaccgccg

SEQ ID NO: 3105616 - RNA, 18 nt, Mycobacterium bovis subsp bovis AF2122/97
uggaagccgacgaccagc

SEQ ID NO: 3105617 - RNA, 15 nt, Mycobacterium bovis subsp bovis AF2122/97
uggaagcggcgacua

SEQ ID NO: 3105618 - RNA, 23 nt, Mycobacterium bovis subsp bovis AF2122/97
uggaagcggcgacuacccagcca

SEQ ID NO: 3105619 - RNA, 17 nt, Mycobacterium bovis subsp bovis AF2122/97
uggaaguacacggcggc

SEQ ID NO: 3105620 - RNA, 20 nt, Mycobacterium bovis subsp bovis AF2122/97
uggaaugccgccacaaagaa

SEQ ID NO: 3105621 - RNA, 17 nt, Mycobacterium bovis subsp bovis AF2122/97
uggaauggaucucggcg

SEQ ID NO: 3105622 - RNA, 14 nt, Mycobacterium bovis subsp bovis AF2122/97
uggaauggcgccgg

SEQ ID NO: 3105623 - RNA, 15 nt, Mycobacterium bovis subsp bovis AF2122/97
uggaauggcgccggc

SEQ ID NO: 3105624 - RNA, 22 nt, Mycobacterium bovis subsp bovis AF2122/97
uggaauggcgccggccggcagg

SEQ ID NO: 3105625 - RNA, 20 nt, Mycobacterium bovis subsp bovis AF2122/97
uggaauugaagaauuucggc

SEQ ID NO: 3105626 - RNA, 13 nt, Mycobacterium bovis subsp bovis AF2122/97
uggacaacagcuu

SEQ ID NO: 3105627 - RNA, 12 nt, Mycobacterium bovis subsp bovis AF2122/97
uggacaccaacc

SEQ ID NO: 3105628 - RNA, 14 nt, Mycobacterium bovis subsp bovis AF2122/97
uggacaccaaccca

SEQ ID NO: 3105629 - RNA, 17 nt, Mycobacterium bovis subsp bovis AF2122/97
uggacaccaacccaccc

SEQ ID NO: 3105630 - RNA, 12 nt, Mycobacterium bovis subsp bovis AF2122/97
uggacaccaccu

SEQ ID NO: 3105631 - RNA, 16 nt, Mycobacterium bovis subsp bovis AF2122/97
uggacaccagccagau

SEQ ID NO: 3105632 - RNA, 22 nt, Mycobacterium bovis subsp bovis AF2122/97
uggacaccagccagaugccggu

SEQ ID NO: 3105633 - RNA, 15 nt, Mycobacterium bovis subsp bovis AF2122/97
uggacacggcgcugc

SEQ ID NO: 3105634 - RNA, 21 nt, Mycobacterium bovis subsp bovis AF2122/97
uggacacguuguucaccgacg

SEQ ID NO: 3105635 - RNA, 20 nt, Mycobacterium bovis subsp bovis AF2122/97
uggacagaaucgaccgccgc

SEQ ID NO: 3105636 - RNA, 21 nt, Mycobacterium bovis subsp bovis AF2122/97
uggacaggucgcccaacaccg

SEQ ID NO: 3105637 - RNA, 17 nt, Mycobacterium bovis subsp bovis AF2122/97
uggacaucgggcggcac

SEQ ID NO: 3105638 - RNA, 15 nt, Mycobacterium bovis subsp bovis AF2122/97
uggaccacgugaucg

SEQ ID NO: 3105639 - RNA, 16 nt, Mycobacterium bovis subsp bovis AF2122/97
uggaccagcgggcggc

SEQ ID NO: 3105640 - RNA, 16 nt, Mycobacterium bovis subsp bovis AF2122/97
uggacccgcauggcgc

SEQ ID NO: 3105641 - RNA, 16 nt, Mycobacterium bovis subsp bovis AF2122/97
uggacccggccggccc

SEQ ID NO: 3105642 - RNA, 17 nt, Mycobacterium bovis subsp bovis AF2122/97
uggacccugcgccgcca

SEQ ID NO: 3105643 - RNA, 15 nt, Mycobacterium bovis subsp bovis AF2122/97
uggaccgaacgacuc

SEQ ID NO: 3105644 - RNA, 13 nt, Mycobacterium bovis subsp bovis AF2122/97
uggaccgccgccg

SEQ ID NO: 3105645 - RNA, 20 nt, Mycobacterium bovis subsp bovis AF2122/97
uggaccggcacgucgucguc

SEQ ID NO: 3105646 - RNA, 21 nt, Mycobacterium bovis subsp bovis AF2122/97
uggaccgggucgggcaccgcg

SEQ ID NO: 3105647 - RNA, 20 nt, Mycobacterium bovis subsp bovis AF2122/97
uggaccguugccgaugguga

SEQ ID NO: 3105648 - RNA, 14 nt, Mycobacterium bovis subsp bovis AF2122/97
uggacgacccgggc

SEQ ID NO: 3105649 - RNA, 19 nt, Mycobacterium bovis subsp bovis AF2122/97
uggacgauacgcgcaccgu

SEQ ID NO: 3105650 - RNA, 18 nt, Mycobacterium bovis subsp bovis AF2122/97
uggacgaugaaccgggca

SEQ ID NO: 3105651 - RNA, 20 nt, Mycobacterium bovis subsp bovis AF2122/97
uggacgaugaaccgggcagc

SEQ ID NO: 3105652 - RNA, 20 nt, Mycobacterium bovis subsp bovis AF2122/97
uggacgcagagucaacagau

SEQ ID NO: 3105653 - RNA, 21 nt, Mycobacterium bovis subsp bovis AF2122/97
uggacgcagagucaacagaua

SEQ ID NO: 3105654 - RNA, 20 nt, Mycobacterium bovis subsp bovis AF2122/97
uggacgcccgaguugaagaa

SEQ ID NO: 3105655 - RNA, 21 nt, Mycobacterium bovis subsp bovis AF2122/97
uggacgcccgaguugaagaau

SEQ ID NO: 3105656 - RNA, 15 nt, Mycobacterium bovis subsp bovis AF2122/97
uggacgccgccggag

SEQ ID NO: 3105657 - RNA, 15 nt, Mycobacterium bovis subsp bovis AF2122/97
uggacgccuugcaca

SEQ ID NO: 3105658 - RNA, 21 nt, Mycobacterium bovis subsp bovis AF2122/97
uggacgccuugcacaagcuga

SEQ ID NO: 3105659 - RNA, 15 nt, Mycobacterium bovis subsp bovis AF2122/97
uggacgcgaugaccg

SEQ ID NO: 3105660 - RNA, 16 nt, Mycobacterium bovis subsp bovis AF2122/97
uggacgcgaugaucau

SEQ ID NO: 3105661 - RNA, 13 nt, Mycobacterium bovis subsp bovis AF2122/97
uggacgcgcaugc

SEQ ID NO: 3105662 - RNA, 20 nt, Mycobacterium bovis subsp bovis AF2122/97
uggacgcgcauuucaccggg

SEQ ID NO: 3105663 - RNA, 16 nt, Mycobacterium bovis subsp bovis AF2122/97
uggacgcgggccgacc

SEQ ID NO: 3105664 - RNA, 16 nt, Mycobacterium bovis subsp bovis AF2122/97
uggacggcaccggccc

SEQ ID NO: 3105665 - RNA, 15 nt, Mycobacterium bovis subsp bovis AF2122/97
uggacggcagccagc

SEQ ID NO: 3105666 - RNA, 23 nt, Mycobacterium bovis subsp bovis AF2122/97
uggacggcaggcggccgccggga

SEQ ID NO: 3105667 - RNA, 12 nt, Mycobacterium bovis subsp bovis AF2122/97
uggacggccucc

SEQ ID NO: 3105668 - RNA, 17 nt, Mycobacterium bovis subsp bovis AF2122/97
uggacggccuccaucgc

SEQ ID NO: 3105669 - RNA, 22 nt, Mycobacterium bovis subsp bovis AF2122/97
uggacgggguacugcggcucgc

SEQ ID NO: 3105670 - RNA, 20 nt, Mycobacterium bovis subsp bovis AF2122/97
uggacggugcgcagggccug

SEQ ID NO: 3105671 - RNA, 21 nt, Mycobacterium bovis subsp bovis AF2122/97
uggacugagucguaguaggcg

SEQ ID NO: 3105672 - RNA, 22 nt, Mycobacterium bovis subsp bovis AF2122/97
uggacuuagcgcuugacccgcg

SEQ ID NO: 3105673 - RNA, 18 nt, Mycobacterium bovis subsp bovis AF2122/97
uggacuucagcaggccca

SEQ ID NO: 3105674 - RNA, 20 nt, Mycobacterium bovis subsp bovis AF2122/97
uggacuuuauggcuagugcu

SEQ ID NO: 3105675 - RNA, 20 nt, Mycobacterium bovis subsp bovis AF2122/97
uggagaagauuuucucggug

SEQ ID NO: 3105676 - RNA, 20 nt, Mycobacterium bovis subsp bovis AF2122/97
uggagaaguuagccaccuug

SEQ ID NO: 3105677 - RNA, 18 nt, Mycobacterium bovis subsp bovis AF2122/97
uggagaucacgugccggc

SEQ ID NO: 3105678 - RNA, 17 nt, Mycobacterium bovis subsp bovis AF2122/97
uggagaucgccgccggc

SEQ ID NO: 3105679 - RNA, 16 nt, Mycobacterium bovis subsp bovis AF2122/97
uggagaucuccucgag

SEQ ID NO: 3105680 - RNA, 12 nt, Mycobacterium bovis subsp bovis AF2122/97
uggagccggccg

SEQ ID NO: 3105681 - RNA, 19 nt, Mycobacterium bovis subsp bovis AF2122/97
uggagcgccagccgcugcc

SEQ ID NO: 3105682 - RNA, 21 nt, Mycobacterium bovis subsp bovis AF2122/97
uggagcgcgccucgcccagca

SEQ ID NO: 3105683 - RNA, 23 nt, Mycobacterium bovis subsp bovis AF2122/97
uggagcgcgccucgcccagcaag

SEQ ID NO: 3105684 - RNA, 19 nt, Mycobacterium bovis subsp bovis AF2122/97
uggagcucaucgacgagcc

SEQ ID NO: 3105685 - RNA, 22 nt, Mycobacterium bovis subsp bovis AF2122/97
uggagcucaucgacgagccgcg

SEQ ID NO: 3105686 - RNA, 21 nt, Mycobacterium bovis subsp bovis AF2122/97
uggagcuuggcccagcguguc

SEQ ID NO: 3105687 - RNA, 20 nt, Mycobacterium bovis subsp bovis AF2122/97
uggaggcuccuggucgccgu

SEQ ID NO: 3105688 - RNA, 22 nt, Mycobacterium bovis subsp bovis AF2122/97
uggaggcuccuggucgccgugg

SEQ ID NO: 3105689 - RNA, 22 nt, Mycobacterium bovis subsp bovis AF2122/97
uggagggaaucuccggcuggcc

SEQ ID NO: 3105690 - RNA, 22 nt, Mycobacterium bovis subsp bovis AF2122/97
uggaguaggugugcgggaagaa

SEQ ID NO: 3105691 - RNA, 19 nt, Mycobacterium bovis subsp bovis AF2122/97
uggagugaggcugugcccc

SEQ ID NO: 3105692 - RNA, 15 nt, Mycobacterium bovis subsp bovis AF2122/97
uggaguucucaucgc

SEQ ID NO: 3105693 - RNA, 18 nt, Mycobacterium bovis subsp bovis AF2122/97
uggaguuuccgaagcccg

SEQ ID NO: 3105694 - RNA, 22 nt, Mycobacterium bovis subsp bovis AF2122/97
uggauacggugcgacgauccag

SEQ ID NO: 3105695 - RNA, 16 nt, Mycobacterium bovis subsp bovis AF2122/97
uggaucagggucauca

SEQ ID NO: 3105696 - RNA, 22 nt, Mycobacterium bovis subsp bovis AF2122/97
uggaucaucccgaccagcagau

SEQ ID NO: 3105697 - RNA, 20 nt, Mycobacterium bovis subsp bovis AF2122/97
uggaucauguucggccacca

SEQ ID NO: 3105698 - RNA, 15 nt, Mycobacterium bovis subsp bovis AF2122/97
uggauccagcccgac

SEQ ID NO: 3105699 - RNA, 18 nt, Mycobacterium bovis subsp bovis AF2122/97
uggaucccacgaguuggc

SEQ ID NO: 3105700 - RNA, 20 nt, Mycobacterium bovis subsp bovis AF2122/97
uggaucccacgaguuggcca

SEQ ID NO: 3105701 - RNA, 19 nt, Mycobacterium bovis subsp bovis AF2122/97
uggauccggcagcagccgg

SEQ ID NO: 3105702 - RNA, 16 nt, Mycobacterium bovis subsp bovis AF2122/97
uggauccggccaccac

SEQ ID NO: 3105703 - RNA, 22 nt, Mycobacterium bovis subsp bovis AF2122/97
uggauccgggagucgacggugc

SEQ ID NO: 3105704 - RNA, 17 nt, Mycobacterium bovis subsp bovis AF2122/97
uggaucgccaccggcgc

SEQ ID NO: 3105705 - RNA, 19 nt, Mycobacterium bovis subsp bovis AF2122/97
uggaucgccaccggcgcca

SEQ ID NO: 3105706 - RNA, 17 nt, Mycobacterium bovis subsp bovis AF2122/97
uggaucggcagcccggu

SEQ ID NO: 3105707 - RNA, 17 nt, Mycobacterium bovis subsp bovis AF2122/97
uggaucgucgcuguggc

SEQ ID NO: 3105708 - RNA, 19 nt, Mycobacterium bovis subsp bovis AF2122/97
uggaucgucgcuguggcuu

SEQ ID NO: 3105709 - RNA, 14 nt, Mycobacterium bovis subsp bovis AF2122/97
uggaucugccucuc

SEQ ID NO: 3105710 - RNA, 14 nt, Mycobacterium bovis subsp bovis AF2122/97
uggaucuggcgcag

SEQ ID NO: 3105711 - RNA, 13 nt, Mycobacterium bovis subsp bovis AF2122/97
uggaucuucaccu

SEQ ID NO: 3105712 - RNA, 16 nt, Mycobacterium bovis subsp bovis AF2122/97
uggaugcccguagacg

SEQ ID NO: 3105713 - RNA, 18 nt, Mycobacterium bovis subsp bovis AF2122/97
uggaugcccugccccgga

SEQ ID NO: 3105714 - RNA, 17 nt, Mycobacterium bovis subsp bovis AF2122/97
uggaugccgacggcggg

SEQ ID NO: 3105715 - RNA, 15 nt, Mycobacterium bovis subsp bovis AF2122/97
uggauggcgcccugc

SEQ ID NO: 3105716 - RNA, 16 nt, Mycobacterium bovis subsp bovis AF2122/97
uggauggcgcucacaa

SEQ ID NO: 3105717 - RNA, 16 nt, Mycobacterium bovis subsp bovis AF2122/97
uggauggcucgccgaa

SEQ ID NO: 3105718 - RNA, 18 nt, Mycobacterium bovis subsp bovis AF2122/97
uggauguaggcuucgccg

SEQ ID NO: 3105719 - RNA, 17 nt, Mycobacterium bovis subsp bovis AF2122/97
uggauucuucagcgcgg

SEQ ID NO: 3105720 - RNA, 14 nt, Mycobacterium bovis subsp bovis AF2122/97
uggauugccaccag

SEQ ID NO: 3105721 - RNA, 22 nt, Mycobacterium bovis subsp bovis AF2122/97
uggauugcgccaggagcgcggc

SEQ ID NO: 3105722 - RNA, 21 nt, Mycobacterium bovis subsp bovis AF2122/97
uggauuggcgucagcagcaac

SEQ ID NO: 3105723 - RNA, 14 nt, Mycobacterium bovis subsp bovis AF2122/97
uggauuuuggcuga

SEQ ID NO: 3105724 - RNA, 21 nt, Mycobacterium bovis subsp bovis AF2122/97
uggcaaccacguccgcaaccu

SEQ ID NO: 3105725 - RNA, 23 nt, Mycobacterium bovis subsp bovis AF2122/97
uggcaaccgaauugaacugagga

SEQ ID NO: 3105726 - RNA, 12 nt, Mycobacterium bovis subsp bovis AF2122/97
uggcaaccgcac

SEQ ID NO: 3105727 - RNA, 16 nt, Mycobacterium bovis subsp bovis AF2122/97
uggcaacgccgcgccg

SEQ ID NO: 3105728 - RNA, 17 nt, Mycobacterium bovis subsp bovis AF2122/97
uggcaacgccgcgccgu

SEQ ID NO: 3105729 - RNA, 21 nt, Mycobacterium bovis subsp bovis AF2122/97
uggcaacgccgcgccguucca

SEQ ID NO: 3105730 - RNA, 22 nt, Mycobacterium bovis subsp bovis AF2122/97
uggcaagcacgcgacggcgcgg

SEQ ID NO: 3105731 - RNA, 17 nt, Mycobacterium bovis subsp bovis AF2122/97
uggcaagcacggcgucg

SEQ ID NO: 3105732 - RNA, 20 nt, Mycobacterium bovis subsp bovis AF2122/97
uggcaagcggccgcggguug

SEQ ID NO: 3105733 - RNA, 15 nt, Mycobacterium bovis subsp bovis AF2122/97
uggcaagcugucguc

SEQ ID NO: 3105734 - RNA, 22 nt, Mycobacterium bovis subsp bovis AF2122/97
uggcaagucaacaccgcggccg

SEQ ID NO: 3105735 - RNA, 22 nt, Mycobacterium bovis subsp bovis AF2122/97
uggcaaucccgccaucugccug

SEQ ID NO: 3105736 - RNA, 15 nt, Mycobacterium bovis subsp bovis AF2122/97
uggcaaugaccccgg

SEQ ID NO: 3105737 - RNA, 22 nt, Mycobacterium bovis subsp bovis AF2122/97
uggcacaagcuggggaacagca

SEQ ID NO: 3105738 - RNA, 19 nt, Mycobacterium bovis subsp bovis AF2122/97
uggcacaguccgcgaagug

SEQ ID NO: 3105739 - RNA, 21 nt, Mycobacterium bovis subsp bovis AF2122/97
uggcaccaccccgaggccgac

SEQ ID NO: 3105740 - RNA, 17 nt, Mycobacterium bovis subsp bovis AF2122/97
uggcaccagccggugag

SEQ ID NO: 3105741 - RNA, 22 nt, Mycobacterium bovis subsp bovis AF2122/97
uggcaccagccggugagcgagc

SEQ ID NO: 3105742 - RNA, 20 nt, Mycobacterium bovis subsp bovis AF2122/97
uggcacccgcgucgagugcc

SEQ ID NO: 3105743 - RNA, 16 nt, Mycobacterium bovis subsp bovis AF2122/97
uggcaccgccagccac

SEQ ID NO: 3105744 - RNA, 20 nt, Mycobacterium bovis subsp bovis AF2122/97
uggcaccgcccccgucggcc

SEQ ID NO: 3105745 - RNA, 17 nt, Mycobacterium bovis subsp bovis AF2122/97
uggcaccggcggcgacg

SEQ ID NO: 3105746 - RNA, 21 nt, Mycobacterium bovis subsp bovis AF2122/97
uggcaccgucagaccauccag

SEQ ID NO: 3105747 - RNA, 14 nt, Mycobacterium bovis subsp bovis AF2122/97
uggcaccucgcccu

SEQ ID NO: 3105748 - RNA, 21 nt, Mycobacterium bovis subsp bovis AF2122/97
uggcacggaaguacuccaccc

SEQ ID NO: 3105749 - RNA, 18 nt, Mycobacterium bovis subsp bovis AF2122/97
uggcacggccccugccac

SEQ ID NO: 3105750 - RNA, 15 nt, Mycobacterium bovis subsp bovis AF2122/97
uggcacgggucguca

SEQ ID NO: 3105751 - RNA, 21 nt, Mycobacterium bovis subsp bovis AF2122/97
uggcacgggucgucaugccag

SEQ ID NO: 3105752 - RNA, 12 nt, Mycobacterium bovis subsp bovis AF2122/97
uggcacugccgg

SEQ ID NO: 3105753 - RNA, 20 nt, Mycobacterium bovis subsp bovis AF2122/97
uggcacugccggcacgccga

SEQ ID NO: 3105754 - RNA, 20 nt, Mycobacterium bovis subsp bovis AF2122/97
uggcagaccggugagcaccg

SEQ ID NO: 3105755 - RNA, 12 nt, Mycobacterium bovis subsp bovis AF2122/97
uggcagagccgc

SEQ ID NO: 3105756 - RNA, 13 nt, Mycobacterium bovis subsp bovis AF2122/97
uggcagagccgcc

SEQ ID NO: 3105757 - RNA, 24 nt, Mycobacterium bovis subsp bovis AF2122/97
uggcagaugugacuuauccggcca

SEQ ID NO: 3105758 - RNA, 15 nt, Mycobacterium bovis subsp bovis AF2122/97
uggcagcacgaccug

SEQ ID NO: 3105759 - RNA, 20 nt, Mycobacterium bovis subsp bovis AF2122/97
uggcagccaaaaacgcugcc

SEQ ID NO: 3105760 - RNA, 15 nt, Mycobacterium bovis subsp bovis AF2122/97
uggcagccagcggcg

SEQ ID NO: 3105761 - RNA, 21 nt, Mycobacterium bovis subsp bovis AF2122/97
uggcagccagcggcgaagguc

SEQ ID NO: 3105762 - RNA, 14 nt, Mycobacterium bovis subsp bovis AF2122/97
uggcagccccagcu

SEQ ID NO: 3105763 - RNA, 17 nt, Mycobacterium bovis subsp bovis AF2122/97
uggcagccgaaguggcg

SEQ ID NO: 3105764 - RNA, 20 nt, Mycobacterium bovis subsp bovis AF2122/97
uggcagccgaaguggcgccu

SEQ ID NO: 3105765 - RNA, 17 nt, Mycobacterium bovis subsp bovis AF2122/97
uggcagcgcgcugaggu

SEQ ID NO: 3105766 - RNA, 18 nt, Mycobacterium bovis subsp bovis AF2122/97
uggcagcgcggccgggcg

SEQ ID NO: 3105767 - RNA, 20 nt, Mycobacterium bovis subsp bovis AF2122/97
uggcagcggccuccgggcca

SEQ ID NO: 3105768 - RNA, 16 nt, Mycobacterium bovis subsp bovis AF2122/97
uggcagcgguguagcc

SEQ ID NO: 3105769 - RNA, 23 nt, Mycobacterium bovis subsp bovis AF2122/97
uggcagcgguguagccggcgccg

SEQ ID NO: 3105770 - RNA, 20 nt, Mycobacterium bovis subsp bovis AF2122/97
uggcagcuccucgcgcucgc

SEQ ID NO: 3105771 - RNA, 21 nt, Mycobacterium bovis subsp bovis AF2122/97
uggcagcuccucgcgcucgcc

SEQ ID NO: 3105772 - RNA, 20 nt, Mycobacterium bovis subsp bovis AF2122/97
uggcagcugcucuccgucgc

SEQ ID NO: 3105773 - RNA, 23 nt, Mycobacterium bovis subsp bovis AF2122/97
uggcagcugcucuccgucgcgca

SEQ ID NO: 3105774 - RNA, 20 nt, Mycobacterium bovis subsp bovis AF2122/97
uggcagcuuugagucccggu

SEQ ID NO: 3105775 - RNA, 14 nt, Mycobacterium bovis subsp bovis AF2122/97
uggcaggccagcau

SEQ ID NO: 3105776 - RNA, 21 nt, Mycobacterium bovis subsp bovis AF2122/97
uggcaggccagcaugucgggc

SEQ ID NO: 3105777 - RNA, 13 nt, Mycobacterium bovis subsp bovis AF2122/97
uggcagggaacca

SEQ ID NO: 3105778 - RNA, 19 nt, Mycobacterium bovis subsp bovis AF2122/97
uggcagggccagcggcagc

SEQ ID NO: 3105779 - RNA, 22 nt, Mycobacterium bovis subsp bovis AF2122/97
uggcaggugaucccgaugguca

SEQ ID NO: 3105780 - RNA, 13 nt, Mycobacterium bovis subsp bovis AF2122/97
uggcaggugccuu

SEQ ID NO: 3105781 - RNA, 18 nt, Mycobacterium bovis subsp bovis AF2122/97
uggcaggugccuucuucg

SEQ ID NO: 3105782 - RNA, 13 nt, Mycobacterium bovis subsp bovis AF2122/97
uggcaguccagcc

SEQ ID NO: 3105783 - RNA, 15 nt, Mycobacterium bovis subsp bovis AF2122/97
uggcaguccagccgg

SEQ ID NO: 3105784 - RNA, 23 nt, Mycobacterium bovis subsp bovis AF2122/97
uggcaguccagccgggugccggc

SEQ ID NO: 3105785 - RNA, 21 nt, Mycobacterium bovis subsp bovis AF2122/97
uggcagugaaauugccgccgc

SEQ ID NO: 3105786 - RNA, 15 nt, Mycobacterium bovis subsp bovis AF2122/97
uggcagugcaggcgg

SEQ ID NO: 3105787 - RNA, 14 nt, Mycobacterium bovis subsp bovis AF2122/97
uggcaguggcgcgg

SEQ ID NO: 3105788 - RNA, 19 nt, Mycobacterium bovis subsp bovis AF2122/97
uggcauaaccgcugauagc

SEQ ID NO: 3105789 - RNA, 19 nt, Mycobacterium bovis subsp bovis AF2122/97
uggcauccaaaaucgccug

SEQ ID NO: 3105790 - RNA, 15 nt, Mycobacterium bovis subsp bovis AF2122/97
uggcauccagcagcg

SEQ ID NO: 3105791 - RNA, 17 nt, Mycobacterium bovis subsp bovis AF2122/97
uggcaucgaacgcccug

SEQ ID NO: 3105792 - RNA, 19 nt, Mycobacterium bovis subsp bovis AF2122/97
uggcaucgaacgcccugac

SEQ ID NO: 3105793 - RNA, 17 nt, Mycobacterium bovis subsp bovis AF2122/97
uggcaucgcgagccagc

SEQ ID NO: 3105794 - RNA, 18 nt, Mycobacterium bovis subsp bovis AF2122/97
uggcaucgcgagccagcu

SEQ ID NO: 3105795 - RNA, 19 nt, Mycobacterium bovis subsp bovis AF2122/97
uggcaugaccgcugccgac

SEQ ID NO: 3105796 - RNA, 16 nt, Mycobacterium bovis subsp bovis AF2122/97
uggcauggucaggcgg

SEQ ID NO: 3105797 - RNA, 22 nt, Mycobacterium bovis subsp bovis AF2122/97
uggcauugaccaccgauauggc

SEQ ID NO: 3105798 - RNA, 16 nt, Mycobacterium bovis subsp bovis AF2122/97
uggcauugcgcccacc

SEQ ID NO: 3105799 - RNA, 21 nt, Mycobacterium bovis subsp bovis AF2122/97
uggccaaccaaccggucacgu

SEQ ID NO: 3105800 - RNA, 11 nt, Mycobacterium bovis subsp bovis AF2122/97
uggccaacccc

SEQ ID NO: 3105801 - RNA, 14 nt, Mycobacterium bovis subsp bovis AF2122/97
uggccaaccccaug

SEQ ID NO: 3105802 - RNA, 18 nt, Mycobacterium bovis subsp bovis AF2122/97
uggccaaccccauggcca

SEQ ID NO: 3105803 - RNA, 19 nt, Mycobacterium bovis subsp bovis AF2122/97
uggccaacucuucagcaag

SEQ ID NO: 3105804 - RNA, 22 nt, Mycobacterium bovis subsp bovis AF2122/97
uggccaacucuucagcaagcca

SEQ ID NO: 3105805 - RNA, 15 nt, Mycobacterium bovis subsp bovis AF2122/97
uggccaagcaggcgg

SEQ ID NO: 3105806 - RNA, 22 nt, Mycobacterium bovis subsp bovis AF2122/97
uggccaauagaagcacgucguc

SEQ ID NO: 3105807 - RNA, 24 nt, Mycobacterium bovis subsp bovis AF2122/97
uggccaauagaagcacgucgucgc

SEQ ID NO: 3105808 - RNA, 13 nt, Mycobacterium bovis subsp bovis AF2122/97
uggccacacucag

SEQ ID NO: 3105809 - RNA, 18 nt, Mycobacterium bovis subsp bovis AF2122/97
uggccacacucagcaccc

SEQ ID NO: 3105810 - RNA, 19 nt, Mycobacterium bovis subsp bovis AF2122/97
uggccacacucagcaccca

SEQ ID NO: 3105811 - RNA, 22 nt, Mycobacterium bovis subsp bovis AF2122/97
uggccaccaaacgcugcuggca

SEQ ID NO: 3105812 - RNA, 24 nt, Mycobacterium bovis subsp bovis AF2122/97
uggccaccaaacgcugcuggcaug

SEQ ID NO: 3105813 - RNA, 11 nt, Mycobacterium bovis subsp bovis AF2122/97
uggccaccacc

SEQ ID NO: 3105814 - RNA, 20 nt, Mycobacterium bovis subsp bovis AF2122/97
uggccaccaggggaccgcgg

SEQ ID NO: 3105815 - RNA, 13 nt, Mycobacterium bovis subsp bovis AF2122/97
uggccaccaucac

SEQ ID NO: 3105816 - RNA, 17 nt, Mycobacterium bovis subsp bovis AF2122/97
uggccaccaucgccgcc

SEQ ID NO: 3105817 - RNA, 18 nt, Mycobacterium bovis subsp bovis AF2122/97
uggccaccgaacgcggcc

SEQ ID NO: 3105818 - RNA, 21 nt, Mycobacterium bovis subsp bovis AF2122/97
uggccaccgaacgcggccacc

SEQ ID NO: 3105819 - RNA, 14 nt, Mycobacterium bovis subsp bovis AF2122/97
uggccaccgccgaa

SEQ ID NO: 3105820 - RNA, 15 nt, Mycobacterium bovis subsp bovis AF2122/97
uggccaccgccgaaa

SEQ ID NO: 3105821 - RNA, 17 nt, Mycobacterium bovis subsp bovis AF2122/97
uggccaccggcggucug

SEQ ID NO: 3105822 - RNA, 21 nt, Mycobacterium bovis subsp bovis AF2122/97
uggccaccucgggugugguca

SEQ ID NO: 3105823 - RNA, 12 nt, Mycobacterium bovis subsp bovis AF2122/97
uggccaccuggu

SEQ ID NO: 3105824 - RNA, 21 nt, Mycobacterium bovis subsp bovis AF2122/97
uggccaccuugugcaggccca

SEQ ID NO: 3105825 - RNA, 23 nt, Mycobacterium bovis subsp bovis AF2122/97
uggccacgaauccgaucaccucg

SEQ ID NO: 3105826 - RNA, 15 nt, Mycobacterium bovis subsp bovis AF2122/97
uggccacgcccaggc

SEQ ID NO: 3105827 - RNA, 24 nt, Mycobacterium bovis subsp bovis AF2122/97
uggccacggaaguaucgccggccg

SEQ ID NO: 3105828 - RNA, 19 nt, Mycobacterium bovis subsp bovis AF2122/97
uggccacggcuuugcggcg

SEQ ID NO: 3105829 - RNA, 15 nt, Mycobacterium bovis subsp bovis AF2122/97
uggccacggggcugc

SEQ ID NO: 3105830 - RNA, 21 nt, Mycobacterium bovis subsp bovis AF2122/97
uggccacucccagccaacccg

SEQ ID NO: 3105831 - RNA, 16 nt, Mycobacterium bovis subsp bovis AF2122/97
uggccacuugcucggu

SEQ ID NO: 3105832 - RNA, 18 nt, Mycobacterium bovis subsp bovis AF2122/97
uggccacuugcucgguga

SEQ ID NO: 3105833 - RNA, 13 nt, Mycobacterium bovis subsp bovis AF2122/97
uggccagacccac

SEQ ID NO: 3105834 - RNA, 17 nt, Mycobacterium bovis subsp bovis AF2122/97
uggccagacccaccacc

SEQ ID NO: 3105835 - RNA, 18 nt, Mycobacterium bovis subsp bovis AF2122/97
uggccagacccaccaccg

SEQ ID NO: 3105836 - RNA, 22 nt, Mycobacterium bovis subsp bovis AF2122/97
uggccagacccaccaccgcaac

SEQ ID NO: 3105837 - RNA, 14 nt, Mycobacterium bovis subsp bovis AF2122/97
uggccagacccgaa

SEQ ID NO: 3105838 - RNA, 22 nt, Mycobacterium bovis subsp bovis AF2122/97
uggccagacccgaauccaccag

SEQ ID NO: 3105839 - RNA, 20 nt, Mycobacterium bovis subsp bovis AF2122/97
uggccagcaacugccgcacc

SEQ ID NO: 3105840 - RNA, 21 nt, Mycobacterium bovis subsp bovis AF2122/97
uggccagcaccacggccagcg

SEQ ID NO: 3105841 - RNA, 15 nt, Mycobacterium bovis subsp bovis AF2122/97
uggccagcagcagcg

SEQ ID NO: 3105842 - RNA, 13 nt, Mycobacterium bovis subsp bovis AF2122/97
uggccagcagccg

SEQ ID NO: 3105843 - RNA, 18 nt, Mycobacterium bovis subsp bovis AF2122/97
uggccagcagccgcgaca

SEQ ID NO: 3105844 - RNA, 14 nt, Mycobacterium bovis subsp bovis AF2122/97
uggccagcagcgcg

SEQ ID NO: 3105845 - RNA, 15 nt, Mycobacterium bovis subsp bovis AF2122/97
uggccagcagcgcgg

SEQ ID NO: 3105846 - RNA, 14 nt, Mycobacterium bovis subsp bovis AF2122/97
uggccagcaggcgg

SEQ ID NO: 3105847 - RNA, 20 nt, Mycobacterium bovis subsp bovis AF2122/97
uggccagcagggccaccacc

SEQ ID NO: 3105848 - RNA, 19 nt, Mycobacterium bovis subsp bovis AF2122/97
uggccagccacagccgacc

SEQ ID NO: 3105849 - RNA, 17 nt, Mycobacterium bovis subsp bovis AF2122/97
uggccagccacuccucg

SEQ ID NO: 3105850 - RNA, 16 nt, Mycobacterium bovis subsp bovis AF2122/97
uggccagccagcgggu

SEQ ID NO: 3105851 - RNA, 15 nt, Mycobacterium bovis subsp bovis AF2122/97
uggccagcccgccca

SEQ ID NO: 3105852 - RNA, 13 nt, Mycobacterium bovis subsp bovis AF2122/97
uggccagccgaca

SEQ ID NO: 3105853 - RNA, 14 nt, Mycobacterium bovis subsp bovis AF2122/97
uggccagccgacaa

SEQ ID NO: 3105854 - RNA, 12 nt, Mycobacterium bovis subsp bovis AF2122/97
uggccagcgcgg

SEQ ID NO: 3105855 - RNA, 21 nt, Mycobacterium bovis subsp bovis AF2122/97
uggccagcgcggcgucgccuu

SEQ ID NO: 3105856 - RNA, 22 nt, Mycobacterium bovis subsp bovis AF2122/97
uggccaggcccgaguuaccggu

SEQ ID NO: 3105857 - RNA, 23 nt, Mycobacterium bovis subsp bovis AF2122/97
uggccaggccguaguggccggcu

SEQ ID NO: 3105858 - RNA, 17 nt, Mycobacterium bovis subsp bovis AF2122/97
uggccaggcuggcguca

SEQ ID NO: 3105859 - RNA, 14 nt, Mycobacterium bovis subsp bovis AF2122/97
uggccaggucggcc

SEQ ID NO: 3105860 - RNA, 15 nt, Mycobacterium bovis subsp bovis AF2122/97
uggccaggucggcca

SEQ ID NO: 3105861 - RNA, 16 nt, Mycobacterium bovis subsp bovis AF2122/97
uggccaggucggccac

SEQ ID NO: 3105862 - RNA, 20 nt, Mycobacterium bovis subsp bovis AF2122/97
uggccagguugccgucggcc

SEQ ID NO: 3105863 - RNA, 21 nt, Mycobacterium bovis subsp bovis AF2122/97
uggccagguuguagacggcac

SEQ ID NO: 3105864 - RNA, 19 nt, Mycobacterium bovis subsp bovis AF2122/97
uggccagugacucaccgug

SEQ ID NO: 3105865 - RNA, 20 nt, Mycobacterium bovis subsp bovis AF2122/97
uggccaucaucgacggugau

SEQ ID NO: 3105866 - RNA, 14 nt, Mycobacterium bovis subsp bovis AF2122/97
uggccaugccacaa

SEQ ID NO: 3105867 - RNA, 18 nt, Mycobacterium bovis subsp bovis AF2122/97
uggccaugccacaacgcc

SEQ ID NO: 3105868 - RNA, 17 nt, Mycobacterium bovis subsp bovis AF2122/97
uggccauguccaccagc

SEQ ID NO: 3105869 - RNA, 18 nt, Mycobacterium bovis subsp bovis AF2122/97
uggccauguccaccagcg

SEQ ID NO: 3105870 - RNA, 21 nt, Mycobacterium bovis subsp bovis AF2122/97
uggccauguccaccagcgugu

SEQ ID NO: 3105871 - RNA, 22 nt, Mycobacterium bovis subsp bovis AF2122/97
uggcccacauguccagcguccu

SEQ ID NO: 3105872 - RNA, 16 nt, Mycobacterium bovis subsp bovis AF2122/97
uggcccaccgccguug

SEQ ID NO: 3105873 - RNA, 13 nt, Mycobacterium bovis subsp bovis AF2122/97
uggcccagcgugu

SEQ ID NO: 3105874 - RNA, 17 nt, Mycobacterium bovis subsp bovis AF2122/97
uggcccaucuugaccaa

SEQ ID NO: 3105875 - RNA, 20 nt, Mycobacterium bovis subsp bovis AF2122/97
uggccccaagcgugcugccg

SEQ ID NO: 3105876 - RNA, 17 nt, Mycobacterium bovis subsp bovis AF2122/97
uggcccccagguaaccc

SEQ ID NO: 3105877 - RNA, 18 nt, Mycobacterium bovis subsp bovis AF2122/97
uggcccccgccggccacg

SEQ ID NO: 3105878 - RNA, 19 nt, Mycobacterium bovis subsp bovis AF2122/97
uggccccgccagcggcagc

SEQ ID NO: 3105879 - RNA, 13 nt, Mycobacterium bovis subsp bovis AF2122/97
uggccccggcucu

SEQ ID NO: 3105880 - RNA, 18 nt, Mycobacterium bovis subsp bovis AF2122/97
uggccccgguggugcugc

SEQ ID NO: 3105881 - RNA, 20 nt, Mycobacterium bovis subsp bovis AF2122/97
uggccccgguggugcugccg

SEQ ID NO: 3105882 - RNA, 19 nt, Mycobacterium bovis subsp bovis AF2122/97
uggccccuuucugaagcug

SEQ ID NO: 3105883 - RNA, 17 nt, Mycobacterium bovis subsp bovis AF2122/97
uggcccgaccgggaacc

SEQ ID NO: 3105884 - RNA, 14 nt, Mycobacterium bovis subsp bovis AF2122/97
uggcccgacgcagc

SEQ ID NO: 3105885 - RNA, 17 nt, Mycobacterium bovis subsp bovis AF2122/97
uggcccgaucgaccgcu

SEQ ID NO: 3105886 - RNA, 12 nt, Mycobacterium bovis subsp bovis AF2122/97
uggcccgcaugc

SEQ ID NO: 3105887 - RNA, 20 nt, Mycobacterium bovis subsp bovis AF2122/97
uggcccgccagaacggcguc

SEQ ID NO: 3105888 - RNA, 21 nt, Mycobacterium bovis subsp bovis AF2122/97
uggcccgccagaacggcgucg

SEQ ID NO: 3105889 - RNA, 22 nt, Mycobacterium bovis subsp bovis AF2122/97
uggcccgcggugacgcaacauc

SEQ ID NO: 3105890 - RNA, 18 nt, Mycobacterium bovis subsp bovis AF2122/97
uggcccgcucccugcacc

SEQ ID NO: 3105891 - RNA, 22 nt, Mycobacterium bovis subsp bovis AF2122/97
uggcccgcucccugcacccagc

SEQ ID NO: 3105892 - RNA, 20 nt, Mycobacterium bovis subsp bovis AF2122/97
uggcccggaacaccgacguc

SEQ ID NO: 3105893 - RNA, 15 nt, Mycobacterium bovis subsp bovis AF2122/97
uggcccgggccgaag

SEQ ID NO: 3105894 - RNA, 19 nt, Mycobacterium bovis subsp bovis AF2122/97
uggcccgggucuccggcgc

SEQ ID NO: 3105895 - RNA, 22 nt, Mycobacterium bovis subsp bovis AF2122/97
uggcccgggucuccggcgcacc

SEQ ID NO: 3105896 - RNA, 17 nt, Mycobacterium bovis subsp bovis AF2122/97
uggcccggugcagcagu

SEQ ID NO: 3105897 - RNA, 18 nt, Mycobacterium bovis subsp bovis AF2122/97
uggcccgucacgcccgcg

SEQ ID NO: 3105898 - RNA, 22 nt, Mycobacterium bovis subsp bovis AF2122/97
uggcccgucacgcccgcgaacc

SEQ ID NO: 3105899 - RNA, 15 nt, Mycobacterium bovis subsp bovis AF2122/97
uggcccgucggcgug

SEQ ID NO: 3105900 - RNA, 22 nt, Mycobacterium bovis subsp bovis AF2122/97
uggcccgucgugaccgaccgcc

SEQ ID NO: 3105901 - RNA, 22 nt, Mycobacterium bovis subsp bovis AF2122/97
uggcccguucgaccguguaacc

SEQ ID NO: 3105902 - RNA, 13 nt, Mycobacterium bovis subsp bovis AF2122/97
uggcccguuggca

SEQ ID NO: 3105903 - RNA, 18 nt, Mycobacterium bovis subsp bovis AF2122/97
uggcccguuggcagcaca

SEQ ID NO: 3105904 - RNA, 16 nt, Mycobacterium bovis subsp bovis AF2122/97
uggcccuccucgguga

SEQ ID NO: 3105905 - RNA, 22 nt, Mycobacterium bovis subsp bovis AF2122/97
uggcccuccucggugagguagc

SEQ ID NO: 3105906 - RNA, 13 nt, Mycobacterium bovis subsp bovis AF2122/97
uggcccugcuccu

SEQ ID NO: 3105907 - RNA, 17 nt, Mycobacterium bovis subsp bovis AF2122/97
uggcccuggcgaccagc

SEQ ID NO: 3105908 - RNA, 12 nt, Mycobacterium bovis subsp bovis AF2122/97
uggcccugggcc

SEQ ID NO: 3105909 - RNA, 16 nt, Mycobacterium bovis subsp bovis AF2122/97
uggccgaaagccaggc

SEQ ID NO: 3105910 - RNA, 21 nt, Mycobacterium bovis subsp bovis AF2122/97
uggccgaacagcugcccgcca

SEQ ID NO: 3105911 - RNA, 15 nt, Mycobacterium bovis subsp bovis AF2122/97
uggccgaacaggaug

SEQ ID NO: 3105912 - RNA, 17 nt, Mycobacterium bovis subsp bovis AF2122/97
uggccgaacauucccau

SEQ ID NO: 3105913 - RNA, 21 nt, Mycobacterium bovis subsp bovis AF2122/97
uggccgaaccguucggcgaca

SEQ ID NO: 3105914 - RNA, 23 nt, Mycobacterium bovis subsp bovis AF2122/97
uggccgaacgggucggcgaccac

SEQ ID NO: 3105915 - RNA, 21 nt, Mycobacterium bovis subsp bovis AF2122/97
uggccgaacuaccgacgcacc

SEQ ID NO: 3105916 - RNA, 15 nt, Mycobacterium bovis subsp bovis AF2122/97
uggccgacagccacc

SEQ ID NO: 3105917 - RNA, 16 nt, Mycobacterium bovis subsp bovis AF2122/97
uggccgacagccaccg

SEQ ID NO: 3105918 - RNA, 14 nt, Mycobacterium bovis subsp bovis AF2122/97
uggccgacagcggg

SEQ ID NO: 3105919 - RNA, 16 nt, Mycobacterium bovis subsp bovis AF2122/97
uggccgagcagggccg

SEQ ID NO: 3105920 - RNA, 20 nt, Mycobacterium bovis subsp bovis AF2122/97
uggccgagcagggccggcac

SEQ ID NO: 3105921 - RNA, 18 nt, Mycobacterium bovis subsp bovis AF2122/97
uggccgaguagauggucg

SEQ ID NO: 3105922 - RNA, 13 nt, Mycobacterium bovis subsp bovis AF2122/97
uggccgaugagcc

SEQ ID NO: 3105923 - RNA, 18 nt, Mycobacterium bovis subsp bovis AF2122/97
uggccgaugagcccagcc

SEQ ID NO: 3105924 - RNA, 21 nt, Mycobacterium bovis subsp bovis AF2122/97
uggccgaugagcccagccgcg

SEQ ID NO: 3105925 - RNA, 22 nt, Mycobacterium bovis subsp bovis AF2122/97
uggccgaugagcccagccgcgg

SEQ ID NO: 3105926 - RNA, 20 nt, Mycobacterium bovis subsp bovis AF2122/97
uggccgauguaguccggcca

SEQ ID NO: 3105927 - RNA, 23 nt, Mycobacterium bovis subsp bovis AF2122/97
uggccgauguaguccggccaguc

SEQ ID NO: 3105928 - RNA, 15 nt, Mycobacterium bovis subsp bovis AF2122/97
uggccgauuccgcgc

SEQ ID NO: 3105929 - RNA, 19 nt, Mycobacterium bovis subsp bovis AF2122/97
uggccgcaaggcguguagc

SEQ ID NO: 3105930 - RNA, 15 nt, Mycobacterium bovis subsp bovis AF2122/97
uggccgcaucgccuc

SEQ ID NO: 3105931 - RNA, 20 nt, Mycobacterium bovis subsp bovis AF2122/97
uggccgcauuggcgaccgcu

SEQ ID NO: 3105932 - RNA, 16 nt, Mycobacterium bovis subsp bovis AF2122/97
uggccgccacaccgcc

SEQ ID NO: 3105933 - RNA, 13 nt, Mycobacterium bovis subsp bovis AF2122/97
uggccgccaccgc

SEQ ID NO: 3105934 - RNA, 19 nt, Mycobacterium bovis subsp bovis AF2122/97
uggccgccaccgcgacgag

SEQ ID NO: 3105935 - RNA, 21 nt, Mycobacterium bovis subsp bovis AF2122/97
uggccgccagauuggcgcugc

SEQ ID NO: 3105936 - RNA, 19 nt, Mycobacterium bovis subsp bovis AF2122/97
uggccgcccagaccgccga

SEQ ID NO: 3105937 - RNA, 15 nt, Mycobacterium bovis subsp bovis AF2122/97
uggccgcccgcucca

SEQ ID NO: 3105938 - RNA, 21 nt, Mycobacterium bovis subsp bovis AF2122/97
uggccgcccgcugcggcggcu

SEQ ID NO: 3105939 - RNA, 18 nt, Mycobacterium bovis subsp bovis AF2122/97
uggccgcccuggccgccc

SEQ ID NO: 3105940 - RNA, 19 nt, Mycobacterium bovis subsp bovis AF2122/97
uggccgcccuggccgccca

SEQ ID NO: 3105941 - RNA, 22 nt, Mycobacterium bovis subsp bovis AF2122/97
uggccgccgaauccgacgucga

SEQ ID NO: 3105942 - RNA, 22 nt, Mycobacterium bovis subsp bovis AF2122/97
uggccgccgcagcuccccgacc

SEQ ID NO: 3105943 - RNA, 12 nt, Mycobacterium bovis subsp bovis AF2122/97
uggccgccgccc

SEQ ID NO: 3105944 - RNA, 24 nt, Mycobacterium bovis subsp bovis AF2122/97
uggccgccgcgaggaugcugagcg

SEQ ID NO: 3105945 - RNA, 13 nt, Mycobacterium bovis subsp bovis AF2122/97
uggccgccgcgca

SEQ ID NO: 3105946 - RNA, 15 nt, Mycobacterium bovis subsp bovis AF2122/97
uggccgccgcgcacc

SEQ ID NO: 3105947 - RNA, 19 nt, Mycobacterium bovis subsp bovis AF2122/97
uggccgccgcgcaccgcgg

SEQ ID NO: 3105948 - RNA, 16 nt, Mycobacterium bovis subsp bovis AF2122/97
uggccgccggccgcgc

SEQ ID NO: 3105949 - RNA, 17 nt, Mycobacterium bovis subsp bovis AF2122/97
uggccgccggcgccgcc

SEQ ID NO: 3105950 - RNA, 17 nt, Mycobacterium bovis subsp bovis AF2122/97
uggccgccggcgcuggc

SEQ ID NO: 3105951 - RNA, 18 nt, Mycobacterium bovis subsp bovis AF2122/97
uggccgccggcgcuggcg

SEQ ID NO: 3105952 - RNA, 14 nt, Mycobacterium bovis subsp bovis AF2122/97
uggccgccgggcag

SEQ ID NO: 3105953 - RNA, 19 nt, Mycobacterium bovis subsp bovis AF2122/97
uggccgccguggcgucggc

SEQ ID NO: 3105954 - RNA, 16 nt, Mycobacterium bovis subsp bovis AF2122/97
uggccgcgagguaccc

SEQ ID NO: 3105955 - RNA, 19 nt, Mycobacterium bovis subsp bovis AF2122/97
uggccgcgaucccggccgu

SEQ ID NO: 3105956 - RNA, 21 nt, Mycobacterium bovis subsp bovis AF2122/97
uggccgcgcaggggcggcgug

SEQ ID NO: 3105957 - RNA, 17 nt, Mycobacterium bovis subsp bovis AF2122/97
uggccgcgccggucguc

SEQ ID NO: 3105958 - RNA, 14 nt, Mycobacterium bovis subsp bovis AF2122/97
uggccgcgcggucg

SEQ ID NO: 3105959 - RNA, 18 nt, Mycobacterium bovis subsp bovis AF2122/97
uggccgcucuccaccccg

SEQ ID NO: 3105960 - RNA, 14 nt, Mycobacterium bovis subsp bovis AF2122/97
uggccgcugccagc

SEQ ID NO: 3105961 - RNA, 14 nt, Mycobacterium bovis subsp bovis AF2122/97
uggccgcugugggc

SEQ ID NO: 3105962 - RNA, 19 nt, Mycobacterium bovis subsp bovis AF2122/97
uggccgcuuuucgauggug

SEQ ID NO: 3105963 - RNA, 23 nt, Mycobacterium bovis subsp bovis AF2122/97
uggccggaauacccgcuggcccg

SEQ ID NO: 3105964 - RNA, 19 nt, Mycobacterium bovis subsp bovis AF2122/97
uggccggaucccagugcca

SEQ ID NO: 3105965 - RNA, 20 nt, Mycobacterium bovis subsp bovis AF2122/97
uggccggaucgaagaccagc

SEQ ID NO: 3105966 - RNA, 19 nt, Mycobacterium bovis subsp bovis AF2122/97
uggccggcaacggcgcgcc

SEQ ID NO: 3105967 - RNA, 23 nt, Mycobacterium bovis subsp bovis AF2122/97
uggccggccagccauggcagcgc

SEQ ID NO: 3105968 - RNA, 15 nt, Mycobacterium bovis subsp bovis AF2122/97
uggccggccaucgcc

SEQ ID NO: 3105969 - RNA, 19 nt, Mycobacterium bovis subsp bovis AF2122/97
uggccggccaucgcccgau

SEQ ID NO: 3105970 - RNA, 12 nt, Mycobacterium bovis subsp bovis AF2122/97
uggccggccccg

SEQ ID NO: 3105971 - RNA, 17 nt, Mycobacterium bovis subsp bovis AF2122/97
uggccggcgagggugag

SEQ ID NO: 3105972 - RNA, 17 nt, Mycobacterium bovis subsp bovis AF2122/97
uggccgggaacacguga

SEQ ID NO: 3105973 - RNA, 23 nt, Mycobacterium bovis subsp bovis AF2122/97
uggccgggaccgccccggccagg

SEQ ID NO: 3105974 - RNA, 15 nt, Mycobacterium bovis subsp bovis AF2122/97
uggccgggcacgcga

SEQ ID NO: 3105975 - RNA, 16 nt, Mycobacterium bovis subsp bovis AF2122/97
uggccggguccagccc

SEQ ID NO: 3105976 - RNA, 19 nt, Mycobacterium bovis subsp bovis AF2122/97
uggccgggucgucuuccag

SEQ ID NO: 3105977 - RNA, 17 nt, Mycobacterium bovis subsp bovis AF2122/97
uggccggugggccgccc

SEQ ID NO: 3105978 - RNA, 18 nt, Mycobacterium bovis subsp bovis AF2122/97
uggccgguucaggggugg

SEQ ID NO: 3105979 - RNA, 18 nt, Mycobacterium bovis subsp bovis AF2122/97
uggccguaccggugaucg

SEQ ID NO: 3105980 - RNA, 20 nt, Mycobacterium bovis subsp bovis AF2122/97
uggccguaccggugaucgug

SEQ ID NO: 3105981 - RNA, 13 nt, Mycobacterium bovis subsp bovis AF2122/97
uggccgucagcca

SEQ ID NO: 3105982 - RNA, 16 nt, Mycobacterium bovis subsp bovis AF2122/97
uggccgucagccaggu

SEQ ID NO: 3105983 - RNA, 22 nt, Mycobacterium bovis subsp bovis AF2122/97
uggccgucagccaggugcccaa

SEQ ID NO: 3105984 - RNA, 17 nt, Mycobacterium bovis subsp bovis AF2122/97
uggccgucagcgucggc

SEQ ID NO: 3105985 - RNA, 16 nt, Mycobacterium bovis subsp bovis AF2122/97
uggccgucccaccagc

SEQ ID NO: 3105986 - RNA, 15 nt, Mycobacterium bovis subsp bovis AF2122/97
uggccgucgccgaag

SEQ ID NO: 3105987 - RNA, 18 nt, Mycobacterium bovis subsp bovis AF2122/97
uggccgucgcugguggcg

SEQ ID NO: 3105988 - RNA, 13 nt, Mycobacterium bovis subsp bovis AF2122/97
uggccgugggugu

SEQ ID NO: 3105989 - RNA, 19 nt, Mycobacterium bovis subsp bovis AF2122/97
uggccguggucgagguggg

SEQ ID NO: 3105990 - RNA, 18 nt, Mycobacterium bovis subsp bovis AF2122/97
uggccguguagauggggu

SEQ ID NO: 3105991 - RNA, 18 nt, Mycobacterium bovis subsp bovis AF2122/97
uggccguugccaacaaca

SEQ ID NO: 3105992 - RNA, 18 nt, Mycobacterium bovis subsp bovis AF2122/97
uggccguuucggcgccgu

SEQ ID NO: 3105993 - RNA, 23 nt, Mycobacterium bovis subsp bovis AF2122/97
uggccguuucggcgccgucgccc

SEQ ID NO: 3105994 - RNA, 18 nt, Mycobacterium bovis subsp bovis AF2122/97
uggccuagccgcggcacc

SEQ ID NO: 3105995 - RNA, 13 nt, Mycobacterium bovis subsp bovis AF2122/97
uggccucagccac

SEQ ID NO: 3105996 - RNA, 18 nt, Mycobacterium bovis subsp bovis AF2122/97
uggccucccacggcgcgu

SEQ ID NO: 3105997 - RNA, 22 nt, Mycobacterium bovis subsp bovis AF2122/97
uggccuccuggaaggaggccgg

SEQ ID NO: 3105998 - RNA, 17 nt, Mycobacterium bovis subsp bovis AF2122/97
uggccucgaacgccgcc

SEQ ID NO: 3105999 - RNA, 14 nt, Mycobacterium bovis subsp bovis AF2122/97
uggccucgaagggc

SEQ ID NO: 3106000 - RNA, 19 nt, Mycobacterium bovis subsp bovis AF2122/97
uggccucguccagcucggu

SEQ ID NO: 3106001 - RNA, 21 nt, Mycobacterium bovis subsp bovis AF2122/97
uggccugauuccacugggccu

SEQ ID NO: 3106002 - RNA, 14 nt, Mycobacterium bovis subsp bovis AF2122/97
uggccugcagcgcg

SEQ ID NO: 3106003 - RNA, 23 nt, Mycobacterium bovis subsp bovis AF2122/97
uggccugcagcgcgacccguagc

SEQ ID NO: 3106004 - RNA, 20 nt, Mycobacterium bovis subsp bovis AF2122/97
uggccugccauaggcccacg

SEQ ID NO: 3106005 - RNA, 13 nt, Mycobacterium bovis subsp bovis AF2122/97
uggccugcccagc

SEQ ID NO: 3106006 - RNA, 14 nt, Mycobacterium bovis subsp bovis AF2122/97
uggccugcccagca

SEQ ID NO: 3106007 - RNA, 21 nt, Mycobacterium bovis subsp bovis AF2122/97
uggccugcccagcaccaccgc

SEQ ID NO: 3106008 - RNA, 22 nt, Mycobacterium bovis subsp bovis AF2122/97
uggccugcggcaggugcgguca

SEQ ID NO: 3106009 - RNA, 13 nt, Mycobacterium bovis subsp bovis AF2122/97
uggccugcucaac

SEQ ID NO: 3106010 - RNA, 13 nt, Mycobacterium bovis subsp bovis AF2122/97
uggccugguuguc

SEQ ID NO: 3106011 - RNA, 22 nt, Mycobacterium bovis subsp bovis AF2122/97
uggccugucgaagauccagcgc

SEQ ID NO: 3106012 - RNA, 17 nt, Mycobacterium bovis subsp bovis AF2122/97
uggccuugacagcuuuc

SEQ ID NO: 3106013 - RNA, 16 nt, Mycobacterium bovis subsp bovis AF2122/97
uggccuuugagcgcgg

SEQ ID NO: 3106014 - RNA, 19 nt, Mycobacterium bovis subsp bovis AF2122/97
uggccuuugagcgcggcca

SEQ ID NO: 3106015 - RNA, 16 nt, Mycobacterium bovis subsp bovis AF2122/97
uggccuuugccgucga

SEQ ID NO: 3106016 - RNA, 19 nt, Mycobacterium bovis subsp bovis AF2122/97
uggcgaacacgucggccag

SEQ ID NO: 3106017 - RNA, 13 nt, Mycobacterium bovis subsp bovis AF2122/97
uggcgaacagcac

SEQ ID NO: 3106018 - RNA, 16 nt, Mycobacterium bovis subsp bovis AF2122/97
uggcgaacccggucaa

SEQ ID NO: 3106019 - RNA, 18 nt, Mycobacterium bovis subsp bovis AF2122/97
uggcgaaccgucagcgcg

SEQ ID NO: 3106020 - RNA, 23 nt, Mycobacterium bovis subsp bovis AF2122/97
uggcgaaccucaccugacacgcc

SEQ ID NO: 3106021 - RNA, 14 nt, Mycobacterium bovis subsp bovis AF2122/97
uggcgaagcccgac

SEQ ID NO: 3106022 - RNA, 18 nt, Mycobacterium bovis subsp bovis AF2122/97
uggcgaaggacaacagcc

SEQ ID NO: 3106023 - RNA, 19 nt, Mycobacterium bovis subsp bovis AF2122/97
uggcgaaggacaacagccg

SEQ ID NO: 3106024 - RNA, 16 nt, Mycobacterium bovis subsp bovis AF2122/97
uggcgaaggccgcaau

SEQ ID NO: 3106025 - RNA, 18 nt, Mycobacterium bovis subsp bovis AF2122/97
uggcgaaggccgcaauac

SEQ ID NO: 3106026 - RNA, 22 nt, Mycobacterium bovis subsp bovis AF2122/97
uggcgaaucuuugguagucugc

SEQ ID NO: 3106027 - RNA, 17 nt, Mycobacterium bovis subsp bovis AF2122/97
uggcgaaugacggccag

SEQ ID NO: 3106028 - RNA, 15 nt, Mycobacterium bovis subsp bovis AF2122/97
uggcgaccaccgcgu

SEQ ID NO: 3106029 - RNA, 22 nt, Mycobacterium bovis subsp bovis AF2122/97
uggcgaccaccgcgucgggccg

SEQ ID NO: 3106030 - RNA, 12 nt, Mycobacterium bovis subsp bovis AF2122/97
uggcgaccacga

SEQ ID NO: 3106031 - RNA, 15 nt, Mycobacterium bovis subsp bovis AF2122/97
uggcgaccagccgag

SEQ ID NO: 3106032 - RNA, 12 nt, Mycobacterium bovis subsp bovis AF2122/97
uggcgaccccgc

SEQ ID NO: 3106033 - RNA, 12 nt, Mycobacterium bovis subsp bovis AF2122/97
uggcgaccuggu

SEQ ID NO: 3106034 - RNA, 17 nt, Mycobacterium bovis subsp bovis AF2122/97
uggcgacgaacgccguc

SEQ ID NO: 3106035 - RNA, 17 nt, Mycobacterium bovis subsp bovis AF2122/97
uggcgacgaggcgacgu

SEQ ID NO: 3106036 - RNA, 15 nt, Mycobacterium bovis subsp bovis AF2122/97
uggcgacggacuccc

SEQ ID NO: 3106037 - RNA, 13 nt, Mycobacterium bovis subsp bovis AF2122/97
uggcgagcagacg

SEQ ID NO: 3106038 - RNA, 17 nt, Mycobacterium bovis subsp bovis AF2122/97
uggcgagcagacgcgaa

SEQ ID NO: 3106039 - RNA, 16 nt, Mycobacterium bovis subsp bovis AF2122/97
uggcgaggcagcaccc

SEQ ID NO: 3106040 - RNA, 21 nt, Mycobacterium bovis subsp bovis AF2122/97
uggcgagggcuaccggcgccg

SEQ ID NO: 3106041 - RNA, 21 nt, Mycobacterium bovis subsp bovis AF2122/97
uggcgaguggcugacacugcc

SEQ ID NO: 3106042 - RNA, 19 nt, Mycobacterium bovis subsp bovis AF2122/97
uggcgauaaccgacgauca

SEQ ID NO: 3106043 - RNA, 15 nt, Mycobacterium bovis subsp bovis AF2122/97
uggcgauaucggccc

SEQ ID NO: 3106044 - RNA, 21 nt, Mycobacterium bovis subsp bovis AF2122/97
uggcgaucagcagccgccgau

SEQ ID NO: 3106045 - RNA, 17 nt, Mycobacterium bovis subsp bovis AF2122/97
uggcgaucaugagcagc

SEQ ID NO: 3106046 - RNA, 18 nt, Mycobacterium bovis subsp bovis AF2122/97
uggcgaucaugagcagca

SEQ ID NO: 3106047 - RNA, 13 nt, Mycobacterium bovis subsp bovis AF2122/97
uggcgaucccgcc

SEQ ID NO: 3106048 - RNA, 14 nt, Mycobacterium bovis subsp bovis AF2122/97
uggcgauccgcggc

SEQ ID NO: 3106049 - RNA, 16 nt, Mycobacterium bovis subsp bovis AF2122/97
uggcgaucucaccugg

SEQ ID NO: 3106050 - RNA, 13 nt, Mycobacterium bovis subsp bovis AF2122/97
uggcgaucuccag

SEQ ID NO: 3106051 - RNA, 15 nt, Mycobacterium bovis subsp bovis AF2122/97
uggcgaucuccagcg

SEQ ID NO: 3106052 - RNA, 12 nt, Mycobacterium bovis subsp bovis AF2122/97
uggcgaucucga

SEQ ID NO: 3106053 - RNA, 16 nt, Mycobacterium bovis subsp bovis AF2122/97
uggcgaucucuaccag

SEQ ID NO: 3106054 - RNA, 20 nt, Mycobacterium bovis subsp bovis AF2122/97
uggcgaugaggaacguuucg

SEQ ID NO: 3106055 - RNA, 14 nt, Mycobacterium bovis subsp bovis AF2122/97
uggcgaugaggugg

SEQ ID NO: 3106056 - RNA, 18 nt, Mycobacterium bovis subsp bovis AF2122/97
uggcgaugagguggccgc

SEQ ID NO: 3106057 - RNA, 20 nt, Mycobacterium bovis subsp bovis AF2122/97
uggcgaugagguggccgcgc

SEQ ID NO: 3106058 - RNA, 12 nt, Mycobacterium bovis subsp bovis AF2122/97
uggcgcaccacc

SEQ ID NO: 3106059 - RNA, 18 nt, Mycobacterium bovis subsp bovis AF2122/97
uggcgcaccggcgucggc

SEQ ID NO: 3106060 - RNA, 22 nt, Mycobacterium bovis subsp bovis AF2122/97
uggcgcaccggcgucggcgcgg

SEQ ID NO: 3106061 - RNA, 17 nt, Mycobacterium bovis subsp bovis AF2122/97
uggcgcacgaaccccac

SEQ ID NO: 3106062 - RNA, 17 nt, Mycobacterium bovis subsp bovis AF2122/97
uggcgcagaucgugcac

SEQ ID NO: 3106063 - RNA, 13 nt, Mycobacterium bovis subsp bovis AF2122/97
uggcgcagcaucu

SEQ ID NO: 3106064 - RNA, 20 nt, Mycobacterium bovis subsp bovis AF2122/97
uggcgcagcucaccgacgga

SEQ ID NO: 3106065 - RNA, 18 nt, Mycobacterium bovis subsp bovis AF2122/97
uggcgcaucagcuuuugc

SEQ ID NO: 3106066 - RNA, 16 nt, Mycobacterium bovis subsp bovis AF2122/97
uggcgccaaaaaggau

SEQ ID NO: 3106067 - RNA, 12 nt, Mycobacterium bovis subsp bovis AF2122/97
uggcgccaccag

SEQ ID NO: 3106068 - RNA, 14 nt, Mycobacterium bovis subsp bovis AF2122/97
uggcgccaccaguc

SEQ ID NO: 3106069 - RNA, 14 nt, Mycobacterium bovis subsp bovis AF2122/97
uggcgccaccggcc

SEQ ID NO: 3106070 - RNA, 15 nt, Mycobacterium bovis subsp bovis AF2122/97
uggcgccaccggccg

SEQ ID NO: 3106071 - RNA, 16 nt, Mycobacterium bovis subsp bovis AF2122/97
uggcgccaccggcguu

SEQ ID NO: 3106072 - RNA, 23 nt, Mycobacterium bovis subsp bovis AF2122/97
uggcgccauccccgccggcgcca

SEQ ID NO: 3106073 - RNA, 22 nt, Mycobacterium bovis subsp bovis AF2122/97
uggcgccaugaagccgggcgcu

SEQ ID NO: 3106074 - RNA, 17 nt, Mycobacterium bovis subsp bovis AF2122/97
uggcgcccauggccacc

SEQ ID NO: 3106075 - RNA, 15 nt, Mycobacterium bovis subsp bovis AF2122/97
uggcgccccaggugg

SEQ ID NO: 3106076 - RNA, 19 nt, Mycobacterium bovis subsp bovis AF2122/97
uggcgcccccgacgacggc

SEQ ID NO: 3106077 - RNA, 13 nt, Mycobacterium bovis subsp bovis AF2122/97
uggcgcccgccgg

SEQ ID NO: 3106078 - RNA, 14 nt, Mycobacterium bovis subsp bovis AF2122/97
uggcgcccgggccc

SEQ ID NO: 3106079 - RNA, 13 nt, Mycobacterium bovis subsp bovis AF2122/97
uggcgcccgucuc

SEQ ID NO: 3106080 - RNA, 18 nt, Mycobacterium bovis subsp bovis AF2122/97
uggcgcccgucuccagca

SEQ ID NO: 3106081 - RNA, 14 nt, Mycobacterium bovis subsp bovis AF2122/97
uggcgcccgugccg

SEQ ID NO: 3106082 - RNA, 17 nt, Mycobacterium bovis subsp bovis AF2122/97
uggcgcccugcgccaca

SEQ ID NO: 3106083 - RNA, 23 nt, Mycobacterium bovis subsp bovis AF2122/97
uggcgccgcgccgauuccaccgc

SEQ ID NO: 3106084 - RNA, 14 nt, Mycobacterium bovis subsp bovis AF2122/97
uggcgccgcggcug

SEQ ID NO: 3106085 - RNA, 17 nt, Mycobacterium bovis subsp bovis AF2122/97
uggcgccggccagccag

SEQ ID NO: 3106086 - RNA, 18 nt, Mycobacterium bovis subsp bovis AF2122/97
uggcgccggccagccagc

SEQ ID NO: 3106087 - RNA, 21 nt, Mycobacterium bovis subsp bovis AF2122/97
uggcgccggccaguucggccu

SEQ ID NO: 3106088 - RNA, 13 nt, Mycobacterium bovis subsp bovis AF2122/97
uggcgccggccgg

SEQ ID NO: 3106089 - RNA, 15 nt, Mycobacterium bovis subsp bovis AF2122/97
uggcgccggccggca

SEQ ID NO: 3106090 - RNA, 14 nt, Mycobacterium bovis subsp bovis AF2122/97
uggcgccggggacc

SEQ ID NO: 3106091 - RNA, 14 nt, Mycobacterium bovis subsp bovis AF2122/97
uggcgccggggccg

SEQ ID NO: 3106092 - RNA, 19 nt, Mycobacterium bovis subsp bovis AF2122/97
uggcgccggggcgcagguu

SEQ ID NO: 3106093 - RNA, 20 nt, Mycobacterium bovis subsp bovis AF2122/97
uggcgccggggcgcagguug

SEQ ID NO: 3106094 - RNA, 20 nt, Mycobacterium bovis subsp bovis AF2122/97
uggcgccggucgccggcugg

SEQ ID NO: 3106095 - RNA, 12 nt, Mycobacterium bovis subsp bovis AF2122/97
uggcgccgucgg

SEQ ID NO: 3106096 - RNA, 17 nt, Mycobacterium bovis subsp bovis AF2122/97
uggcgccgucggccgag

SEQ ID NO: 3106097 - RNA, 19 nt, Mycobacterium bovis subsp bovis AF2122/97
uggcgccguugccggcguu

SEQ ID NO: 3106098 - RNA, 20 nt, Mycobacterium bovis subsp bovis AF2122/97
uggcgccguugccggcguug

SEQ ID NO: 3106099 - RNA, 21 nt, Mycobacterium bovis subsp bovis AF2122/97
uggcgcgcagguagucgacga

SEQ ID NO: 3106100 - RNA, 20 nt, Mycobacterium bovis subsp bovis AF2122/97
uggcgcgcccacagcccggg

SEQ ID NO: 3106101 - RNA, 22 nt, Mycobacterium bovis subsp bovis AF2122/97
uggcgcgcccacagcccgggcg

SEQ ID NO: 3106102 - RNA, 23 nt, Mycobacterium bovis subsp bovis AF2122/97
uggcgcgcccacagcccgggcgg

SEQ ID NO: 3106103 - RNA, 20 nt, Mycobacterium bovis subsp bovis AF2122/97
uggcgcgccugugccaccgc

SEQ ID NO: 3106104 - RNA, 15 nt, Mycobacterium bovis subsp bovis AF2122/97
uggcgcgcggggugg

SEQ ID NO: 3106105 - RNA, 19 nt, Mycobacterium bovis subsp bovis AF2122/97
uggcgcggagcugauugug

SEQ ID NO: 3106106 - RNA, 13 nt, Mycobacterium bovis subsp bovis AF2122/97
uggcgcggcgagc

SEQ ID NO: 3106107 - RNA, 21 nt, Mycobacterium bovis subsp bovis AF2122/97
uggcgcgggccggcgacuguc

SEQ ID NO: 3106108 - RNA, 15 nt, Mycobacterium bovis subsp bovis AF2122/97
uggcgcggggccgcc

SEQ ID NO: 3106109 - RNA, 18 nt, Mycobacterium bovis subsp bovis AF2122/97
uggcgcggguccagccac

SEQ ID NO: 3106110 - RNA, 22 nt, Mycobacterium bovis subsp bovis AF2122/97
uggcgcggguccagccaccgac

SEQ ID NO: 3106111 - RNA, 23 nt, Mycobacterium bovis subsp bovis AF2122/97
uggcgcguaggcccaacgacggc

SEQ ID NO: 3106112 - RNA, 13 nt, Mycobacterium bovis subsp bovis AF2122/97
uggcgcguaucgc

SEQ ID NO: 3106113 - RNA, 23 nt, Mycobacterium bovis subsp bovis AF2122/97
uggcgcguggucgggaacccggu

SEQ ID NO: 3106114 - RNA, 15 nt, Mycobacterium bovis subsp bovis AF2122/97
uggcgcugaagccga

SEQ ID NO: 3106115 - RNA, 16 nt, Mycobacterium bovis subsp bovis AF2122/97
uggcgcugaagccgac

SEQ ID NO: 3106116 - RNA, 18 nt, Mycobacterium bovis subsp bovis AF2122/97
uggcgcugaagccgacga

SEQ ID NO: 3106117 - RNA, 19 nt, Mycobacterium bovis subsp bovis AF2122/97
uggcgcugaagccgacgau

SEQ ID NO: 3106118 - RNA, 12 nt, Mycobacterium bovis subsp bovis AF2122/97
uggcgcugaucg

SEQ ID NO: 3106119 - RNA, 13 nt, Mycobacterium bovis subsp bovis AF2122/97
uggcgcugaucgg

SEQ ID NO: 3106120 - RNA, 16 nt, Mycobacterium bovis subsp bovis AF2122/97
uggcgcugaucggcag

SEQ ID NO: 3106121 - RNA, 12 nt, Mycobacterium bovis subsp bovis AF2122/97
uggcgcugaugc

SEQ ID NO: 3106122 - RNA, 17 nt, Mycobacterium bovis subsp bovis AF2122/97
uggcgcugaugcuggcc

SEQ ID NO: 3106123 - RNA, 18 nt, Mycobacterium bovis subsp bovis AF2122/97
uggcgcugauggugcugc

SEQ ID NO: 3106124 - RNA, 21 nt, Mycobacterium bovis subsp bovis AF2122/97
uggcgcugcccgccgccccgu

SEQ ID NO: 3106125 - RNA, 15 nt, Mycobacterium bovis subsp bovis AF2122/97
uggcgcugcucugag

SEQ ID NO: 3106126 - RNA, 17 nt, Mycobacterium bovis subsp bovis AF2122/97
uggcgcugggauguucg

SEQ ID NO: 3106127 - RNA, 11 nt, Mycobacterium bovis subsp bovis AF2122/97
uggcgcugggg

SEQ ID NO: 3106128 - RNA, 16 nt, Mycobacterium bovis subsp bovis AF2122/97
uggcgcuucggccacu

SEQ ID NO: 3106129 - RNA, 22 nt, Mycobacterium bovis subsp bovis AF2122/97
uggcggaacagcuucgcgcagc

SEQ ID NO: 3106130 - RNA, 15 nt, Mycobacterium bovis subsp bovis AF2122/97
uggcggacagggcgg

SEQ ID NO: 3106131 - RNA, 17 nt, Mycobacterium bovis subsp bovis AF2122/97
uggcggacagggcggca

SEQ ID NO: 3106132 - RNA, 15 nt, Mycobacterium bovis subsp bovis AF2122/97
uggcggacggcgucg

SEQ ID NO: 3106133 - RNA, 17 nt, Mycobacterium bovis subsp bovis AF2122/97
uggcggaucgcgagcgc

SEQ ID NO: 3106134 - RNA, 18 nt, Mycobacterium bovis subsp bovis AF2122/97
uggcggaucgcgagcgcc

SEQ ID NO: 3106135 - RNA, 14 nt, Mycobacterium bovis subsp bovis AF2122/97
uggcggaugcccgc

SEQ ID NO: 3106136 - RNA, 19 nt, Mycobacterium bovis subsp bovis AF2122/97
uggcggaugcccgcaacgc

SEQ ID NO: 3106137 - RNA, 22 nt, Mycobacterium bovis subsp bovis AF2122/97
uggcggcaaggguggggccggc

SEQ ID NO: 3106138 - RNA, 14 nt, Mycobacterium bovis subsp bovis AF2122/97
uggcggcagcaacg

SEQ ID NO: 3106139 - RNA, 14 nt, Mycobacterium bovis subsp bovis AF2122/97
uggcggcagcagcg

SEQ ID NO: 3106140 - RNA, 15 nt, Mycobacterium bovis subsp bovis AF2122/97
uggcggcagcagcgc

SEQ ID NO: 3106141 - RNA, 12 nt, Mycobacterium bovis subsp bovis AF2122/97
uggcggcaggug

SEQ ID NO: 3106142 - RNA, 19 nt, Mycobacterium bovis subsp bovis AF2122/97
uggcggcaggugcggcggc

SEQ ID NO: 3106143 - RNA, 21 nt, Mycobacterium bovis subsp bovis AF2122/97
uggcggcauacauccaggcug

SEQ ID NO: 3106144 - RNA, 22 nt, Mycobacterium bovis subsp bovis AF2122/97
uggcggccaacggcuccgggcg

SEQ ID NO: 3106145 - RNA, 21 nt, Mycobacterium bovis subsp bovis AF2122/97
uggcggccacaacagggugac

SEQ ID NO: 3106146 - RNA, 13 nt, Mycobacterium bovis subsp bovis AF2122/97
uggcggccaccag

SEQ ID NO: 3106147 - RNA, 17 nt, Mycobacterium bovis subsp bovis AF2122/97
uggcggccaccgucagc

SEQ ID NO: 3106148 - RNA, 19 nt, Mycobacterium bovis subsp bovis AF2122/97
uggcggccaccgucagcgc

SEQ ID NO: 3106149 - RNA, 20 nt, Mycobacterium bovis subsp bovis AF2122/97
uggcggccaccgucagcgcg

SEQ ID NO: 3106150 - RNA, 13 nt, Mycobacterium bovis subsp bovis AF2122/97
uggcggccagcgc

SEQ ID NO: 3106151 - RNA, 16 nt, Mycobacterium bovis subsp bovis AF2122/97
uggcggccagcgcacc

SEQ ID NO: 3106152 - RNA, 19 nt, Mycobacterium bovis subsp bovis AF2122/97
uggcggccagcgcaccgcc

SEQ ID NO: 3106153 - RNA, 19 nt, Mycobacterium bovis subsp bovis AF2122/97
uggcggccaguucggcggc

SEQ ID NO: 3106154 - RNA, 21 nt, Mycobacterium bovis subsp bovis AF2122/97
uggcggccaguucggcggccg

SEQ ID NO: 3106155 - RNA, 15 nt, Mycobacterium bovis subsp bovis AF2122/97
uggcggcccggguug

SEQ ID NO: 3106156 - RNA, 22 nt, Mycobacterium bovis subsp bovis AF2122/97
uggcggcccggguuggccgaac

SEQ ID NO: 3106157 - RNA, 14 nt, Mycobacterium bovis subsp bovis AF2122/97
uggcggcccggugg

SEQ ID NO: 3106158 - RNA, 14 nt, Mycobacterium bovis subsp bovis AF2122/97
uggcggccgcgacc

SEQ ID NO: 3106159 - RNA, 19 nt, Mycobacterium bovis subsp bovis AF2122/97
uggcggccuccuccccgac

SEQ ID NO: 3106160 - RNA, 18 nt, Mycobacterium bovis subsp bovis AF2122/97
uggcggccuugcucagca

SEQ ID NO: 3106161 - RNA, 19 nt, Mycobacterium bovis subsp bovis AF2122/97
uggcggcgacacgccaggu

SEQ ID NO: 3106162 - RNA, 14 nt, Mycobacterium bovis subsp bovis AF2122/97
uggcggcgacggcc

SEQ ID NO: 3106163 - RNA, 14 nt, Mycobacterium bovis subsp bovis AF2122/97
uggcggcgagcagc

SEQ ID NO: 3106164 - RNA, 18 nt, Mycobacterium bovis subsp bovis AF2122/97
uggcggcgagcggacaca

SEQ ID NO: 3106165 - RNA, 19 nt, Mycobacterium bovis subsp bovis AF2122/97
uggcggcgaucaacucggg

SEQ ID NO: 3106166 - RNA, 21 nt, Mycobacterium bovis subsp bovis AF2122/97
uggcggcgaugguaucgccgc

SEQ ID NO: 3106167 - RNA, 14 nt, Mycobacterium bovis subsp bovis AF2122/97
uggcggcgcagcgu

SEQ ID NO: 3106168 - RNA, 16 nt, Mycobacterium bovis subsp bovis AF2122/97
uggcggcgccgcagau

SEQ ID NO: 3106169 - RNA, 14 nt, Mycobacterium bovis subsp bovis AF2122/97
uggcggcgccggug

SEQ ID NO: 3106170 - RNA, 16 nt, Mycobacterium bovis subsp bovis AF2122/97
uggcggcgccgguggu

SEQ ID NO: 3106171 - RNA, 20 nt, Mycobacterium bovis subsp bovis AF2122/97
uggcggcgccggugguaccg

SEQ ID NO: 3106172 - RNA, 14 nt, Mycobacterium bovis subsp bovis AF2122/97
uggcggcgcgcgcu

SEQ ID NO: 3106173 - RNA, 20 nt, Mycobacterium bovis subsp bovis AF2122/97
uggcggcgcgcgcugcgcag

SEQ ID NO: 3106174 - RNA, 19 nt, Mycobacterium bovis subsp bovis AF2122/97
uggcggcgcguucgucguc

SEQ ID NO: 3106175 - RNA, 23 nt, Mycobacterium bovis subsp bovis AF2122/97
uggcggcggcauagugcgacugc

SEQ ID NO: 3106176 - RNA, 14 nt, Mycobacterium bovis subsp bovis AF2122/97
uggcggcggcggca

SEQ ID NO: 3106177 - RNA, 20 nt, Mycobacterium bovis subsp bovis AF2122/97
uggcggcgggccucggcgac

SEQ ID NO: 3106178 - RNA, 21 nt, Mycobacterium bovis subsp bovis AF2122/97
uggcggcgggccucggcgacc

SEQ ID NO: 3106179 - RNA, 13 nt, Mycobacterium bovis subsp bovis AF2122/97
uggcggcgggggc

SEQ ID NO: 3106180 - RNA, 16 nt, Mycobacterium bovis subsp bovis AF2122/97
uggcggcgggggcggc

SEQ ID NO: 3106181 - RNA, 15 nt, Mycobacterium bovis subsp bovis AF2122/97
uggcggcggugcagc

SEQ ID NO: 3106182 - RNA, 22 nt, Mycobacterium bovis subsp bovis AF2122/97
uggcggcggugccacgaucggc

SEQ ID NO: 3106183 - RNA, 17 nt, Mycobacterium bovis subsp bovis AF2122/97
uggcggcgguggccagc

SEQ ID NO: 3106184 - RNA, 19 nt, Mycobacterium bovis subsp bovis AF2122/97
uggcggcguagucguuguc

SEQ ID NO: 3106185 - RNA, 15 nt, Mycobacterium bovis subsp bovis AF2122/97
uggcggcucacgacc

SEQ ID NO: 3106186 - RNA, 20 nt, Mycobacterium bovis subsp bovis AF2122/97
uggcggcucguugcgggcgg

SEQ ID NO: 3106187 - RNA, 14 nt, Mycobacterium bovis subsp bovis AF2122/97
uggcggcugcagcc

SEQ ID NO: 3106188 - RNA, 17 nt, Mycobacterium bovis subsp bovis AF2122/97
uggcggcugcagccgac

SEQ ID NO: 3106189 - RNA, 21 nt, Mycobacterium bovis subsp bovis AF2122/97
uggcggcuucgccccgaggau

SEQ ID NO: 3106190 - RNA, 23 nt, Mycobacterium bovis subsp bovis AF2122/97
uggcgggaccgugacguaucgcc

SEQ ID NO: 3106191 - RNA, 18 nt, Mycobacterium bovis subsp bovis AF2122/97
uggcgggagaucgucgcc

SEQ ID NO: 3106192 - RNA, 19 nt, Mycobacterium bovis subsp bovis AF2122/97
uggcgggagcaccgaccag

SEQ ID NO: 3106193 - RNA, 16 nt, Mycobacterium bovis subsp bovis AF2122/97
uggcgggagccuuggu

SEQ ID NO: 3106194 - RNA, 12 nt, Mycobacterium bovis subsp bovis AF2122/97
uggcgggcugaa

SEQ ID NO: 3106195 - RNA, 16 nt, Mycobacterium bovis subsp bovis AF2122/97
uggcgggcugcagccg

SEQ ID NO: 3106196 - RNA, 19 nt, Mycobacterium bovis subsp bovis AF2122/97
uggcgggcugcagccgaca

SEQ ID NO: 3106197 - RNA, 21 nt, Mycobacterium bovis subsp bovis AF2122/97
uggcgggcuugccgucuucgc

SEQ ID NO: 3106198 - RNA, 19 nt, Mycobacterium bovis subsp bovis AF2122/97
uggcggggaaaccggccag

SEQ ID NO: 3106199 - RNA, 20 nt, Mycobacterium bovis subsp bovis AF2122/97
uggcgggguugaucaccgac

SEQ ID NO: 3106200 - RNA, 21 nt, Mycobacterium bovis subsp bovis AF2122/97
uggcggguaagcgaccgacgc

SEQ ID NO: 3106201 - RNA, 22 nt, Mycobacterium bovis subsp bovis AF2122/97
uggcgggugacuucguggccuu

SEQ ID NO: 3106202 - RNA, 14 nt, Mycobacterium bovis subsp bovis AF2122/97
uggcgggugcgaca

SEQ ID NO: 3106203 - RNA, 17 nt, Mycobacterium bovis subsp bovis AF2122/97
uggcgguaagcgaaaca

SEQ ID NO: 3106204 - RNA, 16 nt, Mycobacterium bovis subsp bovis AF2122/97
uggcgguccaccggcc

SEQ ID NO: 3106205 - RNA, 18 nt, Mycobacterium bovis subsp bovis AF2122/97
uggcggucccgcauaucc

SEQ ID NO: 3106206 - RNA, 20 nt, Mycobacterium bovis subsp bovis AF2122/97
uggcgguccggaaauuccgg

SEQ ID NO: 3106207 - RNA, 15 nt, Mycobacterium bovis subsp bovis AF2122/97
uggcggucgguuccg

SEQ ID NO: 3106208 - RNA, 20 nt, Mycobacterium bovis subsp bovis AF2122/97
uggcggucgguuccggugua

SEQ ID NO: 3106209 - RNA, 17 nt, Mycobacterium bovis subsp bovis AF2122/97
uggcggucuugccgcag

SEQ ID NO: 3106210 - RNA, 19 nt, Mycobacterium bovis subsp bovis AF2122/97
uggcggucuugccgcaggc

SEQ ID NO: 3106211 - RNA, 16 nt, Mycobacterium bovis subsp bovis AF2122/97
uggcggugccggcggc

SEQ ID NO: 3106212 - RNA, 14 nt, Mycobacterium bovis subsp bovis AF2122/97
uggcgguggccguc

SEQ ID NO: 3106213 - RNA, 16 nt, Mycobacterium bovis subsp bovis AF2122/97
uggcgguggccgucgg

SEQ ID NO: 3106214 - RNA, 22 nt, Mycobacterium bovis subsp bovis AF2122/97
uggcggugggcuuggcgccgau

SEQ ID NO: 3106215 - RNA, 14 nt, Mycobacterium bovis subsp bovis AF2122/97
uggcgguggugccg

SEQ ID NO: 3106216 - RNA, 19 nt, Mycobacterium bovis subsp bovis AF2122/97
uggcgguggugccgcggcc

SEQ ID NO: 3106217 - RNA, 23 nt, Mycobacterium bovis subsp bovis AF2122/97
uggcgguguaacccggaaccagc

SEQ ID NO: 3106218 - RNA, 16 nt, Mycobacterium bovis subsp bovis AF2122/97
uggcggugucggcgcc

SEQ ID NO: 3106219 - RNA, 19 nt, Mycobacterium bovis subsp bovis AF2122/97
uggcguaauugucgauguc

SEQ ID NO: 3106220 - RNA, 14 nt, Mycobacterium bovis subsp bovis AF2122/97
uggcguacucgggg

SEQ ID NO: 3106221 - RNA, 12 nt, Mycobacterium bovis subsp bovis AF2122/97
uggcguagcaac

SEQ ID NO: 3106222 - RNA, 15 nt, Mycobacterium bovis subsp bovis AF2122/97
uggcguagugcagcu

SEQ ID NO: 3106223 - RNA, 19 nt, Mycobacterium bovis subsp bovis AF2122/97
uggcguauccuugcgacgu

SEQ ID NO: 3106224 - RNA, 22 nt, Mycobacterium bovis subsp bovis AF2122/97
uggcgucaagcacacuggccac

SEQ ID NO: 3106225 - RNA, 13 nt, Mycobacterium bovis subsp bovis AF2122/97
uggcgucaccgcc

SEQ ID NO: 3106226 - RNA, 17 nt, Mycobacterium bovis subsp bovis AF2122/97
uggcgucaccgccggug

SEQ ID NO: 3106227 - RNA, 18 nt, Mycobacterium bovis subsp bovis AF2122/97
uggcgucaccgcgggugg

SEQ ID NO: 3106228 - RNA, 15 nt, Mycobacterium bovis subsp bovis AF2122/97
uggcgucagugcaga

SEQ ID NO: 3106229 - RNA, 22 nt, Mycobacterium bovis subsp bovis AF2122/97
uggcgucgaaccagucgaagaa

SEQ ID NO: 3106230 - RNA, 17 nt, Mycobacterium bovis subsp bovis AF2122/97
uggcgucgacaucggug

SEQ ID NO: 3106231 - RNA, 23 nt, Mycobacterium bovis subsp bovis AF2122/97
uggcgucgaugccggcugccgca

SEQ ID NO: 3106232 - RNA, 20 nt, Mycobacterium bovis subsp bovis AF2122/97
uggcgucgccggcaccggcc

SEQ ID NO: 3106233 - RNA, 13 nt, Mycobacterium bovis subsp bovis AF2122/97
uggcgucggccag

SEQ ID NO: 3106234 - RNA, 15 nt, Mycobacterium bovis subsp bovis AF2122/97
uggcgucggccagga

SEQ ID NO: 3106235 - RNA, 15 nt, Mycobacterium bovis subsp bovis AF2122/97
uggcgucggccggca

SEQ ID NO: 3106236 - RNA, 22 nt, Mycobacterium bovis subsp bovis AF2122/97
uggcgucggugaaugccgucgc

SEQ ID NO: 3106237 - RNA, 12 nt, Mycobacterium bovis subsp bovis AF2122/97
uggcgucgucgg

SEQ ID NO: 3106238 - RNA, 20 nt, Mycobacterium bovis subsp bovis AF2122/97
uggcgucuuggaaggcgcgc

SEQ ID NO: 3106239 - RNA, 11 nt, Mycobacterium bovis subsp bovis AF2122/97
uggcgugcaga

SEQ ID NO: 3106240 - RNA, 14 nt, Mycobacterium bovis subsp bovis AF2122/97
uggcgugccgucgc

SEQ ID NO: 3106241 - RNA, 15 nt, Mycobacterium bovis subsp bovis AF2122/97
uggcgugccgucgcc

SEQ ID NO: 3106242 - RNA, 21 nt, Mycobacterium bovis subsp bovis AF2122/97
uggcguggaucuuggccagca

SEQ ID NO: 3106243 - RNA, 23 nt, Mycobacterium bovis subsp bovis AF2122/97
uggcgugggcacuugcccgucgg

SEQ ID NO: 3106244 - RNA, 16 nt, Mycobacterium bovis subsp bovis AF2122/97
uggcgugucgccgcca

SEQ ID NO: 3106245 - RNA, 19 nt, Mycobacterium bovis subsp bovis AF2122/97
uggcguucagcggccagca

SEQ ID NO: 3106246 - RNA, 15 nt, Mycobacterium bovis subsp bovis AF2122/97
uggcguucggugagg

SEQ ID NO: 3106247 - RNA, 21 nt, Mycobacterium bovis subsp bovis AF2122/97
uggcguucugcgcccguccgc

SEQ ID NO: 3106248 - RNA, 14 nt, Mycobacterium bovis subsp bovis AF2122/97
uggcguugaccagc

SEQ ID NO: 3106249 - RNA, 13 nt, Mycobacterium bovis subsp bovis AF2122/97
uggcguugaggac

SEQ ID NO: 3106250 - RNA, 21 nt, Mycobacterium bovis subsp bovis AF2122/97
uggcguugaggacguggacuu

SEQ ID NO: 3106251 - RNA, 16 nt, Mycobacterium bovis subsp bovis AF2122/97
uggcguugccaccgga

SEQ ID NO: 3106252 - RNA, 17 nt, Mycobacterium bovis subsp bovis AF2122/97
uggcguugccaccggag

SEQ ID NO: 3106253 - RNA, 20 nt, Mycobacterium bovis subsp bovis AF2122/97
uggcguugccaccggagccg

SEQ ID NO: 3106254 - RNA, 17 nt, Mycobacterium bovis subsp bovis AF2122/97
uggcguuggcgaucucg

SEQ ID NO: 3106255 - RNA, 18 nt, Mycobacterium bovis subsp bovis AF2122/97
uggcguuggcgguaaacc

SEQ ID NO: 3106256 - RNA, 14 nt, Mycobacterium bovis subsp bovis AF2122/97
uggcguugggcagc

SEQ ID NO: 3106257 - RNA, 17 nt, Mycobacterium bovis subsp bovis AF2122/97
uggcguugguggucggc

SEQ ID NO: 3106258 - RNA, 16 nt, Mycobacterium bovis subsp bovis AF2122/97
uggcguugguggucug

SEQ ID NO: 3106259 - RNA, 17 nt, Mycobacterium bovis subsp bovis AF2122/97
uggcguuugccggccga

SEQ ID NO: 3106260 - RNA, 20 nt, Mycobacterium bovis subsp bovis AF2122/97
uggcuaacaccgcaggcaca

SEQ ID NO: 3106261 - RNA, 13 nt, Mycobacterium bovis subsp bovis AF2122/97
uggcuacgcccca

SEQ ID NO: 3106262 - RNA, 19 nt, Mycobacterium bovis subsp bovis AF2122/97
uggcuacgccccacugccg

SEQ ID NO: 3106263 - RNA, 20 nt, Mycobacterium bovis subsp bovis AF2122/97
uggcuacgggccgcgguacc

SEQ ID NO: 3106264 - RNA, 21 nt, Mycobacterium bovis subsp bovis AF2122/97
uggcuacgggccgcgguaccc

SEQ ID NO: 3106265 - RNA, 22 nt, Mycobacterium bovis subsp bovis AF2122/97
uggcuaguugggugggugcagc

SEQ ID NO: 3106266 - RNA, 24 nt, Mycobacterium bovis subsp bovis AF2122/97
uggcucaccagcuccucgugcucg

SEQ ID NO: 3106267 - RNA, 19 nt, Mycobacterium bovis subsp bovis AF2122/97
uggcucacccaggcgccga

SEQ ID NO: 3106268 - RNA, 13 nt, Mycobacterium bovis subsp bovis AF2122/97
uggcucacgcucc

SEQ ID NO: 3106269 - RNA, 18 nt, Mycobacterium bovis subsp bovis AF2122/97
uggcucacgcuccgccgg

SEQ ID NO: 3106270 - RNA, 14 nt, Mycobacterium bovis subsp bovis AF2122/97
uggcucaucgaugc

SEQ ID NO: 3106271 - RNA, 14 nt, Mycobacterium bovis subsp bovis AF2122/97
uggcucgagccgcc

SEQ ID NO: 3106272 - RNA, 22 nt, Mycobacterium bovis subsp bovis AF2122/97
uggcucgccgaaaagggcgaca

SEQ ID NO: 3106273 - RNA, 20 nt, Mycobacterium bovis subsp bovis AF2122/97
uggcucgcggaugcucguug

SEQ ID NO: 3106274 - RNA, 22 nt, Mycobacterium bovis subsp bovis AF2122/97
uggcucgcggaugcucguuguu

SEQ ID NO: 3106275 - RNA, 13 nt, Mycobacterium bovis subsp bovis AF2122/97
uggcucgcuggga

SEQ ID NO: 3106276 - RNA, 14 nt, Mycobacterium bovis subsp bovis AF2122/97
uggcucggcauccc

SEQ ID NO: 3106277 - RNA, 17 nt, Mycobacterium bovis subsp bovis AF2122/97
uggcugaacaccgcggg

SEQ ID NO: 3106278 - RNA, 22 nt, Mycobacterium bovis subsp bovis AF2122/97
uggcugaacaccgcgggcagua

SEQ ID NO: 3106279 - RNA, 16 nt, Mycobacterium bovis subsp bovis AF2122/97
uggcugagcagcgcgg

SEQ ID NO: 3106280 - RNA, 21 nt, Mycobacterium bovis subsp bovis AF2122/97
uggcugagcagcgcggccaga

SEQ ID NO: 3106281 - RNA, 14 nt, Mycobacterium bovis subsp bovis AF2122/97
uggcugaucccggc

SEQ ID NO: 3106282 - RNA, 19 nt, Mycobacterium bovis subsp bovis AF2122/97
uggcugaucccggccaggc

SEQ ID NO: 3106283 - RNA, 15 nt, Mycobacterium bovis subsp bovis AF2122/97
uggcugcacuggccc

SEQ ID NO: 3106284 - RNA, 15 nt, Mycobacterium bovis subsp bovis AF2122/97
uggcugccacgaacg

SEQ ID NO: 3106285 - RNA, 20 nt, Mycobacterium bovis subsp bovis AF2122/97
uggcugccuucggcgagcgg

SEQ ID NO: 3106286 - RNA, 13 nt, Mycobacterium bovis subsp bovis AF2122/97
uggcuggacccgc

SEQ ID NO: 3106287 - RNA, 16 nt, Mycobacterium bovis subsp bovis AF2122/97
uggcuggcaugccggc

SEQ ID NO: 3106288 - RNA, 15 nt, Mycobacterium bovis subsp bovis AF2122/97
uggcuggccgccacc

SEQ ID NO: 3106289 - RNA, 15 nt, Mycobacterium bovis subsp bovis AF2122/97
uggcuggcggcgacc

SEQ ID NO: 3106290 - RNA, 18 nt, Mycobacterium bovis subsp bovis AF2122/97
uggcugguuucggggacc

SEQ ID NO: 3106291 - RNA, 20 nt, Mycobacterium bovis subsp bovis AF2122/97
uggcuguaaaaaugcuucgc

SEQ ID NO: 3106292 - RNA, 18 nt, Mycobacterium bovis subsp bovis AF2122/97
uggcuguacccgaccagc

SEQ ID NO: 3106293 - RNA, 17 nt, Mycobacterium bovis subsp bovis AF2122/97
uggcuguccgcgggccg

SEQ ID NO: 3106294 - RNA, 20 nt, Mycobacterium bovis subsp bovis AF2122/97
uggcugugauguuguucagc

SEQ ID NO: 3106295 - RNA, 14 nt, Mycobacterium bovis subsp bovis AF2122/97
uggcuucaacccgg

SEQ ID NO: 3106296 - RNA, 15 nt, Mycobacterium bovis subsp bovis AF2122/97
uggcuucaacccggg

SEQ ID NO: 3106297 - RNA, 20 nt, Mycobacterium bovis subsp bovis AF2122/97
uggcuucaacccgggcagca

SEQ ID NO: 3106298 - RNA, 17 nt, Mycobacterium bovis subsp bovis AF2122/97
uggcuucgaagcgaucg

SEQ ID NO: 3106299 - RNA, 17 nt, Mycobacterium bovis subsp bovis AF2122/97
uggcuugacgcccgggc

SEQ ID NO: 3106300 - RNA, 16 nt, Mycobacterium bovis subsp bovis AF2122/97
uggcuugaguuucggc

SEQ ID NO: 3106301 - RNA, 19 nt, Mycobacterium bovis subsp bovis AF2122/97
uggcuuuugcgucugcucg

SEQ ID NO: 3106302 - RNA, 15 nt, Mycobacterium bovis subsp bovis AF2122/97
ugggaaggauggucg

SEQ ID NO: 3106303 - RNA, 21 nt, Mycobacterium bovis subsp bovis AF2122/97
ugggacaggacgacuggaagg

SEQ ID NO: 3106304 - RNA, 18 nt, Mycobacterium bovis subsp bovis AF2122/97
ugggacaggucggcaucc

SEQ ID NO: 3106305 - RNA, 21 nt, Mycobacterium bovis subsp bovis AF2122/97
ugggaccagugcgguggcagg

SEQ ID NO: 3106306 - RNA, 11 nt, Mycobacterium bovis subsp bovis AF2122/97
ugggaccggca

SEQ ID NO: 3106307 - RNA, 22 nt, Mycobacterium bovis subsp bovis AF2122/97
ugggacgcgcggauuucgccgu

SEQ ID NO: 3106308 - RNA, 12 nt, Mycobacterium bovis subsp bovis AF2122/97
ugggacggcggc

SEQ ID NO: 3106309 - RNA, 14 nt, Mycobacterium bovis subsp bovis AF2122/97
ugggacuggcguga

SEQ ID NO: 3106310 - RNA, 16 nt, Mycobacterium bovis subsp bovis AF2122/97
ugggagcccggcggcc

SEQ ID NO: 3106311 - RNA, 20 nt, Mycobacterium bovis subsp bovis AF2122/97
ugggagcuacccgggccagg

SEQ ID NO: 3106312 - RNA, 15 nt, Mycobacterium bovis subsp bovis AF2122/97
ugggagcuacgguac

SEQ ID NO: 3106313 - RNA, 13 nt, Mycobacterium bovis subsp bovis AF2122/97
ugggagucgucgu

SEQ ID NO: 3106314 - RNA, 15 nt, Mycobacterium bovis subsp bovis AF2122/97
ugggauaccccuccg

SEQ ID NO: 3106315 - RNA, 14 nt, Mycobacterium bovis subsp bovis AF2122/97
ugggauacucgucg

SEQ ID NO: 3106316 - RNA, 19 nt, Mycobacterium bovis subsp bovis AF2122/97
ugggaucccagcgcagcgg

SEQ ID NO: 3106317 - RNA, 22 nt, Mycobacterium bovis subsp bovis AF2122/97
ugggaucgcagcgccauuccaa

SEQ ID NO: 3106318 - RNA, 18 nt, Mycobacterium bovis subsp bovis AF2122/97
ugggaucggauuuuccgc

SEQ ID NO: 3106319 - RNA, 19 nt, Mycobacterium bovis subsp bovis AF2122/97
ugggauugaagcuggccac

SEQ ID NO: 3106320 - RNA, 21 nt, Mycobacterium bovis subsp bovis AF2122/97
ugggcaaacugggcaccggcg

SEQ ID NO: 3106321 - RNA, 21 nt, Mycobacterium bovis subsp bovis AF2122/97
ugggcaauccggucagcgcgg

SEQ ID NO: 3106322 - RNA, 20 nt, Mycobacterium bovis subsp bovis AF2122/97
ugggcaccacccgauuggcc

SEQ ID NO: 3106323 - RNA, 13 nt, Mycobacterium bovis subsp bovis AF2122/97
ugggcaccggcgg

SEQ ID NO: 3106324 - RNA, 19 nt, Mycobacterium bovis subsp bovis AF2122/97
ugggcacuugcccgucggc

SEQ ID NO: 3106325 - RNA, 20 nt, Mycobacterium bovis subsp bovis AF2122/97
ugggcacuugcccgucggcg

SEQ ID NO: 3106326 - RNA, 20 nt, Mycobacterium bovis subsp bovis AF2122/97
ugggcagaccgaucggcagg

SEQ ID NO: 3106327 - RNA, 14 nt, Mycobacterium bovis subsp bovis AF2122/97
ugggcagcagcgcg

SEQ ID NO: 3106328 - RNA, 15 nt, Mycobacterium bovis subsp bovis AF2122/97
ugggcagcagcgcgc

SEQ ID NO: 3106329 - RNA, 23 nt, Mycobacterium bovis subsp bovis AF2122/97
ugggcaggaucgaggcgucggca

SEQ ID NO: 3106330 - RNA, 14 nt, Mycobacterium bovis subsp bovis AF2122/97
ugggcaucaccgcc

SEQ ID NO: 3106331 - RNA, 16 nt, Mycobacterium bovis subsp bovis AF2122/97
ugggcaucaccgccgc

SEQ ID NO: 3106332 - RNA, 22 nt, Mycobacterium bovis subsp bovis AF2122/97
ugggcaucacuucauggggcua

SEQ ID NO: 3106333 - RNA, 18 nt, Mycobacterium bovis subsp bovis AF2122/97
ugggcaucaucgacgcgc

SEQ ID NO: 3106334 - RNA, 16 nt, Mycobacterium bovis subsp bovis AF2122/97
ugggcauugcggcgcg

SEQ ID NO: 3106335 - RNA, 21 nt, Mycobacterium bovis subsp bovis AF2122/97
ugggcauugcggcgcgggugc

SEQ ID NO: 3106336 - RNA, 19 nt, Mycobacterium bovis subsp bovis AF2122/97
ugggccagcagcaaccgcc

SEQ ID NO: 3106337 - RNA, 14 nt, Mycobacterium bovis subsp bovis AF2122/97
ugggccagcagccg

SEQ ID NO: 3106338 - RNA, 17 nt, Mycobacterium bovis subsp bovis AF2122/97
ugggccagugaaaccac

SEQ ID NO: 3106339 - RNA, 21 nt, Mycobacterium bovis subsp bovis AF2122/97
ugggccaugcuaggaccacca

SEQ ID NO: 3106340 - RNA, 23 nt, Mycobacterium bovis subsp bovis AF2122/97
ugggccaugcuaggaccaccagc

SEQ ID NO: 3106341 - RNA, 16 nt, Mycobacterium bovis subsp bovis AF2122/97
ugggccccgaucccga

SEQ ID NO: 3106342 - RNA, 14 nt, Mycobacterium bovis subsp bovis AF2122/97
ugggccccgccgau

SEQ ID NO: 3106343 - RNA, 15 nt, Mycobacterium bovis subsp bovis AF2122/97
ugggcccgccagccc

SEQ ID NO: 3106344 - RNA, 17 nt, Mycobacterium bovis subsp bovis AF2122/97
ugggcccgccagcccag

SEQ ID NO: 3106345 - RNA, 14 nt, Mycobacterium bovis subsp bovis AF2122/97
ugggcccgcuggug

SEQ ID NO: 3106346 - RNA, 19 nt, Mycobacterium bovis subsp bovis AF2122/97
ugggcccugcacagcagcg

SEQ ID NO: 3106347 - RNA, 21 nt, Mycobacterium bovis subsp bovis AF2122/97
ugggcccugcacagcagcguc

SEQ ID NO: 3106348 - RNA, 18 nt, Mycobacterium bovis subsp bovis AF2122/97
ugggcccuucacuguugc

SEQ ID NO: 3106349 - RNA, 21 nt, Mycobacterium bovis subsp bovis AF2122/97
ugggcccuuugcuguccccgc

SEQ ID NO: 3106350 - RNA, 14 nt, Mycobacterium bovis subsp bovis AF2122/97
ugggccgacgggac

SEQ ID NO: 3106351 - RNA, 14 nt, Mycobacterium bovis subsp bovis AF2122/97
ugggccgacgugac

SEQ ID NO: 3106352 - RNA, 20 nt, Mycobacterium bovis subsp bovis AF2122/97
ugggccgacgugaccagcuu

SEQ ID NO: 3106353 - RNA, 21 nt, Mycobacterium bovis subsp bovis AF2122/97
ugggccgacugggcgcgaccc

SEQ ID NO: 3106354 - RNA, 23 nt, Mycobacterium bovis subsp bovis AF2122/97
ugggccgcacaaguggucgauga

SEQ ID NO: 3106355 - RNA, 19 nt, Mycobacterium bovis subsp bovis AF2122/97
ugggccgcccaaagaaaug

SEQ ID NO: 3106356 - RNA, 21 nt, Mycobacterium bovis subsp bovis AF2122/97
ugggccgcugggauucugggc

SEQ ID NO: 3106357 - RNA, 21 nt, Mycobacterium bovis subsp bovis AF2122/97
ugggccgggaugaagccaccc

SEQ ID NO: 3106358 - RNA, 14 nt, Mycobacterium bovis subsp bovis AF2122/97
ugggccuccaccgc

SEQ ID NO: 3106359 - RNA, 19 nt, Mycobacterium bovis subsp bovis AF2122/97
ugggccuccaccgcgucca

SEQ ID NO: 3106360 - RNA, 18 nt, Mycobacterium bovis subsp bovis AF2122/97
ugggccugcccggcgccg

SEQ ID NO: 3106361 - RNA, 16 nt, Mycobacterium bovis subsp bovis AF2122/97
ugggccugggccgcac

SEQ ID NO: 3106362 - RNA, 20 nt, Mycobacterium bovis subsp bovis AF2122/97
ugggccuuguugccgcgcca

SEQ ID NO: 3106363 - RNA, 18 nt, Mycobacterium bovis subsp bovis AF2122/97
ugggcgacgcggcgccgc

SEQ ID NO: 3106364 - RNA, 13 nt, Mycobacterium bovis subsp bovis AF2122/97
ugggcgacggcca

SEQ ID NO: 3106365 - RNA, 23 nt, Mycobacterium bovis subsp bovis AF2122/97
ugggcgacggccaagaucggcgc

SEQ ID NO: 3106366 - RNA, 19 nt, Mycobacterium bovis subsp bovis AF2122/97
ugggcgacggcgaugaucg

SEQ ID NO: 3106367 - RNA, 16 nt, Mycobacterium bovis subsp bovis AF2122/97
ugggcgacuaccggcu

SEQ ID NO: 3106368 - RNA, 15 nt, Mycobacterium bovis subsp bovis AF2122/97
ugggcgagaccgcga

SEQ ID NO: 3106369 - RNA, 20 nt, Mycobacterium bovis subsp bovis AF2122/97
ugggcgagaccgcgagcagc

SEQ ID NO: 3106370 - RNA, 23 nt, Mycobacterium bovis subsp bovis AF2122/97
ugggcgagaccgcgagcagcaca

SEQ ID NO: 3106371 - RNA, 16 nt, Mycobacterium bovis subsp bovis AF2122/97
ugggcgagucgaucuc

SEQ ID NO: 3106372 - RNA, 14 nt, Mycobacterium bovis subsp bovis AF2122/97
ugggcgagucgggg

SEQ ID NO: 3106373 - RNA, 19 nt, Mycobacterium bovis subsp bovis AF2122/97
ugggcgauaaggaccgcgc

SEQ ID NO: 3106374 - RNA, 17 nt, Mycobacterium bovis subsp bovis AF2122/97
ugggcgaugacgccauc

SEQ ID NO: 3106375 - RNA, 17 nt, Mycobacterium bovis subsp bovis AF2122/97
ugggcgauggcaccggc

SEQ ID NO: 3106376 - RNA, 18 nt, Mycobacterium bovis subsp bovis AF2122/97
ugggcgauggcaccggcg

SEQ ID NO: 3106377 - RNA, 19 nt, Mycobacterium bovis subsp bovis AF2122/97
ugggcgauucugcgucugc

SEQ ID NO: 3106378 - RNA, 20 nt, Mycobacterium bovis subsp bovis AF2122/97
ugggcgauucugcgucugcu

SEQ ID NO: 3106379 - RNA, 20 nt, Mycobacterium bovis subsp bovis AF2122/97
ugggcgauucugugucugcu

SEQ ID NO: 3106380 - RNA, 18 nt, Mycobacterium bovis subsp bovis AF2122/97
ugggcgauuuugcgucuc

SEQ ID NO: 3106381 - RNA, 20 nt, Mycobacterium bovis subsp bovis AF2122/97
ugggcgauuuugcgucucgc

SEQ ID NO: 3106382 - RNA, 19 nt, Mycobacterium bovis subsp bovis AF2122/97
ugggcgauuuugcgucugc

SEQ ID NO: 3106383 - RNA, 13 nt, Mycobacterium bovis subsp bovis AF2122/97
ugggcgcaacgcc

SEQ ID NO: 3106384 - RNA, 13 nt, Mycobacterium bovis subsp bovis AF2122/97
ugggcgccaccau

SEQ ID NO: 3106385 - RNA, 23 nt, Mycobacterium bovis subsp bovis AF2122/97
ugggcgccaugcgccaacccggc

SEQ ID NO: 3106386 - RNA, 17 nt, Mycobacterium bovis subsp bovis AF2122/97
ugggcgcccgcgguccg

SEQ ID NO: 3106387 - RNA, 19 nt, Mycobacterium bovis subsp bovis AF2122/97
ugggcgccgacaccggcug

SEQ ID NO: 3106388 - RNA, 17 nt, Mycobacterium bovis subsp bovis AF2122/97
ugggcgccgcaaccgcc

SEQ ID NO: 3106389 - RNA, 11 nt, Mycobacterium bovis subsp bovis AF2122/97
ugggcgccggu

SEQ ID NO: 3106390 - RNA, 16 nt, Mycobacterium bovis subsp bovis AF2122/97
ugggcgccgucgccgu

SEQ ID NO: 3106391 - RNA, 15 nt, Mycobacterium bovis subsp bovis AF2122/97
ugggcgcgcucaucg

SEQ ID NO: 3106392 - RNA, 16 nt, Mycobacterium bovis subsp bovis AF2122/97
ugggcgcgcucaucga

SEQ ID NO: 3106393 - RNA, 15 nt, Mycobacterium bovis subsp bovis AF2122/97
ugggcgcgcuggcgg

SEQ ID NO: 3106394 - RNA, 13 nt, Mycobacterium bovis subsp bovis AF2122/97
ugggcgcggcagg

SEQ ID NO: 3106395 - RNA, 16 nt, Mycobacterium bovis subsp bovis AF2122/97
ugggcgcggcaggccu

SEQ ID NO: 3106396 - RNA, 13 nt, Mycobacterium bovis subsp bovis AF2122/97
ugggcgcggcgcc

SEQ ID NO: 3106397 - RNA, 14 nt, Mycobacterium bovis subsp bovis AF2122/97
ugggcgcggcgcca

SEQ ID NO: 3106398 - RNA, 20 nt, Mycobacterium bovis subsp bovis AF2122/97
ugggcgcguagcucagcggu

SEQ ID NO: 3106399 - RNA, 15 nt, Mycobacterium bovis subsp bovis AF2122/97
ugggcgcugucacgu

SEQ ID NO: 3106400 - RNA, 22 nt, Mycobacterium bovis subsp bovis AF2122/97
ugggcgcugucacguagcgagc

SEQ ID NO: 3106401 - RNA, 14 nt, Mycobacterium bovis subsp bovis AF2122/97
ugggcgcuucugcu

SEQ ID NO: 3106402 - RNA, 13 nt, Mycobacterium bovis subsp bovis AF2122/97
ugggcggcacugg

SEQ ID NO: 3106403 - RNA, 19 nt, Mycobacterium bovis subsp bovis AF2122/97
ugggcggcauagcucagac

SEQ ID NO: 3106404 - RNA, 23 nt, Mycobacterium bovis subsp bovis AF2122/97
ugggcggcauagcucagaccggc

SEQ ID NO: 3106405 - RNA, 17 nt, Mycobacterium bovis subsp bovis AF2122/97
ugggcggcauuaccaac

SEQ ID NO: 3106406 - RNA, 14 nt, Mycobacterium bovis subsp bovis AF2122/97
ugggcggccagcac

SEQ ID NO: 3106407 - RNA, 19 nt, Mycobacterium bovis subsp bovis AF2122/97
ugggcggccagcacgucgu

SEQ ID NO: 3106408 - RNA, 16 nt, Mycobacterium bovis subsp bovis AF2122/97
ugggcggcccaccggc

SEQ ID NO: 3106409 - RNA, 17 nt, Mycobacterium bovis subsp bovis AF2122/97
ugggcggcccaccggcc

SEQ ID NO: 3106410 - RNA, 18 nt, Mycobacterium bovis subsp bovis AF2122/97
ugggcggcccaccggcca

SEQ ID NO: 3106411 - RNA, 17 nt, Mycobacterium bovis subsp bovis AF2122/97
ugggcggccuggucggc

SEQ ID NO: 3106412 - RNA, 22 nt, Mycobacterium bovis subsp bovis AF2122/97
ugggcggccuggucggccaggu

SEQ ID NO: 3106413 - RNA, 14 nt, Mycobacterium bovis subsp bovis AF2122/97
ugggcggcgagcgc

SEQ ID NO: 3106414 - RNA, 15 nt, Mycobacterium bovis subsp bovis AF2122/97
ugggcggcucgucga

SEQ ID NO: 3106415 - RNA, 19 nt, Mycobacterium bovis subsp bovis AF2122/97
ugggcgggaaguucgucgg

SEQ ID NO: 3106416 - RNA, 20 nt, Mycobacterium bovis subsp bovis AF2122/97
ugggcgggcaaucaccgccg

SEQ ID NO: 3106417 - RNA, 22 nt, Mycobacterium bovis subsp bovis AF2122/97
ugggcgggcuuggcgucgacgu

SEQ ID NO: 3106418 - RNA, 16 nt, Mycobacterium bovis subsp bovis AF2122/97
ugggcgguagccgacg

SEQ ID NO: 3106419 - RNA, 14 nt, Mycobacterium bovis subsp bovis AF2122/97
ugggcgguagcuuc

SEQ ID NO: 3106420 - RNA, 20 nt, Mycobacterium bovis subsp bovis AF2122/97
ugggcggugaaggccccgcc

SEQ ID NO: 3106421 - RNA, 15 nt, Mycobacterium bovis subsp bovis AF2122/97
ugggcggugucgucg

SEQ ID NO: 3106422 - RNA, 19 nt, Mycobacterium bovis subsp bovis AF2122/97
ugggcggugucgucgaggu

SEQ ID NO: 3106423 - RNA, 15 nt, Mycobacterium bovis subsp bovis AF2122/97
ugggcgguugaucgc

SEQ ID NO: 3106424 - RNA, 20 nt, Mycobacterium bovis subsp bovis AF2122/97
ugggcgguugaucgccggcc

SEQ ID NO: 3106425 - RNA, 21 nt, Mycobacterium bovis subsp bovis AF2122/97
ugggcguacucggcgcgcagc

SEQ ID NO: 3106426 - RNA, 13 nt, Mycobacterium bovis subsp bovis AF2122/97
ugggcgucaagca

SEQ ID NO: 3106427 - RNA, 14 nt, Mycobacterium bovis subsp bovis AF2122/97
ugggcgucgaagac

SEQ ID NO: 3106428 - RNA, 20 nt, Mycobacterium bovis subsp bovis AF2122/97
ugggcgucgucuugaccgcu

SEQ ID NO: 3106429 - RNA, 18 nt, Mycobacterium bovis subsp bovis AF2122/97
ugggcgugacgggcagga

SEQ ID NO: 3106430 - RNA, 21 nt, Mycobacterium bovis subsp bovis AF2122/97
ugggcgugacguagugcaccg

SEQ ID NO: 3106431 - RNA, 16 nt, Mycobacterium bovis subsp bovis AF2122/97
ugggcgugcaggcugg

SEQ ID NO: 3106432 - RNA, 22 nt, Mycobacterium bovis subsp bovis AF2122/97
ugggcguucccccggcaccgcc

SEQ ID NO: 3106433 - RNA, 23 nt, Mycobacterium bovis subsp bovis AF2122/97
ugggcguucccccggcaccgccg

SEQ ID NO: 3106434 - RNA, 15 nt, Mycobacterium bovis subsp bovis AF2122/97
ugggcguuggcggca

SEQ ID NO: 3106435 - RNA, 16 nt, Mycobacterium bovis subsp bovis AF2122/97
ugggcugaggguggac

SEQ ID NO: 3106436 - RNA, 14 nt, Mycobacterium bovis subsp bovis AF2122/97
ugggcugccggcca

SEQ ID NO: 3106437 - RNA, 15 nt, Mycobacterium bovis subsp bovis AF2122/97
ugggcugcggccgcg

SEQ ID NO: 3106438 - RNA, 13 nt, Mycobacterium bovis subsp bovis AF2122/97
ugggcuggccagc

SEQ ID NO: 3106439 - RNA, 21 nt, Mycobacterium bovis subsp bovis AF2122/97
ugggcugggauagcgcgguug

SEQ ID NO: 3106440 - RNA, 21 nt, Mycobacterium bovis subsp bovis AF2122/97
ugggcuucgaguuuggcgacg

SEQ ID NO: 3106441 - RNA, 22 nt, Mycobacterium bovis subsp bovis AF2122/97
ugggcuucgaguuuggcgacga

SEQ ID NO: 3106442 - RNA, 15 nt, Mycobacterium bovis subsp bovis AF2122/97
ugggcuugccgcgca

SEQ ID NO: 3106443 - RNA, 15 nt, Mycobacterium bovis subsp bovis AF2122/97
ugggcuugcgccgga

SEQ ID NO: 3106444 - RNA, 14 nt, Mycobacterium bovis subsp bovis AF2122/97
ugggcuuucagcac

SEQ ID NO: 3106445 - RNA, 19 nt, Mycobacterium bovis subsp bovis AF2122/97
ugggcuuucugcacccgcc

SEQ ID NO: 3106446 - RNA, 16 nt, Mycobacterium bovis subsp bovis AF2122/97
ugggcuuuugcgucug

SEQ ID NO: 3106447 - RNA, 17 nt, Mycobacterium bovis subsp bovis AF2122/97
ugggcuuuugcgucugc

SEQ ID NO: 3106448 - RNA, 15 nt, Mycobacterium bovis subsp bovis AF2122/97
uggggacccgcucca

SEQ ID NO: 3106449 - RNA, 18 nt, Mycobacterium bovis subsp bovis AF2122/97
uggggacccgcuccaagc

SEQ ID NO: 3106450 - RNA, 19 nt, Mycobacterium bovis subsp bovis AF2122/97
uggggaccggcaggccggc

SEQ ID NO: 3106451 - RNA, 22 nt, Mycobacterium bovis subsp bovis AF2122/97
uggggaccggcaggccggcguc

SEQ ID NO: 3106452 - RNA, 23 nt, Mycobacterium bovis subsp bovis AF2122/97
uggggauaaacugccgcggcacc

SEQ ID NO: 3106453 - RNA, 18 nt, Mycobacterium bovis subsp bovis AF2122/97
uggggauagccgcgucgc

SEQ ID NO: 3106454 - RNA, 22 nt, Mycobacterium bovis subsp bovis AF2122/97
uggggaucgcaccgugggcccu

SEQ ID NO: 3106455 - RNA, 13 nt, Mycobacterium bovis subsp bovis AF2122/97
uggggcacgacgc

SEQ ID NO: 3106456 - RNA, 14 nt, Mycobacterium bovis subsp bovis AF2122/97
uggggcacgacgcc

SEQ ID NO: 3106457 - RNA, 22 nt, Mycobacterium bovis subsp bovis AF2122/97
uggggcacuuccagcccggcaa

SEQ ID NO: 3106458 - RNA, 23 nt, Mycobacterium bovis subsp bovis AF2122/97
uggggcagucccggugggcggcu

SEQ ID NO: 3106459 - RNA, 20 nt, Mycobacterium bovis subsp bovis AF2122/97
uggggccgcggcgcgacggc

SEQ ID NO: 3106460 - RNA, 21 nt, Mycobacterium bovis subsp bovis AF2122/97
uggggccgcuggggcgcccga

SEQ ID NO: 3106461 - RNA, 18 nt, Mycobacterium bovis subsp bovis AF2122/97
uggggccggaugucgacg

SEQ ID NO: 3106462 - RNA, 19 nt, Mycobacterium bovis subsp bovis AF2122/97
uggggccggaugucgacga

SEQ ID NO: 3106463 - RNA, 16 nt, Mycobacterium bovis subsp bovis AF2122/97
uggggccgggcuccuc

SEQ ID NO: 3106464 - RNA, 17 nt, Mycobacterium bovis subsp bovis AF2122/97
uggggccuggucccacc

SEQ ID NO: 3106465 - RNA, 14 nt, Mycobacterium bovis subsp bovis AF2122/97
uggggcgcgccggc

SEQ ID NO: 3106466 - RNA, 19 nt, Mycobacterium bovis subsp bovis AF2122/97
uggggcgcgugggcgugca

SEQ ID NO: 3106467 - RNA, 18 nt, Mycobacterium bovis subsp bovis AF2122/97
uggggcggcaugcucacc

SEQ ID NO: 3106468 - RNA, 13 nt, Mycobacterium bovis subsp bovis AF2122/97
uggggcgguggcc

SEQ ID NO: 3106469 - RNA, 18 nt, Mycobacterium bovis subsp bovis AF2122/97
uggggcucguaggugggc

SEQ ID NO: 3106470 - RNA, 17 nt, Mycobacterium bovis subsp bovis AF2122/97
uggggcuguagucgaug

SEQ ID NO: 3106471 - RNA, 19 nt, Mycobacterium bovis subsp bovis AF2122/97
uggggcugugcaggcggga

SEQ ID NO: 3106472 - RNA, 16 nt, Mycobacterium bovis subsp bovis AF2122/97
ugggggagccggugac

SEQ ID NO: 3106473 - RNA, 12 nt, Mycobacterium bovis subsp bovis AF2122/97
ugggggcgcacc

SEQ ID NO: 3106474 - RNA, 19 nt, Mycobacterium bovis subsp bovis AF2122/97
ugggggcuucugcgucugc

SEQ ID NO: 3106475 - RNA, 20 nt, Mycobacterium bovis subsp bovis AF2122/97
ugggggcuucugcgucugcu

SEQ ID NO: 3106476 - RNA, 21 nt, Mycobacterium bovis subsp bovis AF2122/97
uggggguagccgccggcgccg

SEQ ID NO: 3106477 - RNA, 15 nt, Mycobacterium bovis subsp bovis AF2122/97
uggggguccggcggc

SEQ ID NO: 3106478 - RNA, 16 nt, Mycobacterium bovis subsp bovis AF2122/97
uggggguccggcggcc

SEQ ID NO: 3106479 - RNA, 19 nt, Mycobacterium bovis subsp bovis AF2122/97
uggggguccggcggccgcc

SEQ ID NO: 3106480 - RNA, 19 nt, Mycobacterium bovis subsp bovis AF2122/97
ugggggugguaccggcggc

SEQ ID NO: 3106481 - RNA, 20 nt, Mycobacterium bovis subsp bovis AF2122/97
ugggggugguaccggcggcg

SEQ ID NO: 3106482 - RNA, 17 nt, Mycobacterium bovis subsp bovis AF2122/97
uggggucagugcgggcg

SEQ ID NO: 3106483 - RNA, 19 nt, Mycobacterium bovis subsp bovis AF2122/97
uggggucagugcgggcggc

SEQ ID NO: 3106484 - RNA, 16 nt, Mycobacterium bovis subsp bovis AF2122/97
ugggguccagcguccc

SEQ ID NO: 3106485 - RNA, 20 nt, Mycobacterium bovis subsp bovis AF2122/97
ugggguccgcgucggcggcg

SEQ ID NO: 3106486 - RNA, 14 nt, Mycobacterium bovis subsp bovis AF2122/97
ugggguccggugac

SEQ ID NO: 3106487 - RNA, 14 nt, Mycobacterium bovis subsp bovis AF2122/97
uggggucgcugccg

SEQ ID NO: 3106488 - RNA, 13 nt, Mycobacterium bovis subsp bovis AF2122/97
uggggucguucgc

SEQ ID NO: 3106489 - RNA, 14 nt, Mycobacterium bovis subsp bovis AF2122/97
ugggguguggcggc

SEQ ID NO: 3106490 - RNA, 19 nt, Mycobacterium bovis subsp bovis AF2122/97
ugggguuggcucggcgcag

SEQ ID NO: 3106491 - RNA, 14 nt, Mycobacterium bovis subsp bovis AF2122/97
ugggguuguuggcg

SEQ ID NO: 3106492 - RNA, 21 nt, Mycobacterium bovis subsp bovis AF2122/97
uggguaccgcggggauggugu

SEQ ID NO: 3106493 - RNA, 20 nt, Mycobacterium bovis subsp bovis AF2122/97
uggguaccucucugucgcgu

SEQ ID NO: 3106494 - RNA, 15 nt, Mycobacterium bovis subsp bovis AF2122/97
uggguagcaaacccc

SEQ ID NO: 3106495 - RNA, 13 nt, Mycobacterium bovis subsp bovis AF2122/97
uggguagccagcg

SEQ ID NO: 3106496 - RNA, 16 nt, Mycobacterium bovis subsp bovis AF2122/97
uggguagcggaucaag

SEQ ID NO: 3106497 - RNA, 23 nt, Mycobacterium bovis subsp bovis AF2122/97
uggguagcggaucaagcgcacaa

SEQ ID NO: 3106498 - RNA, 24 nt, Mycobacterium bovis subsp bovis AF2122/97
uggguagcggaucaagcgcacaaa

SEQ ID NO: 3106499 - RNA, 13 nt, Mycobacterium bovis subsp bovis AF2122/97
uggguauccaccg

SEQ ID NO: 3106500 - RNA, 14 nt, Mycobacterium bovis subsp bovis AF2122/97
uggguauccaccgc

SEQ ID NO: 3106501 - RNA, 19 nt, Mycobacterium bovis subsp bovis AF2122/97
ugggucaacgucaggcccu

SEQ ID NO: 3106502 - RNA, 21 nt, Mycobacterium bovis subsp bovis AF2122/97
ugggucaucgagucgaagaac

SEQ ID NO: 3106503 - RNA, 20 nt, Mycobacterium bovis subsp bovis AF2122/97
uggguccccucccaccagcg

SEQ ID NO: 3106504 - RNA, 14 nt, Mycobacterium bovis subsp bovis AF2122/97
uggguccgggcggc

SEQ ID NO: 3106505 - RNA, 14 nt, Mycobacterium bovis subsp bovis AF2122/97
ugggucgcaauauc

SEQ ID NO: 3106506 - RNA, 23 nt, Mycobacterium bovis subsp bovis AF2122/97
ugggucggcuuccggugccggga

SEQ ID NO: 3106507 - RNA, 13 nt, Mycobacterium bovis subsp bovis AF2122/97
ugggucgugcagg

SEQ ID NO: 3106508 - RNA, 20 nt, Mycobacterium bovis subsp bovis AF2122/97
ugggucgugcaggcgacggc

SEQ ID NO: 3106509 - RNA, 17 nt, Mycobacterium bovis subsp bovis AF2122/97
ugggucgugucgccaca

SEQ ID NO: 3106510 - RNA, 16 nt, Mycobacterium bovis subsp bovis AF2122/97
ugggucguucaccgau

SEQ ID NO: 3106511 - RNA, 17 nt, Mycobacterium bovis subsp bovis AF2122/97
ugggucuggcaggccag

SEQ ID NO: 3106512 - RNA, 21 nt, Mycobacterium bovis subsp bovis AF2122/97
ugggucuuugcccgccacgcu

SEQ ID NO: 3106513 - RNA, 19 nt, Mycobacterium bovis subsp bovis AF2122/97
ugggugacaccggugcgac

SEQ ID NO: 3106514 - RNA, 22 nt, Mycobacterium bovis subsp bovis AF2122/97
ugggugaccucgucgaccggga

SEQ ID NO: 3106515 - RNA, 14 nt, Mycobacterium bovis subsp bovis AF2122/97
ugggugacgguggc

SEQ ID NO: 3106516 - RNA, 15 nt, Mycobacterium bovis subsp bovis AF2122/97
ugggugaucugcccu

SEQ ID NO: 3106517 - RNA, 20 nt, Mycobacterium bovis subsp bovis AF2122/97
ugggugauggccgcgcccgc

SEQ ID NO: 3106518 - RNA, 18 nt, Mycobacterium bovis subsp bovis AF2122/97
ugggugccggcagcggcg

SEQ ID NO: 3106519 - RNA, 15 nt, Mycobacterium bovis subsp bovis AF2122/97
ugggugccggcgucg

SEQ ID NO: 3106520 - RNA, 20 nt, Mycobacterium bovis subsp bovis AF2122/97
ugggugccguugcgucugcu

SEQ ID NO: 3106521 - RNA, 21 nt, Mycobacterium bovis subsp bovis AF2122/97
ugggugcgccgucagcccagg

SEQ ID NO: 3106522 - RNA, 13 nt, Mycobacterium bovis subsp bovis AF2122/97
ugggugcgucugg

SEQ ID NO: 3106523 - RNA, 16 nt, Mycobacterium bovis subsp bovis AF2122/97
ugggugcgucugggca

SEQ ID NO: 3106524 - RNA, 15 nt, Mycobacterium bovis subsp bovis AF2122/97
ugggugcuuggccgc

SEQ ID NO: 3106525 - RNA, 13 nt, Mycobacterium bovis subsp bovis AF2122/97
uggguggcgucgc

SEQ ID NO: 3106526 - RNA, 13 nt, Mycobacterium bovis subsp bovis AF2122/97
ugggugggcgccg

SEQ ID NO: 3106527 - RNA, 14 nt, Mycobacterium bovis subsp bovis AF2122/97
ugggugggugcagc

SEQ ID NO: 3106528 - RNA, 15 nt, Mycobacterium bovis subsp bovis AF2122/97
uggguggugcucacc

SEQ ID NO: 3106529 - RNA, 18 nt, Mycobacterium bovis subsp bovis AF2122/97
ugggugguuccgcgcggc

SEQ ID NO: 3106530 - RNA, 16 nt, Mycobacterium bovis subsp bovis AF2122/97
ugggugugcugccacc

SEQ ID NO: 3106531 - RNA, 20 nt, Mycobacterium bovis subsp bovis AF2122/97
uggguguguucggagcuggg

SEQ ID NO: 3106532 - RNA, 17 nt, Mycobacterium bovis subsp bovis AF2122/97
uggguguugcuggccgc

SEQ ID NO: 3106533 - RNA, 19 nt, Mycobacterium bovis subsp bovis AF2122/97
uggguguugcuggccgcga

SEQ ID NO: 3106534 - RNA, 14 nt, Mycobacterium bovis subsp bovis AF2122/97
uggguucgcgguug

SEQ ID NO: 3106535 - RNA, 20 nt, Mycobacterium bovis subsp bovis AF2122/97
uggguugaaaacgcccggca

SEQ ID NO: 3106536 - RNA, 17 nt, Mycobacterium bovis subsp bovis AF2122/97
uggguugccagcgacgc

SEQ ID NO: 3106537 - RNA, 19 nt, Mycobacterium bovis subsp bovis AF2122/97
uggguugugccgcccugga

SEQ ID NO: 3106538 - RNA, 23 nt, Mycobacterium bovis subsp bovis AF2122/97
uggguuucaaagcgacagcgcgg

SEQ ID NO: 3106539 - RNA, 13 nt, Mycobacterium bovis subsp bovis AF2122/97
ugguaccccagca

SEQ ID NO: 3106540 - RNA, 14 nt, Mycobacterium bovis subsp bovis AF2122/97
ugguacccgcgccg

SEQ ID NO: 3106541 - RNA, 13 nt, Mycobacterium bovis subsp bovis AF2122/97
ugguaccgcggug

SEQ ID NO: 3106542 - RNA, 22 nt, Mycobacterium bovis subsp bovis AF2122/97
ugguaccggcgccaccguggug

SEQ ID NO: 3106543 - RNA, 16 nt, Mycobacterium bovis subsp bovis AF2122/97
ugguaccggcgccgca

SEQ ID NO: 3106544 - RNA, 20 nt, Mycobacterium bovis subsp bovis AF2122/97
ugguaccggcggcgccggcc

SEQ ID NO: 3106545 - RNA, 17 nt, Mycobacterium bovis subsp bovis AF2122/97
ugguacggcucggcgcu

SEQ ID NO: 3106546 - RNA, 16 nt, Mycobacterium bovis subsp bovis AF2122/97
ugguacgugcgagccc

SEQ ID NO: 3106547 - RNA, 16 nt, Mycobacterium bovis subsp bovis AF2122/97
ugguacuuucacgcuc

SEQ ID NO: 3106548 - RNA, 19 nt, Mycobacterium bovis subsp bovis AF2122/97
ugguagccauucggugugg

SEQ ID NO: 3106549 - RNA, 19 nt, Mycobacterium bovis subsp bovis AF2122/97
ugguaggagaucaccucgg

SEQ ID NO: 3106550 - RNA, 16 nt, Mycobacterium bovis subsp bovis AF2122/97
ugguaguaggccuggc

SEQ ID NO: 3106551 - RNA, 22 nt, Mycobacterium bovis subsp bovis AF2122/97
ugguagucgcgaccgcgggccg

SEQ ID NO: 3106552 - RNA, 19 nt, Mycobacterium bovis subsp bovis AF2122/97
ugguauccaugucgcgcca

SEQ ID NO: 3106553 - RNA, 16 nt, Mycobacterium bovis subsp bovis AF2122/97
ugguauggguccucga

SEQ ID NO: 3106554 - RNA, 17 nt, Mycobacterium bovis subsp bovis AF2122/97
uggucaagacccgcauc

SEQ ID NO: 3106555 - RNA, 19 nt, Mycobacterium bovis subsp bovis AF2122/97
uggucaagacccgcaucca

SEQ ID NO: 3106556 - RNA, 22 nt, Mycobacterium bovis subsp bovis AF2122/97
uggucaaugccggccgcggggc

SEQ ID NO: 3106557 - RNA, 21 nt, Mycobacterium bovis subsp bovis AF2122/97
uggucaaugcgcuggcgccgc

SEQ ID NO: 3106558 - RNA, 18 nt, Mycobacterium bovis subsp bovis AF2122/97
uggucacacccagcgcgc

SEQ ID NO: 3106559 - RNA, 20 nt, Mycobacterium bovis subsp bovis AF2122/97
uggucaccaagacaccggcc

SEQ ID NO: 3106560 - RNA, 14 nt, Mycobacterium bovis subsp bovis AF2122/97
uggucaccaccugg

SEQ ID NO: 3106561 - RNA, 23 nt, Mycobacterium bovis subsp bovis AF2122/97
uggucaccaggccgaaauccaga

SEQ ID NO: 3106562 - RNA, 21 nt, Mycobacterium bovis subsp bovis AF2122/97
uggucacccacguugaugaug

SEQ ID NO: 3106563 - RNA, 19 nt, Mycobacterium bovis subsp bovis AF2122/97
uggucaccggacugcgccg

SEQ ID NO: 3106564 - RNA, 15 nt, Mycobacterium bovis subsp bovis AF2122/97
uggucaccgucugca

SEQ ID NO: 3106565 - RNA, 15 nt, Mycobacterium bovis subsp bovis AF2122/97
uggucaccugcugca

SEQ ID NO: 3106566 - RNA, 21 nt, Mycobacterium bovis subsp bovis AF2122/97
uggucacgguucgcccgucgc

SEQ ID NO: 3106567 - RNA, 23 nt, Mycobacterium bovis subsp bovis AF2122/97
uggucacgguucgcccgucgcca

SEQ ID NO: 3106568 - RNA, 22 nt, Mycobacterium bovis subsp bovis AF2122/97
uggucacguucaguuccgcggc

SEQ ID NO: 3106569 - RNA, 17 nt, Mycobacterium bovis subsp bovis AF2122/97
uggucagcagauccgcg

SEQ ID NO: 3106570 - RNA, 15 nt, Mycobacterium bovis subsp bovis AF2122/97
uggucagcagcucca

SEQ ID NO: 3106571 - RNA, 13 nt, Mycobacterium bovis subsp bovis AF2122/97
uggucagccgcgg

SEQ ID NO: 3106572 - RNA, 17 nt, Mycobacterium bovis subsp bovis AF2122/97
uggucagccgcggcggc

SEQ ID NO: 3106573 - RNA, 20 nt, Mycobacterium bovis subsp bovis AF2122/97
uggucagccgcggcggcagc

SEQ ID NO: 3106574 - RNA, 16 nt, Mycobacterium bovis subsp bovis AF2122/97
uggucagcggcgcgag

SEQ ID NO: 3106575 - RNA, 21 nt, Mycobacterium bovis subsp bovis AF2122/97
uggucagcuagguauugccgc

SEQ ID NO: 3106576 - RNA, 16 nt, Mycobacterium bovis subsp bovis AF2122/97
uggucaggaacacucg

SEQ ID NO: 3106577 - RNA, 24 nt, Mycobacterium bovis subsp bovis AF2122/97
uggucaggaacacucgcgaauaac

SEQ ID NO: 3106578 - RNA, 16 nt, Mycobacterium bovis subsp bovis AF2122/97
uggucaggcuggaggu

SEQ ID NO: 3106579 - RNA, 16 nt, Mycobacterium bovis subsp bovis AF2122/97
uggucagucaccaacc

SEQ ID NO: 3106580 - RNA, 18 nt, Mycobacterium bovis subsp bovis AF2122/97
uggucagucaccaaccac

SEQ ID NO: 3106581 - RNA, 20 nt, Mycobacterium bovis subsp bovis AF2122/97
uggucaguccgacaccggcg

SEQ ID NO: 3106582 - RNA, 21 nt, Mycobacterium bovis subsp bovis AF2122/97
uggucaguccgacaccggcgg

SEQ ID NO: 3106583 - RNA, 23 nt, Mycobacterium bovis subsp bovis AF2122/97
uggucaguccgacaccggcggca

SEQ ID NO: 3106584 - RNA, 17 nt, Mycobacterium bovis subsp bovis AF2122/97
ugguccaaccagcacca

SEQ ID NO: 3106585 - RNA, 13 nt, Mycobacterium bovis subsp bovis AF2122/97
ugguccaaccggg

SEQ ID NO: 3106586 - RNA, 16 nt, Mycobacterium bovis subsp bovis AF2122/97
ugguccaaccgggccg

SEQ ID NO: 3106587 - RNA, 19 nt, Mycobacterium bovis subsp bovis AF2122/97
ugguccaaccgggccggcu

SEQ ID NO: 3106588 - RNA, 14 nt, Mycobacterium bovis subsp bovis AF2122/97
ugguccacagccgg

SEQ ID NO: 3106589 - RNA, 13 nt, Mycobacterium bovis subsp bovis AF2122/97
ugguccagccggu

SEQ ID NO: 3106590 - RNA, 18 nt, Mycobacterium bovis subsp bovis AF2122/97
ugguccagccggugacgu

SEQ ID NO: 3106591 - RNA, 22 nt, Mycobacterium bovis subsp bovis AF2122/97
ugguccagccggugacguggug

SEQ ID NO: 3106592 - RNA, 13 nt, Mycobacterium bovis subsp bovis AF2122/97
ugguccagcgcug

SEQ ID NO: 3106593 - RNA, 19 nt, Mycobacterium bovis subsp bovis AF2122/97
uggucccgaugaccuugcc

SEQ ID NO: 3106594 - RNA, 18 nt, Mycobacterium bovis subsp bovis AF2122/97
uggucccggcacgaccac

SEQ ID NO: 3106595 - RNA, 15 nt, Mycobacterium bovis subsp bovis AF2122/97
ugguccgaccagcgg

SEQ ID NO: 3106596 - RNA, 17 nt, Mycobacterium bovis subsp bovis AF2122/97
ugguccgaccagcggcc

SEQ ID NO: 3106597 - RNA, 18 nt, Mycobacterium bovis subsp bovis AF2122/97
ugguccgccgucgaccac

SEQ ID NO: 3106598 - RNA, 20 nt, Mycobacterium bovis subsp bovis AF2122/97
ugguccgggugccggugcgc

SEQ ID NO: 3106599 - RNA, 19 nt, Mycobacterium bovis subsp bovis AF2122/97
ugguccuccuucgguggug

SEQ ID NO: 3106600 - RNA, 23 nt, Mycobacterium bovis subsp bovis AF2122/97
uggucgaaacgguacgccgccgc

SEQ ID NO: 3106601 - RNA, 21 nt, Mycobacterium bovis subsp bovis AF2122/97
uggucgaacagcgaaccggcu

SEQ ID NO: 3106602 - RNA, 20 nt, Mycobacterium bovis subsp bovis AF2122/97
uggucgaacucgccccgcgu

SEQ ID NO: 3106603 - RNA, 20 nt, Mycobacterium bovis subsp bovis AF2122/97
uggucgaagaucgccugggg

SEQ ID NO: 3106604 - RNA, 21 nt, Mycobacterium bovis subsp bovis AF2122/97
uggucgaauaguugaccaggc

SEQ ID NO: 3106605 - RNA, 16 nt, Mycobacterium bovis subsp bovis AF2122/97
uggucgacgccgagac

SEQ ID NO: 3106606 - RNA, 22 nt, Mycobacterium bovis subsp bovis AF2122/97
uggucgacgccgagaccgccgc

SEQ ID NO: 3106607 - RNA, 22 nt, Mycobacterium bovis subsp bovis AF2122/97
uggucgacggggcggucggccg

SEQ ID NO: 3106608 - RNA, 20 nt, Mycobacterium bovis subsp bovis AF2122/97
uggucgacgucgguguaacc

SEQ ID NO: 3106609 - RNA, 21 nt, Mycobacterium bovis subsp bovis AF2122/97
uggucgagcacgcugcugcgg

SEQ ID NO: 3106610 - RNA, 14 nt, Mycobacterium bovis subsp bovis AF2122/97
uggucgagcaggcg

SEQ ID NO: 3106611 - RNA, 14 nt, Mycobacterium bovis subsp bovis AF2122/97
uggucgagggcggc

SEQ ID NO: 3106612 - RNA, 22 nt, Mycobacterium bovis subsp bovis AF2122/97
uggucgagucgaugaccccggu

SEQ ID NO: 3106613 - RNA, 16 nt, Mycobacterium bovis subsp bovis AF2122/97
uggucgaguugaagaa

SEQ ID NO: 3106614 - RNA, 20 nt, Mycobacterium bovis subsp bovis AF2122/97
uggucgauccacucggcgau

SEQ ID NO: 3106615 - RNA, 23 nt, Mycobacterium bovis subsp bovis AF2122/97
uggucgaugaaccaaucgcacgc

SEQ ID NO: 3106616 - RNA, 18 nt, Mycobacterium bovis subsp bovis AF2122/97
uggucgauggcguacagc

SEQ ID NO: 3106617 - RNA, 18 nt, Mycobacterium bovis subsp bovis AF2122/97
uggucgcaccgccggccu

SEQ ID NO: 3106618 - RNA, 20 nt, Mycobacterium bovis subsp bovis AF2122/97
uggucgcaggauucccaguc

SEQ ID NO: 3106619 - RNA, 21 nt, Mycobacterium bovis subsp bovis AF2122/97
uggucgcaggauucccagucc

SEQ ID NO: 3106620 - RNA, 19 nt, Mycobacterium bovis subsp bovis AF2122/97
uggucgccaacgccagcac

SEQ ID NO: 3106621 - RNA, 18 nt, Mycobacterium bovis subsp bovis AF2122/97
uggucgccaugucggcca

SEQ ID NO: 3106622 - RNA, 20 nt, Mycobacterium bovis subsp bovis AF2122/97
uggucgccgccuuccuggcg

SEQ ID NO: 3106623 - RNA, 16 nt, Mycobacterium bovis subsp bovis AF2122/97
uggucgccgcggcagc

SEQ ID NO: 3106624 - RNA, 17 nt, Mycobacterium bovis subsp bovis AF2122/97
uggucgccgcuuucuug

SEQ ID NO: 3106625 - RNA, 13 nt, Mycobacterium bovis subsp bovis AF2122/97
uggucgccggcgu

SEQ ID NO: 3106626 - RNA, 19 nt, Mycobacterium bovis subsp bovis AF2122/97
uggucgcgaccgaccgcau

SEQ ID NO: 3106627 - RNA, 14 nt, Mycobacterium bovis subsp bovis AF2122/97
uggucgcgccaccc

SEQ ID NO: 3106628 - RNA, 22 nt, Mycobacterium bovis subsp bovis AF2122/97
uggucgcggcgcuggcugcggu

SEQ ID NO: 3106629 - RNA, 13 nt, Mycobacterium bovis subsp bovis AF2122/97
uggucgcggcugc

SEQ ID NO: 3106630 - RNA, 15 nt, Mycobacterium bovis subsp bovis AF2122/97
uggucgcggcugcca

SEQ ID NO: 3106631 - RNA, 16 nt, Mycobacterium bovis subsp bovis AF2122/97
uggucgcgguggcggc

SEQ ID NO: 3106632 - RNA, 19 nt, Mycobacterium bovis subsp bovis AF2122/97
uggucgcgguggcggcggu

SEQ ID NO: 3106633 - RNA, 14 nt, Mycobacterium bovis subsp bovis AF2122/97
uggucgcugcugcc

SEQ ID NO: 3106634 - RNA, 23 nt, Mycobacterium bovis subsp bovis AF2122/97
uggucgcugcugccgcaccggug

SEQ ID NO: 3106635 - RNA, 17 nt, Mycobacterium bovis subsp bovis AF2122/97
uggucggacagcgucuc

SEQ ID NO: 3106636 - RNA, 21 nt, Mycobacterium bovis subsp bovis AF2122/97
uggucggagcgggugcgggcg

SEQ ID NO: 3106637 - RNA, 18 nt, Mycobacterium bovis subsp bovis AF2122/97
uggucggagguggggugg

SEQ ID NO: 3106638 - RNA, 13 nt, Mycobacterium bovis subsp bovis AF2122/97
uggucggccaccc

SEQ ID NO: 3106639 - RNA, 20 nt, Mycobacterium bovis subsp bovis AF2122/97
uggucggcccuccaccggug

SEQ ID NO: 3106640 - RNA, 16 nt, Mycobacterium bovis subsp bovis AF2122/97
uggucggccucgagac

SEQ ID NO: 3106641 - RNA, 22 nt, Mycobacterium bovis subsp bovis AF2122/97
uggucggcgaccccgaacaucc

SEQ ID NO: 3106642 - RNA, 15 nt, Mycobacterium bovis subsp bovis AF2122/97
uggucggcgaugaug

SEQ ID NO: 3106643 - RNA, 19 nt, Mycobacterium bovis subsp bovis AF2122/97
uggucggcggccucggucu

SEQ ID NO: 3106644 - RNA, 18 nt, Mycobacterium bovis subsp bovis AF2122/97
uggucggcuaccgccgac

SEQ ID NO: 3106645 - RNA, 20 nt, Mycobacterium bovis subsp bovis AF2122/97
uggucggcuaccgccgaccg

SEQ ID NO: 3106646 - RNA, 17 nt, Mycobacterium bovis subsp bovis AF2122/97
uggucggcuacggccag

SEQ ID NO: 3106647 - RNA, 20 nt, Mycobacterium bovis subsp bovis AF2122/97
uggucggcuacggccagugc

SEQ ID NO: 3106648 - RNA, 17 nt, Mycobacterium bovis subsp bovis AF2122/97
uggucggcuccgcgacg

SEQ ID NO: 3106649 - RNA, 17 nt, Mycobacterium bovis subsp bovis AF2122/97
uggucgggaacccggug

SEQ ID NO: 3106650 - RNA, 13 nt, Mycobacterium bovis subsp bovis AF2122/97
uggucgggucgca

SEQ ID NO: 3106651 - RNA, 22 nt, Mycobacterium bovis subsp bovis AF2122/97
uggucggucaauucggugcgcu

SEQ ID NO: 3106652 - RNA, 23 nt, Mycobacterium bovis subsp bovis AF2122/97
uggucggugcugaccccgccggc

SEQ ID NO: 3106653 - RNA, 21 nt, Mycobacterium bovis subsp bovis AF2122/97
uggucgguggcuacgccccac

SEQ ID NO: 3106654 - RNA, 19 nt, Mycobacterium bovis subsp bovis AF2122/97
uggucgucccgauggcggu

SEQ ID NO: 3106655 - RNA, 17 nt, Mycobacterium bovis subsp bovis AF2122/97
uggucgugggccaccac

SEQ ID NO: 3106656 - RNA, 19 nt, Mycobacterium bovis subsp bovis AF2122/97
uggucuccaccaggugcgc

SEQ ID NO: 3106657 - RNA, 12 nt, Mycobacterium bovis subsp bovis AF2122/97
uggucugccaaa

SEQ ID NO: 3106658 - RNA, 12 nt, Mycobacterium bovis subsp bovis AF2122/97
uggucugccagc

SEQ ID NO: 3106659 - RNA, 19 nt, Mycobacterium bovis subsp bovis AF2122/97
uggucuucggaacgccaua

SEQ ID NO: 3106660 - RNA, 15 nt, Mycobacterium bovis subsp bovis AF2122/97
uggugaaccgcgcgg

SEQ ID NO: 3106661 - RNA, 16 nt, Mycobacterium bovis subsp bovis AF2122/97
uggugaaggcaaacac

SEQ ID NO: 3106662 - RNA, 21 nt, Mycobacterium bovis subsp bovis AF2122/97
uggugaaguagucggcgccga

SEQ ID NO: 3106663 - RNA, 22 nt, Mycobacterium bovis subsp bovis AF2122/97
uggugaaguagucggcgccgag

SEQ ID NO: 3106664 - RNA, 23 nt, Mycobacterium bovis subsp bovis AF2122/97
uggugacagagcggguucgacgu

SEQ ID NO: 3106665 - RNA, 15 nt, Mycobacterium bovis subsp bovis AF2122/97
uggugacagauccgc

SEQ ID NO: 3106666 - RNA, 18 nt, Mycobacterium bovis subsp bovis AF2122/97
uggugacauagaccucgc

SEQ ID NO: 3106667 - RNA, 22 nt, Mycobacterium bovis subsp bovis AF2122/97
uggugacguagauguugccgcc

SEQ ID NO: 3106668 - RNA, 14 nt, Mycobacterium bovis subsp bovis AF2122/97
uggugaggcccccc

SEQ ID NO: 3106669 - RNA, 20 nt, Mycobacterium bovis subsp bovis AF2122/97
uggugaggccccccgcgccu

SEQ ID NO: 3106670 - RNA, 22 nt, Mycobacterium bovis subsp bovis AF2122/97
uggugaggccccccgcgccugc

SEQ ID NO: 3106671 - RNA, 19 nt, Mycobacterium bovis subsp bovis AF2122/97
uggugagguggucagccgg

SEQ ID NO: 3106672 - RNA, 22 nt, Mycobacterium bovis subsp bovis AF2122/97
uggugaguaccaauccaggcca

SEQ ID NO: 3106673 - RNA, 16 nt, Mycobacterium bovis subsp bovis AF2122/97
uggugauccgagacca

SEQ ID NO: 3106674 - RNA, 15 nt, Mycobacterium bovis subsp bovis AF2122/97
uggugaucugcuggg

SEQ ID NO: 3106675 - RNA, 18 nt, Mycobacterium bovis subsp bovis AF2122/97
uggugaugcaacucggca

SEQ ID NO: 3106676 - RNA, 17 nt, Mycobacterium bovis subsp bovis AF2122/97
uggugaugccaucaacg

SEQ ID NO: 3106677 - RNA, 13 nt, Mycobacterium bovis subsp bovis AF2122/97
uggugauggccga

SEQ ID NO: 3106678 - RNA, 16 nt, Mycobacterium bovis subsp bovis AF2122/97
uggugauggccgacgu

SEQ ID NO: 3106679 - RNA, 20 nt, Mycobacterium bovis subsp bovis AF2122/97
uggugaugggggagccggug

SEQ ID NO: 3106680 - RNA, 23 nt, Mycobacterium bovis subsp bovis AF2122/97
uggugcagaauucggcgcgacag

SEQ ID NO: 3106681 - RNA, 13 nt, Mycobacterium bovis subsp bovis AF2122/97
uggugcagaccac

SEQ ID NO: 3106682 - RNA, 14 nt, Mycobacterium bovis subsp bovis AF2122/97
uggugcagcgcagg

SEQ ID NO: 3106683 - RNA, 16 nt, Mycobacterium bovis subsp bovis AF2122/97
uggugcagcgugcagc

SEQ ID NO: 3106684 - RNA, 10 nt, Mycobacterium bovis subsp bovis AF2122/97
uggugccaac

SEQ ID NO: 3106685 - RNA, 15 nt, Mycobacterium bovis subsp bovis AF2122/97
uggugccaaccuggg

SEQ ID NO: 3106686 - RNA, 14 nt, Mycobacterium bovis subsp bovis AF2122/97
uggugccaacugcg

SEQ ID NO: 3106687 - RNA, 22 nt, Mycobacterium bovis subsp bovis AF2122/97
uggugccaacugcgccguucgc

SEQ ID NO: 3106688 - RNA, 17 nt, Mycobacterium bovis subsp bovis AF2122/97
uggugcccgacccgccg

SEQ ID NO: 3106689 - RNA, 21 nt, Mycobacterium bovis subsp bovis AF2122/97
uggugcccgugugcagccagc

SEQ ID NO: 3106690 - RNA, 17 nt, Mycobacterium bovis subsp bovis AF2122/97
uggugcccuugaagaaa

SEQ ID NO: 3106691 - RNA, 21 nt, Mycobacterium bovis subsp bovis AF2122/97
uggugccgacccgccgcgccc

SEQ ID NO: 3106692 - RNA, 23 nt, Mycobacterium bovis subsp bovis AF2122/97
uggugccgccaccaccggcgccu

SEQ ID NO: 3106693 - RNA, 14 nt, Mycobacterium bovis subsp bovis AF2122/97
uggugccgcggcca

SEQ ID NO: 3106694 - RNA, 15 nt, Mycobacterium bovis subsp bovis AF2122/97
uggugccgcggccac

SEQ ID NO: 3106695 - RNA, 16 nt, Mycobacterium bovis subsp bovis AF2122/97
uggugccgcggccacc

SEQ ID NO: 3106696 - RNA, 18 nt, Mycobacterium bovis subsp bovis AF2122/97
uggugccgcggccaccgc

SEQ ID NO: 3106697 - RNA, 10 nt, Mycobacterium bovis subsp bovis AF2122/97
uggugccggc

SEQ ID NO: 3106698 - RNA, 12 nt, Mycobacterium bovis subsp bovis AF2122/97
uggugccggcgg

SEQ ID NO: 3106699 - RNA, 19 nt, Mycobacterium bovis subsp bovis AF2122/97
uggugccggucaccucgcc

SEQ ID NO: 3106700 - RNA, 19 nt, Mycobacterium bovis subsp bovis AF2122/97
uggugcgccacgccaccgc

SEQ ID NO: 3106701 - RNA, 19 nt, Mycobacterium bovis subsp bovis AF2122/97
uggugcgccgggcguccgc

SEQ ID NO: 3106702 - RNA, 14 nt, Mycobacterium bovis subsp bovis AF2122/97
uggugcgcgucagc

SEQ ID NO: 3106703 - RNA, 14 nt, Mycobacterium bovis subsp bovis AF2122/97
uggugcggcccugc

SEQ ID NO: 3106704 - RNA, 13 nt, Mycobacterium bovis subsp bovis AF2122/97
uggugcgggguug

SEQ ID NO: 3106705 - RNA, 14 nt, Mycobacterium bovis subsp bovis AF2122/97
uggugcuagcgccg

SEQ ID NO: 3106706 - RNA, 13 nt, Mycobacterium bovis subsp bovis AF2122/97
uggugcucgucgg

SEQ ID NO: 3106707 - RNA, 21 nt, Mycobacterium bovis subsp bovis AF2122/97
uggugcugacauuuccaccac

SEQ ID NO: 3106708 - RNA, 15 nt, Mycobacterium bovis subsp bovis AF2122/97
uggugcugaccgcgc

SEQ ID NO: 3106709 - RNA, 19 nt, Mycobacterium bovis subsp bovis AF2122/97
uggugcugaccgcgccgga

SEQ ID NO: 3106710 - RNA, 22 nt, Mycobacterium bovis subsp bovis AF2122/97
ugguggaagguguuggugcggg

SEQ ID NO: 3106711 - RNA, 23 nt, Mycobacterium bovis subsp bovis AF2122/97
ugguggagcggcgcggggguggg

SEQ ID NO: 3106712 - RNA, 20 nt, Mycobacterium bovis subsp bovis AF2122/97
ugguggaugugugaguccca

SEQ ID NO: 3106713 - RNA, 18 nt, Mycobacterium bovis subsp bovis AF2122/97
ugguggcaacggguccga

SEQ ID NO: 3106714 - RNA, 22 nt, Mycobacterium bovis subsp bovis AF2122/97
ugguggcaacggguccgacggu

SEQ ID NO: 3106715 - RNA, 14 nt, Mycobacterium bovis subsp bovis AF2122/97
ugguggcaccgguu

SEQ ID NO: 3106716 - RNA, 14 nt, Mycobacterium bovis subsp bovis AF2122/97
ugguggcagcgcac

SEQ ID NO: 3106717 - RNA, 15 nt, Mycobacterium bovis subsp bovis AF2122/97
ugguggcagcgcacc

SEQ ID NO: 3106718 - RNA, 16 nt, Mycobacterium bovis subsp bovis AF2122/97
ugguggcagcgcaccc

SEQ ID NO: 3106719 - RNA, 20 nt, Mycobacterium bovis subsp bovis AF2122/97
ugguggccaugacggcuccg

SEQ ID NO: 3106720 - RNA, 13 nt, Mycobacterium bovis subsp bovis AF2122/97
ugguggccgccac

SEQ ID NO: 3106721 - RNA, 17 nt, Mycobacterium bovis subsp bovis AF2122/97
ugguggccggggugccg

SEQ ID NO: 3106722 - RNA, 15 nt, Mycobacterium bovis subsp bovis AF2122/97
ugguggcgaccccgc

SEQ ID NO: 3106723 - RNA, 22 nt, Mycobacterium bovis subsp bovis AF2122/97
ugguggcgaucaucggccccga

SEQ ID NO: 3106724 - RNA, 21 nt, Mycobacterium bovis subsp bovis AF2122/97
ugguggcgaucuggucgccug

SEQ ID NO: 3106725 - RNA, 23 nt, Mycobacterium bovis subsp bovis AF2122/97
ugguggcgccaacgcaacgguga

SEQ ID NO: 3106726 - RNA, 18 nt, Mycobacterium bovis subsp bovis AF2122/97
ugguggcgccauccccgc

SEQ ID NO: 3106727 - RNA, 22 nt, Mycobacterium bovis subsp bovis AF2122/97
ugguggcggucaccacgcggcg

SEQ ID NO: 3106728 - RNA, 18 nt, Mycobacterium bovis subsp bovis AF2122/97
ugguggcgguguugcucc

SEQ ID NO: 3106729 - RNA, 16 nt, Mycobacterium bovis subsp bovis AF2122/97
ugguggcgguuccggc

SEQ ID NO: 3106730 - RNA, 18 nt, Mycobacterium bovis subsp bovis AF2122/97
ugguggcguaucgggccc

SEQ ID NO: 3106731 - RNA, 23 nt, Mycobacterium bovis subsp bovis AF2122/97
uggugggaggggacccagcggcg

SEQ ID NO: 3106732 - RNA, 15 nt, Mycobacterium bovis subsp bovis AF2122/97
uggugggaucgcagc

SEQ ID NO: 3106733 - RNA, 18 nt, Mycobacterium bovis subsp bovis AF2122/97
uggugggaucgcagcgcc

SEQ ID NO: 3106734 - RNA, 19 nt, Mycobacterium bovis subsp bovis AF2122/97
uggugggaucgcagcgcca

SEQ ID NO: 3106735 - RNA, 16 nt, Mycobacterium bovis subsp bovis AF2122/97
uggugggcagauacga

SEQ ID NO: 3106736 - RNA, 17 nt, Mycobacterium bovis subsp bovis AF2122/97
uggugggccagcagcaa

SEQ ID NO: 3106737 - RNA, 14 nt, Mycobacterium bovis subsp bovis AF2122/97
uggugggccggacc

SEQ ID NO: 3106738 - RNA, 19 nt, Mycobacterium bovis subsp bovis AF2122/97
uggugggccgugggugucg

SEQ ID NO: 3106739 - RNA, 14 nt, Mycobacterium bovis subsp bovis AF2122/97
uggugggcguggcu

SEQ ID NO: 3106740 - RNA, 18 nt, Mycobacterium bovis subsp bovis AF2122/97
uggugggucggggcggca

SEQ ID NO: 3106741 - RNA, 13 nt, Mycobacterium bovis subsp bovis AF2122/97
ugguggucaccac

SEQ ID NO: 3106742 - RNA, 14 nt, Mycobacterium bovis subsp bovis AF2122/97
ugguggucaccacc

SEQ ID NO: 3106743 - RNA, 21 nt, Mycobacterium bovis subsp bovis AF2122/97
ugguggucuuggccggugcgc

SEQ ID NO: 3106744 - RNA, 13 nt, Mycobacterium bovis subsp bovis AF2122/97
ugguggugcccgg

SEQ ID NO: 3106745 - RNA, 12 nt, Mycobacterium bovis subsp bovis AF2122/97
uggugguggagu

SEQ ID NO: 3106746 - RNA, 20 nt, Mycobacterium bovis subsp bovis AF2122/97
uggugguuccgcccggugcu

SEQ ID NO: 3106747 - RNA, 21 nt, Mycobacterium bovis subsp bovis AF2122/97
ugguguacccgccucgggccg

SEQ ID NO: 3106748 - RNA, 22 nt, Mycobacterium bovis subsp bovis AF2122/97
ugguguacccgccucgggccgg

SEQ ID NO: 3106749 - RNA, 19 nt, Mycobacterium bovis subsp bovis AF2122/97
ugguguagccgagcacggg

SEQ ID NO: 3106750 - RNA, 13 nt, Mycobacterium bovis subsp bovis AF2122/97
ugguguagcuucg

SEQ ID NO: 3106751 - RNA, 17 nt, Mycobacterium bovis subsp bovis AF2122/97
uggugucaaugacaccg

SEQ ID NO: 3106752 - RNA, 18 nt, Mycobacterium bovis subsp bovis AF2122/97
uggugucagccaccggug

SEQ ID NO: 3106753 - RNA, 22 nt, Mycobacterium bovis subsp bovis AF2122/97
uggugucagcugauuaccgaca

SEQ ID NO: 3106754 - RNA, 12 nt, Mycobacterium bovis subsp bovis AF2122/97
ugguguccacca

SEQ ID NO: 3106755 - RNA, 16 nt, Mycobacterium bovis subsp bovis AF2122/97
ugguguccaccaccgg

SEQ ID NO: 3106756 - RNA, 13 nt, Mycobacterium bovis subsp bovis AF2122/97
ugguguccaccgc

SEQ ID NO: 3106757 - RNA, 18 nt, Mycobacterium bovis subsp bovis AF2122/97
ugguguccucgucgaggu

SEQ ID NO: 3106758 - RNA, 13 nt, Mycobacterium bovis subsp bovis AF2122/97
uggugucgcggcc

SEQ ID NO: 3106759 - RNA, 14 nt, Mycobacterium bovis subsp bovis AF2122/97
uggugucgcggccg

SEQ ID NO: 3106760 - RNA, 15 nt, Mycobacterium bovis subsp bovis AF2122/97
uggugucggcgagag

SEQ ID NO: 3106761 - RNA, 17 nt, Mycobacterium bovis subsp bovis AF2122/97
uggugugacgaucccca

SEQ ID NO: 3106762 - RNA, 22 nt, Mycobacterium bovis subsp bovis AF2122/97
uggugugauacagcgccagggg

SEQ ID NO: 3106763 - RNA, 17 nt, Mycobacterium bovis subsp bovis AF2122/97
uggugugccugcgucuc

SEQ ID NO: 3106764 - RNA, 13 nt, Mycobacterium bovis subsp bovis AF2122/97
ugguguggggcgg

SEQ ID NO: 3106765 - RNA, 17 nt, Mycobacterium bovis subsp bovis AF2122/97
uggugugucaccggauu

SEQ ID NO: 3106766 - RNA, 15 nt, Mycobacterium bovis subsp bovis AF2122/97
uggugugucggguug

SEQ ID NO: 3106767 - RNA, 19 nt, Mycobacterium bovis subsp bovis AF2122/97
ugguguuauugaugcccga

SEQ ID NO: 3106768 - RNA, 11 nt, Mycobacterium bovis subsp bovis AF2122/97
ugguguuccag

SEQ ID NO: 3106769 - RNA, 21 nt, Mycobacterium bovis subsp bovis AF2122/97
ugguuagaggauggucagcag

SEQ ID NO: 3106770 - RNA, 22 nt, Mycobacterium bovis subsp bovis AF2122/97
ugguuagaggauggucagcagc

SEQ ID NO: 3106771 - RNA, 14 nt, Mycobacterium bovis subsp bovis AF2122/97
ugguuagguggcug

SEQ ID NO: 3106772 - RNA, 12 nt, Mycobacterium bovis subsp bovis AF2122/97
ugguucaacacc

SEQ ID NO: 3106773 - RNA, 13 nt, Mycobacterium bovis subsp bovis AF2122/97
ugguucaaccgga

SEQ ID NO: 3106774 - RNA, 13 nt, Mycobacterium bovis subsp bovis AF2122/97
ugguucaccucgg

SEQ ID NO: 3106775 - RNA, 17 nt, Mycobacterium bovis subsp bovis AF2122/97
ugguuccagaggcccga

SEQ ID NO: 3106776 - RNA, 19 nt, Mycobacterium bovis subsp bovis AF2122/97
ugguucgaaccguugcgca

SEQ ID NO: 3106777 - RNA, 13 nt, Mycobacterium bovis subsp bovis AF2122/97
ugguucgcacacc

SEQ ID NO: 3106778 - RNA, 19 nt, Mycobacterium bovis subsp bovis AF2122/97
ugguucgcacaccuccucg

SEQ ID NO: 3106779 - RNA, 19 nt, Mycobacterium bovis subsp bovis AF2122/97
ugguucggcgucgacccag

SEQ ID NO: 3106780 - RNA, 17 nt, Mycobacterium bovis subsp bovis AF2122/97
ugguugaaccgguacaa

SEQ ID NO: 3106781 - RNA, 12 nt, Mycobacterium bovis subsp bovis AF2122/97
ugguugcgacgg

SEQ ID NO: 3106782 - RNA, 14 nt, Mycobacterium bovis subsp bovis AF2122/97
ugguuggaucgcca

SEQ ID NO: 3106783 - RNA, 21 nt, Mycobacterium bovis subsp bovis AF2122/97
ugguuggcacgcaacaccgcc

SEQ ID NO: 3106784 - RNA, 13 nt, Mycobacterium bovis subsp bovis AF2122/97
ugguuggcucgcu

SEQ ID NO: 3106785 - RNA, 15 nt, Mycobacterium bovis subsp bovis AF2122/97
ugguuggugcuggcc

SEQ ID NO: 3106786 - RNA, 16 nt, Mycobacterium bovis subsp bovis AF2122/97
ugguuucgacucgguu

SEQ ID NO: 3106787 - RNA, 21 nt, Mycobacterium bovis subsp bovis AF2122/97
ugguuucggccgcauccccgg

SEQ ID NO: 3106788 - RNA, 23 nt, Mycobacterium bovis subsp bovis AF2122/97
ugguuucggggaccacgccgacg

SEQ ID NO: 3106789 - RNA, 13 nt, Mycobacterium bovis subsp bovis AF2122/97
ugguuugccggcg

SEQ ID NO: 3106790 - RNA, 21 nt, Mycobacterium bovis subsp bovis AF2122/97
uguacaacgacacgccgcauc

SEQ ID NO: 3106791 - RNA, 19 nt, Mycobacterium bovis subsp bovis AF2122/97
uguacaacgccgucgucgu

SEQ ID NO: 3106792 - RNA, 19 nt, Mycobacterium bovis subsp bovis AF2122/97
uguaccagguggaccggcc

SEQ ID NO: 3106793 - RNA, 15 nt, Mycobacterium bovis subsp bovis AF2122/97
uguaccccagcaucu

SEQ ID NO: 3106794 - RNA, 21 nt, Mycobacterium bovis subsp bovis AF2122/97
uguaccuccaggaucgccgcu

SEQ ID NO: 3106795 - RNA, 16 nt, Mycobacterium bovis subsp bovis AF2122/97
uguacugcggugccac

SEQ ID NO: 3106796 - RNA, 21 nt, Mycobacterium bovis subsp bovis AF2122/97
uguacuggucuggacugcagc

SEQ ID NO: 3106797 - RNA, 13 nt, Mycobacterium bovis subsp bovis AF2122/97
uguagacggcacc

SEQ ID NO: 3106798 - RNA, 13 nt, Mycobacterium bovis subsp bovis AF2122/97
uguagacggcggc

SEQ ID NO: 3106799 - RNA, 15 nt, Mycobacterium bovis subsp bovis AF2122/97
uguagacggcggcau

SEQ ID NO: 3106800 - RNA, 17 nt, Mycobacterium bovis subsp bovis AF2122/97
uguagagcauucgggcg

SEQ ID NO: 3106801 - RNA, 12 nt, Mycobacterium bovis subsp bovis AF2122/97
uguagcacaccg

SEQ ID NO: 3106802 - RNA, 20 nt, Mycobacterium bovis subsp bovis AF2122/97
uguagccagcggcugcccau

SEQ ID NO: 3106803 - RNA, 12 nt, Mycobacterium bovis subsp bovis AF2122/97
uguagcccagcc

SEQ ID NO: 3106804 - RNA, 14 nt, Mycobacterium bovis subsp bovis AF2122/97
uguagccggcgccg

SEQ ID NO: 3106805 - RNA, 16 nt, Mycobacterium bovis subsp bovis AF2122/97
uguagcgcaucgccaa

SEQ ID NO: 3106806 - RNA, 17 nt, Mycobacterium bovis subsp bovis AF2122/97
uguagcgcaucgccaau

SEQ ID NO: 3106807 - RNA, 14 nt, Mycobacterium bovis subsp bovis AF2122/97
uguagcgcugcggg

SEQ ID NO: 3106808 - RNA, 21 nt, Mycobacterium bovis subsp bovis AF2122/97
uguagcugcgggucucgccga

SEQ ID NO: 3106809 - RNA, 15 nt, Mycobacterium bovis subsp bovis AF2122/97
uguaggccgggccgg

SEQ ID NO: 3106810 - RNA, 14 nt, Mycobacterium bovis subsp bovis AF2122/97
uguagggcugcucc

SEQ ID NO: 3106811 - RNA, 17 nt, Mycobacterium bovis subsp bovis AF2122/97
uguaguccugcgggccg

SEQ ID NO: 3106812 - RNA, 23 nt, Mycobacterium bovis subsp bovis AF2122/97
uguagucgauguacaccggcugg

SEQ ID NO: 3106813 - RNA, 13 nt, Mycobacterium bovis subsp bovis AF2122/97
uguauccgcgccg

SEQ ID NO: 3106814 - RNA, 15 nt, Mycobacterium bovis subsp bovis AF2122/97
uguaugcauccacug

SEQ ID NO: 3106815 - RNA, 20 nt, Mycobacterium bovis subsp bovis AF2122/97
uguaugcguuacgccgcgag

SEQ ID NO: 3106816 - RNA, 17 nt, Mycobacterium bovis subsp bovis AF2122/97
ugucaaccaagugaccg

SEQ ID NO: 3106817 - RNA, 22 nt, Mycobacterium bovis subsp bovis AF2122/97
ugucaacccggaaguugaucuu

SEQ ID NO: 3106818 - RNA, 16 nt, Mycobacterium bovis subsp bovis AF2122/97
ugucaacgccgcgguc

SEQ ID NO: 3106819 - RNA, 13 nt, Mycobacterium bovis subsp bovis AF2122/97
ugucaacggcacc

SEQ ID NO: 3106820 - RNA, 23 nt, Mycobacterium bovis subsp bovis AF2122/97
ugucaagcgaugucccaucgcgu

SEQ ID NO: 3106821 - RNA, 19 nt, Mycobacterium bovis subsp bovis AF2122/97
ugucaaguucgccagcaac

SEQ ID NO: 3106822 - RNA, 15 nt, Mycobacterium bovis subsp bovis AF2122/97
ugucaaugacaccgg

SEQ ID NO: 3106823 - RNA, 23 nt, Mycobacterium bovis subsp bovis AF2122/97
ugucacaacgcgugaccagggcc

SEQ ID NO: 3106824 - RNA, 15 nt, Mycobacterium bovis subsp bovis AF2122/97
ugucaccccgcccag

SEQ ID NO: 3106825 - RNA, 15 nt, Mycobacterium bovis subsp bovis AF2122/97
ugucacccgcccgag

SEQ ID NO: 3106826 - RNA, 15 nt, Mycobacterium bovis subsp bovis AF2122/97
ugucacccucgggcg

SEQ ID NO: 3106827 - RNA, 18 nt, Mycobacterium bovis subsp bovis AF2122/97
ugucaccgccgggaagcc

SEQ ID NO: 3106828 - RNA, 19 nt, Mycobacterium bovis subsp bovis AF2122/97
ugucaccgccgggaagccg

SEQ ID NO: 3106829 - RNA, 22 nt, Mycobacterium bovis subsp bovis AF2122/97
ugucaccggcuucggccagcag

SEQ ID NO: 3106830 - RNA, 23 nt, Mycobacterium bovis subsp bovis AF2122/97
ugucaccguacggccacguuguc

SEQ ID NO: 3106831 - RNA, 14 nt, Mycobacterium bovis subsp bovis AF2122/97
ugucacgcaccgcg

SEQ ID NO: 3106832 - RNA, 14 nt, Mycobacterium bovis subsp bovis AF2122/97
ugucacgcgaccac

SEQ ID NO: 3106833 - RNA, 21 nt, Mycobacterium bovis subsp bovis AF2122/97
ugucacgcgaccaccgccgag

SEQ ID NO: 3106834 - RNA, 23 nt, Mycobacterium bovis subsp bovis AF2122/97
ugucagcaagaucggcagcgugg

SEQ ID NO: 3106835 - RNA, 14 nt, Mycobacterium bovis subsp bovis AF2122/97
ugucagcagcccau

SEQ ID NO: 3106836 - RNA, 21 nt, Mycobacterium bovis subsp bovis AF2122/97
ugucagcgaacggccaggaca

SEQ ID NO: 3106837 - RNA, 17 nt, Mycobacterium bovis subsp bovis AF2122/97
ugucagcgcugagccgc

SEQ ID NO: 3106838 - RNA, 18 nt, Mycobacterium bovis subsp bovis AF2122/97
ugucagcggccgcgacgu

SEQ ID NO: 3106839 - RNA, 19 nt, Mycobacterium bovis subsp bovis AF2122/97
ugucagcuaauaccugcgg

SEQ ID NO: 3106840 - RNA, 18 nt, Mycobacterium bovis subsp bovis AF2122/97
ugucagcuuuaucggccc

SEQ ID NO: 3106841 - RNA, 12 nt, Mycobacterium bovis subsp bovis AF2122/97
ugucaggcggcg

SEQ ID NO: 3106842 - RNA, 22 nt, Mycobacterium bovis subsp bovis AF2122/97
ugucaggcucacacucggccgg

SEQ ID NO: 3106843 - RNA, 18 nt, Mycobacterium bovis subsp bovis AF2122/97
ugucagugaucaccaacc

SEQ ID NO: 3106844 - RNA, 20 nt, Mycobacterium bovis subsp bovis AF2122/97
ugucagugaucaccaacccg

SEQ ID NO: 3106845 - RNA, 14 nt, Mycobacterium bovis subsp bovis AF2122/97
ugucaguucccgcu

SEQ ID NO: 3106846 - RNA, 16 nt, Mycobacterium bovis subsp bovis AF2122/97
ugucauagcgcaccac

SEQ ID NO: 3106847 - RNA, 17 nt, Mycobacterium bovis subsp bovis AF2122/97
ugucauccccggccagc

SEQ ID NO: 3106848 - RNA, 20 nt, Mycobacterium bovis subsp bovis AF2122/97
uguccacccagacaccggcu

SEQ ID NO: 3106849 - RNA, 15 nt, Mycobacterium bovis subsp bovis AF2122/97
uguccaccgcaucgg

SEQ ID NO: 3106850 - RNA, 19 nt, Mycobacterium bovis subsp bovis AF2122/97
uguccacgaugacgucgac

SEQ ID NO: 3106851 - RNA, 14 nt, Mycobacterium bovis subsp bovis AF2122/97
uguccacgccgugc

SEQ ID NO: 3106852 - RNA, 19 nt, Mycobacterium bovis subsp bovis AF2122/97
uguccacgccgugcuugcg

SEQ ID NO: 3106853 - RNA, 22 nt, Mycobacterium bovis subsp bovis AF2122/97
uguccacggcguuacguggugg

SEQ ID NO: 3106854 - RNA, 13 nt, Mycobacterium bovis subsp bovis AF2122/97
uguccacugccac

SEQ ID NO: 3106855 - RNA, 22 nt, Mycobacterium bovis subsp bovis AF2122/97
uguccagaacgguggcgcggug

SEQ ID NO: 3106856 - RNA, 18 nt, Mycobacterium bovis subsp bovis AF2122/97
uguccagaauccaggugg

SEQ ID NO: 3106857 - RNA, 22 nt, Mycobacterium bovis subsp bovis AF2122/97
uguccagcagcgaaaaccgucg

SEQ ID NO: 3106858 - RNA, 18 nt, Mycobacterium bovis subsp bovis AF2122/97
uguccagcaugcccgcca

SEQ ID NO: 3106859 - RNA, 18 nt, Mycobacterium bovis subsp bovis AF2122/97
uguccaggcgcgcaccac

SEQ ID NO: 3106860 - RNA, 23 nt, Mycobacterium bovis subsp bovis AF2122/97
uguccaggcgcgcaccaccgcgg

SEQ ID NO: 3106861 - RNA, 20 nt, Mycobacterium bovis subsp bovis AF2122/97
uguccauauagaucacugcu

SEQ ID NO: 3106862 - RNA, 15 nt, Mycobacterium bovis subsp bovis AF2122/97
ugucccaacgccacu

SEQ ID NO: 3106863 - RNA, 17 nt, Mycobacterium bovis subsp bovis AF2122/97
ugucccaucgcgucggc

SEQ ID NO: 3106864 - RNA, 14 nt, Mycobacterium bovis subsp bovis AF2122/97
uguccccccgcgca

SEQ ID NO: 3106865 - RNA, 11 nt, Mycobacterium bovis subsp bovis AF2122/97
uguccccgacg

SEQ ID NO: 3106866 - RNA, 13 nt, Mycobacterium bovis subsp bovis AF2122/97
uguccccgccgag

SEQ ID NO: 3106867 - RNA, 18 nt, Mycobacterium bovis subsp bovis AF2122/97
ugucccgcaugcacguca

SEQ ID NO: 3106868 - RNA, 23 nt, Mycobacterium bovis subsp bovis AF2122/97
ugucccggaccaucgccugcaag

SEQ ID NO: 3106869 - RNA, 17 nt, Mycobacterium bovis subsp bovis AF2122/97
ugucccgguguccagcc

SEQ ID NO: 3106870 - RNA, 19 nt, Mycobacterium bovis subsp bovis AF2122/97
uguccgacgcaccaacgcg

SEQ ID NO: 3106871 - RNA, 21 nt, Mycobacterium bovis subsp bovis AF2122/97
uguccgacgccaccgccacca

SEQ ID NO: 3106872 - RNA, 14 nt, Mycobacterium bovis subsp bovis AF2122/97
uguccgagcggccc

SEQ ID NO: 3106873 - RNA, 23 nt, Mycobacterium bovis subsp bovis AF2122/97
uguccgauaccgcgaugauggcg

SEQ ID NO: 3106874 - RNA, 13 nt, Mycobacterium bovis subsp bovis AF2122/97
uguccgcagcggu

SEQ ID NO: 3106875 - RNA, 22 nt, Mycobacterium bovis subsp bovis AF2122/97
uguccgcgacguaguggaagcc

SEQ ID NO: 3106876 - RNA, 15 nt, Mycobacterium bovis subsp bovis AF2122/97
uguccgcgggccgcg

SEQ ID NO: 3106877 - RNA, 15 nt, Mycobacterium bovis subsp bovis AF2122/97
uguccggcaucggug

SEQ ID NO: 3106878 - RNA, 22 nt, Mycobacterium bovis subsp bovis AF2122/97
uguccggcccuacgcagcgcgg

SEQ ID NO: 3106879 - RNA, 15 nt, Mycobacterium bovis subsp bovis AF2122/97
uguccggccgguccg

SEQ ID NO: 3106880 - RNA, 17 nt, Mycobacterium bovis subsp bovis AF2122/97
uguccggcgugggcacc

SEQ ID NO: 3106881 - RNA, 20 nt, Mycobacterium bovis subsp bovis AF2122/97
uguccgguccgccagcgcga

SEQ ID NO: 3106882 - RNA, 15 nt, Mycobacterium bovis subsp bovis AF2122/97
uguccguccgcgaca

SEQ ID NO: 3106883 - RNA, 15 nt, Mycobacterium bovis subsp bovis AF2122/97
uguccgucgcguccg

SEQ ID NO: 3106884 - RNA, 19 nt, Mycobacterium bovis subsp bovis AF2122/97
uguccuauuugcagccuuc

SEQ ID NO: 3106885 - RNA, 14 nt, Mycobacterium bovis subsp bovis AF2122/97
uguccucccauccc

SEQ ID NO: 3106886 - RNA, 22 nt, Mycobacterium bovis subsp bovis AF2122/97
uguccuggcccgauaaaugccg

SEQ ID NO: 3106887 - RNA, 21 nt, Mycobacterium bovis subsp bovis AF2122/97
uguccuucagccaguccagcg

SEQ ID NO: 3106888 - RNA, 19 nt, Mycobacterium bovis subsp bovis AF2122/97
uguccuugaaccagcgcgu

SEQ ID NO: 3106889 - RNA, 21 nt, Mycobacterium bovis subsp bovis AF2122/97
uguccuugagagauuucuuga

SEQ ID NO: 3106890 - RNA, 21 nt, Mycobacterium bovis subsp bovis AF2122/97
uguccuugcgguccaggccgg

SEQ ID NO: 3106891 - RNA, 17 nt, Mycobacterium bovis subsp bovis AF2122/97
uguccuuguuggccagu

SEQ ID NO: 3106892 - RNA, 16 nt, Mycobacterium bovis subsp bovis AF2122/97
uguccuuugccaccuc

SEQ ID NO: 3106893 - RNA, 17 nt, Mycobacterium bovis subsp bovis AF2122/97
ugucgaagaaccggccg

SEQ ID NO: 3106894 - RNA, 21 nt, Mycobacterium bovis subsp bovis AF2122/97
ugucgaagagcaggcccauac

SEQ ID NO: 3106895 - RNA, 17 nt, Mycobacterium bovis subsp bovis AF2122/97
ugucgaagauccagcgc

SEQ ID NO: 3106896 - RNA, 18 nt, Mycobacterium bovis subsp bovis AF2122/97
ugucgacaaccgcugccg

SEQ ID NO: 3106897 - RNA, 14 nt, Mycobacterium bovis subsp bovis AF2122/97
ugucgacaccggcg

SEQ ID NO: 3106898 - RNA, 22 nt, Mycobacterium bovis subsp bovis AF2122/97
ugucgaccuccucgaccagagc

SEQ ID NO: 3106899 - RNA, 21 nt, Mycobacterium bovis subsp bovis AF2122/97
ugucgacgacaacgaugucac

SEQ ID NO: 3106900 - RNA, 22 nt, Mycobacterium bovis subsp bovis AF2122/97
ugucgacgacaacgaugucacc

SEQ ID NO: 3106901 - RNA, 20 nt, Mycobacterium bovis subsp bovis AF2122/97
ugucgacgagcaccgcgccg

SEQ ID NO: 3106902 - RNA, 14 nt, Mycobacterium bovis subsp bovis AF2122/97
ugucgacggucggc

SEQ ID NO: 3106903 - RNA, 13 nt, Mycobacterium bovis subsp bovis AF2122/97
ugucgacgguguc

SEQ ID NO: 3106904 - RNA, 16 nt, Mycobacterium bovis subsp bovis AF2122/97
ugucgacggugucuug

SEQ ID NO: 3106905 - RNA, 15 nt, Mycobacterium bovis subsp bovis AF2122/97
ugucgagcaccucga

SEQ ID NO: 3106906 - RNA, 20 nt, Mycobacterium bovis subsp bovis AF2122/97
ugucgagccggugccgcggu

SEQ ID NO: 3106907 - RNA, 15 nt, Mycobacterium bovis subsp bovis AF2122/97
ugucgaucacggccg

SEQ ID NO: 3106908 - RNA, 22 nt, Mycobacterium bovis subsp bovis AF2122/97
ugucgaucagaaucugccucuc

SEQ ID NO: 3106909 - RNA, 16 nt, Mycobacterium bovis subsp bovis AF2122/97
ugucgaucagccgcau

SEQ ID NO: 3106910 - RNA, 14 nt, Mycobacterium bovis subsp bovis AF2122/97
ugucgaucagcgcg

SEQ ID NO: 3106911 - RNA, 15 nt, Mycobacterium bovis subsp bovis AF2122/97
ugucgaucagcgcga

SEQ ID NO: 3106912 - RNA, 16 nt, Mycobacterium bovis subsp bovis AF2122/97
ugucgaucagcgcgac

SEQ ID NO: 3106913 - RNA, 12 nt, Mycobacterium bovis subsp bovis AF2122/97
ugucgaugccgc

SEQ ID NO: 3106914 - RNA, 19 nt, Mycobacterium bovis subsp bovis AF2122/97
ugucgauggggacggcggc

SEQ ID NO: 3106915 - RNA, 16 nt, Mycobacterium bovis subsp bovis AF2122/97
ugucgauuucgaugac

SEQ ID NO: 3106916 - RNA, 16 nt, Mycobacterium bovis subsp bovis AF2122/97
ugucgauuugaucgac

SEQ ID NO: 3106917 - RNA, 16 nt, Mycobacterium bovis subsp bovis AF2122/97
ugucgcacucagucug

SEQ ID NO: 3106918 - RNA, 17 nt, Mycobacterium bovis subsp bovis AF2122/97
ugucgcauuucgacgag

SEQ ID NO: 3106919 - RNA, 13 nt, Mycobacterium bovis subsp bovis AF2122/97
ugucgccacaccg

SEQ ID NO: 3106920 - RNA, 22 nt, Mycobacterium bovis subsp bovis AF2122/97
ugucgcccucgaucgccacgac

SEQ ID NO: 3106921 - RNA, 21 nt, Mycobacterium bovis subsp bovis AF2122/97
ugucgccgaguaccggccagc

SEQ ID NO: 3106922 - RNA, 16 nt, Mycobacterium bovis subsp bovis AF2122/97
ugucgccgaucaccgc

SEQ ID NO: 3106923 - RNA, 14 nt, Mycobacterium bovis subsp bovis AF2122/97
ugucgccgccguug

SEQ ID NO: 3106924 - RNA, 14 nt, Mycobacterium bovis subsp bovis AF2122/97
ugucgccgcguccu

SEQ ID NO: 3106925 - RNA, 14 nt, Mycobacterium bovis subsp bovis AF2122/97
ugucgccgcucggu

SEQ ID NO: 3106926 - RNA, 18 nt, Mycobacterium bovis subsp bovis AF2122/97
ugucgccgcuuggcccgg

SEQ ID NO: 3106927 - RNA, 18 nt, Mycobacterium bovis subsp bovis AF2122/97
ugucgccgucgcggcacg

SEQ ID NO: 3106928 - RNA, 15 nt, Mycobacterium bovis subsp bovis AF2122/97
ugucgccucgaugcc

SEQ ID NO: 3106929 - RNA, 20 nt, Mycobacterium bovis subsp bovis AF2122/97
ugucgcgcaaaauaugcagu

SEQ ID NO: 3106930 - RNA, 11 nt, Mycobacterium bovis subsp bovis AF2122/97
ugucgcgcacc

SEQ ID NO: 3106931 - RNA, 20 nt, Mycobacterium bovis subsp bovis AF2122/97
ugucgcgcagcaucuccgcc

SEQ ID NO: 3106932 - RNA, 16 nt, Mycobacterium bovis subsp bovis AF2122/97
ugucgcgcgcuaggug

SEQ ID NO: 3106933 - RNA, 22 nt, Mycobacterium bovis subsp bovis AF2122/97
ugucgcggacccgcgcgucgcc

SEQ ID NO: 3106934 - RNA, 16 nt, Mycobacterium bovis subsp bovis AF2122/97
ugucgcggguucgagu

SEQ ID NO: 3106935 - RNA, 13 nt, Mycobacterium bovis subsp bovis AF2122/97
ugucgcggucgag

SEQ ID NO: 3106936 - RNA, 17 nt, Mycobacterium bovis subsp bovis AF2122/97
ugucgcggucgcccgcu

SEQ ID NO: 3106937 - RNA, 14 nt, Mycobacterium bovis subsp bovis AF2122/97
ugucgcggugcggc

SEQ ID NO: 3106938 - RNA, 14 nt, Mycobacterium bovis subsp bovis AF2122/97
ugucgcugcaaccg

SEQ ID NO: 3106939 - RNA, 16 nt, Mycobacterium bovis subsp bovis AF2122/97
ugucgcugcaaccgcc

SEQ ID NO: 3106940 - RNA, 13 nt, Mycobacterium bovis subsp bovis AF2122/97
ugucgcugccgcc

SEQ ID NO: 3106941 - RNA, 14 nt, Mycobacterium bovis subsp bovis AF2122/97
ugucgcugccgccg

SEQ ID NO: 3106942 - RNA, 15 nt, Mycobacterium bovis subsp bovis AF2122/97
ugucgcugcggcgcu

SEQ ID NO: 3106943 - RNA, 22 nt, Mycobacterium bovis subsp bovis AF2122/97
ugucgcugcggcgcuggccagc

SEQ ID NO: 3106944 - RNA, 23 nt, Mycobacterium bovis subsp bovis AF2122/97
ugucggauagccucggcggcgcc

SEQ ID NO: 3106945 - RNA, 12 nt, Mycobacterium bovis subsp bovis AF2122/97
ugucggccaccc

SEQ ID NO: 3106946 - RNA, 16 nt, Mycobacterium bovis subsp bovis AF2122/97
ugucggccacccggac

SEQ ID NO: 3106947 - RNA, 14 nt, Mycobacterium bovis subsp bovis AF2122/97
ugucggccagcaac

SEQ ID NO: 3106948 - RNA, 13 nt, Mycobacterium bovis subsp bovis AF2122/97
ugucggccccggc

SEQ ID NO: 3106949 - RNA, 15 nt, Mycobacterium bovis subsp bovis AF2122/97
ugucggccccggccg

SEQ ID NO: 3106950 - RNA, 21 nt, Mycobacterium bovis subsp bovis AF2122/97
ugucggccgccuucuccggcg

SEQ ID NO: 3106951 - RNA, 11 nt, Mycobacterium bovis subsp bovis AF2122/97
ugucggccgcg

SEQ ID NO: 3106952 - RNA, 21 nt, Mycobacterium bovis subsp bovis AF2122/97
ugucggccggggccacccgca

SEQ ID NO: 3106953 - RNA, 19 nt, Mycobacterium bovis subsp bovis AF2122/97
ugucggcgagggcgcgccg

SEQ ID NO: 3106954 - RNA, 20 nt, Mycobacterium bovis subsp bovis AF2122/97
ugucggcgaucaacgcgcac

SEQ ID NO: 3106955 - RNA, 13 nt, Mycobacterium bovis subsp bovis AF2122/97
ugucggcgccgaa

SEQ ID NO: 3106956 - RNA, 19 nt, Mycobacterium bovis subsp bovis AF2122/97
ugucggcggggcgccggau

SEQ ID NO: 3106957 - RNA, 17 nt, Mycobacterium bovis subsp bovis AF2122/97
ugucggcuggacggcgc

SEQ ID NO: 3106958 - RNA, 19 nt, Mycobacterium bovis subsp bovis AF2122/97
ugucggcuggacggcgccg

SEQ ID NO: 3106959 - RNA, 21 nt, Mycobacterium bovis subsp bovis AF2122/97
ugucgggaacgaguacgggca

SEQ ID NO: 3106960 - RNA, 13 nt, Mycobacterium bovis subsp bovis AF2122/97
ugucgggauuggc

SEQ ID NO: 3106961 - RNA, 24 nt, Mycobacterium bovis subsp bovis AF2122/97
ugucgggcaccgguuugacgucca

SEQ ID NO: 3106962 - RNA, 18 nt, Mycobacterium bovis subsp bovis AF2122/97
ugucgggcacggugauga

SEQ ID NO: 3106963 - RNA, 12 nt, Mycobacterium bovis subsp bovis AF2122/97
ugucgggcgcga

SEQ ID NO: 3106964 - RNA, 19 nt, Mycobacterium bovis subsp bovis AF2122/97
ugucggggccgucgucggu

SEQ ID NO: 3106965 - RNA, 20 nt, Mycobacterium bovis subsp bovis AF2122/97
ugucgggggcuuaugcgucu

SEQ ID NO: 3106966 - RNA, 20 nt, Mycobacterium bovis subsp bovis AF2122/97
ugucgggggcuuuuacgucu

SEQ ID NO: 3106967 - RNA, 20 nt, Mycobacterium bovis subsp bovis AF2122/97
ugucgggggcuuuugcgucu

SEQ ID NO: 3106968 - RNA, 22 nt, Mycobacterium bovis subsp bovis AF2122/97
ugucggggucgcaggccagggu

SEQ ID NO: 3106969 - RNA, 17 nt, Mycobacterium bovis subsp bovis AF2122/97
ugucggggugcacaccg

SEQ ID NO: 3106970 - RNA, 19 nt, Mycobacterium bovis subsp bovis AF2122/97
ugucgggguuucaggcggc

SEQ ID NO: 3106971 - RNA, 23 nt, Mycobacterium bovis subsp bovis AF2122/97
ugucggugacaccaacaccggug

SEQ ID NO: 3106972 - RNA, 14 nt, Mycobacterium bovis subsp bovis AF2122/97
ugucggugccgucg

SEQ ID NO: 3106973 - RNA, 15 nt, Mycobacterium bovis subsp bovis AF2122/97
ugucggugccgucga

SEQ ID NO: 3106974 - RNA, 16 nt, Mycobacterium bovis subsp bovis AF2122/97
ugucgguggccgcggc

SEQ ID NO: 3106975 - RNA, 20 nt, Mycobacterium bovis subsp bovis AF2122/97
ugucgguggccgcggcgguc

SEQ ID NO: 3106976 - RNA, 19 nt, Mycobacterium bovis subsp bovis AF2122/97
ugucggugguaccggcggc

SEQ ID NO: 3106977 - RNA, 22 nt, Mycobacterium bovis subsp bovis AF2122/97
ugucggugguaccggcggcgcc

SEQ ID NO: 3106978 - RNA, 13 nt, Mycobacterium bovis subsp bovis AF2122/97
ugucgguucgucg

SEQ ID NO: 3106979 - RNA, 19 nt, Mycobacterium bovis subsp bovis AF2122/97
ugucgguuggcagccacgg

SEQ ID NO: 3106980 - RNA, 22 nt, Mycobacterium bovis subsp bovis AF2122/97
ugucguaacugcccgcggcgga

SEQ ID NO: 3106981 - RNA, 16 nt, Mycobacterium bovis subsp bovis AF2122/97
ugucguaccgcggauc

SEQ ID NO: 3106982 - RNA, 15 nt, Mycobacterium bovis subsp bovis AF2122/97
ugucguaggcgccgu

SEQ ID NO: 3106983 - RNA, 12 nt, Mycobacterium bovis subsp bovis AF2122/97
ugucgucgacga

SEQ ID NO: 3106984 - RNA, 14 nt, Mycobacterium bovis subsp bovis AF2122/97
ugucgucgccgccg

SEQ ID NO: 3106985 - RNA, 23 nt, Mycobacterium bovis subsp bovis AF2122/97
ugucgucgccggcggcggugcgc

SEQ ID NO: 3106986 - RNA, 14 nt, Mycobacterium bovis subsp bovis AF2122/97
ugucgucgcggccg

SEQ ID NO: 3106987 - RNA, 19 nt, Mycobacterium bovis subsp bovis AF2122/97
ugucgugauacagcucggu

SEQ ID NO: 3106988 - RNA, 18 nt, Mycobacterium bovis subsp bovis AF2122/97
ugucgugcaaugcuucca

SEQ ID NO: 3106989 - RNA, 17 nt, Mycobacterium bovis subsp bovis AF2122/97
ugucgugcgggcgcacc

SEQ ID NO: 3106990 - RNA, 19 nt, Mycobacterium bovis subsp bovis AF2122/97
ugucguggcgggugaugca

SEQ ID NO: 3106991 - RNA, 22 nt, Mycobacterium bovis subsp bovis AF2122/97
ugucguucgcgucacaccagcg

SEQ ID NO: 3106992 - RNA, 16 nt, Mycobacterium bovis subsp bovis AF2122/97
ugucguuguacggggc

SEQ ID NO: 3106993 - RNA, 18 nt, Mycobacterium bovis subsp bovis AF2122/97
ugucguuguacggggccg

SEQ ID NO: 3106994 - RNA, 20 nt, Mycobacterium bovis subsp bovis AF2122/97
ugucuaccaacaccgcccgc

SEQ ID NO: 3106995 - RNA, 17 nt, Mycobacterium bovis subsp bovis AF2122/97
ugucuacgccgggaauu

SEQ ID NO: 3106996 - RNA, 15 nt, Mycobacterium bovis subsp bovis AF2122/97
ugucucccuugccgc

SEQ ID NO: 3106997 - RNA, 17 nt, Mycobacterium bovis subsp bovis AF2122/97
ugucucccuugccgcca

SEQ ID NO: 3106998 - RNA, 14 nt, Mycobacterium bovis subsp bovis AF2122/97
ugucuccggcaaca

SEQ ID NO: 3106999 - RNA, 16 nt, Mycobacterium bovis subsp bovis AF2122/97
ugucuccuuguccugc

SEQ ID NO: 3107000 - RNA, 17 nt, Mycobacterium bovis subsp bovis AF2122/97
ugucucgggcgcgggug

SEQ ID NO: 3107001 - RNA, 20 nt, Mycobacterium bovis subsp bovis AF2122/97
ugucucggugccuagugcca

SEQ ID NO: 3107002 - RNA, 15 nt, Mycobacterium bovis subsp bovis AF2122/97
ugucugcucgccgag

SEQ ID NO: 3107003 - RNA, 17 nt, Mycobacterium bovis subsp bovis AF2122/97
ugucuggucauggccga

SEQ ID NO: 3107004 - RNA, 14 nt, Mycobacterium bovis subsp bovis AF2122/97
ugugaacagcgcgu

SEQ ID NO: 3107005 - RNA, 15 nt, Mycobacterium bovis subsp bovis AF2122/97
ugugaacaggccgag

SEQ ID NO: 3107006 - RNA, 19 nt, Mycobacterium bovis subsp bovis AF2122/97
ugugaaucgcacgacgcga

SEQ ID NO: 3107007 - RNA, 19 nt, Mycobacterium bovis subsp bovis AF2122/97
ugugaaucugacgacgcga

SEQ ID NO: 3107008 - RNA, 21 nt, Mycobacterium bovis subsp bovis AF2122/97
ugugaccaacccggcucgggu

SEQ ID NO: 3107009 - RNA, 14 nt, Mycobacterium bovis subsp bovis AF2122/97
ugugaccccggcca

SEQ ID NO: 3107010 - RNA, 17 nt, Mycobacterium bovis subsp bovis AF2122/97
ugugaccggcgaucggg

SEQ ID NO: 3107011 - RNA, 14 nt, Mycobacterium bovis subsp bovis AF2122/97
ugugaccgucagcc

SEQ ID NO: 3107012 - RNA, 19 nt, Mycobacterium bovis subsp bovis AF2122/97
ugugacggaggucggagcg

SEQ ID NO: 3107013 - RNA, 17 nt, Mycobacterium bovis subsp bovis AF2122/97
ugugacggcggccacgu

SEQ ID NO: 3107014 - RNA, 17 nt, Mycobacterium bovis subsp bovis AF2122/97
ugugacgggcacaacca

SEQ ID NO: 3107015 - RNA, 17 nt, Mycobacterium bovis subsp bovis AF2122/97
ugugacuuauccggcca

SEQ ID NO: 3107016 - RNA, 16 nt, Mycobacterium bovis subsp bovis AF2122/97
ugugagcaauggcgcg

SEQ ID NO: 3107017 - RNA, 21 nt, Mycobacterium bovis subsp bovis AF2122/97
ugugagcacaccgacagcacc

SEQ ID NO: 3107018 - RNA, 11 nt, Mycobacterium bovis subsp bovis AF2122/97
ugugagcagac

SEQ ID NO: 3107019 - RNA, 12 nt, Mycobacterium bovis subsp bovis AF2122/97
ugugagcagacc

SEQ ID NO: 3107020 - RNA, 21 nt, Mycobacterium bovis subsp bovis AF2122/97
ugugagggaggccccccgggg

SEQ ID NO: 3107021 - RNA, 13 nt, Mycobacterium bovis subsp bovis AF2122/97
ugugaguccagcc

SEQ ID NO: 3107022 - RNA, 17 nt, Mycobacterium bovis subsp bovis AF2122/97
ugugcaaaggcgccguc

SEQ ID NO: 3107023 - RNA, 23 nt, Mycobacterium bovis subsp bovis AF2122/97
ugugcaacggugaaucgaagccc

SEQ ID NO: 3107024 - RNA, 21 nt, Mycobacterium bovis subsp bovis AF2122/97
ugugcaaugugggcgcgucga

SEQ ID NO: 3107025 - RNA, 22 nt, Mycobacterium bovis subsp bovis AF2122/97
ugugcagcgagucgggguacag

SEQ ID NO: 3107026 - RNA, 18 nt, Mycobacterium bovis subsp bovis AF2122/97
ugugcaggacguuugaga

SEQ ID NO: 3107027 - RNA, 22 nt, Mycobacterium bovis subsp bovis AF2122/97
ugugcagggacccggcgccguc

SEQ ID NO: 3107028 - RNA, 17 nt, Mycobacterium bovis subsp bovis AF2122/97
ugugcauagcaauccgc

SEQ ID NO: 3107029 - RNA, 22 nt, Mycobacterium bovis subsp bovis AF2122/97
ugugcaucgccggcacggugaa

SEQ ID NO: 3107030 - RNA, 16 nt, Mycobacterium bovis subsp bovis AF2122/97
ugugcaucggcgaccg

SEQ ID NO: 3107031 - RNA, 18 nt, Mycobacterium bovis subsp bovis AF2122/97
ugugccagcagcagcgcc

SEQ ID NO: 3107032 - RNA, 19 nt, Mycobacterium bovis subsp bovis AF2122/97
ugugccagcagcagcgccg

SEQ ID NO: 3107033 - RNA, 13 nt, Mycobacterium bovis subsp bovis AF2122/97
ugugcccaugaug

SEQ ID NO: 3107034 - RNA, 18 nt, Mycobacterium bovis subsp bovis AF2122/97
ugugcccaugaugcucga

SEQ ID NO: 3107035 - RNA, 22 nt, Mycobacterium bovis subsp bovis AF2122/97
ugugcccaugaugcucgaugau

SEQ ID NO: 3107036 - RNA, 13 nt, Mycobacterium bovis subsp bovis AF2122/97
ugugccccagggc

SEQ ID NO: 3107037 - RNA, 14 nt, Mycobacterium bovis subsp bovis AF2122/97
ugugcccgccggcc

SEQ ID NO: 3107038 - RNA, 15 nt, Mycobacterium bovis subsp bovis AF2122/97
ugugcccgccggccc

SEQ ID NO: 3107039 - RNA, 20 nt, Mycobacterium bovis subsp bovis AF2122/97
ugugcccggcuccuccccgg

SEQ ID NO: 3107040 - RNA, 20 nt, Mycobacterium bovis subsp bovis AF2122/97
ugugccgaucggccaacagg

SEQ ID NO: 3107041 - RNA, 11 nt, Mycobacterium bovis subsp bovis AF2122/97
ugugccgccgg

SEQ ID NO: 3107042 - RNA, 16 nt, Mycobacterium bovis subsp bovis AF2122/97
ugugccgccggcgcca

SEQ ID NO: 3107043 - RNA, 15 nt, Mycobacterium bovis subsp bovis AF2122/97
ugugcgauccagggc

SEQ ID NO: 3107044 - RNA, 17 nt, Mycobacterium bovis subsp bovis AF2122/97
ugugcgauccagggccg

SEQ ID NO: 3107045 - RNA, 21 nt, Mycobacterium bovis subsp bovis AF2122/97
ugugcgauccagggccgacgc

SEQ ID NO: 3107046 - RNA, 12 nt, Mycobacterium bovis subsp bovis AF2122/97
ugugcgcacccc

SEQ ID NO: 3107047 - RNA, 17 nt, Mycobacterium bovis subsp bovis AF2122/97
ugugcgccgcagccugc

SEQ ID NO: 3107048 - RNA, 13 nt, Mycobacterium bovis subsp bovis AF2122/97
ugugcgcggugac

SEQ ID NO: 3107049 - RNA, 14 nt, Mycobacterium bovis subsp bovis AF2122/97
ugugcgcgucgcgc

SEQ ID NO: 3107050 - RNA, 13 nt, Mycobacterium bovis subsp bovis AF2122/97
ugugcggccaggc

SEQ ID NO: 3107051 - RNA, 14 nt, Mycobacterium bovis subsp bovis AF2122/97
ugugcggccaggcg

SEQ ID NO: 3107052 - RNA, 14 nt, Mycobacterium bovis subsp bovis AF2122/97
ugugcggcguacuc

SEQ ID NO: 3107053 - RNA, 13 nt, Mycobacterium bovis subsp bovis AF2122/97
ugugcggugaccg

SEQ ID NO: 3107054 - RNA, 15 nt, Mycobacterium bovis subsp bovis AF2122/97
ugugcgucuccagcu

SEQ ID NO: 3107055 - RNA, 16 nt, Mycobacterium bovis subsp bovis AF2122/97
ugugcgucugcggcgg

SEQ ID NO: 3107056 - RNA, 17 nt, Mycobacterium bovis subsp bovis AF2122/97
ugugcgugucacccaau

SEQ ID NO: 3107057 - RNA, 17 nt, Mycobacterium bovis subsp bovis AF2122/97
ugugcguuccugaucga

SEQ ID NO: 3107058 - RNA, 16 nt, Mycobacterium bovis subsp bovis AF2122/97
ugugcucacggcggcg

SEQ ID NO: 3107059 - RNA, 14 nt, Mycobacterium bovis subsp bovis AF2122/97
ugugcucgaugcga

SEQ ID NO: 3107060 - RNA, 13 nt, Mycobacterium bovis subsp bovis AF2122/97
ugugcucgccgac

SEQ ID NO: 3107061 - RNA, 16 nt, Mycobacterium bovis subsp bovis AF2122/97
ugugcucgccgauuug

SEQ ID NO: 3107062 - RNA, 15 nt, Mycobacterium bovis subsp bovis AF2122/97
ugugcucggugacgu

SEQ ID NO: 3107063 - RNA, 19 nt, Mycobacterium bovis subsp bovis AF2122/97
ugugcucggugacguagac

SEQ ID NO: 3107064 - RNA, 23 nt, Mycobacterium bovis subsp bovis AF2122/97
ugugcugccaccggccggcgcag

SEQ ID NO: 3107065 - RNA, 16 nt, Mycobacterium bovis subsp bovis AF2122/97
uguggaaccacggcgc

SEQ ID NO: 3107066 - RNA, 14 nt, Mycobacterium bovis subsp bovis AF2122/97
uguggaaccauccc

SEQ ID NO: 3107067 - RNA, 16 nt, Mycobacterium bovis subsp bovis AF2122/97
uguggaauacgcugcu

SEQ ID NO: 3107068 - RNA, 12 nt, Mycobacterium bovis subsp bovis AF2122/97
uguggacccgcc

SEQ ID NO: 3107069 - RNA, 18 nt, Mycobacterium bovis subsp bovis AF2122/97
uguggacccgccagggca

SEQ ID NO: 3107070 - RNA, 15 nt, Mycobacterium bovis subsp bovis AF2122/97
uguggaccggcuccg

SEQ ID NO: 3107071 - RNA, 12 nt, Mycobacterium bovis subsp bovis AF2122/97
uguggacgcccg

SEQ ID NO: 3107072 - RNA, 19 nt, Mycobacterium bovis subsp bovis AF2122/97
uguggacuucagcaggccc

SEQ ID NO: 3107073 - RNA, 22 nt, Mycobacterium bovis subsp bovis AF2122/97
uguggagacguuuugcggcccg

SEQ ID NO: 3107074 - RNA, 16 nt, Mycobacterium bovis subsp bovis AF2122/97
uguggcacacccgcac

SEQ ID NO: 3107075 - RNA, 13 nt, Mycobacterium bovis subsp bovis AF2122/97
uguggcacccggc

SEQ ID NO: 3107076 - RNA, 14 nt, Mycobacterium bovis subsp bovis AF2122/97
uguggcacccggcu

SEQ ID NO: 3107077 - RNA, 18 nt, Mycobacterium bovis subsp bovis AF2122/97
uguggcacguggcgaccg

SEQ ID NO: 3107078 - RNA, 12 nt, Mycobacterium bovis subsp bovis AF2122/97
uguggccagcgc

SEQ ID NO: 3107079 - RNA, 17 nt, Mycobacterium bovis subsp bovis AF2122/97
uguggcccaacaccgcc

SEQ ID NO: 3107080 - RNA, 19 nt, Mycobacterium bovis subsp bovis AF2122/97
uguggcccaacaccgccag

SEQ ID NO: 3107081 - RNA, 16 nt, Mycobacterium bovis subsp bovis AF2122/97
uguggcccaaccgcau

SEQ ID NO: 3107082 - RNA, 20 nt, Mycobacterium bovis subsp bovis AF2122/97
uguggccccaagcgugcugc

SEQ ID NO: 3107083 - RNA, 20 nt, Mycobacterium bovis subsp bovis AF2122/97
uguggcccgcggugacgcaa

SEQ ID NO: 3107084 - RNA, 13 nt, Mycobacterium bovis subsp bovis AF2122/97
uguggcccgucau

SEQ ID NO: 3107085 - RNA, 20 nt, Mycobacterium bovis subsp bovis AF2122/97
uguggccguggguuugagcc

SEQ ID NO: 3107086 - RNA, 20 nt, Mycobacterium bovis subsp bovis AF2122/97
uguggccguugacggugucu

SEQ ID NO: 3107087 - RNA, 17 nt, Mycobacterium bovis subsp bovis AF2122/97
uguggcggcguccagaa

SEQ ID NO: 3107088 - RNA, 17 nt, Mycobacterium bovis subsp bovis AF2122/97
uguggcgggucagcgcg

SEQ ID NO: 3107089 - RNA, 21 nt, Mycobacterium bovis subsp bovis AF2122/97
uguggcugaucccggccaggc

SEQ ID NO: 3107090 - RNA, 20 nt, Mycobacterium bovis subsp bovis AF2122/97
uguggcuugcgucgcggacg

SEQ ID NO: 3107091 - RNA, 15 nt, Mycobacterium bovis subsp bovis AF2122/97
uguggcuuugacugc

SEQ ID NO: 3107092 - RNA, 21 nt, Mycobacterium bovis subsp bovis AF2122/97
ugugggaacuggaccacagcc

SEQ ID NO: 3107093 - RNA, 13 nt, Mycobacterium bovis subsp bovis AF2122/97
ugugggccccgcc

SEQ ID NO: 3107094 - RNA, 22 nt, Mycobacterium bovis subsp bovis AF2122/97
ugugggcgagucgggggccgcg

SEQ ID NO: 3107095 - RNA, 20 nt, Mycobacterium bovis subsp bovis AF2122/97
ugugggcgauggcaccggcg

SEQ ID NO: 3107096 - RNA, 19 nt, Mycobacterium bovis subsp bovis AF2122/97
uguggggauuccgcacccc

SEQ ID NO: 3107097 - RNA, 19 nt, Mycobacterium bovis subsp bovis AF2122/97
ugugggugaacaccgaggu

SEQ ID NO: 3107098 - RNA, 16 nt, Mycobacterium bovis subsp bovis AF2122/97
ugugggugguuguguc

SEQ ID NO: 3107099 - RNA, 15 nt, Mycobacterium bovis subsp bovis AF2122/97
uguggucaccaggcc

SEQ ID NO: 3107100 - RNA, 11 nt, Mycobacterium bovis subsp bovis AF2122/97
uguggucaccc

SEQ ID NO: 3107101 - RNA, 15 nt, Mycobacterium bovis subsp bovis AF2122/97
uguggucacccgcag

SEQ ID NO: 3107102 - RNA, 15 nt, Mycobacterium bovis subsp bovis AF2122/97
ugugguccaucgcgc

SEQ ID NO: 3107103 - RNA, 18 nt, Mycobacterium bovis subsp bovis AF2122/97
uguggucgaguugaagaa

SEQ ID NO: 3107104 - RNA, 19 nt, Mycobacterium bovis subsp bovis AF2122/97
uguggucgaguugaagaau

SEQ ID NO: 3107105 - RNA, 16 nt, Mycobacterium bovis subsp bovis AF2122/97
uguggucgcugcugcc

SEQ ID NO: 3107106 - RNA, 20 nt, Mycobacterium bovis subsp bovis AF2122/97
uguggugacagauccgcccc

SEQ ID NO: 3107107 - RNA, 14 nt, Mycobacterium bovis subsp bovis AF2122/97
ugugguggagcggc

SEQ ID NO: 3107108 - RNA, 16 nt, Mycobacterium bovis subsp bovis AF2122/97
ugugguggagcggcgc

SEQ ID NO: 3107109 - RNA, 19 nt, Mycobacterium bovis subsp bovis AF2122/97
uguguccgaaggcuugucg

SEQ ID NO: 3107110 - RNA, 18 nt, Mycobacterium bovis subsp bovis AF2122/97
uguguccgcucgccgcca

SEQ ID NO: 3107111 - RNA, 15 nt, Mycobacterium bovis subsp bovis AF2122/97
ugugucgaccuucuc

SEQ ID NO: 3107112 - RNA, 13 nt, Mycobacterium bovis subsp bovis AF2122/97
ugugucggccugg

SEQ ID NO: 3107113 - RNA, 17 nt, Mycobacterium bovis subsp bovis AF2122/97
ugugucugcucgccgag

SEQ ID NO: 3107114 - RNA, 17 nt, Mycobacterium bovis subsp bovis AF2122/97
ugugugcaaaggcgccg

SEQ ID NO: 3107115 - RNA, 20 nt, Mycobacterium bovis subsp bovis AF2122/97
ugugugcaagccgaacaccg

SEQ ID NO: 3107116 - RNA, 16 nt, Mycobacterium bovis subsp bovis AF2122/97
ugugugcagcagcauc

SEQ ID NO: 3107117 - RNA, 14 nt, Mycobacterium bovis subsp bovis AF2122/97
ugugugcucgucgc

SEQ ID NO: 3107118 - RNA, 12 nt, Mycobacterium bovis subsp bovis AF2122/97
uguguggcagcc

SEQ ID NO: 3107119 - RNA, 14 nt, Mycobacterium bovis subsp bovis AF2122/97
uguguggcgccggg

SEQ ID NO: 3107120 - RNA, 22 nt, Mycobacterium bovis subsp bovis AF2122/97
uguguuccaacuccugcagccc

SEQ ID NO: 3107121 - RNA, 19 nt, Mycobacterium bovis subsp bovis AF2122/97
uguguucgccggcaggguu

SEQ ID NO: 3107122 - RNA, 13 nt, Mycobacterium bovis subsp bovis AF2122/97
uguguugcacccg

SEQ ID NO: 3107123 - RNA, 13 nt, Mycobacterium bovis subsp bovis AF2122/97
uguuaaagaagcc

SEQ ID NO: 3107124 - RNA, 18 nt, Mycobacterium bovis subsp bovis AF2122/97
uguuaacgcgcguccgcc

SEQ ID NO: 3107125 - RNA, 19 nt, Mycobacterium bovis subsp bovis AF2122/97
uguuagugaggcccgaguu

SEQ ID NO: 3107126 - RNA, 15 nt, Mycobacterium bovis subsp bovis AF2122/97
uguuauugaugcccg

SEQ ID NO: 3107127 - RNA, 17 nt, Mycobacterium bovis subsp bovis AF2122/97
uguuauuuuuggccaug

SEQ ID NO: 3107128 - RNA, 21 nt, Mycobacterium bovis subsp bovis AF2122/97
uguuauuuuuggccaugcucu

SEQ ID NO: 3107129 - RNA, 14 nt, Mycobacterium bovis subsp bovis AF2122/97
uguucaacucgggc

SEQ ID NO: 3107130 - RNA, 14 nt, Mycobacterium bovis subsp bovis AF2122/97
uguucacgccgccg

SEQ ID NO: 3107131 - RNA, 16 nt, Mycobacterium bovis subsp bovis AF2122/97
uguucacguucagccc

SEQ ID NO: 3107132 - RNA, 19 nt, Mycobacterium bovis subsp bovis AF2122/97
uguucagcuucgccaggug

SEQ ID NO: 3107133 - RNA, 18 nt, Mycobacterium bovis subsp bovis AF2122/97
uguucauuccgaacaaca

SEQ ID NO: 3107134 - RNA, 18 nt, Mycobacterium bovis subsp bovis AF2122/97
uguuccagaaggccgcac

SEQ ID NO: 3107135 - RNA, 16 nt, Mycobacterium bovis subsp bovis AF2122/97
uguuccauuccgguca

SEQ ID NO: 3107136 - RNA, 22 nt, Mycobacterium bovis subsp bovis AF2122/97
uguuccccgucgccagggccuu

SEQ ID NO: 3107137 - RNA, 17 nt, Mycobacterium bovis subsp bovis AF2122/97
uguuccgcccagcgagg

SEQ ID NO: 3107138 - RNA, 19 nt, Mycobacterium bovis subsp bovis AF2122/97
uguuccgugcgggucgucc

SEQ ID NO: 3107139 - RNA, 22 nt, Mycobacterium bovis subsp bovis AF2122/97
uguuccgugcgggucguccgcc

SEQ ID NO: 3107140 - RNA, 19 nt, Mycobacterium bovis subsp bovis AF2122/97
uguuccuugugaccccggc

SEQ ID NO: 3107141 - RNA, 15 nt, Mycobacterium bovis subsp bovis AF2122/97
uguucgacgggccgg

SEQ ID NO: 3107142 - RNA, 21 nt, Mycobacterium bovis subsp bovis AF2122/97
uguucgacgggccggaccauc

SEQ ID NO: 3107143 - RNA, 17 nt, Mycobacterium bovis subsp bovis AF2122/97
uguucgccacacccgug

SEQ ID NO: 3107144 - RNA, 15 nt, Mycobacterium bovis subsp bovis AF2122/97
uguucgccggagacc

SEQ ID NO: 3107145 - RNA, 14 nt, Mycobacterium bovis subsp bovis AF2122/97
uguucggucuugcc

SEQ ID NO: 3107146 - RNA, 18 nt, Mycobacterium bovis subsp bovis AF2122/97
uguucggugguccuggcg

SEQ ID NO: 3107147 - RNA, 20 nt, Mycobacterium bovis subsp bovis AF2122/97
uguucggugguccuggcgaa

SEQ ID NO: 3107148 - RNA, 12 nt, Mycobacterium bovis subsp bovis AF2122/97
uguucugcacgu

SEQ ID NO: 3107149 - RNA, 15 nt, Mycobacterium bovis subsp bovis AF2122/97
uguucugcacguuga

SEQ ID NO: 3107150 - RNA, 15 nt, Mycobacterium bovis subsp bovis AF2122/97
uguugaagaagcccg

SEQ ID NO: 3107151 - RNA, 21 nt, Mycobacterium bovis subsp bovis AF2122/97
uguugaagaggcgcaccuccu

SEQ ID NO: 3107152 - RNA, 23 nt, Mycobacterium bovis subsp bovis AF2122/97
uguugaccguguggccguuggcc

SEQ ID NO: 3107153 - RNA, 16 nt, Mycobacterium bovis subsp bovis AF2122/97
uguugacgcccgaguu

SEQ ID NO: 3107154 - RNA, 20 nt, Mycobacterium bovis subsp bovis AF2122/97
uguugacucugcguccaccg

SEQ ID NO: 3107155 - RNA, 18 nt, Mycobacterium bovis subsp bovis AF2122/97
uguugaggccggugaacg

SEQ ID NO: 3107156 - RNA, 15 nt, Mycobacterium bovis subsp bovis AF2122/97
uguugagggugcccg

SEQ ID NO: 3107157 - RNA, 22 nt, Mycobacterium bovis subsp bovis AF2122/97
uguugcacgcgggugccgacgu

SEQ ID NO: 3107158 - RNA, 14 nt, Mycobacterium bovis subsp bovis AF2122/97
uguugcaucgccgc

SEQ ID NO: 3107159 - RNA, 22 nt, Mycobacterium bovis subsp bovis AF2122/97
uguugcccaauucgacugcaac

SEQ ID NO: 3107160 - RNA, 15 nt, Mycobacterium bovis subsp bovis AF2122/97
uguugccccggucgg

SEQ ID NO: 3107161 - RNA, 19 nt, Mycobacterium bovis subsp bovis AF2122/97
uguugccccggucggcgac

SEQ ID NO: 3107162 - RNA, 20 nt, Mycobacterium bovis subsp bovis AF2122/97
uguugccccggucggcgacg

SEQ ID NO: 3107163 - RNA, 20 nt, Mycobacterium bovis subsp bovis AF2122/97
uguugcccuugggacugcgg

SEQ ID NO: 3107164 - RNA, 16 nt, Mycobacterium bovis subsp bovis AF2122/97
uguugccgaagcccga

SEQ ID NO: 3107165 - RNA, 15 nt, Mycobacterium bovis subsp bovis AF2122/97
uguugccgccggcca

SEQ ID NO: 3107166 - RNA, 14 nt, Mycobacterium bovis subsp bovis AF2122/97
uguugccgccgguc

SEQ ID NO: 3107167 - RNA, 21 nt, Mycobacterium bovis subsp bovis AF2122/97
uguugccgccuggguugaccg

SEQ ID NO: 3107168 - RNA, 18 nt, Mycobacterium bovis subsp bovis AF2122/97
uguugccggagacgucgc

SEQ ID NO: 3107169 - RNA, 19 nt, Mycobacterium bovis subsp bovis AF2122/97
uguugccuaaguucgccac

SEQ ID NO: 3107170 - RNA, 16 nt, Mycobacterium bovis subsp bovis AF2122/97
uguugcgcacccgcgg

SEQ ID NO: 3107171 - RNA, 14 nt, Mycobacterium bovis subsp bovis AF2122/97
uguugcugcugccg

SEQ ID NO: 3107172 - RNA, 19 nt, Mycobacterium bovis subsp bovis AF2122/97
uguugcugucgaaguuggu

SEQ ID NO: 3107173 - RNA, 16 nt, Mycobacterium bovis subsp bovis AF2122/97
uguugcuuugcuggcg

SEQ ID NO: 3107174 - RNA, 18 nt, Mycobacterium bovis subsp bovis AF2122/97
uguuggagaugucgauca

SEQ ID NO: 3107175 - RNA, 16 nt, Mycobacterium bovis subsp bovis AF2122/97
uguuggcaugccgccc

SEQ ID NO: 3107176 - RNA, 19 nt, Mycobacterium bovis subsp bovis AF2122/97
uguuggccagaccgcgcgc

SEQ ID NO: 3107177 - RNA, 22 nt, Mycobacterium bovis subsp bovis AF2122/97
uguuggccagucccucgccaac

SEQ ID NO: 3107178 - RNA, 23 nt, Mycobacterium bovis subsp bovis AF2122/97
uguuggccagucccucgccaacc

SEQ ID NO: 3107179 - RNA, 21 nt, Mycobacterium bovis subsp bovis AF2122/97
uguuggccauguccaccagcg

SEQ ID NO: 3107180 - RNA, 21 nt, Mycobacterium bovis subsp bovis AF2122/97
uguugggagccaccggcgucg

SEQ ID NO: 3107181 - RNA, 21 nt, Mycobacterium bovis subsp bovis AF2122/97
uguuggugaccgggucgauca

SEQ ID NO: 3107182 - RNA, 23 nt, Mycobacterium bovis subsp bovis AF2122/97
uguugguggauucgaucaggccu

SEQ ID NO: 3107183 - RNA, 19 nt, Mycobacterium bovis subsp bovis AF2122/97
uguuggugugcucggccaa

SEQ ID NO: 3107184 - RNA, 21 nt, Mycobacterium bovis subsp bovis AF2122/97
uguugguuugccggcgguggc

SEQ ID NO: 3107185 - RNA, 23 nt, Mycobacterium bovis subsp bovis AF2122/97
uguugguuugccggcgguggccg

SEQ ID NO: 3107186 - RNA, 20 nt, Mycobacterium bovis subsp bovis AF2122/97
uguugucgcauuucgacgag

SEQ ID NO: 3107187 - RNA, 15 nt, Mycobacterium bovis subsp bovis AF2122/97
uguugucggugucgg

SEQ ID NO: 3107188 - RNA, 18 nt, Mycobacterium bovis subsp bovis AF2122/97
uguugucgucgagcgcgc

SEQ ID NO: 3107189 - RNA, 14 nt, Mycobacterium bovis subsp bovis AF2122/97
uguugucgucgccg

SEQ ID NO: 3107190 - RNA, 19 nt, Mycobacterium bovis subsp bovis AF2122/97
uguugugagauuggcagac

SEQ ID NO: 3107191 - RNA, 17 nt, Mycobacterium bovis subsp bovis AF2122/97
uguugugcucggugacg

SEQ ID NO: 3107192 - RNA, 10 nt, Mycobacterium bovis subsp bovis AF2122/97
uguuguugaa

SEQ ID NO: 3107193 - RNA, 15 nt, Mycobacterium bovis subsp bovis AF2122/97
uguuguugaagcccg

SEQ ID NO: 3107194 - RNA, 12 nt, Mycobacterium bovis subsp bovis AF2122/97
uguuguuugaga

SEQ ID NO: 3107195 - RNA, 12 nt, Mycobacterium bovis subsp bovis AF2122/97
uguuugacugcg

SEQ ID NO: 3107196 - RNA, 24 nt, Mycobacterium bovis subsp bovis AF2122/97
uguuugccggcuuugagccgcucg

SEQ ID NO: 3107197 - RNA, 14 nt, Mycobacterium bovis subsp bovis AF2122/97
uguuuggguuuugu

SEQ ID NO: 3107198 - RNA, 13 nt, Mycobacterium bovis subsp bovis AF2122/97
uguuuggugguuu

SEQ ID NO: 3107199 - RNA, 22 nt, Mycobacterium bovis subsp bovis AF2122/97
uguuuuugcgggugguccagcc

SEQ ID NO: 3107200 - RNA, 19 nt, Mycobacterium bovis subsp bovis AF2122/97
uguuuuuguauguucggcg

SEQ ID NO: 3107201 - RNA, 20 nt, Mycobacterium bovis subsp bovis AF2122/97
uuaacacccugggcaaacug

SEQ ID NO: 3107202 - RNA, 13 nt, Mycobacterium bovis subsp bovis AF2122/97
uuaagacgcccga

SEQ ID NO: 3107203 - RNA, 22 nt, Mycobacterium bovis subsp bovis AF2122/97
uuaagcgaacccgagccgccgu

SEQ ID NO: 3107204 - RNA, 11 nt, Mycobacterium bovis subsp bovis AF2122/97
uuacaugcccu

SEQ ID NO: 3107205 - RNA, 17 nt, Mycobacterium bovis subsp bovis AF2122/97
uuaccaacgcggugacg

SEQ ID NO: 3107206 - RNA, 17 nt, Mycobacterium bovis subsp bovis AF2122/97
uuaccaccgucaccgcc

SEQ ID NO: 3107207 - RNA, 14 nt, Mycobacterium bovis subsp bovis AF2122/97
uuaccaccgucucc

SEQ ID NO: 3107208 - RNA, 17 nt, Mycobacterium bovis subsp bovis AF2122/97
uuacccaucgccacacc

SEQ ID NO: 3107209 - RNA, 19 nt, Mycobacterium bovis subsp bovis AF2122/97
uuacccaucgccacaccca

SEQ ID NO: 3107210 - RNA, 14 nt, Mycobacterium bovis subsp bovis AF2122/97
uuaccgaagcccga

SEQ ID NO: 3107211 - RNA, 13 nt, Mycobacterium bovis subsp bovis AF2122/97
uuaccgacaccgu

SEQ ID NO: 3107212 - RNA, 18 nt, Mycobacterium bovis subsp bovis AF2122/97
uuaccgccggcgccggug

SEQ ID NO: 3107213 - RNA, 17 nt, Mycobacterium bovis subsp bovis AF2122/97
uuaccgccguugccgcc

SEQ ID NO: 3107214 - RNA, 20 nt, Mycobacterium bovis subsp bovis AF2122/97
uuaccggcacgccggcggcg

SEQ ID NO: 3107215 - RNA, 11 nt, Mycobacterium bovis subsp bovis AF2122/97
uuaccggugac

SEQ ID NO: 3107216 - RNA, 21 nt, Mycobacterium bovis subsp bovis AF2122/97
uuacgaugcucagcuggucgg

SEQ ID NO: 3107217 - RNA, 21 nt, Mycobacterium bovis subsp bovis AF2122/97
uuacgcaccgaugccuugacc

SEQ ID NO: 3107218 - RNA, 22 nt, Mycobacterium bovis subsp bovis AF2122/97
uuacgccgcgagagccggcggc

SEQ ID NO: 3107219 - RNA, 13 nt, Mycobacterium bovis subsp bovis AF2122/97
uuacgcgacgccg

SEQ ID NO: 3107220 - RNA, 17 nt, Mycobacterium bovis subsp bovis AF2122/97
uuacgcucgcgaagccg

SEQ ID NO: 3107221 - RNA, 21 nt, Mycobacterium bovis subsp bovis AF2122/97
uuacgcucgcgggccaaagcc

SEQ ID NO: 3107222 - RNA, 11 nt, Mycobacterium bovis subsp bovis AF2122/97
uuacgcugccg

SEQ ID NO: 3107223 - RNA, 13 nt, Mycobacterium bovis subsp bovis AF2122/97
uuacucaacaguu

SEQ ID NO: 3107224 - RNA, 13 nt, Mycobacterium bovis subsp bovis AF2122/97
uuagacuggcagg

SEQ ID NO: 3107225 - RNA, 15 nt, Mycobacterium bovis subsp bovis AF2122/97
uuagcagcacccggg

SEQ ID NO: 3107226 - RNA, 18 nt, Mycobacterium bovis subsp bovis AF2122/97
uuagccacaaucgcagau

SEQ ID NO: 3107227 - RNA, 18 nt, Mycobacterium bovis subsp bovis AF2122/97
uuagcccacccauggccu

SEQ ID NO: 3107228 - RNA, 15 nt, Mycobacterium bovis subsp bovis AF2122/97
uuagcgcgggccugg

SEQ ID NO: 3107229 - RNA, 18 nt, Mycobacterium bovis subsp bovis AF2122/97
uuagcggcuugaacagcu

SEQ ID NO: 3107230 - RNA, 22 nt, Mycobacterium bovis subsp bovis AF2122/97
uuaggcccgcacguuggcggcc

SEQ ID NO: 3107231 - RNA, 18 nt, Mycobacterium bovis subsp bovis AF2122/97
uuaggccgccagccggcg

SEQ ID NO: 3107232 - RNA, 15 nt, Mycobacterium bovis subsp bovis AF2122/97
uuagggcgcccgccc

SEQ ID NO: 3107233 - RNA, 20 nt, Mycobacterium bovis subsp bovis AF2122/97
uuagugggcuuuugcgucug

SEQ ID NO: 3107234 - RNA, 14 nt, Mycobacterium bovis subsp bovis AF2122/97
uuaucagcaagagc

SEQ ID NO: 3107235 - RNA, 20 nt, Mycobacterium bovis subsp bovis AF2122/97
uuaucgacaccaccauuccc

SEQ ID NO: 3107236 - RNA, 20 nt, Mycobacterium bovis subsp bovis AF2122/97
uuaucggcagcaggacaccu

SEQ ID NO: 3107237 - RNA, 17 nt, Mycobacterium bovis subsp bovis AF2122/97
uuaucggucggacggcc

SEQ ID NO: 3107238 - RNA, 12 nt, Mycobacterium bovis subsp bovis AF2122/97
uuaugccaggcg

SEQ ID NO: 3107239 - RNA, 20 nt, Mycobacterium bovis subsp bovis AF2122/97
uuaugcgucugcucgccggg

SEQ ID NO: 3107240 - RNA, 18 nt, Mycobacterium bovis subsp bovis AF2122/97
uuauucacccgguaggug

SEQ ID NO: 3107241 - RNA, 15 nt, Mycobacterium bovis subsp bovis AF2122/97
uuauugagucggcug

SEQ ID NO: 3107242 - RNA, 23 nt, Mycobacterium bovis subsp bovis AF2122/97
uucaaagaggauccgcugcggcc

SEQ ID NO: 3107243 - RNA, 16 nt, Mycobacterium bovis subsp bovis AF2122/97
uucaaagcggccucga

SEQ ID NO: 3107244 - RNA, 15 nt, Mycobacterium bovis subsp bovis AF2122/97
uucaacgcgcgcacg

SEQ ID NO: 3107245 - RNA, 19 nt, Mycobacterium bovis subsp bovis AF2122/97
uucaacuccggcaccggca

SEQ ID NO: 3107246 - RNA, 22 nt, Mycobacterium bovis subsp bovis AF2122/97
uucaacucgggcagcuucaaca

SEQ ID NO: 3107247 - RNA, 20 nt, Mycobacterium bovis subsp bovis AF2122/97
uucaagguguucuggcaacc

SEQ ID NO: 3107248 - RNA, 22 nt, Mycobacterium bovis subsp bovis AF2122/97
uucaccacccuguuguugcccc

SEQ ID NO: 3107249 - RNA, 21 nt, Mycobacterium bovis subsp bovis AF2122/97
uucaccacucggucguugccg

SEQ ID NO: 3107250 - RNA, 22 nt, Mycobacterium bovis subsp bovis AF2122/97
uucaccacucggucguugccgc

SEQ ID NO: 3107251 - RNA, 16 nt, Mycobacterium bovis subsp bovis AF2122/97
uucaccaguccaaucu

SEQ ID NO: 3107252 - RNA, 21 nt, Mycobacterium bovis subsp bovis AF2122/97
uucaccgacgcgaacgcggcc

SEQ ID NO: 3107253 - RNA, 19 nt, Mycobacterium bovis subsp bovis AF2122/97
uucaccgcguguaccgcga

SEQ ID NO: 3107254 - RNA, 14 nt, Mycobacterium bovis subsp bovis AF2122/97
uucacgacgccgag

SEQ ID NO: 3107255 - RNA, 16 nt, Mycobacterium bovis subsp bovis AF2122/97
uucacgcaccacaaac

SEQ ID NO: 3107256 - RNA, 16 nt, Mycobacterium bovis subsp bovis AF2122/97
uucacgccagucccac

SEQ ID NO: 3107257 - RNA, 15 nt, Mycobacterium bovis subsp bovis AF2122/97
uucacguucggcgac

SEQ ID NO: 3107258 - RNA, 21 nt, Mycobacterium bovis subsp bovis AF2122/97
uucacguucggcgacgcgccg

SEQ ID NO: 3107259 - RNA, 14 nt, Mycobacterium bovis subsp bovis AF2122/97
uucacuggucuccc

SEQ ID NO: 3107260 - RNA, 20 nt, Mycobacterium bovis subsp bovis AF2122/97
uucagcacggugaucagcag

SEQ ID NO: 3107261 - RNA, 19 nt, Mycobacterium bovis subsp bovis AF2122/97
uucagcacgugggccaacg

SEQ ID NO: 3107262 - RNA, 22 nt, Mycobacterium bovis subsp bovis AF2122/97
uucagcaggcccuucaguucga

SEQ ID NO: 3107263 - RNA, 22 nt, Mycobacterium bovis subsp bovis AF2122/97
uucagccacgcagcacggcacc

SEQ ID NO: 3107264 - RNA, 21 nt, Mycobacterium bovis subsp bovis AF2122/97
uucagccaguccagcgcgcca

SEQ ID NO: 3107265 - RNA, 14 nt, Mycobacterium bovis subsp bovis AF2122/97
uucagcgccagcgc

SEQ ID NO: 3107266 - RNA, 17 nt, Mycobacterium bovis subsp bovis AF2122/97
uucaggcccugccgacg

SEQ ID NO: 3107267 - RNA, 17 nt, Mycobacterium bovis subsp bovis AF2122/97
uucagguccaccgcugc

SEQ ID NO: 3107268 - RNA, 23 nt, Mycobacterium bovis subsp bovis AF2122/97
uucagguccaccgcugccggcag

SEQ ID NO: 3107269 - RNA, 16 nt, Mycobacterium bovis subsp bovis AF2122/97
uucaguuccaccgcgc

SEQ ID NO: 3107270 - RNA, 22 nt, Mycobacterium bovis subsp bovis AF2122/97
uucaguucggccgucauggccc

SEQ ID NO: 3107271 - RNA, 14 nt, Mycobacterium bovis subsp bovis AF2122/97
uucaucacgggacg

SEQ ID NO: 3107272 - RNA, 19 nt, Mycobacterium bovis subsp bovis AF2122/97
uucaucgcuauggaugggg

SEQ ID NO: 3107273 - RNA, 21 nt, Mycobacterium bovis subsp bovis AF2122/97
uucaucucgccuucggggugc

SEQ ID NO: 3107274 - RNA, 14 nt, Mycobacterium bovis subsp bovis AF2122/97
uucaugaugacaau

SEQ ID NO: 3107275 - RNA, 22 nt, Mycobacterium bovis subsp bovis AF2122/97
uucaugcccguccugcaggaag

SEQ ID NO: 3107276 - RNA, 16 nt, Mycobacterium bovis subsp bovis AF2122/97
uucauguggcgcgggu

SEQ ID NO: 3107277 - RNA, 21 nt, Mycobacterium bovis subsp bovis AF2122/97
uucauuccgaacaacaucacu

SEQ ID NO: 3107278 - RNA, 20 nt, Mycobacterium bovis subsp bovis AF2122/97
uuccaaaaucaucugcacau

SEQ ID NO: 3107279 - RNA, 13 nt, Mycobacterium bovis subsp bovis AF2122/97
uuccaacaccaac

SEQ ID NO: 3107280 - RNA, 14 nt, Mycobacterium bovis subsp bovis AF2122/97
uuccaacuccugca

SEQ ID NO: 3107281 - RNA, 19 nt, Mycobacterium bovis subsp bovis AF2122/97
uuccaacuccugcagcccg

SEQ ID NO: 3107282 - RNA, 15 nt, Mycobacterium bovis subsp bovis AF2122/97
uuccaagccgaccug

SEQ ID NO: 3107283 - RNA, 20 nt, Mycobacterium bovis subsp bovis AF2122/97
uuccaagucagaacggcggc

SEQ ID NO: 3107284 - RNA, 21 nt, Mycobacterium bovis subsp bovis AF2122/97
uuccacaaauccaaaccuuug

SEQ ID NO: 3107285 - RNA, 15 nt, Mycobacterium bovis subsp bovis AF2122/97
uuccacaccaggccg

SEQ ID NO: 3107286 - RNA, 19 nt, Mycobacterium bovis subsp bovis AF2122/97
uuccacaggggccagcgcg

SEQ ID NO: 3107287 - RNA, 15 nt, Mycobacterium bovis subsp bovis AF2122/97
uuccacccggugccg

SEQ ID NO: 3107288 - RNA, 17 nt, Mycobacterium bovis subsp bovis AF2122/97
uuccacccggugccgca

SEQ ID NO: 3107289 - RNA, 11 nt, Mycobacterium bovis subsp bovis AF2122/97
uuccaccgccg

SEQ ID NO: 3107290 - RNA, 13 nt, Mycobacterium bovis subsp bovis AF2122/97
uuccaccgccgac

SEQ ID NO: 3107291 - RNA, 22 nt, Mycobacterium bovis subsp bovis AF2122/97
uuccacuccccagccccacccg

SEQ ID NO: 3107292 - RNA, 20 nt, Mycobacterium bovis subsp bovis AF2122/97
uuccacugggccugccaguc

SEQ ID NO: 3107293 - RNA, 17 nt, Mycobacterium bovis subsp bovis AF2122/97
uuccagcagccugcgcc

SEQ ID NO: 3107294 - RNA, 15 nt, Mycobacterium bovis subsp bovis AF2122/97
uuccagcaguacacc

SEQ ID NO: 3107295 - RNA, 21 nt, Mycobacterium bovis subsp bovis AF2122/97
uuccagcaguacaccgcccgg

SEQ ID NO: 3107296 - RNA, 22 nt, Mycobacterium bovis subsp bovis AF2122/97
uuccagccacagcccggcggcg

SEQ ID NO: 3107297 - RNA, 14 nt, Mycobacterium bovis subsp bovis AF2122/97
uuccagccaggccu

SEQ ID NO: 3107298 - RNA, 15 nt, Mycobacterium bovis subsp bovis AF2122/97
uuccagccggugccg

SEQ ID NO: 3107299 - RNA, 18 nt, Mycobacterium bovis subsp bovis AF2122/97
uuccagcucacgaugucg

SEQ ID NO: 3107300 - RNA, 16 nt, Mycobacterium bovis subsp bovis AF2122/97
uuccagggcgacggcc

SEQ ID NO: 3107301 - RNA, 20 nt, Mycobacterium bovis subsp bovis AF2122/97
uuccagguacacguaccggu

SEQ ID NO: 3107302 - RNA, 16 nt, Mycobacterium bovis subsp bovis AF2122/97
uuccauacagccgccg

SEQ ID NO: 3107303 - RNA, 17 nt, Mycobacterium bovis subsp bovis AF2122/97
uuccaugcgacuucauc

SEQ ID NO: 3107304 - RNA, 14 nt, Mycobacterium bovis subsp bovis AF2122/97
uucccaacacagcc

SEQ ID NO: 3107305 - RNA, 15 nt, Mycobacterium bovis subsp bovis AF2122/97
uucccaaccgcccgu

SEQ ID NO: 3107306 - RNA, 18 nt, Mycobacterium bovis subsp bovis AF2122/97
uucccaccaccaccgccg

SEQ ID NO: 3107307 - RNA, 17 nt, Mycobacterium bovis subsp bovis AF2122/97
uucccacccacgccgac

SEQ ID NO: 3107308 - RNA, 14 nt, Mycobacterium bovis subsp bovis AF2122/97
uucccacuggaggu

SEQ ID NO: 3107309 - RNA, 21 nt, Mycobacterium bovis subsp bovis AF2122/97
uucccaggaacgggacgccgu

SEQ ID NO: 3107310 - RNA, 15 nt, Mycobacterium bovis subsp bovis AF2122/97
uucccaggcccgaca

SEQ ID NO: 3107311 - RNA, 21 nt, Mycobacterium bovis subsp bovis AF2122/97
uacuuucacgcucguuugcga

SEQ ID NO: 3107312 - RNA, 20 nt, Mycobacterium bovis subsp bovis AF2122/97
uagaacugcaucauggccgu

SEQ ID NO: 3107313 - RNA, 15 nt, Mycobacterium bovis subsp bovis AF2122/97
uagaagucgaucgcc

SEQ ID NO: 3107314 - RNA, 12 nt, Mycobacterium bovis subsp bovis AF2122/97
uagacaccgcga

SEQ ID NO: 3107315 - RNA, 17 nt, Mycobacterium bovis subsp bovis AF2122/97
uagacaggaccgguggg

SEQ ID NO: 3107316 - RNA, 20 nt, Mycobacterium bovis subsp bovis AF2122/97
uagacagucugcgacuggau

SEQ ID NO: 3107317 - RNA, 18 nt, Mycobacterium bovis subsp bovis AF2122/97
uagaccagucucguggcg

SEQ ID NO: 3107318 - RNA, 22 nt, Mycobacterium bovis subsp bovis AF2122/97
uagacccacagucgccggccgg

SEQ ID NO: 3107319 - RNA, 13 nt, Mycobacterium bovis subsp bovis AF2122/97
uagaccugguuga

SEQ ID NO: 3107320 - RNA, 14 nt, Mycobacterium bovis subsp bovis AF2122/97
uagacgaaacggcc

SEQ ID NO: 3107321 - RNA, 16 nt, Mycobacterium bovis subsp bovis AF2122/97
uagacgaccccgguga

SEQ ID NO: 3107322 - RNA, 18 nt, Mycobacterium bovis subsp bovis AF2122/97
uagacgacgucggccgca

SEQ ID NO: 3107323 - RNA, 18 nt, Mycobacterium bovis subsp bovis AF2122/97
uagacgccgccgcugccg

SEQ ID NO: 3107324 - RNA, 14 nt, Mycobacterium bovis subsp bovis AF2122/97
uagacgccgccguu

SEQ ID NO: 3107325 - RNA, 15 nt, Mycobacterium bovis subsp bovis AF2122/97
uagacggggcgagca

SEQ ID NO: 3107326 - RNA, 22 nt, Mycobacterium bovis subsp bovis AF2122/97
uagacguuguugaaggcuugug

SEQ ID NO: 3107327 - RNA, 21 nt, Mycobacterium bovis subsp bovis AF2122/97
uagagcaugccgcccgcgccg

SEQ ID NO: 3107328 - RNA, 19 nt, Mycobacterium bovis subsp bovis AF2122/97
uagaggacugcggucugga

SEQ ID NO: 3107329 - RNA, 20 nt, Mycobacterium bovis subsp bovis AF2122/97
uagauauggaccgccgccga

SEQ ID NO: 3107330 - RNA, 16 nt, Mycobacterium bovis subsp bovis AF2122/97
uagaucaagaucugcu

SEQ ID NO: 3107331 - RNA, 18 nt, Mycobacterium bovis subsp bovis AF2122/97
uagaucaagaucugcuug

SEQ ID NO: 3107332 - RNA, 16 nt, Mycobacterium bovis subsp bovis AF2122/97
uagaucagcaacggca

SEQ ID NO: 3107333 - RNA, 20 nt, Mycobacterium bovis subsp bovis AF2122/97
uagaucagcagcggcgaccg

SEQ ID NO: 3107334 - RNA, 20 nt, Mycobacterium bovis subsp bovis AF2122/97
uagaucagcaugccuucggc

SEQ ID NO: 3107335 - RNA, 13 nt, Mycobacterium bovis subsp bovis AF2122/97
uagaucagcgccu

SEQ ID NO: 3107336 - RNA, 16 nt, Mycobacterium bovis subsp bovis AF2122/97
uagaucgccucgacgc

SEQ ID NO: 3107337 - RNA, 19 nt, Mycobacterium bovis subsp bovis AF2122/97
uagaugcggaacgccgagc

SEQ ID NO: 3107338 - RNA, 20 nt, Mycobacterium bovis subsp bovis AF2122/97
uagaugcgugcggcagugcc

SEQ ID NO: 3107339 - RNA, 17 nt, Mycobacterium bovis subsp bovis AF2122/97
uagauggugguggcccg

SEQ ID NO: 3107340 - RNA, 19 nt, Mycobacterium bovis subsp bovis AF2122/97
uagauggugguggcccggc

SEQ ID NO: 3107341 - RNA, 20 nt, Mycobacterium bovis subsp bovis AF2122/97
uagauggugguggcccggcu

SEQ ID NO: 3107342 - RNA, 14 nt, Mycobacterium bovis subsp bovis AF2122/97
uagauguugccgcc

SEQ ID NO: 3107343 - RNA, 15 nt, Mycobacterium bovis subsp bovis AF2122/97
uagcaaagccagcgc

SEQ ID NO: 3107344 - RNA, 16 nt, Mycobacterium bovis subsp bovis AF2122/97
uagcaacgcugcggca

SEQ ID NO: 3107345 - RNA, 19 nt, Mycobacterium bovis subsp bovis AF2122/97
uagcaacgguagcggcggg

SEQ ID NO: 3107346 - RNA, 11 nt, Mycobacterium bovis subsp bovis AF2122/97
uagcacaccga

SEQ ID NO: 3107347 - RNA, 15 nt, Mycobacterium bovis subsp bovis AF2122/97
uagcaccacaucggu

SEQ ID NO: 3107348 - RNA, 23 nt, Mycobacterium bovis subsp bovis AF2122/97
uagcaccaguucccuacacccau

SEQ ID NO: 3107349 - RNA, 22 nt, Mycobacterium bovis subsp bovis AF2122/97
uagcaccaguuugugccgccgc

SEQ ID NO: 3107350 - RNA, 15 nt, Mycobacterium bovis subsp bovis AF2122/97
uagcaccgcgccgaa

SEQ ID NO: 3107351 - RNA, 16 nt, Mycobacterium bovis subsp bovis AF2122/97
uagcaccgcgccgaac

SEQ ID NO: 3107352 - RNA, 13 nt, Mycobacterium bovis subsp bovis AF2122/97
uagcagcacccgg

SEQ ID NO: 3107353 - RNA, 17 nt, Mycobacterium bovis subsp bovis AF2122/97
uagcagcgccagcagcu

SEQ ID NO: 3107354 - RNA, 12 nt, Mycobacterium bovis subsp bovis AF2122/97
uagcagcgcugc

SEQ ID NO: 3107355 - RNA, 22 nt, Mycobacterium bovis subsp bovis AF2122/97
uagcagcggcucggcggcgcgu

SEQ ID NO: 3107356 - RNA, 21 nt, Mycobacterium bovis subsp bovis AF2122/97
uagcagggugccggcgccgcc

SEQ ID NO: 3107357 - RNA, 17 nt, Mycobacterium bovis subsp bovis AF2122/97
uagcagguguaggugcc

SEQ ID NO: 3107358 - RNA, 23 nt, Mycobacterium bovis subsp bovis AF2122/97
uagccaaccugaagccagcgcag

SEQ ID NO: 3107359 - RNA, 20 nt, Mycobacterium bovis subsp bovis AF2122/97
uagccacgcaugggccaggu

SEQ ID NO: 3107360 - RNA, 14 nt, Mycobacterium bovis subsp bovis AF2122/97
uagccacgcccaca

SEQ ID NO: 3107361 - RNA, 15 nt, Mycobacterium bovis subsp bovis AF2122/97
uagccagcagcggcu

SEQ ID NO: 3107362 - RNA, 20 nt, Mycobacterium bovis subsp bovis AF2122/97
uagccagcaggaacgccgug

SEQ ID NO: 3107363 - RNA, 20 nt, Mycobacterium bovis subsp bovis AF2122/97
uagccaggcaaccggucagc

SEQ ID NO: 3107364 - RNA, 17 nt, Mycobacterium bovis subsp bovis AF2122/97
uagccagucggccaccu

SEQ ID NO: 3107365 - RNA, 22 nt, Mycobacterium bovis subsp bovis AF2122/97
uagccauccgugaaucgagcac

SEQ ID NO: 3107366 - RNA, 23 nt, Mycobacterium bovis subsp bovis AF2122/97
uagccaugggauucggccagacg

SEQ ID NO: 3107367 - RNA, 23 nt, Mycobacterium bovis subsp bovis AF2122/97
uagccauucgguguggccguggg

SEQ ID NO: 3107368 - RNA, 19 nt, Mycobacterium bovis subsp bovis AF2122/97
uagcccacccauggccucc

SEQ ID NO: 3107369 - RNA, 13 nt, Mycobacterium bovis subsp bovis AF2122/97
uagcccacccggg

SEQ ID NO: 3107370 - RNA, 18 nt, Mycobacterium bovis subsp bovis AF2122/97
uagcccaggucgaugcgg

SEQ ID NO: 3107371 - RNA, 16 nt, Mycobacterium bovis subsp bovis AF2122/97
uagcccaugccgaugc

SEQ ID NO: 3107372 - RNA, 18 nt, Mycobacterium bovis subsp bovis AF2122/97
uagccccguguuguuguc

SEQ ID NO: 3107373 - RNA, 19 nt, Mycobacterium bovis subsp bovis AF2122/97
uagcccgauggugccgacc

SEQ ID NO: 3107374 - RNA, 20 nt, Mycobacterium bovis subsp bovis AF2122/97
uagcccgauggugccgaccc

SEQ ID NO: 3107375 - RNA, 22 nt, Mycobacterium bovis subsp bovis AF2122/97
uagcccgauggugccgacccgc

SEQ ID NO: 3107376 - RNA, 16 nt, Mycobacterium bovis subsp bovis AF2122/97
uagcccggcagcacgu

SEQ ID NO: 3107377 - RNA, 15 nt, Mycobacterium bovis subsp bovis AF2122/97
uagcccuccgagcac

SEQ ID NO: 3107378 - RNA, 12 nt, Mycobacterium bovis subsp bovis AF2122/97
uagcccugcuca

SEQ ID NO: 3107379 - RNA, 23 nt, Mycobacterium bovis subsp bovis AF2122/97
uagcccuugccguguucgggggc

SEQ ID NO: 3107380 - RNA, 14 nt, Mycobacterium bovis subsp bovis AF2122/97
uagccgaacagcgg

SEQ ID NO: 3107381 - RNA, 15 nt, Mycobacterium bovis subsp bovis AF2122/97
uagccgaacagcgga

SEQ ID NO: 3107382 - RNA, 15 nt, Mycobacterium bovis subsp bovis AF2122/97
uagccgaccagcgcu

SEQ ID NO: 3107383 - RNA, 16 nt, Mycobacterium bovis subsp bovis AF2122/97
uagccgaccggcagcg

SEQ ID NO: 3107384 - RNA, 20 nt, Mycobacterium bovis subsp bovis AF2122/97
uagccgaccggcagcgaugc

SEQ ID NO: 3107385 - RNA, 18 nt, Mycobacterium bovis subsp bovis AF2122/97
uagccgacgccggugccg

SEQ ID NO: 3107386 - RNA, 18 nt, Mycobacterium bovis subsp bovis AF2122/97
uagccgacgucgccgacg

SEQ ID NO: 3107387 - RNA, 20 nt, Mycobacterium bovis subsp bovis AF2122/97
uagccgaggaaguccagcug

SEQ ID NO: 3107388 - RNA, 19 nt, Mycobacterium bovis subsp bovis AF2122/97
uagccgaucaacagggcca

SEQ ID NO: 3107389 - RNA, 16 nt, Mycobacterium bovis subsp bovis AF2122/97
uagccgauccagcagg

SEQ ID NO: 3107390 - RNA, 17 nt, Mycobacterium bovis subsp bovis AF2122/97
uagccgcagccccgaca

SEQ ID NO: 3107391 - RNA, 15 nt, Mycobacterium bovis subsp bovis AF2122/97
uagccgccggcgccg

SEQ ID NO: 3107392 - RNA, 16 nt, Mycobacterium bovis subsp bovis AF2122/97
uagccgccggcgccga

SEQ ID NO: 3107393 - RNA, 16 nt, Mycobacterium bovis subsp bovis AF2122/97
uagccgccggugccgc

SEQ ID NO: 3107394 - RNA, 21 nt, Mycobacterium bovis subsp bovis AF2122/97
uagccgccggugccgccggug

SEQ ID NO: 3107395 - RNA, 14 nt, Mycobacterium bovis subsp bovis AF2122/97
uagccgcggccaca

SEQ ID NO: 3107396 - RNA, 14 nt, Mycobacterium bovis subsp bovis AF2122/97
uagccgcuccgccc

SEQ ID NO: 3107397 - RNA, 23 nt, Mycobacterium bovis subsp bovis AF2122/97
uagccgcugcacguggccacggc

SEQ ID NO: 3107398 - RNA, 11 nt, Mycobacterium bovis subsp bovis AF2122/97
uagccggccgc

SEQ ID NO: 3107399 - RNA, 17 nt, Mycobacterium bovis subsp bovis AF2122/97
uagccggcgacaccgca

SEQ ID NO: 3107400 - RNA, 18 nt, Mycobacterium bovis subsp bovis AF2122/97
uagccggcgacaccgcag

SEQ ID NO: 3107401 - RNA, 20 nt, Mycobacterium bovis subsp bovis AF2122/97
uagccggcgacaccgcaggu

SEQ ID NO: 3107402 - RNA, 13 nt, Mycobacterium bovis subsp bovis AF2122/97
uagccggcgcgcc

SEQ ID NO: 3107403 - RNA, 15 nt, Mycobacterium bovis subsp bovis AF2122/97
uagccggcgugcacu

SEQ ID NO: 3107404 - RNA, 20 nt, Mycobacterium bovis subsp bovis AF2122/97
uagccggcgugcacucccuu

SEQ ID NO: 3107405 - RNA, 18 nt, Mycobacterium bovis subsp bovis AF2122/97
uagccgggcgcgccggcc

SEQ ID NO: 3107406 - RNA, 15 nt, Mycobacterium bovis subsp bovis AF2122/97
uagccggguugccug

SEQ ID NO: 3107407 - RNA, 21 nt, Mycobacterium bovis subsp bovis AF2122/97
uagccggucaguauggcgacg

SEQ ID NO: 3107408 - RNA, 15 nt, Mycobacterium bovis subsp bovis AF2122/97
uagccggugaccgcg

SEQ ID NO: 3107409 - RNA, 19 nt, Mycobacterium bovis subsp bovis AF2122/97
uagccguagcggucgauga

SEQ ID NO: 3107410 - RNA, 22 nt, Mycobacterium bovis subsp bovis AF2122/97
uagccguagcggucgaugaucu

SEQ ID NO: 3107411 - RNA, 17 nt, Mycobacterium bovis subsp bovis AF2122/97
uagccgucgaucccggu

SEQ ID NO: 3107412 - RNA, 14 nt, Mycobacterium bovis subsp bovis AF2122/97
uagccguucggcug

SEQ ID NO: 3107413 - RNA, 18 nt, Mycobacterium bovis subsp bovis AF2122/97
uagccguugccgccgaac

SEQ ID NO: 3107414 - RNA, 22 nt, Mycobacterium bovis subsp bovis AF2122/97
uagccguugccgccgaacagcu

SEQ ID NO: 3107415 - RNA, 23 nt, Mycobacterium bovis subsp bovis AF2122/97
uagccguugccgccgaacagcug

SEQ ID NO: 3107416 - RNA, 19 nt, Mycobacterium bovis subsp bovis AF2122/97
uagccugcguggagcgcuu

SEQ ID NO: 3107417 - RNA, 15 nt, Mycobacterium bovis subsp bovis AF2122/97
uagccuuaacggcau

SEQ ID NO: 3107418 - RNA, 16 nt, Mycobacterium bovis subsp bovis AF2122/97
uagccuuacgcgggug

SEQ ID NO: 3107419 - RNA, 18 nt, Mycobacterium bovis subsp bovis AF2122/97
uagcgaagugcgcgcugg

SEQ ID NO: 3107420 - RNA, 19 nt, Mycobacterium bovis subsp bovis AF2122/97
uagcgaaugaucuugccac

SEQ ID NO: 3107421 - RNA, 20 nt, Mycobacterium bovis subsp bovis AF2122/97
uagcgacagcagcgccaccc

SEQ ID NO: 3107422 - RNA, 19 nt, Mycobacterium bovis subsp bovis AF2122/97
uagcgaccgcggucgcugc

SEQ ID NO: 3107423 - RNA, 14 nt, Mycobacterium bovis subsp bovis AF2122/97
uagcgcaaccgcgc

SEQ ID NO: 3107424 - RNA, 17 nt, Mycobacterium bovis subsp bovis AF2122/97
uagcgcaaugcggcccg

SEQ ID NO: 3107425 - RNA, 21 nt, Mycobacterium bovis subsp bovis AF2122/97
uagcgcaccacacuggcagug

SEQ ID NO: 3107426 - RNA, 18 nt, Mycobacterium bovis subsp bovis AF2122/97
uagcgcacugccgggugg

SEQ ID NO: 3107427 - RNA, 20 nt, Mycobacterium bovis subsp bovis AF2122/97
uagcgcagcgccuccucgau

SEQ ID NO: 3107428 - RNA, 20 nt, Mycobacterium bovis subsp bovis AF2122/97
uagcgcaggagcgcgaugac

SEQ ID NO: 3107429 - RNA, 22 nt, Mycobacterium bovis subsp bovis AF2122/97
uagcgcauaggcuuccggcgcg

SEQ ID NO: 3107430 - RNA, 23 nt, Mycobacterium bovis subsp bovis AF2122/97
uagcgcccaccguagacgacauc

SEQ ID NO: 3107431 - RNA, 15 nt, Mycobacterium bovis subsp bovis AF2122/97
uagcgccgaucuucg

SEQ ID NO: 3107432 - RNA, 19 nt, Mycobacterium bovis subsp bovis AF2122/97
uagcgccgcgcccaccaug

SEQ ID NO: 3107433 - RNA, 23 nt, Mycobacterium bovis subsp bovis AF2122/97
uagcgccucgccggccacccgcg

SEQ ID NO: 3107434 - RNA, 12 nt, Mycobacterium bovis subsp bovis AF2122/97
uagcgcggccag

SEQ ID NO: 3107435 - RNA, 13 nt, Mycobacterium bovis subsp bovis AF2122/97
uagcgcggccagc

SEQ ID NO: 3107436 - RNA, 15 nt, Mycobacterium bovis subsp bovis AF2122/97
uagcgcggccagcag

SEQ ID NO: 3107437 - RNA, 13 nt, Mycobacterium bovis subsp bovis AF2122/97
uagcgcggccgau

SEQ ID NO: 3107438 - RNA, 15 nt, Mycobacterium bovis subsp bovis AF2122/97
uagcgcgggccuggc

SEQ ID NO: 3107439 - RNA, 17 nt, Mycobacterium bovis subsp bovis AF2122/97
uagcgcgggccuggccc

SEQ ID NO: 3107440 - RNA, 18 nt, Mycobacterium bovis subsp bovis AF2122/97
uagcgcgggccuggccca

SEQ ID NO: 3107441 - RNA, 20 nt, Mycobacterium bovis subsp bovis AF2122/97
uagcgcgggccuggcccacg

SEQ ID NO: 3107442 - RNA, 17 nt, Mycobacterium bovis subsp bovis AF2122/97
uagcgcgggcucacaug

SEQ ID NO: 3107443 - RNA, 17 nt, Mycobacterium bovis subsp bovis AF2122/97
uagcgcuauaggccgca

SEQ ID NO: 3107444 - RNA, 18 nt, Mycobacterium bovis subsp bovis AF2122/97
uagcgcucgaucagguug

SEQ ID NO: 3107445 - RNA, 17 nt, Mycobacterium bovis subsp bovis AF2122/97
uagcgcuugacccgcgg

SEQ ID NO: 3107446 - RNA, 23 nt, Mycobacterium bovis subsp bovis AF2122/97
uagcggaaaacccagaucggcga

SEQ ID NO: 3107447 - RNA, 18 nt, Mycobacterium bovis subsp bovis AF2122/97
uagcggaucaggucuggc

SEQ ID NO: 3107448 - RNA, 19 nt, Mycobacterium bovis subsp bovis AF2122/97
uagcggaucgcggucagcg

SEQ ID NO: 3107449 - RNA, 19 nt, Mycobacterium bovis subsp bovis AF2122/97
uagcggauucagcgucgcc

SEQ ID NO: 3107450 - RNA, 12 nt, Mycobacterium bovis subsp bovis AF2122/97
uagcggccgcag

SEQ ID NO: 3107451 - RNA, 14 nt, Mycobacterium bovis subsp bovis AF2122/97
uagcggccgcaggc

SEQ ID NO: 3107452 - RNA, 20 nt, Mycobacterium bovis subsp bovis AF2122/97
uagcggcggcggcacgcucg

SEQ ID NO: 3107453 - RNA, 17 nt, Mycobacterium bovis subsp bovis AF2122/97
uagcggcgggcacgcac

SEQ ID NO: 3107454 - RNA, 14 nt, Mycobacterium bovis subsp bovis AF2122/97
uagcggcucaccgc

SEQ ID NO: 3107455 - RNA, 22 nt, Mycobacterium bovis subsp bovis AF2122/97
uagcggcuugaacagcugaucc

SEQ ID NO: 3107456 - RNA, 17 nt, Mycobacterium bovis subsp bovis AF2122/97
uagcgggcgcccuugag

SEQ ID NO: 3107457 - RNA, 21 nt, Mycobacterium bovis subsp bovis AF2122/97
uagcgggggagcgaacggcgc

SEQ ID NO: 3107458 - RNA, 17 nt, Mycobacterium bovis subsp bovis AF2122/97
uagcgggucagcugacg

SEQ ID NO: 3107459 - RNA, 20 nt, Mycobacterium bovis subsp bovis AF2122/97
uagcggucccgcggaccgca

SEQ ID NO: 3107460 - RNA, 17 nt, Mycobacterium bovis subsp bovis AF2122/97
uagcguccaggucaugc

SEQ ID NO: 3107461 - RNA, 15 nt, Mycobacterium bovis subsp bovis AF2122/97
uagcgucuggcgaca

SEQ ID NO: 3107462 - RNA, 19 nt, Mycobacterium bovis subsp bovis AF2122/97
uagcgugaccgugccgucg

SEQ ID NO: 3107463 - RNA, 14 nt, Mycobacterium bovis subsp bovis AF2122/97
uagcguguggcgca

SEQ ID NO: 3107464 - RNA, 13 nt, Mycobacterium bovis subsp bovis AF2122/97
uagcguucggcga

SEQ ID NO: 3107465 - RNA, 22 nt, Mycobacterium bovis subsp bovis AF2122/97
uagcuaaugcacgcccaggcga

SEQ ID NO: 3107466 - RNA, 18 nt, Mycobacterium bovis subsp bovis AF2122/97
uagcucacgguggccgca

SEQ ID NO: 3107467 - RNA, 20 nt, Mycobacterium bovis subsp bovis AF2122/97
uagcucacguuugaggaccu

SEQ ID NO: 3107468 - RNA, 14 nt, Mycobacterium bovis subsp bovis AF2122/97
uagcucccugggcg

SEQ ID NO: 3107469 - RNA, 14 nt, Mycobacterium bovis subsp bovis AF2122/97
uagcuccuauggca

SEQ ID NO: 3107470 - RNA, 23 nt, Mycobacterium bovis subsp bovis AF2122/97
uagcucgucgaggaagaucaccu

SEQ ID NO: 3107471 - RNA, 17 nt, Mycobacterium bovis subsp bovis AF2122/97
uagcugacccgcgguag

SEQ ID NO: 3107472 - RNA, 12 nt, Mycobacterium bovis subsp bovis AF2122/97
uagcugccggcc

SEQ ID NO: 3107473 - RNA, 22 nt, Mycobacterium bovis subsp bovis AF2122/97
uagcugcgcagcgcaaacaucu

SEQ ID NO: 3107474 - RNA, 22 nt, Mycobacterium bovis subsp bovis AF2122/97
uagcugcggucgaacaucaucg

SEQ ID NO: 3107475 - RNA, 16 nt, Mycobacterium bovis subsp bovis AF2122/97
uagcugcguccggaac

SEQ ID NO: 3107476 - RNA, 12 nt, Mycobacterium bovis subsp bovis AF2122/97
uagcugcugaug

SEQ ID NO: 3107477 - RNA, 19 nt, Mycobacterium bovis subsp bovis AF2122/97
uagcuggaguaggugugcg

SEQ ID NO: 3107478 - RNA, 20 nt, Mycobacterium bovis subsp bovis AF2122/97
uagcuggcgaucuggucggc

SEQ ID NO: 3107479 - RNA, 13 nt, Mycobacterium bovis subsp bovis AF2122/97
uagcuguggcccg

SEQ ID NO: 3107480 - RNA, 13 nt, Mycobacterium bovis subsp bovis AF2122/97
uagcuuagcugcc

SEQ ID NO: 3107481 - RNA, 13 nt, Mycobacterium bovis subsp bovis AF2122/97
uagcuuccggucc

SEQ ID NO: 3107482 - RNA, 17 nt, Mycobacterium bovis subsp bovis AF2122/97
uaggacaccaccguggc

SEQ ID NO: 3107483 - RNA, 19 nt, Mycobacterium bovis subsp bovis AF2122/97
uaggacaccgucaugccgu

SEQ ID NO: 3107484 - RNA, 16 nt, Mycobacterium bovis subsp bovis AF2122/97
uaggaccaccagcgcu

SEQ ID NO: 3107485 - RNA, 22 nt, Mycobacterium bovis subsp bovis AF2122/97
uaggaccaccagcgcuccagca

SEQ ID NO: 3107486 - RNA, 16 nt, Mycobacterium bovis subsp bovis AF2122/97
uaggacccagccagcu

SEQ ID NO: 3107487 - RNA, 17 nt, Mycobacterium bovis subsp bovis AF2122/97
uaggacggcgcgagccg

SEQ ID NO: 3107488 - RNA, 18 nt, Mycobacterium bovis subsp bovis AF2122/97
uaggacggcgcgagccgc

SEQ ID NO: 3107489 - RNA, 20 nt, Mycobacterium bovis subsp bovis AF2122/97
uaggacugcgccaccgguga

SEQ ID NO: 3107490 - RNA, 19 nt, Mycobacterium bovis subsp bovis AF2122/97
uaggacuugauaucggcgg

SEQ ID NO: 3107491 - RNA, 15 nt, Mycobacterium bovis subsp bovis AF2122/97
uaggagaucagcacc

SEQ ID NO: 3107492 - RNA, 21 nt, Mycobacterium bovis subsp bovis AF2122/97
uaggaucggauggcggccaca

SEQ ID NO: 3107493 - RNA, 16 nt, Mycobacterium bovis subsp bovis AF2122/97
uaggcaugccacacac

SEQ ID NO: 3107494 - RNA, 16 nt, Mycobacterium bovis subsp bovis AF2122/97
uaggccaccggcgacc

SEQ ID NO: 3107495 - RNA, 14 nt, Mycobacterium bovis subsp bovis AF2122/97
uaggccaccuccga

SEQ ID NO: 3107496 - RNA, 20 nt, Mycobacterium bovis subsp bovis AF2122/97
uaggccaccuccgaggccgc

SEQ ID NO: 3107497 - RNA, 12 nt, Mycobacterium bovis subsp bovis AF2122/97
uaggccagcccg

SEQ ID NO: 3107498 - RNA, 18 nt, Mycobacterium bovis subsp bovis AF2122/97
uaggccccgccagcgccg

SEQ ID NO: 3107499 - RNA, 14 nt, Mycobacterium bovis subsp bovis AF2122/97
uaggcccgcacguu

SEQ ID NO: 3107500 - RNA, 15 nt, Mycobacterium bovis subsp bovis AF2122/97
uaggcccggucuugg

SEQ ID NO: 3107501 - RNA, 19 nt, Mycobacterium bovis subsp bovis AF2122/97
uaggccgcauauugcggcg

SEQ ID NO: 3107502 - RNA, 14 nt, Mycobacterium bovis subsp bovis AF2122/97
uaggccgccagccg

SEQ ID NO: 3107503 - RNA, 14 nt, Mycobacterium bovis subsp bovis AF2122/97
uaggccgcgcggcg

SEQ ID NO: 3107504 - RNA, 16 nt, Mycobacterium bovis subsp bovis AF2122/97
uaggccgcgcggcggc

SEQ ID NO: 3107505 - RNA, 22 nt, Mycobacterium bovis subsp bovis AF2122/97
uaggcgaaaauugcuccaccac

SEQ ID NO: 3107506 - RNA, 17 nt, Mycobacterium bovis subsp bovis AF2122/97
uaggcgaaauagcccaa

SEQ ID NO: 3107507 - RNA, 16 nt, Mycobacterium bovis subsp bovis AF2122/97
uaggcgaaccgcucca

SEQ ID NO: 3107508 - RNA, 14 nt, Mycobacterium bovis subsp bovis AF2122/97
uaggcgaccagaua

SEQ ID NO: 3107509 - RNA, 23 nt, Mycobacterium bovis subsp bovis AF2122/97
uaggcgaccagauagaacaacgu

SEQ ID NO: 3107510 - RNA, 16 nt, Mycobacterium bovis subsp bovis AF2122/97
uaggcgaucgucuccu

SEQ ID NO: 3107511 - RNA, 17 nt, Mycobacterium bovis subsp bovis AF2122/97
uaggcgauggcggcgcg

SEQ ID NO: 3107512 - RNA, 18 nt, Mycobacterium bovis subsp bovis AF2122/97
uaggcgauugcgccgcac

SEQ ID NO: 3107513 - RNA, 16 nt, Mycobacterium bovis subsp bovis AF2122/97
uaggcgcggucaccgc

SEQ ID NO: 3107514 - RNA, 23 nt, Mycobacterium bovis subsp bovis AF2122/97
uaggcggccaugucagcggccug

SEQ ID NO: 3107515 - RNA, 17 nt, Mycobacterium bovis subsp bovis AF2122/97
uaggcggcggcccgcag

SEQ ID NO: 3107516 - RNA, 17 nt, Mycobacterium bovis subsp bovis AF2122/97
uaggcuccaagcaauuc

SEQ ID NO: 3107517 - RNA, 19 nt, Mycobacterium bovis subsp bovis AF2122/97
uaggcuccaagcaauucca

SEQ ID NO: 3107518 - RNA, 14 nt, Mycobacterium bovis subsp bovis AF2122/97
uaggcucccacucc

SEQ ID NO: 3107519 - RNA, 19 nt, Mycobacterium bovis subsp bovis AF2122/97
uaggcuuccggcgcgaccg

SEQ ID NO: 3107520 - RNA, 18 nt, Mycobacterium bovis subsp bovis AF2122/97
uagggauagcagugcagc

SEQ ID NO: 3107521 - RNA, 16 nt, Mycobacterium bovis subsp bovis AF2122/97
uagggcaucgucgccg

SEQ ID NO: 3107522 - RNA, 18 nt, Mycobacterium bovis subsp bovis AF2122/97
uagggccaccgccgccug

SEQ ID NO: 3107523 - RNA, 13 nt, Mycobacterium bovis subsp bovis AF2122/97
uagggcgcccgcc

SEQ ID NO: 3107524 - RNA, 13 nt, Mycobacterium bovis subsp bovis AF2122/97
uagggcuccucgu

SEQ ID NO: 3107525 - RNA, 22 nt, Mycobacterium bovis subsp bovis AF2122/97
uagggcugaccgaagaagcccg

SEQ ID NO: 3107526 - RNA, 18 nt, Mycobacterium bovis subsp bovis AF2122/97
uaggggcuuuugcgucug

SEQ ID NO: 3107527 - RNA, 19 nt, Mycobacterium bovis subsp bovis AF2122/97
uaggggcuuuugcgucugc

SEQ ID NO: 3107528 - RNA, 18 nt, Mycobacterium bovis subsp bovis AF2122/97
uaggguucuucgacgcgg

SEQ ID NO: 3107529 - RNA, 14 nt, Mycobacterium bovis subsp bovis AF2122/97
uagguauugccgca

SEQ ID NO: 3107530 - RNA, 19 nt, Mycobacterium bovis subsp bovis AF2122/97
uagguccuugucggccccg

SEQ ID NO: 3107531 - RNA, 18 nt, Mycobacterium bovis subsp bovis AF2122/97
uaggucgaccacccgcag

SEQ ID NO: 3107532 - RNA, 23 nt, Mycobacterium bovis subsp bovis AF2122/97
uaggucgaccacccgcagggcau

SEQ ID NO: 3107533 - RNA, 13 nt, Mycobacterium bovis subsp bovis AF2122/97
uaggucgacgccg

SEQ ID NO: 3107534 - RNA, 14 nt, Mycobacterium bovis subsp bovis AF2122/97
uaggucgccgccgc

SEQ ID NO: 3107535 - RNA, 16 nt, Mycobacterium bovis subsp bovis AF2122/97
uaggugacgacgucgu

SEQ ID NO: 3107536 - RNA, 20 nt, Mycobacterium bovis subsp bovis AF2122/97
uaggugacgccgccagcacc

SEQ ID NO: 3107537 - RNA, 23 nt, Mycobacterium bovis subsp bovis AF2122/97
uaggugcaacaggcgcgucggug

SEQ ID NO: 3107538 - RNA, 16 nt, Mycobacterium bovis subsp bovis AF2122/97
uaggugcaugucgaug

SEQ ID NO: 3107539 - RNA, 13 nt, Mycobacterium bovis subsp bovis AF2122/97
uagguggccagcg

SEQ ID NO: 3107540 - RNA, 17 nt, Mycobacterium bovis subsp bovis AF2122/97
uagguggccagcgcggc

SEQ ID NO: 3107541 - RNA, 20 nt, Mycobacterium bovis subsp bovis AF2122/97
uagguggucuuggcgguggc

SEQ ID NO: 3107542 - RNA, 19 nt, Mycobacterium bovis subsp bovis AF2122/97
uaggugucgggcucgcauu

SEQ ID NO: 3107543 - RNA, 15 nt, Mycobacterium bovis subsp bovis AF2122/97
uaggugugcgacgac

SEQ ID NO: 3107544 - RNA, 22 nt, Mycobacterium bovis subsp bovis AF2122/97
uaggugugcgacgacggcgccg

SEQ ID NO: 3107545 - RNA, 17 nt, Mycobacterium bovis subsp bovis AF2122/97
uagguucagcgacugag

SEQ ID NO: 3107546 - RNA, 20 nt, Mycobacterium bovis subsp bovis AF2122/97
uagguuuucggcggcucuag

SEQ ID NO: 3107547 - RNA, 21 nt, Mycobacterium bovis subsp bovis AF2122/97
uaguagugagaaaucaaaucc

SEQ ID NO: 3107548 - RNA, 21 nt, Mycobacterium bovis subsp bovis AF2122/97
uaguaguucagccaggccgca

SEQ ID NO: 3107549 - RNA, 12 nt, Mycobacterium bovis subsp bovis AF2122/97
uagucagaaccg

SEQ ID NO: 3107550 - RNA, 21 nt, Mycobacterium bovis subsp bovis AF2122/97
uaguccagcucgcugcgcgcc

SEQ ID NO: 3107551 - RNA, 20 nt, Mycobacterium bovis subsp bovis AF2122/97
uagucccucaucaccucucc

SEQ ID NO: 3107552 - RNA, 20 nt, Mycobacterium bovis subsp bovis AF2122/97
uaguccgagggcgucgccgc

SEQ ID NO: 3107553 - RNA, 21 nt, Mycobacterium bovis subsp bovis AF2122/97
uaguccgagggcgucgccgcc

SEQ ID NO: 3107554 - RNA, 16 nt, Mycobacterium bovis subsp bovis AF2122/97
uaguccgcauccgcga

SEQ ID NO: 3107555 - RNA, 18 nt, Mycobacterium bovis subsp bovis AF2122/97
uaguccgcauccgcgacg

SEQ ID NO: 3107556 - RNA, 21 nt, Mycobacterium bovis subsp bovis AF2122/97
uaguccgcgccgacggccagc

SEQ ID NO: 3107557 - RNA, 22 nt, Mycobacterium bovis subsp bovis AF2122/97
uaguccggcacugcggccaguc

SEQ ID NO: 3107558 - RNA, 16 nt, Mycobacterium bovis subsp bovis AF2122/97
uagucgaaggucagca

SEQ ID NO: 3107559 - RNA, 21 nt, Mycobacterium bovis subsp bovis AF2122/97
uagucgaauggcaacacaccg

SEQ ID NO: 3107560 - RNA, 23 nt, Mycobacterium bovis subsp bovis AF2122/97
uagucgacgucgauuucggcgac

SEQ ID NO: 3107561 - RNA, 15 nt, Mycobacterium bovis subsp bovis AF2122/97
uagucgauuggcugc

SEQ ID NO: 3107562 - RNA, 19 nt, Mycobacterium bovis subsp bovis AF2122/97
uagucgauuggcugcgccg

SEQ ID NO: 3107563 - RNA, 16 nt, Mycobacterium bovis subsp bovis AF2122/97
uagucgccggucaggc

SEQ ID NO: 3107564 - RNA, 15 nt, Mycobacterium bovis subsp bovis AF2122/97
uagucgcgaccgcgg

SEQ ID NO: 3107565 - RNA, 16 nt, Mycobacterium bovis subsp bovis AF2122/97
uagucgcgggccaagc

SEQ ID NO: 3107566 - RNA, 16 nt, Mycobacterium bovis subsp bovis AF2122/97
uagucggccggcgguc

SEQ ID NO: 3107567 - RNA, 11 nt, Mycobacterium bovis subsp bovis AF2122/97
uagucggccug

SEQ ID NO: 3107568 - RNA, 16 nt, Mycobacterium bovis subsp bovis AF2122/97
uagucggcggugcaga

SEQ ID NO: 3107569 - RNA, 23 nt, Mycobacterium bovis subsp bovis AF2122/97
uagucgggcaaggcggcggccag

SEQ ID NO: 3107570 - RNA, 18 nt, Mycobacterium bovis subsp bovis AF2122/97
uagucgucggcgcugacg

SEQ ID NO: 3107571 - RNA, 13 nt, Mycobacterium bovis subsp bovis AF2122/97
uagugcaggugcc

SEQ ID NO: 3107572 - RNA, 18 nt, Mycobacterium bovis subsp bovis AF2122/97
uagugcaucggcagcccc

SEQ ID NO: 3107573 - RNA, 18 nt, Mycobacterium bovis subsp bovis AF2122/97
uagugccaggaucgcggc

SEQ ID NO: 3107574 - RNA, 22 nt, Mycobacterium bovis subsp bovis AF2122/97
uagugccucgauuguggccagc

SEQ ID NO: 3107575 - RNA, 15 nt, Mycobacterium bovis subsp bovis AF2122/97
uagugcucgcagcca

SEQ ID NO: 3107576 - RNA, 22 nt, Mycobacterium bovis subsp bovis AF2122/97
uaguggcgaucugcugcucgau

SEQ ID NO: 3107577 - RNA, 16 nt, Mycobacterium bovis subsp bovis AF2122/97
uaguggcgcgcggcgc

SEQ ID NO: 3107578 - RNA, 13 nt, Mycobacterium bovis subsp bovis AF2122/97
uaguguguuuggu

SEQ ID NO: 3107579 - RNA, 13 nt, Mycobacterium bovis subsp bovis AF2122/97
uaguucaccgcgu

SEQ ID NO: 3107580 - RNA, 23 nt, Mycobacterium bovis subsp bovis AF2122/97
uaguucagccaggccgcaaugcg

SEQ ID NO: 3107581 - RNA, 20 nt, Mycobacterium bovis subsp bovis AF2122/97
uaguugauggccccgggcgg

SEQ ID NO: 3107582 - RNA, 19 nt, Mycobacterium bovis subsp bovis AF2122/97
uaguugguccaggugaccg

SEQ ID NO: 3107583 - RNA, 20 nt, Mycobacterium bovis subsp bovis AF2122/97
uaguuuaucggccgugaauu

SEQ ID NO: 3107584 - RNA, 12 nt, Mycobacterium bovis subsp bovis AF2122/97
uauaccgcuggg

SEQ ID NO: 3107585 - RNA, 15 nt, Mycobacterium bovis subsp bovis AF2122/97
uauaccgcuggggcu

SEQ ID NO: 3107586 - RNA, 20 nt, Mycobacterium bovis subsp bovis AF2122/97
uauagcccguagccgaucag

SEQ ID NO: 3107587 - RNA, 14 nt, Mycobacterium bovis subsp bovis AF2122/97
uauagccgccggug

SEQ ID NO: 3107588 - RNA, 16 nt, Mycobacterium bovis subsp bovis AF2122/97
uauaggacgccgcgcc

SEQ ID NO: 3107589 - RNA, 20 nt, Mycobacterium bovis subsp bovis AF2122/97
uauaggcccgggcggccagc

SEQ ID NO: 3107590 - RNA, 14 nt, Mycobacterium bovis subsp bovis AF2122/97
uauauggugcgcca

SEQ ID NO: 3107591 - RNA, 13 nt, Mycobacterium bovis subsp bovis AF2122/97
uaucacccggaga

SEQ ID NO: 3107592 - RNA, 23 nt, Mycobacterium bovis subsp bovis AF2122/97
uaucagccgcgcgccaucgccuc

SEQ ID NO: 3107593 - RNA, 15 nt, Mycobacterium bovis subsp bovis AF2122/97
uauccagucgauccu

SEQ ID NO: 3107594 - RNA, 13 nt, Mycobacterium bovis subsp bovis AF2122/97
uauccgacgucgg

SEQ ID NO: 3107595 - RNA, 20 nt, Mycobacterium bovis subsp bovis AF2122/97
uauccggaucggccugucca

SEQ ID NO: 3107596 - RNA, 23 nt, Mycobacterium bovis subsp bovis AF2122/97
uauccggccgagccguugcgccu

SEQ ID NO: 3107597 - RNA, 20 nt, Mycobacterium bovis subsp bovis AF2122/97
uauccgugaauggcagcacg

SEQ ID NO: 3107598 - RNA, 19 nt, Mycobacterium bovis subsp bovis AF2122/97
uaucgaaaaguagaccgag

SEQ ID NO: 3107599 - RNA, 14 nt, Mycobacterium bovis subsp bovis AF2122/97
uaucgaaggcgaca

SEQ ID NO: 3107600 - RNA, 22 nt, Mycobacterium bovis subsp bovis AF2122/97
uaucgagcggcacaucagccau

SEQ ID NO: 3107601 - RNA, 17 nt, Mycobacterium bovis subsp bovis AF2122/97
uaucgauugaugcgugg

SEQ ID NO: 3107602 - RNA, 20 nt, Mycobacterium bovis subsp bovis AF2122/97
uaucgcagcguuggccgcug

SEQ ID NO: 3107603 - RNA, 19 nt, Mycobacterium bovis subsp bovis AF2122/97
uaucgccaguggugcaccg

SEQ ID NO: 3107604 - RNA, 22 nt, Mycobacterium bovis subsp bovis AF2122/97
uaucgccgcgggcgaaccgcuc

SEQ ID NO: 3107605 - RNA, 13 nt, Mycobacterium bovis subsp bovis AF2122/97
uaucgccgggaac

SEQ ID NO: 3107606 - RNA, 16 nt, Mycobacterium bovis subsp bovis AF2122/97
uaucggcgaacccgca

SEQ ID NO: 3107607 - RNA, 15 nt, Mycobacterium bovis subsp bovis AF2122/97
uaucggcgugucucg

SEQ ID NO: 3107608 - RNA, 20 nt, Mycobacterium bovis subsp bovis AF2122/97
uaucggcuuauugcccguca

SEQ ID NO: 3107609 - RNA, 22 nt, Mycobacterium bovis subsp bovis AF2122/97
uaucgggcccccuggaucgcgc

SEQ ID NO: 3107610 - RNA, 21 nt, Mycobacterium bovis subsp bovis AF2122/97
uaucggugcuggucgccgcgg

SEQ ID NO: 3107611 - RNA, 13 nt, Mycobacterium bovis subsp bovis AF2122/97
uaucgucgacgcc

SEQ ID NO: 3107612 - RNA, 14 nt, Mycobacterium bovis subsp bovis AF2122/97
uaucgucgacgccg

SEQ ID NO: 3107613 - RNA, 19 nt, Mycobacterium bovis subsp bovis AF2122/97
uaucgucgugucgccgccg

SEQ ID NO: 3107614 - RNA, 19 nt, Mycobacterium bovis subsp bovis AF2122/97
uaucguuaucgacaccacc

SEQ ID NO: 3107615 - RNA, 17 nt, Mycobacterium bovis subsp bovis AF2122/97
uaucguuggcgaccacc

SEQ ID NO: 3107616 - RNA, 20 nt, Mycobacterium bovis subsp bovis AF2122/97
uaucucggugacgaugaacu

SEQ ID NO: 3107617 - RNA, 19 nt, Mycobacterium bovis subsp bovis AF2122/97
uaucuguugacucugcguc

SEQ ID NO: 3107618 - RNA, 12 nt, Mycobacterium bovis subsp bovis AF2122/97
uaugcacccgca

SEQ ID NO: 3107619 - RNA, 12 nt, Mycobacterium bovis subsp bovis AF2122/97
uaugccacaggc

SEQ ID NO: 3107620 - RNA, 17 nt, Mycobacterium bovis subsp bovis AF2122/97
uaugccacaggcugcca

SEQ ID NO: 3107621 - RNA, 22 nt, Mycobacterium bovis subsp bovis AF2122/97
uaugcccacgaaccgugcuggg

SEQ ID NO: 3107622 - RNA, 22 nt, Mycobacterium bovis subsp bovis AF2122/97
uaugcgccaucucgacggugac

SEQ ID NO: 3107623 - RNA, 13 nt, Mycobacterium bovis subsp bovis AF2122/97
uaugcuggcagcu

SEQ ID NO: 3107624 - RNA, 18 nt, Mycobacterium bovis subsp bovis AF2122/97
uauggaucaacgcacggc

SEQ ID NO: 3107625 - RNA, 14 nt, Mycobacterium bovis subsp bovis AF2122/97
uauggcccgggccg

SEQ ID NO: 3107626 - RNA, 13 nt, Mycobacterium bovis subsp bovis AF2122/97
uauggcggcgacg

SEQ ID NO: 3107627 - RNA, 15 nt, Mycobacterium bovis subsp bovis AF2122/97
uaugggagucccacc

SEQ ID NO: 3107628 - RNA, 14 nt, Mycobacterium bovis subsp bovis AF2122/97
uauggguccucgag

SEQ ID NO: 3107629 - RNA, 15 nt, Mycobacterium bovis subsp bovis AF2122/97
uauguauccgcgccg

SEQ ID NO: 3107630 - RNA, 16 nt, Mycobacterium bovis subsp bovis AF2122/97
uaugugcccggcgcga

SEQ ID NO: 3107631 - RNA, 13 nt, Mycobacterium bovis subsp bovis AF2122/97
uauguucggcaau

SEQ ID NO: 3107632 - RNA, 13 nt, Mycobacterium bovis subsp bovis AF2122/97
uauuaccgcuugc

SEQ ID NO: 3107633 - RNA, 12 nt, Mycobacterium bovis subsp bovis AF2122/97
uauucggcggca

SEQ ID NO: 3107634 - RNA, 17 nt, Mycobacterium bovis subsp bovis AF2122/97
uauucguuggcgaacug

SEQ ID NO: 3107635 - RNA, 20 nt, Mycobacterium bovis subsp bovis AF2122/97
uauugagucggcugguccuc

SEQ ID NO: 3107636 - RNA, 23 nt, Mycobacterium bovis subsp bovis AF2122/97
uauugcaggaaaucguccuugga

SEQ ID NO: 3107637 - RNA, 14 nt, Mycobacterium bovis subsp bovis AF2122/97
uauugccaaagccc

SEQ ID NO: 3107638 - RNA, 18 nt, Mycobacterium bovis subsp bovis AF2122/97
uauugcgcccggccauga

SEQ ID NO: 3107639 - RNA, 15 nt, Mycobacterium bovis subsp bovis AF2122/97
uauugcggcgccgug

SEQ ID NO: 3107640 - RNA, 19 nt, Mycobacterium bovis subsp bovis AF2122/97
uauugcggugcaucgccac

SEQ ID NO: 3107641 - RNA, 14 nt, Mycobacterium bovis subsp bovis AF2122/97
uauugcugcggugc

SEQ ID NO: 3107642 - RNA, 19 nt, Mycobacterium bovis subsp bovis AF2122/97
ucaaaaaccacgcgucgcu

SEQ ID NO: 3107643 - RNA, 20 nt, Mycobacterium bovis subsp bovis AF2122/97
ucaaaaagcucggcccuguu

SEQ ID NO: 3107644 - RNA, 15 nt, Mycobacterium bovis subsp bovis AF2122/97
ucaaaaucagggugc

SEQ ID NO: 3107645 - RNA, 19 nt, Mycobacterium bovis subsp bovis AF2122/97
ucaaacccgaaaacccaac

SEQ ID NO: 3107646 - RNA, 20 nt, Mycobacterium bovis subsp bovis AF2122/97
ucaaacccgaaaacccaaca

SEQ ID NO: 3107647 - RNA, 13 nt, Mycobacterium bovis subsp bovis AF2122/97
ucaaaccggcggc

SEQ ID NO: 3107648 - RNA, 22 nt, Mycobacterium bovis subsp bovis AF2122/97
ucaaaccggcggcgacggcggc

SEQ ID NO: 3107649 - RNA, 23 nt, Mycobacterium bovis subsp bovis AF2122/97
ucaaagcggugccauuguaaaau

SEQ ID NO: 3107650 - RNA, 22 nt, Mycobacterium bovis subsp bovis AF2122/97
ucaaaucaacggcgucggcuuc

SEQ ID NO: 3107651 - RNA, 20 nt, Mycobacterium bovis subsp bovis AF2122/97
ucaaaugaaccgcacccuga

SEQ ID NO: 3107652 - RNA, 22 nt, Mycobacterium bovis subsp bovis AF2122/97
ucaacacacugaagaucgcgcc

SEQ ID NO: 3107653 - RNA, 23 nt, Mycobacterium bovis subsp bovis AF2122/97
ucaacaccaacgcgcaccuggcg

SEQ ID NO: 3107654 - RNA, 22 nt, Mycobacterium bovis subsp bovis AF2122/97
ucaacaccagcaagugugagca

SEQ ID NO: 3107655 - RNA, 15 nt, Mycobacterium bovis subsp bovis AF2122/97
ucaacacccggccga

SEQ ID NO: 3107656 - RNA, 17 nt, Mycobacterium bovis subsp bovis AF2122/97
ucaacaccgaguuccuc

SEQ ID NO: 3107657 - RNA, 14 nt, Mycobacterium bovis subsp bovis AF2122/97
ucaacaccgcggcc

SEQ ID NO: 3107658 - RNA, 17 nt, Mycobacterium bovis subsp bovis AF2122/97
ucaacaccgcggccgag

SEQ ID NO: 3107659 - RNA, 13 nt, Mycobacterium bovis subsp bovis AF2122/97
ucaacaccggcau

SEQ ID NO: 3107660 - RNA, 21 nt, Mycobacterium bovis subsp bovis AF2122/97
ucaacaccggcugguucaaca

SEQ ID NO: 3107661 - RNA, 21 nt, Mycobacterium bovis subsp bovis AF2122/97
ucaacagaccuagcaccgcgc

SEQ ID NO: 3107662 - RNA, 12 nt, Mycobacterium bovis subsp bovis AF2122/97
ucaacagcaccg

SEQ ID NO: 3107663 - RNA, 14 nt, Mycobacterium bovis subsp bovis AF2122/97
ucaacagcaccgcg

SEQ ID NO: 3107664 - RNA, 19 nt, Mycobacterium bovis subsp bovis AF2122/97
ucaacagcggcaagaaguu

SEQ ID NO: 3107665 - RNA, 16 nt, Mycobacterium bovis subsp bovis AF2122/97
ucaacaggccguggcg

SEQ ID NO: 3107666 - RNA, 18 nt, Mycobacterium bovis subsp bovis AF2122/97
ucaacaggccucgaccgc

SEQ ID NO: 3107667 - RNA, 21 nt, Mycobacterium bovis subsp bovis AF2122/97
ucaacaggucuacccggucgc

SEQ ID NO: 3107668 - RNA, 13 nt, Mycobacterium bovis subsp bovis AF2122/97
ucaacaucggccc

SEQ ID NO: 3107669 - RNA, 17 nt, Mycobacterium bovis subsp bovis AF2122/97
ucaacauugugcucgcc

SEQ ID NO: 3107670 - RNA, 15 nt, Mycobacterium bovis subsp bovis AF2122/97
ucaaccacggccgcc

SEQ ID NO: 3107671 - RNA, 16 nt, Mycobacterium bovis subsp bovis AF2122/97
ucaacccgguccagcc

SEQ ID NO: 3107672 - RNA, 18 nt, Mycobacterium bovis subsp bovis AF2122/97
ucaaccggacgaccggaa

SEQ ID NO: 3107673 - RNA, 16 nt, Mycobacterium bovis subsp bovis AF2122/97
ucaaccgggucagccc

SEQ ID NO: 3107674 - RNA, 22 nt, Mycobacterium bovis subsp bovis AF2122/97
ucaaccgguguaauugccgacg

SEQ ID NO: 3107675 - RNA, 15 nt, Mycobacterium bovis subsp bovis AF2122/97
ucaaccucuggcggc

SEQ ID NO: 3107676 - RNA, 18 nt, Mycobacterium bovis subsp bovis AF2122/97
ucaaccugaaccggccgc

SEQ ID NO: 3107677 - RNA, 16 nt, Mycobacterium bovis subsp bovis AF2122/97
ucaaccugcugcagaa

SEQ ID NO: 3107678 - RNA, 19 nt, Mycobacterium bovis subsp bovis AF2122/97
ucaacgaaaauuugacgac

SEQ ID NO: 3107679 - RNA, 15 nt, Mycobacterium bovis subsp bovis AF2122/97
ucaacgacaccagau

SEQ ID NO: 3107680 - RNA, 22 nt, Mycobacterium bovis subsp bovis AF2122/97
ucaacgacaccauaggccgacg

SEQ ID NO: 3107681 - RNA, 15 nt, Mycobacterium bovis subsp bovis AF2122/97
ucaacgaggccgacg

SEQ ID NO: 3107682 - RNA, 17 nt, Mycobacterium bovis subsp bovis AF2122/97
ucaacgaggccgacgac

SEQ ID NO: 3107683 - RNA, 22 nt, Mycobacterium bovis subsp bovis AF2122/97
ucaacgaucccggggugccgau

SEQ ID NO: 3107684 - RNA, 14 nt, Mycobacterium bovis subsp bovis AF2122/97
ucaacgaucgcgcc

SEQ ID NO: 3107685 - RNA, 17 nt, Mycobacterium bovis subsp bovis AF2122/97
ucaacgaugguggcgau

SEQ ID NO: 3107686 - RNA, 19 nt, Mycobacterium bovis subsp bovis AF2122/97
ucaacgcaucgguggcacg

SEQ ID NO: 3107687 - RNA, 21 nt, Mycobacterium bovis subsp bovis AF2122/97
ucaacgccgcggucaggaugg

SEQ ID NO: 3107688 - RNA, 15 nt, Mycobacterium bovis subsp bovis AF2122/97
ucaacgcgcgcacgc

SEQ ID NO: 3107689 - RNA, 19 nt, Mycobacterium bovis subsp bovis AF2122/97
ucaacgcguugcacagcag

SEQ ID NO: 3107690 - RNA, 14 nt, Mycobacterium bovis subsp bovis AF2122/97
ucaacggaaugaag

SEQ ID NO: 3107691 - RNA, 21 nt, Mycobacterium bovis subsp bovis AF2122/97
ucaacggaaugaaggcaccga

SEQ ID NO: 3107692 - RNA, 15 nt, Mycobacterium bovis subsp bovis AF2122/97
ucaacggcgacaucg

SEQ ID NO: 3107693 - RNA, 20 nt, Mycobacterium bovis subsp bovis AF2122/97
ucaacggcgacaucggcccg

SEQ ID NO: 3107694 - RNA, 20 nt, Mycobacterium bovis subsp bovis AF2122/97
ucaacggcggcaacggcggc

SEQ ID NO: 3107695 - RNA, 21 nt, Mycobacterium bovis subsp bovis AF2122/97
ucaacggcggcaacggcggca

SEQ ID NO: 3107696 - RNA, 17 nt, Mycobacterium bovis subsp bovis AF2122/97
ucaacguauccccgacc

SEQ ID NO: 3107697 - RNA, 22 nt, Mycobacterium bovis subsp bovis AF2122/97
ucaacguauccccgaccacuga

SEQ ID NO: 3107698 - RNA, 22 nt, Mycobacterium bovis subsp bovis AF2122/97
ucaacgucacccccuucacccu

SEQ ID NO: 3107699 - RNA, 21 nt, Mycobacterium bovis subsp bovis AF2122/97
ucaacgucccagcccuuggcg

SEQ ID NO: 3107700 - RNA, 13 nt, Mycobacterium bovis subsp bovis AF2122/97
ucaacgugaacug

SEQ ID NO: 3107701 - RNA, 17 nt, Mycobacterium bovis subsp bovis AF2122/97
ucaacgugucccaagcc

SEQ ID NO: 3107702 - RNA, 13 nt, Mycobacterium bovis subsp bovis AF2122/97
ucaacguucaacg

SEQ ID NO: 3107703 - RNA, 13 nt, Mycobacterium bovis subsp bovis AF2122/97
ucaacuccacgcg

SEQ ID NO: 3107704 - RNA, 10 nt, Mycobacterium bovis subsp bovis AF2122/97
ucaacucggg

SEQ ID NO: 3107705 - RNA, 20 nt, Mycobacterium bovis subsp bovis AF2122/97
ucaacucgggcagcgcggcc

SEQ ID NO: 3107706 - RNA, 19 nt, Mycobacterium bovis subsp bovis AF2122/97
ucaacuucuuggugcccau

SEQ ID NO: 3107707 - RNA, 14 nt, Mycobacterium bovis subsp bovis AF2122/97
ucaacuugggcccg

SEQ ID NO: 3107708 - RNA, 17 nt, Mycobacterium bovis subsp bovis AF2122/97
ucaagaagaacucggug

SEQ ID NO: 3107709 - RNA, 18 nt, Mycobacterium bovis subsp bovis AF2122/97
ucaagaaggccagcgcgc

SEQ ID NO: 3107710 - RNA, 15 nt, Mycobacterium bovis subsp bovis AF2122/97
ucaagaucggugcca

SEQ ID NO: 3107711 - RNA, 18 nt, Mycobacterium bovis subsp bovis AF2122/97
ucaagaucggugccagca

SEQ ID NO: 3107712 - RNA, 19 nt, Mycobacterium bovis subsp bovis AF2122/97
ucaagauuaccgaagcccg

SEQ ID NO: 3107713 - RNA, 23 nt, Mycobacterium bovis subsp bovis AF2122/97
ucaagcaaguccaccggaucguc

SEQ ID NO: 3107714 - RNA, 19 nt, Mycobacterium bovis subsp bovis AF2122/97
ucaagccguguucgaccgc

SEQ ID NO: 3107715 - RNA, 12 nt, Mycobacterium bovis subsp bovis AF2122/97
ucaaggaagccg

SEQ ID NO: 3107716 - RNA, 15 nt, Mycobacterium bovis subsp bovis AF2122/97
ucaaggaagccgcgg

SEQ ID NO: 3107717 - RNA, 17 nt, Mycobacterium bovis subsp bovis AF2122/97
ucaaggaagccgcggcc

SEQ ID NO: 3107718 - RNA, 19 nt, Mycobacterium bovis subsp bovis AF2122/97
ucaaggagauccagggccu

SEQ ID NO: 3107719 - RNA, 18 nt, Mycobacterium bovis subsp bovis AF2122/97
ucaaggccaccucuucga

SEQ ID NO: 3107720 - RNA, 21 nt, Mycobacterium bovis subsp bovis AF2122/97
ucaaggccaccucuucgaucu

SEQ ID NO: 3107721 - RNA, 15 nt, Mycobacterium bovis subsp bovis AF2122/97
ucaaggugcgccgcc

SEQ ID NO: 3107722 - RNA, 15 nt, Mycobacterium bovis subsp bovis AF2122/97
ucaaggugucgacgg

SEQ ID NO: 3107723 - RNA, 20 nt, Mycobacterium bovis subsp bovis AF2122/97
ucaagguuucgacaucacuc

SEQ ID NO: 3107724 - RNA, 17 nt, Mycobacterium bovis subsp bovis AF2122/97
ucaagucccuucaucau

SEQ ID NO: 3107725 - RNA, 17 nt, Mycobacterium bovis subsp bovis AF2122/97
ucaagucucccggccgc

SEQ ID NO: 3107726 - RNA, 16 nt, Mycobacterium bovis subsp bovis AF2122/97
ucaagugccagcgugg

SEQ ID NO: 3107727 - RNA, 21 nt, Mycobacterium bovis subsp bovis AF2122/97
ucaaguggcaaccgcaccgca

SEQ ID NO: 3107728 - RNA, 14 nt, Mycobacterium bovis subsp bovis AF2122/97
ucaaguucgccgau

SEQ ID NO: 3107729 - RNA, 19 nt, Mycobacterium bovis subsp bovis AF2122/97
ucaaucccacgcccggccc

SEQ ID NO: 3107730 - RNA, 23 nt, Mycobacterium bovis subsp bovis AF2122/97
ucaaucccuccgccaaggaggcc

SEQ ID NO: 3107731 - RNA, 21 nt, Mycobacterium bovis subsp bovis AF2122/97
ucaaucucggucggaguaagc

SEQ ID NO: 3107732 - RNA, 18 nt, Mycobacterium bovis subsp bovis AF2122/97
ucaaugaacgcgcuuggu

SEQ ID NO: 3107733 - RNA, 20 nt, Mycobacterium bovis subsp bovis AF2122/97
ucaaugaacgcgcuuggugu

SEQ ID NO: 3107734 - RNA, 19 nt, Mycobacterium bovis subsp bovis AF2122/97
ucaaugcgcuggcgccgcc

SEQ ID NO: 3107735 - RNA, 17 nt, Mycobacterium bovis subsp bovis AF2122/97
ucaaugcggucaacgac

SEQ ID NO: 3107736 - RNA, 21 nt, Mycobacterium bovis subsp bovis AF2122/97
ucaaugcggucaacgacagcc

SEQ ID NO: 3107737 - RNA, 12 nt, Mycobacterium bovis subsp bovis AF2122/97
ucaaugcugcgu

SEQ ID NO: 3107738 - RNA, 14 nt, Mycobacterium bovis subsp bovis AF2122/97
ucaaugucgaagac

SEQ ID NO: 3107739 - RNA, 19 nt, Mycobacterium bovis subsp bovis AF2122/97
ucaauuccaugcaguuguc

SEQ ID NO: 3107740 - RNA, 12 nt, Mycobacterium bovis subsp bovis AF2122/97
ucacaaacccag

SEQ ID NO: 3107741 - RNA, 17 nt, Mycobacterium bovis subsp bovis AF2122/97
ucacaaacccagcaucg

SEQ ID NO: 3107742 - RNA, 21 nt, Mycobacterium bovis subsp bovis AF2122/97
ucacaagccccgcgcguucgg

SEQ ID NO: 3107743 - RNA, 20 nt, Mycobacterium bovis subsp bovis AF2122/97
ucacaagucgacacgccgaa

SEQ ID NO: 3107744 - RNA, 15 nt, Mycobacterium bovis subsp bovis AF2122/97
ucacaccacgguugg

SEQ ID NO: 3107745 - RNA, 23 nt, Mycobacterium bovis subsp bovis AF2122/97
ucacaccacgguuggccaccagc

SEQ ID NO: 3107746 - RNA, 11 nt, Mycobacterium bovis subsp bovis AF2122/97
ucacaccagcg

SEQ ID NO: 3107747 - RNA, 15 nt, Mycobacterium bovis subsp bovis AF2122/97
ucacacccacaccca

SEQ ID NO: 3107748 - RNA, 13 nt, Mycobacterium bovis subsp bovis AF2122/97
ucacacccaucac

SEQ ID NO: 3107749 - RNA, 17 nt, Mycobacterium bovis subsp bovis AF2122/97
ucacacccaucacccug

SEQ ID NO: 3107750 - RNA, 14 nt, Mycobacterium bovis subsp bovis AF2122/97
ucacacgccagccg

SEQ ID NO: 3107751 - RNA, 17 nt, Mycobacterium bovis subsp bovis AF2122/97
ucacacgguccgccacg

SEQ ID NO: 3107752 - RNA, 14 nt, Mycobacterium bovis subsp bovis AF2122/97
ucacacguccgcgc

SEQ ID NO: 3107753 - RNA, 16 nt, Mycobacterium bovis subsp bovis AF2122/97
ucacagcacagcgcag

SEQ ID NO: 3107754 - RNA, 22 nt, Mycobacterium bovis subsp bovis AF2122/97
ucacagccggguuuggugcagc

SEQ ID NO: 3107755 - RNA, 22 nt, Mycobacterium bovis subsp bovis AF2122/97
ucacagcugcgcacgucgggcc

SEQ ID NO: 3107756 - RNA, 19 nt, Mycobacterium bovis subsp bovis AF2122/97
ucacaggccgccugggggu

SEQ ID NO: 3107757 - RNA, 15 nt, Mycobacterium bovis subsp bovis AF2122/97
ucacaguucugccuu

SEQ ID NO: 3107758 - RNA, 15 nt, Mycobacterium bovis subsp bovis AF2122/97
ucacauacagcaggc

SEQ ID NO: 3107759 - RNA, 13 nt, Mycobacterium bovis subsp bovis AF2122/97
ucacaucggccuc

SEQ ID NO: 3107760 - RNA, 17 nt, Mycobacterium bovis subsp bovis AF2122/97
ucacaugcaagccgaca

SEQ ID NO: 3107761 - RNA, 20 nt, Mycobacterium bovis subsp bovis AF2122/97
ucacaugcaagccgacaucg

SEQ ID NO: 3107762 - RNA, 17 nt, Mycobacterium bovis subsp bovis AF2122/97
ucacaugcccgcaccgu

SEQ ID NO: 3107763 - RNA, 18 nt, Mycobacterium bovis subsp bovis AF2122/97
ucacaugcccgcaccguc

SEQ ID NO: 3107764 - RNA, 14 nt, Mycobacterium bovis subsp bovis AF2122/97
ucacaugcgccgaa

SEQ ID NO: 3107765 - RNA, 21 nt, Mycobacterium bovis subsp bovis AF2122/97
ucacaugcgccgaaacucaag

SEQ ID NO: 3107766 - RNA, 15 nt, Mycobacterium bovis subsp bovis AF2122/97
ucacauuggccaggu

SEQ ID NO: 3107767 - RNA, 21 nt, Mycobacterium bovis subsp bovis AF2122/97
ucaccaaaaacccggugacca

SEQ ID NO: 3107768 - RNA, 22 nt, Mycobacterium bovis subsp bovis AF2122/97
ucaccaaaaacccggugaccag

SEQ ID NO: 3107769 - RNA, 20 nt, Mycobacterium bovis subsp bovis AF2122/97
ucaccaacccguguggcacg

SEQ ID NO: 3107770 - RNA, 21 nt, Mycobacterium bovis subsp bovis AF2122/97
ucaccaagacaccggccugcg

SEQ ID NO: 3107771 - RNA, 16 nt, Mycobacterium bovis subsp bovis AF2122/97
ucaccacaucggugug

SEQ ID NO: 3107772 - RNA, 19 nt, Mycobacterium bovis subsp bovis AF2122/97
ucaccacccgaccgccauc

SEQ ID NO: 3107773 - RNA, 16 nt, Mycobacterium bovis subsp bovis AF2122/97
ucaccaccgccagcga

SEQ ID NO: 3107774 - RNA, 21 nt, Mycobacterium bovis subsp bovis AF2122/97
ucaccaccgccgccaccaccg

SEQ ID NO: 3107775 - RNA, 11 nt, Mycobacterium bovis subsp bovis AF2122/97
ucaccaccgga

SEQ ID NO: 3107776 - RNA, 13 nt, Mycobacterium bovis subsp bovis AF2122/97
ucaccaccggcag

SEQ ID NO: 3107777 - RNA, 14 nt, Mycobacterium bovis subsp bovis AF2122/97
ucaccaccguggcc

SEQ ID NO: 3107778 - RNA, 23 nt, Mycobacterium bovis subsp bovis AF2122/97
ucaccaccuggugcaaccgugcc

SEQ ID NO: 3107779 - RNA, 21 nt, Mycobacterium bovis subsp bovis AF2122/97
ucaccacgccggucgagguga

SEQ ID NO: 3107780 - RNA, 19 nt, Mycobacterium bovis subsp bovis AF2122/97
ucaccacgcggcggucguu

SEQ ID NO: 3107781 - RNA, 14 nt, Mycobacterium bovis subsp bovis AF2122/97
ucaccacggccgcc

SEQ ID NO: 3107782 - RNA, 16 nt, Mycobacterium bovis subsp bovis AF2122/97
ucaccacggcguugcc

SEQ ID NO: 3107783 - RNA, 19 nt, Mycobacterium bovis subsp bovis AF2122/97
ucaccacggcguugccgcc

SEQ ID NO: 3107784 - RNA, 22 nt, Mycobacterium bovis subsp bovis AF2122/97
ucaccacggcguugccgccggc

SEQ ID NO: 3107785 - RNA, 12 nt, Mycobacterium bovis subsp bovis AF2122/97
ucaccacgucgu

SEQ ID NO: 3107786 - RNA, 16 nt, Mycobacterium bovis subsp bovis AF2122/97
ucaccagaaauggcgc

SEQ ID NO: 3107787 - RNA, 17 nt, Mycobacterium bovis subsp bovis AF2122/97
ucaccagcgcaucggcc

SEQ ID NO: 3107788 - RNA, 12 nt, Mycobacterium bovis subsp bovis AF2122/97
ucaccagcggcu

SEQ ID NO: 3107789 - RNA, 13 nt, Mycobacterium bovis subsp bovis AF2122/97
ucaccagcgguca

SEQ ID NO: 3107790 - RNA, 20 nt, Mycobacterium bovis subsp bovis AF2122/97
ucaccaggcgagccggcgcg

SEQ ID NO: 3107791 - RNA, 19 nt, Mycobacterium bovis subsp bovis AF2122/97
ucaccaggguuggcaccgu

SEQ ID NO: 3107792 - RNA, 13 nt, Mycobacterium bovis subsp bovis AF2122/97
ucaccauccagcc

SEQ ID NO: 3107793 - RNA, 14 nt, Mycobacterium bovis subsp bovis AF2122/97
ucaccauccagccc

SEQ ID NO: 3107794 - RNA, 17 nt, Mycobacterium bovis subsp bovis AF2122/97
ucaccaucgccgccgcg

SEQ ID NO: 3107795 - RNA, 17 nt, Mycobacterium bovis subsp bovis AF2122/97
ucaccaucucgcaaggg

SEQ ID NO: 3107796 - RNA, 14 nt, Mycobacterium bovis subsp bovis AF2122/97
ucacccacccgcac

SEQ ID NO: 3107797 - RNA, 16 nt, Mycobacterium bovis subsp bovis AF2122/97
ucacccacccgcaccg

SEQ ID NO: 3107798 - RNA, 22 nt, Mycobacterium bovis subsp bovis AF2122/97
ucacccacccgcaccgcgguac

SEQ ID NO: 3107799 - RNA, 19 nt, Mycobacterium bovis subsp bovis AF2122/97
ucacccacucgacgucguc

SEQ ID NO: 3107800 - RNA, 18 nt, Mycobacterium bovis subsp bovis AF2122/97
ucacccagcucgcgcacc

SEQ ID NO: 3107801 - RNA, 19 nt, Mycobacterium bovis subsp bovis AF2122/97
ucacccccuucacccuccc

SEQ ID NO: 3107802 - RNA, 13 nt, Mycobacterium bovis subsp bovis AF2122/97
ucaccccggccgg

SEQ ID NO: 3107803 - RNA, 21 nt, Mycobacterium bovis subsp bovis AF2122/97
ucaccccggcucggccaccga

SEQ ID NO: 3107804 - RNA, 22 nt, Mycobacterium bovis subsp bovis AF2122/97
ucaccccggucccgccgaccga

SEQ ID NO: 3107805 - RNA, 17 nt, Mycobacterium bovis subsp bovis AF2122/97
ucaccccggucggcccg

SEQ ID NO: 3107806 - RNA, 20 nt, Mycobacterium bovis subsp bovis AF2122/97
ucaccccggucggcccgcgc

SEQ ID NO: 3107807 - RNA, 12 nt, Mycobacterium bovis subsp bovis AF2122/97
ucaccccggugg

SEQ ID NO: 3107808 - RNA, 13 nt, Mycobacterium bovis subsp bovis AF2122/97
ucaccccuucgcc

SEQ ID NO: 3107809 - RNA, 14 nt, Mycobacterium bovis subsp bovis AF2122/97
ucaccccuucgcca

SEQ ID NO: 3107810 - RNA, 13 nt, Mycobacterium bovis subsp bovis AF2122/97
ucacccgagccau

SEQ ID NO: 3107811 - RNA, 19 nt, Mycobacterium bovis subsp bovis AF2122/97
ucacccgcaacgacugauc

SEQ ID NO: 3107812 - RNA, 15 nt, Mycobacterium bovis subsp bovis AF2122/97
ucacccgcacguaga

SEQ ID NO: 3107813 - RNA, 16 nt, Mycobacterium bovis subsp bovis AF2122/97
ucacccgcaggucgau

SEQ ID NO: 3107814 - RNA, 14 nt, Mycobacterium bovis subsp bovis AF2122/97
ucacccgcccggaa

SEQ ID NO: 3107815 - RNA, 23 nt, Mycobacterium bovis subsp bovis AF2122/97
ucacccgcucacgcucacccggc

SEQ ID NO: 3107816 - RNA, 18 nt, Mycobacterium bovis subsp bovis AF2122/97
ucacccgggaugaccacc

SEQ ID NO: 3107817 - RNA, 22 nt, Mycobacterium bovis subsp bovis AF2122/97
ucacccguagguaguuguccag

SEQ ID NO: 3107818 - RNA, 19 nt, Mycobacterium bovis subsp bovis AF2122/97
ucacccugccagagaucag

SEQ ID NO: 3107819 - RNA, 17 nt, Mycobacterium bovis subsp bovis AF2122/97
ucacccugucgcgcacc

SEQ ID NO: 3107820 - RNA, 19 nt, Mycobacterium bovis subsp bovis AF2122/97
ucacccugucgcgcaccgg

SEQ ID NO: 3107821 - RNA, 18 nt, Mycobacterium bovis subsp bovis AF2122/97
ucaccgaacgacccuggc

SEQ ID NO: 3107822 - RNA, 19 nt, Mycobacterium bovis subsp bovis AF2122/97
ucaccgaacgacccuggcc

SEQ ID NO: 3107823 - RNA, 15 nt, Mycobacterium bovis subsp bovis AF2122/97
ucaccgaacggcgag

SEQ ID NO: 3107824 - RNA, 24 nt, Mycobacterium bovis subsp bovis AF2122/97
ucaccgaagaacaguugcccgacg

SEQ ID NO: 3107825 - RNA, 18 nt, Mycobacterium bovis subsp bovis AF2122/97
ucaccgaauaccgccgcg

SEQ ID NO: 3107826 - RNA, 12 nt, Mycobacterium bovis subsp bovis AF2122/97
ucaccgacaccg

SEQ ID NO: 3107827 - RNA, 16 nt, Mycobacterium bovis subsp bovis AF2122/97
ucaccgacaugacgcg

SEQ ID NO: 3107828 - RNA, 13 nt, Mycobacterium bovis subsp bovis AF2122/97
ucaccgaccaacg

SEQ ID NO: 3107829 - RNA, 17 nt, Mycobacterium bovis subsp bovis AF2122/97
ucaccgacggaugauca

SEQ ID NO: 3107830 - RNA, 16 nt, Mycobacterium bovis subsp bovis AF2122/97
ucaccgacgucgccaa

SEQ ID NO: 3107831 - RNA, 15 nt, Mycobacterium bovis subsp bovis AF2122/97
ucaccgagauggcga

SEQ ID NO: 3107832 - RNA, 18 nt, Mycobacterium bovis subsp bovis AF2122/97
ucaccgaggugccgcgca

SEQ ID NO: 3107833 - RNA, 19 nt, Mycobacterium bovis subsp bovis AF2122/97
ucaccgaucucgaccagcg

SEQ ID NO: 3107834 - RNA, 22 nt, Mycobacterium bovis subsp bovis AF2122/97
ucaccgaucucgaccagcgccg

SEQ ID NO: 3107835 - RNA, 18 nt, Mycobacterium bovis subsp bovis AF2122/97
ucaccgauucggccagcg

SEQ ID NO: 3107836 - RNA, 19 nt, Mycobacterium bovis subsp bovis AF2122/97
ucaccgauucggccagcgc

SEQ ID NO: 3107837 - RNA, 13 nt, Mycobacterium bovis subsp bovis AF2122/97
ucaccgccaccac

SEQ ID NO: 3107838 - RNA, 17 nt, Mycobacterium bovis subsp bovis AF2122/97
ucaccgccaccaccagg

SEQ ID NO: 3107839 - RNA, 19 nt, Mycobacterium bovis subsp bovis AF2122/97
ucaccgccaccaccagggc

SEQ ID NO: 3107840 - RNA, 14 nt, Mycobacterium bovis subsp bovis AF2122/97
ucaccgccagcccc

SEQ ID NO: 3107841 - RNA, 15 nt, Mycobacterium bovis subsp bovis AF2122/97
ucaccgcccuugccg

SEQ ID NO: 3107842 - RNA, 13 nt, Mycobacterium bovis subsp bovis AF2122/97
ucaccgccgcgac

SEQ ID NO: 3107843 - RNA, 16 nt, Mycobacterium bovis subsp bovis AF2122/97
ucaccgccgcgaccgc

SEQ ID NO: 3107844 - RNA, 18 nt, Mycobacterium bovis subsp bovis AF2122/97
ucaccgccgcgaccgccu

SEQ ID NO: 3107845 - RNA, 17 nt, Mycobacterium bovis subsp bovis AF2122/97
ucaccgccgcggccgcc

SEQ ID NO: 3107846 - RNA, 19 nt, Mycobacterium bovis subsp bovis AF2122/97
ucaccgccgcuaccgcccg

SEQ ID NO: 3107847 - RNA, 17 nt, Mycobacterium bovis subsp bovis AF2122/97
ucaccgccggcggcggg

SEQ ID NO: 3107848 - RNA, 16 nt, Mycobacterium bovis subsp bovis AF2122/97
ucaccgccgggaagcc

SEQ ID NO: 3107849 - RNA, 12 nt, Mycobacterium bovis subsp bovis AF2122/97
ucaccgccgggg

SEQ ID NO: 3107850 - RNA, 18 nt, Mycobacterium bovis subsp bovis AF2122/97
ucaccgccggugcugacg

SEQ ID NO: 3107851 - RNA, 19 nt, Mycobacterium bovis subsp bovis AF2122/97
ucaccgccggugcugacga

SEQ ID NO: 3107852 - RNA, 20 nt, Mycobacterium bovis subsp bovis AF2122/97
ucaccgccguuaccgccguu

SEQ ID NO: 3107853 - RNA, 17 nt, Mycobacterium bovis subsp bovis AF2122/97
ucaccgccguugccgcc

SEQ ID NO: 3107854 - RNA, 18 nt, Mycobacterium bovis subsp bovis AF2122/97
ucaccgccguugccgccg

SEQ ID NO: 3107855 - RNA, 21 nt, Mycobacterium bovis subsp bovis AF2122/97
ucaccgccguugccgccggcg

SEQ ID NO: 3107856 - RNA, 18 nt, Mycobacterium bovis subsp bovis AF2122/97
ucaccgccugugccgccg

SEQ ID NO: 3107857 - RNA, 17 nt, Mycobacterium bovis subsp bovis AF2122/97
ucaccgccuuugccgcc

SEQ ID NO: 3107858 - RNA, 21 nt, Mycobacterium bovis subsp bovis AF2122/97
ucaccgccuuugccgccggca

SEQ ID NO: 3107859 - RNA, 19 nt, Mycobacterium bovis subsp bovis AF2122/97
ucaccgcgaaacccaugac

SEQ ID NO: 3107860 - RNA, 13 nt, Mycobacterium bovis subsp bovis AF2122/97
ucaccgcgacccc

SEQ ID NO: 3107861 - RNA, 18 nt, Mycobacterium bovis subsp bovis AF2122/97
ucaccgcgauuagcaaac

SEQ ID NO: 3107862 - RNA, 20 nt, Mycobacterium bovis subsp bovis AF2122/97
ucaccgcgauuagcaaaccg

SEQ ID NO: 3107863 - RNA, 14 nt, Mycobacterium bovis subsp bovis AF2122/97
ucaccgcgcagcga

SEQ ID NO: 3107864 - RNA, 22 nt, Mycobacterium bovis subsp bovis AF2122/97
ucaccgcgccagccuccaccag

SEQ ID NO: 3107865 - RNA, 16 nt, Mycobacterium bovis subsp bovis AF2122/97
ucaccgcgcccgccgc

SEQ ID NO: 3107866 - RNA, 19 nt, Mycobacterium bovis subsp bovis AF2122/97
ucaccgcgcgcucgcccag

SEQ ID NO: 3107867 - RNA, 14 nt, Mycobacterium bovis subsp bovis AF2122/97
ucaccgcgcugaac

SEQ ID NO: 3107868 - RNA, 20 nt, Mycobacterium bovis subsp bovis AF2122/97
ucaccgcggaucgacuucga

SEQ ID NO: 3107869 - RNA, 21 nt, Mycobacterium bovis subsp bovis AF2122/97
ucaccgcgggcauaggcgcug

SEQ ID NO: 3107870 - RNA, 19 nt, Mycobacterium bovis subsp bovis AF2122/97
ucaccgcguagaccccaau

SEQ ID NO: 3107871 - RNA, 20 nt, Mycobacterium bovis subsp bovis AF2122/97
ucaccgcguaguccaggccg

SEQ ID NO: 3107872 - RNA, 22 nt, Mycobacterium bovis subsp bovis AF2122/97
ucaccgcguugaugaccagguc

SEQ ID NO: 3107873 - RNA, 16 nt, Mycobacterium bovis subsp bovis AF2122/97
ucaccggaacccccag

SEQ ID NO: 3107874 - RNA, 16 nt, Mycobacterium bovis subsp bovis AF2122/97
ucaccggaggccgccg

SEQ ID NO: 3107875 - RNA, 11 nt, Mycobacterium bovis subsp bovis AF2122/97
ucaccggcaau

SEQ ID NO: 3107876 - RNA, 14 nt, Mycobacterium bovis subsp bovis AF2122/97
ucaccggcauacag

SEQ ID NO: 3107877 - RNA, 17 nt, Mycobacterium bovis subsp bovis AF2122/97
ucaccggcaucccggaa

SEQ ID NO: 3107878 - RNA, 16 nt, Mycobacterium bovis subsp bovis AF2122/97
ucaccggcaugcccgc

SEQ ID NO: 3107879 - RNA, 22 nt, Mycobacterium bovis subsp bovis AF2122/97
ucaccggcaugcgugccggcag

SEQ ID NO: 3107880 - RNA, 17 nt, Mycobacterium bovis subsp bovis AF2122/97
ucaccggcgcccagcgc

SEQ ID NO: 3107881 - RNA, 14 nt, Mycobacterium bovis subsp bovis AF2122/97
ucaccggcgcgguu

SEQ ID NO: 3107882 - RNA, 14 nt, Mycobacterium bovis subsp bovis AF2122/97
ucaccggcuggugc

SEQ ID NO: 3107883 - RNA, 14 nt, Mycobacterium bovis subsp bovis AF2122/97
ucaccgggcccgac

SEQ ID NO: 3107884 - RNA, 19 nt, Mycobacterium bovis subsp bovis AF2122/97
ucaccgguacugcgaugug

SEQ ID NO: 3107885 - RNA, 17 nt, Mycobacterium bovis subsp bovis AF2122/97
ucaccggucaccgcgca

SEQ ID NO: 3107886 - RNA, 15 nt, Mycobacterium bovis subsp bovis AF2122/97
ucaccggucggccau

SEQ ID NO: 3107887 - RNA, 14 nt, Mycobacterium bovis subsp bovis AF2122/97
ucaccgguucggug

SEQ ID NO: 3107888 - RNA, 15 nt, Mycobacterium bovis subsp bovis AF2122/97
ucaccgguucgguga

SEQ ID NO: 3107889 - RNA, 17 nt, Mycobacterium bovis subsp bovis AF2122/97
ucaccguaauuucuuca

SEQ ID NO: 3107890 - RNA, 24 nt, Mycobacterium bovis subsp bovis AF2122/97
ucaccguaauuucuucacggucga

SEQ ID NO: 3107891 - RNA, 23 nt, Mycobacterium bovis subsp bovis AF2122/97
ucaccgucauugccaccaagucc

SEQ ID NO: 3107892 - RNA, 14 nt, Mycobacterium bovis subsp bovis AF2122/97
ucaccguccacgac

SEQ ID NO: 3107893 - RNA, 21 nt, Mycobacterium bovis subsp bovis AF2122/97
ucaccgucgagguacacgccg

SEQ ID NO: 3107894 - RNA, 20 nt, Mycobacterium bovis subsp bovis AF2122/97
ucaccgucguacucggcggc

SEQ ID NO: 3107895 - RNA, 21 nt, Mycobacterium bovis subsp bovis AF2122/97
ucaccgucguacucggcggcc

SEQ ID NO: 3107896 - RNA, 15 nt, Mycobacterium bovis subsp bovis AF2122/97
ucaccgucugcaccg

SEQ ID NO: 3107897 - RNA, 19 nt, Mycobacterium bovis subsp bovis AF2122/97
ucaccgucugcaccggcag

SEQ ID NO: 3107898 - RNA, 22 nt, Mycobacterium bovis subsp bovis AF2122/97
ucaccgucugcggaccggcgcg

SEQ ID NO: 3107899 - RNA, 20 nt, Mycobacterium bovis subsp bovis AF2122/97
ucaccgucuugcacguccaa

SEQ ID NO: 3107900 - RNA, 19 nt, Mycobacterium bovis subsp bovis AF2122/97
ucaccgugaaccgcccgcc

SEQ ID NO: 3107901 - RNA, 20 nt, Mycobacterium bovis subsp bovis AF2122/97
ucaccgugaaccgcccgccc

SEQ ID NO: 3107902 - RNA, 17 nt, Mycobacterium bovis subsp bovis AF2122/97
ucaccgugggccugccc

SEQ ID NO: 3107903 - RNA, 18 nt, Mycobacterium bovis subsp bovis AF2122/97
ucaccguguugcacgcgg

SEQ ID NO: 3107904 - RNA, 23 nt, Mycobacterium bovis subsp bovis AF2122/97
ucaccguguugcacgcgggugcc

SEQ ID NO: 3107905 - RNA, 15 nt, Mycobacterium bovis subsp bovis AF2122/97
ucaccguuggccgcg

SEQ ID NO: 3107906 - RNA, 14 nt, Mycobacterium bovis subsp bovis AF2122/97
ucaccucgaugcgg

SEQ ID NO: 3107907 - RNA, 18 nt, Mycobacterium bovis subsp bovis AF2122/97
ucaccucgcacgacaccu

SEQ ID NO: 3107908 - RNA, 13 nt, Mycobacterium bovis subsp bovis AF2122/97
ucaccucgccaca

SEQ ID NO: 3107909 - RNA, 14 nt, Mycobacterium bovis subsp bovis AF2122/97
ucaccucggcgacg

SEQ ID NO: 3107910 - RNA, 19 nt, Mycobacterium bovis subsp bovis AF2122/97
ucaccucggugccggccgc

SEQ ID NO: 3107911 - RNA, 20 nt, Mycobacterium bovis subsp bovis AF2122/97
ucaccucggugccggccgca

SEQ ID NO: 3107912 - RNA, 19 nt, Mycobacterium bovis subsp bovis AF2122/97
ucaccucgucgacaaacca

SEQ ID NO: 3107913 - RNA, 21 nt, Mycobacterium bovis subsp bovis AF2122/97
ucaccugcaucgucgccaagc

SEQ ID NO: 3107914 - RNA, 20 nt, Mycobacterium bovis subsp bovis AF2122/97
ucaccugccagugggccgac

SEQ ID NO: 3107915 - RNA, 21 nt, Mycobacterium bovis subsp bovis AF2122/97
ucaccugccagugggccgacg

SEQ ID NO: 3107916 - RNA, 23 nt, Mycobacterium bovis subsp bovis AF2122/97
ucaccugccagugggccgacgug

SEQ ID NO: 3107917 - RNA, 20 nt, Mycobacterium bovis subsp bovis AF2122/97
ucaccugcgggugcgucgau

SEQ ID NO: 3107918 - RNA, 20 nt, Mycobacterium bovis subsp bovis AF2122/97
ucaccuggcgugucgccgcc

SEQ ID NO: 3107919 - RNA, 17 nt, Mycobacterium bovis subsp bovis AF2122/97
ucaccuucggccgaccg

SEQ ID NO: 3107920 - RNA, 21 nt, Mycobacterium bovis subsp bovis AF2122/97
ucaccuucggccgaccgggcu

SEQ ID NO: 3107921 - RNA, 18 nt, Mycobacterium bovis subsp bovis AF2122/97
ucaccuucuuggcgggug

SEQ ID NO: 3107922 - RNA, 20 nt, Mycobacterium bovis subsp bovis AF2122/97
ucaccuugccuagccgcagc

SEQ ID NO: 3107923 - RNA, 20 nt, Mycobacterium bovis subsp bovis AF2122/97
ucaccuugucaaaggugcac

SEQ ID NO: 3107924 - RNA, 15 nt, Mycobacterium bovis subsp bovis AF2122/97
ucacgaagaccgcgu

SEQ ID NO: 3107925 - RNA, 20 nt, Mycobacterium bovis subsp bovis AF2122/97
ucacgaagaccgcgucggcg

SEQ ID NO: 3107926 - RNA, 21 nt, Mycobacterium bovis subsp bovis AF2122/97
ucacgacccaagucgccgagg

SEQ ID NO: 3107927 - RNA, 22 nt, Mycobacterium bovis subsp bovis AF2122/97
ucacgaccgcgcaacaccucgu

SEQ ID NO: 3107928 - RNA, 22 nt, Mycobacterium bovis subsp bovis AF2122/97
ucacgaccugcucauccaccuc

SEQ ID NO: 3107929 - RNA, 14 nt, Mycobacterium bovis subsp bovis AF2122/97
ucacgacgccgaau

SEQ ID NO: 3107930 - RNA, 16 nt, Mycobacterium bovis subsp bovis AF2122/97
ucacgacgccgagcag

SEQ ID NO: 3107931 - RNA, 21 nt, Mycobacterium bovis subsp bovis AF2122/97
ucacgacgccgagcagauacu

SEQ ID NO: 3107932 - RNA, 23 nt, Mycobacterium bovis subsp bovis AF2122/97
ucacgagccaaggcuuccuccga

SEQ ID NO: 3107933 - RNA, 17 nt, Mycobacterium bovis subsp bovis AF2122/97
ucacgaugcgguucucg

SEQ ID NO: 3107934 - RNA, 15 nt, Mycobacterium bovis subsp bovis AF2122/97
ucacgaugcucgccg

SEQ ID NO: 3107935 - RNA, 13 nt, Mycobacterium bovis subsp bovis AF2122/97
ucacgcaaccggc

SEQ ID NO: 3107936 - RNA, 12 nt, Mycobacterium bovis subsp bovis AF2122/97
ucacgcaccaca

SEQ ID NO: 3107937 - RNA, 13 nt, Mycobacterium bovis subsp bovis AF2122/97
ucacgcacccggc

SEQ ID NO: 3107938 - RNA, 15 nt, Mycobacterium bovis subsp bovis AF2122/97
ucacgcacccggcgc

SEQ ID NO: 3107939 - RNA, 16 nt, Mycobacterium bovis subsp bovis AF2122/97
ucacgcacccggcgca

SEQ ID NO: 3107940 - RNA, 15 nt, Mycobacterium bovis subsp bovis AF2122/97
ucacgcaccggcgca

SEQ ID NO: 3107941 - RNA, 12 nt, Mycobacterium bovis subsp bovis AF2122/97
ucacgcacugau

SEQ ID NO: 3107942 - RNA, 21 nt, Mycobacterium bovis subsp bovis AF2122/97
ucacgcagcacccugcgggcc

SEQ ID NO: 3107943 - RNA, 13 nt, Mycobacterium bovis subsp bovis AF2122/97
ucacgccaccgca

SEQ ID NO: 3107944 - RNA, 21 nt, Mycobacterium bovis subsp bovis AF2122/97
ucacgccaccgcaacucgccg

SEQ ID NO: 3107945 - RNA, 23 nt, Mycobacterium bovis subsp bovis AF2122/97
ucacgccaccgcaacucgccgaa

SEQ ID NO: 3107946 - RNA, 20 nt, Mycobacterium bovis subsp bovis AF2122/97
ucacgccagucccacugggc

SEQ ID NO: 3107947 - RNA, 21 nt, Mycobacterium bovis subsp bovis AF2122/97
ucacgccagucccacugggcc

SEQ ID NO: 3107948 - RNA, 20 nt, Mycobacterium bovis subsp bovis AF2122/97
ucacgccgccccugcgcggc

SEQ ID NO: 3107949 - RNA, 14 nt, Mycobacterium bovis subsp bovis AF2122/97
ucacgccgccggag

SEQ ID NO: 3107950 - RNA, 14 nt, Mycobacterium bovis subsp bovis AF2122/97
ucacgccgccggcg

SEQ ID NO: 3107951 - RNA, 17 nt, Mycobacterium bovis subsp bovis AF2122/97
ucacgccgccggcgaag

SEQ ID NO: 3107952 - RNA, 19 nt, Mycobacterium bovis subsp bovis AF2122/97
ucacgccggccucgccgaa

SEQ ID NO: 3107953 - RNA, 17 nt, Mycobacterium bovis subsp bovis AF2122/97
ucacgccguccggugug

SEQ ID NO: 3107954 - RNA, 17 nt, Mycobacterium bovis subsp bovis AF2122/97
ucacgcgaaugacgauc

SEQ ID NO: 3107955 - RNA, 18 nt, Mycobacterium bovis subsp bovis AF2122/97
ucacgcgaaugacgaucc

SEQ ID NO: 3107956 - RNA, 13 nt, Mycobacterium bovis subsp bovis AF2122/97
ucacgcgaccacc

SEQ ID NO: 3107957 - RNA, 16 nt, Mycobacterium bovis subsp bovis AF2122/97
ucacgcgaccaccgcc

SEQ ID NO: 3107958 - RNA, 13 nt, Mycobacterium bovis subsp bovis AF2122/97
ucacgcgcggauc

SEQ ID NO: 3107959 - RNA, 18 nt, Mycobacterium bovis subsp bovis AF2122/97
ucacgcggaaaccaucgc

SEQ ID NO: 3107960 - RNA, 22 nt, Mycobacterium bovis subsp bovis AF2122/97
ucacgcguacgucgguccaccc

SEQ ID NO: 3107961 - RNA, 17 nt, Mycobacterium bovis subsp bovis AF2122/97
ucacgcucacccggcgu

SEQ ID NO: 3107962 - RNA, 14 nt, Mycobacterium bovis subsp bovis AF2122/97
ucacgcucgacgac

SEQ ID NO: 3107963 - RNA, 21 nt, Mycobacterium bovis subsp bovis AF2122/97
ucacgcucggcguccgcccag

SEQ ID NO: 3107964 - RNA, 19 nt, Mycobacterium bovis subsp bovis AF2122/97
ucacgcugaagccgcugga

SEQ ID NO: 3107965 - RNA, 17 nt, Mycobacterium bovis subsp bovis AF2122/97
ucacgcugccccgccgc

SEQ ID NO: 3107966 - RNA, 13 nt, Mycobacterium bovis subsp bovis AF2122/97
ucacggaccaggc

SEQ ID NO: 3107967 - RNA, 14 nt, Mycobacterium bovis subsp bovis AF2122/97
ucacggaccgccac

SEQ ID NO: 3107968 - RNA, 18 nt, Mycobacterium bovis subsp bovis AF2122/97
ucacggagguccggugga

SEQ ID NO: 3107969 - RNA, 17 nt, Mycobacterium bovis subsp bovis AF2122/97
ucacggcaggcggugaa

SEQ ID NO: 3107970 - RNA, 21 nt, Mycobacterium bovis subsp bovis AF2122/97
ucacggccgcauaaaacucgc

SEQ ID NO: 3107971 - RNA, 22 nt, Mycobacterium bovis subsp bovis AF2122/97
ucacggccgucgauugcagguc

SEQ ID NO: 3107972 - RNA, 21 nt, Mycobacterium bovis subsp bovis AF2122/97
ucacgggcuaccggcagcugc

SEQ ID NO: 3107973 - RNA, 18 nt, Mycobacterium bovis subsp bovis AF2122/97
ucacgggcuccaacaggu

SEQ ID NO: 3107974 - RNA, 19 nt, Mycobacterium bovis subsp bovis AF2122/97
ucacggucaucucgguggu

SEQ ID NO: 3107975 - RNA, 13 nt, Mycobacterium bovis subsp bovis AF2122/97
ucacggucgacga

SEQ ID NO: 3107976 - RNA, 17 nt, Mycobacterium bovis subsp bovis AF2122/97
ucacgguggccgcaucg

SEQ ID NO: 3107977 - RNA, 22 nt, Mycobacterium bovis subsp bovis AF2122/97
ucacgguggugucagccaccgg

SEQ ID NO: 3107978 - RNA, 19 nt, Mycobacterium bovis subsp bovis AF2122/97
ucacgguucgcccgucgcc

SEQ ID NO: 3107979 - RNA, 14 nt, Mycobacterium bovis subsp bovis AF2122/97
ucacgguugccgcg

SEQ ID NO: 3107980 - RNA, 16 nt, Mycobacterium bovis subsp bovis AF2122/97
ucacgguugccgcgau

SEQ ID NO: 3107981 - RNA, 14 nt, Mycobacterium bovis subsp bovis AF2122/97
ucacguacgccgcc

SEQ ID NO: 3107982 - RNA, 17 nt, Mycobacterium bovis subsp bovis AF2122/97
ucacguagcgaccgcgg

SEQ ID NO: 3107983 - RNA, 22 nt, Mycobacterium bovis subsp bovis AF2122/97
ucacguagcgaccgcggucgcu

SEQ ID NO: 3107984 - RNA, 15 nt, Mycobacterium bovis subsp bovis AF2122/97
ucacguagcgagccc

SEQ ID NO: 3107985 - RNA, 17 nt, Mycobacterium bovis subsp bovis AF2122/97
ucacguagcgagcccac

SEQ ID NO: 3107986 - RNA, 21 nt, Mycobacterium bovis subsp bovis AF2122/97
ucacguagcgagcccacgugg

SEQ ID NO: 3107987 - RNA, 17 nt, Mycobacterium bovis subsp bovis AF2122/97
ucacgucgacggcggcc

SEQ ID NO: 3107988 - RNA, 17 nt, Mycobacterium bovis subsp bovis AF2122/97
ucacgucuaacacgcgg

SEQ ID NO: 3107989 - RNA, 17 nt, Mycobacterium bovis subsp bovis AF2122/97
ucacgugcccgcgcggc

SEQ ID NO: 3107990 - RNA, 15 nt, Mycobacterium bovis subsp bovis AF2122/97
ucacgugcugccgau

SEQ ID NO: 3107991 - RNA, 19 nt, Mycobacterium bovis subsp bovis AF2122/97
ucacgugguccaaccgggc

SEQ ID NO: 3107992 - RNA, 21 nt, Mycobacterium bovis subsp bovis AF2122/97
ucacgugguccaagacagccu

SEQ ID NO: 3107993 - RNA, 21 nt, Mycobacterium bovis subsp bovis AF2122/97
ucacguggucggcaugacgaa

SEQ ID NO: 3107994 - RNA, 20 nt, Mycobacterium bovis subsp bovis AF2122/97
ucacguucaguuccgcggcg

SEQ ID NO: 3107995 - RNA, 15 nt, Mycobacterium bovis subsp bovis AF2122/97
ucacguucggcgacg

SEQ ID NO: 3107996 - RNA, 19 nt, Mycobacterium bovis subsp bovis AF2122/97
ucacguucggcgacgcgcc

SEQ ID NO: 3107997 - RNA, 14 nt, Mycobacterium bovis subsp bovis AF2122/97
ucacuacuccgguc

SEQ ID NO: 3107998 - RNA, 14 nt, Mycobacterium bovis subsp bovis AF2122/97
ucacucaccccaac

SEQ ID NO: 3107999 - RNA, 17 nt, Mycobacterium bovis subsp bovis AF2122/97
ucacucacgacgccguu

SEQ ID NO: 3108000 - RNA, 17 nt, Mycobacterium bovis subsp bovis AF2122/97
ucacucccccacacacc

SEQ ID NO: 3108001 - RNA, 19 nt, Mycobacterium bovis subsp bovis AF2122/97
ucacucggauagccccgug

SEQ ID NO: 3108002 - RNA, 21 nt, Mycobacterium bovis subsp bovis AF2122/97
ucacucguugaccggccggac

SEQ ID NO: 3108003 - RNA, 11 nt, Mycobacterium bovis subsp bovis AF2122/97
ucacugagauc

SEQ ID NO: 3108004 - RNA, 13 nt, Mycobacterium bovis subsp bovis AF2122/97
ucacugcagcgcc

SEQ ID NO: 3108005 - RNA, 14 nt, Mycobacterium bovis subsp bovis AF2122/97
ucacugcgaccguc

SEQ ID NO: 3108006 - RNA, 22 nt, Mycobacterium bovis subsp bovis AF2122/97
ucacugcgaccgucccggccuc

SEQ ID NO: 3108007 - RNA, 15 nt, Mycobacterium bovis subsp bovis AF2122/97
ucacuggugacccug

SEQ ID NO: 3108008 - RNA, 18 nt, Mycobacterium bovis subsp bovis AF2122/97
ucacugugccgcugcauc

SEQ ID NO: 3108009 - RNA, 23 nt, Mycobacterium bovis subsp bovis AF2122/97
ucacuucgcguuucacgaaaccc

SEQ ID NO: 3108010 - RNA, 18 nt, Mycobacterium bovis subsp bovis AF2122/97
ucagaacaccggccaggc

SEQ ID NO: 3108011 - RNA, 14 nt, Mycobacterium bovis subsp bovis AF2122/97
ucagaacggcggca

SEQ ID NO: 3108012 - RNA, 22 nt, Mycobacterium bovis subsp bovis AF2122/97
ucagaacuuguuugucaccgca

SEQ ID NO: 3108013 - RNA, 15 nt, Mycobacterium bovis subsp bovis AF2122/97
ucagaaucaggcucg

SEQ ID NO: 3108014 - RNA, 15 nt, Mycobacterium bovis subsp bovis AF2122/97
ucagaaugugucgac

SEQ ID NO: 3108015 - RNA, 23 nt, Mycobacterium bovis subsp bovis AF2122/97
ucagaauugugugcagcagcauc

SEQ ID NO: 3108016 - RNA, 11 nt, Mycobacterium bovis subsp bovis AF2122/97
ucagacaacaa

SEQ ID NO: 3108017 - RNA, 23 nt, Mycobacterium bovis subsp bovis AF2122/97
ucagacgacgaucgcgucgggcu

SEQ ID NO: 3108018 - RNA, 13 nt, Mycobacterium bovis subsp bovis AF2122/97
ucagacgauucgg

SEQ ID NO: 3108019 - RNA, 16 nt, Mycobacterium bovis subsp bovis AF2122/97
ucagacgauucggcgg

SEQ ID NO: 3108020 - RNA, 17 nt, Mycobacterium bovis subsp bovis AF2122/97
ucagacgauucggcggc

SEQ ID NO: 3108021 - RNA, 23 nt, Mycobacterium bovis subsp bovis AF2122/97
ucagacgccggcccaguucugca

SEQ ID NO: 3108022 - RNA, 22 nt, Mycobacterium bovis subsp bovis AF2122/97
ucagacggugaagccgagcgcc

SEQ ID NO: 3108023 - RNA, 15 nt, Mycobacterium bovis subsp bovis AF2122/97
ucagagacagcagcg

SEQ ID NO: 3108024 - RNA, 21 nt, Mycobacterium bovis subsp bovis AF2122/97
ucagagcgcugguuggccugc

SEQ ID NO: 3108025 - RNA, 22 nt, Mycobacterium bovis subsp bovis AF2122/97
ucagagcgcugguuggccugcc

SEQ ID NO: 3108026 - RNA, 13 nt, Mycobacterium bovis subsp bovis AF2122/97
ucagagggccgcg

SEQ ID NO: 3108027 - RNA, 12 nt, Mycobacterium bovis subsp bovis AF2122/97
ucagauccggcc

SEQ ID NO: 3108028 - RNA, 12 nt, Mycobacterium bovis subsp bovis AF2122/97
ucagauccucga

SEQ ID NO: 3108029 - RNA, 20 nt, Mycobacterium bovis subsp bovis AF2122/97
ucagaucgucacucccgaca

SEQ ID NO: 3108030 - RNA, 19 nt, Mycobacterium bovis subsp bovis AF2122/97
ucagcaacucggccacggc

SEQ ID NO: 3108031 - RNA, 15 nt, Mycobacterium bovis subsp bovis AF2122/97
ucagcacaaacccag

SEQ ID NO: 3108032 - RNA, 15 nt, Mycobacterium bovis subsp bovis AF2122/97
ucagcaccaccagca

SEQ ID NO: 3108033 - RNA, 20 nt, Mycobacterium bovis subsp bovis AF2122/97
ucagcacccaacccggcggc

SEQ ID NO: 3108034 - RNA, 21 nt, Mycobacterium bovis subsp bovis AF2122/97
ucagcacccaacccggcggca

SEQ ID NO: 3108035 - RNA, 20 nt, Mycobacterium bovis subsp bovis AF2122/97
ucagcacccaagaauucacc

SEQ ID NO: 3108036 - RNA, 18 nt, Mycobacterium bovis subsp bovis AF2122/97
ucagcacccaauacaccc

SEQ ID NO: 3108037 - RNA, 16 nt, Mycobacterium bovis subsp bovis AF2122/97
ucagcacccaccgaag

SEQ ID NO: 3108038 - RNA, 21 nt, Mycobacterium bovis subsp bovis AF2122/97
ucagcaccccauggccaccga

SEQ ID NO: 3108039 - RNA, 19 nt, Mycobacterium bovis subsp bovis AF2122/97
ucagcaccggaucgaccaa

SEQ ID NO: 3108040 - RNA, 13 nt, Mycobacterium bovis subsp bovis AF2122/97
ucagcaccggcgc

SEQ ID NO: 3108041 - RNA, 16 nt, Mycobacterium bovis subsp bovis AF2122/97
ucagcaccuccaccgc

SEQ ID NO: 3108042 - RNA, 22 nt, Mycobacterium bovis subsp bovis AF2122/97
ucagcaccuccaccgcgccggc

SEQ ID NO: 3108043 - RNA, 21 nt, Mycobacterium bovis subsp bovis AF2122/97
ucagcacggugaucagcagca

SEQ ID NO: 3108044 - RNA, 17 nt, Mycobacterium bovis subsp bovis AF2122/97
ucagcacggugggcgcu

SEQ ID NO: 3108045 - RNA, 12 nt, Mycobacterium bovis subsp bovis AF2122/97
ucagcacgucgc

SEQ ID NO: 3108046 - RNA, 20 nt, Mycobacterium bovis subsp bovis AF2122/97
ucagcagaauccugcgcugc

SEQ ID NO: 3108047 - RNA, 16 nt, Mycobacterium bovis subsp bovis AF2122/97
ucagcagagccccggc

SEQ ID NO: 3108048 - RNA, 16 nt, Mycobacterium bovis subsp bovis AF2122/97
ucagcagaugggcguc

SEQ ID NO: 3108049 - RNA, 14 nt, Mycobacterium bovis subsp bovis AF2122/97
ucagcagcgccgcg

SEQ ID NO: 3108050 - RNA, 13 nt, Mycobacterium bovis subsp bovis AF2122/97
ucagcagcggcga

SEQ ID NO: 3108051 - RNA, 21 nt, Mycobacterium bovis subsp bovis AF2122/97
ucagcagcggcgaccgcgguc

SEQ ID NO: 3108052 - RNA, 14 nt, Mycobacterium bovis subsp bovis AF2122/97
ucagcagcggcgga

SEQ ID NO: 3108053 - RNA, 13 nt, Mycobacterium bovis subsp bovis AF2122/97
ucagcagcgucgg

SEQ ID NO: 3108054 - RNA, 20 nt, Mycobacterium bovis subsp bovis AF2122/97
ucagcagcuccacuggcguc

SEQ ID NO: 3108055 - RNA, 12 nt, Mycobacterium bovis subsp bovis AF2122/97
ucagcagcuguu

SEQ ID NO: 3108056 - RNA, 14 nt, Mycobacterium bovis subsp bovis AF2122/97
ucagcaggaccaac

SEQ ID NO: 3108057 - RNA, 14 nt, Mycobacterium bovis subsp bovis AF2122/97
ucagcaggcccagc

SEQ ID NO: 3108058 - RNA, 21 nt, Mycobacterium bovis subsp bovis AF2122/97
ucagcaggcccagcggaucga

SEQ ID NO: 3108059 - RNA, 23 nt, Mycobacterium bovis subsp bovis AF2122/97
ucagcaggggaucguccggccgg

SEQ ID NO: 3108060 - RNA, 23 nt, Mycobacterium bovis subsp bovis AF2122/97
ucagcagugggaugaagaacgcg

SEQ ID NO: 3108061 - RNA, 17 nt, Mycobacterium bovis subsp bovis AF2122/97
ucagcaugguccacagc

SEQ ID NO: 3108062 - RNA, 22 nt, Mycobacterium bovis subsp bovis AF2122/97
ucagcaugguccacagccggcg

SEQ ID NO: 3108063 - RNA, 18 nt, Mycobacterium bovis subsp bovis AF2122/97
ucagcauucaccaaaccg

SEQ ID NO: 3108064 - RNA, 22 nt, Mycobacterium bovis subsp bovis AF2122/97
ucagccaccgcaugugggaacu

SEQ ID NO: 3108065 - RNA, 14 nt, Mycobacterium bovis subsp bovis AF2122/97
ucagccaccgguga

SEQ ID NO: 3108066 - RNA, 14 nt, Mycobacterium bovis subsp bovis AF2122/97
ucagccacgcagca

SEQ ID NO: 3108067 - RNA, 21 nt, Mycobacterium bovis subsp bovis AF2122/97
ucagccagcccaggguguccg

SEQ ID NO: 3108068 - RNA, 13 nt, Mycobacterium bovis subsp bovis AF2122/97
ucagccaggccag

SEQ ID NO: 3108069 - RNA, 20 nt, Mycobacterium bovis subsp bovis AF2122/97
ucagccagggucccgccgcc

SEQ ID NO: 3108070 - RNA, 12 nt, Mycobacterium bovis subsp bovis AF2122/97
ucagccaggugu

SEQ ID NO: 3108071 - RNA, 19 nt, Mycobacterium bovis subsp bovis AF2122/97
ucagccaguccagcgcgcc

SEQ ID NO: 3108072 - RNA, 20 nt, Mycobacterium bovis subsp bovis AF2122/97
ucagcccagccaacucaggc

SEQ ID NO: 3108073 - RNA, 21 nt, Mycobacterium bovis subsp bovis AF2122/97
ucagcccagccaacucaggcc

SEQ ID NO: 3108074 - RNA, 16 nt, Mycobacterium bovis subsp bovis AF2122/97
ucagcccaugcccggc

SEQ ID NO: 3108075 - RNA, 14 nt, Mycobacterium bovis subsp bovis AF2122/97
ucagccccagugug

SEQ ID NO: 3108076 - RNA, 18 nt, Mycobacterium bovis subsp bovis AF2122/97
ucagccccgacugcgccc

SEQ ID NO: 3108077 - RNA, 14 nt, Mycobacterium bovis subsp bovis AF2122/97
ucagcccggcacug

SEQ ID NO: 3108078 - RNA, 20 nt, Mycobacterium bovis subsp bovis AF2122/97
ucagcccggcacugaccgcg

SEQ ID NO: 3108079 - RNA, 12 nt, Mycobacterium bovis subsp bovis AF2122/97
ucagcccggcgc

SEQ ID NO: 3108080 - RNA, 18 nt, Mycobacterium bovis subsp bovis AF2122/97
ucagcccggcgcgccgag

SEQ ID NO: 3108081 - RNA, 16 nt, Mycobacterium bovis subsp bovis AF2122/97
ucagccgaccgaccug

SEQ ID NO: 3108082 - RNA, 18 nt, Mycobacterium bovis subsp bovis AF2122/97
ucagccgccugucgggcu

SEQ ID NO: 3108083 - RNA, 19 nt, Mycobacterium bovis subsp bovis AF2122/97
ucagccgcgaccgcagcug

SEQ ID NO: 3108084 - RNA, 18 nt, Mycobacterium bovis subsp bovis AF2122/97
ucagccgcgccggguccg

SEQ ID NO: 3108085 - RNA, 13 nt, Mycobacterium bovis subsp bovis AF2122/97
ucagccgcgcgcc

SEQ ID NO: 3108086 - RNA, 19 nt, Mycobacterium bovis subsp bovis AF2122/97
ucagccgcgcgggucacga

SEQ ID NO: 3108087 - RNA, 20 nt, Mycobacterium bovis subsp bovis AF2122/97
ucagccgcgcgggucacgac

SEQ ID NO: 3108088 - RNA, 23 nt, Mycobacterium bovis subsp bovis AF2122/97
ucagccgcgcgggucacgaccug

SEQ ID NO: 3108089 - RNA, 12 nt, Mycobacterium bovis subsp bovis AF2122/97
ucagccgcggcc

SEQ ID NO: 3108090 - RNA, 21 nt, Mycobacterium bovis subsp bovis AF2122/97
ucagccgcggcggcagcaccc

SEQ ID NO: 3108091 - RNA, 17 nt, Mycobacterium bovis subsp bovis AF2122/97
ucagccggccauacgcg

SEQ ID NO: 3108092 - RNA, 21 nt, Mycobacterium bovis subsp bovis AF2122/97
ucagccgggugcgcacccggg

SEQ ID NO: 3108093 - RNA, 15 nt, Mycobacterium bovis subsp bovis AF2122/97
ucagccgguggucug

SEQ ID NO: 3108094 - RNA, 21 nt, Mycobacterium bovis subsp bovis AF2122/97
ucagccgugcccaggccaccg

SEQ ID NO: 3108095 - RNA, 18 nt, Mycobacterium bovis subsp bovis AF2122/97
ucagccgugccgugguga

SEQ ID NO: 3108096 - RNA, 15 nt, Mycobacterium bovis subsp bovis AF2122/97
ucagccguggcaguc

SEQ ID NO: 3108097 - RNA, 16 nt, Mycobacterium bovis subsp bovis AF2122/97
ucagccguucggcuaa

SEQ ID NO: 3108098 - RNA, 14 nt, Mycobacterium bovis subsp bovis AF2122/97
ucagcgaaccaccg

SEQ ID NO: 3108099 - RNA, 20 nt, Mycobacterium bovis subsp bovis AF2122/97
ucagcgaaccaccggcgccg

SEQ ID NO: 3108100 - RNA, 15 nt, Mycobacterium bovis subsp bovis AF2122/97
ucagcgaacggccag

SEQ ID NO: 3108101 - RNA, 17 nt, Mycobacterium bovis subsp bovis AF2122/97
ucagcgaacggccagga

SEQ ID NO: 3108102 - RNA, 22 nt, Mycobacterium bovis subsp bovis AF2122/97
ucagcgaccacgucaagaagaa

SEQ ID NO: 3108103 - RNA, 21 nt, Mycobacterium bovis subsp bovis AF2122/97
ucagcgacgcauaaccggcgc

SEQ ID NO: 3108104 - RNA, 14 nt, Mycobacterium bovis subsp bovis AF2122/97
ucagcgacggccgc

SEQ ID NO: 3108105 - RNA, 18 nt, Mycobacterium bovis subsp bovis AF2122/97
ucagcgacuugcuggcgu

SEQ ID NO: 3108106 - RNA, 16 nt, Mycobacterium bovis subsp bovis AF2122/97
ucagcgaguggucccg

SEQ ID NO: 3108107 - RNA, 16 nt, Mycobacterium bovis subsp bovis AF2122/97
ucagcgcacuggccgc

SEQ ID NO: 3108108 - RNA, 14 nt, Mycobacterium bovis subsp bovis AF2122/97
ucagcgcagcaucg

SEQ ID NO: 3108109 - RNA, 21 nt, Mycobacterium bovis subsp bovis AF2122/97
ucagcgcaucgccgcuggcca

SEQ ID NO: 3108110 - RNA, 15 nt, Mycobacterium bovis subsp bovis AF2122/97
ucagcgccacgucca

SEQ ID NO: 3108111 - RNA, 17 nt, Mycobacterium bovis subsp bovis AF2122/97
ucagcgccagcgagcau

SEQ ID NO: 3108112 - RNA, 14 nt, Mycobacterium bovis subsp bovis AF2122/97
ucagcgccagcgcc

SEQ ID NO: 3108113 - RNA, 22 nt, Mycobacterium bovis subsp bovis AF2122/97
ucagcgccgacuccaguucggu

SEQ ID NO: 3108114 - RNA, 22 nt, Mycobacterium bovis subsp bovis AF2122/97
ucagcgccgcauucgcgacaac

SEQ ID NO: 3108115 - RNA, 17 nt, Mycobacterium bovis subsp bovis AF2122/97
ucagcgccgcgcgcgcc

SEQ ID NO: 3108116 - RNA, 16 nt, Mycobacterium bovis subsp bovis AF2122/97
ucagcgccugguccuc

SEQ ID NO: 3108117 - RNA, 21 nt, Mycobacterium bovis subsp bovis AF2122/97
ucagcgcgaccgucaggguca

SEQ ID NO: 3108118 - RNA, 21 nt, Mycobacterium bovis subsp bovis AF2122/97
ucagcgcgcgccgcuggguga

SEQ ID NO: 3108119 - RNA, 12 nt, Mycobacterium bovis subsp bovis AF2122/97
ucagcgcgcugc

SEQ ID NO: 3108120 - RNA, 16 nt, Mycobacterium bovis subsp bovis AF2122/97
ucagcgcggcacggug

SEQ ID NO: 3108121 - RNA, 23 nt, Mycobacterium bovis subsp bovis AF2122/97
ucagcgcggcacggugugcggca

SEQ ID NO: 3108122 - RNA, 14 nt, Mycobacterium bovis subsp bovis AF2122/97
ucagcgcggcgccc

SEQ ID NO: 3108123 - RNA, 21 nt, Mycobacterium bovis subsp bovis AF2122/97
ucagcgcggcgcccuggccgc

SEQ ID NO: 3108124 - RNA, 13 nt, Mycobacterium bovis subsp bovis AF2122/97
ucagcgcggcgcg

SEQ ID NO: 3108125 - RNA, 22 nt, Mycobacterium bovis subsp bovis AF2122/97
ucagcgcggcgcgcaggaccug

SEQ ID NO: 3108126 - RNA, 19 nt, Mycobacterium bovis subsp bovis AF2122/97
ucagcgcguagccaaugcc

SEQ ID NO: 3108127 - RNA, 13 nt, Mycobacterium bovis subsp bovis AF2122/97
ucagcgcugagcc

SEQ ID NO: 3108128 - RNA, 16 nt, Mycobacterium bovis subsp bovis AF2122/97
ucagcgcugagccgcu

SEQ ID NO: 3108129 - RNA, 12 nt, Mycobacterium bovis subsp bovis AF2122/97
ucagcgcuggca

SEQ ID NO: 3108130 - RNA, 21 nt, Mycobacterium bovis subsp bovis AF2122/97
ucagcgcuggcaggccgggca

SEQ ID NO: 3108131 - RNA, 18 nt, Mycobacterium bovis subsp bovis AF2122/97
ucagcggcaacgaucgac

SEQ ID NO: 3108132 - RNA, 15 nt, Mycobacterium bovis subsp bovis AF2122/97
ucagcggcagcaccg

SEQ ID NO: 3108133 - RNA, 15 nt, Mycobacterium bovis subsp bovis AF2122/97
ucagcggccaaccca

SEQ ID NO: 3108134 - RNA, 17 nt, Mycobacterium bovis subsp bovis AF2122/97
ucagcggccaacccauc

SEQ ID NO: 3108135 - RNA, 14 nt, Mycobacterium bovis subsp bovis AF2122/97
ucagcggccagcag

SEQ ID NO: 3108136 - RNA, 16 nt, Mycobacterium bovis subsp bovis AF2122/97
ucagcggccagcagug

SEQ ID NO: 3108137 - RNA, 19 nt, Mycobacterium bovis subsp bovis AF2122/97
ucagcggccgcgacguuga

SEQ ID NO: 3108138 - RNA, 15 nt, Mycobacterium bovis subsp bovis AF2122/97
ucagcggccugcucg

SEQ ID NO: 3108139 - RNA, 21 nt, Mycobacterium bovis subsp bovis AF2122/97
ucagcggcggguagauccgcc

SEQ ID NO: 3108140 - RNA, 21 nt, Mycobacterium bovis subsp bovis AF2122/97
ucagcgggcacgccgccgacg

SEQ ID NO: 3108141 - RNA, 22 nt, Mycobacterium bovis subsp bovis AF2122/97
ucagcgggcagcaggcgaugcg

SEQ ID NO: 3108142 - RNA, 15 nt, Mycobacterium bovis subsp bovis AF2122/97
ucagcggggugcugc

SEQ ID NO: 3108143 - RNA, 22 nt, Mycobacterium bovis subsp bovis AF2122/97
ucagcgguacguaaucgagcgc

SEQ ID NO: 3108144 - RNA, 16 nt, Mycobacterium bovis subsp bovis AF2122/97
ucagcgguggcguggu

SEQ ID NO: 3108145 - RNA, 12 nt, Mycobacterium bovis subsp bovis AF2122/97
ucagcgguuggg

SEQ ID NO: 3108146 - RNA, 21 nt, Mycobacterium bovis subsp bovis AF2122/97
ucagcgucaggccuccaaaau

SEQ ID NO: 3108147 - RNA, 14 nt, Mycobacterium bovis subsp bovis AF2122/97
ucagcgucaggugc

SEQ ID NO: 3108148 - RNA, 19 nt, Mycobacterium bovis subsp bovis AF2122/97
ucagcgucccggucgccaa

SEQ ID NO: 3108149 - RNA, 21 nt, Mycobacterium bovis subsp bovis AF2122/97
ucagcgucgacgucagcacca

SEQ ID NO: 3108150 - RNA, 17 nt, Mycobacterium bovis subsp bovis AF2122/97
ucagcgucggcgcauca

SEQ ID NO: 3108151 - RNA, 18 nt, Mycobacterium bovis subsp bovis AF2122/97
ucagcgucggcgcaucac

SEQ ID NO: 3108152 - RNA, 22 nt, Mycobacterium bovis subsp bovis AF2122/97
ucagcgucucucgcagcuccuc

SEQ ID NO: 3108153 - RNA, 11 nt, Mycobacterium bovis subsp bovis AF2122/97
ucagcgucuga

SEQ ID NO: 3108154 - RNA, 20 nt, Mycobacterium bovis subsp bovis AF2122/97
ucagcgucugagcgccggca

SEQ ID NO: 3108155 - RNA, 21 nt, Mycobacterium bovis subsp bovis AF2122/97
ucagcgucugagcgccggcau

SEQ ID NO: 3108156 - RNA, 18 nt, Mycobacterium bovis subsp bovis AF2122/97
ucagcguggacgcccgcc

SEQ ID NO: 3108157 - RNA, 21 nt, Mycobacterium bovis subsp bovis AF2122/97
ucagcguggcgcccgugccgc

SEQ ID NO: 3108158 - RNA, 14 nt, Mycobacterium bovis subsp bovis AF2122/97
ucagcgugucgccg

SEQ ID NO: 3108159 - RNA, 21 nt, Mycobacterium bovis subsp bovis AF2122/97
ucagcuagcgcgggcucacau

SEQ ID NO: 3108160 - RNA, 12 nt, Mycobacterium bovis subsp bovis AF2122/97
ucagcucaccac

SEQ ID NO: 3108161 - RNA, 13 nt, Mycobacterium bovis subsp bovis AF2122/97
ucagcucgaggac

SEQ ID NO: 3108162 - RNA, 22 nt, Mycobacterium bovis subsp bovis AF2122/97
ucagcucgaucacgccggccuc

SEQ ID NO: 3108163 - RNA, 14 nt, Mycobacterium bovis subsp bovis AF2122/97
ucagcucgaugccg

SEQ ID NO: 3108164 - RNA, 16 nt, Mycobacterium bovis subsp bovis AF2122/97
ucagcucgaugccgug

SEQ ID NO: 3108165 - RNA, 15 nt, Mycobacterium bovis subsp bovis AF2122/97
ucagcucgcuugcau

SEQ ID NO: 3108166 - RNA, 18 nt, Mycobacterium bovis subsp bovis AF2122/97
ucagcucggcagcaucuc

SEQ ID NO: 3108167 - RNA, 22 nt, Mycobacterium bovis subsp bovis AF2122/97
ucagcucggugaugucggugcg

SEQ ID NO: 3108168 - RNA, 22 nt, Mycobacterium bovis subsp bovis AF2122/97
ucagcucgucggcgauggccag

SEQ ID NO: 3108169 - RNA, 20 nt, Mycobacterium bovis subsp bovis AF2122/97
ucagcugauuaccgacaccg

SEQ ID NO: 3108170 - RNA, 21 nt, Mycobacterium bovis subsp bovis AF2122/97
ucagcugcaccuccgacggcc

SEQ ID NO: 3108171 - RNA, 23 nt, Mycobacterium bovis subsp bovis AF2122/97
ucagcugcaccuccgacggccgc

SEQ ID NO: 3108172 - RNA, 12 nt, Mycobacterium bovis subsp bovis AF2122/97
ucagcugcggau

SEQ ID NO: 3108173 - RNA, 22 nt, Mycobacterium bovis subsp bovis AF2122/97
ucagcugcggauuaagucggcg

SEQ ID NO: 3108174 - RNA, 15 nt, Mycobacterium bovis subsp bovis AF2122/97
ucagcugcucgucuu

SEQ ID NO: 3108175 - RNA, 13 nt, Mycobacterium bovis subsp bovis AF2122/97
ucagcuggccgcg

SEQ ID NO: 3108176 - RNA, 17 nt, Mycobacterium bovis subsp bovis AF2122/97
ucagcuggccgcggcga

SEQ ID NO: 3108177 - RNA, 21 nt, Mycobacterium bovis subsp bovis AF2122/97
ucagcuggccgcggcgaguac

SEQ ID NO: 3108178 - RNA, 17 nt, Mycobacterium bovis subsp bovis AF2122/97
ucagcugggacccgagc

SEQ ID NO: 3108179 - RNA, 16 nt, Mycobacterium bovis subsp bovis AF2122/97
ucagcuuggacccugc

SEQ ID NO: 3108180 - RNA, 22 nt, Mycobacterium bovis subsp bovis AF2122/97
ucagcuuggacccugcgccgcc

SEQ ID NO: 3108181 - RNA, 22 nt, Mycobacterium bovis subsp bovis AF2122/97
ucagcuugugggcgacggcgau

SEQ ID NO: 3108182 - RNA, 22 nt, Mycobacterium bovis subsp bovis AF2122/97
ucaggaacaaguagccgucguc

SEQ ID NO: 3108183 - RNA, 17 nt, Mycobacterium bovis subsp bovis AF2122/97
ucaggaaccacccaccg

SEQ ID NO: 3108184 - RNA, 21 nt, Mycobacterium bovis subsp bovis AF2122/97
ucaggaagauuucugggccgc

SEQ ID NO: 3108185 - RNA, 18 nt, Mycobacterium bovis subsp bovis AF2122/97
ucaggacgaacgcuggcg

SEQ ID NO: 3108186 - RNA, 20 nt, Mycobacterium bovis subsp bovis AF2122/97
ucaggacgcgaucggcguca

SEQ ID NO: 3108187 - RNA, 19 nt, Mycobacterium bovis subsp bovis AF2122/97
ucaggaucccgguggcagc

SEQ ID NO: 3108188 - RNA, 21 nt, Mycobacterium bovis subsp bovis AF2122/97
ucaggaucccgguggcagcac

SEQ ID NO: 3108189 - RNA, 14 nt, Mycobacterium bovis subsp bovis AF2122/97
ucaggaucgcaccg

SEQ ID NO: 3108190 - RNA, 20 nt, Mycobacterium bovis subsp bovis AF2122/97
ucaggcacaacgcgacgccg

SEQ ID NO: 3108191 - RNA, 17 nt, Mycobacterium bovis subsp bovis AF2122/97
ucaggcaguccaccgcg

SEQ ID NO: 3108192 - RNA, 20 nt, Mycobacterium bovis subsp bovis AF2122/97
ucaggcaguccaccgcgcgg

SEQ ID NO: 3108193 - RNA, 16 nt, Mycobacterium bovis subsp bovis AF2122/97
ucaggccagagucgcc

SEQ ID NO: 3108194 - RNA, 20 nt, Mycobacterium bovis subsp bovis AF2122/97
ucaggccagagucgcccgca

SEQ ID NO: 3108195 - RNA, 14 nt, Mycobacterium bovis subsp bovis AF2122/97
ucaggccagcgcuc

SEQ ID NO: 3108196 - RNA, 20 nt, Mycobacterium bovis subsp bovis AF2122/97
ucaggccagggugaccaggc

SEQ ID NO: 3108197 - RNA, 18 nt, Mycobacterium bovis subsp bovis AF2122/97
ucaggcccauggcagccc

SEQ ID NO: 3108198 - RNA, 14 nt, Mycobacterium bovis subsp bovis AF2122/97
ucaggccccgggaa

SEQ ID NO: 3108199 - RNA, 20 nt, Mycobacterium bovis subsp bovis AF2122/97
ucaggcccucgggacugcgc

SEQ ID NO: 3108200 - RNA, 22 nt, Mycobacterium bovis subsp bovis AF2122/97
ucaggcccuuuucccugccuuc

SEQ ID NO: 3108201 - RNA, 23 nt, Mycobacterium bovis subsp bovis AF2122/97
ucaggccgaugacgaugccgccg

SEQ ID NO: 3108202 - RNA, 19 nt, Mycobacterium bovis subsp bovis AF2122/97
ucaggccgaugcgggucuc

SEQ ID NO: 3108203 - RNA, 17 nt, Mycobacterium bovis subsp bovis AF2122/97
ucaggccgccgcggcga

SEQ ID NO: 3108204 - RNA, 12 nt, Mycobacterium bovis subsp bovis AF2122/97
ucaggccgcgcg

SEQ ID NO: 3108205 - RNA, 13 nt, Mycobacterium bovis subsp bovis AF2122/97
ucaggccgcgcgg

SEQ ID NO: 3108206 - RNA, 17 nt, Mycobacterium bovis subsp bovis AF2122/97
ucaggccgucgccggag

SEQ ID NO: 3108207 - RNA, 16 nt, Mycobacterium bovis subsp bovis AF2122/97
ucaggcgaaccuggug

SEQ ID NO: 3108208 - RNA, 14 nt, Mycobacterium bovis subsp bovis AF2122/97
ucaggcgccgcuau

SEQ ID NO: 3108209 - RNA, 11 nt, Mycobacterium bovis subsp bovis AF2122/97
ucaggcgccgu

SEQ ID NO: 3108210 - RNA, 23 nt, Mycobacterium bovis subsp bovis AF2122/97
ucaggcggcagguucgaggguga

SEQ ID NO: 3108211 - RNA, 19 nt, Mycobacterium bovis subsp bovis AF2122/97
ucaggcggcuggcccgcau

SEQ ID NO: 3108212 - RNA, 22 nt, Mycobacterium bovis subsp bovis AF2122/97
ucaggcgggagcggaauggcgc

SEQ ID NO: 3108213 - RNA, 16 nt, Mycobacterium bovis subsp bovis AF2122/97
ucaggcucauccgccg

SEQ ID NO: 3108214 - RNA, 22 nt, Mycobacterium bovis subsp bovis AF2122/97
ucaggggaucccccgcgcgaac

SEQ ID NO: 3108215 - RNA, 23 nt, Mycobacterium bovis subsp bovis AF2122/97
ucaggggcuacuaggcccagcac

SEQ ID NO: 3108216 - RNA, 20 nt, Mycobacterium bovis subsp bovis AF2122/97
ucaggguauccacgccgggc

SEQ ID NO: 3108217 - RNA, 16 nt, Mycobacterium bovis subsp bovis AF2122/97
ucagggucugcgccgc

SEQ ID NO: 3108218 - RNA, 23 nt, Mycobacterium bovis subsp bovis AF2122/97
ucagggucugcgccgccggcggc

SEQ ID NO: 3108219 - RNA, 12 nt, Mycobacterium bovis subsp bovis AF2122/97
ucagggugggcg

SEQ ID NO: 3108220 - RNA, 13 nt, Mycobacterium bovis subsp bovis AF2122/97
ucagggugucgaa

SEQ ID NO: 3108221 - RNA, 18 nt, Mycobacterium bovis subsp bovis AF2122/97
ucagguacaucccggugu

SEQ ID NO: 3108222 - RNA, 16 nt, Mycobacterium bovis subsp bovis AF2122/97
ucagguacggcgggcg

SEQ ID NO: 3108223 - RNA, 23 nt, Mycobacterium bovis subsp bovis AF2122/97
ucagguagcggcccuucgacgag

SEQ ID NO: 3108224 - RNA, 21 nt, Mycobacterium bovis subsp bovis AF2122/97
ucaggucaccggccgccgaca

SEQ ID NO: 3108225 - RNA, 23 nt, Mycobacterium bovis subsp bovis AF2122/97
ucagguccuaggugugcgacgac

SEQ ID NO: 3108226 - RNA, 20 nt, Mycobacterium bovis subsp bovis AF2122/97
ucaggucgccgagaccggcc

SEQ ID NO: 3108227 - RNA, 16 nt, Mycobacterium bovis subsp bovis AF2122/97
ucaggucgguggucuc

SEQ ID NO: 3108228 - RNA, 17 nt, Mycobacterium bovis subsp bovis AF2122/97
ucaggucgucacgcccc

SEQ ID NO: 3108229 - RNA, 19 nt, Mycobacterium bovis subsp bovis AF2122/97
ucaggucugacagaccggg

SEQ ID NO: 3108230 - RNA, 20 nt, Mycobacterium bovis subsp bovis AF2122/97
ucaggucuucgauggccaug

SEQ ID NO: 3108231 - RNA, 17 nt, Mycobacterium bovis subsp bovis AF2122/97
ucaggugagaccagguu

SEQ ID NO: 3108232 - RNA, 20 nt, Mycobacterium bovis subsp bovis AF2122/97
ucaggugauucgcgcagcgc

SEQ ID NO: 3108233 - RNA, 15 nt, Mycobacterium bovis subsp bovis AF2122/97
ucagguucgcaccgg

SEQ ID NO: 3108234 - RNA, 13 nt, Mycobacterium bovis subsp bovis AF2122/97
ucagguuggcacg

SEQ ID NO: 3108235 - RNA, 16 nt, Mycobacterium bovis subsp bovis AF2122/97
ucaguagcagcggcuc

SEQ ID NO: 3108236 - RNA, 15 nt, Mycobacterium bovis subsp bovis AF2122/97
ucaguagccacgccc

SEQ ID NO: 3108237 - RNA, 16 nt, Mycobacterium bovis subsp bovis AF2122/97
ucagucaacucaccgu

SEQ ID NO: 3108238 - RNA, 18 nt, Mycobacterium bovis subsp bovis AF2122/97
ucaguccgacaccggcgg

SEQ ID NO: 3108239 - RNA, 23 nt, Mycobacterium bovis subsp bovis AF2122/97
ucaguccgacaccggcggcaucg

SEQ ID NO: 3108240 - RNA, 18 nt, Mycobacterium bovis subsp bovis AF2122/97
ucagugaagacaccaggc

SEQ ID NO: 3108241 - RNA, 20 nt, Mycobacterium bovis subsp bovis AF2122/97
ucagugaagacaccaggccc

SEQ ID NO: 3108242 - RNA, 22 nt, Mycobacterium bovis subsp bovis AF2122/97
ucagugaccuguugaacggccg

SEQ ID NO: 3108243 - RNA, 16 nt, Mycobacterium bovis subsp bovis AF2122/97
ucagugaucaccaacc

SEQ ID NO: 3108244 - RNA, 18 nt, Mycobacterium bovis subsp bovis AF2122/97
ucagugaucaccaacccg

SEQ ID NO: 3108245 - RNA, 23 nt, Mycobacterium bovis subsp bovis AF2122/97
ucagugauucggccugagcggcc

SEQ ID NO: 3108246 - RNA, 19 nt, Mycobacterium bovis subsp bovis AF2122/97
ucagugccaaagcggcaug

SEQ ID NO: 3108247 - RNA, 16 nt, Mycobacterium bovis subsp bovis AF2122/97
ucagugccccgcagca

SEQ ID NO: 3108248 - RNA, 15 nt, Mycobacterium bovis subsp bovis AF2122/97
ucagugcgaugcggu

SEQ ID NO: 3108249 - RNA, 20 nt, Mycobacterium bovis subsp bovis AF2122/97
ucagugggcgguugaucgcc

SEQ ID NO: 3108250 - RNA, 14 nt, Mycobacterium bovis subsp bovis AF2122/97
ucaguucacgcucg

SEQ ID NO: 3108251 - RNA, 22 nt, Mycobacterium bovis subsp bovis AF2122/97
ucaguucacguucggcgacgcg

SEQ ID NO: 3108252 - RNA, 14 nt, Mycobacterium bovis subsp bovis AF2122/97
ucaguuccaccgcg

SEQ ID NO: 3108253 - RNA, 13 nt, Mycobacterium bovis subsp bovis AF2122/97
ucaguucccgaac

SEQ ID NO: 3108254 - RNA, 15 nt, Mycobacterium bovis subsp bovis AF2122/97
ucaguucccgaaccc

SEQ ID NO: 3108255 - RNA, 22 nt, Mycobacterium bovis subsp bovis AF2122/97
ucaguucccgcuugaucugggc

SEQ ID NO: 3108256 - RNA, 20 nt, Mycobacterium bovis subsp bovis AF2122/97
ucaguucggugugcggcgca

SEQ ID NO: 3108257 - RNA, 23 nt, Mycobacterium bovis subsp bovis AF2122/97
ucaguugcgcuccaacaacucca

SEQ ID NO: 3108258 - RNA, 17 nt, Mycobacterium bovis subsp bovis AF2122/97
ucaguuugacgccgaug

SEQ ID NO: 3108259 - RNA, 20 nt, Mycobacterium bovis subsp bovis AF2122/97
ucauaaaugggugugcugcc

SEQ ID NO: 3108260 - RNA, 22 nt, Mycobacterium bovis subsp bovis AF2122/97
ucauaccgggaggacaccagcu

SEQ ID NO: 3108261 - RNA, 16 nt, Mycobacterium bovis subsp bovis AF2122/97
ucauacucgacaccga

SEQ ID NO: 3108262 - RNA, 22 nt, Mycobacterium bovis subsp bovis AF2122/97
ucauagaaauacaggcccggca

SEQ ID NO: 3108263 - RNA, 13 nt, Mycobacterium bovis subsp bovis AF2122/97
ucauagaccaguc

SEQ ID NO: 3108264 - RNA, 21 nt, Mycobacterium bovis subsp bovis AF2122/97
ucauagccguugcgggccagg

SEQ ID NO: 3108265 - RNA, 20 nt, Mycobacterium bovis subsp bovis AF2122/97
ucauagcgcaccaccgucuc

SEQ ID NO: 3108266 - RNA, 12 nt, Mycobacterium bovis subsp bovis AF2122/97
ucauagcgccgg

SEQ ID NO: 3108267 - RNA, 22 nt, Mycobacterium bovis subsp bovis AF2122/97
ucauaggcccgcacgaucucgu

SEQ ID NO: 3108268 - RNA, 14 nt, Mycobacterium bovis subsp bovis AF2122/97
ucauaggccggcgg

SEQ ID NO: 3108269 - RNA, 12 nt, Mycobacterium bovis subsp bovis AF2122/97
ucauagugcagg

SEQ ID NO: 3108270 - RNA, 20 nt, Mycobacterium bovis subsp bovis AF2122/97
ucauaucucgagcccucguu

SEQ ID NO: 3108271 - RNA, 14 nt, Mycobacterium bovis subsp bovis AF2122/97
ucaucaacgacacc

SEQ ID NO: 3108272 - RNA, 22 nt, Mycobacterium bovis subsp bovis AF2122/97
ucaucaacucgacccggccaag

SEQ ID NO: 3108273 - RNA, 13 nt, Mycobacterium bovis subsp bovis AF2122/97
ucaucacccagcg

SEQ ID NO: 3108274 - RNA, 21 nt, Mycobacterium bovis subsp bovis AF2122/97
ucaucaccucuccguccucgu

SEQ ID NO: 3108275 - RNA, 15 nt, Mycobacterium bovis subsp bovis AF2122/97
ucaucacgccgccgg

SEQ ID NO: 3108276 - RNA, 19 nt, Mycobacterium bovis subsp bovis AF2122/97
ucaucacuaaccuggcgua

SEQ ID NO: 3108277 - RNA, 13 nt, Mycobacterium bovis subsp bovis AF2122/97
ucaucauggccgg

SEQ ID NO: 3108278 - RNA, 15 nt, Mycobacterium bovis subsp bovis AF2122/97
ucaucauggccggau

SEQ ID NO: 3108279 - RNA, 14 nt, Mycobacterium bovis subsp bovis AF2122/97
ucaucaugugguca

SEQ ID NO: 3108280 - RNA, 19 nt, Mycobacterium bovis subsp bovis AF2122/97
ucauccaccccugagcucc

SEQ ID NO: 3108281 - RNA, 17 nt, Mycobacterium bovis subsp bovis AF2122/97
ucauccauccgggccgc

SEQ ID NO: 3108282 - RNA, 18 nt, Mycobacterium bovis subsp bovis AF2122/97
ucauccauccgggccgcg

SEQ ID NO: 3108283 - RNA, 15 nt, Mycobacterium bovis subsp bovis AF2122/97
ucauccccggccagc

SEQ ID NO: 3108284 - RNA, 16 nt, Mycobacterium bovis subsp bovis AF2122/97
ucauccccggccagcc

SEQ ID NO: 3108285 - RNA, 17 nt, Mycobacterium bovis subsp bovis AF2122/97
ucauccccggccagccu

SEQ ID NO: 3108286 - RNA, 12 nt, Mycobacterium bovis subsp bovis AF2122/97
ucaucccgacca

SEQ ID NO: 3108287 - RNA, 16 nt, Mycobacterium bovis subsp bovis AF2122/97
ucaucccgaccagcag

SEQ ID NO: 3108288 - RNA, 18 nt, Mycobacterium bovis subsp bovis AF2122/97
ucaucccgagaucaccuu

SEQ ID NO: 3108289 - RNA, 23 nt, Mycobacterium bovis subsp bovis AF2122/97
ucaucccgauguaccccagcgcc

SEQ ID NO: 3108290 - RNA, 19 nt, Mycobacterium bovis subsp bovis AF2122/97
ucaucccuuucgcgccgcg

SEQ ID NO: 3108291 - RNA, 13 nt, Mycobacterium bovis subsp bovis AF2122/97
ucauccgaucgcc

SEQ ID NO: 3108292 - RNA, 12 nt, Mycobacterium bovis subsp bovis AF2122/97
ucauccggccgu

SEQ ID NO: 3108293 - RNA, 13 nt, Mycobacterium bovis subsp bovis AF2122/97
ucauccggccguc

SEQ ID NO: 3108294 - RNA, 20 nt, Mycobacterium bovis subsp bovis AF2122/97
ucauccuucgccggcgccag

SEQ ID NO: 3108295 - RNA, 22 nt, Mycobacterium bovis subsp bovis AF2122/97
ucauccuucgccggcgccagca

SEQ ID NO: 3108296 - RNA, 13 nt, Mycobacterium bovis subsp bovis AF2122/97
ucaucgaagcuuc

SEQ ID NO: 3108297 - RNA, 16 nt, Mycobacterium bovis subsp bovis AF2122/97
ucaucgacaaucgcac

SEQ ID NO: 3108298 - RNA, 15 nt, Mycobacterium bovis subsp bovis AF2122/97
ucaucgaccuggcca

SEQ ID NO: 3108299 - RNA, 17 nt, Mycobacterium bovis subsp bovis AF2122/97
ucaucgaccuggccacg

SEQ ID NO: 3108300 - RNA, 18 nt, Mycobacterium bovis subsp bovis AF2122/97
ucaucgaccuggccacgg

SEQ ID NO: 3108301 - RNA, 22 nt, Mycobacterium bovis subsp bovis AF2122/97
ucaucgacgagccgcggucggc

SEQ ID NO: 3108302 - RNA, 15 nt, Mycobacterium bovis subsp bovis AF2122/97
ucaucgagcccgucc

SEQ ID NO: 3108303 - RNA, 16 nt, Mycobacterium bovis subsp bovis AF2122/97
ucaucgagcugaccug

SEQ ID NO: 3108304 - RNA, 15 nt, Mycobacterium bovis subsp bovis AF2122/97
ucaucgcagucaugu

SEQ ID NO: 3108305 - RNA, 13 nt, Mycobacterium bovis subsp bovis AF2122/97
ucaucgccagcgg

SEQ ID NO: 3108306 - RNA, 23 nt, Mycobacterium bovis subsp bovis AF2122/97
ucaucgccaucguuucacccggg

SEQ ID NO: 3108307 - RNA, 18 nt, Mycobacterium bovis subsp bovis AF2122/97
ucaucgcccaccgcaacg

SEQ ID NO: 3108308 - RNA, 23 nt, Mycobacterium bovis subsp bovis AF2122/97
ucaucgcccugggcgccggcguc

SEQ ID NO: 3108309 - RNA, 16 nt, Mycobacterium bovis subsp bovis AF2122/97
ucaucgccgacccgcc

SEQ ID NO: 3108310 - RNA, 18 nt, Mycobacterium bovis subsp bovis AF2122/97
ucaucgccgacccgccac

SEQ ID NO: 3108311 - RNA, 15 nt, Mycobacterium bovis subsp bovis AF2122/97
ucaucgcgcacgccc

SEQ ID NO: 3108312 - RNA, 13 nt, Mycobacterium bovis subsp bovis AF2122/97
ucaucgcggugug

SEQ ID NO: 3108313 - RNA, 19 nt, Mycobacterium bovis subsp bovis AF2122/97
ucaucgcugugcgcugguc

SEQ ID NO: 3108314 - RNA, 22 nt, Mycobacterium bovis subsp bovis AF2122/97
ucaucggcacaggcggccagca

SEQ ID NO: 3108315 - RNA, 20 nt, Mycobacterium bovis subsp bovis AF2122/97
ucaucggcaucgacugccag

SEQ ID NO: 3108316 - RNA, 23 nt, Mycobacterium bovis subsp bovis AF2122/97
ucaucggccgcggucggccacca

SEQ ID NO: 3108317 - RNA, 11 nt, Mycobacterium bovis subsp bovis AF2122/97
ucaucggcgcu

SEQ ID NO: 3108318 - RNA, 20 nt, Mycobacterium bovis subsp bovis AF2122/97
ucaucgggguggccaccagc

SEQ ID NO: 3108319 - RNA, 22 nt, Mycobacterium bovis subsp bovis AF2122/97
ucaucggugaauguugccgccg

SEQ ID NO: 3108320 - RNA, 22 nt, Mycobacterium bovis subsp bovis AF2122/97
ucaucgguugaccggucgacca

SEQ ID NO: 3108321 - RNA, 19 nt, Mycobacterium bovis subsp bovis AF2122/97
ucaucucccgaccgccgag

SEQ ID NO: 3108322 - RNA, 16 nt, Mycobacterium bovis subsp bovis AF2122/97
ucaucucgguggacgg

SEQ ID NO: 3108323 - RNA, 22 nt, Mycobacterium bovis subsp bovis AF2122/97
ucaucucgguggacggcaggcg

SEQ ID NO: 3108324 - RNA, 21 nt, Mycobacterium bovis subsp bovis AF2122/97
ucaucucggugguggccauga

SEQ ID NO: 3108325 - RNA, 13 nt, Mycobacterium bovis subsp bovis AF2122/97
ucaucuggcgcug

SEQ ID NO: 3108326 - RNA, 13 nt, Mycobacterium bovis subsp bovis AF2122/97
ucaugaacaucgg

SEQ ID NO: 3108327 - RNA, 14 nt, Mycobacterium bovis subsp bovis AF2122/97
ucaugaacgaucgg

SEQ ID NO: 3108328 - RNA, 16 nt, Mycobacterium bovis subsp bovis AF2122/97
ucaugaacgcaagcag

SEQ ID NO: 3108329 - RNA, 14 nt, Mycobacterium bovis subsp bovis AF2122/97
ucaugaccaucgag

SEQ ID NO: 3108330 - RNA, 20 nt, Mycobacterium bovis subsp bovis AF2122/97
ucaugagccgcugcgccagg

SEQ ID NO: 3108331 - RNA, 21 nt, Mycobacterium bovis subsp bovis AF2122/97
ucaugcaaaagccgcgaucgg

SEQ ID NO: 3108332 - RNA, 20 nt, Mycobacterium bovis subsp bovis AF2122/97
ucaugcacgccguagcaucg

SEQ ID NO: 3108333 - RNA, 21 nt, Mycobacterium bovis subsp bovis AF2122/97
ucaugccagccgucaccgcga

SEQ ID NO: 3108334 - RNA, 21 nt, Mycobacterium bovis subsp bovis AF2122/97
ucaugccauagaugcccgcga

SEQ ID NO: 3108335 - RNA, 20 nt, Mycobacterium bovis subsp bovis AF2122/97
ucaugcccaugauggccgcg

SEQ ID NO: 3108336 - RNA, 23 nt, Mycobacterium bovis subsp bovis AF2122/97
ucaugccgacgacaacagccagc

SEQ ID NO: 3108337 - RNA, 21 nt, Mycobacterium bovis subsp bovis AF2122/97
ucaugcgagucgucccagucc

SEQ ID NO: 3108338 - RNA, 20 nt, Mycobacterium bovis subsp bovis AF2122/97
ucaugcgauucugcguccug

SEQ ID NO: 3108339 - RNA, 14 nt, Mycobacterium bovis subsp bovis AF2122/97
ucaugcggcggcgc

SEQ ID NO: 3108340 - RNA, 21 nt, Mycobacterium bovis subsp bovis AF2122/97
ucaugcggcggcgcucgucga

SEQ ID NO: 3108341 - RNA, 23 nt, Mycobacterium bovis subsp bovis AF2122/97
ucaugcuaggccaccggcgaccg

SEQ ID NO: 3108342 - RNA, 20 nt, Mycobacterium bovis subsp bovis AF2122/97
ucauggcccgaucgaccgcu

SEQ ID NO: 3108343 - RNA, 17 nt, Mycobacterium bovis subsp bovis AF2122/97
ucauggccggucugcug

SEQ ID NO: 3108344 - RNA, 22 nt, Mycobacterium bovis subsp bovis AF2122/97
ucauggccggucugcugggcac

SEQ ID NO: 3108345 - RNA, 17 nt, Mycobacterium bovis subsp bovis AF2122/97
ucauggcgaaccgucag

SEQ ID NO: 3108346 - RNA, 18 nt, Mycobacterium bovis subsp bovis AF2122/97
ucauggcgaguacggccu

SEQ ID NO: 3108347 - RNA, 20 nt, Mycobacterium bovis subsp bovis AF2122/97
ucaugggcgccaucccgccg

SEQ ID NO: 3108348 - RNA, 14 nt, Mycobacterium bovis subsp bovis AF2122/97
ucauggucagcaga

SEQ ID NO: 3108349 - RNA, 22 nt, Mycobacterium bovis subsp bovis AF2122/97
ucauggugaaggcaaacaccag

SEQ ID NO: 3108350 - RNA, 18 nt, Mycobacterium bovis subsp bovis AF2122/97
ucaugguggggaccgcga

SEQ ID NO: 3108351 - RNA, 19 nt, Mycobacterium bovis subsp bovis AF2122/97
ucaugucagcgcugagccg

SEQ ID NO: 3108352 - RNA, 19 nt, Mycobacterium bovis subsp bovis AF2122/97
ucauguccauagccggcau

SEQ ID NO: 3108353 - RNA, 14 nt, Mycobacterium bovis subsp bovis AF2122/97
ucauguccgccgug

SEQ ID NO: 3108354 - RNA, 17 nt, Mycobacterium bovis subsp bovis AF2122/97
ucauguccugggccgcc

SEQ ID NO: 3108355 - RNA, 24 nt, Mycobacterium bovis subsp bovis AF2122/97
ucaugucgaagaaccggccgacga

SEQ ID NO: 3108356 - RNA, 21 nt, Mycobacterium bovis subsp bovis AF2122/97
ucaugucgaucagcgcgacgg

SEQ ID NO: 3108357 - RNA, 16 nt, Mycobacterium bovis subsp bovis AF2122/97
ucauguucggccacca

SEQ ID NO: 3108358 - RNA, 20 nt, Mycobacterium bovis subsp bovis AF2122/97
ucauuacucaacaguucacg

SEQ ID NO: 3108359 - RNA, 23 nt, Mycobacterium bovis subsp bovis AF2122/97
ucauucgugggaaccaccagcac

SEQ ID NO: 3108360 - RNA, 15 nt, Mycobacterium bovis subsp bovis AF2122/97
ucauugcccuugacc

SEQ ID NO: 3108361 - RNA, 23 nt, Mycobacterium bovis subsp bovis AF2122/97
ucauuggccuggcuaguugggug

SEQ ID NO: 3108362 - RNA, 16 nt, Mycobacterium bovis subsp bovis AF2122/97
uccaaaaaguagcugc

SEQ ID NO: 3108363 - RNA, 22 nt, Mycobacterium bovis subsp bovis AF2122/97
uccaaaacacucggaaucggcg

SEQ ID NO: 3108364 - RNA, 20 nt, Mycobacterium bovis subsp bovis AF2122/97
uccaaacccgguguuccggu

SEQ ID NO: 3108365 - RNA, 19 nt, Mycobacterium bovis subsp bovis AF2122/97
uccaacaacuccagcaggu

SEQ ID NO: 3108366 - RNA, 14 nt, Mycobacterium bovis subsp bovis AF2122/97
uccaacacuggggc

SEQ ID NO: 3108367 - RNA, 13 nt, Mycobacterium bovis subsp bovis AF2122/97
uccaacagcgcca

SEQ ID NO: 3108368 - RNA, 22 nt, Mycobacterium bovis subsp bovis AF2122/97
uccaaccaccgguccagcgccg

SEQ ID NO: 3108369 - RNA, 20 nt, Mycobacterium bovis subsp bovis AF2122/97
uccaacgacuguggcgccgc

SEQ ID NO: 3108370 - RNA, 13 nt, Mycobacterium bovis subsp bovis AF2122/97
uccaacgaucagu

SEQ ID NO: 3108371 - RNA, 14 nt, Mycobacterium bovis subsp bovis AF2122/97
uccaacgaucaguc

SEQ ID NO: 3108372 - RNA, 22 nt, Mycobacterium bovis subsp bovis AF2122/97
uccaacgcacacaccguaccga

SEQ ID NO: 3108373 - RNA, 14 nt, Mycobacterium bovis subsp bovis AF2122/97
uccaacgcggcgcg

SEQ ID NO: 3108374 - RNA, 16 nt, Mycobacterium bovis subsp bovis AF2122/97
uccaacuccugcagcc

SEQ ID NO: 3108375 - RNA, 15 nt, Mycobacterium bovis subsp bovis AF2122/97
uccaacucggcggcc

SEQ ID NO: 3108376 - RNA, 22 nt, Mycobacterium bovis subsp bovis AF2122/97
uccaacugaucccguagccgug

SEQ ID NO: 3108377 - RNA, 15 nt, Mycobacterium bovis subsp bovis AF2122/97
uccaacuggccgcgu

SEQ ID NO: 3108378 - RNA, 16 nt, Mycobacterium bovis subsp bovis AF2122/97
uccaacuggccgcguc

SEQ ID NO: 3108379 - RNA, 14 nt, Mycobacterium bovis subsp bovis AF2122/97
uccaagacagccug

SEQ ID NO: 3108380 - RNA, 19 nt, Mycobacterium bovis subsp bovis AF2122/97
uccaagauguccgguccgc

SEQ ID NO: 3108381 - RNA, 20 nt, Mycobacterium bovis subsp bovis AF2122/97
uccaagccagcguuggcggc

SEQ ID NO: 3108382 - RNA, 23 nt, Mycobacterium bovis subsp bovis AF2122/97
uccaagcggagacugguugcgga

SEQ ID NO: 3108383 - RNA, 17 nt, Mycobacterium bovis subsp bovis AF2122/97
uccaagcucgacaacug

SEQ ID NO: 3108384 - RNA, 20 nt, Mycobacterium bovis subsp bovis AF2122/97
uccaagcucgacaacugccc

SEQ ID NO: 3108385 - RNA, 19 nt, Mycobacterium bovis subsp bovis AF2122/97
uccaaggcgcgcugggcgc

SEQ ID NO: 3108386 - RNA, 19 nt, Mycobacterium bovis subsp bovis AF2122/97
uccaaggcggucaccaccg

SEQ ID NO: 3108387 - RNA, 14 nt, Mycobacterium bovis subsp bovis AF2122/97
uccaagucacagcu

SEQ ID NO: 3108388 - RNA, 20 nt, Mycobacterium bovis subsp bovis AF2122/97
uccaaguccuccacggcggg

SEQ ID NO: 3108389 - RNA, 23 nt, Mycobacterium bovis subsp bovis AF2122/97
uccaagugcuuccggccauugcg

SEQ ID NO: 3108390 - RNA, 15 nt, Mycobacterium bovis subsp bovis AF2122/97
uccaagugggccggc

SEQ ID NO: 3108391 - RNA, 22 nt, Mycobacterium bovis subsp bovis AF2122/97
uccaauaucgcuuucgaagaac

SEQ ID NO: 3108392 - RNA, 16 nt, Mycobacterium bovis subsp bovis AF2122/97
uccaauccacgguugc

SEQ ID NO: 3108393 - RNA, 22 nt, Mycobacterium bovis subsp bovis AF2122/97
uccaauccacgguugccggcgg

SEQ ID NO: 3108394 - RNA, 16 nt, Mycobacterium bovis subsp bovis AF2122/97
uccaauugcggccgcg

SEQ ID NO: 3108395 - RNA, 21 nt, Mycobacterium bovis subsp bovis AF2122/97
uccaauugggcgaugcggcgu

SEQ ID NO: 3108396 - RNA, 14 nt, Mycobacterium bovis subsp bovis AF2122/97
uccacaacagcccg

SEQ ID NO: 3108397 - RNA, 24 nt, Mycobacterium bovis subsp bovis AF2122/97
uccacaaguaccgcaucgaguccg

SEQ ID NO: 3108398 - RNA, 15 nt, Mycobacterium bovis subsp bovis AF2122/97
uccacaauccgcucg

SEQ ID NO: 3108399 - RNA, 19 nt, Mycobacterium bovis subsp bovis AF2122/97
uccacaauccgcucggucg

SEQ ID NO: 3108400 - RNA, 14 nt, Mycobacterium bovis subsp bovis AF2122/97
uccacaauccugaa

SEQ ID NO: 3108401 - RNA, 17 nt, Mycobacterium bovis subsp bovis AF2122/97
uccacacacagccggug

SEQ ID NO: 3108402 - RNA, 12 nt, Mycobacterium bovis subsp bovis AF2122/97
uccacaccaggc

SEQ ID NO: 3108403 - RNA, 13 nt, Mycobacterium bovis subsp bovis AF2122/97
uccacaccaggcc

SEQ ID NO: 3108404 - RNA, 17 nt, Mycobacterium bovis subsp bovis AF2122/97
uccacaccgcggcggcg

SEQ ID NO: 3108405 - RNA, 10 nt, Mycobacterium bovis subsp bovis AF2122/97
uccacaucaa

SEQ ID NO: 3108406 - RNA, 13 nt, Mycobacterium bovis subsp bovis AF2122/97
uccacaucaaaac

SEQ ID NO: 3108407 - RNA, 19 nt, Mycobacterium bovis subsp bovis AF2122/97
uccacauggugaccauggc

SEQ ID NO: 3108408 - RNA, 20 nt, Mycobacterium bovis subsp bovis AF2122/97
uccaccaagcucgcaaccga

SEQ ID NO: 3108409 - RNA, 12 nt, Mycobacterium bovis subsp bovis AF2122/97
uccaccacccug

SEQ ID NO: 3108410 - RNA, 15 nt, Mycobacterium bovis subsp bovis AF2122/97
uccaccacccugcac

SEQ ID NO: 3108411 - RNA, 22 nt, Mycobacterium bovis subsp bovis AF2122/97
uccaccaccgucgagccggaca

SEQ ID NO: 3108412 - RNA, 15 nt, Mycobacterium bovis subsp bovis AF2122/97
uccaccaccuggccg

SEQ ID NO: 3108413 - RNA, 16 nt, Mycobacterium bovis subsp bovis AF2122/97
uccaccacgcaaaagu

SEQ ID NO: 3108414 - RNA, 20 nt, Mycobacterium bovis subsp bovis AF2122/97
uccaccacgcuggccucguc

SEQ ID NO: 3108415 - RNA, 13 nt, Mycobacterium bovis subsp bovis AF2122/97
uccaccacgucgg

SEQ ID NO: 3108416 - RNA, 17 nt, Mycobacterium bovis subsp bovis AF2122/97
uccaccagccgguagcc

SEQ ID NO: 3108417 - RNA, 22 nt, Mycobacterium bovis subsp bovis AF2122/97
uccaccagcguguagcgaugcc

SEQ ID NO: 3108418 - RNA, 18 nt, Mycobacterium bovis subsp bovis AF2122/97
uccaccaggacguggucg

SEQ ID NO: 3108419 - RNA, 17 nt, Mycobacterium bovis subsp bovis AF2122/97
uccaccaggucgugccc

SEQ ID NO: 3108420 - RNA, 17 nt, Mycobacterium bovis subsp bovis AF2122/97
uccacccaacgcggugg

SEQ ID NO: 3108421 - RNA, 18 nt, Mycobacterium bovis subsp bovis AF2122/97
uccacccaagcucgguca

SEQ ID NO: 3108422 - RNA, 23 nt, Mycobacterium bovis subsp bovis AF2122/97
uccacccaggccgaugugucgau

SEQ ID NO: 3108423 - RNA, 18 nt, Mycobacterium bovis subsp bovis AF2122/97
uccaccccgauccgccac

SEQ ID NO: 3108424 - RNA, 14 nt, Mycobacterium bovis subsp bovis AF2122/97
uccaccccgccgau

SEQ ID NO: 3108425 - RNA, 22 nt, Mycobacterium bovis subsp bovis AF2122/97
uccacccgccggccgucggccg

SEQ ID NO: 3108426 - RNA, 20 nt, Mycobacterium bovis subsp bovis AF2122/97
uccaccgaaaaguccgccgc

SEQ ID NO: 3108427 - RNA, 18 nt, Mycobacterium bovis subsp bovis AF2122/97
uccaccgaagccccuccc

SEQ ID NO: 3108428 - RNA, 16 nt, Mycobacterium bovis subsp bovis AF2122/97
uccaccgaccuaccgu

SEQ ID NO: 3108429 - RNA, 19 nt, Mycobacterium bovis subsp bovis AF2122/97
uccaccgacguggccagcc

SEQ ID NO: 3108430 - RNA, 22 nt, Mycobacterium bovis subsp bovis AF2122/97
uccaccgacguggccagcccgc

SEQ ID NO: 3108431 - RNA, 13 nt, Mycobacterium bovis subsp bovis AF2122/97
uccaccgccacca

SEQ ID NO: 3108432 - RNA, 13 nt, Mycobacterium bovis subsp bovis AF2122/97
uccaccgccgaca

SEQ ID NO: 3108433 - RNA, 18 nt, Mycobacterium bovis subsp bovis AF2122/97
uccaccgccgacgcccga

SEQ ID NO: 3108434 - RNA, 24 nt, Mycobacterium bovis subsp bovis AF2122/97
uccaccgccgagaugcuggucggc

SEQ ID NO: 3108435 - RNA, 17 nt, Mycobacterium bovis subsp bovis AF2122/97
uccaccgcgccggcggc

SEQ ID NO: 3108436 - RNA, 18 nt, Mycobacterium bovis subsp bovis AF2122/97
uccaccgcgccggcggca

SEQ ID NO: 3108437 - RNA, 17 nt, Mycobacterium bovis subsp bovis AF2122/97
uccaccgcgccgucguc

SEQ ID NO: 3108438 - RNA, 22 nt, Mycobacterium bovis subsp bovis AF2122/97
uccaccgcgcggcgcagcaccg

SEQ ID NO: 3108439 - RNA, 13 nt, Mycobacterium bovis subsp bovis AF2122/97
uccaccggaccga

SEQ ID NO: 3108440 - RNA, 19 nt, Mycobacterium bovis subsp bovis AF2122/97
uccaccggaccgaccaccg

SEQ ID NO: 3108441 - RNA, 20 nt, Mycobacterium bovis subsp bovis AF2122/97
uccaccgggauagccgcgac

SEQ ID NO: 3108442 - RNA, 17 nt, Mycobacterium bovis subsp bovis AF2122/97
uccaccgggcccgccgg

SEQ ID NO: 3108443 - RNA, 17 nt, Mycobacterium bovis subsp bovis AF2122/97
uccaccgguccagggcc

SEQ ID NO: 3108444 - RNA, 14 nt, Mycobacterium bovis subsp bovis AF2122/97
uccaccgucgccgc

SEQ ID NO: 3108445 - RNA, 16 nt, Mycobacterium bovis subsp bovis AF2122/97
uccaccgucgccgccg

SEQ ID NO: 3108446 - RNA, 16 nt, Mycobacterium bovis subsp bovis AF2122/97
uccaccguuagccagg

SEQ ID NO: 3108447 - RNA, 20 nt, Mycobacterium bovis subsp bovis AF2122/97
uccaccucggcguuggaaaa

SEQ ID NO: 3108448 - RNA, 18 nt, Mycobacterium bovis subsp bovis AF2122/97
uccaccugaacggcaacg

SEQ ID NO: 3108449 - RNA, 14 nt, Mycobacterium bovis subsp bovis AF2122/97
uccacgacaaccgu

SEQ ID NO: 3108450 - RNA, 21 nt, Mycobacterium bovis subsp bovis AF2122/97
uccacgaugacgucgacaacg

SEQ ID NO: 3108451 - RNA, 22 nt, Mycobacterium bovis subsp bovis AF2122/97
uccacgcagaggcggcuggcgg

SEQ ID NO: 3108452 - RNA, 21 nt, Mycobacterium bovis subsp bovis AF2122/97
uccacgccgaccaucucaccg

SEQ ID NO: 3108453 - RNA, 18 nt, Mycobacterium bovis subsp bovis AF2122/97
uccacgccgggcaaggcc

SEQ ID NO: 3108454 - RNA, 18 nt, Mycobacterium bovis subsp bovis AF2122/97
uccacgccgugcuugcga

SEQ ID NO: 3108455 - RNA, 18 nt, Mycobacterium bovis subsp bovis AF2122/97
uccacgcgcucggugccg

SEQ ID NO: 3108456 - RNA, 18 nt, Mycobacterium bovis subsp bovis AF2122/97
uccacggagaccggccgg

SEQ ID NO: 3108457 - RNA, 14 nt, Mycobacterium bovis subsp bovis AF2122/97
uccacggagucaac

SEQ ID NO: 3108458 - RNA, 13 nt, Mycobacterium bovis subsp bovis AF2122/97
uccacggccaggu

SEQ ID NO: 3108459 - RNA, 23 nt, Mycobacterium bovis subsp bovis AF2122/97
uccacggcgggaacggugccgau

SEQ ID NO: 3108460 - RNA, 15 nt, Mycobacterium bovis subsp bovis AF2122/97
uccacggcggugccg

SEQ ID NO: 3108461 - RNA, 13 nt, Mycobacterium bovis subsp bovis AF2122/97
uccacggucggga

SEQ ID NO: 3108462 - RNA, 18 nt, Mycobacterium bovis subsp bovis AF2122/97
uccacgguugccggcggc

SEQ ID NO: 3108463 - RNA, 15 nt, Mycobacterium bovis subsp bovis AF2122/97
uccacgucgcggcgu

SEQ ID NO: 3108464 - RNA, 14 nt, Mycobacterium bovis subsp bovis AF2122/97
uccacgucuccugu

SEQ ID NO: 3108465 - RNA, 17 nt, Mycobacterium bovis subsp bovis AF2122/97
uccacguucggcugcga

SEQ ID NO: 3108466 - RNA, 18 nt, Mycobacterium bovis subsp bovis AF2122/97
uccacuccagcgaaccga

SEQ ID NO: 3108467 - RNA, 15 nt, Mycobacterium bovis subsp bovis AF2122/97
uccacuccgccaaca

SEQ ID NO: 3108468 - RNA, 12 nt, Mycobacterium bovis subsp bovis AF2122/97
uccacucggucu

SEQ ID NO: 3108469 - RNA, 15 nt, Mycobacterium bovis subsp bovis AF2122/97
uccacugaccagguc

SEQ ID NO: 3108470 - RNA, 15 nt, Mycobacterium bovis subsp bovis AF2122/97
uccacugccaccgcg

SEQ ID NO: 3108471 - RNA, 16 nt, Mycobacterium bovis subsp bovis AF2122/97
uccacugccaccgcga

SEQ ID NO: 3108472 - RNA, 21 nt, Mycobacterium bovis subsp bovis AF2122/97
uccacuggucaacgggaugcc

SEQ ID NO: 3108473 - RNA, 20 nt, Mycobacterium bovis subsp bovis AF2122/97
uccacuuccgggcgaccaac

SEQ ID NO: 3108474 - RNA, 15 nt, Mycobacterium bovis subsp bovis AF2122/97
uccagaacgcaucgg

SEQ ID NO: 3108475 - RNA, 23 nt, Mycobacterium bovis subsp bovis AF2122/97
uccagaagaagaugaucgcgaac

SEQ ID NO: 3108476 - RNA, 13 nt, Mycobacterium bovis subsp bovis AF2122/97
uccagaaggccgc

SEQ ID NO: 3108477 - RNA, 17 nt, Mycobacterium bovis subsp bovis AF2122/97
uccagaaggccgcaccg

SEQ ID NO: 3108478 - RNA, 21 nt, Mycobacterium bovis subsp bovis AF2122/97
uccagacgccacugccagccg

SEQ ID NO: 3108479 - RNA, 15 nt, Mycobacterium bovis subsp bovis AF2122/97
uccagagacagcgcc

SEQ ID NO: 3108480 - RNA, 20 nt, Mycobacterium bovis subsp bovis AF2122/97
uccagagacaugucgcugcc

SEQ ID NO: 3108481 - RNA, 23 nt, Mycobacterium bovis subsp bovis AF2122/97
uccagagcuggcuacgggccgcu

SEQ ID NO: 3108482 - RNA, 22 nt, Mycobacterium bovis subsp bovis AF2122/97
uccagaggccggcgggcucgcc

SEQ ID NO: 3108483 - RNA, 16 nt, Mycobacterium bovis subsp bovis AF2122/97
uccagauacaggaaca

SEQ ID NO: 3108484 - RNA, 17 nt, Mycobacterium bovis subsp bovis AF2122/97
uccagauaccaccgccg

SEQ ID NO: 3108485 - RNA, 22 nt, Mycobacterium bovis subsp bovis AF2122/97
uccagauaccaccgccgcugcc

SEQ ID NO: 3108486 - RNA, 15 nt, Mycobacterium bovis subsp bovis AF2122/97
uccagauaucgaagc

SEQ ID NO: 3108487 - RNA, 16 nt, Mycobacterium bovis subsp bovis AF2122/97
uccagauggggcucga

SEQ ID NO: 3108488 - RNA, 13 nt, Mycobacterium bovis subsp bovis AF2122/97
uccagauguccga

SEQ ID NO: 3108489 - RNA, 16 nt, Mycobacterium bovis subsp bovis AF2122/97
uccagcaaccucgguu

SEQ ID NO: 3108490 - RNA, 18 nt, Mycobacterium bovis subsp bovis AF2122/97
uccagcaaggccagcacg

SEQ ID NO: 3108491 - RNA, 22 nt, Mycobacterium bovis subsp bovis AF2122/97
uccagcaaggccagcacggcuu

SEQ ID NO: 3108492 - RNA, 13 nt, Mycobacterium bovis subsp bovis AF2122/97
uccagcaccaccg

SEQ ID NO: 3108493 - RNA, 15 nt, Mycobacterium bovis subsp bovis AF2122/97
uccagcaccaccgga

SEQ ID NO: 3108494 - RNA, 13 nt, Mycobacterium bovis subsp bovis AF2122/97
uccagcaccagca

SEQ ID NO: 3108495 - RNA, 18 nt, Mycobacterium bovis subsp bovis AF2122/97
uccagcaccagcacggca

SEQ ID NO: 3108496 - RNA, 23 nt, Mycobacterium bovis subsp bovis AF2122/97
uccagcaccagcacggcaaccag

SEQ ID NO: 3108497 - RNA, 21 nt, Mycobacterium bovis subsp bovis AF2122/97
uccagcacccgcgcgacgccg

SEQ ID NO: 3108498 - RNA, 14 nt, Mycobacterium bovis subsp bovis AF2122/97
uccagcacgccguc

SEQ ID NO: 3108499 - RNA, 17 nt, Mycobacterium bovis subsp bovis AF2122/97
uccagcagccaggagcc

SEQ ID NO: 3108500 - RNA, 13 nt, Mycobacterium bovis subsp bovis AF2122/97
uccagcagcgagu

SEQ ID NO: 3108501 - RNA, 16 nt, Mycobacterium bovis subsp bovis AF2122/97
uccagcagcgagucga

SEQ ID NO: 3108502 - RNA, 14 nt, Mycobacterium bovis subsp bovis AF2122/97
uccagcagcgccuc

SEQ ID NO: 3108503 - RNA, 21 nt, Mycobacterium bovis subsp bovis AF2122/97
uccagcagcucgccggcacgc

SEQ ID NO: 3108504 - RNA, 22 nt, Mycobacterium bovis subsp bovis AF2122/97
uccagcagcucgccggcacgca

SEQ ID NO: 3108505 - RNA, 14 nt, Mycobacterium bovis subsp bovis AF2122/97
uccagcagcucggc

SEQ ID NO: 3108506 - RNA, 17 nt, Mycobacterium bovis subsp bovis AF2122/97
uccagcagcucggccga

SEQ ID NO: 3108507 - RNA, 19 nt, Mycobacterium bovis subsp bovis AF2122/97
uccagcaggacggugaagc

SEQ ID NO: 3108508 - RNA, 16 nt, Mycobacterium bovis subsp bovis AF2122/97
uccagcaggccgucga

SEQ ID NO: 3108509 - RNA, 19 nt, Mycobacterium bovis subsp bovis AF2122/97
uccagcagguccgcggccg

SEQ ID NO: 3108510 - RNA, 18 nt, Mycobacterium bovis subsp bovis AF2122/97
uccagcaggucgccugcc

SEQ ID NO: 3108511 - RNA, 17 nt, Mycobacterium bovis subsp bovis AF2122/97
uccagcaguacaccgcc

SEQ ID NO: 3108512 - RNA, 18 nt, Mycobacterium bovis subsp bovis AF2122/97
uccagcaguacaccgccc

SEQ ID NO: 3108513 - RNA, 22 nt, Mycobacterium bovis subsp bovis AF2122/97
uccagcaucaguuugacgccga

SEQ ID NO: 3108514 - RNA, 14 nt, Mycobacterium bovis subsp bovis AF2122/97
uccagcaugggcga

SEQ ID NO: 3108515 - RNA, 13 nt, Mycobacterium bovis subsp bovis AF2122/97
uccagccaacggg

SEQ ID NO: 3108516 - RNA, 18 nt, Mycobacterium bovis subsp bovis AF2122/97
uccagccaacgggaacaa

SEQ ID NO: 3108517 - RNA, 23 nt, Mycobacterium bovis subsp bovis AF2122/97
uccagccaacgggaacaacggcg

SEQ ID NO: 3108518 - RNA, 15 nt, Mycobacterium bovis subsp bovis AF2122/97
uccagccacagcccg

SEQ ID NO: 3108519 - RNA, 17 nt, Mycobacterium bovis subsp bovis AF2122/97
uccagccaccgaccccg

SEQ ID NO: 3108520 - RNA, 12 nt, Mycobacterium bovis subsp bovis AF2122/97
uccagccaccgc

SEQ ID NO: 3108521 - RNA, 12 nt, Mycobacterium bovis subsp bovis AF2122/97
uccagccaggcc

SEQ ID NO: 3108522 - RNA, 19 nt, Mycobacterium bovis subsp bovis AF2122/97
uccagccaggcgauugccc

SEQ ID NO: 3108523 - RNA, 16 nt, Mycobacterium bovis subsp bovis AF2122/97
uccagcccaacucggc

SEQ ID NO: 3108524 - RNA, 18 nt, Mycobacterium bovis subsp bovis AF2122/97
uccagcccaacucggcca

SEQ ID NO: 3108525 - RNA, 20 nt, Mycobacterium bovis subsp bovis AF2122/97
uccagcccaacucggccagc

SEQ ID NO: 3108526 - RNA, 21 nt, Mycobacterium bovis subsp bovis AF2122/97
uccagcccaacucggccagcu

SEQ ID NO: 3108527 - RNA, 14 nt, Mycobacterium bovis subsp bovis AF2122/97
uccagcccagaucc

SEQ ID NO: 3108528 - RNA, 23 nt, Mycobacterium bovis subsp bovis AF2122/97
uccagcccaugcgccacgccacu

SEQ ID NO: 3108529 - RNA, 15 nt, Mycobacterium bovis subsp bovis AF2122/97
uccagcccgagcaga

SEQ ID NO: 3108530 - RNA, 20 nt, Mycobacterium bovis subsp bovis AF2122/97
uccagcccguccaggcgcug

SEQ ID NO: 3108531 - RNA, 22 nt, Mycobacterium bovis subsp bovis AF2122/97
uccagcccuguuugacugcgac

SEQ ID NO: 3108532 - RNA, 15 nt, Mycobacterium bovis subsp bovis AF2122/97
uccagccgcgcgccg

SEQ ID NO: 3108533 - RNA, 19 nt, Mycobacterium bovis subsp bovis AF2122/97
uccagccgcgcgccggcca

SEQ ID NO: 3108534 - RNA, 18 nt, Mycobacterium bovis subsp bovis AF2122/97
uccagccgcgcguccggg

SEQ ID NO: 3108535 - RNA, 22 nt, Mycobacterium bovis subsp bovis AF2122/97
uccagccgcgcguccgggcagc

SEQ ID NO: 3108536 - RNA, 12 nt, Mycobacterium bovis subsp bovis AF2122/97
uccagccggcgc

SEQ ID NO: 3108537 - RNA, 20 nt, Mycobacterium bovis subsp bovis AF2122/97
uccagccggcgcgccggaug

SEQ ID NO: 3108538 - RNA, 19 nt, Mycobacterium bovis subsp bovis AF2122/97
uccagccgggugccggcau

SEQ ID NO: 3108539 - RNA, 16 nt, Mycobacterium bovis subsp bovis AF2122/97
uccagccgguccagac

SEQ ID NO: 3108540 - RNA, 14 nt, Mycobacterium bovis subsp bovis AF2122/97
uccagccgucggcg

SEQ ID NO: 3108541 - RNA, 18 nt, Mycobacterium bovis subsp bovis AF2122/97
uccagccgucggcgcugc

SEQ ID NO: 3108542 - RNA, 13 nt, Mycobacterium bovis subsp bovis AF2122/97
uccagccguggcg

SEQ ID NO: 3108543 - RNA, 12 nt, Mycobacterium bovis subsp bovis AF2122/97
uccagcgaaccg

SEQ ID NO: 3108544 - RNA, 21 nt, Mycobacterium bovis subsp bovis AF2122/97
uccagcgaaccgacccggccg

SEQ ID NO: 3108545 - RNA, 20 nt, Mycobacterium bovis subsp bovis AF2122/97
uccagcgaggagcagggcuc

SEQ ID NO: 3108546 - RNA, 14 nt, Mycobacterium bovis subsp bovis AF2122/97
uccagcgccgaccu

SEQ ID NO: 3108547 - RNA, 16 nt, Mycobacterium bovis subsp bovis AF2122/97
uccagcgccgcggccc

SEQ ID NO: 3108548 - RNA, 22 nt, Mycobacterium bovis subsp bovis AF2122/97
uccagcgcgacguccaccagcc

SEQ ID NO: 3108549 - RNA, 19 nt, Mycobacterium bovis subsp bovis AF2122/97
uccagcgcgccacccagca

SEQ ID NO: 3108550 - RNA, 13 nt, Mycobacterium bovis subsp bovis AF2122/97
uccagcgcgcgcc

SEQ ID NO: 3108551 - RNA, 21 nt, Mycobacterium bovis subsp bovis AF2122/97
uccagcgcguaguccgcaucc

SEQ ID NO: 3108552 - RNA, 21 nt, Mycobacterium bovis subsp bovis AF2122/97
uccagcggaucgucguuguca

SEQ ID NO: 3108553 - RNA, 15 nt, Mycobacterium bovis subsp bovis AF2122/97
uccagcggccgccgc

SEQ ID NO: 3108554 - RNA, 16 nt, Mycobacterium bovis subsp bovis AF2122/97
uccagcgucgccgcca

SEQ ID NO: 3108555 - RNA, 14 nt, Mycobacterium bovis subsp bovis AF2122/97
uccagcgugccugg

SEQ ID NO: 3108556 - RNA, 18 nt, Mycobacterium bovis subsp bovis AF2122/97
uccagcguuugcuggcgg

SEQ ID NO: 3108557 - RNA, 19 nt, Mycobacterium bovis subsp bovis AF2122/97
uccagcguuugcuggcgga

SEQ ID NO: 3108558 - RNA, 13 nt, Mycobacterium bovis subsp bovis AF2122/97
uccagcucgggca

SEQ ID NO: 3108559 - RNA, 18 nt, Mycobacterium bovis subsp bovis AF2122/97
uccagcucgucgucggcg

SEQ ID NO: 3108560 - RNA, 16 nt, Mycobacterium bovis subsp bovis AF2122/97
uccagcugcgcgggcg

SEQ ID NO: 3108561 - RNA, 12 nt, Mycobacterium bovis subsp bovis AF2122/97
uccagcuggcau

SEQ ID NO: 3108562 - RNA, 20 nt, Mycobacterium bovis subsp bovis AF2122/97
uccagcuguacaacgccguc

SEQ ID NO: 3108563 - RNA, 22 nt, Mycobacterium bovis subsp bovis AF2122/97
uccaggaauuccccaccgucgu

SEQ ID NO: 3108564 - RNA, 21 nt, Mycobacterium bovis subsp bovis AF2122/97
uccaggagagaucgucgaccc

SEQ ID NO: 3108565 - RNA, 21 nt, Mycobacterium bovis subsp bovis AF2122/97
uccaggagccccagguagucg

SEQ ID NO: 3108566 - RNA, 15 nt, Mycobacterium bovis subsp bovis AF2122/97
uccaggagccgagga

SEQ ID NO: 3108567 - RNA, 22 nt, Mycobacterium bovis subsp bovis AF2122/97
uccaggaucgcguggcgcacca

SEQ ID NO: 3108568 - RNA, 22 nt, Mycobacterium bovis subsp bovis AF2122/97
uccaggcacuccagcggcgggg

SEQ ID NO: 3108569 - RNA, 13 nt, Mycobacterium bovis subsp bovis AF2122/97
uccaggccacccc

SEQ ID NO: 3108570 - RNA, 14 nt, Mycobacterium bovis subsp bovis AF2122/97
uccaggccagggcg

SEQ ID NO: 3108571 - RNA, 20 nt, Mycobacterium bovis subsp bovis AF2122/97
uccaggccagggcgguggcc

SEQ ID NO: 3108572 - RNA, 21 nt, Mycobacterium bovis subsp bovis AF2122/97
uccaggcccauacgugccgcc

SEQ ID NO: 3108573 - RNA, 12 nt, Mycobacterium bovis subsp bovis AF2122/97
uccaggccggca

SEQ ID NO: 3108574 - RNA, 22 nt, Mycobacterium bovis subsp bovis AF2122/97
uccaggccgucguugccggcga

SEQ ID NO: 3108575 - RNA, 17 nt, Mycobacterium bovis subsp bovis AF2122/97
uccaggcgcgcaccacc

SEQ ID NO: 3108576 - RNA, 14 nt, Mycobacterium bovis subsp bovis AF2122/97
uccaggcgcgccgc

SEQ ID NO: 3108577 - RNA, 16 nt, Mycobacterium bovis subsp bovis AF2122/97
uccaggcgcugcagca

SEQ ID NO: 3108578 - RNA, 21 nt, Mycobacterium bovis subsp bovis AF2122/97
uccaggcguuggaucccagcc

SEQ ID NO: 3108579 - RNA, 22 nt, Mycobacterium bovis subsp bovis AF2122/97
uccaggcguuggaucccagccc

SEQ ID NO: 3108580 - RNA, 14 nt, Mycobacterium bovis subsp bovis AF2122/97
uccaggcugucgcg

SEQ ID NO: 3108581 - RNA, 17 nt, Mycobacterium bovis subsp bovis AF2122/97
uccaggcuguggccagc

SEQ ID NO: 3108582 - RNA, 19 nt, Mycobacterium bovis subsp bovis AF2122/97
uccagggagcggcugcacg

SEQ ID NO: 3108583 - RNA, 22 nt, Mycobacterium bovis subsp bovis AF2122/97
uccagggagcggcugcacgccu

SEQ ID NO: 3108584 - RNA, 14 nt, Mycobacterium bovis subsp bovis AF2122/97
uccagggccacgau

SEQ ID NO: 3108585 - RNA, 16 nt, Mycobacterium bovis subsp bovis AF2122/97
uccagggcccugcugg

SEQ ID NO: 3108586 - RNA, 16 nt, Mycobacterium bovis subsp bovis AF2122/97
uccagggccgacgcga

SEQ ID NO: 3108587 - RNA, 19 nt, Mycobacterium bovis subsp bovis AF2122/97
uccaggggauugccccgca

SEQ ID NO: 3108588 - RNA, 19 nt, Mycobacterium bovis subsp bovis AF2122/97
uccaggggcuggugcuacu

SEQ ID NO: 3108589 - RNA, 13 nt, Mycobacterium bovis subsp bovis AF2122/97
uccaggucaugcc

SEQ ID NO: 3108590 - RNA, 20 nt, Mycobacterium bovis subsp bovis AF2122/97
uccagguccaaguccuccac

SEQ ID NO: 3108591 - RNA, 13 nt, Mycobacterium bovis subsp bovis AF2122/97
uccaggucggccg

SEQ ID NO: 3108592 - RNA, 12 nt, Mycobacterium bovis subsp bovis AF2122/97
uccaggucuggg

SEQ ID NO: 3108593 - RNA, 16 nt, Mycobacterium bovis subsp bovis AF2122/97
uccaggucugggcuuu

SEQ ID NO: 3108594 - RNA, 17 nt, Mycobacterium bovis subsp bovis AF2122/97
uccagguggucaucgcc

SEQ ID NO: 3108595 - RNA, 18 nt, Mycobacterium bovis subsp bovis AF2122/97
uccagguucuucuccacc

SEQ ID NO: 3108596 - RNA, 22 nt, Mycobacterium bovis subsp bovis AF2122/97
uccagguucuucuccaccaccg

SEQ ID NO: 3108597 - RNA, 21 nt, Mycobacterium bovis subsp bovis AF2122/97
uccagguugaggugugccgac

SEQ ID NO: 3108598 - RNA, 23 nt, Mycobacterium bovis subsp bovis AF2122/97
uccaguccuaucagugagccgcc

SEQ ID NO: 3108599 - RNA, 12 nt, Mycobacterium bovis subsp bovis AF2122/97
uccagugcugga

SEQ ID NO: 3108600 - RNA, 17 nt, Mycobacterium bovis subsp bovis AF2122/97
uccaguggcagccagcg

SEQ ID NO: 3108601 - RNA, 18 nt, Mycobacterium bovis subsp bovis AF2122/97
uccaguggcagccagcgg

SEQ ID NO: 3108602 - RNA, 19 nt, Mycobacterium bovis subsp bovis AF2122/97
uccaucacauccacgcacu

SEQ ID NO: 3108603 - RNA, 19 nt, Mycobacterium bovis subsp bovis AF2122/97
uccaucagagacagcagcg

SEQ ID NO: 3108604 - RNA, 15 nt, Mycobacterium bovis subsp bovis AF2122/97
uccaucgccaccgcg

SEQ ID NO: 3108605 - RNA, 16 nt, Mycobacterium bovis subsp bovis AF2122/97
uccaucgccaccgcgu

SEQ ID NO: 3108606 - RNA, 17 nt, Mycobacterium bovis subsp bovis AF2122/97
uccaucgcgcaccgcau

SEQ ID NO: 3108607 - RNA, 16 nt, Mycobacterium bovis subsp bovis AF2122/97
uccaucgucggcaaca

SEQ ID NO: 3108608 - RNA, 16 nt, Mycobacterium bovis subsp bovis AF2122/97
uccaucgucugguggc

SEQ ID NO: 3108609 - RNA, 18 nt, Mycobacterium bovis subsp bovis AF2122/97
uccaucugugcgcggaca

SEQ ID NO: 3108610 - RNA, 18 nt, Mycobacterium bovis subsp bovis AF2122/97
uccaugacaaaccugcau

SEQ ID NO: 3108611 - RNA, 22 nt, Mycobacterium bovis subsp bovis AF2122/97
uccaugauggccgucagccagg

SEQ ID NO: 3108612 - RNA, 17 nt, Mycobacterium bovis subsp bovis AF2122/97
uccauggacggccaggu

SEQ ID NO: 3108613 - RNA, 21 nt, Mycobacterium bovis subsp bovis AF2122/97
uccauggacggccaggugcag

SEQ ID NO: 3108614 - RNA, 13 nt, Mycobacterium bovis subsp bovis AF2122/97
uccaugucgucga

SEQ ID NO: 3108615 - RNA, 15 nt, Mycobacterium bovis subsp bovis AF2122/97
uccaugugcccaggu

SEQ ID NO: 3108616 - RNA, 21 nt, Mycobacterium bovis subsp bovis AF2122/97
uccauguuuugcugcaugccg

SEQ ID NO: 3108617 - RNA, 23 nt, Mycobacterium bovis subsp bovis AF2122/97
uccauguuuugcugcaugccgac

SEQ ID NO: 3108618 - RNA, 15 nt, Mycobacterium bovis subsp bovis AF2122/97
uccauucggcggcgg

SEQ ID NO: 3108619 - RNA, 17 nt, Mycobacterium bovis subsp bovis AF2122/97
ucccaacacagccgucg

SEQ ID NO: 3108620 - RNA, 22 nt, Mycobacterium bovis subsp bovis AF2122/97
ucccaaccgguggccggucguu

SEQ ID NO: 3108621 - RNA, 23 nt, Mycobacterium bovis subsp bovis AF2122/97
ucccaaugcaacaaggcaaagga

SEQ ID NO: 3108622 - RNA, 20 nt, Mycobacterium bovis subsp bovis AF2122/97
ucccacaggcuuuuccggcg

SEQ ID NO: 3108623 - RNA, 20 nt, Mycobacterium bovis subsp bovis AF2122/97
ucccacagguagaccgucuc

SEQ ID NO: 3108624 - RNA, 19 nt, Mycobacterium bovis subsp bovis AF2122/97
ucccacagguuugcgccgc

SEQ ID NO: 3108625 - RNA, 22 nt, Mycobacterium bovis subsp bovis AF2122/97
ucccacagguuugcgccgcgca

SEQ ID NO: 3108626 - RNA, 18 nt, Mycobacterium bovis subsp bovis AF2122/97
ucccaccaccaccgccgg

SEQ ID NO: 3108627 - RNA, 20 nt, Mycobacterium bovis subsp bovis AF2122/97
ucccaccaccaccgccggug

SEQ ID NO: 3108628 - RNA, 15 nt, Mycobacterium bovis subsp bovis AF2122/97
ucccaccaccgcucg

SEQ ID NO: 3108629 - RNA, 17 nt, Mycobacterium bovis subsp bovis AF2122/97
ucccaccaccgcucguc

SEQ ID NO: 3108630 - RNA, 11 nt, Mycobacterium bovis subsp bovis AF2122/97
ucccaccagcc

SEQ ID NO: 3108631 - RNA, 22 nt, Mycobacterium bovis subsp bovis AF2122/97
ucccaccagguacgcgaucagc

SEQ ID NO: 3108632 - RNA, 13 nt, Mycobacterium bovis subsp bovis AF2122/97
ucccacccggccu

SEQ ID NO: 3108633 - RNA, 16 nt, Mycobacterium bovis subsp bovis AF2122/97
ucccacgccagcgcga

SEQ ID NO: 3108634 - RNA, 20 nt, Mycobacterium bovis subsp bovis AF2122/97
ucccacgccagcgcgaccaa

SEQ ID NO: 3108635 - RNA, 23 nt, Mycobacterium bovis subsp bovis AF2122/97
ucccacgcccggccccgcggcca

SEQ ID NO: 3108636 - RNA, 14 nt, Mycobacterium bovis subsp bovis AF2122/97
ucccacgccgccgu

SEQ ID NO: 3108637 - RNA, 15 nt, Mycobacterium bovis subsp bovis AF2122/97
ucccacgccgccguu

SEQ ID NO: 3108638 - RNA, 21 nt, Mycobacterium bovis subsp bovis AF2122/97
ucccacgccgccguugccgau

SEQ ID NO: 3108639 - RNA, 16 nt, Mycobacterium bovis subsp bovis AF2122/97
ucccacggccggccgc

SEQ ID NO: 3108640 - RNA, 23 nt, Mycobacterium bovis subsp bovis AF2122/97
ucccacggccggccgcugccacu

SEQ ID NO: 3108641 - RNA, 14 nt, Mycobacterium bovis subsp bovis AF2122/97
ucccacggcgguug

SEQ ID NO: 3108642 - RNA, 19 nt, Mycobacterium bovis subsp bovis AF2122/97
ucccacggcgguugccccg

SEQ ID NO: 3108643 - RNA, 13 nt, Mycobacterium bovis subsp bovis AF2122/97
ucccacucccgcc

SEQ ID NO: 3108644 - RNA, 17 nt, Mycobacterium bovis subsp bovis AF2122/97
ucccacuggaggucguc

SEQ ID NO: 3108645 - RNA, 19 nt, Mycobacterium bovis subsp bovis AF2122/97
ucccacuggaggucgucga

SEQ ID NO: 3108646 - RNA, 16 nt, Mycobacterium bovis subsp bovis AF2122/97
ucccagcacgguggcu

SEQ ID NO: 3108647 - RNA, 13 nt, Mycobacterium bovis subsp bovis AF2122/97
ucccagccaaccc

SEQ ID NO: 3108648 - RNA, 14 nt, Mycobacterium bovis subsp bovis AF2122/97
ucccagccaacccg

SEQ ID NO: 3108649 - RNA, 14 nt, Mycobacterium bovis subsp bovis AF2122/97
ucccagcccggccc

SEQ ID NO: 3108650 - RNA, 22 nt, Mycobacterium bovis subsp bovis AF2122/97
ucccagccgacgccuuccagcc

SEQ ID NO: 3108651 - RNA, 21 nt, Mycobacterium bovis subsp bovis AF2122/97
ucccagccuggcaaccacguc

SEQ ID NO: 3108652 - RNA, 11 nt, Mycobacterium bovis subsp bovis AF2122/97
ucccagcgccg

SEQ ID NO: 3108653 - RNA, 19 nt, Mycobacterium bovis subsp bovis AF2122/97
ucccagcgccgcacagaaa

SEQ ID NO: 3108654 - RNA, 17 nt, Mycobacterium bovis subsp bovis AF2122/97
ucccagcgguagccgag

SEQ ID NO: 3108655 - RNA, 18 nt, Mycobacterium bovis subsp bovis AF2122/97
ucccagcugaccagcguc

SEQ ID NO: 3108656 - RNA, 17 nt, Mycobacterium bovis subsp bovis AF2122/97
ucccaggacuccggccg

SEQ ID NO: 3108657 - RNA, 19 nt, Mycobacterium bovis subsp bovis AF2122/97
ucccaggcguuuggcgugc

SEQ ID NO: 3108658 - RNA, 17 nt, Mycobacterium bovis subsp bovis AF2122/97
ucccagucauccaacgc

SEQ ID NO: 3108659 - RNA, 15 nt, Mycobacterium bovis subsp bovis AF2122/97
ucccauaucgaucgg

SEQ ID NO: 3108660 - RNA, 19 nt, Mycobacterium bovis subsp bovis AF2122/97
ucccaucaguugcacaccg

SEQ ID NO: 3108661 - RNA, 14 nt, Mycobacterium bovis subsp bovis AF2122/97
ucccauucccaaca

SEQ ID NO: 3108662 - RNA, 15 nt, Mycobacterium bovis subsp bovis AF2122/97
uccccacauggcccg

SEQ ID NO: 3108663 - RNA, 14 nt, Mycobacterium bovis subsp bovis AF2122/97
uccccaccgucguc

SEQ ID NO: 3108664 - RNA, 12 nt, Mycobacterium bovis subsp bovis AF2122/97
uccccagcacca

SEQ ID NO: 3108665 - RNA, 17 nt, Mycobacterium bovis subsp bovis AF2122/97
uccccagccccacccgc

SEQ ID NO: 3108666 - RNA, 15 nt, Mycobacterium bovis subsp bovis AF2122/97
uccccagcgccaccg

SEQ ID NO: 3108667 - RNA, 14 nt, Mycobacterium bovis subsp bovis AF2122/97
uccccaggccgcuu

SEQ ID NO: 3108668 - RNA, 22 nt, Mycobacterium bovis subsp bovis AF2122/97
uccccaggugggcagcaggccc

SEQ ID NO: 3108669 - RNA, 22 nt, Mycobacterium bovis subsp bovis AF2122/97
uccccaguugugcggccaggcg

SEQ ID NO: 3108670 - RNA, 22 nt, Mycobacterium bovis subsp bovis AF2122/97
uccccaugcagcgcgucgccga

SEQ ID NO: 3108671 - RNA, 21 nt, Mycobacterium bovis subsp bovis AF2122/97
ucccccaaaucaacagggugg

SEQ ID NO: 3108672 - RNA, 14 nt, Mycobacterium bovis subsp bovis AF2122/97
ucccccacacaccc

SEQ ID NO: 3108673 - RNA, 22 nt, Mycobacterium bovis subsp bovis AF2122/97
ucccccagaugcugguguugau

SEQ ID NO: 3108674 - RNA, 13 nt, Mycobacterium bovis subsp bovis AF2122/97
ucccccagccgcg

SEQ ID NO: 3108675 - RNA, 18 nt, Mycobacterium bovis subsp bovis AF2122/97
ucccccagccgcggcgcc

SEQ ID NO: 3108676 - RNA, 16 nt, Mycobacterium bovis subsp bovis AF2122/97
uccccccguugccgcc

SEQ ID NO: 3108677 - RNA, 19 nt, Mycobacterium bovis subsp bovis AF2122/97
uccccccguugccgccguu

SEQ ID NO: 3108678 - RNA, 17 nt, Mycobacterium bovis subsp bovis AF2122/97
ucccccgccaaccccaa

SEQ ID NO: 3108679 - RNA, 16 nt, Mycobacterium bovis subsp bovis AF2122/97
ucccccgcgcgaaccg

SEQ ID NO: 3108680 - RNA, 18 nt, Mycobacterium bovis subsp bovis AF2122/97
ucccccggguccgccguu

SEQ ID NO: 3108681 - RNA, 18 nt, Mycobacterium bovis subsp bovis AF2122/97
uccccgacaucgcugcga

SEQ ID NO: 3108682 - RNA, 20 nt, Mycobacterium bovis subsp bovis AF2122/97
uccccgaccgccaccgccag

SEQ ID NO: 3108683 - RNA, 22 nt, Mycobacterium bovis subsp bovis AF2122/97
uccccgaccgcgcccgcgggca

SEQ ID NO: 3108684 - RNA, 20 nt, Mycobacterium bovis subsp bovis AF2122/97
uccccgacggacuccggccg

SEQ ID NO: 3108685 - RNA, 13 nt, Mycobacterium bovis subsp bovis AF2122/97
uccccgacgucag

SEQ ID NO: 3108686 - RNA, 21 nt, Mycobacterium bovis subsp bovis AF2122/97
uccccgaucugcuccucgguc

SEQ ID NO: 3108687 - RNA, 22 nt, Mycobacterium bovis subsp bovis AF2122/97
uccccgcaauucccaucggccu

SEQ ID NO: 3108688 - RNA, 23 nt, Mycobacterium bovis subsp bovis AF2122/97
uccccgcaauucccaucggccug

SEQ ID NO: 3108689 - RNA, 14 nt, Mycobacterium bovis subsp bovis AF2122/97
uccccgcccuugcc

SEQ ID NO: 3108690 - RNA, 18 nt, Mycobacterium bovis subsp bovis AF2122/97
uccccgcccuugccgcca

SEQ ID NO: 3108691 - RNA, 15 nt, Mycobacterium bovis subsp bovis AF2122/97
uccccgccgacgccg

SEQ ID NO: 3108692 - RNA, 21 nt, Mycobacterium bovis subsp bovis AF2122/97
uccccgccggaacugcgcaac

SEQ ID NO: 3108693 - RNA, 15 nt, Mycobacterium bovis subsp bovis AF2122/97
uccccgccggcgcca

SEQ ID NO: 3108694 - RNA, 18 nt, Mycobacterium bovis subsp bovis AF2122/97
uccccgccggcgccaccg

SEQ ID NO: 3108695 - RNA, 19 nt, Mycobacterium bovis subsp bovis AF2122/97
uccccgccggcgccaccgu

SEQ ID NO: 3108696 - RNA, 21 nt, Mycobacterium bovis subsp bovis AF2122/97
uccccgccggcggguuuugau

SEQ ID NO: 3108697 - RNA, 20 nt, Mycobacterium bovis subsp bovis AF2122/97
uccccgcggcgguaaaccug

SEQ ID NO: 3108698 - RNA, 18 nt, Mycobacterium bovis subsp bovis AF2122/97
uccccgcguucggcggcg

SEQ ID NO: 3108699 - RNA, 16 nt, Mycobacterium bovis subsp bovis AF2122/97
uccccggauuccucgu

SEQ ID NO: 3108700 - RNA, 15 nt, Mycobacterium bovis subsp bovis AF2122/97
uccccggcccgcuca

SEQ ID NO: 3108701 - RNA, 17 nt, Mycobacterium bovis subsp bovis AF2122/97
uccccggcguccgaccg

SEQ ID NO: 3108702 - RNA, 15 nt, Mycobacterium bovis subsp bovis AF2122/97
uccccgguagccccg

SEQ ID NO: 3108703 - RNA, 17 nt, Mycobacterium bovis subsp bovis AF2122/97
uccccgguucugcgccc

SEQ ID NO: 3108704 - RNA, 23 nt, Mycobacterium bovis subsp bovis AF2122/97
uccccgguucugcgcccacccgc

SEQ ID NO: 3108705 - RNA, 18 nt, Mycobacterium bovis subsp bovis AF2122/97
uccccguccugccagucc

SEQ ID NO: 3108706 - RNA, 19 nt, Mycobacterium bovis subsp bovis AF2122/97
uccccguugacccagaccg

SEQ ID NO: 3108707 - RNA, 21 nt, Mycobacterium bovis subsp bovis AF2122/97
uccccguugacccagaccggc

SEQ ID NO: 3108708 - RNA, 23 nt, Mycobacterium bovis subsp bovis AF2122/97
uccccuacugcguugacgucaag

SEQ ID NO: 3108709 - RNA, 13 nt, Mycobacterium bovis subsp bovis AF2122/97
uccccucggccgc

SEQ ID NO: 3108710 - RNA, 20 nt, Mycobacterium bovis subsp bovis AF2122/97
uccccuggaaagggccgccg

SEQ ID NO: 3108711 - RNA, 13 nt, Mycobacterium bovis subsp bovis AF2122/97
uccccuggccagc

SEQ ID NO: 3108712 - RNA, 15 nt, Mycobacterium bovis subsp bovis AF2122/97
uccccuggccagcag

SEQ ID NO: 3108713 - RNA, 20 nt, Mycobacterium bovis subsp bovis AF2122/97
uccccuguugcagaaaaccc

SEQ ID NO: 3108714 - RNA, 23 nt, Mycobacterium bovis subsp bovis AF2122/97
ucccgaacaacucggugccuguc

SEQ ID NO: 3108715 - RNA, 21 nt, Mycobacterium bovis subsp bovis AF2122/97
ucccgaacacuuugcgcacua

SEQ ID NO: 3108716 - RNA, 14 nt, Mycobacterium bovis subsp bovis AF2122/97
ucccgaaucgugcg

SEQ ID NO: 3108717 - RNA, 19 nt, Mycobacterium bovis subsp bovis AF2122/97
ucccgaaucucacccacau

SEQ ID NO: 3108718 - RNA, 15 nt, Mycobacterium bovis subsp bovis AF2122/97
ucccgaauggccgau

SEQ ID NO: 3108719 - RNA, 21 nt, Mycobacterium bovis subsp bovis AF2122/97
ucccgacaucgugauccccgc

SEQ ID NO: 3108720 - RNA, 22 nt, Mycobacterium bovis subsp bovis AF2122/97
ucccgaccaccucagcugcgga

SEQ ID NO: 3108721 - RNA, 12 nt, Mycobacterium bovis subsp bovis AF2122/97
ucccgacccugc

SEQ ID NO: 3108722 - RNA, 14 nt, Mycobacterium bovis subsp bovis AF2122/97
ucccgagcccguca

SEQ ID NO: 3108723 - RNA, 15 nt, Mycobacterium bovis subsp bovis AF2122/97
ucccgaggcgcccaa

SEQ ID NO: 3108724 - RNA, 19 nt, Mycobacterium bovis subsp bovis AF2122/97
ucccgaguugcccucuggc

SEQ ID NO: 3108725 - RNA, 15 nt, Mycobacterium bovis subsp bovis AF2122/97
ucccgauacggccgg

SEQ ID NO: 3108726 - RNA, 12 nt, Mycobacterium bovis subsp bovis AF2122/97
ucccgaucaccc

SEQ ID NO: 3108727 - RNA, 13 nt, Mycobacterium bovis subsp bovis AF2122/97
ucccgaucccggc

SEQ ID NO: 3108728 - RNA, 14 nt, Mycobacterium bovis subsp bovis AF2122/97
ucccgaugaccuug

SEQ ID NO: 3108729 - RNA, 14 nt, Mycobacterium bovis subsp bovis AF2122/97
ucccgaugcuggca

SEQ ID NO: 3108730 - RNA, 19 nt, Mycobacterium bovis subsp bovis AF2122/97
ucccgauguaugacagguc

SEQ ID NO: 3108731 - RNA, 17 nt, Mycobacterium bovis subsp bovis AF2122/97
ucccgcaaaccgguccg

SEQ ID NO: 3108732 - RNA, 23 nt, Mycobacterium bovis subsp bovis AF2122/97
ucccgcaacauuuucgcccgcuc

SEQ ID NO: 3108733 - RNA, 21 nt, Mycobacterium bovis subsp bovis AF2122/97
ucccgcaaugcgagcgcgccg

SEQ ID NO: 3108734 - RNA, 19 nt, Mycobacterium bovis subsp bovis AF2122/97
ucccgcacaagcccagccc

SEQ ID NO: 3108735 - RNA, 18 nt, Mycobacterium bovis subsp bovis AF2122/97
ucccgcacggccgggucg

SEQ ID NO: 3108736 - RNA, 23 nt, Mycobacterium bovis subsp bovis AF2122/97
ucccgcaugcacgucaucggcug

SEQ ID NO: 3108737 - RNA, 17 nt, Mycobacterium bovis subsp bovis AF2122/97
ucccgccauugccgccg

SEQ ID NO: 3108738 - RNA, 13 nt, Mycobacterium bovis subsp bovis AF2122/97
ucccgcccagcag

SEQ ID NO: 3108739 - RNA, 14 nt, Mycobacterium bovis subsp bovis AF2122/97
ucccgccgaccgac

SEQ ID NO: 3108740 - RNA, 15 nt, Mycobacterium bovis subsp bovis AF2122/97
ucccgccgaucgaac

SEQ ID NO: 3108741 - RNA, 19 nt, Mycobacterium bovis subsp bovis AF2122/97
ucccgccgcaccgccgcau

SEQ ID NO: 3108742 - RNA, 22 nt, Mycobacterium bovis subsp bovis AF2122/97
ucccgccgcccgcaucgcggca

SEQ ID NO: 3108743 - RNA, 14 nt, Mycobacterium bovis subsp bovis AF2122/97
ucccgccgcugccg

SEQ ID NO: 3108744 - RNA, 11 nt, Mycobacterium bovis subsp bovis AF2122/97
ucccgccgggu

SEQ ID NO: 3108745 - RNA, 15 nt, Mycobacterium bovis subsp bovis AF2122/97
ucccgccggucacga

SEQ ID NO: 3108746 - RNA, 19 nt, Mycobacterium bovis subsp bovis AF2122/97
ucccgccggugugcccgcc

SEQ ID NO: 3108747 - RNA, 20 nt, Mycobacterium bovis subsp bovis AF2122/97
ucccgccggugugcccgccu

SEQ ID NO: 3108748 - RNA, 19 nt, Mycobacterium bovis subsp bovis AF2122/97
ucccgccgugccgcggcga

SEQ ID NO: 3108749 - RNA, 15 nt, Mycobacterium bovis subsp bovis AF2122/97
ucccgccguugccgc

SEQ ID NO: 3108750 - RNA, 23 nt, Mycobacterium bovis subsp bovis AF2122/97
ucccgccguugccgccgucaccg

SEQ ID NO: 3108751 - RNA, 23 nt, Mycobacterium bovis subsp bovis AF2122/97
ucccgccuucucccgcacggccg

SEQ ID NO: 3108752 - RNA, 13 nt, Mycobacterium bovis subsp bovis AF2122/97
ucccgcgaucgcg

SEQ ID NO: 3108753 - RNA, 13 nt, Mycobacterium bovis subsp bovis AF2122/97
ucccgcgccggcg

SEQ ID NO: 3108754 - RNA, 14 nt, Mycobacterium bovis subsp bovis AF2122/97
ucccgcgcgagccg

SEQ ID NO: 3108755 - RNA, 12 nt, Mycobacterium bovis subsp bovis AF2122/97
ucccgcgcggcg

SEQ ID NO: 3108756 - RNA, 13 nt, Mycobacterium bovis subsp bovis AF2122/97
ucccgcgcgggcg

SEQ ID NO: 3108757 - RNA, 18 nt, Mycobacterium bovis subsp bovis AF2122/97
ucccgcggacagcccgga

SEQ ID NO: 3108758 - RNA, 20 nt, Mycobacterium bovis subsp bovis AF2122/97
ucccgcggucgaucaggccg

SEQ ID NO: 3108759 - RNA, 20 nt, Mycobacterium bovis subsp bovis AF2122/97
ucccgcgugccacucgaugc

SEQ ID NO: 3108760 - RNA, 16 nt, Mycobacterium bovis subsp bovis AF2122/97
ucccgcucagcauuca

SEQ ID NO: 3108761 - RNA, 21 nt, Mycobacterium bovis subsp bovis AF2122/97
ucccgcucagcauucaccaaa

SEQ ID NO: 3108762 - RNA, 21 nt, Mycobacterium bovis subsp bovis AF2122/97
ucccgcucgagcagcgcgccg

SEQ ID NO: 3108763 - RNA, 18 nt, Mycobacterium bovis subsp bovis AF2122/97
ucccgcucuggucgucga

SEQ ID NO: 3108764 - RNA, 23 nt, Mycobacterium bovis subsp bovis AF2122/97
ucccgcuugaucugggcugcggc

SEQ ID NO: 3108765 - RNA, 15 nt, Mycobacterium bovis subsp bovis AF2122/97
ucccgcuuggcguga

SEQ ID NO: 3108766 - RNA, 20 nt, Mycobacterium bovis subsp bovis AF2122/97
ucccggaacgccgccagcgc

SEQ ID NO: 3108767 - RNA, 17 nt, Mycobacterium bovis subsp bovis AF2122/97
ucccggaauauggcggc

SEQ ID NO: 3108768 - RNA, 15 nt, Mycobacterium bovis subsp bovis AF2122/97
ucccggaccaucgcc

SEQ ID NO: 3108769 - RNA, 14 nt, Mycobacterium bovis subsp bovis AF2122/97
ucccggacgugccg

SEQ ID NO: 3108770 - RNA, 15 nt, Mycobacterium bovis subsp bovis AF2122/97
ucccggacgugccgg

SEQ ID NO: 3108771 - RNA, 17 nt, Mycobacterium bovis subsp bovis AF2122/97
ucccggauauugccauc

SEQ ID NO: 3108772 - RNA, 21 nt, Mycobacterium bovis subsp bovis AF2122/97
ucccggauauugccaucccuc

SEQ ID NO: 3108773 - RNA, 13 nt, Mycobacterium bovis subsp bovis AF2122/97
ucccggaugccga

SEQ ID NO: 3108774 - RNA, 16 nt, Mycobacterium bovis subsp bovis AF2122/97
ucccggcacgaccacc

SEQ ID NO: 3108775 - RNA, 20 nt, Mycobacterium bovis subsp bovis AF2122/97
ucccggcacgaccaccggau

SEQ ID NO: 3108776 - RNA, 23 nt, Mycobacterium bovis subsp bovis AF2122/97
ucccggcagcuggucggugggcu

SEQ ID NO: 3108777 - RNA, 13 nt, Mycobacterium bovis subsp bovis AF2122/97
ucccggccaggcc

SEQ ID NO: 3108778 - RNA, 14 nt, Mycobacterium bovis subsp bovis AF2122/97
ucccggccaggccg

SEQ ID NO: 3108779 - RNA, 12 nt, Mycobacterium bovis subsp bovis AF2122/97
ucccggccaggg

SEQ ID NO: 3108780 - RNA, 19 nt, Mycobacterium bovis subsp bovis AF2122/97
ucccggccaggggcgcagc

SEQ ID NO: 3108781 - RNA, 21 nt, Mycobacterium bovis subsp bovis AF2122/97
ucccggccaggggcgcagcgc

SEQ ID NO: 3108782 - RNA, 21 nt, Mycobacterium bovis subsp bovis AF2122/97
ucccggccauagcccgagcgc

SEQ ID NO: 3108783 - RNA, 20 nt, Mycobacterium bovis subsp bovis AF2122/97
ucccggccgaguaccagccc

SEQ ID NO: 3108784 - RNA, 12 nt, Mycobacterium bovis subsp bovis AF2122/97
ucccggccgccg

SEQ ID NO: 3108785 - RNA, 21 nt, Mycobacterium bovis subsp bovis AF2122/97
ucccggccgggucuuccggug

SEQ ID NO: 3108786 - RNA, 23 nt, Mycobacterium bovis subsp bovis AF2122/97
ucccggccuccauaucgcagcgu

SEQ ID NO: 3108787 - RNA, 15 nt, Mycobacterium bovis subsp bovis AF2122/97
ucccggccucgaugu

SEQ ID NO: 3108788 - RNA, 13 nt, Mycobacterium bovis subsp bovis AF2122/97
ucccggcgaccgg

SEQ ID NO: 3108789 - RNA, 18 nt, Mycobacterium bovis subsp bovis AF2122/97
ucccggcgaccggguccg

SEQ ID NO: 3108790 - RNA, 16 nt, Mycobacterium bovis subsp bovis AF2122/97
ucccggcgcgguggcc

SEQ ID NO: 3108791 - RNA, 14 nt, Mycobacterium bovis subsp bovis AF2122/97
ucccggcggucagc

SEQ ID NO: 3108792 - RNA, 23 nt, Mycobacterium bovis subsp bovis AF2122/97
ucccggcggucagcggcucggcg

SEQ ID NO: 3108793 - RNA, 19 nt, Mycobacterium bovis subsp bovis AF2122/97
ucccggcucgagcucggcg

SEQ ID NO: 3108794 - RNA, 14 nt, Mycobacterium bovis subsp bovis AF2122/97
ucccggcucggcca

SEQ ID NO: 3108795 - RNA, 14 nt, Mycobacterium bovis subsp bovis AF2122/97
ucccggcuggggcc

SEQ ID NO: 3108796 - RNA, 16 nt, Mycobacterium bovis subsp bovis AF2122/97
ucccgggcagccgcac

SEQ ID NO: 3108797 - RNA, 18 nt, Mycobacterium bovis subsp bovis AF2122/97
ucccgggcaguccaggca

SEQ ID NO: 3108798 - RNA, 13 nt, Mycobacterium bovis subsp bovis AF2122/97
ucccgggccgccg

SEQ ID NO: 3108799 - RNA, 16 nt, Mycobacterium bovis subsp bovis AF2122/97
ucccgggccgccgcga

SEQ ID NO: 3108800 - RNA, 15 nt, Mycobacterium bovis subsp bovis AF2122/97
ucccgggcggcggcc

SEQ ID NO: 3108801 - RNA, 22 nt, Mycobacterium bovis subsp bovis AF2122/97
ucccgggcucugcugccagccg

SEQ ID NO: 3108802 - RNA, 17 nt, Mycobacterium bovis subsp bovis AF2122/97
ucccgggggcacuccgg

SEQ ID NO: 3108803 - RNA, 14 nt, Mycobacterium bovis subsp bovis AF2122/97
ucccgggugcgacg

SEQ ID NO: 3108804 - RNA, 20 nt, Mycobacterium bovis subsp bovis AF2122/97
ucccgggugcgacgcgaccg

SEQ ID NO: 3108805 - RNA, 13 nt, Mycobacterium bovis subsp bovis AF2122/97
ucccgguagcggc

SEQ ID NO: 3108806 - RNA, 19 nt, Mycobacterium bovis subsp bovis AF2122/97
ucccgguccuucuccagau

SEQ ID NO: 3108807 - RNA, 17 nt, Mycobacterium bovis subsp bovis AF2122/97
ucccggucuacgacguc

SEQ ID NO: 3108808 - RNA, 21 nt, Mycobacterium bovis subsp bovis AF2122/97
ucccggucuuuaauccagcgc

SEQ ID NO: 3108809 - RNA, 20 nt, Mycobacterium bovis subsp bovis AF2122/97
ucccggugagggguugcggu

SEQ ID NO: 3108810 - RNA, 14 nt, Mycobacterium bovis subsp bovis AF2122/97
ucccggugggcggc

SEQ ID NO: 3108811 - RNA, 17 nt, Mycobacterium bovis subsp bovis AF2122/97
ucccggugucgaugcgc

SEQ ID NO: 3108812 - RNA, 19 nt, Mycobacterium bovis subsp bovis AF2122/97
ucccggugucgaugcgcag

SEQ ID NO: 3108813 - RNA, 16 nt, Mycobacterium bovis subsp bovis AF2122/97
ucccguacgccggcgg

SEQ ID NO: 3108814 - RNA, 15 nt, Mycobacterium bovis subsp bovis AF2122/97
ucccguauucgaugc

SEQ ID NO: 3108815 - RNA, 17 nt, Mycobacterium bovis subsp bovis AF2122/97
ucccguauucgaugccg

SEQ ID NO: 3108816 - RNA, 13 nt, Mycobacterium bovis subsp bovis AF2122/97
ucccgucgacgag

SEQ ID NO: 3108817 - RNA, 17 nt, Mycobacterium bovis subsp bovis AF2122/97
ucccgucgacgagcgcc

SEQ ID NO: 3108818 - RNA, 11 nt, Mycobacterium bovis subsp bovis AF2122/97
ucccgucgccg

SEQ ID NO: 3108819 - RNA, 14 nt, Mycobacterium bovis subsp bovis AF2122/97
ucccgucgccgccc

SEQ ID NO: 3108820 - RNA, 22 nt, Mycobacterium bovis subsp bovis AF2122/97
ucccgucgggcacaccgacgcc

SEQ ID NO: 3108821 - RNA, 22 nt, Mycobacterium bovis subsp bovis AF2122/97
ucccgugacgaacuucgaugcc

SEQ ID NO: 3108822 - RNA, 18 nt, Mycobacterium bovis subsp bovis AF2122/97
ucccgugcgcgcgcagcu

SEQ ID NO: 3108823 - RNA, 15 nt, Mycobacterium bovis subsp bovis AF2122/97
ucccguucgcccgcc

SEQ ID NO: 3108824 - RNA, 16 nt, Mycobacterium bovis subsp bovis AF2122/97
ucccguucgcccgccc

SEQ ID NO: 3108825 - RNA, 16 nt, Mycobacterium bovis subsp bovis AF2122/97
ucccguugccgcccac

SEQ ID NO: 3108826 - RNA, 18 nt, Mycobacterium bovis subsp bovis AF2122/97
ucccguugccgcccacua

SEQ ID NO: 3108827 - RNA, 17 nt, Mycobacterium bovis subsp bovis AF2122/97
ucccuauaccgcugggg

SEQ ID NO: 3108828 - RNA, 17 nt, Mycobacterium bovis subsp bovis AF2122/97
ucccuauugcugcggug

SEQ ID NO: 3108829 - RNA, 22 nt, Mycobacterium bovis subsp bovis AF2122/97
ucccuccgacuaacggugcggu

SEQ ID NO: 3108830 - RNA, 13 nt, Mycobacterium bovis subsp bovis AF2122/97
ucccuccgccaag

SEQ ID NO: 3108831 - RNA, 24 nt, Mycobacterium bovis subsp bovis AF2122/97
ucccucgccaaccagucgcacgac

SEQ ID NO: 3108832 - RNA, 15 nt, Mycobacterium bovis subsp bovis AF2122/97
ucccugaagccagcg

SEQ ID NO: 3108833 - RNA, 19 nt, Mycobacterium bovis subsp bovis AF2122/97
ucccugaucaaggaccgcu

SEQ ID NO: 3108834 - RNA, 16 nt, Mycobacterium bovis subsp bovis AF2122/97
ucccuggccgccgccg

SEQ ID NO: 3108835 - RNA, 20 nt, Mycobacterium bovis subsp bovis AF2122/97
ucccuggcggggaucagcga

SEQ ID NO: 3108836 - RNA, 12 nt, Mycobacterium bovis subsp bovis AF2122/97
ucccugggcguc

SEQ ID NO: 3108837 - RNA, 15 nt, Mycobacterium bovis subsp bovis AF2122/97
ucccuggggccgucc

SEQ ID NO: 3108838 - RNA, 16 nt, Mycobacterium bovis subsp bovis AF2122/97
ucccuuguucccgaaa

SEQ ID NO: 3108839 - RNA, 19 nt, Mycobacterium bovis subsp bovis AF2122/97
ucccuuuguggggccgggc

SEQ ID NO: 3108840 - RNA, 11 nt, Mycobacterium bovis subsp bovis AF2122/97
ucccuuuucca

SEQ ID NO: 3108841 - RNA, 15 nt, Mycobacterium bovis subsp bovis AF2122/97
uccgaaagccgccga

SEQ ID NO: 3108842 - RNA, 18 nt, Mycobacterium bovis subsp bovis AF2122/97
uccgaacauggccagcau

SEQ ID NO: 3108843 - RNA, 15 nt, Mycobacterium bovis subsp bovis AF2122/97
uccgaacgcgauccg

SEQ ID NO: 3108844 - RNA, 22 nt, Mycobacterium bovis subsp bovis AF2122/97
uccgaacggguagacccacauc

SEQ ID NO: 3108845 - RNA, 21 nt, Mycobacterium bovis subsp bovis AF2122/97
uccgaacuggucgacgccgag

SEQ ID NO: 3108846 - RNA, 18 nt, Mycobacterium bovis subsp bovis AF2122/97
uccgaaggccgccagucc

SEQ ID NO: 3108847 - RNA, 17 nt, Mycobacterium bovis subsp bovis AF2122/97
uccgacacccgaagccu

SEQ ID NO: 3108848 - RNA, 11 nt, Mycobacterium bovis subsp bovis AF2122/97
uccgacaccgg

SEQ ID NO: 3108849 - RNA, 13 nt, Mycobacterium bovis subsp bovis AF2122/97
uccgacaugaacc

SEQ ID NO: 3108850 - RNA, 18 nt, Mycobacterium bovis subsp bovis AF2122/97
uccgacaugaaccggucg

SEQ ID NO: 3108851 - RNA, 16 nt, Mycobacterium bovis subsp bovis AF2122/97
uccgaccagggaucga

SEQ ID NO: 3108852 - RNA, 13 nt, Mycobacterium bovis subsp bovis AF2122/97
uccgacccaacga

SEQ ID NO: 3108853 - RNA, 15 nt, Mycobacterium bovis subsp bovis AF2122/97
uccgaccccgccgag

SEQ ID NO: 3108854 - RNA, 16 nt, Mycobacterium bovis subsp bovis AF2122/97
uccgaccccgccgagc

SEQ ID NO: 3108855 - RNA, 23 nt, Mycobacterium bovis subsp bovis AF2122/97
uccgaccgauaacacccgggcca

SEQ ID NO: 3108856 - RNA, 15 nt, Mycobacterium bovis subsp bovis AF2122/97
uccgaccgguacccg

SEQ ID NO: 3108857 - RNA, 14 nt, Mycobacterium bovis subsp bovis AF2122/97
uccgaccucgccgc

SEQ ID NO: 3108858 - RNA, 20 nt, Mycobacterium bovis subsp bovis AF2122/97
uccgaccucugcguccagca

SEQ ID NO: 3108859 - RNA, 13 nt, Mycobacterium bovis subsp bovis AF2122/97
uccgacggccgcg

SEQ ID NO: 3108860 - RNA, 14 nt, Mycobacterium bovis subsp bovis AF2122/97
uccgacggccgcgg

SEQ ID NO: 3108861 - RNA, 17 nt, Mycobacterium bovis subsp bovis AF2122/97
uccgacggccgcggcgu

SEQ ID NO: 3108862 - RNA, 20 nt, Mycobacterium bovis subsp bovis AF2122/97
uccgacggcggauaaccggc

SEQ ID NO: 3108863 - RNA, 15 nt, Mycobacterium bovis subsp bovis AF2122/97
uccgacgggccacga

SEQ ID NO: 3108864 - RNA, 19 nt, Mycobacterium bovis subsp bovis AF2122/97
uccgacgggccgucgccgu

SEQ ID NO: 3108865 - RNA, 22 nt, Mycobacterium bovis subsp bovis AF2122/97
uccgacgggccgucgccgucca

SEQ ID NO: 3108866 - RNA, 15 nt, Mycobacterium bovis subsp bovis AF2122/97
uccgacgucggugac

SEQ ID NO: 3108867 - RNA, 16 nt, Mycobacterium bovis subsp bovis AF2122/97
uccgacgugcccccgu

SEQ ID NO: 3108868 - RNA, 21 nt, Mycobacterium bovis subsp bovis AF2122/97
uccgacuggccccgccagcgg

SEQ ID NO: 3108869 - RNA, 16 nt, Mycobacterium bovis subsp bovis AF2122/97
uccgacuugucgccau

SEQ ID NO: 3108870 - RNA, 15 nt, Mycobacterium bovis subsp bovis AF2122/97
uccgagaccaugccg

SEQ ID NO: 3108871 - RNA, 15 nt, Mycobacterium bovis subsp bovis AF2122/97
uccgagcgcggcggc

SEQ ID NO: 3108872 - RNA, 16 nt, Mycobacterium bovis subsp bovis AF2122/97
uccgagcuuggccgcc

SEQ ID NO: 3108873 - RNA, 20 nt, Mycobacterium bovis subsp bovis AF2122/97
uccgagcuuggccgccgcca

SEQ ID NO: 3108874 - RNA, 17 nt, Mycobacterium bovis subsp bovis AF2122/97
uccgaggaauacagcuu

SEQ ID NO: 3108875 - RNA, 22 nt, Mycobacterium bovis subsp bovis AF2122/97
uccgaggauguugugccgaucg

SEQ ID NO: 3108876 - RNA, 14 nt, Mycobacterium bovis subsp bovis AF2122/97
uccgaggccgccau

SEQ ID NO: 3108877 - RNA, 19 nt, Mycobacterium bovis subsp bovis AF2122/97
uccgagggcgucgccgccg

SEQ ID NO: 3108878 - RNA, 20 nt, Mycobacterium bovis subsp bovis AF2122/97
uccgagggcgucgccgccgu

SEQ ID NO: 3108879 - RNA, 13 nt, Mycobacterium bovis subsp bovis AF2122/97
uccgaguugaacg

SEQ ID NO: 3108880 - RNA, 15 nt, Mycobacterium bovis subsp bovis AF2122/97
uccgaucaccucggc

SEQ ID NO: 3108881 - RNA, 19 nt, Mycobacterium bovis subsp bovis AF2122/97
uccgaucaugucggccggg

SEQ ID NO: 3108882 - RNA, 20 nt, Mycobacterium bovis subsp bovis AF2122/97
uccgaucaugucggccgggg

SEQ ID NO: 3108883 - RNA, 16 nt, Mycobacterium bovis subsp bovis AF2122/97
uccgauccgcacagca

SEQ ID NO: 3108884 - RNA, 13 nt, Mycobacterium bovis subsp bovis AF2122/97
uccgaucgcagac

SEQ ID NO: 3108885 - RNA, 20 nt, Mycobacterium bovis subsp bovis AF2122/97
uccgaucgcguuagccaggu

SEQ ID NO: 3108886 - RNA, 14 nt, Mycobacterium bovis subsp bovis AF2122/97
uccgaucggcaauc

SEQ ID NO: 3108887 - RNA, 13 nt, Mycobacterium bovis subsp bovis AF2122/97
uccgaucggcgcg

SEQ ID NO: 3108888 - RNA, 17 nt, Mycobacterium bovis subsp bovis AF2122/97
uccgaucggcgcgccga

SEQ ID NO: 3108889 - RNA, 20 nt, Mycobacterium bovis subsp bovis AF2122/97
uccgaugaacaucuggcgac

SEQ ID NO: 3108890 - RNA, 22 nt, Mycobacterium bovis subsp bovis AF2122/97
uccgaugaccagggucugcuca

SEQ ID NO: 3108891 - RNA, 19 nt, Mycobacterium bovis subsp bovis AF2122/97
uccgaugcaucggugcagc

SEQ ID NO: 3108892 - RNA, 18 nt, Mycobacterium bovis subsp bovis AF2122/97
uccgaugcgcgcggcgcg

SEQ ID NO: 3108893 - RNA, 15 nt, Mycobacterium bovis subsp bovis AF2122/97
uccgaugggaaucag

SEQ ID NO: 3108894 - RNA, 19 nt, Mycobacterium bovis subsp bovis AF2122/97
uccgaugguaugcccgccg

SEQ ID NO: 3108895 - RNA, 14 nt, Mycobacterium bovis subsp bovis AF2122/97
uccgauuccgaacu

SEQ ID NO: 3108896 - RNA, 21 nt, Mycobacterium bovis subsp bovis AF2122/97
uccgauuccgaacuggucgac

SEQ ID NO: 3108897 - RNA, 15 nt, Mycobacterium bovis subsp bovis AF2122/97
uccgauuggcgaucu

SEQ ID NO: 3108898 - RNA, 21 nt, Mycobacterium bovis subsp bovis AF2122/97
uccgcaaccccuggggugcuc

SEQ ID NO: 3108899 - RNA, 22 nt, Mycobacterium bovis subsp bovis AF2122/97
uccgcaacggauaacccguggc

SEQ ID NO: 3108900 - RNA, 23 nt, Mycobacterium bovis subsp bovis AF2122/97
uccgcaacggauaacccguggcg

SEQ ID NO: 3108901 - RNA, 14 nt, Mycobacterium bovis subsp bovis AF2122/97
uccgcaaggaccug

SEQ ID NO: 3108902 - RNA, 17 nt, Mycobacterium bovis subsp bovis AF2122/97
uccgcaaucgcgacggg

SEQ ID NO: 3108903 - RNA, 18 nt, Mycobacterium bovis subsp bovis AF2122/97
uccgcaaucgcgacgggg

SEQ ID NO: 3108904 - RNA, 22 nt, Mycobacterium bovis subsp bovis AF2122/97
uccgcaaucgcgacggggucgc

SEQ ID NO: 3108905 - RNA, 18 nt, Mycobacterium bovis subsp bovis AF2122/97
uccgcaaugaccuggccg

SEQ ID NO: 3108906 - RNA, 12 nt, Mycobacterium bovis subsp bovis AF2122/97
uccgcacagcaa

SEQ ID NO: 3108907 - RNA, 14 nt, Mycobacterium bovis subsp bovis AF2122/97
uccgcacagcaaca

SEQ ID NO: 3108908 - RNA, 15 nt, Mycobacterium bovis subsp bovis AF2122/97
uccgcacagcgacga

SEQ ID NO: 3108909 - RNA, 17 nt, Mycobacterium bovis subsp bovis AF2122/97
uccgcacagcgacgaga

SEQ ID NO: 3108910 - RNA, 18 nt, Mycobacterium bovis subsp bovis AF2122/97
uccgcacagguccggguu

SEQ ID NO: 3108911 - RNA, 14 nt, Mycobacterium bovis subsp bovis AF2122/97
uccgcaccacgccc

SEQ ID NO: 3108912 - RNA, 22 nt, Mycobacterium bovis subsp bovis AF2122/97
uccgcaccacgcccgacgagga

SEQ ID NO: 3108913 - RNA, 19 nt, Mycobacterium bovis subsp bovis AF2122/97
uccgcaccccauacucggc

SEQ ID NO: 3108914 - RNA, 16 nt, Mycobacterium bovis subsp bovis AF2122/97
uccgcacccccgucga

SEQ ID NO: 3108915 - RNA, 14 nt, Mycobacterium bovis subsp bovis AF2122/97
uccgcacccggccg

SEQ ID NO: 3108916 - RNA, 16 nt, Mycobacterium bovis subsp bovis AF2122/97
uccgcacccggccgcg

SEQ ID NO: 3108917 - RNA, 15 nt, Mycobacterium bovis subsp bovis AF2122/97
uccgcacgaucgccc

SEQ ID NO: 3108918 - RNA, 22 nt, Mycobacterium bovis subsp bovis AF2122/97
uccgcacugugcccucaacguc

SEQ ID NO: 3108919 - RNA, 23 nt, Mycobacterium bovis subsp bovis AF2122/97
uccgcagagaccaagguccgcac

SEQ ID NO: 3108920 - RNA, 22 nt, Mycobacterium bovis subsp bovis AF2122/97
uccgcagcgaagaccagcggcg

SEQ ID NO: 3108921 - RNA, 20 nt, Mycobacterium bovis subsp bovis AF2122/97
uccgcagcguccagcgccug

SEQ ID NO: 3108922 - RNA, 23 nt, Mycobacterium bovis subsp bovis AF2122/97
uccgcagugagcaaugccaacgg

SEQ ID NO: 3108923 - RNA, 14 nt, Mycobacterium bovis subsp bovis AF2122/97
uccgccaacaucuc

SEQ ID NO: 3108924 - RNA, 17 nt, Mycobacterium bovis subsp bovis AF2122/97
uccgccaaguacugggc

SEQ ID NO: 3108925 - RNA, 11 nt, Mycobacterium bovis subsp bovis AF2122/97
uccgccacgaa

SEQ ID NO: 3108926 - RNA, 20 nt, Mycobacterium bovis subsp bovis AF2122/97
uccgccacggcgggcgaccc

SEQ ID NO: 3108927 - RNA, 14 nt, Mycobacterium bovis subsp bovis AF2122/97
uccgccacuggcgc

SEQ ID NO: 3108928 - RNA, 19 nt, Mycobacterium bovis subsp bovis AF2122/97
uccgccacuggcgccggug

SEQ ID NO: 3108929 - RNA, 20 nt, Mycobacterium bovis subsp bovis AF2122/97
uccgccagaauugccggcga

SEQ ID NO: 3108930 - RNA, 17 nt, Mycobacterium bovis subsp bovis AF2122/97
uccgccagaccgcggcg

SEQ ID NO: 3108931 - RNA, 15 nt, Mycobacterium bovis subsp bovis AF2122/97
uccgccagaucucgc

SEQ ID NO: 3108932 - RNA, 21 nt, Mycobacterium bovis subsp bovis AF2122/97
uccgccagaucucgcgcgcgg

SEQ ID NO: 3108933 - RNA, 19 nt, Mycobacterium bovis subsp bovis AF2122/97
uccgccaggccgaccgcgc

SEQ ID NO: 3108934 - RNA, 21 nt, Mycobacterium bovis subsp bovis AF2122/97
uccgccauugccguccggugg

SEQ ID NO: 3108935 - RNA, 14 nt, Mycobacterium bovis subsp bovis AF2122/97
uccgcccagccgca

SEQ ID NO: 3108936 - RNA, 14 nt, Mycobacterium bovis subsp bovis AF2122/97
uccgcccagcgagg

SEQ ID NO: 3108937 - RNA, 23 nt, Mycobacterium bovis subsp bovis AF2122/97
uccgcccagcgaggugggcguca

SEQ ID NO: 3108938 - RNA, 14 nt, Mycobacterium bovis subsp bovis AF2122/97
uccgccccagcugc

SEQ ID NO: 3108939 - RNA, 17 nt, Mycobacterium bovis subsp bovis AF2122/97
uccgccccgcccgcacc

SEQ ID NO: 3108940 - RNA, 20 nt, Mycobacterium bovis subsp bovis AF2122/97
uccgccccgcccgcacccau

SEQ ID NO: 3108941 - RNA, 18 nt, Mycobacterium bovis subsp bovis AF2122/97
uccgcccucaguucacgc

SEQ ID NO: 3108942 - RNA, 20 nt, Mycobacterium bovis subsp bovis AF2122/97
uccgcccucaguucacgcuc

SEQ ID NO: 3108943 - RNA, 20 nt, Mycobacterium bovis subsp bovis AF2122/97
uccgcccucaguucacguuc

SEQ ID NO: 3108944 - RNA, 18 nt, Mycobacterium bovis subsp bovis AF2122/97
uccgccgauagcaccgga

SEQ ID NO: 3108945 - RNA, 19 nt, Mycobacterium bovis subsp bovis AF2122/97
uccgccgauagcaccggaa

SEQ ID NO: 3108946 - RNA, 20 nt, Mycobacterium bovis subsp bovis AF2122/97
uccgccgcagacgccgacuc

SEQ ID NO: 3108947 - RNA, 14 nt, Mycobacterium bovis subsp bovis AF2122/97
uccgccgcccccgc

SEQ ID NO: 3108948 - RNA, 15 nt, Mycobacterium bovis subsp bovis AF2122/97
uccgccgccugcgca

SEQ ID NO: 3108949 - RNA, 21 nt, Mycobacterium bovis subsp bovis AF2122/97
uccgccgcgggcuccccggca

SEQ ID NO: 3108950 - RNA, 13 nt, Mycobacterium bovis subsp bovis AF2122/97
uccgccggcccca

SEQ ID NO: 3108951 - RNA, 14 nt, Mycobacterium bovis subsp bovis AF2122/97
uccgccggccccac

SEQ ID NO: 3108952 - RNA, 17 nt, Mycobacterium bovis subsp bovis AF2122/97
uccgccgggccaggccg

SEQ ID NO: 3108953 - RNA, 20 nt, Mycobacterium bovis subsp bovis AF2122/97
uccgccgggccaggccgaug

SEQ ID NO: 3108954 - RNA, 22 nt, Mycobacterium bovis subsp bovis AF2122/97
uccgccgggccaggccgaugcc

SEQ ID NO: 3108955 - RNA, 23 nt, Mycobacterium bovis subsp bovis AF2122/97
uccgccgggccaggccgaugccg

SEQ ID NO: 3108956 - RNA, 17 nt, Mycobacterium bovis subsp bovis AF2122/97
uccgccgggccccgggg

SEQ ID NO: 3108957 - RNA, 16 nt, Mycobacterium bovis subsp bovis AF2122/97
uccgccggugccgccg

SEQ ID NO: 3108958 - RNA, 18 nt, Mycobacterium bovis subsp bovis AF2122/97
uccgccggugccgccguc

SEQ ID NO: 3108959 - RNA, 21 nt, Mycobacterium bovis subsp bovis AF2122/97
uccgccguaugccgccaaccg

SEQ ID NO: 3108960 - RNA, 14 nt, Mycobacterium bovis subsp bovis AF2122/97
uccgccgucgacca

SEQ ID NO: 3108961 - RNA, 16 nt, Mycobacterium bovis subsp bovis AF2122/97
uccgccgucgccgccg

SEQ ID NO: 3108962 - RNA, 17 nt, Mycobacterium bovis subsp bovis AF2122/97
uccgccgucgccgccgg

SEQ ID NO: 3108963 - RNA, 21 nt, Mycobacterium bovis subsp bovis AF2122/97
uccgccgugaguucacguucg

SEQ ID NO: 3108964 - RNA, 17 nt, Mycobacterium bovis subsp bovis AF2122/97
uccgccguugccgaucc

SEQ ID NO: 3108965 - RNA, 18 nt, Mycobacterium bovis subsp bovis AF2122/97
uccgccguugccgauccc

SEQ ID NO: 3108966 - RNA, 20 nt, Mycobacterium bovis subsp bovis AF2122/97
uccgccguugccgaucccca

SEQ ID NO: 3108967 - RNA, 21 nt, Mycobacterium bovis subsp bovis AF2122/97
uccgccguugccgauccccag

SEQ ID NO: 3108968 - RNA, 15 nt, Mycobacterium bovis subsp bovis AF2122/97
uccgccguugccgcc

SEQ ID NO: 3108969 - RNA, 16 nt, Mycobacterium bovis subsp bovis AF2122/97
uccgccguugccgccg

SEQ ID NO: 3108970 - RNA, 22 nt, Mycobacterium bovis subsp bovis AF2122/97
uccgccuaagcauucagcgcgc

SEQ ID NO: 3108971 - RNA, 17 nt, Mycobacterium bovis subsp bovis AF2122/97
uccgccugcaccgccgc

SEQ ID NO: 3108972 - RNA, 22 nt, Mycobacterium bovis subsp bovis AF2122/97
uccgcgaagugcuugggccgcu

SEQ ID NO: 3108973 - RNA, 23 nt, Mycobacterium bovis subsp bovis AF2122/97
uccgcgaagugcuugggccgcug

SEQ ID NO: 3108974 - RNA, 20 nt, Mycobacterium bovis subsp bovis AF2122/97
uccgcgaaucaacaggaccg

SEQ ID NO: 3108975 - RNA, 14 nt, Mycobacterium bovis subsp bovis AF2122/97
uccgcgacgcucgc

SEQ ID NO: 3108976 - RNA, 22 nt, Mycobacterium bovis subsp bovis AF2122/97
uccgcgacggcggcucccgggg

SEQ ID NO: 3108977 - RNA, 16 nt, Mycobacterium bovis subsp bovis AF2122/97
uccgcgaucugcagcg

SEQ ID NO: 3108978 - RNA, 19 nt, Mycobacterium bovis subsp bovis AF2122/97
uccgcgaucugcagcgcgg

SEQ ID NO: 3108979 - RNA, 20 nt, Mycobacterium bovis subsp bovis AF2122/97
uccgcgaucugcagcgcgga

SEQ ID NO: 3108980 - RNA, 14 nt, Mycobacterium bovis subsp bovis AF2122/97
uccgcgaugugggc

SEQ ID NO: 3108981 - RNA, 23 nt, Mycobacterium bovis subsp bovis AF2122/97
uccgcgcaacuuccauuuucgcc

SEQ ID NO: 3108982 - RNA, 18 nt, Mycobacterium bovis subsp bovis AF2122/97
uccgcgccaguggccacc

SEQ ID NO: 3108983 - RNA, 22 nt, Mycobacterium bovis subsp bovis AF2122/97
uccgcgccgacggccagcagga

SEQ ID NO: 3108984 - RNA, 14 nt, Mycobacterium bovis subsp bovis AF2122/97
uccgcgccgcacca

SEQ ID NO: 3108985 - RNA, 22 nt, Mycobacterium bovis subsp bovis AF2122/97
uccgcgccgcaccaucggcgag

SEQ ID NO: 3108986 - RNA, 16 nt, Mycobacterium bovis subsp bovis AF2122/97
uccgcgccgccccgcu

SEQ ID NO: 3108987 - RNA, 19 nt, Mycobacterium bovis subsp bovis AF2122/97
uccgcgcgcaagucgaugu

SEQ ID NO: 3108988 - RNA, 14 nt, Mycobacterium bovis subsp bovis AF2122/97
uccgcgcgccgacc

SEQ ID NO: 3108989 - RNA, 12 nt, Mycobacterium bovis subsp bovis AF2122/97
uccgcgcguccg

SEQ ID NO: 3108990 - RNA, 22 nt, Mycobacterium bovis subsp bovis AF2122/97
uccgcgcucaaccgcaaucgga

SEQ ID NO: 3108991 - RNA, 17 nt, Mycobacterium bovis subsp bovis AF2122/97
uccgcgcuucacagcca

SEQ ID NO: 3108992 - RNA, 16 nt, Mycobacterium bovis subsp bovis AF2122/97
uccgcggaucaccauc

SEQ ID NO: 3108993 - RNA, 20 nt, Mycobacterium bovis subsp bovis AF2122/97
uccgcggcauuggcgucguc

SEQ ID NO: 3108994 - RNA, 14 nt, Mycobacterium bovis subsp bovis AF2122/97
uccgcggccaccac

SEQ ID NO: 3108995 - RNA, 22 nt, Mycobacterium bovis subsp bovis AF2122/97
uccgcggcgagcuccgaugccg

SEQ ID NO: 3108996 - RNA, 11 nt, Mycobacterium bovis subsp bovis AF2122/97
uccgcggcgca

SEQ ID NO: 3108997 - RNA, 14 nt, Mycobacterium bovis subsp bovis AF2122/97
uccgcggcgcagca

SEQ ID NO: 3108998 - RNA, 20 nt, Mycobacterium bovis subsp bovis AF2122/97
uccgcgggaaguucgccggu

SEQ ID NO: 3108999 - RNA, 19 nt, Mycobacterium bovis subsp bovis AF2122/97
uccgcgggggaccgcccga

SEQ ID NO: 3109000 - RNA, 23 nt, Mycobacterium bovis subsp bovis AF2122/97
uccgcgguguuggacgcgggccg

SEQ ID NO: 3109001 - RNA, 16 nt, Mycobacterium bovis subsp bovis AF2122/97
uccgcguagagcagca

SEQ ID NO: 3109002 - RNA, 21 nt, Mycobacterium bovis subsp bovis AF2122/97
uccgcgucggcggcgaccgcc

SEQ ID NO: 3109003 - RNA, 22 nt, Mycobacterium bovis subsp bovis AF2122/97
uccgcgucggcggcgaccgcca

SEQ ID NO: 3109004 - RNA, 22 nt, Mycobacterium bovis subsp bovis AF2122/97
uccgcgucggucagcugugcga

SEQ ID NO: 3109005 - RNA, 17 nt, Mycobacterium bovis subsp bovis AF2122/97
uccgcgucuggacgcga

SEQ ID NO: 3109006 - RNA, 18 nt, Mycobacterium bovis subsp bovis AF2122/97
uccgcgucuggacgcgaa

SEQ ID NO: 3109007 - RNA, 15 nt, Mycobacterium bovis subsp bovis AF2122/97
uccgcguggugcuga

SEQ ID NO: 3109008 - RNA, 23 nt, Mycobacterium bovis subsp bovis AF2122/97
uccgcguggugcugaccgcgccg

SEQ ID NO: 3109009 - RNA, 16 nt, Mycobacterium bovis subsp bovis AF2122/97
uccgcguugggcaccu

SEQ ID NO: 3109010 - RNA, 14 nt, Mycobacterium bovis subsp bovis AF2122/97
uccgcucgccgcca

SEQ ID NO: 3109011 - RNA, 15 nt, Mycobacterium bovis subsp bovis AF2122/97
uccgcucggucgccu

SEQ ID NO: 3109012 - RNA, 16 nt, Mycobacterium bovis subsp bovis AF2122/97
uccgcucggucgccuc

SEQ ID NO: 3109013 - RNA, 15 nt, Mycobacterium bovis subsp bovis AF2122/97
uccgcugcaggucca

SEQ ID NO: 3109014 - RNA, 22 nt, Mycobacterium bovis subsp bovis AF2122/97
uccgcugccaucggcaccagcg

SEQ ID NO: 3109015 - RNA, 15 nt, Mycobacterium bovis subsp bovis AF2122/97
uccgcugcggcccgu

SEQ ID NO: 3109016 - RNA, 21 nt, Mycobacterium bovis subsp bovis AF2122/97
uccgcugucgagccggugccg

SEQ ID NO: 3109017 - RNA, 17 nt, Mycobacterium bovis subsp bovis AF2122/97
uccgcuugcucucgcag

SEQ ID NO: 3109018 - RNA, 22 nt, Mycobacterium bovis subsp bovis AF2122/97
uccgcuugggcggugucgucga

SEQ ID NO: 3109019 - RNA, 21 nt, Mycobacterium bovis subsp bovis AF2122/97
uccggaaagcucucggcaccc

SEQ ID NO: 3109020 - RNA, 13 nt, Mycobacterium bovis subsp bovis AF2122/97
uccggaaccaacc

SEQ ID NO: 3109021 - RNA, 13 nt, Mycobacterium bovis subsp bovis AF2122/97
uccggaagcggcg

SEQ ID NO: 3109022 - RNA, 14 nt, Mycobacterium bovis subsp bovis AF2122/97
uccggaaucgcccg

SEQ ID NO: 3109023 - RNA, 16 nt, Mycobacterium bovis subsp bovis AF2122/97
uccggacccacccgca

SEQ ID NO: 3109024 - RNA, 17 nt, Mycobacterium bovis subsp bovis AF2122/97
uccggacccacccgcac

SEQ ID NO: 3109025 - RNA, 17 nt, Mycobacterium bovis subsp bovis AF2122/97
uccggacgcacgauccg

SEQ ID NO: 3109026 - RNA, 19 nt, Mycobacterium bovis subsp bovis AF2122/97
uccggauaacccagcggcg

SEQ ID NO: 3109027 - RNA, 20 nt, Mycobacterium bovis subsp bovis AF2122/97
uccggauaacccagcggcgc

SEQ ID NO: 3109028 - RNA, 15 nt, Mycobacterium bovis subsp bovis AF2122/97
uccggaucgccgaau

SEQ ID NO: 3109029 - RNA, 20 nt, Mycobacterium bovis subsp bovis AF2122/97
uccggaucggccuguccacc

SEQ ID NO: 3109030 - RNA, 15 nt, Mycobacterium bovis subsp bovis AF2122/97
uccggcaaccaccgg

SEQ ID NO: 3109031 - RNA, 18 nt, Mycobacterium bovis subsp bovis AF2122/97
uccggcaagcacaccgcc

SEQ ID NO: 3109032 - RNA, 23 nt, Mycobacterium bovis subsp bovis AF2122/97
uccggcaagcacaccgccagcgg

SEQ ID NO: 3109033 - RNA, 18 nt, Mycobacterium bovis subsp bovis AF2122/97
uccggcaccaacgccacc

SEQ ID NO: 3109034 - RNA, 19 nt, Mycobacterium bovis subsp bovis AF2122/97
uccggcaccaacgccaccg

SEQ ID NO: 3109035 - RNA, 21 nt, Mycobacterium bovis subsp bovis AF2122/97
uccggcaccaacgccaccguc

SEQ ID NO: 3109036 - RNA, 17 nt, Mycobacterium bovis subsp bovis AF2122/97
uccggcaccggucuugg

SEQ ID NO: 3109037 - RNA, 19 nt, Mycobacterium bovis subsp bovis AF2122/97
uccggcacugcggccaguc

SEQ ID NO: 3109038 - RNA, 14 nt, Mycobacterium bovis subsp bovis AF2122/97
uccggcagcagccg

SEQ ID NO: 3109039 - RNA, 15 nt, Mycobacterium bovis subsp bovis AF2122/97
uccggcaggcccgac

SEQ ID NO: 3109040 - RNA, 16 nt, Mycobacterium bovis subsp bovis AF2122/97
uccggcauacaucgcc

SEQ ID NO: 3109041 - RNA, 21 nt, Mycobacterium bovis subsp bovis AF2122/97
uccggcaucgagacgcacggc

SEQ ID NO: 3109042 - RNA, 20 nt, Mycobacterium bovis subsp bovis AF2122/97
uccggccacacucgccaggg

SEQ ID NO: 3109043 - RNA, 22 nt, Mycobacterium bovis subsp bovis AF2122/97
uccggccacacucgccagggcc

SEQ ID NO: 3109044 - RNA, 20 nt, Mycobacterium bovis subsp bovis AF2122/97
uccggccacucaacgaccug

SEQ ID NO: 3109045 - RNA, 14 nt, Mycobacterium bovis subsp bovis AF2122/97
uccggccacuccgg

SEQ ID NO: 3109046 - RNA, 21 nt, Mycobacterium bovis subsp bovis AF2122/97
uccggccagacccuggccguc

SEQ ID NO: 3109047 - RNA, 15 nt, Mycobacterium bovis subsp bovis AF2122/97
uccggcccaccagcg

SEQ ID NO: 3109048 - RNA, 17 nt, Mycobacterium bovis subsp bovis AF2122/97
uccggcccaccagcgca

SEQ ID NO: 3109049 - RNA, 12 nt, Mycobacterium bovis subsp bovis AF2122/97
uccggcccccga

SEQ ID NO: 3109050 - RNA, 20 nt, Mycobacterium bovis subsp bovis AF2122/97
uccggcccguagcugcgcag

SEQ ID NO: 3109051 - RNA, 14 nt, Mycobacterium bovis subsp bovis AF2122/97
uccggccgaugcga

SEQ ID NO: 3109052 - RNA, 18 nt, Mycobacterium bovis subsp bovis AF2122/97
uccggccgcacgccgacc

SEQ ID NO: 3109053 - RNA, 21 nt, Mycobacterium bovis subsp bovis AF2122/97
uccggccgccaacuucaccac

SEQ ID NO: 3109054 - RNA, 21 nt, Mycobacterium bovis subsp bovis AF2122/97
uccggccgcguugggguuggc

SEQ ID NO: 3109055 - RNA, 15 nt, Mycobacterium bovis subsp bovis AF2122/97
uccggccggccagca

SEQ ID NO: 3109056 - RNA, 16 nt, Mycobacterium bovis subsp bovis AF2122/97
uccggccggccagcac

SEQ ID NO: 3109057 - RNA, 20 nt, Mycobacterium bovis subsp bovis AF2122/97
uccggccggccuagccgaug

SEQ ID NO: 3109058 - RNA, 19 nt, Mycobacterium bovis subsp bovis AF2122/97
uccggccgguccgggaagu

SEQ ID NO: 3109059 - RNA, 20 nt, Mycobacterium bovis subsp bovis AF2122/97
uccggccgguuggccagcca

SEQ ID NO: 3109060 - RNA, 14 nt, Mycobacterium bovis subsp bovis AF2122/97
uccggccgucggcg

SEQ ID NO: 3109061 - RNA, 17 nt, Mycobacterium bovis subsp bovis AF2122/97
uccggccgucgggcagc

SEQ ID NO: 3109062 - RNA, 22 nt, Mycobacterium bovis subsp bovis AF2122/97
uccggcgaaaagacugcgccgc

SEQ ID NO: 3109063 - RNA, 19 nt, Mycobacterium bovis subsp bovis AF2122/97
uccggcgacgaucucgccg

SEQ ID NO: 3109064 - RNA, 19 nt, Mycobacterium bovis subsp bovis AF2122/97
uccggcgaucaacgcgcac

SEQ ID NO: 3109065 - RNA, 17 nt, Mycobacterium bovis subsp bovis AF2122/97
uccggcgaucucgaccg

SEQ ID NO: 3109066 - RNA, 12 nt, Mycobacterium bovis subsp bovis AF2122/97
uccggcgcaccu

SEQ ID NO: 3109067 - RNA, 17 nt, Mycobacterium bovis subsp bovis AF2122/97
uccggcgcacgaaaccg

SEQ ID NO: 3109068 - RNA, 20 nt, Mycobacterium bovis subsp bovis AF2122/97
uccggcgcagcgaccgguaa

SEQ ID NO: 3109069 - RNA, 17 nt, Mycobacterium bovis subsp bovis AF2122/97
uccggcgcagguucucg

SEQ ID NO: 3109070 - RNA, 13 nt, Mycobacterium bovis subsp bovis AF2122/97
uccggcgcagugc

SEQ ID NO: 3109071 - RNA, 16 nt, Mycobacterium bovis subsp bovis AF2122/97
uccggcgccaccgccg

SEQ ID NO: 3109072 - RNA, 17 nt, Mycobacterium bovis subsp bovis AF2122/97
uccggcgccaccgccgc

SEQ ID NO: 3109073 - RNA, 22 nt, Mycobacterium bovis subsp bovis AF2122/97
uccggcgccaccgccgcugccg

SEQ ID NO: 3109074 - RNA, 21 nt, Mycobacterium bovis subsp bovis AF2122/97
uccggcgccaggaucgaucgu

SEQ ID NO: 3109075 - RNA, 15 nt, Mycobacterium bovis subsp bovis AF2122/97
uccggcgccauucgc

SEQ ID NO: 3109076 - RNA, 12 nt, Mycobacterium bovis subsp bovis AF2122/97
uccggcgccgag

SEQ ID NO: 3109077 - RNA, 20 nt, Mycobacterium bovis subsp bovis AF2122/97
uccggcgccgaggucgaacg

SEQ ID NO: 3109078 - RNA, 14 nt, Mycobacterium bovis subsp bovis AF2122/97
uccggcgcgacgcc

SEQ ID NO: 3109079 - RNA, 15 nt, Mycobacterium bovis subsp bovis AF2122/97
uccggcgcuccgcca

SEQ ID NO: 3109080 - RNA, 21 nt, Mycobacterium bovis subsp bovis AF2122/97
uccggcggacccucgccgaag

SEQ ID NO: 3109081 - RNA, 21 nt, Mycobacterium bovis subsp bovis AF2122/97
uccggcggagcgggccagcac

SEQ ID NO: 3109082 - RNA, 14 nt, Mycobacterium bovis subsp bovis AF2122/97
uccggcggcaggaa

SEQ ID NO: 3109083 - RNA, 17 nt, Mycobacterium bovis subsp bovis AF2122/97
uccggcggccacgccgg

SEQ ID NO: 3109084 - RNA, 18 nt, Mycobacterium bovis subsp bovis AF2122/97
uccggcggccacgccggc

SEQ ID NO: 3109085 - RNA, 23 nt, Mycobacterium bovis subsp bovis AF2122/97
uccggcggcgaagaagccggcaa

SEQ ID NO: 3109086 - RNA, 13 nt, Mycobacterium bovis subsp bovis AF2122/97
uccggcggcggcc

SEQ ID NO: 3109087 - RNA, 16 nt, Mycobacterium bovis subsp bovis AF2122/97
uccggcggcuucgccg

SEQ ID NO: 3109088 - RNA, 12 nt, Mycobacterium bovis subsp bovis AF2122/97
uccggcgguggu

SEQ ID NO: 3109089 - RNA, 21 nt, Mycobacterium bovis subsp bovis AF2122/97
uccggcguacucggugaucgc

SEQ ID NO: 3109090 - RNA, 17 nt, Mycobacterium bovis subsp bovis AF2122/97
uccggcgugcagcaccc

SEQ ID NO: 3109091 - RNA, 19 nt, Mycobacterium bovis subsp bovis AF2122/97
uccggcgugcagcaccccc

SEQ ID NO: 3109092 - RNA, 23 nt, Mycobacterium bovis subsp bovis AF2122/97
uccggcguucccccacucggacc

SEQ ID NO: 3109093 - RNA, 17 nt, Mycobacterium bovis subsp bovis AF2122/97
uccggcucaccgauccc

SEQ ID NO: 3109094 - RNA, 12 nt, Mycobacterium bovis subsp bovis AF2122/97
uccggcugcggg

SEQ ID NO: 3109095 - RNA, 20 nt, Mycobacterium bovis subsp bovis AF2122/97
uccggcuggaagcggcgacu

SEQ ID NO: 3109096 - RNA, 21 nt, Mycobacterium bovis subsp bovis AF2122/97
uccggcuggaagcggcgacua

SEQ ID NO: 3109097 - RNA, 19 nt, Mycobacterium bovis subsp bovis AF2122/97
uccggcuggugggacgcgg

SEQ ID NO: 3109098 - RNA, 22 nt, Mycobacterium bovis subsp bovis AF2122/97
uccggcuggugggacgcggccg

SEQ ID NO: 3109099 - RNA, 15 nt, Mycobacterium bovis subsp bovis AF2122/97
uccggcuucggcgaa

SEQ ID NO: 3109100 - RNA, 23 nt, Mycobacterium bovis subsp bovis AF2122/97
uccggcuucggcgaacccuccgc

SEQ ID NO: 3109101 - RNA, 17 nt, Mycobacterium bovis subsp bovis AF2122/97
uccggcuucguccaccg

SEQ ID NO: 3109102 - RNA, 20 nt, Mycobacterium bovis subsp bovis AF2122/97
uccgggaccggaaacugggg

SEQ ID NO: 3109103 - RNA, 18 nt, Mycobacterium bovis subsp bovis AF2122/97
uccgggacuaccacccgc

SEQ ID NO: 3109104 - RNA, 18 nt, Mycobacterium bovis subsp bovis AF2122/97
uccgggaugucgaagucg

SEQ ID NO: 3109105 - RNA, 14 nt, Mycobacterium bovis subsp bovis AF2122/97
uccgggcagaugau

SEQ ID NO: 3109106 - RNA, 20 nt, Mycobacterium bovis subsp bovis AF2122/97
uccgggcagccgcgccgcgg

SEQ ID NO: 3109107 - RNA, 16 nt, Mycobacterium bovis subsp bovis AF2122/97
uccgggccaugugggg

SEQ ID NO: 3109108 - RNA, 15 nt, Mycobacterium bovis subsp bovis AF2122/97
uccgggcccaucgcc

SEQ ID NO: 3109109 - RNA, 16 nt, Mycobacterium bovis subsp bovis AF2122/97
uccgggccccacggcg

SEQ ID NO: 3109110 - RNA, 14 nt, Mycobacterium bovis subsp bovis AF2122/97
uccgggccgagcgc

SEQ ID NO: 3109111 - RNA, 20 nt, Mycobacterium bovis subsp bovis AF2122/97
uccgggccgaucaccccggu

SEQ ID NO: 3109112 - RNA, 23 nt, Mycobacterium bovis subsp bovis AF2122/97
uccgggccgaucaccccggugga

SEQ ID NO: 3109113 - RNA, 22 nt, Mycobacterium bovis subsp bovis AF2122/97
uccgggccgcggccacaucgcc

SEQ ID NO: 3109114 - RNA, 23 nt, Mycobacterium bovis subsp bovis AF2122/97
uccgggccuggccugcccagcac

SEQ ID NO: 3109115 - RNA, 18 nt, Mycobacterium bovis subsp bovis AF2122/97
uccgggcgaccaccaccg

SEQ ID NO: 3109116 - RNA, 18 nt, Mycobacterium bovis subsp bovis AF2122/97
uccgggcucggcgucgcc

SEQ ID NO: 3109117 - RNA, 19 nt, Mycobacterium bovis subsp bovis AF2122/97
uccggggaaagccgcagcc

SEQ ID NO: 3109118 - RNA, 14 nt, Mycobacterium bovis subsp bovis AF2122/97
uccggggcccggac

SEQ ID NO: 3109119 - RNA, 19 nt, Mycobacterium bovis subsp bovis AF2122/97
uccggggccgcggcccacu

SEQ ID NO: 3109120 - RNA, 17 nt, Mycobacterium bovis subsp bovis AF2122/97
uccggggggauccagca

SEQ ID NO: 3109121 - RNA, 19 nt, Mycobacterium bovis subsp bovis AF2122/97
uccgggguaucgacccucc

SEQ ID NO: 3109122 - RNA, 14 nt, Mycobacterium bovis subsp bovis AF2122/97
uccggguagcggcg

SEQ ID NO: 3109123 - RNA, 21 nt, Mycobacterium bovis subsp bovis AF2122/97
uccggguauggcggcgacggc

SEQ ID NO: 3109124 - RNA, 16 nt, Mycobacterium bovis subsp bovis AF2122/97
uccgggucaccagcgc

SEQ ID NO: 3109125 - RNA, 19 nt, Mycobacterium bovis subsp bovis AF2122/97
uccgggucaccagcgcauc

SEQ ID NO: 3109126 - RNA, 13 nt, Mycobacterium bovis subsp bovis AF2122/97
uccgggucgacga

SEQ ID NO: 3109127 - RNA, 15 nt, Mycobacterium bovis subsp bovis AF2122/97
uccgggucgacgacg

SEQ ID NO: 3109128 - RNA, 17 nt, Mycobacterium bovis subsp bovis AF2122/97
uccgggucgacgacguc

SEQ ID NO: 3109129 - RNA, 12 nt, Mycobacterium bovis subsp bovis AF2122/97
uccgggugcaga

SEQ ID NO: 3109130 - RNA, 16 nt, Mycobacterium bovis subsp bovis AF2122/97
uccgggugcagaucgc

SEQ ID NO: 3109131 - RNA, 18 nt, Mycobacterium bovis subsp bovis AF2122/97
uccgggugccggugcgcu

SEQ ID NO: 3109132 - RNA, 15 nt, Mycobacterium bovis subsp bovis AF2122/97
uccggguuggccacc

SEQ ID NO: 3109133 - RNA, 14 nt, Mycobacterium bovis subsp bovis AF2122/97
uccgguagcagcgc

SEQ ID NO: 3109134 - RNA, 16 nt, Mycobacterium bovis subsp bovis AF2122/97
uccggucagcgcggcg

SEQ ID NO: 3109135 - RNA, 17 nt, Mycobacterium bovis subsp bovis AF2122/97
uccggucagcgcggcgc

SEQ ID NO: 3109136 - RNA, 13 nt, Mycobacterium bovis subsp bovis AF2122/97
uccgguccagcgg

SEQ ID NO: 3109137 - RNA, 16 nt, Mycobacterium bovis subsp bovis AF2122/97
uccgguccagcggccg

SEQ ID NO: 3109138 - RNA, 17 nt, Mycobacterium bovis subsp bovis AF2122/97
uccgguccagcggccgc

SEQ ID NO: 3109139 - RNA, 22 nt, Mycobacterium bovis subsp bovis AF2122/97
uccgguccagcggccgccgcgg

SEQ ID NO: 3109140 - RNA, 21 nt, Mycobacterium bovis subsp bovis AF2122/97
uccggucccgccgugccgcgg

SEQ ID NO: 3109141 - RNA, 16 nt, Mycobacterium bovis subsp bovis AF2122/97
uccgguccgccagcgc

SEQ ID NO: 3109142 - RNA, 18 nt, Mycobacterium bovis subsp bovis AF2122/97
uccggucgacuccagcac

SEQ ID NO: 3109143 - RNA, 23 nt, Mycobacterium bovis subsp bovis AF2122/97
uccggucgacuccagcaccagca

SEQ ID NO: 3109144 - RNA, 22 nt, Mycobacterium bovis subsp bovis AF2122/97
uccggucgccucaccggcgcga

SEQ ID NO: 3109145 - RNA, 16 nt, Mycobacterium bovis subsp bovis AF2122/97
uccggucgcuccgggu

SEQ ID NO: 3109146 - RNA, 17 nt, Mycobacterium bovis subsp bovis AF2122/97
uccggucggccaggccg

SEQ ID NO: 3109147 - RNA, 16 nt, Mycobacterium bovis subsp bovis AF2122/97
uccggucggcgggcac

SEQ ID NO: 3109148 - RNA, 19 nt, Mycobacterium bovis subsp bovis AF2122/97
uccggugaucgcgguggcg

SEQ ID NO: 3109149 - RNA, 12 nt, Mycobacterium bovis subsp bovis AF2122/97
uccggugccgcg

SEQ ID NO: 3109150 - RNA, 19 nt, Mycobacterium bovis subsp bovis AF2122/97
uccggugccgcgaucgcgg

SEQ ID NO: 3109151 - RNA, 14 nt, Mycobacterium bovis subsp bovis AF2122/97
uccggugcgcagcc

SEQ ID NO: 3109152 - RNA, 17 nt, Mycobacterium bovis subsp bovis AF2122/97
uccggugcgccgauccc

SEQ ID NO: 3109153 - RNA, 22 nt, Mycobacterium bovis subsp bovis AF2122/97
uccggugcgccgaucccgccca

SEQ ID NO: 3109154 - RNA, 21 nt, Mycobacterium bovis subsp bovis AF2122/97
uccgguggaauccaccagccg

SEQ ID NO: 3109155 - RNA, 14 nt, Mycobacterium bovis subsp bovis AF2122/97
uccgguggaccgcc

SEQ ID NO: 3109156 - RNA, 19 nt, Mycobacterium bovis subsp bovis AF2122/97
uccgguggacgaucuggca

SEQ ID NO: 3109157 - RNA, 21 nt, Mycobacterium bovis subsp bovis AF2122/97
uccgguggccaacaccgccag

SEQ ID NO: 3109158 - RNA, 23 nt, Mycobacterium bovis subsp bovis AF2122/97
uccgguggccaacaccgccagca

SEQ ID NO: 3109159 - RNA, 21 nt, Mycobacterium bovis subsp bovis AF2122/97
uccgguguaggccugcccccg

SEQ ID NO: 3109160 - RNA, 19 nt, Mycobacterium bovis subsp bovis AF2122/97
uccggugucggugcgcggc

SEQ ID NO: 3109161 - RNA, 19 nt, Mycobacterium bovis subsp bovis AF2122/97
uccgguguggcgcugaucg

SEQ ID NO: 3109162 - RNA, 22 nt, Mycobacterium bovis subsp bovis AF2122/97
uccgguguggcgcugaucggca

SEQ ID NO: 3109163 - RNA, 18 nt, Mycobacterium bovis subsp bovis AF2122/97
uccgguguugagaucgcc

SEQ ID NO: 3109164 - RNA, 14 nt, Mycobacterium bovis subsp bovis AF2122/97
uccgguuacgcucg

SEQ ID NO: 3109165 - RNA, 15 nt, Mycobacterium bovis subsp bovis AF2122/97
uccgguucaucggca

SEQ ID NO: 3109166 - RNA, 16 nt, Mycobacterium bovis subsp bovis AF2122/97
uccgguucaucggcau

SEQ ID NO: 3109167 - RNA, 15 nt, Mycobacterium bovis subsp bovis AF2122/97
uccgguucgccgccg

SEQ ID NO: 3109168 - RNA, 15 nt, Mycobacterium bovis subsp bovis AF2122/97
uccgguucugggccu

SEQ ID NO: 3109169 - RNA, 12 nt, Mycobacterium bovis subsp bovis AF2122/97
uccgguuucggg

SEQ ID NO: 3109170 - RNA, 15 nt, Mycobacterium bovis subsp bovis AF2122/97
uccgguuucgggugc

SEQ ID NO: 3109171 - RNA, 16 nt, Mycobacterium bovis subsp bovis AF2122/97
uccguacuugccaccc

SEQ ID NO: 3109172 - RNA, 22 nt, Mycobacterium bovis subsp bovis AF2122/97
uccguagacggggugagccgac

SEQ ID NO: 3109173 - RNA, 14 nt, Mycobacterium bovis subsp bovis AF2122/97
uccguagccggcgg

SEQ ID NO: 3109174 - RNA, 20 nt, Mycobacterium bovis subsp bovis AF2122/97
uccguagccggcgguggggc

SEQ ID NO: 3109175 - RNA, 16 nt, Mycobacterium bovis subsp bovis AF2122/97
uccguccccgcagcgc

SEQ ID NO: 3109176 - RNA, 19 nt, Mycobacterium bovis subsp bovis AF2122/97
uccgucgacaccgcggacc

SEQ ID NO: 3109177 - RNA, 17 nt, Mycobacterium bovis subsp bovis AF2122/97
uccgucgagucgccgag

SEQ ID NO: 3109178 - RNA, 17 nt, Mycobacterium bovis subsp bovis AF2122/97
uccgucgauggaccgca

SEQ ID NO: 3109179 - RNA, 14 nt, Mycobacterium bovis subsp bovis AF2122/97
uccgucgccgaaca

SEQ ID NO: 3109180 - RNA, 22 nt, Mycobacterium bovis subsp bovis AF2122/97
uccgucgcggccgagacggcgu

SEQ ID NO: 3109181 - RNA, 14 nt, Mycobacterium bovis subsp bovis AF2122/97
uccgucggccaggc

SEQ ID NO: 3109182 - RNA, 15 nt, Mycobacterium bovis subsp bovis AF2122/97
uccgucggccaggcc

SEQ ID NO: 3109183 - RNA, 19 nt, Mycobacterium bovis subsp bovis AF2122/97
uccgucggccaggccacgg

SEQ ID NO: 3109184 - RNA, 19 nt, Mycobacterium bovis subsp bovis AF2122/97
uccgucggggacauccgcu

SEQ ID NO: 3109185 - RNA, 17 nt, Mycobacterium bovis subsp bovis AF2122/97
uccgugaauggcagcac

SEQ ID NO: 3109186 - RNA, 23 nt, Mycobacterium bovis subsp bovis AF2122/97
uccgugaauggcagcacgaccug

SEQ ID NO: 3109187 - RNA, 18 nt, Mycobacterium bovis subsp bovis AF2122/97
uccgugagccggaccggc

SEQ ID NO: 3109188 - RNA, 20 nt, Mycobacterium bovis subsp bovis AF2122/97
uccgugagccggaccggcuu

SEQ ID NO: 3109189 - RNA, 24 nt, Mycobacterium bovis subsp bovis AF2122/97
uccgugccgagcuucagcgcgcug

SEQ ID NO: 3109190 - RNA, 17 nt, Mycobacterium bovis subsp bovis AF2122/97
uccgugccgaugccggc

SEQ ID NO: 3109191 - RNA, 22 nt, Mycobacterium bovis subsp bovis AF2122/97
uccgugcgggucguccgccugc

SEQ ID NO: 3109192 - RNA, 20 nt, Mycobacterium bovis subsp bovis AF2122/97
uccgugggcagcgcgcccga

SEQ ID NO: 3109193 - RNA, 16 nt, Mycobacterium bovis subsp bovis AF2122/97
uccgugguugccgaag

SEQ ID NO: 3109194 - RNA, 14 nt, Mycobacterium bovis subsp bovis AF2122/97
uccguucgaugcca

SEQ ID NO: 3109195 - RNA, 23 nt, Mycobacterium bovis subsp bovis AF2122/97
uccguugagguaggugagcgcgc

SEQ ID NO: 3109196 - RNA, 13 nt, Mycobacterium bovis subsp bovis AF2122/97
uccguugccccca

SEQ ID NO: 3109197 - RNA, 17 nt, Mycobacterium bovis subsp bovis AF2122/97
uccguuuggcugccgaa

SEQ ID NO: 3109198 - RNA, 20 nt, Mycobacterium bovis subsp bovis AF2122/97
uccucaaggucggccaggcu

SEQ ID NO: 3109199 - RNA, 23 nt, Mycobacterium bovis subsp bovis AF2122/97
uccucagccaucucuugcaaccu

SEQ ID NO: 3109200 - RNA, 16 nt, Mycobacterium bovis subsp bovis AF2122/97
uccucagccgccuguc

SEQ ID NO: 3109201 - RNA, 19 nt, Mycobacterium bovis subsp bovis AF2122/97
uccucauagagcggcacca

SEQ ID NO: 3109202 - RNA, 19 nt, Mycobacterium bovis subsp bovis AF2122/97
uccuccacuuuuccgccgg

SEQ ID NO: 3109203 - RNA, 13 nt, Mycobacterium bovis subsp bovis AF2122/97
uccuccagcagcg

SEQ ID NO: 3109204 - RNA, 18 nt, Mycobacterium bovis subsp bovis AF2122/97
uccucccauucccaacac

SEQ ID NO: 3109205 - RNA, 13 nt, Mycobacterium bovis subsp bovis AF2122/97
uccuccccgaccg

SEQ ID NO: 3109206 - RNA, 14 nt, Mycobacterium bovis subsp bovis AF2122/97
uccuccccgaccgc

SEQ ID NO: 3109207 - RNA, 13 nt, Mycobacterium bovis subsp bovis AF2122/97
uccuccgacgcga

SEQ ID NO: 3109208 - RNA, 17 nt, Mycobacterium bovis subsp bovis AF2122/97
uccuccggaaagcucuc

SEQ ID NO: 3109209 - RNA, 22 nt, Mycobacterium bovis subsp bovis AF2122/97
uccuccggcaccaacgccaccg

SEQ ID NO: 3109210 - RNA, 20 nt, Mycobacterium bovis subsp bovis AF2122/97
uccuccgggcagucgagugc

SEQ ID NO: 3109211 - RNA, 14 nt, Mycobacterium bovis subsp bovis AF2122/97
uccuccggguuggc

SEQ ID NO: 3109212 - RNA, 18 nt, Mycobacterium bovis subsp bovis AF2122/97
uccuccgguaucggcgac

SEQ ID NO: 3109213 - RNA, 19 nt, Mycobacterium bovis subsp bovis AF2122/97
uccuccguuuggcugccga

SEQ ID NO: 3109214 - RNA, 15 nt, Mycobacterium bovis subsp bovis AF2122/97
uccuccugcgccgca

SEQ ID NO: 3109215 - RNA, 14 nt, Mycobacterium bovis subsp bovis AF2122/97
uccucgaagaacug

SEQ ID NO: 3109216 - RNA, 22 nt, Mycobacterium bovis subsp bovis AF2122/97
uccucgaaggcguucgacucga

SEQ ID NO: 3109217 - RNA, 11 nt, Mycobacterium bovis subsp bovis AF2122/97
uccucgacgag

SEQ ID NO: 3109218 - RNA, 13 nt, Mycobacterium bovis subsp bovis AF2122/97
uccucgacgucgg

SEQ ID NO: 3109219 - RNA, 17 nt, Mycobacterium bovis subsp bovis AF2122/97
uccucgacgucggcgag

SEQ ID NO: 3109220 - RNA, 16 nt, Mycobacterium bovis subsp bovis AF2122/97
uccucgagguccucgu

SEQ ID NO: 3109221 - RNA, 21 nt, Mycobacterium bovis subsp bovis AF2122/97
uccucgaguacccaaccggua

SEQ ID NO: 3109222 - RNA, 17 nt, Mycobacterium bovis subsp bovis AF2122/97
uccucgagugccgccgu

SEQ ID NO: 3109223 - RNA, 22 nt, Mycobacterium bovis subsp bovis AF2122/97
uccucgagugccgccgucgcca

SEQ ID NO: 3109224 - RNA, 17 nt, Mycobacterium bovis subsp bovis AF2122/97
uccucgauagcggcgcc

SEQ ID NO: 3109225 - RNA, 19 nt, Mycobacterium bovis subsp bovis AF2122/97
uccucgauagcggcgccug

SEQ ID NO: 3109226 - RNA, 19 nt, Mycobacterium bovis subsp bovis AF2122/97
uccucgauauggguugcca

SEQ ID NO: 3109227 - RNA, 22 nt, Mycobacterium bovis subsp bovis AF2122/97
uccucgauauggguugccagcg

SEQ ID NO: 3109228 - RNA, 22 nt, Mycobacterium bovis subsp bovis AF2122/97
uccucgaucagacgcucgaccu

SEQ ID NO: 3109229 - RNA, 11 nt, Mycobacterium bovis subsp bovis AF2122/97
uccucgaucgu

SEQ ID NO: 3109230 - RNA, 18 nt, Mycobacterium bovis subsp bovis AF2122/97
uccucgaucgucgacgcg

SEQ ID NO: 3109231 - RNA, 20 nt, Mycobacterium bovis subsp bovis AF2122/97
uccucgcccauuggccaggu

SEQ ID NO: 3109232 - RNA, 14 nt, Mycobacterium bovis subsp bovis AF2122/97
uccucgccgcacgc

SEQ ID NO: 3109233 - RNA, 19 nt, Mycobacterium bovis subsp bovis AF2122/97
uccucgccgcacgccggca

SEQ ID NO: 3109234 - RNA, 16 nt, Mycobacterium bovis subsp bovis AF2122/97
uccucgcgaaaccgcc

SEQ ID NO: 3109235 - RNA, 13 nt, Mycobacterium bovis subsp bovis AF2122/97
uccucgcugucga

SEQ ID NO: 3109236 - RNA, 17 nt, Mycobacterium bovis subsp bovis AF2122/97
uccucggauugcagcgc

SEQ ID NO: 3109237 - RNA, 15 nt, Mycobacterium bovis subsp bovis AF2122/97
uccucggccacccgc

SEQ ID NO: 3109238 - RNA, 21 nt, Mycobacterium bovis subsp bovis AF2122/97
uccucggcguggcaguacacc

SEQ ID NO: 3109239 - RNA, 20 nt, Mycobacterium bovis subsp bovis AF2122/97
uccucggguucgucagucaa

SEQ ID NO: 3109240 - RNA, 18 nt, Mycobacterium bovis subsp bovis AF2122/97
uccucggucaccgagggc

SEQ ID NO: 3109241 - RNA, 13 nt, Mycobacterium bovis subsp bovis AF2122/97
uccucggucagcu

SEQ ID NO: 3109242 - RNA, 22 nt, Mycobacterium bovis subsp bovis AF2122/97
uccucggugugcucgccgacca

SEQ ID NO: 3109243 - RNA, 20 nt, Mycobacterium bovis subsp bovis AF2122/97
uccucguagacgaaacggcc

SEQ ID NO: 3109244 - RNA, 13 nt, Mycobacterium bovis subsp bovis AF2122/97
uccucgucgaggu

SEQ ID NO: 3109245 - RNA, 19 nt, Mycobacterium bovis subsp bovis AF2122/97
uccucgucggcgucgagcu

SEQ ID NO: 3109246 - RNA, 13 nt, Mycobacterium bovis subsp bovis AF2122/97
uccucgucgucga

SEQ ID NO: 3109247 - RNA, 18 nt, Mycobacterium bovis subsp bovis AF2122/97
uccucgugcucggccaga

SEQ ID NO: 3109248 - RNA, 22 nt, Mycobacterium bovis subsp bovis AF2122/97
uccucuugcaccagggccucga

SEQ ID NO: 3109249 - RNA, 16 nt, Mycobacterium bovis subsp bovis AF2122/97
uccucuuggguccaca

SEQ ID NO: 3109250 - RNA, 14 nt, Mycobacterium bovis subsp bovis AF2122/97
uccugaaaacaccg

SEQ ID NO: 3109251 - RNA, 17 nt, Mycobacterium bovis subsp bovis AF2122/97
uccugaaaacaccgcac

SEQ ID NO: 3109252 - RNA, 21 nt, Mycobacterium bovis subsp bovis AF2122/97
uccugaaucgguucggccaga

SEQ ID NO: 3109253 - RNA, 20 nt, Mycobacterium bovis subsp bovis AF2122/97
uccugauccgccugccgacg

SEQ ID NO: 3109254 - RNA, 20 nt, Mycobacterium bovis subsp bovis AF2122/97
uccugcaagaaccacugcau

SEQ ID NO: 3109255 - RNA, 19 nt, Mycobacterium bovis subsp bovis AF2122/97
uccugcagcccgggcagca

SEQ ID NO: 3109256 - RNA, 17 nt, Mycobacterium bovis subsp bovis AF2122/97
uccugcagcucgggcag

SEQ ID NO: 3109257 - RNA, 21 nt, Mycobacterium bovis subsp bovis AF2122/97
uccugcagcuggcgaaugcgg

SEQ ID NO: 3109258 - RNA, 19 nt, Mycobacterium bovis subsp bovis AF2122/97
uccugcaggaucaaaaccu

SEQ ID NO: 3109259 - RNA, 17 nt, Mycobacterium bovis subsp bovis AF2122/97
uccugcagugcggcguu

SEQ ID NO: 3109260 - RNA, 19 nt, Mycobacterium bovis subsp bovis AF2122/97
uccugccaaugcugcaggu

SEQ ID NO: 3109261 - RNA, 17 nt, Mycobacterium bovis subsp bovis AF2122/97
uccugccagaagaccug

SEQ ID NO: 3109262 - RNA, 20 nt, Mycobacterium bovis subsp bovis AF2122/97
uccugcccaccaucccgcuc

SEQ ID NO: 3109263 - RNA, 15 nt, Mycobacterium bovis subsp bovis AF2122/97
uccugcccuccgugg

SEQ ID NO: 3109264 - RNA, 22 nt, Mycobacterium bovis subsp bovis AF2122/97
uccugcgagugcggcacgaucg

SEQ ID NO: 3109265 - RNA, 14 nt, Mycobacterium bovis subsp bovis AF2122/97
uccugcgcugcacc

SEQ ID NO: 3109266 - RNA, 13 nt, Mycobacterium bovis subsp bovis AF2122/97
uccugcggcaccg

SEQ ID NO: 3109267 - RNA, 17 nt, Mycobacterium bovis subsp bovis AF2122/97
uccugcggcaccgcuga

SEQ ID NO: 3109268 - RNA, 18 nt, Mycobacterium bovis subsp bovis AF2122/97
uccugcgucaaguccgag

SEQ ID NO: 3109269 - RNA, 20 nt, Mycobacterium bovis subsp bovis AF2122/97
uccugcugugggauucgggu

SEQ ID NO: 3109270 - RNA, 18 nt, Mycobacterium bovis subsp bovis AF2122/97
uccugcuuguagcgcauc

SEQ ID NO: 3109271 - RNA, 22 nt, Mycobacterium bovis subsp bovis AF2122/97
uccuggauaugcuccggccgca

SEQ ID NO: 3109272 - RNA, 18 nt, Mycobacterium bovis subsp bovis AF2122/97
uccuggaucgcggugggc

SEQ ID NO: 3109273 - RNA, 18 nt, Mycobacterium bovis subsp bovis AF2122/97
uccuggccacucccagcc

SEQ ID NO: 3109274 - RNA, 15 nt, Mycobacterium bovis subsp bovis AF2122/97
uccuggccgccgccc

SEQ ID NO: 3109275 - RNA, 22 nt, Mycobacterium bovis subsp bovis AF2122/97
uccuggccgccgccccggcgcu

SEQ ID NO: 3109276 - RNA, 14 nt, Mycobacterium bovis subsp bovis AF2122/97
uccuggcgugagcc

SEQ ID NO: 3109277 - RNA, 18 nt, Mycobacterium bovis subsp bovis AF2122/97
uccugggauccggcggca

SEQ ID NO: 3109278 - RNA, 19 nt, Mycobacterium bovis subsp bovis AF2122/97
uccugggauccggcggcag

SEQ ID NO: 3109279 - RNA, 13 nt, Mycobacterium bovis subsp bovis AF2122/97
uccugggccgccg

SEQ ID NO: 3109280 - RNA, 21 nt, Mycobacterium bovis subsp bovis AF2122/97
uccugggccgccgcccugguc

SEQ ID NO: 3109281 - RNA, 15 nt, Mycobacterium bovis subsp bovis AF2122/97
uccuggucaaccgcg

SEQ ID NO: 3109282 - RNA, 16 nt, Mycobacterium bovis subsp bovis AF2122/97
uccuggucgagcacgc

SEQ ID NO: 3109283 - RNA, 13 nt, Mycobacterium bovis subsp bovis AF2122/97
uccuggucgccgu

SEQ ID NO: 3109284 - RNA, 15 nt, Mycobacterium bovis subsp bovis AF2122/97
uccuggugagauugg

SEQ ID NO: 3109285 - RNA, 18 nt, Mycobacterium bovis subsp bovis AF2122/97
uccugguguucgggcagc

SEQ ID NO: 3109286 - RNA, 16 nt, Mycobacterium bovis subsp bovis AF2122/97
uccuguccgggcugca

SEQ ID NO: 3109287 - RNA, 17 nt, Mycobacterium bovis subsp bovis AF2122/97
uccugugcggagccgcc

SEQ ID NO: 3109288 - RNA, 15 nt, Mycobacterium bovis subsp bovis AF2122/97
uccuucagccagucc

SEQ ID NO: 3109289 - RNA, 19 nt, Mycobacterium bovis subsp bovis AF2122/97
uccuucagggcgucgaacu

SEQ ID NO: 3109290 - RNA, 14 nt, Mycobacterium bovis subsp bovis AF2122/97
uccuuccuggguug

SEQ ID NO: 3109291 - RNA, 18 nt, Mycobacterium bovis subsp bovis AF2122/97
uccuucgaaugccgugcc

SEQ ID NO: 3109292 - RNA, 21 nt, Mycobacterium bovis subsp bovis AF2122/97
uccuucuccagauccacgccg

SEQ ID NO: 3109293 - RNA, 22 nt, Mycobacterium bovis subsp bovis AF2122/97
uccuucucgcggaccucggcga

SEQ ID NO: 3109294 - RNA, 19 nt, Mycobacterium bovis subsp bovis AF2122/97
uccuucuuguuggucccga

SEQ ID NO: 3109295 - RNA, 20 nt, Mycobacterium bovis subsp bovis AF2122/97
uccuugagcaaugacccgcg

SEQ ID NO: 3109296 - RNA, 19 nt, Mycobacterium bovis subsp bovis AF2122/97
uccuugaggucacccauca

SEQ ID NO: 3109297 - RNA, 21 nt, Mycobacterium bovis subsp bovis AF2122/97
uccuugaucaaggugucgacg

SEQ ID NO: 3109298 - RNA, 22 nt, Mycobacterium bovis subsp bovis AF2122/97
uccuugcgcagcaccagggugg

SEQ ID NO: 3109299 - RNA, 17 nt, Mycobacterium bovis subsp bovis AF2122/97
uccuugcgguccaggcc

SEQ ID NO: 3109300 - RNA, 18 nt, Mycobacterium bovis subsp bovis AF2122/97
uccuugcgguccaggccg

SEQ ID NO: 3109301 - RNA, 21 nt, Mycobacterium bovis subsp bovis AF2122/97
uccuuggcuaacaccgcaggc

SEQ ID NO: 3109302 - RNA, 16 nt, Mycobacterium bovis subsp bovis AF2122/97
uccuugggcgacgcgg

SEQ ID NO: 3109303 - RNA, 13 nt, Mycobacterium bovis subsp bovis AF2122/97
uccuugucgaccc

SEQ ID NO: 3109304 - RNA, 13 nt, Mycobacterium bovis subsp bovis AF2122/97
uccuugucggccc

SEQ ID NO: 3109305 - RNA, 22 nt, Mycobacterium bovis subsp bovis AF2122/97
uccuugucggccccggccgcgu

SEQ ID NO: 3109306 - RNA, 13 nt, Mycobacterium bovis subsp bovis AF2122/97
ucgaaaacagcga

SEQ ID NO: 3109307 - RNA, 18 nt, Mycobacterium bovis subsp bovis AF2122/97
ucgaaaacagcgauccga

SEQ ID NO: 3109308 - RNA, 18 nt, Mycobacterium bovis subsp bovis AF2122/97
ucgaaaaggugcaccauu

SEQ ID NO: 3109309 - RNA, 21 nt, Mycobacterium bovis subsp bovis AF2122/97
ucgaaaccgcccguauugaug

SEQ ID NO: 3109310 - RNA, 16 nt, Mycobacterium bovis subsp bovis AF2122/97
ucgaaaucgcacagcg

SEQ ID NO: 3109311 - RNA, 21 nt, Mycobacterium bovis subsp bovis AF2122/97
ucgaacaccguccaauuggcg

SEQ ID NO: 3109312 - RNA, 16 nt, Mycobacterium bovis subsp bovis AF2122/97
ucgaacagcaccgccg

SEQ ID NO: 3109313 - RNA, 21 nt, Mycobacterium bovis subsp bovis AF2122/97
ucgaacagcgaaccggcuggg

SEQ ID NO: 3109314 - RNA, 18 nt, Mycobacterium bovis subsp bovis AF2122/97
ucgaacaggaucagcgac

SEQ ID NO: 3109315 - RNA, 15 nt, Mycobacterium bovis subsp bovis AF2122/97
ucgaacaggccggcc

SEQ ID NO: 3109316 - RNA, 17 nt, Mycobacterium bovis subsp bovis AF2122/97
ucgaacaggccggccgc

SEQ ID NO: 3109317 - RNA, 17 nt, Mycobacterium bovis subsp bovis AF2122/97
ucgaacaucaucggguc

SEQ ID NO: 3109318 - RNA, 18 nt, Mycobacterium bovis subsp bovis AF2122/97
ucgaaccagaggucacgc

SEQ ID NO: 3109319 - RNA, 16 nt, Mycobacterium bovis subsp bovis AF2122/97
ucgaacgcagccagcg

SEQ ID NO: 3109320 - RNA, 14 nt, Mycobacterium bovis subsp bovis AF2122/97
ucgaacgccgcccg

SEQ ID NO: 3109321 - RNA, 15 nt, Mycobacterium bovis subsp bovis AF2122/97
ucgaacgcugaggaa

SEQ ID NO: 3109322 - RNA, 15 nt, Mycobacterium bovis subsp bovis AF2122/97
ucgaacggcuuggcg

SEQ ID NO: 3109323 - RNA, 20 nt, Mycobacterium bovis subsp bovis AF2122/97
ucgaacuccccggucgccgc

SEQ ID NO: 3109324 - RNA, 13 nt, Mycobacterium bovis subsp bovis AF2122/97
ucgaacugccgga

SEQ ID NO: 3109325 - RNA, 13 nt, Mycobacterium bovis subsp bovis AF2122/97
ucgaacugggggc

SEQ ID NO: 3109326 - RNA, 17 nt, Mycobacterium bovis subsp bovis AF2122/97
ucgaacugggggccggc

SEQ ID NO: 3109327 - RNA, 20 nt, Mycobacterium bovis subsp bovis AF2122/97
ucgaacugguuucgcaccgu

SEQ ID NO: 3109328 - RNA, 18 nt, Mycobacterium bovis subsp bovis AF2122/97
ucgaacuugaucaccgcg

SEQ ID NO: 3109329 - RNA, 13 nt, Mycobacterium bovis subsp bovis AF2122/97
ucgaagaaccggc

SEQ ID NO: 3109330 - RNA, 15 nt, Mycobacterium bovis subsp bovis AF2122/97
ucgaagaaccggccg

SEQ ID NO: 3109331 - RNA, 20 nt, Mycobacterium bovis subsp bovis AF2122/97
ucgaagaaccggccgacgaa

SEQ ID NO: 3109332 - RNA, 24 nt, Mycobacterium bovis subsp bovis AF2122/97
ucgaagaaccugagcaccaagacc

SEQ ID NO: 3109333 - RNA, 20 nt, Mycobacterium bovis subsp bovis AF2122/97
ucgaagaccgccuccaccgc

SEQ ID NO: 3109334 - RNA, 17 nt, Mycobacterium bovis subsp bovis AF2122/97
ucgaagaccucgucgcg

SEQ ID NO: 3109335 - RNA, 21 nt, Mycobacterium bovis subsp bovis AF2122/97
ucgaagaccucgucgcgucgc

SEQ ID NO: 3109336 - RNA, 18 nt, Mycobacterium bovis subsp bovis AF2122/97
ucgaagacgaacgugucg

SEQ ID NO: 3109337 - RNA, 22 nt, Mycobacterium bovis subsp bovis AF2122/97
ucgaagacgaacgugucgggug

SEQ ID NO: 3109338 - RNA, 19 nt, Mycobacterium bovis subsp bovis AF2122/97
ucgaagaucgccugggggu

SEQ ID NO: 3109339 - RNA, 22 nt, Mycobacterium bovis subsp bovis AF2122/97
ucgaagcccgaguugaaggugc

SEQ ID NO: 3109340 - RNA, 13 nt, Mycobacterium bovis subsp bovis AF2122/97
ucgaagcccggcg

SEQ ID NO: 3109341 - RNA, 14 nt, Mycobacterium bovis subsp bovis AF2122/97
ucgaagcccggcgg

SEQ ID NO: 3109342 - RNA, 20 nt, Mycobacterium bovis subsp bovis AF2122/97
ucgaagcgaucgccggccgc

SEQ ID NO: 3109343 - RNA, 14 nt, Mycobacterium bovis subsp bovis AF2122/97
ucgaagcggcugcu

SEQ ID NO: 3109344 - RNA, 23 nt, Mycobacterium bovis subsp bovis AF2122/97
ucgaagcgggcuugagcgccgau

SEQ ID NO: 3109345 - RNA, 19 nt, Mycobacterium bovis subsp bovis AF2122/97
ucgaaggcacugcgaucgc

SEQ ID NO: 3109346 - RNA, 20 nt, Mycobacterium bovis subsp bovis AF2122/97
ucgaagggcuugucgccggc

SEQ ID NO: 3109347 - RNA, 13 nt, Mycobacterium bovis subsp bovis AF2122/97
ucgaaguaauagc

SEQ ID NO: 3109348 - RNA, 19 nt, Mycobacterium bovis subsp bovis AF2122/97
ucgaaguccgcuugggcgg

SEQ ID NO: 3109349 - RNA, 18 nt, Mycobacterium bovis subsp bovis AF2122/97
ucgaagugcaggugcggg

SEQ ID NO: 3109350 - RNA, 17 nt, Mycobacterium bovis subsp bovis AF2122/97
ucgaaguucucggugcg

SEQ ID NO: 3109351 - RNA, 22 nt, Mycobacterium bovis subsp bovis AF2122/97
ucgaauagguguguggcgccgg

SEQ ID NO: 3109352 - RNA, 23 nt, Mycobacterium bovis subsp bovis AF2122/97
ucgaauaguugaccaggccgaca

SEQ ID NO: 3109353 - RNA, 15 nt, Mycobacterium bovis subsp bovis AF2122/97
ucgaauuaaagccac

SEQ ID NO: 3109354 - RNA, 14 nt, Mycobacterium bovis subsp bovis AF2122/97
ucgaauuccggcuc

SEQ ID NO: 3109355 - RNA, 16 nt, Mycobacterium bovis subsp bovis AF2122/97
ucgacaaaccacagac

SEQ ID NO: 3109356 - RNA, 24 nt, Mycobacterium bovis subsp bovis AF2122/97
ucgacaaaccacagacugcgcggc

SEQ ID NO: 3109357 - RNA, 15 nt, Mycobacterium bovis subsp bovis AF2122/97
ucgacaaagcggcug

SEQ ID NO: 3109358 - RNA, 16 nt, Mycobacterium bovis subsp bovis AF2122/97
ucgacaaagcggcugc

SEQ ID NO: 3109359 - RNA, 21 nt, Mycobacterium bovis subsp bovis AF2122/97
ucgacaaagcggcugcccgag

SEQ ID NO: 3109360 - RNA, 16 nt, Mycobacterium bovis subsp bovis AF2122/97
ucgacaaccgcugccg

SEQ ID NO: 3109361 - RNA, 17 nt, Mycobacterium bovis subsp bovis AF2122/97
ucgacaacgaucgcgcg

SEQ ID NO: 3109362 - RNA, 19 nt, Mycobacterium bovis subsp bovis AF2122/97
ucgacaacgaucgcgcgag

SEQ ID NO: 3109363 - RNA, 20 nt, Mycobacterium bovis subsp bovis AF2122/97
ucgacaacgccuuguuggcg

SEQ ID NO: 3109364 - RNA, 16 nt, Mycobacterium bovis subsp bovis AF2122/97
ucgacaaguccgcgau

SEQ ID NO: 3109365 - RNA, 16 nt, Mycobacterium bovis subsp bovis AF2122/97
ucgacaccaccauucc

SEQ ID NO: 3109366 - RNA, 16 nt, Mycobacterium bovis subsp bovis AF2122/97
ucgacaccagcgugug

SEQ ID NO: 3109367 - RNA, 23 nt, Mycobacterium bovis subsp bovis AF2122/97
ucgacacccauccucgcggugcg

SEQ ID NO: 3109368 - RNA, 15 nt, Mycobacterium bovis subsp bovis AF2122/97
ucgacacccguugag

SEQ ID NO: 3109369 - RNA, 15 nt, Mycobacterium bovis subsp bovis AF2122/97
ucgacaccgagccac

SEQ ID NO: 3109370 - RNA, 23 nt, Mycobacterium bovis subsp bovis AF2122/97
ucgacaccgagccacgacccagc

SEQ ID NO: 3109371 - RNA, 12 nt, Mycobacterium bovis subsp bovis AF2122/97
ucgacaccgccc

SEQ ID NO: 3109372 - RNA, 13 nt, Mycobacterium bovis subsp bovis AF2122/97
ucgacaccggcgc

SEQ ID NO: 3109373 - RNA, 18 nt, Mycobacterium bovis subsp bovis AF2122/97
ucgacaccgugaccgccg

SEQ ID NO: 3109374 - RNA, 19 nt, Mycobacterium bovis subsp bovis AF2122/97
ucgacaccgugaccgccgc

SEQ ID NO: 3109375 - RNA, 14 nt, Mycobacterium bovis subsp bovis AF2122/97
ucgacacgccgaac

SEQ ID NO: 3109376 - RNA, 17 nt, Mycobacterium bovis subsp bovis AF2122/97
ucgacagcagcgcgaca

SEQ ID NO: 3109377 - RNA, 22 nt, Mycobacterium bovis subsp bovis AF2122/97
ucgacagcgaaggcgccgaaca

SEQ ID NO: 3109378 - RNA, 14 nt, Mycobacterium bovis subsp bovis AF2122/97
ucgacagcggcgau

SEQ ID NO: 3109379 - RNA, 21 nt, Mycobacterium bovis subsp bovis AF2122/97
ucgacaggccaccgcagacgc

SEQ ID NO: 3109380 - RNA, 18 nt, Mycobacterium bovis subsp bovis AF2122/97
ucgacaggugccagacca

SEQ ID NO: 3109381 - RNA, 15 nt, Mycobacterium bovis subsp bovis AF2122/97
ucgacagguuucccg

SEQ ID NO: 3109382 - RNA, 15 nt, Mycobacterium bovis subsp bovis AF2122/97
ucgacaguugcgcca

SEQ ID NO: 3109383 - RNA, 17 nt, Mycobacterium bovis subsp bovis AF2122/97
ucgacaguugcgccagc

SEQ ID NO: 3109384 - RNA, 18 nt, Mycobacterium bovis subsp bovis AF2122/97
ucgacaguugcgccagcg

SEQ ID NO: 3109385 - RNA, 19 nt, Mycobacterium bovis subsp bovis AF2122/97
ucgacaguuuucaccgcga

SEQ ID NO: 3109386 - RNA, 13 nt, Mycobacterium bovis subsp bovis AF2122/97
ucgacaucauccc

SEQ ID NO: 3109387 - RNA, 13 nt, Mycobacterium bovis subsp bovis AF2122/97
ucgacaucgccau

SEQ ID NO: 3109388 - RNA, 13 nt, Mycobacterium bovis subsp bovis AF2122/97
ucgacaucggcca

SEQ ID NO: 3109389 - RNA, 15 nt, Mycobacterium bovis subsp bovis AF2122/97
ucgacaucguuggcc

SEQ ID NO: 3109390 - RNA, 19 nt, Mycobacterium bovis subsp bovis AF2122/97
ucgaccaagguguccagca

SEQ ID NO: 3109391 - RNA, 22 nt, Mycobacterium bovis subsp bovis AF2122/97
ucgaccaagguguccagcaccu

SEQ ID NO: 3109392 - RNA, 13 nt, Mycobacterium bovis subsp bovis AF2122/97
ucgaccaccgccg

SEQ ID NO: 3109393 - RNA, 18 nt, Mycobacterium bovis subsp bovis AF2122/97
ucgaccaccgccggcccg

SEQ ID NO: 3109394 - RNA, 15 nt, Mycobacterium bovis subsp bovis AF2122/97
ucgaccacggucugc

SEQ ID NO: 3109395 - RNA, 15 nt, Mycobacterium bovis subsp bovis AF2122/97
ucgaccacucgccgc

SEQ ID NO: 3109396 - RNA, 16 nt, Mycobacterium bovis subsp bovis AF2122/97
ucgaccacucgccgcg

SEQ ID NO: 3109397 - RNA, 17 nt, Mycobacterium bovis subsp bovis AF2122/97
ucgaccacugcccgggg

SEQ ID NO: 3109398 - RNA, 15 nt, Mycobacterium bovis subsp bovis AF2122/97
ucgaccagagccgcg

SEQ ID NO: 3109399 - RNA, 23 nt, Mycobacterium bovis subsp bovis AF2122/97
ucgaccagcgccgauaccagcca

SEQ ID NO: 3109400 - RNA, 17 nt, Mycobacterium bovis subsp bovis AF2122/97
ucgaccauauuggcgcg

SEQ ID NO: 3109401 - RNA, 18 nt, Mycobacterium bovis subsp bovis AF2122/97
ucgaccaucaucucggug

SEQ ID NO: 3109402 - RNA, 17 nt, Mycobacterium bovis subsp bovis AF2122/97
ucgaccaugccgucguc

SEQ ID NO: 3109403 - RNA, 14 nt, Mycobacterium bovis subsp bovis AF2122/97
ucgaccaugcgacc

SEQ ID NO: 3109404 - RNA, 16 nt, Mycobacterium bovis subsp bovis AF2122/97
ucgacccacucaucag

SEQ ID NO: 3109405 - RNA, 20 nt, Mycobacterium bovis subsp bovis AF2122/97
ucgacccacucaucagagcg

SEQ ID NO: 3109406 - RNA, 16 nt, Mycobacterium bovis subsp bovis AF2122/97
ucgacccccgcaucgg

SEQ ID NO: 3109407 - RNA, 16 nt, Mycobacterium bovis subsp bovis AF2122/97
ucgacccccugccaca

SEQ ID NO: 3109408 - RNA, 20 nt, Mycobacterium bovis subsp bovis AF2122/97
ucgacccccugccacagcga

SEQ ID NO: 3109409 - RNA, 22 nt, Mycobacterium bovis subsp bovis AF2122/97
ucgacccccugccacagcgaca

SEQ ID NO: 3109410 - RNA, 17 nt, Mycobacterium bovis subsp bovis AF2122/97
ucgacccgaucacgcug

SEQ ID NO: 3109411 - RNA, 16 nt, Mycobacterium bovis subsp bovis AF2122/97
ucgacccggucgacgg

SEQ ID NO: 3109412 - RNA, 19 nt, Mycobacterium bovis subsp bovis AF2122/97
ucgacccuccagcacgccg

SEQ ID NO: 3109413 - RNA, 21 nt, Mycobacterium bovis subsp bovis AF2122/97
ucgaccgacugcccgauggcu

SEQ ID NO: 3109414 - RNA, 19 nt, Mycobacterium bovis subsp bovis AF2122/97
ucgaccgauagcuggccga

SEQ ID NO: 3109415 - RNA, 18 nt, Mycobacterium bovis subsp bovis AF2122/97
ucgaccgccagccgcgag

SEQ ID NO: 3109416 - RNA, 14 nt, Mycobacterium bovis subsp bovis AF2122/97
ucgaccgcccgcca

SEQ ID NO: 3109417 - RNA, 13 nt, Mycobacterium bovis subsp bovis AF2122/97
ucgaccgccgugg

SEQ ID NO: 3109418 - RNA, 17 nt, Mycobacterium bovis subsp bovis AF2122/97
ucgaccgccguggcccg

SEQ ID NO: 3109419 - RNA, 22 nt, Mycobacterium bovis subsp bovis AF2122/97
ucgaccgcgccauagcagagcc

SEQ ID NO: 3109420 - RNA, 14 nt, Mycobacterium bovis subsp bovis AF2122/97
ucgaccgcggcccg

SEQ ID NO: 3109421 - RNA, 24 nt, Mycobacterium bovis subsp bovis AF2122/97
ucgaccgcggcccggacgucggcg

SEQ ID NO: 3109422 - RNA, 18 nt, Mycobacterium bovis subsp bovis AF2122/97
ucgaccgcggccuuggcg

SEQ ID NO: 3109423 - RNA, 20 nt, Mycobacterium bovis subsp bovis AF2122/97
ucgaccgcggccuuggcggc

SEQ ID NO: 3109424 - RNA, 21 nt, Mycobacterium bovis subsp bovis AF2122/97
ucgaccgcggccuuggcggcc

SEQ ID NO: 3109425 - RNA, 17 nt, Mycobacterium bovis subsp bovis AF2122/97
ucgaccggaaugcccgg

SEQ ID NO: 3109426 - RNA, 22 nt, Mycobacterium bovis subsp bovis AF2122/97
ucgaccggacaaacaucgcacc

SEQ ID NO: 3109427 - RNA, 21 nt, Mycobacterium bovis subsp bovis AF2122/97
ucgaccggcgggaugcgcgcc

SEQ ID NO: 3109428 - RNA, 15 nt, Mycobacterium bovis subsp bovis AF2122/97
ucgaccggcguugcg

SEQ ID NO: 3109429 - RNA, 19 nt, Mycobacterium bovis subsp bovis AF2122/97
ucgaccgggaacagggugg

SEQ ID NO: 3109430 - RNA, 16 nt, Mycobacterium bovis subsp bovis AF2122/97
ucgaccgucaccggaa

SEQ ID NO: 3109431 - RNA, 20 nt, Mycobacterium bovis subsp bovis AF2122/97
ucgaccguccgggucaccag

SEQ ID NO: 3109432 - RNA, 15 nt, Mycobacterium bovis subsp bovis AF2122/97
ucgaccguggcggcc

SEQ ID NO: 3109433 - RNA, 16 nt, Mycobacterium bovis subsp bovis AF2122/97
ucgaccgugucaccgc

SEQ ID NO: 3109434 - RNA, 18 nt, Mycobacterium bovis subsp bovis AF2122/97
ucgaccgugucaccgccg

SEQ ID NO: 3109435 - RNA, 20 nt, Mycobacterium bovis subsp bovis AF2122/97
ucgaccucacccacccgcgg

SEQ ID NO: 3109436 - RNA, 22 nt, Mycobacterium bovis subsp bovis AF2122/97
ucgaccucagacagcugcacac

SEQ ID NO: 3109437 - RNA, 16 nt, Mycobacterium bovis subsp bovis AF2122/97
ucgaccucgcgggcga

SEQ ID NO: 3109438 - RNA, 15 nt, Mycobacterium bovis subsp bovis AF2122/97
ucgaccuucgggaca

SEQ ID NO: 3109439 - RNA, 18 nt, Mycobacterium bovis subsp bovis AF2122/97
ucgaccuucucgaugcug

SEQ ID NO: 3109440 - RNA, 18 nt, Mycobacterium bovis subsp bovis AF2122/97
ucgaccuugcaccggccg

SEQ ID NO: 3109441 - RNA, 22 nt, Mycobacterium bovis subsp bovis AF2122/97
ucgacgaacgccucaccgacgu

SEQ ID NO: 3109442 - RNA, 20 nt, Mycobacterium bovis subsp bovis AF2122/97
ucgacgaacuccgcguuggg

SEQ ID NO: 3109443 - RNA, 22 nt, Mycobacterium bovis subsp bovis AF2122/97
ucgacgaagaucuucaccggcc

SEQ ID NO: 3109444 - RNA, 23 nt, Mycobacterium bovis subsp bovis AF2122/97
ucgacgaagaucuucaccggccg

SEQ ID NO: 3109445 - RNA, 15 nt, Mycobacterium bovis subsp bovis AF2122/97
ucgacgaagguggcg

SEQ ID NO: 3109446 - RNA, 15 nt, Mycobacterium bovis subsp bovis AF2122/97
ucgacgaccaccuuc

SEQ ID NO: 3109447 - RNA, 14 nt, Mycobacterium bovis subsp bovis AF2122/97
ucgacgacguccuc

SEQ ID NO: 3109448 - RNA, 20 nt, Mycobacterium bovis subsp bovis AF2122/97
ucgacgacguccucgacgau

SEQ ID NO: 3109449 - RNA, 19 nt, Mycobacterium bovis subsp bovis AF2122/97
ucgacgacgucgcgcaucg

SEQ ID NO: 3109450 - RNA, 20 nt, Mycobacterium bovis subsp bovis AF2122/97
ucgacgagaagacaccgcgc

SEQ ID NO: 3109451 - RNA, 21 nt, Mycobacterium bovis subsp bovis AF2122/97
ucgacgagacgaaccgccgac

SEQ ID NO: 3109452 - RNA, 22 nt, Mycobacterium bovis subsp bovis AF2122/97
ucgacgagauagcauccgcccg

SEQ ID NO: 3109453 - RNA, 18 nt, Mycobacterium bovis subsp bovis AF2122/97
ucgacgagcaccgcgccg

SEQ ID NO: 3109454 - RNA, 20 nt, Mycobacterium bovis subsp bovis AF2122/97
ucgacgagcaccgcgccgcg

SEQ ID NO: 3109455 - RNA, 13 nt, Mycobacterium bovis subsp bovis AF2122/97
ucgacgagcgaua

SEQ ID NO: 3109456 - RNA, 19 nt, Mycobacterium bovis subsp bovis AF2122/97
ucgacgagcgccucaagcu

SEQ ID NO: 3109457 - RNA, 24 nt, Mycobacterium bovis subsp bovis AF2122/97
ucgacgagguugccgcaccagucg

SEQ ID NO: 3109458 - RNA, 12 nt, Mycobacterium bovis subsp bovis AF2122/97
ucgacgaucagc

SEQ ID NO: 3109459 - RNA, 21 nt, Mycobacterium bovis subsp bovis AF2122/97
ucgacgaucgucuugucgccg

SEQ ID NO: 3109460 - RNA, 13 nt, Mycobacterium bovis subsp bovis AF2122/97
ucgacgaucucgc

SEQ ID NO: 3109461 - RNA, 16 nt, Mycobacterium bovis subsp bovis AF2122/97
ucgacgaucucuccug

SEQ ID NO: 3109462 - RNA, 15 nt, Mycobacterium bovis subsp bovis AF2122/97
ucgacgaugcgguca

SEQ ID NO: 3109463 - RNA, 13 nt, Mycobacterium bovis subsp bovis AF2122/97
ucgacgcacaccc

SEQ ID NO: 3109464 - RNA, 16 nt, Mycobacterium bovis subsp bovis AF2122/97
ucgacgcacacccggu

SEQ ID NO: 3109465 - RNA, 15 nt, Mycobacterium bovis subsp bovis AF2122/97
ucgacgcauuccucg

SEQ ID NO: 3109466 - RNA, 15 nt, Mycobacterium bovis subsp bovis AF2122/97
ucgacgcccgcccug

SEQ ID NO: 3109467 - RNA, 13 nt, Mycobacterium bovis subsp bovis AF2122/97
ucgacgccgacca

SEQ ID NO: 3109468 - RNA, 15 nt, Mycobacterium bovis subsp bovis AF2122/97
ucgacgccgcagcgu

SEQ ID NO: 3109469 - RNA, 18 nt, Mycobacterium bovis subsp bovis AF2122/97
ucgacgccgccacccggc

SEQ ID NO: 3109470 - RNA, 22 nt, Mycobacterium bovis subsp bovis AF2122/97
ucgacgccgccacccggcgggc

SEQ ID NO: 3109471 - RNA, 16 nt, Mycobacterium bovis subsp bovis AF2122/97
ucgacgccgcgcagcc

SEQ ID NO: 3109472 - RNA, 15 nt, Mycobacterium bovis subsp bovis AF2122/97
ucgacgccggccagc

SEQ ID NO: 3109473 - RNA, 14 nt, Mycobacterium bovis subsp bovis AF2122/97
ucgacgcgcaucgc

SEQ ID NO: 3109474 - RNA, 17 nt, Mycobacterium bovis subsp bovis AF2122/97
ucgacgcgcauucgccg

SEQ ID NO: 3109475 - RNA, 20 nt, Mycobacterium bovis subsp bovis AF2122/97
ucgacgcgcauucgccgggc

SEQ ID NO: 3109476 - RNA, 14 nt, Mycobacterium bovis subsp bovis AF2122/97
ucgacgcggcaggc

SEQ ID NO: 3109477 - RNA, 15 nt, Mycobacterium bovis subsp bovis AF2122/97
ucgacgcggccggcc

SEQ ID NO: 3109478 - RNA, 18 nt, Mycobacterium bovis subsp bovis AF2122/97
ucgacgcgggcguugacg

SEQ ID NO: 3109479 - RNA, 23 nt, Mycobacterium bovis subsp bovis AF2122/97
ucgacgcgucguggucggcgacc

SEQ ID NO: 3109480 - RNA, 14 nt, Mycobacterium bovis subsp bovis AF2122/97
ucgacgcuguggcu

SEQ ID NO: 3109481 - RNA, 13 nt, Mycobacterium bovis subsp bovis AF2122/97
ucgacggccacgg

SEQ ID NO: 3109482 - RNA, 14 nt, Mycobacterium bovis subsp bovis AF2122/97
ucgacggccacggu

SEQ ID NO: 3109483 - RNA, 17 nt, Mycobacterium bovis subsp bovis AF2122/97
ucgacggccagugcgca

SEQ ID NO: 3109484 - RNA, 19 nt, Mycobacterium bovis subsp bovis AF2122/97
ucgacggccaucgugcggc

SEQ ID NO: 3109485 - RNA, 16 nt, Mycobacterium bovis subsp bovis AF2122/97
ucgacggccucgucga

SEQ ID NO: 3109486 - RNA, 17 nt, Mycobacterium bovis subsp bovis AF2122/97
ucgacggccucgucgau

SEQ ID NO: 3109487 - RNA, 15 nt, Mycobacterium bovis subsp bovis AF2122/97
ucgacggccuggggc

SEQ ID NO: 3109488 - RNA, 20 nt, Mycobacterium bovis subsp bovis AF2122/97
ucgacggccuggggcagccg

SEQ ID NO: 3109489 - RNA, 22 nt, Mycobacterium bovis subsp bovis AF2122/97
ucgacggcgauggcgcgcaacg

SEQ ID NO: 3109490 - RNA, 17 nt, Mycobacterium bovis subsp bovis AF2122/97
ucgacggcgccgcccac

SEQ ID NO: 3109491 - RNA, 21 nt, Mycobacterium bovis subsp bovis AF2122/97
ucgacggcggccgcgauggcg

SEQ ID NO: 3109492 - RNA, 13 nt, Mycobacterium bovis subsp bovis AF2122/97
ucgacggcgucga

SEQ ID NO: 3109493 - RNA, 16 nt, Mycobacterium bovis subsp bovis AF2122/97
ucgacggcgucgacug

SEQ ID NO: 3109494 - RNA, 18 nt, Mycobacterium bovis subsp bovis AF2122/97
ucgacggcuccgauuccg

SEQ ID NO: 3109495 - RNA, 19 nt, Mycobacterium bovis subsp bovis AF2122/97
ucgacggcugcgccgaaca

SEQ ID NO: 3109496 - RNA, 17 nt, Mycobacterium bovis subsp bovis AF2122/97
ucgacgggagcgacguc

SEQ ID NO: 3109497 - RNA, 16 nt, Mycobacterium bovis subsp bovis AF2122/97
ucgacgggccggacca

SEQ ID NO: 3109498 - RNA, 18 nt, Mycobacterium bovis subsp bovis AF2122/97
ucgacggggcggucggcc

SEQ ID NO: 3109499 - RNA, 17 nt, Mycobacterium bovis subsp bovis AF2122/97
ucgacgggucggcgccg

SEQ ID NO: 3109500 - RNA, 16 nt, Mycobacterium bovis subsp bovis AF2122/97
ucgacggguucacccu

SEQ ID NO: 3109501 - RNA, 20 nt, Mycobacterium bovis subsp bovis AF2122/97
ucgacggguucacccugcca

SEQ ID NO: 3109502 - RNA, 18 nt, Mycobacterium bovis subsp bovis AF2122/97
ucgacggucaccggcgca

SEQ ID NO: 3109503 - RNA, 17 nt, Mycobacterium bovis subsp bovis AF2122/97
ucgacggucacgguggu

SEQ ID NO: 3109504 - RNA, 11 nt, Mycobacterium bovis subsp bovis AF2122/97
ucgacggugac

SEQ ID NO: 3109505 - RNA, 15 nt, Mycobacterium bovis subsp bovis AF2122/97
ucgacggugccgucg

SEQ ID NO: 3109506 - RNA, 18 nt, Mycobacterium bovis subsp bovis AF2122/97
ucgacggugccgucugcg

SEQ ID NO: 3109507 - RNA, 21 nt, Mycobacterium bovis subsp bovis AF2122/97
ucgacgguggcgccgucggcc

SEQ ID NO: 3109508 - RNA, 19 nt, Mycobacterium bovis subsp bovis AF2122/97
ucgacguauuggcgcagca

SEQ ID NO: 3109509 - RNA, 18 nt, Mycobacterium bovis subsp bovis AF2122/97
ucgacgucagcaccaucc

SEQ ID NO: 3109510 - RNA, 14 nt, Mycobacterium bovis subsp bovis AF2122/97
ucgacgucaugcag

SEQ ID NO: 3109511 - RNA, 20 nt, Mycobacterium bovis subsp bovis AF2122/97
ucgacguccaucccggcgcc

SEQ ID NO: 3109512 - RNA, 21 nt, Mycobacterium bovis subsp bovis AF2122/97
ucgacguccaucccggcgccg

SEQ ID NO: 3109513 - RNA, 14 nt, Mycobacterium bovis subsp bovis AF2122/97
ucgacgucgacggc

SEQ ID NO: 3109514 - RNA, 15 nt, Mycobacterium bovis subsp bovis AF2122/97
ucgacgucgauuucg

SEQ ID NO: 3109515 - RNA, 13 nt, Mycobacterium bovis subsp bovis AF2122/97
ucgacgucggcaa

SEQ ID NO: 3109516 - RNA, 16 nt, Mycobacterium bovis subsp bovis AF2122/97
ucgacgucggcgagca

SEQ ID NO: 3109517 - RNA, 20 nt, Mycobacterium bovis subsp bovis AF2122/97
ucgacgucguagaccuccag

SEQ ID NO: 3109518 - RNA, 21 nt, Mycobacterium bovis subsp bovis AF2122/97
ucgacgucgucgucgacggcc

SEQ ID NO: 3109519 - RNA, 23 nt, Mycobacterium bovis subsp bovis AF2122/97
ucgacgucgucgucgacggccug

SEQ ID NO: 3109520 - RNA, 15 nt, Mycobacterium bovis subsp bovis AF2122/97
ucgacgucguugccg

SEQ ID NO: 3109521 - RNA, 21 nt, Mycobacterium bovis subsp bovis AF2122/97
ucgacgugaucgcgguccaac

SEQ ID NO: 3109522 - RNA, 16 nt, Mycobacterium bovis subsp bovis AF2122/97
ucgacgugcacgguca

SEQ ID NO: 3109523 - RNA, 14 nt, Mycobacterium bovis subsp bovis AF2122/97
ucgacguuccagca

SEQ ID NO: 3109524 - RNA, 17 nt, Mycobacterium bovis subsp bovis AF2122/97
ucgacguuccagcagua

SEQ ID NO: 3109525 - RNA, 18 nt, Mycobacterium bovis subsp bovis AF2122/97
ucgacguucgggucgagc

SEQ ID NO: 3109526 - RNA, 17 nt, Mycobacterium bovis subsp bovis AF2122/97
ucgacguucgguggcga

SEQ ID NO: 3109527 - RNA, 21 nt, Mycobacterium bovis subsp bovis AF2122/97
ucgacguucgguggcgaugcg

SEQ ID NO: 3109528 - RNA, 17 nt, Mycobacterium bovis subsp bovis AF2122/97
ucgacguugaucgccau

SEQ ID NO: 3109529 - RNA, 17 nt, Mycobacterium bovis subsp bovis AF2122/97
ucgacguugcggacggc

SEQ ID NO: 3109530 - RNA, 20 nt, Mycobacterium bovis subsp bovis AF2122/97
ucgacuacacauucauccac

SEQ ID NO: 3109531 - RNA, 15 nt, Mycobacterium bovis subsp bovis AF2122/97
ucgacucacacaccg

SEQ ID NO: 3109532 - RNA, 15 nt, Mycobacterium bovis subsp bovis AF2122/97
ucgacucagcccggc

SEQ ID NO: 3109533 - RNA, 16 nt, Mycobacterium bovis subsp bovis AF2122/97
ucgacucgaccgcgac

SEQ ID NO: 3109534 - RNA, 16 nt, Mycobacterium bovis subsp bovis AF2122/97
ucgacucguggcgcca

SEQ ID NO: 3109535 - RNA, 16 nt, Mycobacterium bovis subsp bovis AF2122/97
ucgacugaucgccacc

SEQ ID NO: 3109536 - RNA, 13 nt, Mycobacterium bovis subsp bovis AF2122/97
ucgacugcagccc

SEQ ID NO: 3109537 - RNA, 16 nt, Mycobacterium bovis subsp bovis AF2122/97
ucgacuggccguuucg

SEQ ID NO: 3109538 - RNA, 21 nt, Mycobacterium bovis subsp bovis AF2122/97
ucgacuggccguuucggcgcc

SEQ ID NO: 3109539 - RNA, 15 nt, Mycobacterium bovis subsp bovis AF2122/97
ucgacuucagcggcc

SEQ ID NO: 3109540 - RNA, 15 nt, Mycobacterium bovis subsp bovis AF2122/97
ucgacuucgacgaca

SEQ ID NO: 3109541 - RNA, 20 nt, Mycobacterium bovis subsp bovis AF2122/97
ucgacuucgacgacacguug

SEQ ID NO: 3109542 - RNA, 19 nt, Mycobacterium bovis subsp bovis AF2122/97
ucgacuugugacggucguc

SEQ ID NO: 3109543 - RNA, 22 nt, Mycobacterium bovis subsp bovis AF2122/97
ucgagaagaucucguagccgcc

SEQ ID NO: 3109544 - RNA, 17 nt, Mycobacterium bovis subsp bovis AF2122/97
ucgagaaugcugacggu

SEQ ID NO: 3109545 - RNA, 22 nt, Mycobacterium bovis subsp bovis AF2122/97
ucgagaaugcugacggugcagg

SEQ ID NO: 3109546 - RNA, 21 nt, Mycobacterium bovis subsp bovis AF2122/97
ucgagaccccgacgaugcgca

SEQ ID NO: 3109547 - RNA, 16 nt, Mycobacterium bovis subsp bovis AF2122/97
ucgagacgagccacgg

SEQ ID NO: 3109548 - RNA, 22 nt, Mycobacterium bovis subsp bovis AF2122/97
ucgagagccccgaccagcagac

SEQ ID NO: 3109549 - RNA, 18 nt, Mycobacterium bovis subsp bovis AF2122/97
ucgagagccucuaaacca

SEQ ID NO: 3109550 - RNA, 17 nt, Mycobacterium bovis subsp bovis AF2122/97
ucgagagggaucacgcc

SEQ ID NO: 3109551 - RNA, 18 nt, Mycobacterium bovis subsp bovis AF2122/97
ucgagauagucggccggc

SEQ ID NO: 3109552 - RNA, 18 nt, Mycobacterium bovis subsp bovis AF2122/97
ucgagaucgccguugccg

SEQ ID NO: 3109553 - RNA, 20 nt, Mycobacterium bovis subsp bovis AF2122/97
ucgagauugccgaggucacu

SEQ ID NO: 3109554 - RNA, 22 nt, Mycobacterium bovis subsp bovis AF2122/97
ucgagcaacggacgaagcaccu

SEQ ID NO: 3109555 - RNA, 22 nt, Mycobacterium bovis subsp bovis AF2122/97
ucgagcacaccgaggucgccaa

SEQ ID NO: 3109556 - RNA, 13 nt, Mycobacterium bovis subsp bovis AF2122/97
ucgagcaccaccc

SEQ ID NO: 3109557 - RNA, 19 nt, Mycobacterium bovis subsp bovis AF2122/97
ucgagcaccccgacguucg

SEQ ID NO: 3109558 - RNA, 16 nt, Mycobacterium bovis subsp bovis AF2122/97
ucgagcacccgcaaug

SEQ ID NO: 3109559 - RNA, 17 nt, Mycobacterium bovis subsp bovis AF2122/97
ucgagcaccgacaccgg

SEQ ID NO: 3109560 - RNA, 21 nt, Mycobacterium bovis subsp bovis AF2122/97
ucgagcaccgacaccggccgc

SEQ ID NO: 3109561 - RNA, 14 nt, Mycobacterium bovis subsp bovis AF2122/97
ucgagcaccggcug

SEQ ID NO: 3109562 - RNA, 22 nt, Mycobacterium bovis subsp bovis AF2122/97
ucgagcaccuccacugggucgc

SEQ ID NO: 3109563 - RNA, 18 nt, Mycobacterium bovis subsp bovis AF2122/97
ucgagcaccucgaaggcc

SEQ ID NO: 3109564 - RNA, 19 nt, Mycobacterium bovis subsp bovis AF2122/97
ucgagcaccuugcgauugc

SEQ ID NO: 3109565 - RNA, 22 nt, Mycobacterium bovis subsp bovis AF2122/97
ucgagcaccuugcgauugcgca

SEQ ID NO: 3109566 - RNA, 21 nt, Mycobacterium bovis subsp bovis AF2122/97
ucgagcaccuuggggugggcg

SEQ ID NO: 3109567 - RNA, 20 nt, Mycobacterium bovis subsp bovis AF2122/97
ucgagcacgccaacguugcg

SEQ ID NO: 3109568 - RNA, 12 nt, Mycobacterium bovis subsp bovis AF2122/97
ucgagcacgucg

SEQ ID NO: 3109569 - RNA, 16 nt, Mycobacterium bovis subsp bovis AF2122/97
ucgagcagccgagcuc

SEQ ID NO: 3109570 - RNA, 15 nt, Mycobacterium bovis subsp bovis AF2122/97
ucgagcagcgccacc

SEQ ID NO: 3109571 - RNA, 19 nt, Mycobacterium bovis subsp bovis AF2122/97
ucgagcagcgcgccguucg

SEQ ID NO: 3109572 - RNA, 19 nt, Mycobacterium bovis subsp bovis AF2122/97
ucgagcaggcccaacgcga

SEQ ID NO: 3109573 - RNA, 13 nt, Mycobacterium bovis subsp bovis AF2122/97
ucgagcaggcugg

SEQ ID NO: 3109574 - RNA, 23 nt, Mycobacterium bovis subsp bovis AF2122/97
ucgagcaggcuggcguugggcgg

SEQ ID NO: 3109575 - RNA, 18 nt, Mycobacterium bovis subsp bovis AF2122/97
ucgagcaggcuggcugcc

SEQ ID NO: 3109576 - RNA, 20 nt, Mycobacterium bovis subsp bovis AF2122/97
ucgagcaguggccgccgggc

SEQ ID NO: 3109577 - RNA, 20 nt, Mycobacterium bovis subsp bovis AF2122/97
ucgagcaucucgucggugaa

SEQ ID NO: 3109578 - RNA, 15 nt, Mycobacterium bovis subsp bovis AF2122/97
ucgagcaugcccagc

SEQ ID NO: 3109579 - RNA, 17 nt, Mycobacterium bovis subsp bovis AF2122/97
ucgagccacccaccgac

SEQ ID NO: 3109580 - RNA, 19 nt, Mycobacterium bovis subsp bovis AF2122/97
ucgagcccgucgaguaggu

SEQ ID NO: 3109581 - RNA, 22 nt, Mycobacterium bovis subsp bovis AF2122/97
ucgagcccucguuaucgaccgc

SEQ ID NO: 3109582 - RNA, 15 nt, Mycobacterium bovis subsp bovis AF2122/97
ucgagccgaccgcgg

SEQ ID NO: 3109583 - RNA, 13 nt, Mycobacterium bovis subsp bovis AF2122/97
ucgagccgaucgc

SEQ ID NO: 3109584 - RNA, 20 nt, Mycobacterium bovis subsp bovis AF2122/97
ucgagccgcacaaacgggcg

SEQ ID NO: 3109585 - RNA, 18 nt, Mycobacterium bovis subsp bovis AF2122/97
ucgagccggauucggcug

SEQ ID NO: 3109586 - RNA, 23 nt, Mycobacterium bovis subsp bovis AF2122/97
ucgagccggauucggcugccacc

SEQ ID NO: 3109587 - RNA, 13 nt, Mycobacterium bovis subsp bovis AF2122/97
ucgagccggcggc

SEQ ID NO: 3109588 - RNA, 20 nt, Mycobacterium bovis subsp bovis AF2122/97
ucgagccgugccucgaggac

SEQ ID NO: 3109589 - RNA, 19 nt, Mycobacterium bovis subsp bovis AF2122/97
ucgagcgaacccuucgcgg

SEQ ID NO: 3109590 - RNA, 22 nt, Mycobacterium bovis subsp bovis AF2122/97
ucgagcgaaccgaagccgucga

SEQ ID NO: 3109591 - RNA, 20 nt, Mycobacterium bovis subsp bovis AF2122/97
ucgagcgaccccacacgccg

SEQ ID NO: 3109592 - RNA, 13 nt, Mycobacterium bovis subsp bovis AF2122/97
ucgagcgccagcg

SEQ ID NO: 3109593 - RNA, 18 nt, Mycobacterium bovis subsp bovis AF2122/97
ucgagcgcgaucgggccg

SEQ ID NO: 3109594 - RNA, 13 nt, Mycobacterium bovis subsp bovis AF2122/97
ucgagcgcgccgc

SEQ ID NO: 3109595 - RNA, 19 nt, Mycobacterium bovis subsp bovis AF2122/97
ucgagcgcgccgcgcucgc

SEQ ID NO: 3109596 - RNA, 20 nt, Mycobacterium bovis subsp bovis AF2122/97
ucgagcgcgccgcgcucgcc

SEQ ID NO: 3109597 - RNA, 21 nt, Mycobacterium bovis subsp bovis AF2122/97
ucgagcgcgccgcgcucgccg

SEQ ID NO: 3109598 - RNA, 21 nt, Mycobacterium bovis subsp bovis AF2122/97
ucgagcgcgccuucacgcugg

SEQ ID NO: 3109599 - RNA, 16 nt, Mycobacterium bovis subsp bovis AF2122/97
ucgagcgcgcgacgga

SEQ ID NO: 3109600 - RNA, 13 nt, Mycobacterium bovis subsp bovis AF2122/97
ucgagcgguggcg

SEQ ID NO: 3109601 - RNA, 22 nt, Mycobacterium bovis subsp bovis AF2122/97
ucgagcgguggcgucgucggcg

SEQ ID NO: 3109602 - RNA, 19 nt, Mycobacterium bovis subsp bovis AF2122/97
ucgagcgucugcgaucccg

SEQ ID NO: 3109603 - RNA, 13 nt, Mycobacterium bovis subsp bovis AF2122/97
ucgagcgugcgca

SEQ ID NO: 3109604 - RNA, 18 nt, Mycobacterium bovis subsp bovis AF2122/97
ucgagcgugcgcacggcg

SEQ ID NO: 3109605 - RNA, 13 nt, Mycobacterium bovis subsp bovis AF2122/97
ucgagcguggcga

SEQ ID NO: 3109606 - RNA, 21 nt, Mycobacterium bovis subsp bovis AF2122/97
ucgagcucggcgaacggcacc

SEQ ID NO: 3109607 - RNA, 14 nt, Mycobacterium bovis subsp bovis AF2122/97
ucgagcucggcgau

SEQ ID NO: 3109608 - RNA, 22 nt, Mycobacterium bovis subsp bovis AF2122/97
ucgagcucggcgaugcugagcc

SEQ ID NO: 3109609 - RNA, 22 nt, Mycobacterium bovis subsp bovis AF2122/97
ucgagcucguaggugaagagca

SEQ ID NO: 3109610 - RNA, 17 nt, Mycobacterium bovis subsp bovis AF2122/97
ucgagcucguccucguc

SEQ ID NO: 3109611 - RNA, 19 nt, Mycobacterium bovis subsp bovis AF2122/97
ucgagcucguccucgucuu

SEQ ID NO: 3109612 - RNA, 21 nt, Mycobacterium bovis subsp bovis AF2122/97
ucgagcugauacgcaugcgag

SEQ ID NO: 3109613 - RNA, 15 nt, Mycobacterium bovis subsp bovis AF2122/97
ucgagcugcuggcgc

SEQ ID NO: 3109614 - RNA, 21 nt, Mycobacterium bovis subsp bovis AF2122/97
ucgagcuuuucgaccuucacc

SEQ ID NO: 3109615 - RNA, 17 nt, Mycobacterium bovis subsp bovis AF2122/97
ucgaggaacacgaugcc

SEQ ID NO: 3109616 - RNA, 18 nt, Mycobacterium bovis subsp bovis AF2122/97
ucgaggaacacgaugccc

SEQ ID NO: 3109617 - RNA, 14 nt, Mycobacterium bovis subsp bovis AF2122/97
ucgaggaacucgga

SEQ ID NO: 3109618 - RNA, 19 nt, Mycobacterium bovis subsp bovis AF2122/97
ucgaggaagaucaccuccc

SEQ ID NO: 3109619 - RNA, 16 nt, Mycobacterium bovis subsp bovis AF2122/97
ucgaggaaggugugcg

SEQ ID NO: 3109620 - RNA, 19 nt, Mycobacterium bovis subsp bovis AF2122/97
ucgaggaaggugugcgucu

SEQ ID NO: 3109621 - RNA, 14 nt, Mycobacterium bovis subsp bovis AF2122/97
ucgaggaccaccac

SEQ ID NO: 3109622 - RNA, 17 nt, Mycobacterium bovis subsp bovis AF2122/97
ucgaggaccaccacuag

SEQ ID NO: 3109623 - RNA, 19 nt, Mycobacterium bovis subsp bovis AF2122/97
ucgaggaguuggugcagcg

SEQ ID NO: 3109624 - RNA, 22 nt, Mycobacterium bovis subsp bovis AF2122/97
ucgaggcaggccucggcgccgc

SEQ ID NO: 3109625 - RNA, 16 nt, Mycobacterium bovis subsp bovis AF2122/97
ucgaggccacgccagc

SEQ ID NO: 3109626 - RNA, 19 nt, Mycobacterium bovis subsp bovis AF2122/97
ucgaggccacgccagcucg

SEQ ID NO: 3109627 - RNA, 18 nt, Mycobacterium bovis subsp bovis AF2122/97
ucgaggcgaucaccgcgc

SEQ ID NO: 3109628 - RNA, 18 nt, Mycobacterium bovis subsp bovis AF2122/97
ucgaggcugaccguggcg

SEQ ID NO: 3109629 - RNA, 15 nt, Mycobacterium bovis subsp bovis AF2122/97
ucgagggagcgccgc

SEQ ID NO: 3109630 - RNA, 16 nt, Mycobacterium bovis subsp bovis AF2122/97
ucgagggggacgcuga

SEQ ID NO: 3109631 - RNA, 18 nt, Mycobacterium bovis subsp bovis AF2122/97
ucgaggguaccaggcgcc

SEQ ID NO: 3109632 - RNA, 23 nt, Mycobacterium bovis subsp bovis AF2122/97
ucgagggugaaguggcgcagcac

SEQ ID NO: 3109633 - RNA, 20 nt, Mycobacterium bovis subsp bovis AF2122/97
ucgagggugaccaacgucga

SEQ ID NO: 3109634 - RNA, 21 nt, Mycobacterium bovis subsp bovis AF2122/97
ucgagguacagcgggcacgcu

SEQ ID NO: 3109635 - RNA, 14 nt, Mycobacterium bovis subsp bovis AF2122/97
ucgaggucagcucc

SEQ ID NO: 3109636 - RNA, 16 nt, Mycobacterium bovis subsp bovis AF2122/97
ucgaggucagugggcg

SEQ ID NO: 3109637 - RNA, 17 nt, Mycobacterium bovis subsp bovis AF2122/97
ucgaggucagugggcgg

SEQ ID NO: 3109638 - RNA, 18 nt, Mycobacterium bovis subsp bovis AF2122/97
ucgagguccaccacccug

SEQ ID NO: 3109639 - RNA, 16 nt, Mycobacterium bovis subsp bovis AF2122/97
ucgagguccucagcga

SEQ ID NO: 3109640 - RNA, 14 nt, Mycobacterium bovis subsp bovis AF2122/97
ucgagguccucggu

SEQ ID NO: 3109641 - RNA, 13 nt, Mycobacterium bovis subsp bovis AF2122/97
ucgagguccucgu

SEQ ID NO: 3109642 - RNA, 18 nt, Mycobacterium bovis subsp bovis AF2122/97
ucgagguccucgucggcg

SEQ ID NO: 3109643 - RNA, 15 nt, Mycobacterium bovis subsp bovis AF2122/97
ucgaggucgagcgcc

SEQ ID NO: 3109644 - RNA, 21 nt, Mycobacterium bovis subsp bovis AF2122/97
ucgaggucguuucccuggccg

SEQ ID NO: 3109645 - RNA, 22 nt, Mycobacterium bovis subsp bovis AF2122/97
ucgaggucguuucccuggccgc

SEQ ID NO: 3109646 - RNA, 15 nt, Mycobacterium bovis subsp bovis AF2122/97
ucgagguggcgggcg

SEQ ID NO: 3109647 - RNA, 20 nt, Mycobacterium bovis subsp bovis AF2122/97
ucgagguggcgggcgaugcg

SEQ ID NO: 3109648 - RNA, 22 nt, Mycobacterium bovis subsp bovis AF2122/97
ucgagguguagcccuccgagca

SEQ ID NO: 3109649 - RNA, 17 nt, Mycobacterium bovis subsp bovis AF2122/97
ucgagguucccgcauug

SEQ ID NO: 3109650 - RNA, 23 nt, Mycobacterium bovis subsp bovis AF2122/97
ucgagguucucccgcgcuuggcu

SEQ ID NO: 3109651 - RNA, 24 nt, Mycobacterium bovis subsp bovis AF2122/97
ucgaguaguucgucgacgucggcg

SEQ ID NO: 3109652 - RNA, 21 nt, Mycobacterium bovis subsp bovis AF2122/97
ucgaguauugcaggaaaucgu

SEQ ID NO: 3109653 - RNA, 17 nt, Mycobacterium bovis subsp bovis AF2122/97
ucgaguccaccaccugg

SEQ ID NO: 3109654 - RNA, 17 nt, Mycobacterium bovis subsp bovis AF2122/97
ucgaguccaggcagcuu

SEQ ID NO: 3109655 - RNA, 14 nt, Mycobacterium bovis subsp bovis AF2122/97
ucgagugccgccgu

SEQ ID NO: 3109656 - RNA, 17 nt, Mycobacterium bovis subsp bovis AF2122/97
ucgagugccucgaccug

SEQ ID NO: 3109657 - RNA, 16 nt, Mycobacterium bovis subsp bovis AF2122/97
ucgagugcgaagguaa

SEQ ID NO: 3109658 - RNA, 13 nt, Mycobacterium bovis subsp bovis AF2122/97
ucgagugcgacgg

SEQ ID NO: 3109659 - RNA, 14 nt, Mycobacterium bovis subsp bovis AF2122/97
ucgagugcgacggc

SEQ ID NO: 3109660 - RNA, 16 nt, Mycobacterium bovis subsp bovis AF2122/97
ucgagugcgacggcga

SEQ ID NO: 3109661 - RNA, 21 nt, Mycobacterium bovis subsp bovis AF2122/97
ucgaguggaucacacauuucg

SEQ ID NO: 3109662 - RNA, 21 nt, Mycobacterium bovis subsp bovis AF2122/97
ucgagugugaacuggucgacg

SEQ ID NO: 3109663 - RNA, 15 nt, Mycobacterium bovis subsp bovis AF2122/97
ucgaguguggccgaa

SEQ ID NO: 3109664 - RNA, 15 nt, Mycobacterium bovis subsp bovis AF2122/97
ucgaguucggccgcg

SEQ ID NO: 3109665 - RNA, 14 nt, Mycobacterium bovis subsp bovis AF2122/97
ucgaguugcgcggc

SEQ ID NO: 3109666 - RNA, 19 nt, Mycobacterium bovis subsp bovis AF2122/97
ucgaguugcucgacacugg

SEQ ID NO: 3109667 - RNA, 14 nt, Mycobacterium bovis subsp bovis AF2122/97
ucgaguuuggccag

SEQ ID NO: 3109668 - RNA, 18 nt, Mycobacterium bovis subsp bovis AF2122/97
ucgaguuuggccaguucg

SEQ ID NO: 3109669 - RNA, 18 nt, Mycobacterium bovis subsp bovis AF2122/97
ucgauaaccgcgaccagc

SEQ ID NO: 3109670 - RNA, 16 nt, Mycobacterium bovis subsp bovis AF2122/97
ucgauacccaggaugu

SEQ ID NO: 3109671 - RNA, 13 nt, Mycobacterium bovis subsp bovis AF2122/97
ucgauaccggcgu

SEQ ID NO: 3109672 - RNA, 17 nt, Mycobacterium bovis subsp bovis AF2122/97
ucgauagcccgccaccc

SEQ ID NO: 3109673 - RNA, 15 nt, Mycobacterium bovis subsp bovis AF2122/97
ucgauagcggcggcg

SEQ ID NO: 3109674 - RNA, 16 nt, Mycobacterium bovis subsp bovis AF2122/97
ucgauagcggcggcgg

SEQ ID NO: 3109675 - RNA, 17 nt, Mycobacterium bovis subsp bovis AF2122/97
ucgauagcggcggcggc

SEQ ID NO: 3109676 - RNA, 16 nt, Mycobacterium bovis subsp bovis AF2122/97
ucgauauagccgccgg

SEQ ID NO: 3109677 - RNA, 23 nt, Mycobacterium bovis subsp bovis AF2122/97
ucgaucaacaccaacgacagcga

SEQ ID NO: 3109678 - RNA, 18 nt, Mycobacterium bovis subsp bovis AF2122/97
ucgaucaacaccaaucgg

SEQ ID NO: 3109679 - RNA, 19 nt, Mycobacterium bovis subsp bovis AF2122/97
ucgaucaacaggucuaccc

SEQ ID NO: 3109680 - RNA, 20 nt, Mycobacterium bovis subsp bovis AF2122/97
ucgaucacacguccgcgcac

SEQ ID NO: 3109681 - RNA, 16 nt, Mycobacterium bovis subsp bovis AF2122/97
ucgaucaccgacaccg

SEQ ID NO: 3109682 - RNA, 13 nt, Mycobacterium bovis subsp bovis AF2122/97
ucgaucaccugca

SEQ ID NO: 3109683 - RNA, 16 nt, Mycobacterium bovis subsp bovis AF2122/97
ucgaucaccugcagca

SEQ ID NO: 3109684 - RNA, 15 nt, Mycobacterium bovis subsp bovis AF2122/97
ucgaucacggccguc

SEQ ID NO: 3109685 - RNA, 16 nt, Mycobacterium bovis subsp bovis AF2122/97
ucgaucacggccgucg

SEQ ID NO: 3109686 - RNA, 15 nt, Mycobacterium bovis subsp bovis AF2122/97
ucgaucacggcggcc

SEQ ID NO: 3109687 - RNA, 18 nt, Mycobacterium bovis subsp bovis AF2122/97
ucgaucacggcggccccg

SEQ ID NO: 3109688 - RNA, 12 nt, Mycobacterium bovis subsp bovis AF2122/97
ucgaucacgucg

SEQ ID NO: 3109689 - RNA, 13 nt, Mycobacterium bovis subsp bovis AF2122/97
ucgaucacgucgu

SEQ ID NO: 3109690 - RNA, 18 nt, Mycobacterium bovis subsp bovis AF2122/97
ucgaucacguggugcggc

SEQ ID NO: 3109691 - RNA, 21 nt, Mycobacterium bovis subsp bovis AF2122/97
ucgaucacguggugcggccgg

SEQ ID NO: 3109692 - RNA, 18 nt, Mycobacterium bovis subsp bovis AF2122/97
ucgaucagaaucugccuc

SEQ ID NO: 3109693 - RNA, 22 nt, Mycobacterium bovis subsp bovis AF2122/97
ucgaucagacgcucgaccugcc

SEQ ID NO: 3109694 - RNA, 21 nt, Mycobacterium bovis subsp bovis AF2122/97
ucgaucagcaacucggccacg

SEQ ID NO: 3109695 - RNA, 14 nt, Mycobacterium bovis subsp bovis AF2122/97
ucgaucagccgcau

SEQ ID NO: 3109696 - RNA, 14 nt, Mycobacterium bovis subsp bovis AF2122/97
ucgaucagccgggu

SEQ ID NO: 3109697 - RNA, 14 nt, Mycobacterium bovis subsp bovis AF2122/97
ucgaucagcgccgg

SEQ ID NO: 3109698 - RNA, 21 nt, Mycobacterium bovis subsp bovis AF2122/97
ucgaucagcuccuguaacugc

SEQ ID NO: 3109699 - RNA, 18 nt, Mycobacterium bovis subsp bovis AF2122/97
ucgaucagcuugggcagc

SEQ ID NO: 3109700 - RNA, 15 nt, Mycobacterium bovis subsp bovis AF2122/97
ucgaucaggccuugg

SEQ ID NO: 3109701 - RNA, 19 nt, Mycobacterium bovis subsp bovis AF2122/97
ucgaucagucgugggcugu

SEQ ID NO: 3109702 - RNA, 16 nt, Mycobacterium bovis subsp bovis AF2122/97
ucgauccacugccgcg

SEQ ID NO: 3109703 - RNA, 18 nt, Mycobacterium bovis subsp bovis AF2122/97
ucgauccccgcaauuccc

SEQ ID NO: 3109704 - RNA, 18 nt, Mycobacterium bovis subsp bovis AF2122/97
ucgaucccggucggugug

SEQ ID NO: 3109705 - RNA, 21 nt, Mycobacterium bovis subsp bovis AF2122/97
ucgauccgcaacaacgccgcg

SEQ ID NO: 3109706 - RNA, 19 nt, Mycobacterium bovis subsp bovis AF2122/97
ucgauccucgcccgcacca

SEQ ID NO: 3109707 - RNA, 19 nt, Mycobacterium bovis subsp bovis AF2122/97
ucgaucgacucacacaccg

SEQ ID NO: 3109708 - RNA, 16 nt, Mycobacterium bovis subsp bovis AF2122/97
ucgaucgagcaggccg

SEQ ID NO: 3109709 - RNA, 16 nt, Mycobacterium bovis subsp bovis AF2122/97
ucgaucgccacgacag

SEQ ID NO: 3109710 - RNA, 14 nt, Mycobacterium bovis subsp bovis AF2122/97
ucgaucgccgcgau

SEQ ID NO: 3109711 - RNA, 20 nt, Mycobacterium bovis subsp bovis AF2122/97
ucgaucgccgcgauggcggu

SEQ ID NO: 3109712 - RNA, 16 nt, Mycobacterium bovis subsp bovis AF2122/97
ucgaucgcgccgucgg

SEQ ID NO: 3109713 - RNA, 19 nt, Mycobacterium bovis subsp bovis AF2122/97
ucgaucgcggcgcccagga

SEQ ID NO: 3109714 - RNA, 17 nt, Mycobacterium bovis subsp bovis AF2122/97
ucgaucgcuugccccgc

SEQ ID NO: 3109715 - RNA, 17 nt, Mycobacterium bovis subsp bovis AF2122/97
ucgaucggaucggcacc

SEQ ID NO: 3109716 - RNA, 18 nt, Mycobacterium bovis subsp bovis AF2122/97
ucgaucggaucggcaccc

SEQ ID NO: 3109717 - RNA, 16 nt, Mycobacterium bovis subsp bovis AF2122/97
ucgaucguuccgcugg

SEQ ID NO: 3109718 - RNA, 22 nt, Mycobacterium bovis subsp bovis AF2122/97
ucgaucuccucuugcaccaggg

SEQ ID NO: 3109719 - RNA, 14 nt, Mycobacterium bovis subsp bovis AF2122/97
ucgaucucgaucga

SEQ ID NO: 3109720 - RNA, 14 nt, Mycobacterium bovis subsp bovis AF2122/97
ucgaucucggcgca

SEQ ID NO: 3109721 - RNA, 20 nt, Mycobacterium bovis subsp bovis AF2122/97
ucgaucugcggaggcgggug

SEQ ID NO: 3109722 - RNA, 22 nt, Mycobacterium bovis subsp bovis AF2122/97
ucgaucuggucaagacccgcau

SEQ ID NO: 3109723 - RNA, 18 nt, Mycobacterium bovis subsp bovis AF2122/97
ucgaucugucgcgccggu

SEQ ID NO: 3109724 - RNA, 22 nt, Mycobacterium bovis subsp bovis AF2122/97
ucgaugaagcgucguugcucgg

SEQ ID NO: 3109725 - RNA, 22 nt, Mycobacterium bovis subsp bovis AF2122/97
ucgaugacccauacgaacucac

SEQ ID NO: 3109726 - RNA, 19 nt, Mycobacterium bovis subsp bovis AF2122/97
ucgaugaccccgguggucu

SEQ ID NO: 3109727 - RNA, 19 nt, Mycobacterium bovis subsp bovis AF2122/97
ucgaugaccuuugagucga

SEQ ID NO: 3109728 - RNA, 12 nt, Mycobacterium bovis subsp bovis AF2122/97
ucgaugacgccg

SEQ ID NO: 3109729 - RNA, 20 nt, Mycobacterium bovis subsp bovis AF2122/97
ucgaugacgccgucagcggc

SEQ ID NO: 3109730 - RNA, 23 nt, Mycobacterium bovis subsp bovis AF2122/97
ucgaugagcgcgaaguacgacga

SEQ ID NO: 3109731 - RNA, 22 nt, Mycobacterium bovis subsp bovis AF2122/97
ucgaugaggcgcagcgccagcg

SEQ ID NO: 3109732 - RNA, 18 nt, Mycobacterium bovis subsp bovis AF2122/97
ucgaugagguucaucgcc

SEQ ID NO: 3109733 - RNA, 17 nt, Mycobacterium bovis subsp bovis AF2122/97
ucgaugagugacggucc

SEQ ID NO: 3109734 - RNA, 14 nt, Mycobacterium bovis subsp bovis AF2122/97
ucgaugaucugcuu

SEQ ID NO: 3109735 - RNA, 23 nt, Mycobacterium bovis subsp bovis AF2122/97
ucgaugaugcccauccggccguc

SEQ ID NO: 3109736 - RNA, 12 nt, Mycobacterium bovis subsp bovis AF2122/97
ucgaugccgcgu

SEQ ID NO: 3109737 - RNA, 20 nt, Mycobacterium bovis subsp bovis AF2122/97
ucgaugccgcguagcugguc

SEQ ID NO: 3109738 - RNA, 12 nt, Mycobacterium bovis subsp bovis AF2122/97
ucgaugccggcu

SEQ ID NO: 3109739 - RNA, 15 nt, Mycobacterium bovis subsp bovis AF2122/97
ucgaugccgggugug

SEQ ID NO: 3109740 - RNA, 20 nt, Mycobacterium bovis subsp bovis AF2122/97
ucgaugccguguucagcacc

SEQ ID NO: 3109741 - RNA, 19 nt, Mycobacterium bovis subsp bovis AF2122/97
ucgaugccguuguggacca

SEQ ID NO: 3109742 - RNA, 20 nt, Mycobacterium bovis subsp bovis AF2122/97
ucgaugcgacgaaccucggc

SEQ ID NO: 3109743 - RNA, 22 nt, Mycobacterium bovis subsp bovis AF2122/97
ucgaugcgacgaaccucggcgg

SEQ ID NO: 3109744 - RNA, 16 nt, Mycobacterium bovis subsp bovis AF2122/97
ucgaugcgaucgacga

SEQ ID NO: 3109745 - RNA, 16 nt, Mycobacterium bovis subsp bovis AF2122/97
ucgaugcgcgccggcu

SEQ ID NO: 3109746 - RNA, 17 nt, Mycobacterium bovis subsp bovis AF2122/97
ucgaugcgcgccggcuu

SEQ ID NO: 3109747 - RNA, 13 nt, Mycobacterium bovis subsp bovis AF2122/97
ucgaugcgcugcu

SEQ ID NO: 3109748 - RNA, 19 nt, Mycobacterium bovis subsp bovis AF2122/97
ucgaugcggguggcgccgg

SEQ ID NO: 3109749 - RNA, 15 nt, Mycobacterium bovis subsp bovis AF2122/97
ucgaugcugaacacg

SEQ ID NO: 3109750 - RNA, 21 nt, Mycobacterium bovis subsp bovis AF2122/97
ucgaugcugaacacgcagccg

SEQ ID NO: 3109751 - RNA, 18 nt, Mycobacterium bovis subsp bovis AF2122/97
ucgauggaaaacgccaug

SEQ ID NO: 3109752 - RNA, 17 nt, Mycobacterium bovis subsp bovis AF2122/97
ucgauggcaucggccau

SEQ ID NO: 3109753 - RNA, 20 nt, Mycobacterium bovis subsp bovis AF2122/97
ucgauggccaggcuggcguc

SEQ ID NO: 3109754 - RNA, 20 nt, Mycobacterium bovis subsp bovis AF2122/97
ucgauggcguagggcugucc

SEQ ID NO: 3109755 - RNA, 17 nt, Mycobacterium bovis subsp bovis AF2122/97
ucgauggggacggcggc

SEQ ID NO: 3109756 - RNA, 19 nt, Mycobacterium bovis subsp bovis AF2122/97
ucgauggguagcgagucga

SEQ ID NO: 3109757 - RNA, 18 nt, Mycobacterium bovis subsp bovis AF2122/97
ucgauggucagcagaucc

SEQ ID NO: 3109758 - RNA, 23 nt, Mycobacterium bovis subsp bovis AF2122/97
ucgauggucucccggcugaugcc

SEQ ID NO: 3109759 - RNA, 13 nt, Mycobacterium bovis subsp bovis AF2122/97
ucgauggugcggc

SEQ ID NO: 3109760 - RNA, 22 nt, Mycobacterium bovis subsp bovis AF2122/97
ucgauggugcggcccaaccggu

SEQ ID NO: 3109761 - RNA, 16 nt, Mycobacterium bovis subsp bovis AF2122/97
ucgauggugucgcgca

SEQ ID NO: 3109762 - RNA, 15 nt, Mycobacterium bovis subsp bovis AF2122/97
ucgauggugugcccg

SEQ ID NO: 3109763 - RNA, 17 nt, Mycobacterium bovis subsp bovis AF2122/97
ucgauguauccgaugcg

SEQ ID NO: 3109764 - RNA, 17 nt, Mycobacterium bovis subsp bovis AF2122/97
ucgauguccacgccgug

SEQ ID NO: 3109765 - RNA, 17 nt, Mycobacterium bovis subsp bovis AF2122/97
ucgauguccgcagcacc

SEQ ID NO: 3109766 - RNA, 17 nt, Mycobacterium bovis subsp bovis AF2122/97
ucgauguccucgauccg

SEQ ID NO: 3109767 - RNA, 20 nt, Mycobacterium bovis subsp bovis AF2122/97
ucgauguccucgauccgggc

SEQ ID NO: 3109768 - RNA, 21 nt, Mycobacterium bovis subsp bovis AF2122/97
ucgaugucggcgaaccacggc

SEQ ID NO: 3109769 - RNA, 18 nt, Mycobacterium bovis subsp bovis AF2122/97
ucgauguggcgcuccggc

SEQ ID NO: 3109770 - RNA, 14 nt, Mycobacterium bovis subsp bovis AF2122/97
ucgauuagcccacc

SEQ ID NO: 3109771 - RNA, 20 nt, Mycobacterium bovis subsp bovis AF2122/97
ucgauugaugcgugguuggc

SEQ ID NO: 3109772 - RNA, 17 nt, Mycobacterium bovis subsp bovis AF2122/97
ucgauugccaccgagau

SEQ ID NO: 3109773 - RNA, 15 nt, Mycobacterium bovis subsp bovis AF2122/97
ucgauuggcugcgcc

SEQ ID NO: 3109774 - RNA, 13 nt, Mycobacterium bovis subsp bovis AF2122/97
ucgcaaaagcccc

SEQ ID NO: 3109775 - RNA, 16 nt, Mycobacterium bovis subsp bovis AF2122/97
ucgcaaccgccgccau

SEQ ID NO: 3109776 - RNA, 12 nt, Mycobacterium bovis subsp bovis AF2122/97
ucgcaaccggcg

SEQ ID NO: 3109777 - RNA, 23 nt, Mycobacterium bovis subsp bovis AF2122/97
ucgcaacgauuuuagcggcugcc

SEQ ID NO: 3109778 - RNA, 23 nt, Mycobacterium bovis subsp bovis AF2122/97
ucgcaagcgcggcgaagccgggu

SEQ ID NO: 3109779 - RNA, 17 nt, Mycobacterium bovis subsp bovis AF2122/97
ucgcaaggcccgcaccg

SEQ ID NO: 3109780 - RNA, 19 nt, Mycobacterium bovis subsp bovis AF2122/97
ucgcaaggcccgcaccgcu

SEQ ID NO: 3109781 - RNA, 16 nt, Mycobacterium bovis subsp bovis AF2122/97
ucgcaauauccggccg

SEQ ID NO: 3109782 - RNA, 16 nt, Mycobacterium bovis subsp bovis AF2122/97
ucgcaauaugccacag

SEQ ID NO: 3109783 - RNA, 19 nt, Mycobacterium bovis subsp bovis AF2122/97
ucgcaaucguuggccaugc

SEQ ID NO: 3109784 - RNA, 12 nt, Mycobacterium bovis subsp bovis AF2122/97
ucgcaaugaccu

SEQ ID NO: 3109785 - RNA, 23 nt, Mycobacterium bovis subsp bovis AF2122/97
ucgcaauugcucguagcccaggu

SEQ ID NO: 3109786 - RNA, 19 nt, Mycobacterium bovis subsp bovis AF2122/97
ucgcacaccuccucgaccg

SEQ ID NO: 3109787 - RNA, 23 nt, Mycobacterium bovis subsp bovis AF2122/97
ucgcacaccuccucgaccguggc

SEQ ID NO: 3109788 - RNA, 22 nt, Mycobacterium bovis subsp bovis AF2122/97
ucgcacagcaccacgugcgagg

SEQ ID NO: 3109789 - RNA, 20 nt, Mycobacterium bovis subsp bovis AF2122/97
ucgcacagccgcuuggcgcg

SEQ ID NO: 3109790 - RNA, 21 nt, Mycobacterium bovis subsp bovis AF2122/97
ucgcaccaccacgugaucaga

SEQ ID NO: 3109791 - RNA, 17 nt, Mycobacterium bovis subsp bovis AF2122/97
ucgcaccaccugggcgg

SEQ ID NO: 3109792 - RNA, 20 nt, Mycobacterium bovis subsp bovis AF2122/97
ucgcacccagggcguuggcg

SEQ ID NO: 3109793 - RNA, 22 nt, Mycobacterium bovis subsp bovis AF2122/97
ucgcacccagggcguuggcggc

SEQ ID NO: 3109794 - RNA, 15 nt, Mycobacterium bovis subsp bovis AF2122/97
ucgcaccccggcggc

SEQ ID NO: 3109795 - RNA, 13 nt, Mycobacterium bovis subsp bovis AF2122/97
ucgcacccguucg

SEQ ID NO: 3109796 - RNA, 14 nt, Mycobacterium bovis subsp bovis AF2122/97
ucgcacccugcgaa

SEQ ID NO: 3109797 - RNA, 22 nt, Mycobacterium bovis subsp bovis AF2122/97
ucgcaccgcgccguggacgauc

SEQ ID NO: 3109798 - RNA, 16 nt, Mycobacterium bovis subsp bovis AF2122/97
ucgcaccggagucggc

SEQ ID NO: 3109799 - RNA, 21 nt, Mycobacterium bovis subsp bovis AF2122/97
ucgcaccggagucggcgucga

SEQ ID NO: 3109800 - RNA, 21 nt, Mycobacterium bovis subsp bovis AF2122/97
ucgcacgacgcgacacgccgg

SEQ ID NO: 3109801 - RNA, 14 nt, Mycobacterium bovis subsp bovis AF2122/97
ucgcacgagccaac

SEQ ID NO: 3109802 - RNA, 17 nt, Mycobacterium bovis subsp bovis AF2122/97
ucgcacgagccaacaag

SEQ ID NO: 3109803 - RNA, 21 nt, Mycobacterium bovis subsp bovis AF2122/97
ucgcacgcucaugaccgcucg

SEQ ID NO: 3109804 - RNA, 18 nt, Mycobacterium bovis subsp bovis AF2122/97
ucgcacggaaggcccggc

SEQ ID NO: 3109805 - RNA, 22 nt, Mycobacterium bovis subsp bovis AF2122/97
ucgcacggaaggcccggcgcgg

SEQ ID NO: 3109806 - RNA, 17 nt, Mycobacterium bovis subsp bovis AF2122/97
ucgcacggaugaugccg

SEQ ID NO: 3109807 - RNA, 16 nt, Mycobacterium bovis subsp bovis AF2122/97
ucgcacgggccaccag

SEQ ID NO: 3109808 - RNA, 20 nt, Mycobacterium bovis subsp bovis AF2122/97
ucgcacgggccaccagcguc

SEQ ID NO: 3109809 - RNA, 16 nt, Mycobacterium bovis subsp bovis AF2122/97
ucgcacggugccgccg

SEQ ID NO: 3109810 - RNA, 18 nt, Mycobacterium bovis subsp bovis AF2122/97
ucgcacggugccgccguc

SEQ ID NO: 3109811 - RNA, 12 nt, Mycobacterium bovis subsp bovis AF2122/97
ucgcacgugggc

SEQ ID NO: 3109812 - RNA, 19 nt, Mycobacterium bovis subsp bovis AF2122/97
ucgcacucguugccgacca

SEQ ID NO: 3109813 - RNA, 18 nt, Mycobacterium bovis subsp bovis AF2122/97
ucgcacugcgccggccgg

SEQ ID NO: 3109814 - RNA, 21 nt, Mycobacterium bovis subsp bovis AF2122/97
ucgcacuggucaacacgacug

SEQ ID NO: 3109815 - RNA, 15 nt, Mycobacterium bovis subsp bovis AF2122/97
ucgcagacggcugcc

SEQ ID NO: 3109816 - RNA, 17 nt, Mycobacterium bovis subsp bovis AF2122/97
ucgcagacggcugccac

SEQ ID NO: 3109817 - RNA, 21 nt, Mycobacterium bovis subsp bovis AF2122/97
ucgcagacggcugccacgcgu

SEQ ID NO: 3109818 - RNA, 15 nt, Mycobacterium bovis subsp bovis AF2122/97
ucgcagauugugagc

SEQ ID NO: 3109819 - RNA, 16 nt, Mycobacterium bovis subsp bovis AF2122/97
ucgcagcaacaccucg

SEQ ID NO: 3109820 - RNA, 16 nt, Mycobacterium bovis subsp bovis AF2122/97
ucgcagcaacggcggc

SEQ ID NO: 3109821 - RNA, 17 nt, Mycobacterium bovis subsp bovis AF2122/97
ucgcagcaacggcggcg

SEQ ID NO: 3109822 - RNA, 13 nt, Mycobacterium bovis subsp bovis AF2122/97
ucgcagcaccaca

SEQ ID NO: 3109823 - RNA, 19 nt, Mycobacterium bovis subsp bovis AF2122/97
ucgcagcacgggugagcac

SEQ ID NO: 3109824 - RNA, 14 nt, Mycobacterium bovis subsp bovis AF2122/97
ucgcagcagaccac

SEQ ID NO: 3109825 - RNA, 11 nt, Mycobacterium bovis subsp bovis AF2122/97
ucgcagcagca

SEQ ID NO: 3109826 - RNA, 17 nt, Mycobacterium bovis subsp bovis AF2122/97
ucgcagcaucacguccg

SEQ ID NO: 3109827 - RNA, 19 nt, Mycobacterium bovis subsp bovis AF2122/97
ucgcagcaucacguccgcg

SEQ ID NO: 3109828 - RNA, 19 nt, Mycobacterium bovis subsp bovis AF2122/97
ucgcagcauguggccgccg

SEQ ID NO: 3109829 - RNA, 13 nt, Mycobacterium bovis subsp bovis AF2122/97
ucgcagccaacgc

SEQ ID NO: 3109830 - RNA, 15 nt, Mycobacterium bovis subsp bovis AF2122/97
ucgcagccgcaccgg

SEQ ID NO: 3109831 - RNA, 16 nt, Mycobacterium bovis subsp bovis AF2122/97
ucgcagcgacacguug

SEQ ID NO: 3109832 - RNA, 21 nt, Mycobacterium bovis subsp bovis AF2122/97
ucgcagcgaggagcccggucc

SEQ ID NO: 3109833 - RNA, 12 nt, Mycobacterium bovis subsp bovis AF2122/97
ucgcagcgcaca

SEQ ID NO: 3109834 - RNA, 22 nt, Mycobacterium bovis subsp bovis AF2122/97
ucgcagcgcacacuaccgccgc

SEQ ID NO: 3109835 - RNA, 20 nt, Mycobacterium bovis subsp bovis AF2122/97
ucgcagcgguggucggcgcg

SEQ ID NO: 3109836 - RNA, 18 nt, Mycobacterium bovis subsp bovis AF2122/97
ucgcaggauucccagucc

SEQ ID NO: 3109837 - RNA, 16 nt, Mycobacterium bovis subsp bovis AF2122/97
ucgcaggccggcggcg

SEQ ID NO: 3109838 - RNA, 20 nt, Mycobacterium bovis subsp bovis AF2122/97
ucgcaggccggcggcggugg

SEQ ID NO: 3109839 - RNA, 15 nt, Mycobacterium bovis subsp bovis AF2122/97
ucgcagggaucaccc

SEQ ID NO: 3109840 - RNA, 21 nt, Mycobacterium bovis subsp bovis AF2122/97
ucgcagggaucaccccggccg

SEQ ID NO: 3109841 - RNA, 20 nt, Mycobacterium bovis subsp bovis AF2122/97
ucgcagguggugacacgacg

SEQ ID NO: 3109842 - RNA, 21 nt, Mycobacterium bovis subsp bovis AF2122/97
ucgcaguacuugguugcgacg

SEQ ID NO: 3109843 - RNA, 22 nt, Mycobacterium bovis subsp bovis AF2122/97
ucgcaguauucacagucgcucg

SEQ ID NO: 3109844 - RNA, 18 nt, Mycobacterium bovis subsp bovis AF2122/97
ucgcaguccgguuacgcu

SEQ ID NO: 3109845 - RNA, 13 nt, Mycobacterium bovis subsp bovis AF2122/97
ucgcagucgauga

SEQ ID NO: 3109846 - RNA, 20 nt, Mycobacterium bovis subsp bovis AF2122/97
ucgcagugacguuccgcucg

SEQ ID NO: 3109847 - RNA, 14 nt, Mycobacterium bovis subsp bovis AF2122/97
ucgcagugagcagc

SEQ ID NO: 3109848 - RNA, 16 nt, Mycobacterium bovis subsp bovis AF2122/97
ucgcagugagcagccg

SEQ ID NO: 3109849 - RNA, 21 nt, Mycobacterium bovis subsp bovis AF2122/97
ucgcaguggagggcccggccg

SEQ ID NO: 3109850 - RNA, 20 nt, Mycobacterium bovis subsp bovis AF2122/97
ucgcaguggcguuacgcucg

SEQ ID NO: 3109851 - RNA, 22 nt, Mycobacterium bovis subsp bovis AF2122/97
ucgcaucggcggggcccacacg

SEQ ID NO: 3109852 - RNA, 12 nt, Mycobacterium bovis subsp bovis AF2122/97
ucgcauggcggc

SEQ ID NO: 3109853 - RNA, 15 nt, Mycobacterium bovis subsp bovis AF2122/97
ucgcauggucgacga

SEQ ID NO: 3109854 - RNA, 19 nt, Mycobacterium bovis subsp bovis AF2122/97
ucgcauguucuccacgccg

SEQ ID NO: 3109855 - RNA, 22 nt, Mycobacterium bovis subsp bovis AF2122/97
ucgcauuuguacugguuagaga

SEQ ID NO: 3109856 - RNA, 23 nt, Mycobacterium bovis subsp bovis AF2122/97
ucgccaaaaguacuggcguugcc

SEQ ID NO: 3109857 - RNA, 22 nt, Mycobacterium bovis subsp bovis AF2122/97
ucgccaaacccaugucggcgcg

SEQ ID NO: 3109858 - RNA, 15 nt, Mycobacterium bovis subsp bovis AF2122/97
ucgccaaccagucgc

SEQ ID NO: 3109859 - RNA, 11 nt, Mycobacterium bovis subsp bovis AF2122/97
ucgccaacccg

SEQ ID NO: 3109860 - RNA, 22 nt, Mycobacterium bovis subsp bovis AF2122/97
ucgccaaccuuugcguugcuga

SEQ ID NO: 3109861 - RNA, 19 nt, Mycobacterium bovis subsp bovis AF2122/97
ucgccaagugcagggcugc

SEQ ID NO: 3109862 - RNA, 21 nt, Mycobacterium bovis subsp bovis AF2122/97
ucgccaagugcagggcugcua

SEQ ID NO: 3109863 - RNA, 14 nt, Mycobacterium bovis subsp bovis AF2122/97
ucgccaaugcccag

SEQ ID NO: 3109864 - RNA, 16 nt, Mycobacterium bovis subsp bovis AF2122/97
ucgccaaugcccaggu

SEQ ID NO: 3109865 - RNA, 15 nt, Mycobacterium bovis subsp bovis AF2122/97
ucgccacaccaugau

SEQ ID NO: 3109866 - RNA, 23 nt, Mycobacterium bovis subsp bovis AF2122/97
ucgccacauuucaccaccguggc

SEQ ID NO: 3109867 - RNA, 13 nt, Mycobacterium bovis subsp bovis AF2122/97
ucgccaccacccc

SEQ ID NO: 3109868 - RNA, 16 nt, Mycobacterium bovis subsp bovis AF2122/97
ucgccaccaccggaac

SEQ ID NO: 3109869 - RNA, 17 nt, Mycobacterium bovis subsp bovis AF2122/97
ucgccaccaccggaacg

SEQ ID NO: 3109870 - RNA, 16 nt, Mycobacterium bovis subsp bovis AF2122/97
ucgccaccaucaccgc

SEQ ID NO: 3109871 - RNA, 17 nt, Mycobacterium bovis subsp bovis AF2122/97
ucgccaccaucaccgcc

SEQ ID NO: 3109872 - RNA, 24 nt, Mycobacterium bovis subsp bovis AF2122/97
ucgccaccaucguugccggugccg

SEQ ID NO: 3109873 - RNA, 11 nt, Mycobacterium bovis subsp bovis AF2122/97
ucgccaccgca

SEQ ID NO: 3109874 - RNA, 18 nt, Mycobacterium bovis subsp bovis AF2122/97
ucgccaccgccggcagca

SEQ ID NO: 3109875 - RNA, 21 nt, Mycobacterium bovis subsp bovis AF2122/97
ucgccaccgccggcagcaucg

SEQ ID NO: 3109876 - RNA, 22 nt, Mycobacterium bovis subsp bovis AF2122/97
ucgccaccgccggcagcaucgg

SEQ ID NO: 3109877 - RNA, 20 nt, Mycobacterium bovis subsp bovis AF2122/97
ucgccaccgcggcgauuacg

SEQ ID NO: 3109878 - RNA, 21 nt, Mycobacterium bovis subsp bovis AF2122/97
ucgccaccggcgccaccggcg

SEQ ID NO: 3109879 - RNA, 14 nt, Mycobacterium bovis subsp bovis AF2122/97
ucgccacgcccagc

SEQ ID NO: 3109880 - RNA, 21 nt, Mycobacterium bovis subsp bovis AF2122/97
ucgccacgccugcucggagag

SEQ ID NO: 3109881 - RNA, 13 nt, Mycobacterium bovis subsp bovis AF2122/97
ucgccacggucgc

SEQ ID NO: 3109882 - RNA, 18 nt, Mycobacterium bovis subsp bovis AF2122/97
ucgccacggucgccgacc

SEQ ID NO: 3109883 - RNA, 14 nt, Mycobacterium bovis subsp bovis AF2122/97
ucgccacucagccc

SEQ ID NO: 3109884 - RNA, 18 nt, Mycobacterium bovis subsp bovis AF2122/97
ucgccacuguugaagaag

SEQ ID NO: 3109885 - RNA, 16 nt, Mycobacterium bovis subsp bovis AF2122/97
ucgccagcaacgucgg

SEQ ID NO: 3109886 - RNA, 12 nt, Mycobacterium bovis subsp bovis AF2122/97
ucgccagcagca

SEQ ID NO: 3109887 - RNA, 18 nt, Mycobacterium bovis subsp bovis AF2122/97
ucgccagcaucagcccgg

SEQ ID NO: 3109888 - RNA, 14 nt, Mycobacterium bovis subsp bovis AF2122/97
ucgccagccugugc

SEQ ID NO: 3109889 - RNA, 22 nt, Mycobacterium bovis subsp bovis AF2122/97
ucgccagccugugcugccaacg

SEQ ID NO: 3109890 - RNA, 18 nt, Mycobacterium bovis subsp bovis AF2122/97
ucgccagcgccggccagg

SEQ ID NO: 3109891 - RNA, 19 nt, Mycobacterium bovis subsp bovis AF2122/97
ucgccagcggcgcgaccgu

SEQ ID NO: 3109892 - RNA, 18 nt, Mycobacterium bovis subsp bovis AF2122/97
ucgccagcugacacccgc

SEQ ID NO: 3109893 - RNA, 15 nt, Mycobacterium bovis subsp bovis AF2122/97
ucgccaggcccugaa

SEQ ID NO: 3109894 - RNA, 22 nt, Mycobacterium bovis subsp bovis AF2122/97
ucgccaggccgagcccggugcu

SEQ ID NO: 3109895 - RNA, 23 nt, Mycobacterium bovis subsp bovis AF2122/97
ucgccaggccuaggccgaggccg

SEQ ID NO: 3109896 - RNA, 21 nt, Mycobacterium bovis subsp bovis AF2122/97
ucgccagguggccgcucucca

SEQ ID NO: 3109897 - RNA, 14 nt, Mycobacterium bovis subsp bovis AF2122/97
ucgccagucgauuc

SEQ ID NO: 3109898 - RNA, 21 nt, Mycobacterium bovis subsp bovis AF2122/97
ucgccagugcuccaaaucggc

SEQ ID NO: 3109899 - RNA, 14 nt, Mycobacterium bovis subsp bovis AF2122/97
ucgccaugcugccc

SEQ ID NO: 3109900 - RNA, 16 nt, Mycobacterium bovis subsp bovis AF2122/97
ucgccaugucggccag

SEQ ID NO: 3109901 - RNA, 16 nt, Mycobacterium bovis subsp bovis AF2122/97
ucgcccaacaccgcgc

SEQ ID NO: 3109902 - RNA, 18 nt, Mycobacterium bovis subsp bovis AF2122/97
ucgcccaauuucgugccg

SEQ ID NO: 3109903 - RNA, 23 nt, Mycobacterium bovis subsp bovis AF2122/97
ucgcccagagccgcugcggcacc

SEQ ID NO: 3109904 - RNA, 19 nt, Mycobacterium bovis subsp bovis AF2122/97
ucgcccagcaaggcccgaa

SEQ ID NO: 3109905 - RNA, 15 nt, Mycobacterium bovis subsp bovis AF2122/97
ucgcccagcccgaca

SEQ ID NO: 3109906 - RNA, 16 nt, Mycobacterium bovis subsp bovis AF2122/97
ucgcccagcgugaacu

SEQ ID NO: 3109907 - RNA, 16 nt, Mycobacterium bovis subsp bovis AF2122/97
ucgcccagugcgcaac

SEQ ID NO: 3109908 - RNA, 15 nt, Mycobacterium bovis subsp bovis AF2122/97
ucgcccauuggccag

SEQ ID NO: 3109909 - RNA, 16 nt, Mycobacterium bovis subsp bovis AF2122/97
ucgcccauuggccagg

SEQ ID NO: 3109910 - RNA, 17 nt, Mycobacterium bovis subsp bovis AF2122/97
ucgcccauuucggcacg

SEQ ID NO: 3109911 - RNA, 17 nt, Mycobacterium bovis subsp bovis AF2122/97
ucgcccauuucggcccg

SEQ ID NO: 3109912 - RNA, 20 nt, Mycobacterium bovis subsp bovis AF2122/97
ucgcccccagugcacgcucg

SEQ ID NO: 3109913 - RNA, 17 nt, Mycobacterium bovis subsp bovis AF2122/97
ucgccccgaggaugccg

SEQ ID NO: 3109914 - RNA, 18 nt, Mycobacterium bovis subsp bovis AF2122/97
ucgccccgaggaugccga

SEQ ID NO: 3109915 - RNA, 22 nt, Mycobacterium bovis subsp bovis AF2122/97
ucgccccgaggaugccgaaccg

SEQ ID NO: 3109916 - RNA, 16 nt, Mycobacterium bovis subsp bovis AF2122/97
ucgccccgaugaccgc

SEQ ID NO: 3109917 - RNA, 17 nt, Mycobacterium bovis subsp bovis AF2122/97
ucgccccguucacgcuc

SEQ ID NO: 3109918 - RNA, 18 nt, Mycobacterium bovis subsp bovis AF2122/97
ucgccccguucacgcucg

SEQ ID NO: 3109919 - RNA, 19 nt, Mycobacterium bovis subsp bovis AF2122/97
ucgccccguuucggucgac

SEQ ID NO: 3109920 - RNA, 16 nt, Mycobacterium bovis subsp bovis AF2122/97
ucgccccugcacagca

SEQ ID NO: 3109921 - RNA, 20 nt, Mycobacterium bovis subsp bovis AF2122/97
ucgccccugcacagcaggcu

SEQ ID NO: 3109922 - RNA, 21 nt, Mycobacterium bovis subsp bovis AF2122/97
ucgcccgaggcaacgaacgcc

SEQ ID NO: 3109923 - RNA, 12 nt, Mycobacterium bovis subsp bovis AF2122/97
ucgcccgauccg

SEQ ID NO: 3109924 - RNA, 14 nt, Mycobacterium bovis subsp bovis AF2122/97
ucgcccgcacacag

SEQ ID NO: 3109925 - RNA, 18 nt, Mycobacterium bovis subsp bovis AF2122/97
ucgcccgcacacagaccg

SEQ ID NO: 3109926 - RNA, 15 nt, Mycobacterium bovis subsp bovis AF2122/97
ucgcccgcaccagcu

SEQ ID NO: 3109927 - RNA, 21 nt, Mycobacterium bovis subsp bovis AF2122/97
ucgcccgcccgucuuccagcc

SEQ ID NO: 3109928 - RNA, 17 nt, Mycobacterium bovis subsp bovis AF2122/97
ucgcccgccgccaccag

SEQ ID NO: 3109929 - RNA, 19 nt, Mycobacterium bovis subsp bovis AF2122/97
ucgcccgcgcuagcgguug

SEQ ID NO: 3109930 - RNA, 15 nt, Mycobacterium bovis subsp bovis AF2122/97
ucgcccgcugagcac

SEQ ID NO: 3109931 - RNA, 18 nt, Mycobacterium bovis subsp bovis AF2122/97
ucgcccgcugccgucgga

SEQ ID NO: 3109932 - RNA, 13 nt, Mycobacterium bovis subsp bovis AF2122/97
ucgcccggccccg

SEQ ID NO: 3109933 - RNA, 23 nt, Mycobacterium bovis subsp bovis AF2122/97
ucgcccgggcgggauccacccag

SEQ ID NO: 3109934 - RNA, 20 nt, Mycobacterium bovis subsp bovis AF2122/97
ucgcccggguggcgucgauc

SEQ ID NO: 3109935 - RNA, 18 nt, Mycobacterium bovis subsp bovis AF2122/97
ucgcccgugagcagcggg

SEQ ID NO: 3109936 - RNA, 19 nt, Mycobacterium bovis subsp bovis AF2122/97
ucgcccucguaauccacgc

SEQ ID NO: 3109937 - RNA, 21 nt, Mycobacterium bovis subsp bovis AF2122/97
ucgcccucguaauccacgccg

SEQ ID NO: 3109938 - RNA, 22 nt, Mycobacterium bovis subsp bovis AF2122/97
ucgcccugacacccaucgaccg

SEQ ID NO: 3109939 - RNA, 23 nt, Mycobacterium bovis subsp bovis AF2122/97
ucgcccugacacccaucgaccgc

SEQ ID NO: 3109940 - RNA, 19 nt, Mycobacterium bovis subsp bovis AF2122/97
ucgcccugacccggagccg

SEQ ID NO: 3109941 - RNA, 20 nt, Mycobacterium bovis subsp bovis AF2122/97
ucgcccugacgucacguucg

SEQ ID NO: 3109942 - RNA, 20 nt, Mycobacterium bovis subsp bovis AF2122/97
ucgcccugagaacacguucg

SEQ ID NO: 3109943 - RNA, 17 nt, Mycobacterium bovis subsp bovis AF2122/97
ucgcccuguucggcccg

SEQ ID NO: 3109944 - RNA, 18 nt, Mycobacterium bovis subsp bovis AF2122/97
ucgccgaaaucggccagc

SEQ ID NO: 3109945 - RNA, 19 nt, Mycobacterium bovis subsp bovis AF2122/97
ucgccgaaaucggccagcu

SEQ ID NO: 3109946 - RNA, 17 nt, Mycobacterium bovis subsp bovis AF2122/97
ucgccgaacgccaccac

SEQ ID NO: 3109947 - RNA, 17 nt, Mycobacterium bovis subsp bovis AF2122/97
ucgccgaagccggaccg

SEQ ID NO: 3109948 - RNA, 20 nt, Mycobacterium bovis subsp bovis AF2122/97
ucgccgaagcgccgcuuggc

SEQ ID NO: 3109949 - RNA, 21 nt, Mycobacterium bovis subsp bovis AF2122/97
ucgccgaagcgccgcuuggcg

SEQ ID NO: 3109950 - RNA, 15 nt, Mycobacterium bovis subsp bovis AF2122/97
ucgccgaaguagacg

SEQ ID NO: 3109951 - RNA, 20 nt, Mycobacterium bovis subsp bovis AF2122/97
ucgccgaaguagacgguggu

SEQ ID NO: 3109952 - RNA, 12 nt, Mycobacterium bovis subsp bovis AF2122/97
ucgccgaagugg

SEQ ID NO: 3109953 - RNA, 17 nt, Mycobacterium bovis subsp bovis AF2122/97
ucgccgaaucgcugacc

SEQ ID NO: 3109954 - RNA, 14 nt, Mycobacterium bovis subsp bovis AF2122/97
ucgccgaaucggca

SEQ ID NO: 3109955 - RNA, 20 nt, Mycobacterium bovis subsp bovis AF2122/97
ucgccgacagcgccuuguug

SEQ ID NO: 3109956 - RNA, 16 nt, Mycobacterium bovis subsp bovis AF2122/97
ucgccgaccacucgag

SEQ ID NO: 3109957 - RNA, 13 nt, Mycobacterium bovis subsp bovis AF2122/97
ucgccgacccggg

SEQ ID NO: 3109958 - RNA, 16 nt, Mycobacterium bovis subsp bovis AF2122/97
ucgccgaccuuggcgu

SEQ ID NO: 3109959 - RNA, 19 nt, Mycobacterium bovis subsp bovis AF2122/97
ucgccgaccuuggcgucga

SEQ ID NO: 3109960 - RNA, 14 nt, Mycobacterium bovis subsp bovis AF2122/97
ucgccgacgccaga

SEQ ID NO: 3109961 - RNA, 15 nt, Mycobacterium bovis subsp bovis AF2122/97
ucgccgacgccagaa

SEQ ID NO: 3109962 - RNA, 14 nt, Mycobacterium bovis subsp bovis AF2122/97
ucgccgacgcgaag

SEQ ID NO: 3109963 - RNA, 16 nt, Mycobacterium bovis subsp bovis AF2122/97
ucgccgacgucgacgc

SEQ ID NO: 3109964 - RNA, 17 nt, Mycobacterium bovis subsp bovis AF2122/97
ucgccgagaacgauguc

SEQ ID NO: 3109965 - RNA, 22 nt, Mycobacterium bovis subsp bovis AF2122/97
ucgccgagaacgauguccgcgc

SEQ ID NO: 3109966 - RNA, 14 nt, Mycobacterium bovis subsp bovis AF2122/97
ucgccgagaccggc

SEQ ID NO: 3109967 - RNA, 16 nt, Mycobacterium bovis subsp bovis AF2122/97
ucgccgagaccggcca

SEQ ID NO: 3109968 - RNA, 17 nt, Mycobacterium bovis subsp bovis AF2122/97
ucgccgagauagggccg

SEQ ID NO: 3109969 - RNA, 19 nt, Mycobacterium bovis subsp bovis AF2122/97
ucgccgagauagggccgcg

SEQ ID NO: 3109970 - RNA, 14 nt, Mycobacterium bovis subsp bovis AF2122/97
ucgccgagauccgc

SEQ ID NO: 3109971 - RNA, 16 nt, Mycobacterium bovis subsp bovis AF2122/97
ucgccgagauccgcgc

SEQ ID NO: 3109972 - RNA, 14 nt, Mycobacterium bovis subsp bovis AF2122/97
ucgccgagcagguc

SEQ ID NO: 3109973 - RNA, 20 nt, Mycobacterium bovis subsp bovis AF2122/97
ucgccgagcggaucgucguc

SEQ ID NO: 3109974 - RNA, 21 nt, Mycobacterium bovis subsp bovis AF2122/97
ucgccgaggacgccggcgccg

SEQ ID NO: 3109975 - RNA, 22 nt, Mycobacterium bovis subsp bovis AF2122/97
ucgccgaggacgccggcgccgc

SEQ ID NO: 3109976 - RNA, 17 nt, Mycobacterium bovis subsp bovis AF2122/97
ucgccgaggcagcgucg

SEQ ID NO: 3109977 - RNA, 21 nt, Mycobacterium bovis subsp bovis AF2122/97
ucgccgaggcagcgucgucga

SEQ ID NO: 3109978 - RNA, 21 nt, Mycobacterium bovis subsp bovis AF2122/97
ucgccgaggccucggccagcg

SEQ ID NO: 3109979 - RNA, 22 nt, Mycobacterium bovis subsp bovis AF2122/97
ucgccgagguagauggcgaacc

SEQ ID NO: 3109980 - RNA, 13 nt, Mycobacterium bovis subsp bovis AF2122/97
ucgccgaggucga

SEQ ID NO: 3109981 - RNA, 17 nt, Mycobacterium bovis subsp bovis AF2122/97
ucgccgaguaccggcca

SEQ ID NO: 3109982 - RNA, 16 nt, Mycobacterium bovis subsp bovis AF2122/97
ucgccgauaucugcca

SEQ ID NO: 3109983 - RNA, 18 nt, Mycobacterium bovis subsp bovis AF2122/97
ucgccgauaucugccacg

SEQ ID NO: 3109984 - RNA, 14 nt, Mycobacterium bovis subsp bovis AF2122/97
ucgccgaucaccgc

SEQ ID NO: 3109985 - RNA, 23 nt, Mycobacterium bovis subsp bovis AF2122/97
ucgccgaucagcugcgcaucgcc

SEQ ID NO: 3109986 - RNA, 14 nt, Mycobacterium bovis subsp bovis AF2122/97
ucgccgaugcugua

SEQ ID NO: 3109987 - RNA, 20 nt, Mycobacterium bovis subsp bovis AF2122/97
ucgccgauguuggcagggcc

SEQ ID NO: 3109988 - RNA, 23 nt, Mycobacterium bovis subsp bovis AF2122/97
ucgccgccaccagcgcacgcucg

SEQ ID NO: 3109989 - RNA, 23 nt, Mycobacterium bovis subsp bovis AF2122/97
ucgccgccaccagggcacguucg

SEQ ID NO: 3109990 - RNA, 13 nt, Mycobacterium bovis subsp bovis AF2122/97
ucgccgccagcgc

SEQ ID NO: 3109991 - RNA, 21 nt, Mycobacterium bovis subsp bovis AF2122/97
ucgccgccauugccgccggug

SEQ ID NO: 3109992 - RNA, 22 nt, Mycobacterium bovis subsp bovis AF2122/97
ucgccgcccccguuuacggccc

SEQ ID NO: 3109993 - RNA, 18 nt, Mycobacterium bovis subsp bovis AF2122/97
ucgccgcccgcagggccg

SEQ ID NO: 3109994 - RNA, 21 nt, Mycobacterium bovis subsp bovis AF2122/97
ucgccgcccgcagggccgccg

SEQ ID NO: 3109995 - RNA, 11 nt, Mycobacterium bovis subsp bovis AF2122/97
ucgccgcccgg

SEQ ID NO: 3109996 - RNA, 12 nt, Mycobacterium bovis subsp bovis AF2122/97
ucgccgcccggc

SEQ ID NO: 3109997 - RNA, 13 nt, Mycobacterium bovis subsp bovis AF2122/97
ucgccgcccggcg

SEQ ID NO: 3109998 - RNA, 22 nt, Mycobacterium bovis subsp bovis AF2122/97
ucgccgcccgugccgcccucac

SEQ ID NO: 3109999 - RNA, 18 nt, Mycobacterium bovis subsp bovis AF2122/97
ucgccgcccuggccgccg

SEQ ID NO: 3110000 - RNA, 21 nt, Mycobacterium bovis subsp bovis AF2122/97
ucgccgccgaaaaccucgccc

SEQ ID NO: 3110001 - RNA, 17 nt, Mycobacterium bovis subsp bovis AF2122/97
ucgccgccgcgcguucg

SEQ ID NO: 3110002 - RNA, 22 nt, Mycobacterium bovis subsp bovis AF2122/97
ucgccgccgcgcguucggcgcu

SEQ ID NO: 3110003 - RNA, 13 nt, Mycobacterium bovis subsp bovis AF2122/97
ucgccgccgcuac

SEQ ID NO: 3110004 - RNA, 16 nt, Mycobacterium bovis subsp bovis AF2122/97
ucgccgccggcgccgc

SEQ ID NO: 3110005 - RNA, 20 nt, Mycobacterium bovis subsp bovis AF2122/97
ucgccgccggcgccgccggu

SEQ ID NO: 3110006 - RNA, 21 nt, Mycobacterium bovis subsp bovis AF2122/97
ucgccgccggcgccgccggug

SEQ ID NO: 3110007 - RNA, 13 nt, Mycobacterium bovis subsp bovis AF2122/97
ucgccgccgggca

SEQ ID NO: 3110008 - RNA, 14 nt, Mycobacterium bovis subsp bovis AF2122/97
ucgccgccgggcag

SEQ ID NO: 3110009 - RNA, 23 nt, Mycobacterium bovis subsp bovis AF2122/97
ucgccgccggugaggaucagcgu

SEQ ID NO: 3110010 - RNA, 23 nt, Mycobacterium bovis subsp bovis AF2122/97
ucgccgccggugccgcccgagcc

SEQ ID NO: 3110011 - RNA, 16 nt, Mycobacterium bovis subsp bovis AF2122/97
ucgccgccgucaccgc

SEQ ID NO: 3110012 - RNA, 18 nt, Mycobacterium bovis subsp bovis AF2122/97
ucgccgccgucaccgccc

SEQ ID NO: 3110013 - RNA, 22 nt, Mycobacterium bovis subsp bovis AF2122/97
ucgccgccgucaccgcccuugc

SEQ ID NO: 3110014 - RNA, 21 nt, Mycobacterium bovis subsp bovis AF2122/97
ucgccgccguugccgccggug

SEQ ID NO: 3110015 - RNA, 22 nt, Mycobacterium bovis subsp bovis AF2122/97
ucgccgccguuggcucgagccg

SEQ ID NO: 3110016 - RNA, 19 nt, Mycobacterium bovis subsp bovis AF2122/97
ucgccgccuuacgcaccga

SEQ ID NO: 3110017 - RNA, 18 nt, Mycobacterium bovis subsp bovis AF2122/97
ucgccgccuuccuggcgg

SEQ ID NO: 3110018 - RNA, 18 nt, Mycobacterium bovis subsp bovis AF2122/97
ucgccgccuucuuggcgg

SEQ ID NO: 3110019 - RNA, 19 nt, Mycobacterium bovis subsp bovis AF2122/97
ucgccgccuucuuggcggc

SEQ ID NO: 3110020 - RNA, 14 nt, Mycobacterium bovis subsp bovis AF2122/97
ucgccgcgaagggg

SEQ ID NO: 3110021 - RNA, 16 nt, Mycobacterium bovis subsp bovis AF2122/97
ucgccgcgacugcacc

SEQ ID NO: 3110022 - RNA, 20 nt, Mycobacterium bovis subsp bovis AF2122/97
ucgccgcgacugcaccuggc

SEQ ID NO: 3110023 - RNA, 13 nt, Mycobacterium bovis subsp bovis AF2122/97
ucgccgcgcaccg

SEQ ID NO: 3110024 - RNA, 13 nt, Mycobacterium bovis subsp bovis AF2122/97
ucgccgcgcagcc

SEQ ID NO: 3110025 - RNA, 22 nt, Mycobacterium bovis subsp bovis AF2122/97
ucgccgcgcagccuucucgcug

SEQ ID NO: 3110026 - RNA, 21 nt, Mycobacterium bovis subsp bovis AF2122/97
ucgccgcgcagcgugcgaugc

SEQ ID NO: 3110027 - RNA, 12 nt, Mycobacterium bovis subsp bovis AF2122/97
ucgccgcgccgu

SEQ ID NO: 3110028 - RNA, 14 nt, Mycobacterium bovis subsp bovis AF2122/97
ucgccgcgcggaac

SEQ ID NO: 3110029 - RNA, 14 nt, Mycobacterium bovis subsp bovis AF2122/97
ucgccgcggcggca

SEQ ID NO: 3110030 - RNA, 16 nt, Mycobacterium bovis subsp bovis AF2122/97
ucgccgcggcggcagc

SEQ ID NO: 3110031 - RNA, 17 nt, Mycobacterium bovis subsp bovis AF2122/97
ucgccgcggcggcagcg

SEQ ID NO: 3110032 - RNA, 22 nt, Mycobacterium bovis subsp bovis AF2122/97
ucgccgcgggacagauggcggc

SEQ ID NO: 3110033 - RNA, 14 nt, Mycobacterium bovis subsp bovis AF2122/97
ucgccgcgggcagc

SEQ ID NO: 3110034 - RNA, 20 nt, Mycobacterium bovis subsp bovis AF2122/97
ucgccgcgguagacgccgcc

SEQ ID NO: 3110035 - RNA, 23 nt, Mycobacterium bovis subsp bovis AF2122/97
ucgccgcguccucgcccuggccg

SEQ ID NO: 3110036 - RNA, 15 nt, Mycobacterium bovis subsp bovis AF2122/97
ucgccgcuacgccgg

SEQ ID NO: 3110037 - RNA, 18 nt, Mycobacterium bovis subsp bovis AF2122/97
ucgccgcucgguccccgc

SEQ ID NO: 3110038 - RNA, 14 nt, Mycobacterium bovis subsp bovis AF2122/97
ucgccgcuggccag

SEQ ID NO: 3110039 - RNA, 16 nt, Mycobacterium bovis subsp bovis AF2122/97
ucgccgcuggccagca

SEQ ID NO: 3110040 - RNA, 20 nt, Mycobacterium bovis subsp bovis AF2122/97
ucgccgcuggccagcacacc

SEQ ID NO: 3110041 - RNA, 18 nt, Mycobacterium bovis subsp bovis AF2122/97
ucgccggaaagcccgucg

SEQ ID NO: 3110042 - RNA, 19 nt, Mycobacterium bovis subsp bovis AF2122/97
ucgccggacgggugcagcg

SEQ ID NO: 3110043 - RNA, 18 nt, Mycobacterium bovis subsp bovis AF2122/97
ucgccggacugcggcccg

SEQ ID NO: 3110044 - RNA, 19 nt, Mycobacterium bovis subsp bovis AF2122/97
ucgccggacugcggcccga

SEQ ID NO: 3110045 - RNA, 13 nt, Mycobacterium bovis subsp bovis AF2122/97
ucgccggagucga

SEQ ID NO: 3110046 - RNA, 15 nt, Mycobacterium bovis subsp bovis AF2122/97
ucgccggagucgacc

SEQ ID NO: 3110047 - RNA, 19 nt, Mycobacterium bovis subsp bovis AF2122/97
ucgccggauagcgcagcuc

SEQ ID NO: 3110048 - RNA, 21 nt, Mycobacterium bovis subsp bovis AF2122/97
ucgccggaucguucgcgugcc

SEQ ID NO: 3110049 - RNA, 22 nt, Mycobacterium bovis subsp bovis AF2122/97
ucgccggaugcugucagcagcc

SEQ ID NO: 3110050 - RNA, 14 nt, Mycobacterium bovis subsp bovis AF2122/97
ucgccggcaccgga

SEQ ID NO: 3110051 - RNA, 16 nt, Mycobacterium bovis subsp bovis AF2122/97
ucgccggcaccggaug

SEQ ID NO: 3110052 - RNA, 16 nt, Mycobacterium bovis subsp bovis AF2122/97
ucgccggcacgcagcc

SEQ ID NO: 3110053 - RNA, 18 nt, Mycobacterium bovis subsp bovis AF2122/97
ucgccggccaacugggcc

SEQ ID NO: 3110054 - RNA, 19 nt, Mycobacterium bovis subsp bovis AF2122/97
ucgccggccaacugggccg

SEQ ID NO: 3110055 - RNA, 16 nt, Mycobacterium bovis subsp bovis AF2122/97
ucgccggccaccagcc

SEQ ID NO: 3110056 - RNA, 13 nt, Mycobacterium bovis subsp bovis AF2122/97
ucgccggccaccc

SEQ ID NO: 3110057 - RNA, 14 nt, Mycobacterium bovis subsp bovis AF2122/97
ucgccggccacccg

SEQ ID NO: 3110058 - RNA, 22 nt, Mycobacterium bovis subsp bovis AF2122/97
ucgccggccacccgcgcgaugc

SEQ ID NO: 3110059 - RNA, 13 nt, Mycobacterium bovis subsp bovis AF2122/97
ucgccggccccgc

SEQ ID NO: 3110060 - RNA, 18 nt, Mycobacterium bovis subsp bovis AF2122/97
ucgccggccccgccggcg

SEQ ID NO: 3110061 - RNA, 20 nt, Mycobacterium bovis subsp bovis AF2122/97
ucgccggccccgccggcgcc

SEQ ID NO: 3110062 - RNA, 12 nt, Mycobacterium bovis subsp bovis AF2122/97
ucgccggccgcg

SEQ ID NO: 3110063 - RNA, 16 nt, Mycobacterium bovis subsp bovis AF2122/97
ucgccggccgcgugac

SEQ ID NO: 3110064 - RNA, 15 nt, Mycobacterium bovis subsp bovis AF2122/97
ucgccggccggcccg

SEQ ID NO: 3110065 - RNA, 18 nt, Mycobacterium bovis subsp bovis AF2122/97
ucgccggcgaacugaucg

SEQ ID NO: 3110066 - RNA, 17 nt, Mycobacterium bovis subsp bovis AF2122/97
ucgccggcgaaguuggu

SEQ ID NO: 3110067 - RNA, 16 nt, Mycobacterium bovis subsp bovis AF2122/97
ucgccggcgccagcag

SEQ ID NO: 3110068 - RNA, 22 nt, Mycobacterium bovis subsp bovis AF2122/97
ucgccggcgcgcagccgggcca

SEQ ID NO: 3110069 - RNA, 14 nt, Mycobacterium bovis subsp bovis AF2122/97
ucgccggcgcgccg

SEQ ID NO: 3110070 - RNA, 16 nt, Mycobacterium bovis subsp bovis AF2122/97
ucgccggcgcgccggg

SEQ ID NO: 3110071 - RNA, 23 nt, Mycobacterium bovis subsp bovis AF2122/97
ucgccggcgcgccgggcggcgcg

SEQ ID NO: 3110072 - RNA, 14 nt, Mycobacterium bovis subsp bovis AF2122/97
ucgccggcggcccg

SEQ ID NO: 3110073 - RNA, 18 nt, Mycobacterium bovis subsp bovis AF2122/97
ucgccggcuucgcccaga

SEQ ID NO: 3110074 - RNA, 21 nt, Mycobacterium bovis subsp bovis AF2122/97
ucgccggcuucgcccagagcc

SEQ ID NO: 3110075 - RNA, 17 nt, Mycobacterium bovis subsp bovis AF2122/97
ucgccgggacgauaccg

SEQ ID NO: 3110076 - RNA, 22 nt, Mycobacterium bovis subsp bovis AF2122/97
ucgccgggcagcuacggggcgg

SEQ ID NO: 3110077 - RNA, 20 nt, Mycobacterium bovis subsp bovis AF2122/97
ucgccgggcaguuuggcggc

SEQ ID NO: 3110078 - RNA, 21 nt, Mycobacterium bovis subsp bovis AF2122/97
ucgccgggccacguccugccc

SEQ ID NO: 3110079 - RNA, 14 nt, Mycobacterium bovis subsp bovis AF2122/97
ucgccgggcccguc

SEQ ID NO: 3110080 - RNA, 22 nt, Mycobacterium bovis subsp bovis AF2122/97
ucgccgggcggcauccugcacg

SEQ ID NO: 3110081 - RNA, 19 nt, Mycobacterium bovis subsp bovis AF2122/97
ucgccgggcugcaaaucgu

SEQ ID NO: 3110082 - RNA, 20 nt, Mycobacterium bovis subsp bovis AF2122/97
ucgccggggacgccgcggcg

SEQ ID NO: 3110083 - RNA, 21 nt, Mycobacterium bovis subsp bovis AF2122/97
ucgccggggacgccgcggcgc

SEQ ID NO: 3110084 - RNA, 22 nt, Mycobacterium bovis subsp bovis AF2122/97
ucgccggggacgccgcggcgcc

SEQ ID NO: 3110085 - RNA, 19 nt, Mycobacterium bovis subsp bovis AF2122/97
ucgccggggccgcuggcgg

SEQ ID NO: 3110086 - RNA, 13 nt, Mycobacterium bovis subsp bovis AF2122/97
ucgccgggucagc

SEQ ID NO: 3110087 - RNA, 16 nt, Mycobacterium bovis subsp bovis AF2122/97
ucgccgggucagcccg

SEQ ID NO: 3110088 - RNA, 16 nt, Mycobacterium bovis subsp bovis AF2122/97
ucgccgggugcaggcg

SEQ ID NO: 3110089 - RNA, 18 nt, Mycobacterium bovis subsp bovis AF2122/97
ucgccgguaugccgaacg

SEQ ID NO: 3110090 - RNA, 15 nt, Mycobacterium bovis subsp bovis AF2122/97
ucgccggucaggccg

SEQ ID NO: 3110091 - RNA, 23 nt, Mycobacterium bovis subsp bovis AF2122/97
ucgccggucaggccgccgcggcg

SEQ ID NO: 3110092 - RNA, 15 nt, Mycobacterium bovis subsp bovis AF2122/97
ucgccggucccccgc

SEQ ID NO: 3110093 - RNA, 20 nt, Mycobacterium bovis subsp bovis AF2122/97
ucgccggugacgacgucgcc

SEQ ID NO: 3110094 - RNA, 18 nt, Mycobacterium bovis subsp bovis AF2122/97
ucgccggugacgggguug

SEQ ID NO: 3110095 - RNA, 14 nt, Mycobacterium bovis subsp bovis AF2122/97
ucgccggugagccg

SEQ ID NO: 3110096 - RNA, 14 nt, Mycobacterium bovis subsp bovis AF2122/97
ucgccgguguccuu

SEQ ID NO: 3110097 - RNA, 18 nt, Mycobacterium bovis subsp bovis AF2122/97
ucgccgguguccuuggcc

SEQ ID NO: 3110098 - RNA, 18 nt, Mycobacterium bovis subsp bovis AF2122/97
ucgccguaagcaccagcc

SEQ ID NO: 3110099 - RNA, 23 nt, Mycobacterium bovis subsp bovis AF2122/97
ucgccguacaaccacccacccgc

SEQ ID NO: 3110100 - RNA, 19 nt, Mycobacterium bovis subsp bovis AF2122/97
ucgccguacaucagcgcga

SEQ ID NO: 3110101 - RNA, 21 nt, Mycobacterium bovis subsp bovis AF2122/97
ucgccguacaucagcgcgaac

SEQ ID NO: 3110102 - RNA, 18 nt, Mycobacterium bovis subsp bovis AF2122/97
ucgccgucacgcacgccg

SEQ ID NO: 3110103 - RNA, 20 nt, Mycobacterium bovis subsp bovis AF2122/97
ucgccgucacgcacgccgcg

SEQ ID NO: 3110104 - RNA, 15 nt, Mycobacterium bovis subsp bovis AF2122/97
ucgccgucgcggcac

SEQ ID NO: 3110105 - RNA, 13 nt, Mycobacterium bovis subsp bovis AF2122/97
ucgccgucggugc

SEQ ID NO: 3110106 - RNA, 20 nt, Mycobacterium bovis subsp bovis AF2122/97
ucgccgucguacucgaccgc

SEQ ID NO: 3110107 - RNA, 18 nt, Mycobacterium bovis subsp bovis AF2122/97
ucgccgucgucgaucgac

SEQ ID NO: 3110108 - RNA, 14 nt, Mycobacterium bovis subsp bovis AF2122/97
ucgccgugaccagg

SEQ ID NO: 3110109 - RNA, 23 nt, Mycobacterium bovis subsp bovis AF2122/97
ucgccgugcgccgugcgaucguc

SEQ ID NO: 3110110 - RNA, 13 nt, Mycobacterium bovis subsp bovis AF2122/97
ucgccguggugga

SEQ ID NO: 3110111 - RNA, 18 nt, Mycobacterium bovis subsp bovis AF2122/97
ucgccguugccggcgacc

SEQ ID NO: 3110112 - RNA, 14 nt, Mycobacterium bovis subsp bovis AF2122/97
ucgccuaccggccu

SEQ ID NO: 3110113 - RNA, 16 nt, Mycobacterium bovis subsp bovis AF2122/97
ucgccucaccacgucg

SEQ ID NO: 3110114 - RNA, 18 nt, Mycobacterium bovis subsp bovis AF2122/97
ucgccuccucgacgucgg

SEQ ID NO: 3110115 - RNA, 14 nt, Mycobacterium bovis subsp bovis AF2122/97
ucgccuccugccgc

SEQ ID NO: 3110116 - RNA, 19 nt, Mycobacterium bovis subsp bovis AF2122/97
ucgccucgacgcggcaggc

SEQ ID NO: 3110117 - RNA, 16 nt, Mycobacterium bovis subsp bovis AF2122/97
ucgccucggcgcugcg

SEQ ID NO: 3110118 - RNA, 17 nt, Mycobacterium bovis subsp bovis AF2122/97
ucgccucggcguaggcg

SEQ ID NO: 3110119 - RNA, 20 nt, Mycobacterium bovis subsp bovis AF2122/97
ucgccucggcguaggcgaug

SEQ ID NO: 3110120 - RNA, 16 nt, Mycobacterium bovis subsp bovis AF2122/97
ucgccugagcgccgcg

SEQ ID NO: 3110121 - RNA, 18 nt, Mycobacterium bovis subsp bovis AF2122/97
ucgccugcccccgcgcgc

SEQ ID NO: 3110122 - RNA, 21 nt, Mycobacterium bovis subsp bovis AF2122/97
ucgccugcccccgcgcgcacg

SEQ ID NO: 3110123 - RNA, 13 nt, Mycobacterium bovis subsp bovis AF2122/97
ucgccugccgacg

SEQ ID NO: 3110124 - RNA, 15 nt, Mycobacterium bovis subsp bovis AF2122/97
ucgccugcgggaacg

SEQ ID NO: 3110125 - RNA, 12 nt, Mycobacterium bovis subsp bovis AF2122/97
ucgccuggaaga

SEQ ID NO: 3110126 - RNA, 21 nt, Mycobacterium bovis subsp bovis AF2122/97
ucgccuggaagaucacgcguc

SEQ ID NO: 3110127 - RNA, 22 nt, Mycobacterium bovis subsp bovis AF2122/97
ucgccuggaagaucacgcgucg

SEQ ID NO: 3110128 - RNA, 15 nt, Mycobacterium bovis subsp bovis AF2122/97
ucgccuucccagccg

SEQ ID NO: 3110129 - RNA, 17 nt, Mycobacterium bovis subsp bovis AF2122/97
ucgccuuggcgcccgcg

SEQ ID NO: 3110130 - RNA, 19 nt, Mycobacterium bovis subsp bovis AF2122/97
ucgccuuggcgcccgcgaa

SEQ ID NO: 3110131 - RNA, 16 nt, Mycobacterium bovis subsp bovis AF2122/97
ucgcgaaacaccagac

SEQ ID NO: 3110132 - RNA, 19 nt, Mycobacterium bovis subsp bovis AF2122/97
ucgcgaaacagcacgcccg

SEQ ID NO: 3110133 - RNA, 14 nt, Mycobacterium bovis subsp bovis AF2122/97
ucgcgaaaccgccg

SEQ ID NO: 3110134 - RNA, 14 nt, Mycobacterium bovis subsp bovis AF2122/97
ucgcgaacaucgcc

SEQ ID NO: 3110135 - RNA, 16 nt, Mycobacterium bovis subsp bovis AF2122/97
ucgcgaacaucgccag

SEQ ID NO: 3110136 - RNA, 18 nt, Mycobacterium bovis subsp bovis AF2122/97
ucgcgaacaucgccagcg

SEQ ID NO: 3110137 - RNA, 23 nt, Mycobacterium bovis subsp bovis AF2122/97
ucgcgaacaucgccagcgccggc

SEQ ID NO: 3110138 - RNA, 18 nt, Mycobacterium bovis subsp bovis AF2122/97
ucgcgaacgaagucgacg

SEQ ID NO: 3110139 - RNA, 11 nt, Mycobacterium bovis subsp bovis AF2122/97
ucgcgaacucg

SEQ ID NO: 3110140 - RNA, 21 nt, Mycobacterium bovis subsp bovis AF2122/97
ucgcgaagaacgacgccaccg

SEQ ID NO: 3110141 - RNA, 22 nt, Mycobacterium bovis subsp bovis AF2122/97
ucgcgaagaacgacgccaccgc

SEQ ID NO: 3110142 - RNA, 21 nt, Mycobacterium bovis subsp bovis AF2122/97
ucgcgaagaauaaggagaacc

SEQ ID NO: 3110143 - RNA, 14 nt, Mycobacterium bovis subsp bovis AF2122/97
ucgcgaagccgguu

SEQ ID NO: 3110144 - RNA, 20 nt, Mycobacterium bovis subsp bovis AF2122/97
ucgcgaagcggaccgagccg

SEQ ID NO: 3110145 - RNA, 14 nt, Mycobacterium bovis subsp bovis AF2122/97
ucgcgaauccuggc

SEQ ID NO: 3110146 - RNA, 17 nt, Mycobacterium bovis subsp bovis AF2122/97
ucgcgacacgcggcccg

SEQ ID NO: 3110147 - RNA, 18 nt, Mycobacterium bovis subsp bovis AF2122/97
ucgcgacacggccauccg

SEQ ID NO: 3110148 - RNA, 19 nt, Mycobacterium bovis subsp bovis AF2122/97
ucgcgacaucgguggcggc

SEQ ID NO: 3110149 - RNA, 22 nt, Mycobacterium bovis subsp bovis AF2122/97
ucgcgacccgaucgcgccaggc

SEQ ID NO: 3110150 - RNA, 14 nt, Mycobacterium bovis subsp bovis AF2122/97
ucgcgaccgcgggc

SEQ ID NO: 3110151 - RNA, 13 nt, Mycobacterium bovis subsp bovis AF2122/97
ucgcgacgacgua

SEQ ID NO: 3110152 - RNA, 15 nt, Mycobacterium bovis subsp bovis AF2122/97
ucgcgacggcaagca

SEQ ID NO: 3110153 - RNA, 20 nt, Mycobacterium bovis subsp bovis AF2122/97
ucgcgacggggucgcgaugc

SEQ ID NO: 3110154 - RNA, 15 nt, Mycobacterium bovis subsp bovis AF2122/97
ucgcgacgucggccg

SEQ ID NO: 3110155 - RNA, 19 nt, Mycobacterium bovis subsp bovis AF2122/97
ucgcgacgucugccaggcg

SEQ ID NO: 3110156 - RNA, 19 nt, Mycobacterium bovis subsp bovis AF2122/97
ucgcgacuagacgccgccg

SEQ ID NO: 3110157 - RNA, 20 nt, Mycobacterium bovis subsp bovis AF2122/97
ucgcgacuagacgccgccgc

SEQ ID NO: 3110158 - RNA, 14 nt, Mycobacterium bovis subsp bovis AF2122/97
ucgcgagccagcug

SEQ ID NO: 3110159 - RNA, 22 nt, Mycobacterium bovis subsp bovis AF2122/97
ucgcgagccagcugcuccaccc

SEQ ID NO: 3110160 - RNA, 16 nt, Mycobacterium bovis subsp bovis AF2122/97
ucgcgagcgagccaac

SEQ ID NO: 3110161 - RNA, 21 nt, Mycobacterium bovis subsp bovis AF2122/97
ucgcgagcucccuaacaucgu

SEQ ID NO: 3110162 - RNA, 21 nt, Mycobacterium bovis subsp bovis AF2122/97
ucgcgagcugcgacgaugccg

SEQ ID NO: 3110163 - RNA, 18 nt, Mycobacterium bovis subsp bovis AF2122/97
ucgcgagcuuggccggca

SEQ ID NO: 3110164 - RNA, 20 nt, Mycobacterium bovis subsp bovis AF2122/97
ucgcgaggcgucaccccggu

SEQ ID NO: 3110165 - RNA, 17 nt, Mycobacterium bovis subsp bovis AF2122/97
ucgcgaggcucgcgugg

SEQ ID NO: 3110166 - RNA, 23 nt, Mycobacterium bovis subsp bovis AF2122/97
ucgcgaggcuguccgaaccgacg

SEQ ID NO: 3110167 - RNA, 17 nt, Mycobacterium bovis subsp bovis AF2122/97
ucgcgagguccagcaug

SEQ ID NO: 3110168 - RNA, 19 nt, Mycobacterium bovis subsp bovis AF2122/97
ucgcgauaaggaugcaucg

SEQ ID NO: 3110169 - RNA, 16 nt, Mycobacterium bovis subsp bovis AF2122/97
ucgcgauagccgccgc

SEQ ID NO: 3110170 - RNA, 17 nt, Mycobacterium bovis subsp bovis AF2122/97
ucgcgauagccgccgcg

SEQ ID NO: 3110171 - RNA, 13 nt, Mycobacterium bovis subsp bovis AF2122/97
ucgcgauccaccc

SEQ ID NO: 3110172 - RNA, 20 nt, Mycobacterium bovis subsp bovis AF2122/97
ucgcgaucgcagugagcagc

SEQ ID NO: 3110173 - RNA, 22 nt, Mycobacterium bovis subsp bovis AF2122/97
ucgcgauguccuuguuggccag

SEQ ID NO: 3110174 - RNA, 19 nt, Mycobacterium bovis subsp bovis AF2122/97
ucgcgaugugcgccaccuc

SEQ ID NO: 3110175 - RNA, 15 nt, Mycobacterium bovis subsp bovis AF2122/97
ucgcgcaaccagccc

SEQ ID NO: 3110176 - RNA, 15 nt, Mycobacterium bovis subsp bovis AF2122/97
ucgcgcaaccgggcg

SEQ ID NO: 3110177 - RNA, 21 nt, Mycobacterium bovis subsp bovis AF2122/97
ucgcgcaaggcgccgcagggc

SEQ ID NO: 3110178 - RNA, 20 nt, Mycobacterium bovis subsp bovis AF2122/97
ucgcgcacauaggcgaucgc

SEQ ID NO: 3110179 - RNA, 14 nt, Mycobacterium bovis subsp bovis AF2122/97
ucgcgcacccagcc

SEQ ID NO: 3110180 - RNA, 19 nt, Mycobacterium bovis subsp bovis AF2122/97
ucgcgcaccugaucgguca

SEQ ID NO: 3110181 - RNA, 14 nt, Mycobacterium bovis subsp bovis AF2122/97
ucgcgcacgcccug

SEQ ID NO: 3110182 - RNA, 20 nt, Mycobacterium bovis subsp bovis AF2122/97
ucgcgcacggcccgagccgc

SEQ ID NO: 3110183 - RNA, 11 nt, Mycobacterium bovis subsp bovis AF2122/97
ucgcgcacguc

SEQ ID NO: 3110184 - RNA, 19 nt, Mycobacterium bovis subsp bovis AF2122/97
ucgcgcagcaucuccgccg

SEQ ID NO: 3110185 - RNA, 22 nt, Mycobacterium bovis subsp bovis AF2122/97
ucgcgcagcauggugcggcggc

SEQ ID NO: 3110186 - RNA, 23 nt, Mycobacterium bovis subsp bovis AF2122/97
ucgcgcagcauggugcggcggcg

SEQ ID NO: 3110187 - RNA, 17 nt, Mycobacterium bovis subsp bovis AF2122/97
ucgcgcagccgccgcgc

SEQ ID NO: 3110188 - RNA, 19 nt, Mycobacterium bovis subsp bovis AF2122/97
ucgcgcagccgccgcgccc

SEQ ID NO: 3110189 - RNA, 14 nt, Mycobacterium bovis subsp bovis AF2122/97
ucgcgcagcgccgc

SEQ ID NO: 3110190 - RNA, 18 nt, Mycobacterium bovis subsp bovis AF2122/97
ucgcgcagcgccgccacc

SEQ ID NO: 3110191 - RNA, 13 nt, Mycobacterium bovis subsp bovis AF2122/97
ucgcgcagcgcga

SEQ ID NO: 3110192 - RNA, 18 nt, Mycobacterium bovis subsp bovis AF2122/97
ucgcgcagcgcgaucgcg

SEQ ID NO: 3110193 - RNA, 19 nt, Mycobacterium bovis subsp bovis AF2122/97
ucgcgcagcgucaucgcgu

SEQ ID NO: 3110194 - RNA, 15 nt, Mycobacterium bovis subsp bovis AF2122/97
ucgcgcagcuccacc

SEQ ID NO: 3110195 - RNA, 13 nt, Mycobacterium bovis subsp bovis AF2122/97
ucgcgcaggaagc

SEQ ID NO: 3110196 - RNA, 17 nt, Mycobacterium bovis subsp bovis AF2122/97
ucgcgcaggaagcccac

SEQ ID NO: 3110197 - RNA, 22 nt, Mycobacterium bovis subsp bovis AF2122/97
ucgcgcaggaagcccacgaucg

SEQ ID NO: 3110198 - RNA, 22 nt, Mycobacterium bovis subsp bovis AF2122/97
ucgcgcaguuggccaugcaccg

SEQ ID NO: 3110199 - RNA, 19 nt, Mycobacterium bovis subsp bovis AF2122/97
ucgcgcauugccgacgcgc

SEQ ID NO: 3110200 - RNA, 17 nt, Mycobacterium bovis subsp bovis AF2122/97
ucgcgcauugcgcuucc

SEQ ID NO: 3110201 - RNA, 14 nt, Mycobacterium bovis subsp bovis AF2122/97
ucgcgccaggccac

SEQ ID NO: 3110202 - RNA, 15 nt, Mycobacterium bovis subsp bovis AF2122/97
ucgcgccaggccacg

SEQ ID NO: 3110203 - RNA, 22 nt, Mycobacterium bovis subsp bovis AF2122/97
ucgcgccaggccacguagcagc

SEQ ID NO: 3110204 - RNA, 21 nt, Mycobacterium bovis subsp bovis AF2122/97
ucgcgccaggcgcgaucgcgc

SEQ ID NO: 3110205 - RNA, 18 nt, Mycobacterium bovis subsp bovis AF2122/97
ucgcgccauacuggcggu

SEQ ID NO: 3110206 - RNA, 19 nt, Mycobacterium bovis subsp bovis AF2122/97
ucgcgccaucgucgcgccg

SEQ ID NO: 3110207 - RNA, 21 nt, Mycobacterium bovis subsp bovis AF2122/97
ucgcgccaucgucgcgccgcg

SEQ ID NO: 3110208 - RNA, 21 nt, Mycobacterium bovis subsp bovis AF2122/97
ucgcgcccucagccgcggcca

SEQ ID NO: 3110209 - RNA, 12 nt, Mycobacterium bovis subsp bovis AF2122/97
ucgcgccgcgag

SEQ ID NO: 3110210 - RNA, 13 nt, Mycobacterium bovis subsp bovis AF2122/97
ucgcgccgguggu

SEQ ID NO: 3110211 - RNA, 15 nt, Mycobacterium bovis subsp bovis AF2122/97
ucgcgccggugguca

SEQ ID NO: 3110212 - RNA, 15 nt, Mycobacterium bovis subsp bovis AF2122/97
ucgcgccgucggcga

SEQ ID NO: 3110213 - RNA, 15 nt, Mycobacterium bovis subsp bovis AF2122/97
ucgcgccgucgucga

SEQ ID NO: 3110214 - RNA, 21 nt, Mycobacterium bovis subsp bovis AF2122/97
ucgcgcgaccuggucgaacug

SEQ ID NO: 3110215 - RNA, 13 nt, Mycobacterium bovis subsp bovis AF2122/97
ucgcgcgcaaccg

SEQ ID NO: 3110216 - RNA, 14 nt, Mycobacterium bovis subsp bovis AF2122/97
ucgcgcgcaccggg

SEQ ID NO: 3110217 - RNA, 16 nt, Mycobacterium bovis subsp bovis AF2122/97
ucgcgcgcaccggguu

SEQ ID NO: 3110218 - RNA, 11 nt, Mycobacterium bovis subsp bovis AF2122/97
ucgcgcgccga

SEQ ID NO: 3110219 - RNA, 13 nt, Mycobacterium bovis subsp bovis AF2122/97
ucgcgcgccgacc

SEQ ID NO: 3110220 - RNA, 16 nt, Mycobacterium bovis subsp bovis AF2122/97
ucgcgcgccgaccgac

SEQ ID NO: 3110221 - RNA, 14 nt, Mycobacterium bovis subsp bovis AF2122/97
ucgcgcgccgcgac

SEQ ID NO: 3110222 - RNA, 23 nt, Mycobacterium bovis subsp bovis AF2122/97
ucgcgcgcgaacacccgaagccg

SEQ ID NO: 3110223 - RNA, 16 nt, Mycobacterium bovis subsp bovis AF2122/97
ucgcgcgcggcauggg

SEQ ID NO: 3110224 - RNA, 12 nt, Mycobacterium bovis subsp bovis AF2122/97
ucgcgcgcucgc

SEQ ID NO: 3110225 - RNA, 14 nt, Mycobacterium bovis subsp bovis AF2122/97
ucgcgcgcucgcgg

SEQ ID NO: 3110226 - RNA, 14 nt, Mycobacterium bovis subsp bovis AF2122/97
ucgcgcgcugggcg

SEQ ID NO: 3110227 - RNA, 17 nt, Mycobacterium bovis subsp bovis AF2122/97
ucgcgcgcugggcgcgc

SEQ ID NO: 3110228 - RNA, 23 nt, Mycobacterium bovis subsp bovis AF2122/97
ucgcgcggcaccgauggcgcacc

SEQ ID NO: 3110229 - RNA, 20 nt, Mycobacterium bovis subsp bovis AF2122/97
ucgcgcggcugugcccgauc

SEQ ID NO: 3110230 - RNA, 24 nt, Mycobacterium bovis subsp bovis AF2122/97
ucgcgcggcugugcccgaucagcc

SEQ ID NO: 3110231 - RNA, 14 nt, Mycobacterium bovis subsp bovis AF2122/97
ucgcgcgucgucgc

SEQ ID NO: 3110232 - RNA, 22 nt, Mycobacterium bovis subsp bovis AF2122/97
ucgcgcucauugcaucugccaa

SEQ ID NO: 3110233 - RNA, 24 nt, Mycobacterium bovis subsp bovis AF2122/97
ucgcgcucgacaaagccacgcaga

SEQ ID NO: 3110234 - RNA, 13 nt, Mycobacterium bovis subsp bovis AF2122/97
ucgcgcucgcacc

SEQ ID NO: 3110235 - RNA, 15 nt, Mycobacterium bovis subsp bovis AF2122/97
ucgcgcucgccggug

SEQ ID NO: 3110236 - RNA, 20 nt, Mycobacterium bovis subsp bovis AF2122/97
ucgcgcucgcucacgccguc

SEQ ID NO: 3110237 - RNA, 18 nt, Mycobacterium bovis subsp bovis AF2122/97
ucgcgcugaagguggcga

SEQ ID NO: 3110238 - RNA, 14 nt, Mycobacterium bovis subsp bovis AF2122/97
ucgcgcugaucagc

SEQ ID NO: 3110239 - RNA, 13 nt, Mycobacterium bovis subsp bovis AF2122/97
ucgcgcugccggc

SEQ ID NO: 3110240 - RNA, 23 nt, Mycobacterium bovis subsp bovis AF2122/97
ucgcgcugcggcccacaccagcg

SEQ ID NO: 3110241 - RNA, 14 nt, Mycobacterium bovis subsp bovis AF2122/97
ucgcgcuggccaug

SEQ ID NO: 3110242 - RNA, 12 nt, Mycobacterium bovis subsp bovis AF2122/97
ucgcgcuggcgc

SEQ ID NO: 3110243 - RNA, 23 nt, Mycobacterium bovis subsp bovis AF2122/97
ucgcgcuggcgcccuugccggcg

SEQ ID NO: 3110244 - RNA, 20 nt, Mycobacterium bovis subsp bovis AF2122/97
ucgcgcuggcgccggccagc

SEQ ID NO: 3110245 - RNA, 15 nt, Mycobacterium bovis subsp bovis AF2122/97
ucgcgcuguccacga

SEQ ID NO: 3110246 - RNA, 21 nt, Mycobacterium bovis subsp bovis AF2122/97
ucgcggaagcgggcgaugccg

SEQ ID NO: 3110247 - RNA, 17 nt, Mycobacterium bovis subsp bovis AF2122/97
ucgcggaagugucgucg

SEQ ID NO: 3110248 - RNA, 22 nt, Mycobacterium bovis subsp bovis AF2122/97
ucgcggacagguagucgccggu

SEQ ID NO: 3110249 - RNA, 15 nt, Mycobacterium bovis subsp bovis AF2122/97
ucgcggacccgcgcg

SEQ ID NO: 3110250 - RNA, 20 nt, Mycobacterium bovis subsp bovis AF2122/97
ucgcggacccgucggcgugg

SEQ ID NO: 3110251 - RNA, 16 nt, Mycobacterium bovis subsp bovis AF2122/97
ucgcggacggugcggu

SEQ ID NO: 3110252 - RNA, 14 nt, Mycobacterium bovis subsp bovis AF2122/97
ucgcggacgucgcc

SEQ ID NO: 3110253 - RNA, 18 nt, Mycobacterium bovis subsp bovis AF2122/97
ucgcggagccaggacgac

SEQ ID NO: 3110254 - RNA, 23 nt, Mycobacterium bovis subsp bovis AF2122/97
ucgcggagccaggacgacgccga

SEQ ID NO: 3110255 - RNA, 23 nt, Mycobacterium bovis subsp bovis AF2122/97
ucgcggagccgucgcaucagguc

SEQ ID NO: 3110256 - RNA, 13 nt, Mycobacterium bovis subsp bovis AF2122/97
ucgcggagucugc

SEQ ID NO: 3110257 - RNA, 19 nt, Mycobacterium bovis subsp bovis AF2122/97
ucgcggagucugcugaucg

SEQ ID NO: 3110258 - RNA, 18 nt, Mycobacterium bovis subsp bovis AF2122/97
ucgcggaucagcccgcgc

SEQ ID NO: 3110259 - RNA, 18 nt, Mycobacterium bovis subsp bovis AF2122/97
ucgcggaucugggcggcc

SEQ ID NO: 3110260 - RNA, 19 nt, Mycobacterium bovis subsp bovis AF2122/97
ucgcggauuucucgcccug

SEQ ID NO: 3110261 - RNA, 20 nt, Mycobacterium bovis subsp bovis AF2122/97
ucgcggcaaugaggccgucu

SEQ ID NO: 3110262 - RNA, 22 nt, Mycobacterium bovis subsp bovis AF2122/97
ucgcggcacgcccacagcugac

SEQ ID NO: 3110263 - RNA, 18 nt, Mycobacterium bovis subsp bovis AF2122/97
ucgcggcagccggcggag

SEQ ID NO: 3110264 - RNA, 19 nt, Mycobacterium bovis subsp bovis AF2122/97
ucgcggcaucgacgcggcc

SEQ ID NO: 3110265 - RNA, 19 nt, Mycobacterium bovis subsp bovis AF2122/97
ucgcggccaacccauuucg

SEQ ID NO: 3110266 - RNA, 13 nt, Mycobacterium bovis subsp bovis AF2122/97
ucgcggccacggu

SEQ ID NO: 3110267 - RNA, 15 nt, Mycobacterium bovis subsp bovis AF2122/97
ucgcggccacgguca

SEQ ID NO: 3110268 - RNA, 13 nt, Mycobacterium bovis subsp bovis AF2122/97
ucgcggccagcag

SEQ ID NO: 3110269 - RNA, 17 nt, Mycobacterium bovis subsp bovis AF2122/97
ucgcggccgagacggcg

SEQ ID NO: 3110270 - RNA, 19 nt, Mycobacterium bovis subsp bovis AF2122/97
ucgcggccgagacggcguu

SEQ ID NO: 3110271 - RNA, 14 nt, Mycobacterium bovis subsp bovis AF2122/97
ucgcggccgcggcc

SEQ ID NO: 3110272 - RNA, 15 nt, Mycobacterium bovis subsp bovis AF2122/97
ucgcggccggcggcc

SEQ ID NO: 3110273 - RNA, 13 nt, Mycobacterium bovis subsp bovis AF2122/97
ucgcggccggcgu

SEQ ID NO: 3110274 - RNA, 17 nt, Mycobacterium bovis subsp bovis AF2122/97
ucgcggccggcgucggc

SEQ ID NO: 3110275 - RNA, 15 nt, Mycobacterium bovis subsp bovis AF2122/97
ucgcggccgucgcgg

SEQ ID NO: 3110276 - RNA, 15 nt, Mycobacterium bovis subsp bovis AF2122/97
ucgcggcgacccggu

SEQ ID NO: 3110277 - RNA, 23 nt, Mycobacterium bovis subsp bovis AF2122/97
ucgcggcgacccggucgcggaac

SEQ ID NO: 3110278 - RNA, 20 nt, Mycobacterium bovis subsp bovis AF2122/97
ucgcggcgagcaccacccca

SEQ ID NO: 3110279 - RNA, 13 nt, Mycobacterium bovis subsp bovis AF2122/97
ucgcggcgaucgc

SEQ ID NO: 3110280 - RNA, 14 nt, Mycobacterium bovis subsp bovis AF2122/97
ucgcggcgcagguc

SEQ ID NO: 3110281 - RNA, 21 nt, Mycobacterium bovis subsp bovis AF2122/97
ucgcggcgccgucgucagcgg

SEQ ID NO: 3110282 - RNA, 16 nt, Mycobacterium bovis subsp bovis AF2122/97
ucgcggcgcggccgca

SEQ ID NO: 3110283 - RNA, 11 nt, Mycobacterium bovis subsp bovis AF2122/97
ucgcggcggca

SEQ ID NO: 3110284 - RNA, 22 nt, Mycobacterium bovis subsp bovis AF2122/97
ucgcggcggcacuacgcagccg

SEQ ID NO: 3110285 - RNA, 11 nt, Mycobacterium bovis subsp bovis AF2122/97
ucgcggcggcg

SEQ ID NO: 3110286 - RNA, 12 nt, Mycobacterium bovis subsp bovis AF2122/97
ucgcggcggcga

SEQ ID NO: 3110287 - RNA, 22 nt, Mycobacterium bovis subsp bovis AF2122/97
ucgcggcggcgauccggucggg

SEQ ID NO: 3110288 - RNA, 23 nt, Mycobacterium bovis subsp bovis AF2122/97
ucgcggcggucccugaagccagc

SEQ ID NO: 3110289 - RNA, 21 nt, Mycobacterium bovis subsp bovis AF2122/97
ucgcggcggucguugauuucg

SEQ ID NO: 3110290 - RNA, 13 nt, Mycobacterium bovis subsp bovis AF2122/97
ucgcggcggugaa

SEQ ID NO: 3110291 - RNA, 19 nt, Mycobacterium bovis subsp bovis AF2122/97
ucgcgggacaacagcaugg

SEQ ID NO: 3110292 - RNA, 19 nt, Mycobacterium bovis subsp bovis AF2122/97
ucgcgggacgcgacucggc

SEQ ID NO: 3110293 - RNA, 21 nt, Mycobacterium bovis subsp bovis AF2122/97
ucgcgggacgcgacucggcgg

SEQ ID NO: 3110294 - RNA, 23 nt, Mycobacterium bovis subsp bovis AF2122/97
ucgcgggacgcgacucggcgguc

SEQ ID NO: 3110295 - RNA, 19 nt, Mycobacterium bovis subsp bovis AF2122/97
ucgcgggagaaaacggcgg

SEQ ID NO: 3110296 - RNA, 20 nt, Mycobacterium bovis subsp bovis AF2122/97
ucgcgggagaaaacggcggc

SEQ ID NO: 3110297 - RNA, 21 nt, Mycobacterium bovis subsp bovis AF2122/97
ucgcgggagaaaacggcggcg

SEQ ID NO: 3110298 - RNA, 22 nt, Mycobacterium bovis subsp bovis AF2122/97
ucgcgggauccaggcccagccg

SEQ ID NO: 3110299 - RNA, 15 nt, Mycobacterium bovis subsp bovis AF2122/97
ucgcgggcagggccu

SEQ ID NO: 3110300 - RNA, 17 nt, Mycobacterium bovis subsp bovis AF2122/97
ucgcgggcagggccucg

SEQ ID NO: 3110301 - RNA, 20 nt, Mycobacterium bovis subsp bovis AF2122/97
ucgcgggccgcgucgaacug

SEQ ID NO: 3110302 - RNA, 15 nt, Mycobacterium bovis subsp bovis AF2122/97
ucgcgggcgaucggc

SEQ ID NO: 3110303 - RNA, 15 nt, Mycobacterium bovis subsp bovis AF2122/97
ucgcgggcgauggcc

SEQ ID NO: 3110304 - RNA, 14 nt, Mycobacterium bovis subsp bovis AF2122/97
ucgcgggcggcgcu

SEQ ID NO: 3110305 - RNA, 13 nt, Mycobacterium bovis subsp bovis AF2122/97
ucgcgggcggcgu

SEQ ID NO: 3110306 - RNA, 20 nt, Mycobacterium bovis subsp bovis AF2122/97
ucgcgggcuuaugcacgacg

SEQ ID NO: 3110307 - RNA, 13 nt, Mycobacterium bovis subsp bovis AF2122/97
ucgcggggccgga

SEQ ID NO: 3110308 - RNA, 18 nt, Mycobacterium bovis subsp bovis AF2122/97
ucgcgggguaggcccagc

SEQ ID NO: 3110309 - RNA, 22 nt, Mycobacterium bovis subsp bovis AF2122/97
ucgcggguguuccacaccaggc

SEQ ID NO: 3110310 - RNA, 20 nt, Mycobacterium bovis subsp bovis AF2122/97
ucgcgguaccaucaccgcgc

SEQ ID NO: 3110311 - RNA, 15 nt, Mycobacterium bovis subsp bovis AF2122/97
ucgcgguagccgcgg

SEQ ID NO: 3110312 - RNA, 16 nt, Mycobacterium bovis subsp bovis AF2122/97
ucgcgguagccuggcu

SEQ ID NO: 3110313 - RNA, 17 nt, Mycobacterium bovis subsp bovis AF2122/97
ucgcgguagcgccguga

SEQ ID NO: 3110314 - RNA, 23 nt, Mycobacterium bovis subsp bovis AF2122/97
ucgcgguaguugucccgccgcgc

SEQ ID NO: 3110315 - RNA, 22 nt, Mycobacterium bovis subsp bovis AF2122/97
ucgcggucaugggaucaggcug

SEQ ID NO: 3110316 - RNA, 17 nt, Mycobacterium bovis subsp bovis AF2122/97
ucgcgguccaacagcgc

SEQ ID NO: 3110317 - RNA, 17 nt, Mycobacterium bovis subsp bovis AF2122/97
ucgcggucccacggccg

SEQ ID NO: 3110318 - RNA, 20 nt, Mycobacterium bovis subsp bovis AF2122/97
ucgcggucccacggccggcc

SEQ ID NO: 3110319 - RNA, 14 nt, Mycobacterium bovis subsp bovis AF2122/97
ucgcggucgccacc

SEQ ID NO: 3110320 - RNA, 16 nt, Mycobacterium bovis subsp bovis AF2122/97
ucgcggucgccaccgu

SEQ ID NO: 3110321 - RNA, 19 nt, Mycobacterium bovis subsp bovis AF2122/97
ucgcggucuuugagccggu

SEQ ID NO: 3110322 - RNA, 15 nt, Mycobacterium bovis subsp bovis AF2122/97
ucgcggugaccggcu

SEQ ID NO: 3110323 - RNA, 13 nt, Mycobacterium bovis subsp bovis AF2122/97
ucgcgguggccga

SEQ ID NO: 3110324 - RNA, 13 nt, Mycobacterium bovis subsp bovis AF2122/97
ucgcgguggcggc

SEQ ID NO: 3110325 - RNA, 22 nt, Mycobacterium bovis subsp bovis AF2122/97
ucgcgguggcggcggugccacg

SEQ ID NO: 3110326 - RNA, 14 nt, Mycobacterium bovis subsp bovis AF2122/97
ucgcggugguuggg

SEQ ID NO: 3110327 - RNA, 14 nt, Mycobacterium bovis subsp bovis AF2122/97
ucgcggugugcggc

SEQ ID NO: 3110328 - RNA, 18 nt, Mycobacterium bovis subsp bovis AF2122/97
ucgcggugugcggcagcc

SEQ ID NO: 3110329 - RNA, 23 nt, Mycobacterium bovis subsp bovis AF2122/97
ucgcgguuggagguaauccggcu

SEQ ID NO: 3110330 - RNA, 21 nt, Mycobacterium bovis subsp bovis AF2122/97
ucgcgguuguccuccgacggg

SEQ ID NO: 3110331 - RNA, 22 nt, Mycobacterium bovis subsp bovis AF2122/97
ucgcguaauuuggcuugcgccg

SEQ ID NO: 3110332 - RNA, 19 nt, Mycobacterium bovis subsp bovis AF2122/97
ucgcguaccaacaggaugg

SEQ ID NO: 3110333 - RNA, 17 nt, Mycobacterium bovis subsp bovis AF2122/97
ucgcguacguacugcuu

SEQ ID NO: 3110334 - RNA, 18 nt, Mycobacterium bovis subsp bovis AF2122/97
ucgcguagcuggccaggu

SEQ ID NO: 3110335 - RNA, 16 nt, Mycobacterium bovis subsp bovis AF2122/97
ucgcgucacaccagcg

SEQ ID NO: 3110336 - RNA, 17 nt, Mycobacterium bovis subsp bovis AF2122/97
ucgcgucacccggggcu

SEQ ID NO: 3110337 - RNA, 12 nt, Mycobacterium bovis subsp bovis AF2122/97
ucgcguccaccc

SEQ ID NO: 3110338 - RNA, 13 nt, Mycobacterium bovis subsp bovis AF2122/97
ucgcguccucggg

SEQ ID NO: 3110339 - RNA, 15 nt, Mycobacterium bovis subsp bovis AF2122/97
ucgcgucgacccgaa

SEQ ID NO: 3110340 - RNA, 22 nt, Mycobacterium bovis subsp bovis AF2122/97
ucgcgucgacccgaacugggcg

SEQ ID NO: 3110341 - RNA, 16 nt, Mycobacterium bovis subsp bovis AF2122/97
ucgcgucgaccggaca

SEQ ID NO: 3110342 - RNA, 14 nt, Mycobacterium bovis subsp bovis AF2122/97
ucgcgucgagcgcc

SEQ ID NO: 3110343 - RNA, 19 nt, Mycobacterium bovis subsp bovis AF2122/97
ucgcgucgagcgccggccg

SEQ ID NO: 3110344 - RNA, 16 nt, Mycobacterium bovis subsp bovis AF2122/97
ucgcgucgccgaugaa

SEQ ID NO: 3110345 - RNA, 23 nt, Mycobacterium bovis subsp bovis AF2122/97
ucgcgucgucuucuucgcggauc

SEQ ID NO: 3110346 - RNA, 22 nt, Mycobacterium bovis subsp bovis AF2122/97
ucgcgucugacaucgucgacga

SEQ ID NO: 3110347 - RNA, 14 nt, Mycobacterium bovis subsp bovis AF2122/97
ucgcgucugcucgc

SEQ ID NO: 3110348 - RNA, 19 nt, Mycobacterium bovis subsp bovis AF2122/97
ucgcgucugcucgccagcg

SEQ ID NO: 3110349 - RNA, 16 nt, Mycobacterium bovis subsp bovis AF2122/97
ucgcgugcaucgccug

SEQ ID NO: 3110350 - RNA, 15 nt, Mycobacterium bovis subsp bovis AF2122/97
ucgcgugccacagca

SEQ ID NO: 3110351 - RNA, 13 nt, Mycobacterium bovis subsp bovis AF2122/97
ucgcgugcggcug

SEQ ID NO: 3110352 - RNA, 23 nt, Mycobacterium bovis subsp bovis AF2122/97
ucgcgugcggugccgugguggac

SEQ ID NO: 3110353 - RNA, 14 nt, Mycobacterium bovis subsp bovis AF2122/97
ucgcguggccgccg

SEQ ID NO: 3110354 - RNA, 18 nt, Mycobacterium bovis subsp bovis AF2122/97
ucgcguggcgcaccaccg

SEQ ID NO: 3110355 - RNA, 18 nt, Mycobacterium bovis subsp bovis AF2122/97
ucgcgugggaugucgagc

SEQ ID NO: 3110356 - RNA, 23 nt, Mycobacterium bovis subsp bovis AF2122/97
ucgcguuagccaggucgauaccg

SEQ ID NO: 3110357 - RNA, 20 nt, Mycobacterium bovis subsp bovis AF2122/97
ucgcguucuccggcaccggu

SEQ ID NO: 3110358 - RNA, 14 nt, Mycobacterium bovis subsp bovis AF2122/97
ucgcguucugcacc

SEQ ID NO: 3110359 - RNA, 18 nt, Mycobacterium bovis subsp bovis AF2122/97
ucgcguucugcaccagcu

SEQ ID NO: 3110360 - RNA, 22 nt, Mycobacterium bovis subsp bovis AF2122/97
ucgcguucugcaccagcucggu

SEQ ID NO: 3110361 - RNA, 18 nt, Mycobacterium bovis subsp bovis AF2122/97
ucgcguuucgcgaugugc

SEQ ID NO: 3110362 - RNA, 16 nt, Mycobacterium bovis subsp bovis AF2122/97
ucgcuaauugcggccg

SEQ ID NO: 3110363 - RNA, 17 nt, Mycobacterium bovis subsp bovis AF2122/97
ucgcuaccuucuuggcu

SEQ ID NO: 3110364 - RNA, 15 nt, Mycobacterium bovis subsp bovis AF2122/97
ucgcuacgcaacggg

SEQ ID NO: 3110365 - RNA, 22 nt, Mycobacterium bovis subsp bovis AF2122/97
ucgcuacgcaacgggucggguc

SEQ ID NO: 3110366 - RNA, 16 nt, Mycobacterium bovis subsp bovis AF2122/97
ucgcuaucgugcgccg

SEQ ID NO: 3110367 - RNA, 13 nt, Mycobacterium bovis subsp bovis AF2122/97
ucgcucagggugu

SEQ ID NO: 3110368 - RNA, 20 nt, Mycobacterium bovis subsp bovis AF2122/97
ucgcucaguuuggcgggugc

SEQ ID NO: 3110369 - RNA, 20 nt, Mycobacterium bovis subsp bovis AF2122/97
ucgcucccccgcuacgcgcg

SEQ ID NO: 3110370 - RNA, 19 nt, Mycobacterium bovis subsp bovis AF2122/97
ucgcucccgguuggggugg

SEQ ID NO: 3110371 - RNA, 18 nt, Mycobacterium bovis subsp bovis AF2122/97
ucgcuccgaccgguggcg

SEQ ID NO: 3110372 - RNA, 20 nt, Mycobacterium bovis subsp bovis AF2122/97
ucgcuccgcggcgcagcacg

SEQ ID NO: 3110373 - RNA, 21 nt, Mycobacterium bovis subsp bovis AF2122/97
ucgcuccggcccugccgccgg

SEQ ID NO: 3110374 - RNA, 15 nt, Mycobacterium bovis subsp bovis AF2122/97
ucgcucgccgagcug

SEQ ID NO: 3110375 - RNA, 13 nt, Mycobacterium bovis subsp bovis AF2122/97
ucgcucucgguca

SEQ ID NO: 3110376 - RNA, 20 nt, Mycobacterium bovis subsp bovis AF2122/97
ucgcugaagccgucguaugc

SEQ ID NO: 3110377 - RNA, 20 nt, Mycobacterium bovis subsp bovis AF2122/97
ucgcugacccgggccgggcc

SEQ ID NO: 3110378 - RNA, 22 nt, Mycobacterium bovis subsp bovis AF2122/97
ucgcugaccgcguagaccagug

SEQ ID NO: 3110379 - RNA, 17 nt, Mycobacterium bovis subsp bovis AF2122/97
ucgcugaccuggggcuu

SEQ ID NO: 3110380 - RNA, 23 nt, Mycobacterium bovis subsp bovis AF2122/97
ucgcugaccuuguugaccaccac

SEQ ID NO: 3110381 - RNA, 17 nt, Mycobacterium bovis subsp bovis AF2122/97
ucgcugagcacggcgcg

SEQ ID NO: 3110382 - RNA, 17 nt, Mycobacterium bovis subsp bovis AF2122/97
ucgcugagcagcgccgc

SEQ ID NO: 3110383 - RNA, 15 nt, Mycobacterium bovis subsp bovis AF2122/97
ucgcugauccgggcg

SEQ ID NO: 3110384 - RNA, 15 nt, Mycobacterium bovis subsp bovis AF2122/97
ucgcugcaaccgccg

SEQ ID NO: 3110385 - RNA, 18 nt, Mycobacterium bovis subsp bovis AF2122/97
ucgcugcaaccgccggug

SEQ ID NO: 3110386 - RNA, 16 nt, Mycobacterium bovis subsp bovis AF2122/97
ucgcugcaccagcugc

SEQ ID NO: 3110387 - RNA, 12 nt, Mycobacterium bovis subsp bovis AF2122/97
ucgcugcagcag

SEQ ID NO: 3110388 - RNA, 22 nt, Mycobacterium bovis subsp bovis AF2122/97
ucgcugccagcggccgggcggc

SEQ ID NO: 3110389 - RNA, 21 nt, Mycobacterium bovis subsp bovis AF2122/97
ucgcugcccaucacacccggu

SEQ ID NO: 3110390 - RNA, 17 nt, Mycobacterium bovis subsp bovis AF2122/97
ucgcugccgccaccgcu

SEQ ID NO: 3110391 - RNA, 17 nt, Mycobacterium bovis subsp bovis AF2122/97
ucgcugccgccgucgcc

SEQ ID NO: 3110392 - RNA, 16 nt, Mycobacterium bovis subsp bovis AF2122/97
ucgcugcgacuggugc

SEQ ID NO: 3110393 - RNA, 22 nt, Mycobacterium bovis subsp bovis AF2122/97
ucgcugcgacuggugccugccg

SEQ ID NO: 3110394 - RNA, 19 nt, Mycobacterium bovis subsp bovis AF2122/97
ucgcugcggcgcuggccag

SEQ ID NO: 3110395 - RNA, 14 nt, Mycobacterium bovis subsp bovis AF2122/97
ucgcugcggugggc

SEQ ID NO: 3110396 - RNA, 19 nt, Mycobacterium bovis subsp bovis AF2122/97
ucgcugcggugggccaggu

SEQ ID NO: 3110397 - RNA, 15 nt, Mycobacterium bovis subsp bovis AF2122/97
ucgcugcugccgcac

SEQ ID NO: 3110398 - RNA, 16 nt, Mycobacterium bovis subsp bovis AF2122/97
ucgcugcugcgaucgc

SEQ ID NO: 3110399 - RNA, 12 nt, Mycobacterium bovis subsp bovis AF2122/97
ucgcuggccagg

SEQ ID NO: 3110400 - RNA, 12 nt, Mycobacterium bovis subsp bovis AF2122/97
ucgcuggccgcg

SEQ ID NO: 3110401 - RNA, 14 nt, Mycobacterium bovis subsp bovis AF2122/97
ucgcuggccggcac

SEQ ID NO: 3110402 - RNA, 20 nt, Mycobacterium bovis subsp bovis AF2122/97
ucgcuggccggcaccgugaa

SEQ ID NO: 3110403 - RNA, 21 nt, Mycobacterium bovis subsp bovis AF2122/97
ucgcuggcgacccaaaaugcc

SEQ ID NO: 3110404 - RNA, 20 nt, Mycobacterium bovis subsp bovis AF2122/97
ucgcuggcuugggccagcgc

SEQ ID NO: 3110405 - RNA, 15 nt, Mycobacterium bovis subsp bovis AF2122/97
ucgcugggacgggcg

SEQ ID NO: 3110406 - RNA, 16 nt, Mycobacterium bovis subsp bovis AF2122/97
ucgcugggcgcaacgc

SEQ ID NO: 3110407 - RNA, 15 nt, Mycobacterium bovis subsp bovis AF2122/97
ucgcugggugcgcga

SEQ ID NO: 3110408 - RNA, 18 nt, Mycobacterium bovis subsp bovis AF2122/97
ucgcuggguggcgggccg

SEQ ID NO: 3110409 - RNA, 21 nt, Mycobacterium bovis subsp bovis AF2122/97
ucgcugguauagcucacggug

SEQ ID NO: 3110410 - RNA, 22 nt, Mycobacterium bovis subsp bovis AF2122/97
ucgcugguauagcucacggugg

SEQ ID NO: 3110411 - RNA, 16 nt, Mycobacterium bovis subsp bovis AF2122/97
ucgcuguaggcagccu

SEQ ID NO: 3110412 - RNA, 20 nt, Mycobacterium bovis subsp bovis AF2122/97
ucgcuguaggccagcccggc

SEQ ID NO: 3110413 - RNA, 22 nt, Mycobacterium bovis subsp bovis AF2122/97
ucgcuguaggccagcccggcgu

SEQ ID NO: 3110414 - RNA, 16 nt, Mycobacterium bovis subsp bovis AF2122/97
ucgcuguccacugcca

SEQ ID NO: 3110415 - RNA, 18 nt, Mycobacterium bovis subsp bovis AF2122/97
ucgcuguugaagccgccc

SEQ ID NO: 3110416 - RNA, 22 nt, Mycobacterium bovis subsp bovis AF2122/97
ucgcuucagcgccaaugucagc

SEQ ID NO: 3110417 - RNA, 13 nt, Mycobacterium bovis subsp bovis AF2122/97
ucgcuucgcaagu

SEQ ID NO: 3110418 - RNA, 13 nt, Mycobacterium bovis subsp bovis AF2122/97
ucgcuugcgcacg

SEQ ID NO: 3110419 - RNA, 19 nt, Mycobacterium bovis subsp bovis AF2122/97
ucggaaaaccgcaccgucc

SEQ ID NO: 3110420 - RNA, 23 nt, Mycobacterium bovis subsp bovis AF2122/97
ucggaaacggaccuccucgccca

SEQ ID NO: 3110421 - RNA, 21 nt, Mycobacterium bovis subsp bovis AF2122/97
ucggaagaaacgucugccacg

SEQ ID NO: 3110422 - RNA, 15 nt, Mycobacterium bovis subsp bovis AF2122/97
ucggaauacaacagc

SEQ ID NO: 3110423 - RNA, 13 nt, Mycobacterium bovis subsp bovis AF2122/97
ucggaaucggcgg

SEQ ID NO: 3110424 - RNA, 13 nt, Mycobacterium bovis subsp bovis AF2122/97
ucggaaugggcgc

SEQ ID NO: 3110425 - RNA, 22 nt, Mycobacterium bovis subsp bovis AF2122/97
ucggacacagcccacaggcggc

SEQ ID NO: 3110426 - RNA, 18 nt, Mycobacterium bovis subsp bovis AF2122/97
ucggacagcagccggcgu

SEQ ID NO: 3110427 - RNA, 14 nt, Mycobacterium bovis subsp bovis AF2122/97
ucggaccacccggc

SEQ ID NO: 3110428 - RNA, 18 nt, Mycobacterium bovis subsp bovis AF2122/97
ucggaccuuccgggugaa

SEQ ID NO: 3110429 - RNA, 21 nt, Mycobacterium bovis subsp bovis AF2122/97
ucggacggccaucgccagccu

SEQ ID NO: 3110430 - RNA, 24 nt, Mycobacterium bovis subsp bovis AF2122/97
ucggacggcugagacagaccgggc

SEQ ID NO: 3110431 - RNA, 22 nt, Mycobacterium bovis subsp bovis AF2122/97
ucggacggcugguagcugcggu

SEQ ID NO: 3110432 - RNA, 21 nt, Mycobacterium bovis subsp bovis AF2122/97
ucggagaacacgucgacaccg

SEQ ID NO: 3110433 - RNA, 23 nt, Mycobacterium bovis subsp bovis AF2122/97
ucggagaacauguaggucgccgc

SEQ ID NO: 3110434 - RNA, 20 nt, Mycobacterium bovis subsp bovis AF2122/97
ucggagauacucgaguggcg

SEQ ID NO: 3110435 - RNA, 18 nt, Mycobacterium bovis subsp bovis AF2122/97
ucggagauuucgucgcug

SEQ ID NO: 3110436 - RNA, 18 nt, Mycobacterium bovis subsp bovis AF2122/97
ucggagccgacaacgacg

SEQ ID NO: 3110437 - RNA, 18 nt, Mycobacterium bovis subsp bovis AF2122/97
ucggagccgucgagcagc

SEQ ID NO: 3110438 - RNA, 16 nt, Mycobacterium bovis subsp bovis AF2122/97
ucggagcgcacgaacg

SEQ ID NO: 3110439 - RNA, 19 nt, Mycobacterium bovis subsp bovis AF2122/97
ucggagcgggcuccggcuc

SEQ ID NO: 3110440 - RNA, 17 nt, Mycobacterium bovis subsp bovis AF2122/97
ucggagcgggugcgggc

SEQ ID NO: 3110441 - RNA, 14 nt, Mycobacterium bovis subsp bovis AF2122/97
ucggagcugggcug

SEQ ID NO: 3110442 - RNA, 14 nt, Mycobacterium bovis subsp bovis AF2122/97
ucggaggcccgcca

SEQ ID NO: 3110443 - RNA, 19 nt, Mycobacterium bovis subsp bovis AF2122/97
ucggaggcccgccacaacg

SEQ ID NO: 3110444 - RNA, 21 nt, Mycobacterium bovis subsp bovis AF2122/97
ucggaggcccgccacaacggc

SEQ ID NO: 3110445 - RNA, 13 nt, Mycobacterium bovis subsp bovis AF2122/97
ucggaggcgacca

SEQ ID NO: 3110446 - RNA, 12 nt, Mycobacterium bovis subsp bovis AF2122/97
ucggaggcgauc

SEQ ID NO: 3110447 - RNA, 19 nt, Mycobacterium bovis subsp bovis AF2122/97
ucggagucaccagcaacag

SEQ ID NO: 3110448 - RNA, 14 nt, Mycobacterium bovis subsp bovis AF2122/97
ucggauccgcccgc

SEQ ID NO: 3110449 - RNA, 18 nt, Mycobacterium bovis subsp bovis AF2122/97
ucggaucgauuccgccgc

SEQ ID NO: 3110450 - RNA, 15 nt, Mycobacterium bovis subsp bovis AF2122/97
ucggaugaccaguga

SEQ ID NO: 3110451 - RNA, 19 nt, Mycobacterium bovis subsp bovis AF2122/97
ucggaugcaacccggugau

SEQ ID NO: 3110452 - RNA, 16 nt, Mycobacterium bovis subsp bovis AF2122/97
ucggaugucccuugac

SEQ ID NO: 3110453 - RNA, 16 nt, Mycobacterium bovis subsp bovis AF2122/97
ucggauuuuccgccug

SEQ ID NO: 3110454 - RNA, 16 nt, Mycobacterium bovis subsp bovis AF2122/97
ucggcaaaccaagcgc

SEQ ID NO: 3110455 - RNA, 19 nt, Mycobacterium bovis subsp bovis AF2122/97
ucggcaaaccaagcgcgcc

SEQ ID NO: 3110456 - RNA, 20 nt, Mycobacterium bovis subsp bovis AF2122/97
ucggcaaccaccucgugggc

SEQ ID NO: 3110457 - RNA, 24 nt, Mycobacterium bovis subsp bovis AF2122/97
ucggcaaccaccucgugggccacu

SEQ ID NO: 3110458 - RNA, 20 nt, Mycobacterium bovis subsp bovis AF2122/97
ucggcaacccgcaccagggu

SEQ ID NO: 3110459 - RNA, 18 nt, Mycobacterium bovis subsp bovis AF2122/97
ucggcaacgacccgccgc

SEQ ID NO: 3110460 - RNA, 22 nt, Mycobacterium bovis subsp bovis AF2122/97
ucggcaacgacccgccgcccca

SEQ ID NO: 3110461 - RNA, 17 nt, Mycobacterium bovis subsp bovis AF2122/97
ucggcaaggacguggcg

SEQ ID NO: 3110462 - RNA, 20 nt, Mycobacterium bovis subsp bovis AF2122/97
ucggcaaggacguggcgcug

SEQ ID NO: 3110463 - RNA, 15 nt, Mycobacterium bovis subsp bovis AF2122/97
ucggcaagucgacgc

SEQ ID NO: 3110464 - RNA, 24 nt, Mycobacterium bovis subsp bovis AF2122/97
ucggcaagucgacgccgcagcguc

SEQ ID NO: 3110465 - RNA, 20 nt, Mycobacterium bovis subsp bovis AF2122/97
ucggcaaugacggccugcac

SEQ ID NO: 3110466 - RNA, 18 nt, Mycobacterium bovis subsp bovis AF2122/97
ucggcaaugucuucgaua

SEQ ID NO: 3110467 - RNA, 23 nt, Mycobacterium bovis subsp bovis AF2122/97
ucggcacaggcggccagcaucgc

SEQ ID NO: 3110468 - RNA, 13 nt, Mycobacterium bovis subsp bovis AF2122/97
ucggcaccaccgc

SEQ ID NO: 3110469 - RNA, 15 nt, Mycobacterium bovis subsp bovis AF2122/97
ucggcaccaccgcga

SEQ ID NO: 3110470 - RNA, 18 nt, Mycobacterium bovis subsp bovis AF2122/97
ucggcaccaccgcgaccu

SEQ ID NO: 3110471 - RNA, 12 nt, Mycobacterium bovis subsp bovis AF2122/97
ucggcaccagcg

SEQ ID NO: 3110472 - RNA, 20 nt, Mycobacterium bovis subsp bovis AF2122/97
ucggcaccagcgcgcgccga

SEQ ID NO: 3110473 - RNA, 19 nt, Mycobacterium bovis subsp bovis AF2122/97
ucggcaccccacgccugcc

SEQ ID NO: 3110474 - RNA, 12 nt, Mycobacterium bovis subsp bovis AF2122/97
ucggcaccgcgg

SEQ ID NO: 3110475 - RNA, 15 nt, Mycobacterium bovis subsp bovis AF2122/97
ucggcaccgcggccg

SEQ ID NO: 3110476 - RNA, 17 nt, Mycobacterium bovis subsp bovis AF2122/97
ucggcaccgcggccgcg

SEQ ID NO: 3110477 - RNA, 21 nt, Mycobacterium bovis subsp bovis AF2122/97
ucggcaccgguuuucgccggc

SEQ ID NO: 3110478 - RNA, 22 nt, Mycobacterium bovis subsp bovis AF2122/97
ucggcaccgugcggggggcagc

SEQ ID NO: 3110479 - RNA, 12 nt, Mycobacterium bovis subsp bovis AF2122/97
ucggcacgaccc

SEQ ID NO: 3110480 - RNA, 14 nt, Mycobacterium bovis subsp bovis AF2122/97
ucggcacgacccgg

SEQ ID NO: 3110481 - RNA, 21 nt, Mycobacterium bovis subsp bovis AF2122/97
ucggcacgccgggcaucggcg

SEQ ID NO: 3110482 - RNA, 21 nt, Mycobacterium bovis subsp bovis AF2122/97
ucggcacggaccgcgucgcgg

SEQ ID NO: 3110483 - RNA, 18 nt, Mycobacterium bovis subsp bovis AF2122/97
ucggcacggauuuucgca

SEQ ID NO: 3110484 - RNA, 20 nt, Mycobacterium bovis subsp bovis AF2122/97
ucggcacggucgcccgaucg

SEQ ID NO: 3110485 - RNA, 22 nt, Mycobacterium bovis subsp bovis AF2122/97
ucggcacgucguugggcauguc

SEQ ID NO: 3110486 - RNA, 19 nt, Mycobacterium bovis subsp bovis AF2122/97
ucggcacuagcgagccggc

SEQ ID NO: 3110487 - RNA, 13 nt, Mycobacterium bovis subsp bovis AF2122/97
ucggcacuuagcc

SEQ ID NO: 3110488 - RNA, 21 nt, Mycobacterium bovis subsp bovis AF2122/97
ucggcagagacguacugggcg

SEQ ID NO: 3110489 - RNA, 15 nt, Mycobacterium bovis subsp bovis AF2122/97
ucggcagcagcgcaa

SEQ ID NO: 3110490 - RNA, 19 nt, Mycobacterium bovis subsp bovis AF2122/97
ucggcagcagcggugcagc

SEQ ID NO: 3110491 - RNA, 16 nt, Mycobacterium bovis subsp bovis AF2122/97
ucggcagcaggacacc

SEQ ID NO: 3110492 - RNA, 15 nt, Mycobacterium bovis subsp bovis AF2122/97
ucggcagccagggcg

SEQ ID NO: 3110493 - RNA, 13 nt, Mycobacterium bovis subsp bovis AF2122/97
ucggcagccggcu

SEQ ID NO: 3110494 - RNA, 20 nt, Mycobacterium bovis subsp bovis AF2122/97
ucggcagcgacgccggcccg

SEQ ID NO: 3110495 - RNA, 14 nt, Mycobacterium bovis subsp bovis AF2122/97
ucggcagcggcgcg

SEQ ID NO: 3110496 - RNA, 19 nt, Mycobacterium bovis subsp bovis AF2122/97
ucggcagcguggacaucgg

SEQ ID NO: 3110497 - RNA, 20 nt, Mycobacterium bovis subsp bovis AF2122/97
ucggcagcucccgccacguc

SEQ ID NO: 3110498 - RNA, 17 nt, Mycobacterium bovis subsp bovis AF2122/97
ucggcaggaaugccgcg

SEQ ID NO: 3110499 - RNA, 20 nt, Mycobacterium bovis subsp bovis AF2122/97
ucggcagggcccccaguucg

SEQ ID NO: 3110500 - RNA, 16 nt, Mycobacterium bovis subsp bovis AF2122/97
ucggcaggguggccag

SEQ ID NO: 3110501 - RNA, 15 nt, Mycobacterium bovis subsp bovis AF2122/97
ucggcagucccagcg

SEQ ID NO: 3110502 - RNA, 19 nt, Mycobacterium bovis subsp bovis AF2122/97
ucggcagucccagcgccgc

SEQ ID NO: 3110503 - RNA, 18 nt, Mycobacterium bovis subsp bovis AF2122/97
ucggcaguugaacucgac

SEQ ID NO: 3110504 - RNA, 22 nt, Mycobacterium bovis subsp bovis AF2122/97
ucggcauacccaucaacaucgg

SEQ ID NO: 3110505 - RNA, 15 nt, Mycobacterium bovis subsp bovis AF2122/97
ucggcaucgagcagc

SEQ ID NO: 3110506 - RNA, 21 nt, Mycobacterium bovis subsp bovis AF2122/97
ucggcaugacgaaugcgggug

SEQ ID NO: 3110507 - RNA, 14 nt, Mycobacterium bovis subsp bovis AF2122/97
ucggcaugcagccc

SEQ ID NO: 3110508 - RNA, 21 nt, Mycobacterium bovis subsp bovis AF2122/97
ucggcaugccggucuucgcgg

SEQ ID NO: 3110509 - RNA, 15 nt, Mycobacterium bovis subsp bovis AF2122/97
ucggcaugggccggc

SEQ ID NO: 3110510 - RNA, 17 nt, Mycobacterium bovis subsp bovis AF2122/97
ucggcaugggccggcgc

SEQ ID NO: 3110511 - RNA, 22 nt, Mycobacterium bovis subsp bovis AF2122/97
ucggcauguuccuugcggccgc

SEQ ID NO: 3110512 - RNA, 14 nt, Mycobacterium bovis subsp bovis AF2122/97
ucggcauucaccgc

SEQ ID NO: 3110513 - RNA, 16 nt, Mycobacterium bovis subsp bovis AF2122/97
ucggcauucaccgcgg

SEQ ID NO: 3110514 - RNA, 17 nt, Mycobacterium bovis subsp bovis AF2122/97
ucggcauucaccgcgga

SEQ ID NO: 3110515 - RNA, 19 nt, Mycobacterium bovis subsp bovis AF2122/97
ucggccaacagguccaccg

SEQ ID NO: 3110516 - RNA, 19 nt, Mycobacterium bovis subsp bovis AF2122/97
ucggccaaccaugcugucg

SEQ ID NO: 3110517 - RNA, 17 nt, Mycobacterium bovis subsp bovis AF2122/97
ucggccaacccgggccg

SEQ ID NO: 3110518 - RNA, 18 nt, Mycobacterium bovis subsp bovis AF2122/97
ucggccaacccgggccgc

SEQ ID NO: 3110519 - RNA, 18 nt, Mycobacterium bovis subsp bovis AF2122/97
ucggccaacgacggccga

SEQ ID NO: 3110520 - RNA, 17 nt, Mycobacterium bovis subsp bovis AF2122/97
ucggccacauccagcgc

SEQ ID NO: 3110521 - RNA, 13 nt, Mycobacterium bovis subsp bovis AF2122/97
ucggccaccaacu

SEQ ID NO: 3110522 - RNA, 17 nt, Mycobacterium bovis subsp bovis AF2122/97
ucggccaccaacucggc

SEQ ID NO: 3110523 - RNA, 20 nt, Mycobacterium bovis subsp bovis AF2122/97
ucggccaccaacucggcgac

SEQ ID NO: 3110524 - RNA, 14 nt, Mycobacterium bovis subsp bovis AF2122/97
ucggccaccagaac

SEQ ID NO: 3110525 - RNA, 15 nt, Mycobacterium bovis subsp bovis AF2122/97
ucggccaccagcgcc

SEQ ID NO: 3110526 - RNA, 13 nt, Mycobacterium bovis subsp bovis AF2122/97
ucggccacccgca

SEQ ID NO: 3110527 - RNA, 15 nt, Mycobacterium bovis subsp bovis AF2122/97
ucggccacccggaca

SEQ ID NO: 3110528 - RNA, 13 nt, Mycobacterium bovis subsp bovis AF2122/97
ucggccacccggu

SEQ ID NO: 3110529 - RNA, 16 nt, Mycobacterium bovis subsp bovis AF2122/97
ucggccaccgccugag

SEQ ID NO: 3110530 - RNA, 15 nt, Mycobacterium bovis subsp bovis AF2122/97
ucggccaccggcguc

SEQ ID NO: 3110531 - RNA, 15 nt, Mycobacterium bovis subsp bovis AF2122/97
ucggccacgcgcacu

SEQ ID NO: 3110532 - RNA, 17 nt, Mycobacterium bovis subsp bovis AF2122/97
ucggccacgucccagag

SEQ ID NO: 3110533 - RNA, 17 nt, Mycobacterium bovis subsp bovis AF2122/97
ucggccagaucacgcac

SEQ ID NO: 3110534 - RNA, 21 nt, Mycobacterium bovis subsp bovis AF2122/97
ucggccagcagaucagguccu

SEQ ID NO: 3110535 - RNA, 13 nt, Mycobacterium bovis subsp bovis AF2122/97
ucggccagcagca

SEQ ID NO: 3110536 - RNA, 17 nt, Mycobacterium bovis subsp bovis AF2122/97
ucggccagcagcagugc

SEQ ID NO: 3110537 - RNA, 24 nt, Mycobacterium bovis subsp bovis AF2122/97
ucggccagcagcagugccaccggu

SEQ ID NO: 3110538 - RNA, 13 nt, Mycobacterium bovis subsp bovis AF2122/97
ucggccagcagcg

SEQ ID NO: 3110539 - RNA, 16 nt, Mycobacterium bovis subsp bovis AF2122/97
ucggccagcucccggg

SEQ ID NO: 3110540 - RNA, 23 nt, Mycobacterium bovis subsp bovis AF2122/97
ucggccagcucccgggcggcggc

SEQ ID NO: 3110541 - RNA, 21 nt, Mycobacterium bovis subsp bovis AF2122/97
ucggccagcucgcgggccgcg

SEQ ID NO: 3110542 - RNA, 20 nt, Mycobacterium bovis subsp bovis AF2122/97
ucggccagcuugagguccgu

SEQ ID NO: 3110543 - RNA, 19 nt, Mycobacterium bovis subsp bovis AF2122/97
ucggccaggaucaaccggc

SEQ ID NO: 3110544 - RNA, 13 nt, Mycobacterium bovis subsp bovis AF2122/97
ucggccaggauga

SEQ ID NO: 3110545 - RNA, 21 nt, Mycobacterium bovis subsp bovis AF2122/97
ucggccaggucgagcaccggc

SEQ ID NO: 3110546 - RNA, 13 nt, Mycobacterium bovis subsp bovis AF2122/97
ucggccagugccg

SEQ ID NO: 3110547 - RNA, 20 nt, Mycobacterium bovis subsp bovis AF2122/97
ucggccauagcgccgcgccc

SEQ ID NO: 3110548 - RNA, 20 nt, Mycobacterium bovis subsp bovis AF2122/97
ucggccaucagaaccuccuc

SEQ ID NO: 3110549 - RNA, 21 nt, Mycobacterium bovis subsp bovis AF2122/97
ucggccaucagaaccuccucg

SEQ ID NO: 3110550 - RNA, 15 nt, Mycobacterium bovis subsp bovis AF2122/97
ucggccauccaccgc

SEQ ID NO: 3110551 - RNA, 16 nt, Mycobacterium bovis subsp bovis AF2122/97
ucggccauccaccgca

SEQ ID NO: 3110552 - RNA, 17 nt, Mycobacterium bovis subsp bovis AF2122/97
ucggccaucguccagca

SEQ ID NO: 3110553 - RNA, 14 nt, Mycobacterium bovis subsp bovis AF2122/97
ucggccauggcggc

SEQ ID NO: 3110554 - RNA, 16 nt, Mycobacterium bovis subsp bovis AF2122/97
ucggccauggcggcgc

SEQ ID NO: 3110555 - RNA, 22 nt, Mycobacterium bovis subsp bovis AF2122/97
ucggccaugguguucggcagcg

SEQ ID NO: 3110556 - RNA, 16 nt, Mycobacterium bovis subsp bovis AF2122/97
ucggcccacacggucg

SEQ ID NO: 3110557 - RNA, 15 nt, Mycobacterium bovis subsp bovis AF2122/97
ucggcccagcgcgcc

SEQ ID NO: 3110558 - RNA, 16 nt, Mycobacterium bovis subsp bovis AF2122/97
ucggcccagcgcgcca

SEQ ID NO: 3110559 - RNA, 22 nt, Mycobacterium bovis subsp bovis AF2122/97
ucggcccagguugccuuggcgg

SEQ ID NO: 3110560 - RNA, 18 nt, Mycobacterium bovis subsp bovis AF2122/97
ucggcccauaacagcugg

SEQ ID NO: 3110561 - RNA, 20 nt, Mycobacterium bovis subsp bovis AF2122/97
ucggcccauaacagcuggcg

SEQ ID NO: 3110562 - RNA, 14 nt, Mycobacterium bovis subsp bovis AF2122/97
ucggcccaugcagc

SEQ ID NO: 3110563 - RNA, 21 nt, Mycobacterium bovis subsp bovis AF2122/97
ucggcccaugcagcggcgaag

SEQ ID NO: 3110564 - RNA, 21 nt, Mycobacterium bovis subsp bovis AF2122/97
ucggcccgaggugccggggcc

SEQ ID NO: 3110565 - RNA, 22 nt, Mycobacterium bovis subsp bovis AF2122/97
ucggcccgaucaccauccagcc

SEQ ID NO: 3110566 - RNA, 16 nt, Mycobacterium bovis subsp bovis AF2122/97
ucggcccgcggucgcg

SEQ ID NO: 3110567 - RNA, 13 nt, Mycobacterium bovis subsp bovis AF2122/97
ucggcccggcccg

SEQ ID NO: 3110568 - RNA, 15 nt, Mycobacterium bovis subsp bovis AF2122/97
ucggcccuccaccgg

SEQ ID NO: 3110569 - RNA, 22 nt, Mycobacterium bovis subsp bovis AF2122/97
ucggccgaaucuccgccgugag

SEQ ID NO: 3110570 - RNA, 17 nt, Mycobacterium bovis subsp bovis AF2122/97
ucggccgacaccgccac

SEQ ID NO: 3110571 - RNA, 15 nt, Mycobacterium bovis subsp bovis AF2122/97
ucggccgaccgggcu

SEQ ID NO: 3110572 - RNA, 13 nt, Mycobacterium bovis subsp bovis AF2122/97
ucggccgaggcgg

SEQ ID NO: 3110573 - RNA, 15 nt, Mycobacterium bovis subsp bovis AF2122/97
ucggccgcaaggcgc

SEQ ID NO: 3110574 - RNA, 15 nt, Mycobacterium bovis subsp bovis AF2122/97
ucggccgcaccagca

SEQ ID NO: 3110575 - RNA, 22 nt, Mycobacterium bovis subsp bovis AF2122/97
ucggccgcacugggugcgucga

SEQ ID NO: 3110576 - RNA, 17 nt, Mycobacterium bovis subsp bovis AF2122/97
ucggccgcauccccggu

SEQ ID NO: 3110577 - RNA, 17 nt, Mycobacterium bovis subsp bovis AF2122/97
ucggccgcaucgcccaa

SEQ ID NO: 3110578 - RNA, 11 nt, Mycobacterium bovis subsp bovis AF2122/97
ucggccgccag

SEQ ID NO: 3110579 - RNA, 19 nt, Mycobacterium bovis subsp bovis AF2122/97
ucggccgccuucuccggcg

SEQ ID NO: 3110580 - RNA, 20 nt, Mycobacterium bovis subsp bovis AF2122/97
ucggccgcgagacgcauguc

SEQ ID NO: 3110581 - RNA, 18 nt, Mycobacterium bovis subsp bovis AF2122/97
ucggccgcggucggccac

SEQ ID NO: 3110582 - RNA, 21 nt, Mycobacterium bovis subsp bovis AF2122/97
ucggccgcuggaggcggcgcc

SEQ ID NO: 3110583 - RNA, 15 nt, Mycobacterium bovis subsp bovis AF2122/97
ucggccggagccgcc

SEQ ID NO: 3110584 - RNA, 15 nt, Mycobacterium bovis subsp bovis AF2122/97
ucggccggcacccca

SEQ ID NO: 3110585 - RNA, 20 nt, Mycobacterium bovis subsp bovis AF2122/97
ucggccggcaccccacggcc

SEQ ID NO: 3110586 - RNA, 14 nt, Mycobacterium bovis subsp bovis AF2122/97
ucggccggcggcgc

SEQ ID NO: 3110587 - RNA, 21 nt, Mycobacterium bovis subsp bovis AF2122/97
ucggccggcggcgcccaucgc

SEQ ID NO: 3110588 - RNA, 15 nt, Mycobacterium bovis subsp bovis AF2122/97
ucggccggcgucagc

SEQ ID NO: 3110589 - RNA, 21 nt, Mycobacterium bovis subsp bovis AF2122/97
ucggccgguauuucggcgacu

SEQ ID NO: 3110590 - RNA, 16 nt, Mycobacterium bovis subsp bovis AF2122/97
ucggccgucagggugu

SEQ ID NO: 3110591 - RNA, 19 nt, Mycobacterium bovis subsp bovis AF2122/97
ucggccgucauggcccgau

SEQ ID NO: 3110592 - RNA, 21 nt, Mycobacterium bovis subsp bovis AF2122/97
ucggccgugaauucgccgaac

SEQ ID NO: 3110593 - RNA, 17 nt, Mycobacterium bovis subsp bovis AF2122/97
ucggccguuuccaccgu

SEQ ID NO: 3110594 - RNA, 23 nt, Mycobacterium bovis subsp bovis AF2122/97
ucggccuccucgucgcucccggu

SEQ ID NO: 3110595 - RNA, 23 nt, Mycobacterium bovis subsp bovis AF2122/97
ucggccucgagacggucgaucac

SEQ ID NO: 3110596 - RNA, 17 nt, Mycobacterium bovis subsp bovis AF2122/97
ucggccucgucgugcac

SEQ ID NO: 3110597 - RNA, 17 nt, Mycobacterium bovis subsp bovis AF2122/97
ucggccucugaccagcc

SEQ ID NO: 3110598 - RNA, 14 nt, Mycobacterium bovis subsp bovis AF2122/97
ucggccugaccggu

SEQ ID NO: 3110599 - RNA, 16 nt, Mycobacterium bovis subsp bovis AF2122/97
ucggccugaccgguca

SEQ ID NO: 3110600 - RNA, 13 nt, Mycobacterium bovis subsp bovis AF2122/97
ucggccugagcgg

SEQ ID NO: 3110601 - RNA, 18 nt, Mycobacterium bovis subsp bovis AF2122/97
ucggccugcagcgaugac

SEQ ID NO: 3110602 - RNA, 16 nt, Mycobacterium bovis subsp bovis AF2122/97
ucggccugccggcagc

SEQ ID NO: 3110603 - RNA, 20 nt, Mycobacterium bovis subsp bovis AF2122/97
ucggccugccggcagcggcg

SEQ ID NO: 3110604 - RNA, 16 nt, Mycobacterium bovis subsp bovis AF2122/97
ucggccugcgccggcg

SEQ ID NO: 3110605 - RNA, 20 nt, Mycobacterium bovis subsp bovis AF2122/97
ucggccugcgccggcgcugc

SEQ ID NO: 3110606 - RNA, 18 nt, Mycobacterium bovis subsp bovis AF2122/97
ucggccuggcaggguggg

SEQ ID NO: 3110607 - RNA, 24 nt, Mycobacterium bovis subsp bovis AF2122/97
ucggccugguacucccgcgaucgc

SEQ ID NO: 3110608 - RNA, 15 nt, Mycobacterium bovis subsp bovis AF2122/97
ucggccuguccaccg

SEQ ID NO: 3110609 - RNA, 18 nt, Mycobacterium bovis subsp bovis AF2122/97
ucggcgaaaggccagucg

SEQ ID NO: 3110610 - RNA, 20 nt, Mycobacterium bovis subsp bovis AF2122/97
ucggcgaaccacggcagcca

SEQ ID NO: 3110611 - RNA, 18 nt, Mycobacterium bovis subsp bovis AF2122/97
ucggcgaacccuccgcag

SEQ ID NO: 3110612 - RNA, 15 nt, Mycobacterium bovis subsp bovis AF2122/97
ucggcgaacgccgug

SEQ ID NO: 3110613 - RNA, 21 nt, Mycobacterium bovis subsp bovis AF2122/97
ucggcgaacgccguggugcgc

SEQ ID NO: 3110614 - RNA, 16 nt, Mycobacterium bovis subsp bovis AF2122/97
ucggcgaacgcgucca

SEQ ID NO: 3110615 - RNA, 21 nt, Mycobacterium bovis subsp bovis AF2122/97
ucggcgaacggauucccgccc

SEQ ID NO: 3110616 - RNA, 24 nt, Mycobacterium bovis subsp bovis AF2122/97
ucggcgaacggauucccgcccagc

SEQ ID NO: 3110617 - RNA, 20 nt, Mycobacterium bovis subsp bovis AF2122/97
ucggcgaacggcaccagauc

SEQ ID NO: 3110618 - RNA, 15 nt, Mycobacterium bovis subsp bovis AF2122/97
ucggcgaagcacacc

SEQ ID NO: 3110619 - RNA, 17 nt, Mycobacterium bovis subsp bovis AF2122/97
ucggcgaagcacaccgu

SEQ ID NO: 3110620 - RNA, 23 nt, Mycobacterium bovis subsp bovis AF2122/97
ucggcgaaggccgcgcgcagggc

SEQ ID NO: 3110621 - RNA, 19 nt, Mycobacterium bovis subsp bovis AF2122/97
ucggcgaaguugcgcgacg

SEQ ID NO: 3110622 - RNA, 16 nt, Mycobacterium bovis subsp bovis AF2122/97
ucggcgaauccgccgc

SEQ ID NO: 3110623 - RNA, 20 nt, Mycobacterium bovis subsp bovis AF2122/97
ucggcgaauccgccgccuag

SEQ ID NO: 3110624 - RNA, 18 nt, Mycobacterium bovis subsp bovis AF2122/97
ucggcgaaugcgauugcc

SEQ ID NO: 3110625 - RNA, 15 nt, Mycobacterium bovis subsp bovis AF2122/97
ucggcgacagcgcgg

SEQ ID NO: 3110626 - RNA, 16 nt, Mycobacterium bovis subsp bovis AF2122/97
ucggcgacaggagacg

SEQ ID NO: 3110627 - RNA, 15 nt, Mycobacterium bovis subsp bovis AF2122/97
ucggcgaccaccagc

SEQ ID NO: 3110628 - RNA, 17 nt, Mycobacterium bovis subsp bovis AF2122/97
ucggcgaccaccagcgc

SEQ ID NO: 3110629 - RNA, 19 nt, Mycobacterium bovis subsp bovis AF2122/97
ucggcgaccaccagcgccg

SEQ ID NO: 3110630 - RNA, 21 nt, Mycobacterium bovis subsp bovis AF2122/97
ucggcgaccaccagcgccgac

SEQ ID NO: 3110631 - RNA, 12 nt, Mycobacterium bovis subsp bovis AF2122/97
ucggcgaccagc

SEQ ID NO: 3110632 - RNA, 16 nt, Mycobacterium bovis subsp bovis AF2122/97
ucggcgaccgacgccg

SEQ ID NO: 3110633 - RNA, 22 nt, Mycobacterium bovis subsp bovis AF2122/97
ucggcgaccgacgccggugucg

SEQ ID NO: 3110634 - RNA, 14 nt, Mycobacterium bovis subsp bovis AF2122/97
ucggcgaccgccug

SEQ ID NO: 3110635 - RNA, 20 nt, Mycobacterium bovis subsp bovis AF2122/97
ucggcgaccgccugcgcggc

SEQ ID NO: 3110636 - RNA, 24 nt, Mycobacterium bovis subsp bovis AF2122/97
ucggcgaccgccugcgcggcugcc

SEQ ID NO: 3110637 - RNA, 17 nt, Mycobacterium bovis subsp bovis AF2122/97
ucggcgaccgcgucguc

SEQ ID NO: 3110638 - RNA, 20 nt, Mycobacterium bovis subsp bovis AF2122/97
ucggcgaccggccggccgcg

SEQ ID NO: 3110639 - RNA, 16 nt, Mycobacterium bovis subsp bovis AF2122/97
ucggcgaccgucgggg

SEQ ID NO: 3110640 - RNA, 22 nt, Mycobacterium bovis subsp bovis AF2122/97
ucggcgaccuccgggaugucga

SEQ ID NO: 3110641 - RNA, 19 nt, Mycobacterium bovis subsp bovis AF2122/97
ucggcgaccugccggaccg

SEQ ID NO: 3110642 - RNA, 19 nt, Mycobacterium bovis subsp bovis AF2122/97
ucggcgaccuggcucaucg

SEQ ID NO: 3110643 - RNA, 15 nt, Mycobacterium bovis subsp bovis AF2122/97
ucggcgacgaugucg

SEQ ID NO: 3110644 - RNA, 19 nt, Mycobacterium bovis subsp bovis AF2122/97
ucggcgacgaugucgagcg

SEQ ID NO: 3110645 - RNA, 18 nt, Mycobacterium bovis subsp bovis AF2122/97
ucggcgacgccgucuagc

SEQ ID NO: 3110646 - RNA, 14 nt, Mycobacterium bovis subsp bovis AF2122/97
ucggcgacgcgccg

SEQ ID NO: 3110647 - RNA, 18 nt, Mycobacterium bovis subsp bovis AF2122/97
ucggcgacgcggaguccg

SEQ ID NO: 3110648 - RNA, 16 nt, Mycobacterium bovis subsp bovis AF2122/97
ucggcgacggccagcg

SEQ ID NO: 3110649 - RNA, 13 nt, Mycobacterium bovis subsp bovis AF2122/97
ucggcgacgucgg

SEQ ID NO: 3110650 - RNA, 17 nt, Mycobacterium bovis subsp bovis AF2122/97
ucggcgacugcgucggc

SEQ ID NO: 3110651 - RNA, 19 nt, Mycobacterium bovis subsp bovis AF2122/97
ucggcgacugcgucggcgg

SEQ ID NO: 3110652 - RNA, 20 nt, Mycobacterium bovis subsp bovis AF2122/97
ucggcgacugcgucggcggc

SEQ ID NO: 3110653 - RNA, 20 nt, Mycobacterium bovis subsp bovis AF2122/97
ucggcgagcaacacgagcgc

SEQ ID NO: 3110654 - RNA, 20 nt, Mycobacterium bovis subsp bovis AF2122/97
ucggcgagcacgucacgcgc

SEQ ID NO: 3110655 - RNA, 14 nt, Mycobacterium bovis subsp bovis AF2122/97
ucggcgagcagacg

SEQ ID NO: 3110656 - RNA, 19 nt, Mycobacterium bovis subsp bovis AF2122/97
ucggcgagcagacgccgcg

SEQ ID NO: 3110657 - RNA, 15 nt, Mycobacterium bovis subsp bovis AF2122/97
ucggcgagcagcgca

SEQ ID NO: 3110658 - RNA, 16 nt, Mycobacterium bovis subsp bovis AF2122/97
ucggcgagccgcgccc

SEQ ID NO: 3110659 - RNA, 20 nt, Mycobacterium bovis subsp bovis AF2122/97
ucggcgagccgugcuaccca

SEQ ID NO: 3110660 - RNA, 15 nt, Mycobacterium bovis subsp bovis AF2122/97
ucggcgagcgcaucg

SEQ ID NO: 3110661 - RNA, 22 nt, Mycobacterium bovis subsp bovis AF2122/97
ucggcgagcgcaucggccaaca

SEQ ID NO: 3110662 - RNA, 13 nt, Mycobacterium bovis subsp bovis AF2122/97
ucggcgagcgccc

SEQ ID NO: 3110663 - RNA, 22 nt, Mycobacterium bovis subsp bovis AF2122/97
ucggcgagcucggccccgccgc

SEQ ID NO: 3110664 - RNA, 18 nt, Mycobacterium bovis subsp bovis AF2122/97
ucggcgaggccucggcgg

SEQ ID NO: 3110665 - RNA, 20 nt, Mycobacterium bovis subsp bovis AF2122/97
ucggcgaggucccggccgag

SEQ ID NO: 3110666 - RNA, 18 nt, Mycobacterium bovis subsp bovis AF2122/97
ucggcgaguagaccucga

SEQ ID NO: 3110667 - RNA, 21 nt, Mycobacterium bovis subsp bovis AF2122/97
ucggcgagucgguugucgggg

SEQ ID NO: 3110668 - RNA, 22 nt, Mycobacterium bovis subsp bovis AF2122/97
ucggcgagugucuuagccagca

SEQ ID NO: 3110669 - RNA, 23 nt, Mycobacterium bovis subsp bovis AF2122/97
ucggcgagugucuuagccagcag

SEQ ID NO: 3110670 - RNA, 20 nt, Mycobacterium bovis subsp bovis AF2122/97
ucggcgaucaauugcccggc

SEQ ID NO: 3110671 - RNA, 20 nt, Mycobacterium bovis subsp bovis AF2122/97
ucggcgaucgucaagccggg

SEQ ID NO: 3110672 - RNA, 24 nt, Mycobacterium bovis subsp bovis AF2122/97
ucggcgaucgucaagccgggcacg

SEQ ID NO: 3110673 - RNA, 16 nt, Mycobacterium bovis subsp bovis AF2122/97
ucggcgaucuccggcg

SEQ ID NO: 3110674 - RNA, 15 nt, Mycobacterium bovis subsp bovis AF2122/97
ucggcgaucucgucg

SEQ ID NO: 3110675 - RNA, 21 nt, Mycobacterium bovis subsp bovis AF2122/97
ucggcgaugaacgggaucgac

SEQ ID NO: 3110676 - RNA, 21 nt, Mycobacterium bovis subsp bovis AF2122/97
ucggcgaugacaucaccgacc

SEQ ID NO: 3110677 - RNA, 21 nt, Mycobacterium bovis subsp bovis AF2122/97
ucggcgaugaugcucgacaac

SEQ ID NO: 3110678 - RNA, 12 nt, Mycobacterium bovis subsp bovis AF2122/97
ucggcgaugccg

SEQ ID NO: 3110679 - RNA, 16 nt, Mycobacterium bovis subsp bovis AF2122/97
ucggcgaugcgcacca

SEQ ID NO: 3110680 - RNA, 19 nt, Mycobacterium bovis subsp bovis AF2122/97
ucggcgaugcgcaccagca

SEQ ID NO: 3110681 - RNA, 21 nt, Mycobacterium bovis subsp bovis AF2122/97
ucggcgaugcgcaccagcacc

SEQ ID NO: 3110682 - RNA, 16 nt, Mycobacterium bovis subsp bovis AF2122/97
ucggcgaugcguccgc

SEQ ID NO: 3110683 - RNA, 19 nt, Mycobacterium bovis subsp bovis AF2122/97
ucggcgaugcguccgccca

SEQ ID NO: 3110684 - RNA, 23 nt, Mycobacterium bovis subsp bovis AF2122/97
ucggcgaugcguccgcccagccg

SEQ ID NO: 3110685 - RNA, 19 nt, Mycobacterium bovis subsp bovis AF2122/97
ucggcgaugggccgguccg

SEQ ID NO: 3110686 - RNA, 19 nt, Mycobacterium bovis subsp bovis AF2122/97
ucggcgcaaucaacgucac

SEQ ID NO: 3110687 - RNA, 14 nt, Mycobacterium bovis subsp bovis AF2122/97
ucggcgcacagcga

SEQ ID NO: 3110688 - RNA, 17 nt, Mycobacterium bovis subsp bovis AF2122/97
ucggcgcacagcgagca

SEQ ID NO: 3110689 - RNA, 15 nt, Mycobacterium bovis subsp bovis AF2122/97
ucggcgcagccggug

SEQ ID NO: 3110690 - RNA, 17 nt, Mycobacterium bovis subsp bovis AF2122/97
ucggcgcagccggugag

SEQ ID NO: 3110691 - RNA, 14 nt, Mycobacterium bovis subsp bovis AF2122/97
ucggcgcagcuaac

SEQ ID NO: 3110692 - RNA, 20 nt, Mycobacterium bovis subsp bovis AF2122/97
ucggcgcagcuaacccgcca

SEQ ID NO: 3110693 - RNA, 15 nt, Mycobacterium bovis subsp bovis AF2122/97
ucggcgcaucaccac

SEQ ID NO: 3110694 - RNA, 19 nt, Mycobacterium bovis subsp bovis AF2122/97
ucggcgccagaucgacgcc

SEQ ID NO: 3110695 - RNA, 15 nt, Mycobacterium bovis subsp bovis AF2122/97
ucggcgcccagcucg

SEQ ID NO: 3110696 - RNA, 21 nt, Mycobacterium bovis subsp bovis AF2122/97
ucggcgcccagcucgucgagc

SEQ ID NO: 3110697 - RNA, 23 nt, Mycobacterium bovis subsp bovis AF2122/97
ucggcgcccuccuuggcguugcc

SEQ ID NO: 3110698 - RNA, 12 nt, Mycobacterium bovis subsp bovis AF2122/97
ucggcgccgaag

SEQ ID NO: 3110699 - RNA, 21 nt, Mycobacterium bovis subsp bovis AF2122/97
ucggcgccgagcagcccgcgg

SEQ ID NO: 3110700 - RNA, 14 nt, Mycobacterium bovis subsp bovis AF2122/97
ucggcgccgcauac

SEQ ID NO: 3110701 - RNA, 15 nt, Mycobacterium bovis subsp bovis AF2122/97
ucggcgccgcccagc

SEQ ID NO: 3110702 - RNA, 21 nt, Mycobacterium bovis subsp bovis AF2122/97
ucggcgccgccguccagcgcc

SEQ ID NO: 3110703 - RNA, 23 nt, Mycobacterium bovis subsp bovis AF2122/97
ucggcgccgccguccagcgccgc

SEQ ID NO: 3110704 - RNA, 12 nt, Mycobacterium bovis subsp bovis AF2122/97
ucggcgccggcg

SEQ ID NO: 3110705 - RNA, 20 nt, Mycobacterium bovis subsp bovis AF2122/97
ucggcgccgucggagccggc

SEQ ID NO: 3110706 - RNA, 22 nt, Mycobacterium bovis subsp bovis AF2122/97
ucggcgccgucggagccggcca

SEQ ID NO: 3110707 - RNA, 19 nt, Mycobacterium bovis subsp bovis AF2122/97
ucggcgccgucucgaucgc

SEQ ID NO: 3110708 - RNA, 20 nt, Mycobacterium bovis subsp bovis AF2122/97
ucggcgccucggaccagacc

SEQ ID NO: 3110709 - RNA, 14 nt, Mycobacterium bovis subsp bovis AF2122/97
ucggcgccuggcgg

SEQ ID NO: 3110710 - RNA, 15 nt, Mycobacterium bovis subsp bovis AF2122/97
ucggcgcgacagccg

SEQ ID NO: 3110711 - RNA, 13 nt, Mycobacterium bovis subsp bovis AF2122/97
ucggcgcgcaccu

SEQ ID NO: 3110712 - RNA, 15 nt, Mycobacterium bovis subsp bovis AF2122/97
ucggcgcgcaccucg

SEQ ID NO: 3110713 - RNA, 17 nt, Mycobacterium bovis subsp bovis AF2122/97
ucggcgcgccgcacacg

SEQ ID NO: 3110714 - RNA, 13 nt, Mycobacterium bovis subsp bovis AF2122/97
ucggcgcgccggu

SEQ ID NO: 3110715 - RNA, 20 nt, Mycobacterium bovis subsp bovis AF2122/97
ucggcgcgccggucgccgac

SEQ ID NO: 3110716 - RNA, 21 nt, Mycobacterium bovis subsp bovis AF2122/97
ucggcgcgccggucgccgacg

SEQ ID NO: 3110717 - RNA, 21 nt, Mycobacterium bovis subsp bovis AF2122/97
ucggcgcgccguugccggcca

SEQ ID NO: 3110718 - RNA, 17 nt, Mycobacterium bovis subsp bovis AF2122/97
ucggcgcgcggguuguc

SEQ ID NO: 3110719 - RNA, 21 nt, Mycobacterium bovis subsp bovis AF2122/97
ucggcgcgcggguugucggcg

SEQ ID NO: 3110720 - RNA, 23 nt, Mycobacterium bovis subsp bovis AF2122/97
ucggcgcgcggguugucggcgac

SEQ ID NO: 3110721 - RNA, 23 nt, Mycobacterium bovis subsp bovis AF2122/97
ucggcgcggccguagugcacguc

SEQ ID NO: 3110722 - RNA, 14 nt, Mycobacterium bovis subsp bovis AF2122/97
ucggcgcggcuguc

SEQ ID NO: 3110723 - RNA, 16 nt, Mycobacterium bovis subsp bovis AF2122/97
ucggcgcuagcugcug

SEQ ID NO: 3110724 - RNA, 14 nt, Mycobacterium bovis subsp bovis AF2122/97
ucggcgcucgucgc

SEQ ID NO: 3110725 - RNA, 21 nt, Mycobacterium bovis subsp bovis AF2122/97
ucggcgcugacgacccuccgc

SEQ ID NO: 3110726 - RNA, 16 nt, Mycobacterium bovis subsp bovis AF2122/97
ucggcgcugcgcaccg

SEQ ID NO: 3110727 - RNA, 18 nt, Mycobacterium bovis subsp bovis AF2122/97
ucggcgcugcgcaccgcc

SEQ ID NO: 3110728 - RNA, 13 nt, Mycobacterium bovis subsp bovis AF2122/97
ucggcgcugcggc

SEQ ID NO: 3110729 - RNA, 22 nt, Mycobacterium bovis subsp bovis AF2122/97
ucggcgcugcggcgugccgggu

SEQ ID NO: 3110730 - RNA, 13 nt, Mycobacterium bovis subsp bovis AF2122/97
ucggcggaagacc

SEQ ID NO: 3110731 - RNA, 14 nt, Mycobacterium bovis subsp bovis AF2122/97
ucggcggacccggu

SEQ ID NO: 3110732 - RNA, 19 nt, Mycobacterium bovis subsp bovis AF2122/97
ucggcggacccggugaccc

SEQ ID NO: 3110733 - RNA, 21 nt, Mycobacterium bovis subsp bovis AF2122/97
ucggcggcaaccgccgccacc

SEQ ID NO: 3110734 - RNA, 15 nt, Mycobacterium bovis subsp bovis AF2122/97
ucggcggcaacggcg

SEQ ID NO: 3110735 - RNA, 15 nt, Mycobacterium bovis subsp bovis AF2122/97
ucggcggccaccaug

SEQ ID NO: 3110736 - RNA, 13 nt, Mycobacterium bovis subsp bovis AF2122/97
ucggcggccagcg

SEQ ID NO: 3110737 - RNA, 16 nt, Mycobacterium bovis subsp bovis AF2122/97
ucggcggcccggccga

SEQ ID NO: 3110738 - RNA, 21 nt, Mycobacterium bovis subsp bovis AF2122/97
ucggcggcccggccgaacgcc

SEQ ID NO: 3110739 - RNA, 19 nt, Mycobacterium bovis subsp bovis AF2122/97
ucggcggccgagcgcaccg

SEQ ID NO: 3110740 - RNA, 20 nt, Mycobacterium bovis subsp bovis AF2122/97
ucggcggccgccgcguuucg

SEQ ID NO: 3110741 - RNA, 23 nt, Mycobacterium bovis subsp bovis AF2122/97
ucggcggccgcgaccagcgccgc

SEQ ID NO: 3110742 - RNA, 13 nt, Mycobacterium bovis subsp bovis AF2122/97
ucggcggccggca

SEQ ID NO: 3110743 - RNA, 20 nt, Mycobacterium bovis subsp bovis AF2122/97
ucggcggccggcacgggcgg

SEQ ID NO: 3110744 - RNA, 22 nt, Mycobacterium bovis subsp bovis AF2122/97
ucggcggccggcacgggcgggg

SEQ ID NO: 3110745 - RNA, 14 nt, Mycobacterium bovis subsp bovis AF2122/97
ucggcggccguggc

SEQ ID NO: 3110746 - RNA, 15 nt, Mycobacterium bovis subsp bovis AF2122/97
ucggcggccguggcc

SEQ ID NO: 3110747 - RNA, 20 nt, Mycobacterium bovis subsp bovis AF2122/97
ucggcggccguggccucgau

SEQ ID NO: 3110748 - RNA, 15 nt, Mycobacterium bovis subsp bovis AF2122/97
ucggcggccguggcu

SEQ ID NO: 3110749 - RNA, 19 nt, Mycobacterium bovis subsp bovis AF2122/97
ucggcggccgugucgggcg

SEQ ID NO: 3110750 - RNA, 20 nt, Mycobacterium bovis subsp bovis AF2122/97
ucggcggccgugucgggcgc

SEQ ID NO: 3110751 - RNA, 13 nt, Mycobacterium bovis subsp bovis AF2122/97
ucggcggccucgc

SEQ ID NO: 3110752 - RNA, 17 nt, Mycobacterium bovis subsp bovis AF2122/97
ucggcggccucgcugcu

SEQ ID NO: 3110753 - RNA, 22 nt, Mycobacterium bovis subsp bovis AF2122/97
ucggcggccucgcugcucagca

SEQ ID NO: 3110754 - RNA, 17 nt, Mycobacterium bovis subsp bovis AF2122/97
ucggcggccucggucug

SEQ ID NO: 3110755 - RNA, 20 nt, Mycobacterium bovis subsp bovis AF2122/97
ucggcggccuucuccccgau

SEQ ID NO: 3110756 - RNA, 14 nt, Mycobacterium bovis subsp bovis AF2122/97
ucggcggcgaccgc

SEQ ID NO: 3110757 - RNA, 17 nt, Mycobacterium bovis subsp bovis AF2122/97
ucggcggcgaccgccag

SEQ ID NO: 3110758 - RNA, 18 nt, Mycobacterium bovis subsp bovis AF2122/97
ucggcggcgaccgccagc

SEQ ID NO: 3110759 - RNA, 20 nt, Mycobacterium bovis subsp bovis AF2122/97
ucggcggcgaccgccagcgu

SEQ ID NO: 3110760 - RNA, 22 nt, Mycobacterium bovis subsp bovis AF2122/97
ucggcggcgaccgccagcgugg

SEQ ID NO: 3110761 - RNA, 22 nt, Mycobacterium bovis subsp bovis AF2122/97
ucggcggcgacguggcgccgac

SEQ ID NO: 3110762 - RNA, 18 nt, Mycobacterium bovis subsp bovis AF2122/97
ucggcggcgcgccgaucg

SEQ ID NO: 3110763 - RNA, 19 nt, Mycobacterium bovis subsp bovis AF2122/97
ucggcggcgcggucgaagc

SEQ ID NO: 3110764 - RNA, 11 nt, Mycobacterium bovis subsp bovis AF2122/97
ucggcggcggc

SEQ ID NO: 3110765 - RNA, 16 nt, Mycobacterium bovis subsp bovis AF2122/97
ucggcggcggcgccuu

SEQ ID NO: 3110766 - RNA, 23 nt, Mycobacterium bovis subsp bovis AF2122/97
ucggcggcggggacucugccacc

SEQ ID NO: 3110767 - RNA, 15 nt, Mycobacterium bovis subsp bovis AF2122/97
ucggcggcgguggcg

SEQ ID NO: 3110768 - RNA, 23 nt, Mycobacterium bovis subsp bovis AF2122/97
ucggcggcgguggcgaacagcac

SEQ ID NO: 3110769 - RNA, 19 nt, Mycobacterium bovis subsp bovis AF2122/97
ucggcggcguccagcagcg

SEQ ID NO: 3110770 - RNA, 14 nt, Mycobacterium bovis subsp bovis AF2122/97
ucggcggcgucuuc

SEQ ID NO: 3110771 - RNA, 18 nt, Mycobacterium bovis subsp bovis AF2122/97
ucggcggcgucuucgucg

SEQ ID NO: 3110772 - RNA, 18 nt, Mycobacterium bovis subsp bovis AF2122/97
ucggcggcucuagaucgc

SEQ ID NO: 3110773 - RNA, 22 nt, Mycobacterium bovis subsp bovis AF2122/97
ucggcggcucuagaucgccgag

SEQ ID NO: 3110774 - RNA, 23 nt, Mycobacterium bovis subsp bovis AF2122/97
ucggcggcucuagaucgccgagc

SEQ ID NO: 3110775 - RNA, 14 nt, Mycobacterium bovis subsp bovis AF2122/97
ucggcggcugccag

SEQ ID NO: 3110776 - RNA, 14 nt, Mycobacterium bovis subsp bovis AF2122/97
ucggcggcuuggcc

SEQ ID NO: 3110777 - RNA, 20 nt, Mycobacterium bovis subsp bovis AF2122/97
ucggcggcuuggccgccccg

SEQ ID NO: 3110778 - RNA, 19 nt, Mycobacterium bovis subsp bovis AF2122/97
ucggcgggaaacacguucu

SEQ ID NO: 3110779 - RNA, 17 nt, Mycobacterium bovis subsp bovis AF2122/97
ucggcgggauccucgaa

SEQ ID NO: 3110780 - RNA, 17 nt, Mycobacterium bovis subsp bovis AF2122/97
ucggcgggcgacaucga

SEQ ID NO: 3110781 - RNA, 15 nt, Mycobacterium bovis subsp bovis AF2122/97
ucggcgggcggcagc

SEQ ID NO: 3110782 - RNA, 16 nt, Mycobacterium bovis subsp bovis AF2122/97
ucggcggggcccacac

SEQ ID NO: 3110783 - RNA, 16 nt, Mycobacterium bovis subsp bovis AF2122/97
ucggcggggcgccgga

SEQ ID NO: 3110784 - RNA, 21 nt, Mycobacterium bovis subsp bovis AF2122/97
ucggcgggggaccccgccagc

SEQ ID NO: 3110785 - RNA, 23 nt, Mycobacterium bovis subsp bovis AF2122/97
ucggcgggggaccccgccagccg

SEQ ID NO: 3110786 - RNA, 20 nt, Mycobacterium bovis subsp bovis AF2122/97
ucggcggguauauggugcgc

SEQ ID NO: 3110787 - RNA, 13 nt, Mycobacterium bovis subsp bovis AF2122/97
ucggcgggucagg

SEQ ID NO: 3110788 - RNA, 23 nt, Mycobacterium bovis subsp bovis AF2122/97
ucggcgggucaggccagggugac

SEQ ID NO: 3110789 - RNA, 20 nt, Mycobacterium bovis subsp bovis AF2122/97
ucggcgggucugggucaggc

SEQ ID NO: 3110790 - RNA, 21 nt, Mycobacterium bovis subsp bovis AF2122/97
ucggcgggucugggucaggcg

SEQ ID NO: 3110791 - RNA, 20 nt, Mycobacterium bovis subsp bovis AF2122/97
ucggcggugaaaucgcacag

SEQ ID NO: 3110792 - RNA, 22 nt, Mycobacterium bovis subsp bovis AF2122/97
ucggcggugaaaucgcacagcg

SEQ ID NO: 3110793 - RNA, 21 nt, Mycobacterium bovis subsp bovis AF2122/97
ucggcggugaacuucuccacc

SEQ ID NO: 3110794 - RNA, 24 nt, Mycobacterium bovis subsp bovis AF2122/97
ucggcggugaacuucuccaccagc

SEQ ID NO: 3110795 - RNA, 13 nt, Mycobacterium bovis subsp bovis AF2122/97
ucggcggugagca

SEQ ID NO: 3110796 - RNA, 16 nt, Mycobacterium bovis subsp bovis AF2122/97
ucggcggugagcaacu

SEQ ID NO: 3110797 - RNA, 13 nt, Mycobacterium bovis subsp bovis AF2122/97
ucggcggugcaga

SEQ ID NO: 3110798 - RNA, 15 nt, Mycobacterium bovis subsp bovis AF2122/97
ucggcggugccgacg

SEQ ID NO: 3110799 - RNA, 14 nt, Mycobacterium bovis subsp bovis AF2122/97
ucggcggugccgcg

SEQ ID NO: 3110800 - RNA, 17 nt, Mycobacterium bovis subsp bovis AF2122/97
ucggcggugccgcggcu

SEQ ID NO: 3110801 - RNA, 15 nt, Mycobacterium bovis subsp bovis AF2122/97
ucggcgguucgaucc

SEQ ID NO: 3110802 - RNA, 20 nt, Mycobacterium bovis subsp bovis AF2122/97
ucggcguagucgcugucggc

SEQ ID NO: 3110803 - RNA, 19 nt, Mycobacterium bovis subsp bovis AF2122/97
ucggcgucacgguggacga

SEQ ID NO: 3110804 - RNA, 18 nt, Mycobacterium bovis subsp bovis AF2122/97
ucggcgucccagggcaca

SEQ ID NO: 3110805 - RNA, 19 nt, Mycobacterium bovis subsp bovis AF2122/97
ucggcguccuugcgcagca

SEQ ID NO: 3110806 - RNA, 20 nt, Mycobacterium bovis subsp bovis AF2122/97
ucggcguccuugcgcagcac

SEQ ID NO: 3110807 - RNA, 14 nt, Mycobacterium bovis subsp bovis AF2122/97
ucggcgucgaagac

SEQ ID NO: 3110808 - RNA, 22 nt, Mycobacterium bovis subsp bovis AF2122/97
ucggcgucgaagugggugaacc

SEQ ID NO: 3110809 - RNA, 17 nt, Mycobacterium bovis subsp bovis AF2122/97
ucggcgucgaccaguuc

SEQ ID NO: 3110810 - RNA, 15 nt, Mycobacterium bovis subsp bovis AF2122/97
ucggcgucgagcucg

SEQ ID NO: 3110811 - RNA, 20 nt, Mycobacterium bovis subsp bovis AF2122/97
ucggcgucgagcucguccuc

SEQ ID NO: 3110812 - RNA, 19 nt, Mycobacterium bovis subsp bovis AF2122/97
ucggcgucguauucgaugc

SEQ ID NO: 3110813 - RNA, 20 nt, Mycobacterium bovis subsp bovis AF2122/97
ucggcgucguauucgaugcc

SEQ ID NO: 3110814 - RNA, 16 nt, Mycobacterium bovis subsp bovis AF2122/97
ucggcgucgucgacgg

SEQ ID NO: 3110815 - RNA, 21 nt, Mycobacterium bovis subsp bovis AF2122/97
ucggcgucguggcuuccggug

SEQ ID NO: 3110816 - RNA, 20 nt, Mycobacterium bovis subsp bovis AF2122/97
ucggcgucgugguggccacg

SEQ ID NO: 3110817 - RNA, 16 nt, Mycobacterium bovis subsp bovis AF2122/97
ucggcgugcagcagcu

SEQ ID NO: 3110818 - RNA, 19 nt, Mycobacterium bovis subsp bovis AF2122/97
ucggcgugcggacugacgu

SEQ ID NO: 3110819 - RNA, 20 nt, Mycobacterium bovis subsp bovis AF2122/97
ucggcguggucgcgcggcac

SEQ ID NO: 3110820 - RNA, 21 nt, Mycobacterium bovis subsp bovis AF2122/97
ucggcgugguguccaccgcau

SEQ ID NO: 3110821 - RNA, 17 nt, Mycobacterium bovis subsp bovis AF2122/97
ucggcgugucgcgucgc

SEQ ID NO: 3110822 - RNA, 14 nt, Mycobacterium bovis subsp bovis AF2122/97
ucggcgugucgggg

SEQ ID NO: 3110823 - RNA, 18 nt, Mycobacterium bovis subsp bovis AF2122/97
ucggcuaccgccgaccgg

SEQ ID NO: 3110824 - RNA, 13 nt, Mycobacterium bovis subsp bovis AF2122/97
ucggcuaccuaac

SEQ ID NO: 3110825 - RNA, 15 nt, Mycobacterium bovis subsp bovis AF2122/97
ucggcuaccuaaccc

SEQ ID NO: 3110826 - RNA, 16 nt, Mycobacterium bovis subsp bovis AF2122/97
ucggcuaccuaacccg

SEQ ID NO: 3110827 - RNA, 18 nt, Mycobacterium bovis subsp bovis AF2122/97
ucggcuaccuuguccggc

SEQ ID NO: 3110828 - RNA, 20 nt, Mycobacterium bovis subsp bovis AF2122/97
ucggcuaccuuguccggccc

SEQ ID NO: 3110829 - RNA, 21 nt, Mycobacterium bovis subsp bovis AF2122/97
ucggcuaccuuguccggcccg

SEQ ID NO: 3110830 - RNA, 23 nt, Mycobacterium bovis subsp bovis AF2122/97
ucggcuagcaacgggucgauguc

SEQ ID NO: 3110831 - RNA, 23 nt, Mycobacterium bovis subsp bovis AF2122/97
ucggcuaggccggccggaguccg

SEQ ID NO: 3110832 - RNA, 16 nt, Mycobacterium bovis subsp bovis AF2122/97
ucggcuauggguucgc

SEQ ID NO: 3110833 - RNA, 17 nt, Mycobacterium bovis subsp bovis AF2122/97
ucggcucaccgaacgcg

SEQ ID NO: 3110834 - RNA, 12 nt, Mycobacterium bovis subsp bovis AF2122/97
ucggcuccgccg

SEQ ID NO: 3110835 - RNA, 14 nt, Mycobacterium bovis subsp bovis AF2122/97
ucggcuccgccgcg

SEQ ID NO: 3110836 - RNA, 15 nt, Mycobacterium bovis subsp bovis AF2122/97
ucggcuccgccgcgg

SEQ ID NO: 3110837 - RNA, 17 nt, Mycobacterium bovis subsp bovis AF2122/97
ucggcuccgccgcgggc

SEQ ID NO: 3110838 - RNA, 22 nt, Mycobacterium bovis subsp bovis AF2122/97
ucggcucgagucgcagcacggg

SEQ ID NO: 3110839 - RNA, 19 nt, Mycobacterium bovis subsp bovis AF2122/97
ucggcugccaccgcagacg

SEQ ID NO: 3110840 - RNA, 17 nt, Mycobacterium bovis subsp bovis AF2122/97
ucggcugccgcggcugc

SEQ ID NO: 3110841 - RNA, 18 nt, Mycobacterium bovis subsp bovis AF2122/97
ucggcugccgcggcugcc

SEQ ID NO: 3110842 - RNA, 22 nt, Mycobacterium bovis subsp bovis AF2122/97
ucggcugcgacaggacgucggc

SEQ ID NO: 3110843 - RNA, 15 nt, Mycobacterium bovis subsp bovis AF2122/97
ucggcugcgcgcucg

SEQ ID NO: 3110844 - RNA, 17 nt, Mycobacterium bovis subsp bovis AF2122/97
ucggcugcgcgcucggc

SEQ ID NO: 3110845 - RNA, 20 nt, Mycobacterium bovis subsp bovis AF2122/97
ucggcugcgcgcucggccag

SEQ ID NO: 3110846 - RNA, 14 nt, Mycobacterium bovis subsp bovis AF2122/97
ucggcuggacggcg

SEQ ID NO: 3110847 - RNA, 21 nt, Mycobacterium bovis subsp bovis AF2122/97
ucggcugucacaagccugccg

SEQ ID NO: 3110848 - RNA, 14 nt, Mycobacterium bovis subsp bovis AF2122/97
ucggcuuccuccuc

SEQ ID NO: 3110849 - RNA, 16 nt, Mycobacterium bovis subsp bovis AF2122/97
ucggcuuccuccucgg

SEQ ID NO: 3110850 - RNA, 20 nt, Mycobacterium bovis subsp bovis AF2122/97
ucggcuuccuccucggcgcg

SEQ ID NO: 3110851 - RNA, 19 nt, Mycobacterium bovis subsp bovis AF2122/97
ucggcuugccugcgccgag

SEQ ID NO: 3110852 - RNA, 20 nt, Mycobacterium bovis subsp bovis AF2122/97
ucggcuugggaaacccggcc

SEQ ID NO: 3110853 - RNA, 23 nt, Mycobacterium bovis subsp bovis AF2122/97
ucggcuugggaaacccggccagc

SEQ ID NO: 3110854 - RNA, 17 nt, Mycobacterium bovis subsp bovis AF2122/97
ucggcuuugccgcugug

SEQ ID NO: 3110855 - RNA, 22 nt, Mycobacterium bovis subsp bovis AF2122/97
ucgggaacgccgaacaccgccg

SEQ ID NO: 3110856 - RNA, 20 nt, Mycobacterium bovis subsp bovis AF2122/97
ucgggaacgcucgucgacag

SEQ ID NO: 3110857 - RNA, 16 nt, Mycobacterium bovis subsp bovis AF2122/97
ucgggaagcgagcagc

SEQ ID NO: 3110858 - RNA, 17 nt, Mycobacterium bovis subsp bovis AF2122/97
ucgggaaguacggcagg

SEQ ID NO: 3110859 - RNA, 18 nt, Mycobacterium bovis subsp bovis AF2122/97
ucgggaagucgggccggu

SEQ ID NO: 3110860 - RNA, 23 nt, Mycobacterium bovis subsp bovis AF2122/97
ucgggacaaagccgaacgacagc

SEQ ID NO: 3110861 - RNA, 19 nt, Mycobacterium bovis subsp bovis AF2122/97
ucgggaccaccgaccgcgu

SEQ ID NO: 3110862 - RNA, 19 nt, Mycobacterium bovis subsp bovis AF2122/97
ucgggaccggcuugccgcc

SEQ ID NO: 3110863 - RNA, 14 nt, Mycobacterium bovis subsp bovis AF2122/97
ucgggaccgggaac

SEQ ID NO: 3110864 - RNA, 22 nt, Mycobacterium bovis subsp bovis AF2122/97
ucgggaccggggacgcgcccca

SEQ ID NO: 3110865 - RNA, 15 nt, Mycobacterium bovis subsp bovis AF2122/97
ucgggacgaaaaaau

SEQ ID NO: 3110866 - RNA, 22 nt, Mycobacterium bovis subsp bovis AF2122/97
ucgggacgccuugaucggcgag

SEQ ID NO: 3110867 - RNA, 20 nt, Mycobacterium bovis subsp bovis AF2122/97
ucgggacggccaacagggcg

SEQ ID NO: 3110868 - RNA, 23 nt, Mycobacterium bovis subsp bovis AF2122/97
ucgggacuuccggggagcagaga

SEQ ID NO: 3110869 - RNA, 11 nt, Mycobacterium bovis subsp bovis AF2122/97
ucgggagauga

SEQ ID NO: 3110870 - RNA, 13 nt, Mycobacterium bovis subsp bovis AF2122/97
ucgggagcggcug

SEQ ID NO: 3110871 - RNA, 18 nt, Mycobacterium bovis subsp bovis AF2122/97
ucgggagcggcugcggca

SEQ ID NO: 3110872 - RNA, 14 nt, Mycobacterium bovis subsp bovis AF2122/97
ucgggagcugauca

SEQ ID NO: 3110873 - RNA, 14 nt, Mycobacterium bovis subsp bovis AF2122/97
ucgggaggcagcgc

SEQ ID NO: 3110874 - RNA, 19 nt, Mycobacterium bovis subsp bovis AF2122/97
ucgggagucuucggcgaca

SEQ ID NO: 3110875 - RNA, 24 nt, Mycobacterium bovis subsp bovis AF2122/97
ucgggagucuucggcgacaggccg

SEQ ID NO: 3110876 - RNA, 22 nt, Mycobacterium bovis subsp bovis AF2122/97
ucgggauccaugcgggugguga

SEQ ID NO: 3110877 - RNA, 17 nt, Mycobacterium bovis subsp bovis AF2122/97
ucgggaucgcugccagc

SEQ ID NO: 3110878 - RNA, 13 nt, Mycobacterium bovis subsp bovis AF2122/97
ucgggaucggcgg

SEQ ID NO: 3110879 - RNA, 18 nt, Mycobacterium bovis subsp bovis AF2122/97
ucgggaucugcgccgcgc

SEQ ID NO: 3110880 - RNA, 17 nt, Mycobacterium bovis subsp bovis AF2122/97
ucgggaucugggcucgg

SEQ ID NO: 3110881 - RNA, 15 nt, Mycobacterium bovis subsp bovis AF2122/97
ucgggaugcaaggaa

SEQ ID NO: 3110882 - RNA, 19 nt, Mycobacterium bovis subsp bovis AF2122/97
ucgggaugcccgcugauca

SEQ ID NO: 3110883 - RNA, 12 nt, Mycobacterium bovis subsp bovis AF2122/97
ucgggaugcgcg

SEQ ID NO: 3110884 - RNA, 19 nt, Mycobacterium bovis subsp bovis AF2122/97
ucgggauggacaccaccuc

SEQ ID NO: 3110885 - RNA, 20 nt, Mycobacterium bovis subsp bovis AF2122/97
ucgggauggacggcagccag

SEQ ID NO: 3110886 - RNA, 21 nt, Mycobacterium bovis subsp bovis AF2122/97
ucgggauggacggcagccagc

SEQ ID NO: 3110887 - RNA, 17 nt, Mycobacterium bovis subsp bovis AF2122/97
ucgggcaaccugccggg

SEQ ID NO: 3110888 - RNA, 17 nt, Mycobacterium bovis subsp bovis AF2122/97
ucgggcaacggcagccc

SEQ ID NO: 3110889 - RNA, 19 nt, Mycobacterium bovis subsp bovis AF2122/97
ucgggcaaggccaccggcg

SEQ ID NO: 3110890 - RNA, 20 nt, Mycobacterium bovis subsp bovis AF2122/97
ucgggcaaggccaccggcgg

SEQ ID NO: 3110891 - RNA, 17 nt, Mycobacterium bovis subsp bovis AF2122/97
ucgggcaaggcggcggc

SEQ ID NO: 3110892 - RNA, 14 nt, Mycobacterium bovis subsp bovis AF2122/97
ucgggcacaccgac

SEQ ID NO: 3110893 - RNA, 17 nt, Mycobacterium bovis subsp bovis AF2122/97
ucgggcacaccgacgcc

SEQ ID NO: 3110894 - RNA, 18 nt, Mycobacterium bovis subsp bovis AF2122/97
ucgggcacaccgacgccg

SEQ ID NO: 3110895 - RNA, 20 nt, Mycobacterium bovis subsp bovis AF2122/97
ucgggcaccccgaccaccag

SEQ ID NO: 3110896 - RNA, 22 nt, Mycobacterium bovis subsp bovis AF2122/97
ucgggcaccgguuugacgucca

SEQ ID NO: 3110897 - RNA, 11 nt, Mycobacterium bovis subsp bovis AF2122/97
ucgggcaccug

SEQ ID NO: 3110898 - RNA, 16 nt, Mycobacterium bovis subsp bovis AF2122/97
ucgggcaccuggucgg

SEQ ID NO: 3110899 - RNA, 17 nt, Mycobacterium bovis subsp bovis AF2122/97
ucgggcaccuggucggc

SEQ ID NO: 3110900 - RNA, 21 nt, Mycobacterium bovis subsp bovis AF2122/97
ucgggcaccuggucggccgca

SEQ ID NO: 3110901 - RNA, 12 nt, Mycobacterium bovis subsp bovis AF2122/97
ucgggcagcacc

SEQ ID NO: 3110902 - RNA, 14 nt, Mycobacterium bovis subsp bovis AF2122/97
ucgggcagcacgcc

SEQ ID NO: 3110903 - RNA, 19 nt, Mycobacterium bovis subsp bovis AF2122/97
ucgggcagcacgccagccc

SEQ ID NO: 3110904 - RNA, 14 nt, Mycobacterium bovis subsp bovis AF2122/97
ucgggcagcgcggc

SEQ ID NO: 3110905 - RNA, 21 nt, Mycobacterium bovis subsp bovis AF2122/97
ucgggcagcggcaucggccag

SEQ ID NO: 3110906 - RNA, 14 nt, Mycobacterium bovis subsp bovis AF2122/97
ucgggcagcgucac

SEQ ID NO: 3110907 - RNA, 16 nt, Mycobacterium bovis subsp bovis AF2122/97
ucgggcagcuucaaca

SEQ ID NO: 3110908 - RNA, 20 nt, Mycobacterium bovis subsp bovis AF2122/97
ucgggcagcuucaacaccgg

SEQ ID NO: 3110909 - RNA, 15 nt, Mycobacterium bovis subsp bovis AF2122/97
ucgggcaggccgucg

SEQ ID NO: 3110910 - RNA, 18 nt, Mycobacterium bovis subsp bovis AF2122/97
ucgggcaggcggccagcg

SEQ ID NO: 3110911 - RNA, 22 nt, Mycobacterium bovis subsp bovis AF2122/97
ucgggcaugacgaauugguugc

SEQ ID NO: 3110912 - RNA, 15 nt, Mycobacterium bovis subsp bovis AF2122/97
ucgggcauggucgcc

SEQ ID NO: 3110913 - RNA, 21 nt, Mycobacterium bovis subsp bovis AF2122/97
ucgggccacagcaacgugugc

SEQ ID NO: 3110914 - RNA, 17 nt, Mycobacterium bovis subsp bovis AF2122/97
ucgggccagucgaaucg

SEQ ID NO: 3110915 - RNA, 13 nt, Mycobacterium bovis subsp bovis AF2122/97
ucgggcccaccgc

SEQ ID NO: 3110916 - RNA, 16 nt, Mycobacterium bovis subsp bovis AF2122/97
ucgggcccagcagcgc

SEQ ID NO: 3110917 - RNA, 17 nt, Mycobacterium bovis subsp bovis AF2122/97
ucgggcccuccggcgca

SEQ ID NO: 3110918 - RNA, 12 nt, Mycobacterium bovis subsp bovis AF2122/97
ucgggccgcaac

SEQ ID NO: 3110919 - RNA, 14 nt, Mycobacterium bovis subsp bovis AF2122/97
ucgggccggccgcc

SEQ ID NO: 3110920 - RNA, 21 nt, Mycobacterium bovis subsp bovis AF2122/97
ucgggccggccgccgcgggac

SEQ ID NO: 3110921 - RNA, 14 nt, Mycobacterium bovis subsp bovis AF2122/97
ucgggccggcgcgg

SEQ ID NO: 3110922 - RNA, 13 nt, Mycobacterium bovis subsp bovis AF2122/97
ucgggccguccuc

SEQ ID NO: 3110923 - RNA, 19 nt, Mycobacterium bovis subsp bovis AF2122/97
ucgggccuagccgaagcgc

SEQ ID NO: 3110924 - RNA, 22 nt, Mycobacterium bovis subsp bovis AF2122/97
ucgggcgagaucuuuucaccac

SEQ ID NO: 3110925 - RNA, 21 nt, Mycobacterium bovis subsp bovis AF2122/97
ucgggcgagcucgucgagcgc

SEQ ID NO: 3110926 - RNA, 23 nt, Mycobacterium bovis subsp bovis AF2122/97
ucgggcgaucaacccuagggcgg

SEQ ID NO: 3110927 - RNA, 21 nt, Mycobacterium bovis subsp bovis AF2122/97
ucgggcgcgaaaccgcauguc

SEQ ID NO: 3110928 - RNA, 20 nt, Mycobacterium bovis subsp bovis AF2122/97
ucgggcgcgcucguggucga

SEQ ID NO: 3110929 - RNA, 15 nt, Mycobacterium bovis subsp bovis AF2122/97
ucgggcgcggggcgg

SEQ ID NO: 3110930 - RNA, 16 nt, Mycobacterium bovis subsp bovis AF2122/97
ucgggcgcggggcggc

SEQ ID NO: 3110931 - RNA, 23 nt, Mycobacterium bovis subsp bovis AF2122/97
ucgggcgcgggugaccaggcggc

SEQ ID NO: 3110932 - RNA, 22 nt, Mycobacterium bovis subsp bovis AF2122/97
ucgggcggauacaugguccggc

SEQ ID NO: 3110933 - RNA, 16 nt, Mycobacterium bovis subsp bovis AF2122/97
ucgggcggcgucgcgg

SEQ ID NO: 3110934 - RNA, 19 nt, Mycobacterium bovis subsp bovis AF2122/97
ucgggcggcgucgcggauc

SEQ ID NO: 3110935 - RNA, 19 nt, Mycobacterium bovis subsp bovis AF2122/97
ucgggcguacauucgggcg

SEQ ID NO: 3110936 - RNA, 23 nt, Mycobacterium bovis subsp bovis AF2122/97
ucgggcgucagcaguucggcgau

SEQ ID NO: 3110937 - RNA, 16 nt, Mycobacterium bovis subsp bovis AF2122/97
ucgggcgugaucccgc

SEQ ID NO: 3110938 - RNA, 19 nt, Mycobacterium bovis subsp bovis AF2122/97
ucgggcgugaucccgccca

SEQ ID NO: 3110939 - RNA, 23 nt, Mycobacterium bovis subsp bovis AF2122/97
ucgggcucgcauucggcgagccg

SEQ ID NO: 3110940 - RNA, 16 nt, Mycobacterium bovis subsp bovis AF2122/97
ucgggcucggagauga

SEQ ID NO: 3110941 - RNA, 19 nt, Mycobacterium bovis subsp bovis AF2122/97
ucgggcucguccagcaacc

SEQ ID NO: 3110942 - RNA, 17 nt, Mycobacterium bovis subsp bovis AF2122/97
ucgggcugccgcaugcg

SEQ ID NO: 3110943 - RNA, 13 nt, Mycobacterium bovis subsp bovis AF2122/97
ucgggcuggucgg

SEQ ID NO: 3110944 - RNA, 17 nt, Mycobacterium bovis subsp bovis AF2122/97
ucgggcuggucggucaa

SEQ ID NO: 3110945 - RNA, 20 nt, Mycobacterium bovis subsp bovis AF2122/97
ucgggcugucaggcucacac

SEQ ID NO: 3110946 - RNA, 19 nt, Mycobacterium bovis subsp bovis AF2122/97
ucgggcuugcgcagcagcg

SEQ ID NO: 3110947 - RNA, 11 nt, Mycobacterium bovis subsp bovis AF2122/97
ucggggaacac

SEQ ID NO: 3110948 - RNA, 14 nt, Mycobacterium bovis subsp bovis AF2122/97
ucggggaacgcggc

SEQ ID NO: 3110949 - RNA, 14 nt, Mycobacterium bovis subsp bovis AF2122/97
ucggggaccacgcc

SEQ ID NO: 3110950 - RNA, 17 nt, Mycobacterium bovis subsp bovis AF2122/97
ucggggagcugcggcgg

SEQ ID NO: 3110951 - RNA, 21 nt, Mycobacterium bovis subsp bovis AF2122/97
ucggggaguucgcgcagcacc

SEQ ID NO: 3110952 - RNA, 12 nt, Mycobacterium bovis subsp bovis AF2122/97
ucggggcccccg

SEQ ID NO: 3110953 - RNA, 20 nt, Mycobacterium bovis subsp bovis AF2122/97
ucggggccccgcggcgccgc

SEQ ID NO: 3110954 - RNA, 17 nt, Mycobacterium bovis subsp bovis AF2122/97
ucggggccgcaggccag

SEQ ID NO: 3110955 - RNA, 15 nt, Mycobacterium bovis subsp bovis AF2122/97
ucggggccgucgggg

SEQ ID NO: 3110956 - RNA, 13 nt, Mycobacterium bovis subsp bovis AF2122/97
ucggggcgacgau

SEQ ID NO: 3110957 - RNA, 23 nt, Mycobacterium bovis subsp bovis AF2122/97
ucggggcgcgguaccggugucag

SEQ ID NO: 3110958 - RNA, 14 nt, Mycobacterium bovis subsp bovis AF2122/97
ucgggggcagcgcc

SEQ ID NO: 3110959 - RNA, 16 nt, Mycobacterium bovis subsp bovis AF2122/97
ucgggggcggucgcgu

SEQ ID NO: 3110960 - RNA, 14 nt, Mycobacterium bovis subsp bovis AF2122/97
ucgggggcguccuc

SEQ ID NO: 3110961 - RNA, 20 nt, Mycobacterium bovis subsp bovis AF2122/97
ucgggggcuuuuacgucugc

SEQ ID NO: 3110962 - RNA, 17 nt, Mycobacterium bovis subsp bovis AF2122/97
ucgggguaaccggcgga

SEQ ID NO: 3110963 - RNA, 21 nt, Mycobacterium bovis subsp bovis AF2122/97
ucgggguaauacgcggggccg

SEQ ID NO: 3110964 - RNA, 19 nt, Mycobacterium bovis subsp bovis AF2122/97
ucgggguaguugaggccgu

SEQ ID NO: 3110965 - RNA, 18 nt, Mycobacterium bovis subsp bovis AF2122/97
ucgggguggucgcaccgc

SEQ ID NO: 3110966 - RNA, 16 nt, Mycobacterium bovis subsp bovis AF2122/97
ucgggguggugguauc

SEQ ID NO: 3110967 - RNA, 18 nt, Mycobacterium bovis subsp bovis AF2122/97
ucgggguucuuccacagc

SEQ ID NO: 3110968 - RNA, 13 nt, Mycobacterium bovis subsp bovis AF2122/97
ucgggguugacug

SEQ ID NO: 3110969 - RNA, 22 nt, Mycobacterium bovis subsp bovis AF2122/97
ucgggguuuaguuuaucggccg

SEQ ID NO: 3110970 - RNA, 21 nt, Mycobacterium bovis subsp bovis AF2122/97
ucggguaaccccaccuggagu

SEQ ID NO: 3110971 - RNA, 15 nt, Mycobacterium bovis subsp bovis AF2122/97
ucggguagaucgccu

SEQ ID NO: 3110972 - RNA, 15 nt, Mycobacterium bovis subsp bovis AF2122/97
ucggguaggccgccg

SEQ ID NO: 3110973 - RNA, 17 nt, Mycobacterium bovis subsp bovis AF2122/97
ucggguaggccgccgug

SEQ ID NO: 3110974 - RNA, 12 nt, Mycobacterium bovis subsp bovis AF2122/97
ucgggucagcac

SEQ ID NO: 3110975 - RNA, 23 nt, Mycobacterium bovis subsp bovis AF2122/97
ucgggucccagccuggcaaccac

SEQ ID NO: 3110976 - RNA, 22 nt, Mycobacterium bovis subsp bovis AF2122/97
ucggguccgaaguacuggccgc

SEQ ID NO: 3110977 - RNA, 14 nt, Mycobacterium bovis subsp bovis AF2122/97
ucgggucgaucacc

SEQ ID NO: 3110978 - RNA, 18 nt, Mycobacterium bovis subsp bovis AF2122/97
ucgggucgaucaccgaca

SEQ ID NO: 3110979 - RNA, 11 nt, Mycobacterium bovis subsp bovis AF2122/97
ucgggugcagc

SEQ ID NO: 3110980 - RNA, 21 nt, Mycobacterium bovis subsp bovis AF2122/97
ucgggugcagcacggcgccgc

SEQ ID NO: 3110981 - RNA, 12 nt, Mycobacterium bovis subsp bovis AF2122/97
ucgggugcagcc

SEQ ID NO: 3110982 - RNA, 22 nt, Mycobacterium bovis subsp bovis AF2122/97
ucgggugcgcccggccaagccg

SEQ ID NO: 3110983 - RNA, 16 nt, Mycobacterium bovis subsp bovis AF2122/97
ucgggugcgcugcgau

SEQ ID NO: 3110984 - RNA, 14 nt, Mycobacterium bovis subsp bovis AF2122/97
ucggguggccagcg

SEQ ID NO: 3110985 - RNA, 17 nt, Mycobacterium bovis subsp bovis AF2122/97
ucggguggugcgcuggc

SEQ ID NO: 3110986 - RNA, 23 nt, Mycobacterium bovis subsp bovis AF2122/97
ucgggugucacaguggugggcgu

SEQ ID NO: 3110987 - RNA, 16 nt, Mycobacterium bovis subsp bovis AF2122/97
ucgggugugcaggccg

SEQ ID NO: 3110988 - RNA, 14 nt, Mycobacterium bovis subsp bovis AF2122/97
ucggguguggucac

SEQ ID NO: 3110989 - RNA, 20 nt, Mycobacterium bovis subsp bovis AF2122/97
ucggguguggucaccaggcc

SEQ ID NO: 3110990 - RNA, 15 nt, Mycobacterium bovis subsp bovis AF2122/97
ucggguucuucaacu

SEQ ID NO: 3110991 - RNA, 14 nt, Mycobacterium bovis subsp bovis AF2122/97
ucggguugcgacga

SEQ ID NO: 3110992 - RNA, 21 nt, Mycobacterium bovis subsp bovis AF2122/97
ucggguugguuggcucgcugg

SEQ ID NO: 3110993 - RNA, 13 nt, Mycobacterium bovis subsp bovis AF2122/97
ucgguaagugccu

SEQ ID NO: 3110994 - RNA, 18 nt, Mycobacterium bovis subsp bovis AF2122/97
ucgguaauggccgccggu

SEQ ID NO: 3110995 - RNA, 19 nt, Mycobacterium bovis subsp bovis AF2122/97
ucgguaccccagcgcuguc

SEQ ID NO: 3110996 - RNA, 14 nt, Mycobacterium bovis subsp bovis AF2122/97
ucgguaccgcccag

SEQ ID NO: 3110997 - RNA, 17 nt, Mycobacterium bovis subsp bovis AF2122/97
ucgguacgguggguggu

SEQ ID NO: 3110998 - RNA, 14 nt, Mycobacterium bovis subsp bovis AF2122/97
ucgguagcauccag

SEQ ID NO: 3110999 - RNA, 20 nt, Mycobacterium bovis subsp bovis AF2122/97
ucgguagcgaucgugcugcc

SEQ ID NO: 3111000 - RNA, 17 nt, Mycobacterium bovis subsp bovis AF2122/97
ucgguaggcaggccggc

SEQ ID NO: 3111001 - RNA, 13 nt, Mycobacterium bovis subsp bovis AF2122/97
ucgguagucgaug

SEQ ID NO: 3111002 - RNA, 14 nt, Mycobacterium bovis subsp bovis AF2122/97
ucgguagucgaugc

SEQ ID NO: 3111003 - RNA, 18 nt, Mycobacterium bovis subsp bovis AF2122/97
ucgguagucgaugcugac

SEQ ID NO: 3111004 - RNA, 20 nt, Mycobacterium bovis subsp bovis AF2122/97
ucgguaucgagggcagccgc

SEQ ID NO: 3111005 - RNA, 20 nt, Mycobacterium bovis subsp bovis AF2122/97
ucggucaacucgaacgucac

SEQ ID NO: 3111006 - RNA, 22 nt, Mycobacterium bovis subsp bovis AF2122/97
ucggucaagucugucuggcccc

SEQ ID NO: 3111007 - RNA, 18 nt, Mycobacterium bovis subsp bovis AF2122/97
ucggucaauucggugcgc

SEQ ID NO: 3111008 - RNA, 12 nt, Mycobacterium bovis subsp bovis AF2122/97
ucggucaccgaa

SEQ ID NO: 3111009 - RNA, 15 nt, Mycobacterium bovis subsp bovis AF2122/97
ucggucaccgaacga

SEQ ID NO: 3111010 - RNA, 19 nt, Mycobacterium bovis subsp bovis AF2122/97
ucggucacgacggcacgcc

SEQ ID NO: 3111011 - RNA, 19 nt, Mycobacterium bovis subsp bovis AF2122/97
ucggucagccaccugacaa

SEQ ID NO: 3111012 - RNA, 15 nt, Mycobacterium bovis subsp bovis AF2122/97
ucggucagccagccc

SEQ ID NO: 3111013 - RNA, 16 nt, Mycobacterium bovis subsp bovis AF2122/97
ucggucagcgccgacu

SEQ ID NO: 3111014 - RNA, 22 nt, Mycobacterium bovis subsp bovis AF2122/97
ucggucagcgggcacgccgccg

SEQ ID NO: 3111015 - RNA, 22 nt, Mycobacterium bovis subsp bovis AF2122/97
ucggucagcgucaggugcgcga

SEQ ID NO: 3111016 - RNA, 24 nt, Mycobacterium bovis subsp bovis AF2122/97
ucggucagcgucaggugcgcgacc

SEQ ID NO: 3111017 - RNA, 15 nt, Mycobacterium bovis subsp bovis AF2122/97
ucggucagcugugcg

SEQ ID NO: 3111018 - RNA, 17 nt, Mycobacterium bovis subsp bovis AF2122/97
ucggucaggcggcuggc

SEQ ID NO: 3111019 - RNA, 19 nt, Mycobacterium bovis subsp bovis AF2122/97
ucggucagggugggcucgu

SEQ ID NO: 3111020 - RNA, 14 nt, Mycobacterium bovis subsp bovis AF2122/97
ucggucaguuccuc

SEQ ID NO: 3111021 - RNA, 22 nt, Mycobacterium bovis subsp bovis AF2122/97
ucgguccacccaagcucgguca

SEQ ID NO: 3111022 - RNA, 19 nt, Mycobacterium bovis subsp bovis AF2122/97
ucggucccgccggucacga

SEQ ID NO: 3111023 - RNA, 16 nt, Mycobacterium bovis subsp bovis AF2122/97
ucgguccggcgaacug

SEQ ID NO: 3111024 - RNA, 13 nt, Mycobacterium bovis subsp bovis AF2122/97
ucgguccugccaa

SEQ ID NO: 3111025 - RNA, 21 nt, Mycobacterium bovis subsp bovis AF2122/97
ucggucgacgaucucgccggc

SEQ ID NO: 3111026 - RNA, 22 nt, Mycobacterium bovis subsp bovis AF2122/97
ucggucgacgaucucgccggcg

SEQ ID NO: 3111027 - RNA, 16 nt, Mycobacterium bovis subsp bovis AF2122/97
ucggucgaguagccgu

SEQ ID NO: 3111028 - RNA, 15 nt, Mycobacterium bovis subsp bovis AF2122/97
ucggucgaugcucag

SEQ ID NO: 3111029 - RNA, 12 nt, Mycobacterium bovis subsp bovis AF2122/97
ucggucgccacc

SEQ ID NO: 3111030 - RNA, 14 nt, Mycobacterium bovis subsp bovis AF2122/97
ucggucgccaccgc

SEQ ID NO: 3111031 - RNA, 16 nt, Mycobacterium bovis subsp bovis AF2122/97
ucggucgccaccgccg

SEQ ID NO: 3111032 - RNA, 18 nt, Mycobacterium bovis subsp bovis AF2122/97
ucggucgccaccgccggc

SEQ ID NO: 3111033 - RNA, 22 nt, Mycobacterium bovis subsp bovis AF2122/97
ucggucgccaccgccggcagca

SEQ ID NO: 3111034 - RNA, 23 nt, Mycobacterium bovis subsp bovis AF2122/97
ucggucgcgcgacggccgggaca

SEQ ID NO: 3111035 - RNA, 17 nt, Mycobacterium bovis subsp bovis AF2122/97
ucggucggcaccagguu

SEQ ID NO: 3111036 - RNA, 23 nt, Mycobacterium bovis subsp bovis AF2122/97
ucggucgguaacggcggugcggg

SEQ ID NO: 3111037 - RNA, 22 nt, Mycobacterium bovis subsp bovis AF2122/97
ucggucguccggaucggucggc

SEQ ID NO: 3111038 - RNA, 17 nt, Mycobacterium bovis subsp bovis AF2122/97
ucggucguugccgcggu

SEQ ID NO: 3111039 - RNA, 20 nt, Mycobacterium bovis subsp bovis AF2122/97
ucggucucauagugcagguc

SEQ ID NO: 3111040 - RNA, 16 nt, Mycobacterium bovis subsp bovis AF2122/97
ucggucucgaccgcgc

SEQ ID NO: 3111041 - RNA, 15 nt, Mycobacterium bovis subsp bovis AF2122/97
ucggucucgucgcgg

SEQ ID NO: 3111042 - RNA, 13 nt, Mycobacterium bovis subsp bovis AF2122/97
ucggucugcaugc

SEQ ID NO: 3111043 - RNA, 21 nt, Mycobacterium bovis subsp bovis AF2122/97
ucggucugguggucggcgacg

SEQ ID NO: 3111044 - RNA, 22 nt, Mycobacterium bovis subsp bovis AF2122/97
ucggucuuuggcauugccgcca

SEQ ID NO: 3111045 - RNA, 21 nt, Mycobacterium bovis subsp bovis AF2122/97
ucggugaaaaaggcgacucgg

SEQ ID NO: 3111046 - RNA, 23 nt, Mycobacterium bovis subsp bovis AF2122/97
ucggugaaaaaggcgacucggug

SEQ ID NO: 3111047 - RNA, 22 nt, Mycobacterium bovis subsp bovis AF2122/97
ucggugaaaugacggcugaacc

SEQ ID NO: 3111048 - RNA, 20 nt, Mycobacterium bovis subsp bovis AF2122/97
ucggugaacgccgccccgau

SEQ ID NO: 3111049 - RNA, 14 nt, Mycobacterium bovis subsp bovis AF2122/97
ucggugaagaacau

SEQ ID NO: 3111050 - RNA, 12 nt, Mycobacterium bovis subsp bovis AF2122/97
ucggugaagacg

SEQ ID NO: 3111051 - RNA, 18 nt, Mycobacterium bovis subsp bovis AF2122/97
ucggugaaugccgucgcc

SEQ ID NO: 3111052 - RNA, 16 nt, Mycobacterium bovis subsp bovis AF2122/97
ucggugacccgggcgg

SEQ ID NO: 3111053 - RNA, 20 nt, Mycobacterium bovis subsp bovis AF2122/97
ucggugaccucggcgaccag

SEQ ID NO: 3111054 - RNA, 17 nt, Mycobacterium bovis subsp bovis AF2122/97
ucggugaccuguuuggg

SEQ ID NO: 3111055 - RNA, 22 nt, Mycobacterium bovis subsp bovis AF2122/97
ucggugacgaagagcaccgcgc

SEQ ID NO: 3111056 - RNA, 23 nt, Mycobacterium bovis subsp bovis AF2122/97
ucggugacgcgccguaacagccg

SEQ ID NO: 3111057 - RNA, 20 nt, Mycobacterium bovis subsp bovis AF2122/97
ucggugacggccggcggucg

SEQ ID NO: 3111058 - RNA, 20 nt, Mycobacterium bovis subsp bovis AF2122/97
ucggugacggucaaaugaau

SEQ ID NO: 3111059 - RNA, 17 nt, Mycobacterium bovis subsp bovis AF2122/97
ucggugaggucgaugcc

SEQ ID NO: 3111060 - RNA, 18 nt, Mycobacterium bovis subsp bovis AF2122/97
ucggugaggucgaugccg

SEQ ID NO: 3111061 - RNA, 22 nt, Mycobacterium bovis subsp bovis AF2122/97
ucggugaucaaaccggcggcga

SEQ ID NO: 3111062 - RNA, 20 nt, Mycobacterium bovis subsp bovis AF2122/97
ucggugaucacggucggcgg

SEQ ID NO: 3111063 - RNA, 14 nt, Mycobacterium bovis subsp bovis AF2122/97
ucggugaucgcggu

SEQ ID NO: 3111064 - RNA, 17 nt, Mycobacterium bovis subsp bovis AF2122/97
ucggugaucgcgguggc

SEQ ID NO: 3111065 - RNA, 18 nt, Mycobacterium bovis subsp bovis AF2122/97
ucggugauggagccggug

SEQ ID NO: 3111066 - RNA, 19 nt, Mycobacterium bovis subsp bovis AF2122/97
ucggugaugucggugcguc

SEQ ID NO: 3111067 - RNA, 15 nt, Mycobacterium bovis subsp bovis AF2122/97
ucggugcacgagcgg

SEQ ID NO: 3111068 - RNA, 14 nt, Mycobacterium bovis subsp bovis AF2122/97
ucggugcagcagcg

SEQ ID NO: 3111069 - RNA, 21 nt, Mycobacterium bovis subsp bovis AF2122/97
ucggugcagcccgccgcugaa

SEQ ID NO: 3111070 - RNA, 21 nt, Mycobacterium bovis subsp bovis AF2122/97
ucggugcagcgcacgcagccg

SEQ ID NO: 3111071 - RNA, 15 nt, Mycobacterium bovis subsp bovis AF2122/97
ucggugccacggcac

SEQ ID NO: 3111072 - RNA, 16 nt, Mycobacterium bovis subsp bovis AF2122/97
ucggugccacggcacc

SEQ ID NO: 3111073 - RNA, 14 nt, Mycobacterium bovis subsp bovis AF2122/97
ucggugcccaaccc

SEQ ID NO: 3111074 - RNA, 23 nt, Mycobacterium bovis subsp bovis AF2122/97
ucggugccgccgccggcgccgga

SEQ ID NO: 3111075 - RNA, 17 nt, Mycobacterium bovis subsp bovis AF2122/97
ucggugccggggcugcc

SEQ ID NO: 3111076 - RNA, 22 nt, Mycobacterium bovis subsp bovis AF2122/97
ucggugccggggcugccgccgu

SEQ ID NO: 3111077 - RNA, 15 nt, Mycobacterium bovis subsp bovis AF2122/97
ucggugcgcuggcgg

SEQ ID NO: 3111078 - RNA, 21 nt, Mycobacterium bovis subsp bovis AF2122/97
ucggugcgcuggcggcgcagc

SEQ ID NO: 3111079 - RNA, 24 nt, Mycobacterium bovis subsp bovis AF2122/97
ucggugcggaacacgaugcgcggu

SEQ ID NO: 3111080 - RNA, 16 nt, Mycobacterium bovis subsp bovis AF2122/97
ucggugcgggcgccgc

SEQ ID NO: 3111081 - RNA, 15 nt, Mycobacterium bovis subsp bovis AF2122/97
ucggugcggugcaca

SEQ ID NO: 3111082 - RNA, 22 nt, Mycobacterium bovis subsp bovis AF2122/97
ucgguggaagaguuggggcaca

SEQ ID NO: 3111083 - RNA, 17 nt, Mycobacterium bovis subsp bovis AF2122/97
ucgguggagggcgagca

SEQ ID NO: 3111084 - RNA, 14 nt, Mycobacterium bovis subsp bovis AF2122/97
ucgguggcaacggg

SEQ ID NO: 3111085 - RNA, 18 nt, Mycobacterium bovis subsp bovis AF2122/97
ucgguggcaacgggucgg

SEQ ID NO: 3111086 - RNA, 16 nt, Mycobacterium bovis subsp bovis AF2122/97
ucgguggccaccaccg

SEQ ID NO: 3111087 - RNA, 14 nt, Mycobacterium bovis subsp bovis AF2122/97
ucgguggccaucgc

SEQ ID NO: 3111088 - RNA, 16 nt, Mycobacterium bovis subsp bovis AF2122/97
ucgguggccggcagcc

SEQ ID NO: 3111089 - RNA, 22 nt, Mycobacterium bovis subsp bovis AF2122/97
ucgguggcgaugcgauaggccc

SEQ ID NO: 3111090 - RNA, 23 nt, Mycobacterium bovis subsp bovis AF2122/97
ucgguggcgccgaacgccagcag

SEQ ID NO: 3111091 - RNA, 14 nt, Mycobacterium bovis subsp bovis AF2122/97
ucgguggcgccggg

SEQ ID NO: 3111092 - RNA, 19 nt, Mycobacterium bovis subsp bovis AF2122/97
ucgguggcgccggggcgca

SEQ ID NO: 3111093 - RNA, 15 nt, Mycobacterium bovis subsp bovis AF2122/97
ucgguggcggacggc

SEQ ID NO: 3111094 - RNA, 16 nt, Mycobacterium bovis subsp bovis AF2122/97
ucgguggcggcacgca

SEQ ID NO: 3111095 - RNA, 14 nt, Mycobacterium bovis subsp bovis AF2122/97
ucgguggcggcagc

SEQ ID NO: 3111096 - RNA, 15 nt, Mycobacterium bovis subsp bovis AF2122/97
ucgguggcggcagca

SEQ ID NO: 3111097 - RNA, 20 nt, Mycobacterium bovis subsp bovis AF2122/97
ucgguggcuacgccccacug

SEQ ID NO: 3111098 - RNA, 15 nt, Mycobacterium bovis subsp bovis AF2122/97
ucgguggcugcgccg

SEQ ID NO: 3111099 - RNA, 17 nt, Mycobacterium bovis subsp bovis AF2122/97
ucgguggcugcgccgga

SEQ ID NO: 3111100 - RNA, 17 nt, Mycobacterium bovis subsp bovis AF2122/97
ucggugggcgggugcgc

SEQ ID NO: 3111101 - RNA, 18 nt, Mycobacterium bovis subsp bovis AF2122/97
ucggugggcuugccgcgc

SEQ ID NO: 3111102 - RNA, 19 nt, Mycobacterium bovis subsp bovis AF2122/97
ucggugggcuugccgcgca

SEQ ID NO: 3111103 - RNA, 16 nt, Mycobacterium bovis subsp bovis AF2122/97
ucgguggggcgccggg

SEQ ID NO: 3111104 - RNA, 22 nt, Mycobacterium bovis subsp bovis AF2122/97
ucgguggggucgcugccgccgu

SEQ ID NO: 3111105 - RNA, 17 nt, Mycobacterium bovis subsp bovis AF2122/97
ucggugggugccagccg

SEQ ID NO: 3111106 - RNA, 13 nt, Mycobacterium bovis subsp bovis AF2122/97
ucggugguaacgg

SEQ ID NO: 3111107 - RNA, 12 nt, Mycobacterium bovis subsp bovis AF2122/97
ucggugguacgu

SEQ ID NO: 3111108 - RNA, 22 nt, Mycobacterium bovis subsp bovis AF2122/97
ucggugguacgugcgagcccac

SEQ ID NO: 3111109 - RNA, 14 nt, Mycobacterium bovis subsp bovis AF2122/97
ucggugguccagcg

SEQ ID NO: 3111110 - RNA, 19 nt, Mycobacterium bovis subsp bovis AF2122/97
ucggugguggcgucgaugg

SEQ ID NO: 3111111 - RNA, 17 nt, Mycobacterium bovis subsp bovis AF2122/97
ucggugguuagguggcu

SEQ ID NO: 3111112 - RNA, 22 nt, Mycobacterium bovis subsp bovis AF2122/97
ucgguguagagagccauguccu

SEQ ID NO: 3111113 - RNA, 16 nt, Mycobacterium bovis subsp bovis AF2122/97
ucgguguccucgaccg

SEQ ID NO: 3111114 - RNA, 22 nt, Mycobacterium bovis subsp bovis AF2122/97
ucggugucgccacccgcgcucc

SEQ ID NO: 3111115 - RNA, 14 nt, Mycobacterium bovis subsp bovis AF2122/97
ucggugucggccgc

SEQ ID NO: 3111116 - RNA, 19 nt, Mycobacterium bovis subsp bovis AF2122/97
ucggugucuuccuccucga

SEQ ID NO: 3111117 - RNA, 15 nt, Mycobacterium bovis subsp bovis AF2122/97
ucggugugcaucgcc

SEQ ID NO: 3111118 - RNA, 18 nt, Mycobacterium bovis subsp bovis AF2122/97
ucggugugcgcgccaggc

SEQ ID NO: 3111119 - RNA, 17 nt, Mycobacterium bovis subsp bovis AF2122/97
ucgguguggcccaacac

SEQ ID NO: 3111120 - RNA, 18 nt, Mycobacterium bovis subsp bovis AF2122/97
ucgguguggcccaacacc

SEQ ID NO: 3111121 - RNA, 14 nt, Mycobacterium bovis subsp bovis AF2122/97
ucgguguggccgug

SEQ ID NO: 3111122 - RNA, 15 nt, Mycobacterium bovis subsp bovis AF2122/97
ucgguguuccgccgc

SEQ ID NO: 3111123 - RNA, 17 nt, Mycobacterium bovis subsp bovis AF2122/97
ucgguguuccgccgcgc

SEQ ID NO: 3111124 - RNA, 14 nt, Mycobacterium bovis subsp bovis AF2122/97
ucgguuagcgcggc

SEQ ID NO: 3111125 - RNA, 16 nt, Mycobacterium bovis subsp bovis AF2122/97
ucgguuagcgcggcca

SEQ ID NO: 3111126 - RNA, 16 nt, Mycobacterium bovis subsp bovis AF2122/97
ucgguuagcugcucug

SEQ ID NO: 3111127 - RNA, 21 nt, Mycobacterium bovis subsp bovis AF2122/97
ucgguucgccccugcacagca

SEQ ID NO: 3111128 - RNA, 15 nt, Mycobacterium bovis subsp bovis AF2122/97
ucgguugaucggcca

SEQ ID NO: 3111129 - RNA, 19 nt, Mycobacterium bovis subsp bovis AF2122/97
ucgguugcacccgcgcgga

SEQ ID NO: 3111130 - RNA, 17 nt, Mycobacterium bovis subsp bovis AF2122/97
ucgguugcccccagggc

SEQ ID NO: 3111131 - RNA, 15 nt, Mycobacterium bovis subsp bovis AF2122/97
ucgguuggcucgggc

SEQ ID NO: 3111132 - RNA, 19 nt, Mycobacterium bovis subsp bovis AF2122/97
ucguacaacacgggcagcu

SEQ ID NO: 3111133 - RNA, 18 nt, Mycobacterium bovis subsp bovis AF2122/97
ucguacaccucgagcgcg

SEQ ID NO: 3111134 - RNA, 15 nt, Mycobacterium bovis subsp bovis AF2122/97
ucguacaugggcaga

SEQ ID NO: 3111135 - RNA, 20 nt, Mycobacterium bovis subsp bovis AF2122/97
ucguacccggccugcgucga

SEQ ID NO: 3111136 - RNA, 19 nt, Mycobacterium bovis subsp bovis AF2122/97
ucguaccgguugacgggcu

SEQ ID NO: 3111137 - RNA, 22 nt, Mycobacterium bovis subsp bovis AF2122/97
ucguaccuaaggcucaccaggc

SEQ ID NO: 3111138 - RNA, 20 nt, Mycobacterium bovis subsp bovis AF2122/97
ucguacucccaggccgccgc

SEQ ID NO: 3111139 - RNA, 15 nt, Mycobacterium bovis subsp bovis AF2122/97
ucguacuucggacaa

SEQ ID NO: 3111140 - RNA, 22 nt, Mycobacterium bovis subsp bovis AF2122/97
ucguagaaggaccgcucgucgc

SEQ ID NO: 3111141 - RNA, 22 nt, Mycobacterium bovis subsp bovis AF2122/97
ucguagacagucugcgacugga

SEQ ID NO: 3111142 - RNA, 23 nt, Mycobacterium bovis subsp bovis AF2122/97
ucguagcaccggucccugcgccg

SEQ ID NO: 3111143 - RNA, 20 nt, Mycobacterium bovis subsp bovis AF2122/97
ucguagcgcgcauagggcug

SEQ ID NO: 3111144 - RNA, 14 nt, Mycobacterium bovis subsp bovis AF2122/97
ucguagcggccgca

SEQ ID NO: 3111145 - RNA, 20 nt, Mycobacterium bovis subsp bovis AF2122/97
ucguagcgggcaaacgaacg

SEQ ID NO: 3111146 - RNA, 16 nt, Mycobacterium bovis subsp bovis AF2122/97
ucguaggacaccaccg

SEQ ID NO: 3111147 - RNA, 16 nt, Mycobacterium bovis subsp bovis AF2122/97
ucguaggacucggcgg

SEQ ID NO: 3111148 - RNA, 13 nt, Mycobacterium bovis subsp bovis AF2122/97
ucguaggccgcau

SEQ ID NO: 3111149 - RNA, 12 nt, Mycobacterium bovis subsp bovis AF2122/97
ucguaggcgaug

SEQ ID NO: 3111150 - RNA, 21 nt, Mycobacterium bovis subsp bovis AF2122/97
ucguaggugggcucguagcgc

SEQ ID NO: 3111151 - RNA, 16 nt, Mycobacterium bovis subsp bovis AF2122/97
ucguaguaggcgccgc

SEQ ID NO: 3111152 - RNA, 21 nt, Mycobacterium bovis subsp bovis AF2122/97
ucguauccgguucugggccug

SEQ ID NO: 3111153 - RNA, 18 nt, Mycobacterium bovis subsp bovis AF2122/97
ucguaugauucacgcucg

SEQ ID NO: 3111154 - RNA, 17 nt, Mycobacterium bovis subsp bovis AF2122/97
ucguauucggccgcgag

SEQ ID NO: 3111155 - RNA, 15 nt, Mycobacterium bovis subsp bovis AF2122/97
ucguauugauccagg

SEQ ID NO: 3111156 - RNA, 21 nt, Mycobacterium bovis subsp bovis AF2122/97
ucgucaaaucuggcuggacca

SEQ ID NO: 3111157 - RNA, 16 nt, Mycobacterium bovis subsp bovis AF2122/97
ucgucaacgacgacga

SEQ ID NO: 3111158 - RNA, 21 nt, Mycobacterium bovis subsp bovis AF2122/97
ucgucaaucaccaccgccagc

SEQ ID NO: 3111159 - RNA, 19 nt, Mycobacterium bovis subsp bovis AF2122/97
ucgucaccgaugcgccgga

SEQ ID NO: 3111160 - RNA, 22 nt, Mycobacterium bovis subsp bovis AF2122/97
ucgucaccgaugcgccggacca

SEQ ID NO: 3111161 - RNA, 17 nt, Mycobacterium bovis subsp bovis AF2122/97
ucgucaccgcgaccagc

SEQ ID NO: 3111162 - RNA, 15 nt, Mycobacterium bovis subsp bovis AF2122/97
ucgucaccggucagc

SEQ ID NO: 3111163 - RNA, 18 nt, Mycobacterium bovis subsp bovis AF2122/97
ucgucaccguuggccgcg

SEQ ID NO: 3111164 - RNA, 19 nt, Mycobacterium bovis subsp bovis AF2122/97
ucgucacgccccucacgug

SEQ ID NO: 3111165 - RNA, 20 nt, Mycobacterium bovis subsp bovis AF2122/97
ucgucacgccccucacgugg

SEQ ID NO: 3111166 - RNA, 22 nt, Mycobacterium bovis subsp bovis AF2122/97
ucgucacggacccuuccgccgc

SEQ ID NO: 3111167 - RNA, 18 nt, Mycobacterium bovis subsp bovis AF2122/97
ucgucagccagcguugug

SEQ ID NO: 3111168 - RNA, 12 nt, Mycobacterium bovis subsp bovis AF2122/97
ucgucagcggcc

SEQ ID NO: 3111169 - RNA, 13 nt, Mycobacterium bovis subsp bovis AF2122/97
ucgucaguaccgc

SEQ ID NO: 3111170 - RNA, 17 nt, Mycobacterium bovis subsp bovis AF2122/97
ucgucaguaccgcacgc

SEQ ID NO: 3111171 - RNA, 15 nt, Mycobacterium bovis subsp bovis AF2122/97
ucgucauacagcgcc

SEQ ID NO: 3111172 - RNA, 14 nt, Mycobacterium bovis subsp bovis AF2122/97
ucgucaucagcgcg

SEQ ID NO: 3111173 - RNA, 15 nt, Mycobacterium bovis subsp bovis AF2122/97
ucguccaagccggcc

SEQ ID NO: 3111174 - RNA, 19 nt, Mycobacterium bovis subsp bovis AF2122/97
ucguccaccccgauccgcc

SEQ ID NO: 3111175 - RNA, 17 nt, Mycobacterium bovis subsp bovis AF2122/97
ucguccaccgccgacau

SEQ ID NO: 3111176 - RNA, 23 nt, Mycobacterium bovis subsp bovis AF2122/97
ucguccaucagcaacacgucggg

SEQ ID NO: 3111177 - RNA, 19 nt, Mycobacterium bovis subsp bovis AF2122/97
ucgucccagucccgcgucg

SEQ ID NO: 3111178 - RNA, 14 nt, Mycobacterium bovis subsp bovis AF2122/97
ucguccccagaccg

SEQ ID NO: 3111179 - RNA, 13 nt, Mycobacterium bovis subsp bovis AF2122/97
ucgucccgcggcg

SEQ ID NO: 3111180 - RNA, 15 nt, Mycobacterium bovis subsp bovis AF2122/97
ucguccgccugcacc

SEQ ID NO: 3111181 - RNA, 13 nt, Mycobacterium bovis subsp bovis AF2122/97
ucguccgcugacc

SEQ ID NO: 3111182 - RNA, 18 nt, Mycobacterium bovis subsp bovis AF2122/97
ucguccgcugacccgcca

SEQ ID NO: 3111183 - RNA, 13 nt, Mycobacterium bovis subsp bovis AF2122/97
ucguccggccacg

SEQ ID NO: 3111184 - RNA, 22 nt, Mycobacterium bovis subsp bovis AF2122/97
ucguccggccacgguccggccc

SEQ ID NO: 3111185 - RNA, 14 nt, Mycobacterium bovis subsp bovis AF2122/97
ucguccggugcgau

SEQ ID NO: 3111186 - RNA, 16 nt, Mycobacterium bovis subsp bovis AF2122/97
ucguccggugcgaucc

SEQ ID NO: 3111187 - RNA, 19 nt, Mycobacterium bovis subsp bovis AF2122/97
ucguccgugguuugcguca

SEQ ID NO: 3111188 - RNA, 22 nt, Mycobacterium bovis subsp bovis AF2122/97
ucguccuggaaccaaaccuggg

SEQ ID NO: 3111189 - RNA, 18 nt, Mycobacterium bovis subsp bovis AF2122/97
ucguccuguccgggcugc

SEQ ID NO: 3111190 - RNA, 21 nt, Mycobacterium bovis subsp bovis AF2122/97
ucguccuguccgggcugcaug

SEQ ID NO: 3111191 - RNA, 14 nt, Mycobacterium bovis subsp bovis AF2122/97
ucgucgaaagccug

SEQ ID NO: 3111192 - RNA, 17 nt, Mycobacterium bovis subsp bovis AF2122/97
ucgucgaacauggcacg

SEQ ID NO: 3111193 - RNA, 18 nt, Mycobacterium bovis subsp bovis AF2122/97
ucgucgaacuuugucgcg

SEQ ID NO: 3111194 - RNA, 19 nt, Mycobacterium bovis subsp bovis AF2122/97
ucgucgaagggaucacgac

SEQ ID NO: 3111195 - RNA, 21 nt, Mycobacterium bovis subsp bovis AF2122/97
ucgucgaagggaucacgaccg

SEQ ID NO: 3111196 - RNA, 22 nt, Mycobacterium bovis subsp bovis AF2122/97
ucgucgaaguagccgacgucgc

SEQ ID NO: 3111197 - RNA, 23 nt, Mycobacterium bovis subsp bovis AF2122/97
ucgucgaaguuggcgaagcccga

SEQ ID NO: 3111198 - RNA, 17 nt, Mycobacterium bovis subsp bovis AF2122/97
ucgucgacaguucaacg

SEQ ID NO: 3111199 - RNA, 20 nt, Mycobacterium bovis subsp bovis AF2122/97
ucgucgacaguuuucaccgc

SEQ ID NO: 3111200 - RNA, 17 nt, Mycobacterium bovis subsp bovis AF2122/97
ucgucgaccacgacguu

SEQ ID NO: 3111201 - RNA, 14 nt, Mycobacterium bovis subsp bovis AF2122/97
ucgucgaccaggcc

SEQ ID NO: 3111202 - RNA, 20 nt, Mycobacterium bovis subsp bovis AF2122/97
ucgucgaccaugcgaccggc

SEQ ID NO: 3111203 - RNA, 17 nt, Mycobacterium bovis subsp bovis AF2122/97
ucgucgacccaccaugu

SEQ ID NO: 3111204 - RNA, 15 nt, Mycobacterium bovis subsp bovis AF2122/97
ucgucgaccgcgcca

SEQ ID NO: 3111205 - RNA, 15 nt, Mycobacterium bovis subsp bovis AF2122/97
ucgucgacgagguca

SEQ ID NO: 3111206 - RNA, 15 nt, Mycobacterium bovis subsp bovis AF2122/97
ucgucgacgaugucg

SEQ ID NO: 3111207 - RNA, 13 nt, Mycobacterium bovis subsp bovis AF2122/97
ucgucgacgccga

SEQ ID NO: 3111208 - RNA, 12 nt, Mycobacterium bovis subsp bovis AF2122/97
ucgucgacgcgu

SEQ ID NO: 3111209 - RNA, 13 nt, Mycobacterium bovis subsp bovis AF2122/97
ucgucgacgucgu

SEQ ID NO: 3111210 - RNA, 17 nt, Mycobacterium bovis subsp bovis AF2122/97
ucgucgacuugcaggcg

SEQ ID NO: 3111211 - RNA, 20 nt, Mycobacterium bovis subsp bovis AF2122/97
ucgucgagagguucgccguc

SEQ ID NO: 3111212 - RNA, 18 nt, Mycobacterium bovis subsp bovis AF2122/97
ucgucgagauagccgacg

SEQ ID NO: 3111213 - RNA, 22 nt, Mycobacterium bovis subsp bovis AF2122/97
ucgucgagauagccgacgucgc

SEQ ID NO: 3111214 - RNA, 14 nt, Mycobacterium bovis subsp bovis AF2122/97
ucgucgagcaccac

SEQ ID NO: 3111215 - RNA, 13 nt, Mycobacterium bovis subsp bovis AF2122/97
ucgucgagccaca

SEQ ID NO: 3111216 - RNA, 13 nt, Mycobacterium bovis subsp bovis AF2122/97
ucgucgagccgac

SEQ ID NO: 3111217 - RNA, 20 nt, Mycobacterium bovis subsp bovis AF2122/97
ucgucgagccgaucgcccgc

SEQ ID NO: 3111218 - RNA, 16 nt, Mycobacterium bovis subsp bovis AF2122/97
ucgucgagcugaccac

SEQ ID NO: 3111219 - RNA, 15 nt, Mycobacterium bovis subsp bovis AF2122/97
ucgucgagcugaucc

SEQ ID NO: 3111220 - RNA, 20 nt, Mycobacterium bovis subsp bovis AF2122/97
ucgucgaggucagugggcgg

SEQ ID NO: 3111221 - RNA, 14 nt, Mycobacterium bovis subsp bovis AF2122/97
ucgucgagguccuc

SEQ ID NO: 3111222 - RNA, 16 nt, Mycobacterium bovis subsp bovis AF2122/97
ucgucgagguccucga

SEQ ID NO: 3111223 - RNA, 21 nt, Mycobacterium bovis subsp bovis AF2122/97
ucgucgagguccucgucgucg

SEQ ID NO: 3111224 - RNA, 13 nt, Mycobacterium bovis subsp bovis AF2122/97
ucgucgaguuggc

SEQ ID NO: 3111225 - RNA, 15 nt, Mycobacterium bovis subsp bovis AF2122/97
ucgucgaguuggcca

SEQ ID NO: 3111226 - RNA, 22 nt, Mycobacterium bovis subsp bovis AF2122/97
ucgucgaucgacucacacaccg

SEQ ID NO: 3111227 - RNA, 23 nt, Mycobacterium bovis subsp bovis AF2122/97
ucgucgaucucgaucgacccggu

SEQ ID NO: 3111228 - RNA, 19 nt, Mycobacterium bovis subsp bovis AF2122/97
ucgucgaugaugccggaca

SEQ ID NO: 3111229 - RNA, 12 nt, Mycobacterium bovis subsp bovis AF2122/97
ucgucgaugccu

SEQ ID NO: 3111230 - RNA, 20 nt, Mycobacterium bovis subsp bovis AF2122/97
ucgucgauggucuccggacg

SEQ ID NO: 3111231 - RNA, 18 nt, Mycobacterium bovis subsp bovis AF2122/97
ucgucgauguucgccgcg

SEQ ID NO: 3111232 - RNA, 19 nt, Mycobacterium bovis subsp bovis AF2122/97
ucgucgauguucgccgcgc

SEQ ID NO: 3111233 - RNA, 22 nt, Mycobacterium bovis subsp bovis AF2122/97
ucgucgcaaacuucgcgcacgc

SEQ ID NO: 3111234 - RNA, 17 nt, Mycobacterium bovis subsp bovis AF2122/97
ucgucgcaucaccaggg

SEQ ID NO: 3111235 - RNA, 19 nt, Mycobacterium bovis subsp bovis AF2122/97
ucgucgccaagcccaggcg

SEQ ID NO: 3111236 - RNA, 14 nt, Mycobacterium bovis subsp bovis AF2122/97
ucgucgccagggcc

SEQ ID NO: 3111237 - RNA, 15 nt, Mycobacterium bovis subsp bovis AF2122/97
ucgucgccagggccg

SEQ ID NO: 3111238 - RNA, 14 nt, Mycobacterium bovis subsp bovis AF2122/97
ucgucgcccaggcg

SEQ ID NO: 3111239 - RNA, 20 nt, Mycobacterium bovis subsp bovis AF2122/97
ucgucgccccguucacgcuc

SEQ ID NO: 3111240 - RNA, 14 nt, Mycobacterium bovis subsp bovis AF2122/97
ucgucgccgagcgg

SEQ ID NO: 3111241 - RNA, 13 nt, Mycobacterium bovis subsp bovis AF2122/97
ucgucgccggcgg

SEQ ID NO: 3111242 - RNA, 14 nt, Mycobacterium bovis subsp bovis AF2122/97
ucgucgccggcggc

SEQ ID NO: 3111243 - RNA, 21 nt, Mycobacterium bovis subsp bovis AF2122/97
ucgucgccggcggcggugcgc

SEQ ID NO: 3111244 - RNA, 15 nt, Mycobacterium bovis subsp bovis AF2122/97
ucgucgccgucggug

SEQ ID NO: 3111245 - RNA, 22 nt, Mycobacterium bovis subsp bovis AF2122/97
ucgucgccugcgacuaagggca

SEQ ID NO: 3111246 - RNA, 13 nt, Mycobacterium bovis subsp bovis AF2122/97
ucgucgcggccgc

SEQ ID NO: 3111247 - RNA, 19 nt, Mycobacterium bovis subsp bovis AF2122/97
ucgucgcgggccaccgcug

SEQ ID NO: 3111248 - RNA, 17 nt, Mycobacterium bovis subsp bovis AF2122/97
ucgucgcggguguucca

SEQ ID NO: 3111249 - RNA, 13 nt, Mycobacterium bovis subsp bovis AF2122/97
ucgucgcucccgg

SEQ ID NO: 3111250 - RNA, 20 nt, Mycobacterium bovis subsp bovis AF2122/97
ucgucgcugaacagacggcu

SEQ ID NO: 3111251 - RNA, 15 nt, Mycobacterium bovis subsp bovis AF2122/97
ucgucgcugagcagc

SEQ ID NO: 3111252 - RNA, 17 nt, Mycobacterium bovis subsp bovis AF2122/97
ucgucgcugagcagcgc

SEQ ID NO: 3111253 - RNA, 19 nt, Mycobacterium bovis subsp bovis AF2122/97
ucgucgcugagcagcgccg

SEQ ID NO: 3111254 - RNA, 21 nt, Mycobacterium bovis subsp bovis AF2122/97
ucgucgcugcccaucacaccc

SEQ ID NO: 3111255 - RNA, 18 nt, Mycobacterium bovis subsp bovis AF2122/97
ucgucggaccucgcccau

SEQ ID NO: 3111256 - RNA, 18 nt, Mycobacterium bovis subsp bovis AF2122/97
ucgucggaguaccgcgcg

SEQ ID NO: 3111257 - RNA, 14 nt, Mycobacterium bovis subsp bovis AF2122/97
ucgucggcaggcag
